United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 104

SEQ ID NO: 3695495 - RNA, 18 nt, Salmonella enterica enterica serovar Typhi Ty2
aagccgaaaccacagcgg

SEQ ID NO: 3695496 - RNA, 22 nt, Salmonella enterica enterica serovar Typhi Ty2
aagccgacccgcaucagaccuc

SEQ ID NO: 3695497 - RNA, 22 nt, Salmonella enterica enterica serovar Typhi Ty2
aagccgaugacaucucaucggc

SEQ ID NO: 3695498 - RNA, 17 nt, Salmonella enterica enterica serovar Typhi Ty2
aagccgcauuacaaaca

SEQ ID NO: 3695499 - RNA, 18 nt, Salmonella enterica enterica serovar Typhi Ty2
aagccgcauuacaaacag

SEQ ID NO: 3695500 - RNA, 18 nt, Salmonella enterica enterica serovar Typhi Ty2
aagccgccaacgccagca

SEQ ID NO: 3695501 - RNA, 15 nt, Salmonella enterica enterica serovar Typhi Ty2
aagccgccauccggc

SEQ ID NO: 3695502 - RNA, 20 nt, Salmonella enterica enterica serovar Typhi Ty2
aagccgcccugcggacaggc

SEQ ID NO: 3695503 - RNA, 19 nt, Salmonella enterica enterica serovar Typhi Ty2
aagccgcgucgcaccugcu

SEQ ID NO: 3695504 - RNA, 22 nt, Salmonella enterica enterica serovar Typhi Ty2
aagccggcaggcagcgccagcg

SEQ ID NO: 3695505 - RNA, 22 nt, Salmonella enterica enterica serovar Typhi Ty2
aagccgggucagcccccaguuu

SEQ ID NO: 3695506 - RNA, 22 nt, Salmonella enterica enterica serovar Typhi Ty2
aagccggucguaaugagcacuu

SEQ ID NO: 3695507 - RNA, 20 nt, Salmonella enterica enterica serovar Typhi Ty2
aagccguauuuuauuuuuca

SEQ ID NO: 3695508 - RNA, 20 nt, Salmonella enterica enterica serovar Typhi Ty2
aagccguuuuggcagcgccc

SEQ ID NO: 3695509 - RNA, 16 nt, Salmonella enterica enterica serovar Typhi Ty2
aagccuacaccuuacu

SEQ ID NO: 3695510 - RNA, 23 nt, Salmonella enterica enterica serovar Typhi Ty2
aagccucucuuacgagaggcuuu

SEQ ID NO: 3695511 - RNA, 22 nt, Salmonella enterica enterica serovar Typhi Ty2
aagccucuuccgccugauaaaa

SEQ ID NO: 3695512 - RNA, 12 nt, Salmonella enterica enterica serovar Typhi Ty2
aagccugagcgc

SEQ ID NO: 3695513 - RNA, 22 nt, Salmonella enterica enterica serovar Typhi Ty2
aagccugcacauugcaggcuuu

SEQ ID NO: 3695514 - RNA, 20 nt, Salmonella enterica enterica serovar Typhi Ty2
aagccugcuucaccgcgcca

SEQ ID NO: 3695515 - RNA, 14 nt, Salmonella enterica enterica serovar Typhi Ty2
aagccuggucaccu

SEQ ID NO: 3695516 - RNA, 16 nt, Salmonella enterica enterica serovar Typhi Ty2
aagccuugcugaauca

SEQ ID NO: 3695517 - RNA, 13 nt, Salmonella enterica enterica serovar Typhi Ty2
aagccuuuccgca

SEQ ID NO: 3695518 - RNA, 14 nt, Salmonella enterica enterica serovar Typhi Ty2
aagcgaaaauaaac

SEQ ID NO: 3695519 - RNA, 13 nt, Salmonella enterica enterica serovar Typhi Ty2
aagcgaagcgcca

SEQ ID NO: 3695520 - RNA, 22 nt, Salmonella enterica enterica serovar Typhi Ty2
aagcgaagcgucauccggcaau

SEQ ID NO: 3695521 - RNA, 20 nt, Salmonella enterica enterica serovar Typhi Ty2
aagcgaauaauuaacccaca

SEQ ID NO: 3695522 - RNA, 16 nt, Salmonella enterica enterica serovar Typhi Ty2
aagcgaauacucacuu

SEQ ID NO: 3695523 - RNA, 13 nt, Salmonella enterica enterica serovar Typhi Ty2
aagcgaccuucuc

SEQ ID NO: 3695524 - RNA, 18 nt, Salmonella enterica enterica serovar Typhi Ty2
aagcgauacgucagcggu

SEQ ID NO: 3695525 - RNA, 13 nt, Salmonella enterica enterica serovar Typhi Ty2
aagcgauccggca

SEQ ID NO: 3695526 - RNA, 21 nt, Salmonella enterica enterica serovar Typhi Ty2
aagcgcaaacggaucuuccac

SEQ ID NO: 3695527 - RNA, 13 nt, Salmonella enterica enterica serovar Typhi Ty2
aagcgcaguguua

SEQ ID NO: 3695528 - RNA, 22 nt, Salmonella enterica enterica serovar Typhi Ty2
aagcgcauccagcucuuucaau

SEQ ID NO: 3695529 - RNA, 19 nt, Salmonella enterica enterica serovar Typhi Ty2
aagcgccagauaugaucga

SEQ ID NO: 3695530 - RNA, 14 nt, Salmonella enterica enterica serovar Typhi Ty2
aagcgccaucaggc

SEQ ID NO: 3695531 - RNA, 14 nt, Salmonella enterica enterica serovar Typhi Ty2
aagcgccaucgggc

SEQ ID NO: 3695532 - RNA, 18 nt, Salmonella enterica enterica serovar Typhi Ty2
aagcgcccaggccgggcg

SEQ ID NO: 3695533 - RNA, 20 nt, Salmonella enterica enterica serovar Typhi Ty2
aagcgcccaugaagauguag

SEQ ID NO: 3695534 - RNA, 19 nt, Salmonella enterica enterica serovar Typhi Ty2
aaggaugaacucuaugcaa

SEQ ID NO: 3695535 - RNA, 16 nt, Salmonella enterica enterica serovar Typhi Ty2
aaggaugacuaaucaa

SEQ ID NO: 3695536 - RNA, 14 nt, Salmonella enterica enterica serovar Typhi Ty2
aaggaugcccguag

SEQ ID NO: 3695537 - RNA, 16 nt, Salmonella enterica enterica serovar Typhi Ty2
aaggcaaaaugccagc

SEQ ID NO: 3695538 - RNA, 22 nt, Salmonella enterica enterica serovar Typhi Ty2
aaggcaaauaugcugucuauug

SEQ ID NO: 3695539 - RNA, 18 nt, Salmonella enterica enterica serovar Typhi Ty2
aaggcagaagaaucugcc

SEQ ID NO: 3695540 - RNA, 20 nt, Salmonella enterica enterica serovar Typhi Ty2
aaggcagcaaugugcgccag

SEQ ID NO: 3695541 - RNA, 18 nt, Salmonella enterica enterica serovar Typhi Ty2
aaggcagcgaaagcugcc

SEQ ID NO: 3695542 - RNA, 14 nt, Salmonella enterica enterica serovar Typhi Ty2
aaggcaucuucaga

SEQ ID NO: 3695543 - RNA, 15 nt, Salmonella enterica enterica serovar Typhi Ty2
aaggcaucuucagac

SEQ ID NO: 3695544 - RNA, 20 nt, Salmonella enterica enterica serovar Typhi Ty2
aaggcaucuucagacaguuu

SEQ ID NO: 3695545 - RNA, 19 nt, Salmonella enterica enterica serovar Typhi Ty2
aaggcaugaugccacgaga

SEQ ID NO: 3695546 - RNA, 15 nt, Salmonella enterica enterica serovar Typhi Ty2
aaggcauucacgcca

SEQ ID NO: 3695547 - RNA, 23 nt, Salmonella enterica enterica serovar Typhi Ty2
aaggcauuucgccgccauccggc

SEQ ID NO: 3695548 - RNA, 19 nt, Salmonella enterica enterica serovar Typhi Ty2
aaggcauuugccagacuug

SEQ ID NO: 3695549 - RNA, 14 nt, Salmonella enterica enterica serovar Typhi Ty2
aaggccgagcgaag

SEQ ID NO: 3695550 - RNA, 20 nt, Salmonella enterica enterica serovar Typhi Ty2
aaggccgcgaaagcggccuu

SEQ ID NO: 3695551 - RNA, 20 nt, Salmonella enterica enterica serovar Typhi Ty2
aaggccggcagccgcugaua

SEQ ID NO: 3695552 - RNA, 18 nt, Salmonella enterica enterica serovar Typhi Ty2
aaggccgggaaaucuucu

SEQ ID NO: 3695553 - RNA, 22 nt, Salmonella enterica enterica serovar Typhi Ty2
aaggccucaucgggacggcggu

SEQ ID NO: 3695554 - RNA, 13 nt, Salmonella enterica enterica serovar Typhi Ty2
aaggcgaaaacau

SEQ ID NO: 3695555 - RNA, 23 nt, Salmonella enterica enterica serovar Typhi Ty2
aaggcgaaaccgcuacccggcac

SEQ ID NO: 3695556 - RNA, 21 nt, Salmonella enterica enterica serovar Typhi Ty2
aaggcgaacaaggauauguau

SEQ ID NO: 3695557 - RNA, 22 nt, Salmonella enterica enterica serovar Typhi Ty2
aaggcgacgaugugcauaaccg

SEQ ID NO: 3695558 - RNA, 18 nt, Salmonella enterica enterica serovar Typhi Ty2
aaggcgauucaacagggc

SEQ ID NO: 3695559 - RNA, 14 nt, Salmonella enterica enterica serovar Typhi Ty2
aaggcgccuuuuuu

SEQ ID NO: 3695560 - RNA, 21 nt, Salmonella enterica enterica serovar Typhi Ty2
aaggcgcuugcgccaucaucc

SEQ ID NO: 3695561 - RNA, 15 nt, Salmonella enterica enterica serovar Typhi Ty2
aaggcggcaaagaua

SEQ ID NO: 3695562 - RNA, 16 nt, Salmonella enterica enterica serovar Typhi Ty2
aaggcggcaaagauaa

SEQ ID NO: 3695563 - RNA, 22 nt, Salmonella enterica enterica serovar Typhi Ty2
aaggcguaugaaugaaacaguc

SEQ ID NO: 3695564 - RNA, 15 nt, Salmonella enterica enterica serovar Typhi Ty2
aaggcguucacaccg

SEQ ID NO: 3695565 - RNA, 22 nt, Salmonella enterica enterica serovar Typhi Ty2
aaggcguucacaccgccgccag

SEQ ID NO: 3695566 - RNA, 17 nt, Salmonella enterica enterica serovar Typhi Ty2
aaggcguugaugaaggu

SEQ ID NO: 3695567 - RNA, 23 nt, Salmonella enterica enterica serovar Typhi Ty2
aaggcuaccgcugggaugaccug

SEQ ID NO: 3695568 - RNA, 19 nt, Salmonella enterica enterica serovar Typhi Ty2
aaggcuaccgggcaaacau

SEQ ID NO: 3695569 - RNA, 14 nt, Salmonella enterica enterica serovar Typhi Ty2
aagggaaaagccau

SEQ ID NO: 3695570 - RNA, 21 nt, Salmonella enterica enterica serovar Typhi Ty2
aagggaaaagccauugccgcg

SEQ ID NO: 3695571 - RNA, 22 nt, Salmonella enterica enterica serovar Typhi Ty2
aagggaaaagccauugccgcga

SEQ ID NO: 3695572 - RNA, 14 nt, Salmonella enterica enterica serovar Typhi Ty2
aagggaccgcgaag

SEQ ID NO: 3695573 - RNA, 18 nt, Salmonella enterica enterica serovar Typhi Ty2
aagggaggugcucuccca

SEQ ID NO: 3695574 - RNA, 20 nt, Salmonella enterica enterica serovar Typhi Ty2
aagggaggugcucucccagc

SEQ ID NO: 3695575 - RNA, 20 nt, Salmonella enterica enterica serovar Typhi Ty2
aagggauaagaaagauaaaa

SEQ ID NO: 3695576 - RNA, 15 nt, Salmonella enterica enterica serovar Typhi Ty2
aagggcaccugggca

SEQ ID NO: 3695577 - RNA, 12 nt, Salmonella enterica enterica serovar Typhi Ty2
aagggcgcugcc

SEQ ID NO: 3695578 - RNA, 22 nt, Salmonella enterica enterica serovar Typhi Ty2
aaggggccacaggcggcauggg

SEQ ID NO: 3695579 - RNA, 13 nt, Salmonella enterica enterica serovar Typhi Ty2
aaggguaagcaau

SEQ ID NO: 3695580 - RNA, 16 nt, Salmonella enterica enterica serovar Typhi Ty2
aagggugcccgccugg

SEQ ID NO: 3695581 - RNA, 23 nt, Salmonella enterica enterica serovar Typhi Ty2
aagguaaacgcgaccagcgcgcc

SEQ ID NO: 3695582 - RNA, 17 nt, Salmonella enterica enterica serovar Typhi Ty2
aagguaacgcgaaaaaa

SEQ ID NO: 3695583 - RNA, 13 nt, Salmonella enterica enterica serovar Typhi Ty2
aagguauguuugu

SEQ ID NO: 3695584 - RNA, 21 nt, Salmonella enterica enterica serovar Typhi Ty2
aaggucacgccggguacauau

SEQ ID NO: 3695585 - RNA, 18 nt, Salmonella enterica enterica serovar Typhi Ty2
aaggucgacauuuaauga

SEQ ID NO: 3695586 - RNA, 20 nt, Salmonella enterica enterica serovar Typhi Ty2
aaggucgcauccgcguuagc

SEQ ID NO: 3695587 - RNA, 17 nt, Salmonella enterica enterica serovar Typhi Ty2
aaggucgcuauccagca

SEQ ID NO: 3695588 - RNA, 13 nt, Salmonella enterica enterica serovar Typhi Ty2
aaggugagaaaaa

SEQ ID NO: 3695589 - RNA, 19 nt, Salmonella enterica enterica serovar Typhi Ty2
aaggugagcauugcgcuca

SEQ ID NO: 3695590 - RNA, 18 nt, Salmonella enterica enterica serovar Typhi Ty2
aagguuauccgccggagg

SEQ ID NO: 3695591 - RNA, 16 nt, Salmonella enterica enterica serovar Typhi Ty2
aagguucccugcgcca

SEQ ID NO: 3695592 - RNA, 21 nt, Salmonella enterica enterica serovar Typhi Ty2
aagguucuggcauuggcaucu

SEQ ID NO: 3695593 - RNA, 16 nt, Salmonella enterica enterica serovar Typhi Ty2
aagguuugcugcguca

SEQ ID NO: 3695594 - RNA, 15 nt, Salmonella enterica enterica serovar Typhi Ty2
aaguaaaaugcccug

SEQ ID NO: 3695595 - RNA, 18 nt, Salmonella enterica enterica serovar Typhi Ty2
aaguaaggaggaaucgcu

SEQ ID NO: 3695596 - RNA, 14 nt, Salmonella enterica enterica serovar Typhi Ty2
aaguaauaaaauaa

SEQ ID NO: 3695597 - RNA, 15 nt, Salmonella enterica enterica serovar Typhi Ty2
aaguaauaaaauaau

SEQ ID NO: 3695598 - RNA, 22 nt, Salmonella enterica enterica serovar Typhi Ty2
aaguaccgugaagaaacggaaa

SEQ ID NO: 3695599 - RNA, 19 nt, Salmonella enterica enterica serovar Typhi Ty2
aaguacgccugaaaacaga

SEQ ID NO: 3695600 - RNA, 14 nt, Salmonella enterica enterica serovar Typhi Ty2
aaguagccgucagg

SEQ ID NO: 3695601 - RNA, 22 nt, Salmonella enterica enterica serovar Typhi Ty2
aaguagcugaaaaucaaaucgg

SEQ ID NO: 3695602 - RNA, 17 nt, Salmonella enterica enterica serovar Typhi Ty2
aaguauaguggcgacaa

SEQ ID NO: 3695603 - RNA, 19 nt, Salmonella enterica enterica serovar Typhi Ty2
aaguaugccgcacaaaauu

SEQ ID NO: 3695604 - RNA, 18 nt, Salmonella enterica enterica serovar Typhi Ty2
aaguauucgaugguguua

SEQ ID NO: 3695605 - RNA, 12 nt, Salmonella enterica enterica serovar Typhi Ty2
aagucaaacuga

SEQ ID NO: 3695606 - RNA, 16 nt, Salmonella enterica enterica serovar Typhi Ty2
aagucacuuacuuucu

SEQ ID NO: 3695607 - RNA, 18 nt, Salmonella enterica enterica serovar Typhi Ty2
aagucauaccuguuccuc

SEQ ID NO: 3695608 - RNA, 17 nt, Salmonella enterica enterica serovar Typhi Ty2
aagucauccagacuaac

SEQ ID NO: 3695609 - RNA, 14 nt, Salmonella enterica enterica serovar Typhi Ty2
aagucaucugccag

SEQ ID NO: 3695610 - RNA, 20 nt, Salmonella enterica enterica serovar Typhi Ty2
aagucaucuguucaacuuuu

SEQ ID NO: 3695611 - RNA, 18 nt, Salmonella enterica enterica serovar Typhi Ty2
aaguccaaguauguuaac

SEQ ID NO: 3695612 - RNA, 18 nt, Salmonella enterica enterica serovar Typhi Ty2
aagucccuggcgcgccag

SEQ ID NO: 3695613 - RNA, 17 nt, Salmonella enterica enterica serovar Typhi Ty2
aaguccuaacaccugcc

SEQ ID NO: 3695614 - RNA, 13 nt, Salmonella enterica enterica serovar Typhi Ty2
aaguccuucuccu

SEQ ID NO: 3695615 - RNA, 16 nt, Salmonella enterica enterica serovar Typhi Ty2
aaguccuucuuccccc

SEQ ID NO: 3695616 - RNA, 20 nt, Salmonella enterica enterica serovar Typhi Ty2
aauaauaugccccgacauca

SEQ ID NO: 3695617 - RNA, 23 nt, Salmonella enterica enterica serovar Typhi Ty2
aauaauaugccccgacaucagau

SEQ ID NO: 3695618 - RNA, 17 nt, Salmonella enterica enterica serovar Typhi Ty2
aauaaucccuucuuuua

SEQ ID NO: 3695619 - RNA, 15 nt, Salmonella enterica enterica serovar Typhi Ty2
aauaaugaccagcgc

SEQ ID NO: 3695620 - RNA, 12 nt, Salmonella enterica enterica serovar Typhi Ty2
aauaaugacuaa

SEQ ID NO: 3695621 - RNA, 18 nt, Salmonella enterica enterica serovar Typhi Ty2
aauaauggcgcgaaaaca

SEQ ID NO: 3695622 - RNA, 16 nt, Salmonella enterica enterica serovar Typhi Ty2
aauaauguaaaaaaau

SEQ ID NO: 3695623 - RNA, 17 nt, Salmonella enterica enterica serovar Typhi Ty2
aauaauguaaaaaaaua

SEQ ID NO: 3695624 - RNA, 18 nt, Salmonella enterica enterica serovar Typhi Ty2
aauaauguaaaaaaauaa

SEQ ID NO: 3695625 - RNA, 15 nt, Salmonella enterica enterica serovar Typhi Ty2
aauaauuaacccaca

SEQ ID NO: 3695626 - RNA, 15 nt, Salmonella enterica enterica serovar Typhi Ty2
aauaauuaauccaaa

SEQ ID NO: 3695627 - RNA, 23 nt, Salmonella enterica enterica serovar Typhi Ty2
aauaauucuuaacccacaagaaa

SEQ ID NO: 3695628 - RNA, 15 nt, Salmonella enterica enterica serovar Typhi Ty2
aauacaauucaacuc

SEQ ID NO: 3695629 - RNA, 18 nt, Salmonella enterica enterica serovar Typhi Ty2
aauacaauucaacucacu

SEQ ID NO: 3695630 - RNA, 15 nt, Salmonella enterica enterica serovar Typhi Ty2
aauacacaaugcuuc

SEQ ID NO: 3695631 - RNA, 21 nt, Salmonella enterica enterica serovar Typhi Ty2
aauacaccguuuaucguuacc

SEQ ID NO: 3695632 - RNA, 21 nt, Salmonella enterica enterica serovar Typhi Ty2
aauacaggguuugucagcaua

SEQ ID NO: 3695633 - RNA, 23 nt, Salmonella enterica enterica serovar Typhi Ty2
aauacaucaacaaagggcaccug

SEQ ID NO: 3695634 - RNA, 22 nt, Salmonella enterica enterica serovar Typhi Ty2
aauaccaaagugguuccaggcg

SEQ ID NO: 3695635 - RNA, 17 nt, Salmonella enterica enterica serovar Typhi Ty2
aauaccaaauauuucuu

SEQ ID NO: 3695636 - RNA, 20 nt, Salmonella enterica enterica serovar Typhi Ty2
aauaccacaaauuuugauaa

SEQ ID NO: 3695637 - RNA, 15 nt, Salmonella enterica enterica serovar Typhi Ty2
aauaccacaucagac

SEQ ID NO: 3695638 - RNA, 20 nt, Salmonella enterica enterica serovar Typhi Ty2
aauaccaccugccaaagcug

SEQ ID NO: 3695639 - RNA, 16 nt, Salmonella enterica enterica serovar Typhi Ty2
aauaccaggcacuuga

SEQ ID NO: 3695640 - RNA, 19 nt, Salmonella enterica enterica serovar Typhi Ty2
aauacccgacucuuuuuuc

SEQ ID NO: 3695641 - RNA, 22 nt, Salmonella enterica enterica serovar Typhi Ty2
aauacccgacucuuuuuucaga

SEQ ID NO: 3695642 - RNA, 14 nt, Salmonella enterica enterica serovar Typhi Ty2
aauacccuucacgg

SEQ ID NO: 3695643 - RNA, 16 nt, Salmonella enterica enterica serovar Typhi Ty2
aauaccgaaauccgcu

SEQ ID NO: 3695644 - RNA, 16 nt, Salmonella enterica enterica serovar Typhi Ty2
aauaccgcaauaaaca

SEQ ID NO: 3695645 - RNA, 13 nt, Salmonella enterica enterica serovar Typhi Ty2
aauaccggcauca

SEQ ID NO: 3695646 - RNA, 21 nt, Salmonella enterica enterica serovar Typhi Ty2
aauaccguggucuccgccugg

SEQ ID NO: 3695647 - RNA, 19 nt, Salmonella enterica enterica serovar Typhi Ty2
aauaccuaacucuuccgca

SEQ ID NO: 3695648 - RNA, 18 nt, Salmonella enterica enterica serovar Typhi Ty2
aauaccucaaaugcugaa

SEQ ID NO: 3695649 - RNA, 22 nt, Salmonella enterica enterica serovar Typhi Ty2
aauaccuccuggcguuaucauc

SEQ ID NO: 3695650 - RNA, 19 nt, Salmonella enterica enterica serovar Typhi Ty2
aauaccugccugucacgca

SEQ ID NO: 3695651 - RNA, 15 nt, Salmonella enterica enterica serovar Typhi Ty2
aauaccuggaauauc

SEQ ID NO: 3695652 - RNA, 20 nt, Salmonella enterica enterica serovar Typhi Ty2
aauaccuuauucagcccacg

SEQ ID NO: 3695653 - RNA, 14 nt, Salmonella enterica enterica serovar Typhi Ty2
aauacgaaaauccu

SEQ ID NO: 3695654 - RNA, 19 nt, Salmonella enterica enterica serovar Typhi Ty2
aauacgaaauugagaauua

SEQ ID NO: 3695655 - RNA, 19 nt, Salmonella enterica enterica serovar Typhi Ty2
aauacgauguacauaggca

SEQ ID NO: 3695656 - RNA, 18 nt, Salmonella enterica enterica serovar Typhi Ty2
aauacgcaagccgaacuc

SEQ ID NO: 3695657 - RNA, 20 nt, Salmonella enterica enterica serovar Typhi Ty2
aauacgccagccgucaugau

SEQ ID NO: 3695658 - RNA, 18 nt, Salmonella enterica enterica serovar Typhi Ty2
aauacgccgccagcaaua

SEQ ID NO: 3695659 - RNA, 18 nt, Salmonella enterica enterica serovar Typhi Ty2
aauacgcuccagcuggcu

SEQ ID NO: 3695660 - RNA, 17 nt, Salmonella enterica enterica serovar Typhi Ty2
aauacgcuguagcuggc

SEQ ID NO: 3695661 - RNA, 23 nt, Salmonella enterica enterica serovar Typhi Ty2
aauacgggagagcguauccagca

SEQ ID NO: 3695662 - RNA, 19 nt, Salmonella enterica enterica serovar Typhi Ty2
aauacgguaaacagauaag

SEQ ID NO: 3695663 - RNA, 12 nt, Salmonella enterica enterica serovar Typhi Ty2
aauacguaaacc

SEQ ID NO: 3695664 - RNA, 23 nt, Salmonella enterica enterica serovar Typhi Ty2
aauacguaauaccugaagcccuu

SEQ ID NO: 3695665 - RNA, 20 nt, Salmonella enterica enterica serovar Typhi Ty2
aauacgucgugacccacaca

SEQ ID NO: 3695666 - RNA, 20 nt, Salmonella enterica enterica serovar Typhi Ty2
aauacgucucgaguaaucac

SEQ ID NO: 3695667 - RNA, 18 nt, Salmonella enterica enterica serovar Typhi Ty2
aauacgugagcgaaguuc

SEQ ID NO: 3695668 - RNA, 19 nt, Salmonella enterica enterica serovar Typhi Ty2
aauacucccggcgcuggac

SEQ ID NO: 3695669 - RNA, 15 nt, Salmonella enterica enterica serovar Typhi Ty2
aauacucuucacgca

SEQ ID NO: 3695670 - RNA, 12 nt, Salmonella enterica enterica serovar Typhi Ty2
aauacugauaaa

SEQ ID NO: 3695671 - RNA, 14 nt, Salmonella enterica enterica serovar Typhi Ty2
aauacugaucaauu

SEQ ID NO: 3695672 - RNA, 23 nt, Salmonella enterica enterica serovar Typhi Ty2
aauacugcacgccgcguuuuagc

SEQ ID NO: 3695673 - RNA, 18 nt, Salmonella enterica enterica serovar Typhi Ty2
aauacugcuuuuccggca

SEQ ID NO: 3695674 - RNA, 16 nt, Salmonella enterica enterica serovar Typhi Ty2
aauacuggaaaaaacg

SEQ ID NO: 3695675 - RNA, 15 nt, Salmonella enterica enterica serovar Typhi Ty2
aauacuguaagccuc

SEQ ID NO: 3695676 - RNA, 18 nt, Salmonella enterica enterica serovar Typhi Ty2
aauacuucgcucucuuuu

SEQ ID NO: 3695677 - RNA, 15 nt, Salmonella enterica enterica serovar Typhi Ty2
aauacuuuccagcug

SEQ ID NO: 3695678 - RNA, 16 nt, Salmonella enterica enterica serovar Typhi Ty2
aauagaacgucgcgcg

SEQ ID NO: 3695679 - RNA, 21 nt, Salmonella enterica enterica serovar Typhi Ty2
aauagacaacaucccagaaaa

SEQ ID NO: 3695680 - RNA, 14 nt, Salmonella enterica enterica serovar Typhi Ty2
aauagagaaaauaa

SEQ ID NO: 3695681 - RNA, 18 nt, Salmonella enterica enterica serovar Typhi Ty2
aauagagaaaauaacaau

SEQ ID NO: 3695682 - RNA, 23 nt, Salmonella enterica enterica serovar Typhi Ty2
aauagagagcgacagcccggcgu

SEQ ID NO: 3695683 - RNA, 16 nt, Salmonella enterica enterica serovar Typhi Ty2
aauagaggaaauaaca

SEQ ID NO: 3695684 - RNA, 14 nt, Salmonella enterica enterica serovar Typhi Ty2
aauagaguaaugac

SEQ ID NO: 3695685 - RNA, 16 nt, Salmonella enterica enterica serovar Typhi Ty2
aauagaguaaugacaa

SEQ ID NO: 3695686 - RNA, 20 nt, Salmonella enterica enterica serovar Typhi Ty2
aauagagugcgauuugacau

SEQ ID NO: 3695687 - RNA, 18 nt, Salmonella enterica enterica serovar Typhi Ty2
aauagcaauuauauugcg

SEQ ID NO: 3695688 - RNA, 18 nt, Salmonella enterica enterica serovar Typhi Ty2
aauagcacaucagccaac

SEQ ID NO: 3695689 - RNA, 12 nt, Salmonella enterica enterica serovar Typhi Ty2
aauagccagaca

SEQ ID NO: 3695690 - RNA, 16 nt, Salmonella enterica enterica serovar Typhi Ty2
aauagccagccccaga

SEQ ID NO: 3695691 - RNA, 19 nt, Salmonella enterica enterica serovar Typhi Ty2
aauagccagccccagaaaa

SEQ ID NO: 3695692 - RNA, 22 nt, Salmonella enterica enterica serovar Typhi Ty2
aauagccccucaauuauguauu

SEQ ID NO: 3695693 - RNA, 13 nt, Salmonella enterica enterica serovar Typhi Ty2
aauagccugggca

SEQ ID NO: 3695694 - RNA, 22 nt, Salmonella enterica enterica serovar Typhi Ty2
aauagcgaacaguccaugauga

SEQ ID NO: 3695695 - RNA, 22 nt, Salmonella enterica enterica serovar Typhi Ty2
aauagcgaucgagauaagaucu

SEQ ID NO: 3695696 - RNA, 19 nt, Salmonella enterica enterica serovar Typhi Ty2
aauagcgccacgcgaugca

SEQ ID NO: 3695697 - RNA, 15 nt, Salmonella enterica enterica serovar Typhi Ty2
aauagcgccauccug

SEQ ID NO: 3695698 - RNA, 18 nt, Salmonella enterica enterica serovar Typhi Ty2
aauauuguuuaacguuuc

SEQ ID NO: 3695699 - RNA, 14 nt, Salmonella enterica enterica serovar Typhi Ty2
aauauuuauuauuu

SEQ ID NO: 3695700 - RNA, 18 nt, Salmonella enterica enterica serovar Typhi Ty2
aauauuucuuugucgcca

SEQ ID NO: 3695701 - RNA, 21 nt, Salmonella enterica enterica serovar Typhi Ty2
aauauuugaaucucagacgcc

SEQ ID NO: 3695702 - RNA, 22 nt, Salmonella enterica enterica serovar Typhi Ty2
aaucaacacgucgauuuucccu

SEQ ID NO: 3695703 - RNA, 14 nt, Salmonella enterica enterica serovar Typhi Ty2
aaucaaccggguaa

SEQ ID NO: 3695704 - RNA, 22 nt, Salmonella enterica enterica serovar Typhi Ty2
aaucaacgccacaccgagacag

SEQ ID NO: 3695705 - RNA, 20 nt, Salmonella enterica enterica serovar Typhi Ty2
aaucaacgccgccaggauaa

SEQ ID NO: 3695706 - RNA, 20 nt, Salmonella enterica enterica serovar Typhi Ty2
aaucaacugcgccacaucau

SEQ ID NO: 3695707 - RNA, 17 nt, Salmonella enterica enterica serovar Typhi Ty2
aaucaagcccagcucag

SEQ ID NO: 3695708 - RNA, 21 nt, Salmonella enterica enterica serovar Typhi Ty2
aaucaagccuaucaccgcgau

SEQ ID NO: 3695709 - RNA, 16 nt, Salmonella enterica enterica serovar Typhi Ty2
aaucaauguauuuaag

SEQ ID NO: 3695710 - RNA, 18 nt, Salmonella enterica enterica serovar Typhi Ty2
aaucacagggggaacauu

SEQ ID NO: 3695711 - RNA, 15 nt, Salmonella enterica enterica serovar Typhi Ty2
aaucacaucauuaaa

SEQ ID NO: 3695712 - RNA, 13 nt, Salmonella enterica enterica serovar Typhi Ty2
aaucacauccgcc

SEQ ID NO: 3695713 - RNA, 12 nt, Salmonella enterica enterica serovar Typhi Ty2
aaucacaucgcc

SEQ ID NO: 3695714 - RNA, 13 nt, Salmonella enterica enterica serovar Typhi Ty2
aaucacaucgccg

SEQ ID NO: 3695715 - RNA, 13 nt, Salmonella enterica enterica serovar Typhi Ty2
aaucacaugcauu

SEQ ID NO: 3695716 - RNA, 16 nt, Salmonella enterica enterica serovar Typhi Ty2
aaucaccacauggccc

SEQ ID NO: 3695717 - RNA, 14 nt, Salmonella enterica enterica serovar Typhi Ty2
aaucaccagcccga

SEQ ID NO: 3695718 - RNA, 13 nt, Salmonella enterica enterica serovar Typhi Ty2
aaucaccagcgca

SEQ ID NO: 3695719 - RNA, 22 nt, Salmonella enterica enterica serovar Typhi Ty2
aaucacccagaugcgaaucuuc

SEQ ID NO: 3695720 - RNA, 15 nt, Salmonella enterica enterica serovar Typhi Ty2
aaucaccccaagcaa

SEQ ID NO: 3695721 - RNA, 17 nt, Salmonella enterica enterica serovar Typhi Ty2
aaucaccgacagcaccg

SEQ ID NO: 3695722 - RNA, 12 nt, Salmonella enterica enterica serovar Typhi Ty2
aaucaccgccag

SEQ ID NO: 3695723 - RNA, 15 nt, Salmonella enterica enterica serovar Typhi Ty2
aaucaccgccagcaa

SEQ ID NO: 3695724 - RNA, 21 nt, Salmonella enterica enterica serovar Typhi Ty2
aaucaccguuguggcgaccag

SEQ ID NO: 3695725 - RNA, 19 nt, Salmonella enterica enterica serovar Typhi Ty2
aaucaccugcaucacgccc

SEQ ID NO: 3695726 - RNA, 18 nt, Salmonella enterica enterica serovar Typhi Ty2
aaucaccuuacgcucgcu

SEQ ID NO: 3695727 - RNA, 22 nt, Salmonella enterica enterica serovar Typhi Ty2
aaucaccuuacgcucgcugaug

SEQ ID NO: 3695728 - RNA, 21 nt, Salmonella enterica enterica serovar Typhi Ty2
aaucacgcccgcagcaauaga

SEQ ID NO: 3695729 - RNA, 13 nt, Salmonella enterica enterica serovar Typhi Ty2
aaucacguaaucg

SEQ ID NO: 3695730 - RNA, 20 nt, Salmonella enterica enterica serovar Typhi Ty2
aaucacguuuacuaaaacgg

SEQ ID NO: 3695731 - RNA, 18 nt, Salmonella enterica enterica serovar Typhi Ty2
aaucagagacaaauacau

SEQ ID NO: 3695732 - RNA, 18 nt, Salmonella enterica enterica serovar Typhi Ty2
aaucagcaauuuuguuaa

SEQ ID NO: 3695733 - RNA, 23 nt, Salmonella enterica enterica serovar Typhi Ty2
aaucagcacauucagcagcgccc

SEQ ID NO: 3695734 - RNA, 21 nt, Salmonella enterica enterica serovar Typhi Ty2
aaucagcagccgggccagacg

SEQ ID NO: 3695735 - RNA, 17 nt, Salmonella enterica enterica serovar Typhi Ty2
aaucagccgacggcgau

SEQ ID NO: 3695736 - RNA, 17 nt, Salmonella enterica enterica serovar Typhi Ty2
aaucagcgauaaccaga

SEQ ID NO: 3695737 - RNA, 15 nt, Salmonella enterica enterica serovar Typhi Ty2
aaucagcgcaauaaa

SEQ ID NO: 3695738 - RNA, 22 nt, Salmonella enterica enterica serovar Typhi Ty2
aaucagcgccgucgccaucacc

SEQ ID NO: 3695739 - RNA, 20 nt, Salmonella enterica enterica serovar Typhi Ty2
aaucagcgcggcaaggauaa

SEQ ID NO: 3695740 - RNA, 21 nt, Salmonella enterica enterica serovar Typhi Ty2
aaucagcgcggcgugaucaaa

SEQ ID NO: 3695741 - RNA, 15 nt, Salmonella enterica enterica serovar Typhi Ty2
aaucagcuuugcggc

SEQ ID NO: 3695742 - RNA, 13 nt, Salmonella enterica enterica serovar Typhi Ty2
aaucaggaaaaag

SEQ ID NO: 3695743 - RNA, 17 nt, Salmonella enterica enterica serovar Typhi Ty2
aaucaggaaagagccgc

SEQ ID NO: 3695744 - RNA, 22 nt, Salmonella enterica enterica serovar Typhi Ty2
aaucaggcaucccguuuucguc

SEQ ID NO: 3695745 - RNA, 17 nt, Salmonella enterica enterica serovar Typhi Ty2
aaucaggcauccugccc

SEQ ID NO: 3695746 - RNA, 18 nt, Salmonella enterica enterica serovar Typhi Ty2
aaucaguacugcgcccgc

SEQ ID NO: 3695747 - RNA, 14 nt, Salmonella enterica enterica serovar Typhi Ty2
aaucagucgcagcg

SEQ ID NO: 3695748 - RNA, 14 nt, Salmonella enterica enterica serovar Typhi Ty2
aaucagugcugaaa

SEQ ID NO: 3695749 - RNA, 18 nt, Salmonella enterica enterica serovar Typhi Ty2
aaucaguggcggcaaaaa

SEQ ID NO: 3695750 - RNA, 22 nt, Salmonella enterica enterica serovar Typhi Ty2
aaucaguggcggcaaaaaauau

SEQ ID NO: 3695751 - RNA, 13 nt, Salmonella enterica enterica serovar Typhi Ty2
aaucauaaagcgc

SEQ ID NO: 3695752 - RNA, 14 nt, Salmonella enterica enterica serovar Typhi Ty2
aaucaucaaucgcu

SEQ ID NO: 3695753 - RNA, 18 nt, Salmonella enterica enterica serovar Typhi Ty2
aaucaucaccguuuucca

SEQ ID NO: 3695754 - RNA, 21 nt, Salmonella enterica enterica serovar Typhi Ty2
aaucaucagaccgauaaauac

SEQ ID NO: 3695755 - RNA, 14 nt, Salmonella enterica enterica serovar Typhi Ty2
aaucaucaucaucc

SEQ ID NO: 3695756 - RNA, 23 nt, Salmonella enterica enterica serovar Typhi Ty2
aaucaucgaggccaccaaaaauu

SEQ ID NO: 3695757 - RNA, 22 nt, Salmonella enterica enterica serovar Typhi Ty2
aaucaugaacguuaucggcaua

SEQ ID NO: 3695758 - RNA, 13 nt, Salmonella enterica enterica serovar Typhi Ty2
aaucaugucaaau

SEQ ID NO: 3695759 - RNA, 15 nt, Salmonella enterica enterica serovar Typhi Ty2
aaucauguuuuucuc

SEQ ID NO: 3695760 - RNA, 16 nt, Salmonella enterica enterica serovar Typhi Ty2
aaucauuaauacacug

SEQ ID NO: 3695761 - RNA, 18 nt, Salmonella enterica enterica serovar Typhi Ty2
aaucauucgggaugcaua

SEQ ID NO: 3695762 - RNA, 19 nt, Salmonella enterica enterica serovar Typhi Ty2
aaucauucgggaugcauaa

SEQ ID NO: 3695763 - RNA, 20 nt, Salmonella enterica enterica serovar Typhi Ty2
aaucauucgggaugcauaaa

SEQ ID NO: 3695764 - RNA, 22 nt, Salmonella enterica enterica serovar Typhi Ty2
aaucauucuacaaguucaguag

SEQ ID NO: 3695765 - RNA, 20 nt, Salmonella enterica enterica serovar Typhi Ty2
aaucauugcgcuaaaaucca

SEQ ID NO: 3695766 - RNA, 15 nt, Salmonella enterica enterica serovar Typhi Ty2
aaucauugcguucag

SEQ ID NO: 3695767 - RNA, 18 nt, Salmonella enterica enterica serovar Typhi Ty2
aaucauugugguuucccu

SEQ ID NO: 3695768 - RNA, 15 nt, Salmonella enterica enterica serovar Typhi Ty2
aaucauuuguacaaa

SEQ ID NO: 3695769 - RNA, 19 nt, Salmonella enterica enterica serovar Typhi Ty2
aauccaacgaaacgcaucg

SEQ ID NO: 3695770 - RNA, 22 nt, Salmonella enterica enterica serovar Typhi Ty2
aauccaacgaaacucagcggcc

SEQ ID NO: 3695771 - RNA, 16 nt, Salmonella enterica enterica serovar Typhi Ty2
aauccacauuccagac

SEQ ID NO: 3695772 - RNA, 12 nt, Salmonella enterica enterica serovar Typhi Ty2
aauccaccagcg

SEQ ID NO: 3695773 - RNA, 19 nt, Salmonella enterica enterica serovar Typhi Ty2
aauccacuccguguugcug

SEQ ID NO: 3695774 - RNA, 21 nt, Salmonella enterica enterica serovar Typhi Ty2
aauccagaauguuccugcaau

SEQ ID NO: 3695775 - RNA, 20 nt, Salmonella enterica enterica serovar Typhi Ty2
aauccagaggguaauuucuu

SEQ ID NO: 3695776 - RNA, 15 nt, Salmonella enterica enterica serovar Typhi Ty2
aauccagcagaauaa

SEQ ID NO: 3695777 - RNA, 13 nt, Salmonella enterica enterica serovar Typhi Ty2
aauccagcgcgcu

SEQ ID NO: 3695778 - RNA, 15 nt, Salmonella enterica enterica serovar Typhi Ty2
aauccagcuacuggc

SEQ ID NO: 3695779 - RNA, 16 nt, Salmonella enterica enterica serovar Typhi Ty2
aauccaggaauuuucc

SEQ ID NO: 3695780 - RNA, 17 nt, Salmonella enterica enterica serovar Typhi Ty2
aaugcgcgaauaucuuu

SEQ ID NO: 3695781 - RNA, 15 nt, Salmonella enterica enterica serovar Typhi Ty2
aaugcgcgucaggcc

SEQ ID NO: 3695782 - RNA, 17 nt, Salmonella enterica enterica serovar Typhi Ty2
aaugcgcuuuuuuugcc

SEQ ID NO: 3695783 - RNA, 19 nt, Salmonella enterica enterica serovar Typhi Ty2
aaugcgcuuuuuuugcccu

SEQ ID NO: 3695784 - RNA, 16 nt, Salmonella enterica enterica serovar Typhi Ty2
aaugcggccauccugc

SEQ ID NO: 3695785 - RNA, 18 nt, Salmonella enterica enterica serovar Typhi Ty2
aaugcggcguguggcugu

SEQ ID NO: 3695786 - RNA, 15 nt, Salmonella enterica enterica serovar Typhi Ty2
aaugcgucggcacca

SEQ ID NO: 3695787 - RNA, 16 nt, Salmonella enterica enterica serovar Typhi Ty2
aaugcgucggcaccau

SEQ ID NO: 3695788 - RNA, 20 nt, Salmonella enterica enterica serovar Typhi Ty2
aaugcguuugauuugcgcgu

SEQ ID NO: 3695789 - RNA, 23 nt, Salmonella enterica enterica serovar Typhi Ty2
aaugcugacgcguuuuuucauga

SEQ ID NO: 3695790 - RNA, 20 nt, Salmonella enterica enterica serovar Typhi Ty2
aaugcugcuuugaugcggca

SEQ ID NO: 3695791 - RNA, 16 nt, Salmonella enterica enterica serovar Typhi Ty2
aaugcuggugcaucug

SEQ ID NO: 3695792 - RNA, 18 nt, Salmonella enterica enterica serovar Typhi Ty2
aaugcuggugcaucuggg

SEQ ID NO: 3695793 - RNA, 18 nt, Salmonella enterica enterica serovar Typhi Ty2
aaugcuuagucagccuua

SEQ ID NO: 3695794 - RNA, 20 nt, Salmonella enterica enterica serovar Typhi Ty2
aaugcuucuucgccagcuuc

SEQ ID NO: 3695795 - RNA, 14 nt, Salmonella enterica enterica serovar Typhi Ty2
aaugcuuuaaaugc

SEQ ID NO: 3695796 - RNA, 10 nt, Salmonella enterica enterica serovar Typhi Ty2
aaugcuuucc

SEQ ID NO: 3695797 - RNA, 18 nt, Salmonella enterica enterica serovar Typhi Ty2
aauggaaaauaauaaucg

SEQ ID NO: 3695798 - RNA, 14 nt, Salmonella enterica enterica serovar Typhi Ty2
aauggaacugccug

SEQ ID NO: 3695799 - RNA, 19 nt, Salmonella enterica enterica serovar Typhi Ty2
aauggaccagccaggcgau

SEQ ID NO: 3695800 - RNA, 14 nt, Salmonella enterica enterica serovar Typhi Ty2
aauggaggcaguga

SEQ ID NO: 3695801 - RNA, 23 nt, Salmonella enterica enterica serovar Typhi Ty2
aauggauucaugguacucaacau

SEQ ID NO: 3695802 - RNA, 20 nt, Salmonella enterica enterica serovar Typhi Ty2
aauggauuuauggcacauca

SEQ ID NO: 3695803 - RNA, 19 nt, Salmonella enterica enterica serovar Typhi Ty2
aauggcagaauaaaacagc

SEQ ID NO: 3695804 - RNA, 22 nt, Salmonella enterica enterica serovar Typhi Ty2
aauggccgcagcgccauaaaaa

SEQ ID NO: 3695805 - RNA, 12 nt, Salmonella enterica enterica serovar Typhi Ty2
aauggcgaaaaa

SEQ ID NO: 3695806 - RNA, 21 nt, Salmonella enterica enterica serovar Typhi Ty2
aauggcgacgacgcuguuuau

SEQ ID NO: 3695807 - RNA, 22 nt, Salmonella enterica enterica serovar Typhi Ty2
aauggcgacgaucagcgccacg

SEQ ID NO: 3695808 - RNA, 13 nt, Salmonella enterica enterica serovar Typhi Ty2
aauggucgcgcca

SEQ ID NO: 3695809 - RNA, 21 nt, Salmonella enterica enterica serovar Typhi Ty2
aauggucuuaaaugccgccgg

SEQ ID NO: 3695810 - RNA, 15 nt, Salmonella enterica enterica serovar Typhi Ty2
aaugguggucgccau

SEQ ID NO: 3695811 - RNA, 12 nt, Salmonella enterica enterica serovar Typhi Ty2
aaugguugcguu

SEQ ID NO: 3695812 - RNA, 15 nt, Salmonella enterica enterica serovar Typhi Ty2
aauguaaaacugacu

SEQ ID NO: 3695813 - RNA, 16 nt, Salmonella enterica enterica serovar Typhi Ty2
aauguacgccuaaaaa

SEQ ID NO: 3695814 - RNA, 23 nt, Salmonella enterica enterica serovar Typhi Ty2
aauguauucucccgucagcaaca

SEQ ID NO: 3695815 - RNA, 16 nt, Salmonella enterica enterica serovar Typhi Ty2
aauguauuuuuuguaa

SEQ ID NO: 3695816 - RNA, 14 nt, Salmonella enterica enterica serovar Typhi Ty2
aaugucaugcgcca

SEQ ID NO: 3695817 - RNA, 20 nt, Salmonella enterica enterica serovar Typhi Ty2
aauguccagcagugucugcu

SEQ ID NO: 3695818 - RNA, 20 nt, Salmonella enterica enterica serovar Typhi Ty2
aauguccauaaauagaucau

SEQ ID NO: 3695819 - RNA, 20 nt, Salmonella enterica enterica serovar Typhi Ty2
aauguccguuuucgacaugg

SEQ ID NO: 3695820 - RNA, 15 nt, Salmonella enterica enterica serovar Typhi Ty2
aaugucgcgcaggcg

SEQ ID NO: 3695821 - RNA, 14 nt, Salmonella enterica enterica serovar Typhi Ty2
aaugucgcgucagg

SEQ ID NO: 3695822 - RNA, 16 nt, Salmonella enterica enterica serovar Typhi Ty2
aaugucgcgucagguu

SEQ ID NO: 3695823 - RNA, 21 nt, Salmonella enterica enterica serovar Typhi Ty2
aaugucggccugauuucugac

SEQ ID NO: 3695824 - RNA, 16 nt, Salmonella enterica enterica serovar Typhi Ty2
aaugucguccaugcug

SEQ ID NO: 3695825 - RNA, 14 nt, Salmonella enterica enterica serovar Typhi Ty2
aaugucuggcgcua

SEQ ID NO: 3695826 - RNA, 18 nt, Salmonella enterica enterica serovar Typhi Ty2
aaugucuggcgcuaaaau

SEQ ID NO: 3695827 - RNA, 21 nt, Salmonella enterica enterica serovar Typhi Ty2
aaugugaaauacagccagguu

SEQ ID NO: 3695828 - RNA, 17 nt, Salmonella enterica enterica serovar Typhi Ty2
aaugugaauccaggcca

SEQ ID NO: 3695829 - RNA, 23 nt, Salmonella enterica enterica serovar Typhi Ty2
aaugugcaaucacacuacacgaa

SEQ ID NO: 3695830 - RNA, 19 nt, Salmonella enterica enterica serovar Typhi Ty2
aaugugccgguaagaagaa

SEQ ID NO: 3695831 - RNA, 18 nt, Salmonella enterica enterica serovar Typhi Ty2
aauguguguacaaccauc

SEQ ID NO: 3695832 - RNA, 22 nt, Salmonella enterica enterica serovar Typhi Ty2
aauguuagcauuauuuuuaacc

SEQ ID NO: 3695833 - RNA, 19 nt, Salmonella enterica enterica serovar Typhi Ty2
aauguuagcgucugcggcu

SEQ ID NO: 3695834 - RNA, 18 nt, Salmonella enterica enterica serovar Typhi Ty2
aauguucgguauaugaau

SEQ ID NO: 3695835 - RNA, 17 nt, Salmonella enterica enterica serovar Typhi Ty2
aauguugguauauucga

SEQ ID NO: 3695836 - RNA, 15 nt, Salmonella enterica enterica serovar Typhi Ty2
aauguuguuccagag

SEQ ID NO: 3695837 - RNA, 22 nt, Salmonella enterica enterica serovar Typhi Ty2
aauguuuaaucggccagcgaaa

SEQ ID NO: 3695838 - RNA, 20 nt, Salmonella enterica enterica serovar Typhi Ty2
aauguuuagucuuuuaguau

SEQ ID NO: 3695839 - RNA, 19 nt, Salmonella enterica enterica serovar Typhi Ty2
aauguuuucugccagcaga

SEQ ID NO: 3695840 - RNA, 11 nt, Salmonella enterica enterica serovar Typhi Ty2
aauuaaaaaua

SEQ ID NO: 3695841 - RNA, 18 nt, Salmonella enterica enterica serovar Typhi Ty2
aauuaaauaacaaaugaa

SEQ ID NO: 3695842 - RNA, 20 nt, Salmonella enterica enterica serovar Typhi Ty2
aauuaaauagggacuuauaa

SEQ ID NO: 3695843 - RNA, 21 nt, Salmonella enterica enterica serovar Typhi Ty2
aauuaacauuuaagaaacaau

SEQ ID NO: 3695844 - RNA, 13 nt, Salmonella enterica enterica serovar Typhi Ty2
aauuaacccacau

SEQ ID NO: 3695845 - RNA, 13 nt, Salmonella enterica enterica serovar Typhi Ty2
aauuaaccgauaa

SEQ ID NO: 3695846 - RNA, 21 nt, Salmonella enterica enterica serovar Typhi Ty2
aauuaacgacaaaaauaccac

SEQ ID NO: 3695847 - RNA, 15 nt, Salmonella enterica enterica serovar Typhi Ty2
aauuaacucaucaca

SEQ ID NO: 3695848 - RNA, 18 nt, Salmonella enterica enterica serovar Typhi Ty2
aauuaagccggugaugau

SEQ ID NO: 3695849 - RNA, 14 nt, Salmonella enterica enterica serovar Typhi Ty2
aauuaauaaacaau

SEQ ID NO: 3695850 - RNA, 13 nt, Salmonella enterica enterica serovar Typhi Ty2
aauuaauauuuaa

SEQ ID NO: 3695851 - RNA, 21 nt, Salmonella enterica enterica serovar Typhi Ty2
aauuaaucaggcauccugccc

SEQ ID NO: 3695852 - RNA, 17 nt, Salmonella enterica enterica serovar Typhi Ty2
aauuaaucccaacccga

SEQ ID NO: 3695853 - RNA, 17 nt, Salmonella enterica enterica serovar Typhi Ty2
aauuacaucaauaaaca

SEQ ID NO: 3695854 - RNA, 17 nt, Salmonella enterica enterica serovar Typhi Ty2
aauuacgcccaucagcc

SEQ ID NO: 3695855 - RNA, 22 nt, Salmonella enterica enterica serovar Typhi Ty2
aauuacguuggggauaaccaga

SEQ ID NO: 3695856 - RNA, 18 nt, Salmonella enterica enterica serovar Typhi Ty2
aauuacuaucuucaaagc

SEQ ID NO: 3695857 - RNA, 22 nt, Salmonella enterica enterica serovar Typhi Ty2
aauuacuccguuuuaaucuuuu

SEQ ID NO: 3695858 - RNA, 17 nt, Salmonella enterica enterica serovar Typhi Ty2
aauuacuuaugauauau

SEQ ID NO: 3695859 - RNA, 19 nt, Salmonella enterica enterica serovar Typhi Ty2
aauuagacaagcaguucug

SEQ ID NO: 3695860 - RNA, 13 nt, Salmonella enterica enterica serovar Typhi Ty2
aauuauaaagcau

SEQ ID NO: 3695861 - RNA, 17 nt, Salmonella enterica enterica serovar Typhi Ty2
aauuaugaauaaccauc

SEQ ID NO: 3695862 - RNA, 17 nt, Salmonella enterica enterica serovar Typhi Ty2
aauuaugaccaauguua

SEQ ID NO: 3695863 - RNA, 17 nt, Salmonella enterica enterica serovar Typhi Ty2
aauuauguauuucucgc

SEQ ID NO: 3695864 - RNA, 16 nt, Salmonella enterica enterica serovar Typhi Ty2
aauuauuaucaauuuc

SEQ ID NO: 3695865 - RNA, 22 nt, Salmonella enterica enterica serovar Typhi Ty2
aauuauuaucaauuucauauua

SEQ ID NO: 3695866 - RNA, 18 nt, Salmonella enterica enterica serovar Typhi Ty2
aauuauuccuuaucacau

SEQ ID NO: 3695867 - RNA, 19 nt, Salmonella enterica enterica serovar Typhi Ty2
aauuauuuuucaaaugauc

SEQ ID NO: 3695868 - RNA, 19 nt, Salmonella enterica enterica serovar Typhi Ty2
aauucaccaaauccucacu

SEQ ID NO: 3695869 - RNA, 21 nt, Salmonella enterica enterica serovar Typhi Ty2
aauucacccguuauucauuca

SEQ ID NO: 3695870 - RNA, 15 nt, Salmonella enterica enterica serovar Typhi Ty2
aauucaccgcaugac

SEQ ID NO: 3695871 - RNA, 18 nt, Salmonella enterica enterica serovar Typhi Ty2
aauucacguuccauuuca

SEQ ID NO: 3695872 - RNA, 14 nt, Salmonella enterica enterica serovar Typhi Ty2
aauuccaauauuua

SEQ ID NO: 3695873 - RNA, 11 nt, Salmonella enterica enterica serovar Typhi Ty2
aauuccagcaa

SEQ ID NO: 3695874 - RNA, 14 nt, Salmonella enterica enterica serovar Typhi Ty2
aauuccaggaugac

SEQ ID NO: 3695875 - RNA, 19 nt, Salmonella enterica enterica serovar Typhi Ty2
aauuccauuagcauucccu

SEQ ID NO: 3695876 - RNA, 16 nt, Salmonella enterica enterica serovar Typhi Ty2
aauucccggcggaaau

SEQ ID NO: 3695877 - RNA, 19 nt, Salmonella enterica enterica serovar Typhi Ty2
aauuccgcaggagagccag

SEQ ID NO: 3695878 - RNA, 16 nt, Salmonella enterica enterica serovar Typhi Ty2
aauuccgcaucauuca

SEQ ID NO: 3695879 - RNA, 17 nt, Salmonella enterica enterica serovar Typhi Ty2
aauuccgcaucauucau

SEQ ID NO: 3695880 - RNA, 14 nt, Salmonella enterica enterica serovar Typhi Ty2
aauuccgcauugag

SEQ ID NO: 3695881 - RNA, 16 nt, Salmonella enterica enterica serovar Typhi Ty2
aauuccggagccugug

SEQ ID NO: 3695882 - RNA, 19 nt, Salmonella enterica enterica serovar Typhi Ty2
aauuccggcacaaccuggc

SEQ ID NO: 3695883 - RNA, 18 nt, Salmonella enterica enterica serovar Typhi Ty2
aauuccuucaauuuuacu

SEQ ID NO: 3695884 - RNA, 21 nt, Salmonella enterica enterica serovar Typhi Ty2
aauucgaaauaaagaaaguag

SEQ ID NO: 3695885 - RNA, 22 nt, Salmonella enterica enterica serovar Typhi Ty2
aauucgucaauaccuaaguuca

SEQ ID NO: 3695886 - RNA, 14 nt, Salmonella enterica enterica serovar Typhi Ty2
aauucguccacacg

SEQ ID NO: 3695887 - RNA, 14 nt, Salmonella enterica enterica serovar Typhi Ty2
aauucgugugauuu

SEQ ID NO: 3695888 - RNA, 20 nt, Salmonella enterica enterica serovar Typhi Ty2
aauucguguuuuugaacauu

SEQ ID NO: 3695889 - RNA, 17 nt, Salmonella enterica enterica serovar Typhi Ty2
aauucguuaccugcgca

SEQ ID NO: 3695890 - RNA, 21 nt, Salmonella enterica enterica serovar Typhi Ty2
aauucucagaaacaacacaaa

SEQ ID NO: 3695891 - RNA, 21 nt, Salmonella enterica enterica serovar Typhi Ty2
aauucucccaaauuuuuuuag

SEQ ID NO: 3695892 - RNA, 19 nt, Salmonella enterica enterica serovar Typhi Ty2
aauucugcgcgucaucgcu

SEQ ID NO: 3695893 - RNA, 20 nt, Salmonella enterica enterica serovar Typhi Ty2
aauucuuaacccacaagaaa

SEQ ID NO: 3695894 - RNA, 18 nt, Salmonella enterica enterica serovar Typhi Ty2
aauucuucugugauuauc

SEQ ID NO: 3695895 - RNA, 20 nt, Salmonella enterica enterica serovar Typhi Ty2
aauucuugcccgcugagugg

SEQ ID NO: 3695896 - RNA, 23 nt, Salmonella enterica enterica serovar Typhi Ty2
aauugaaauacucuuugaacagc

SEQ ID NO: 3695897 - RNA, 18 nt, Salmonella enterica enterica serovar Typhi Ty2
aauugaagaguuugauca

SEQ ID NO: 3695898 - RNA, 15 nt, Salmonella enterica enterica serovar Typhi Ty2
aauugaauuauaaua

SEQ ID NO: 3695899 - RNA, 14 nt, Salmonella enterica enterica serovar Typhi Ty2
aauugacgcugccu

SEQ ID NO: 3695900 - RNA, 20 nt, Salmonella enterica enterica serovar Typhi Ty2
aauugacgcuugacucugug

SEQ ID NO: 3695901 - RNA, 22 nt, Salmonella enterica enterica serovar Typhi Ty2
aauugaggccguuauugucaug

SEQ ID NO: 3695902 - RNA, 18 nt, Salmonella enterica enterica serovar Typhi Ty2
aauugaucacaaaaucau

SEQ ID NO: 3695903 - RNA, 21 nt, Salmonella enterica enterica serovar Typhi Ty2
aauugauuagcuuuaauccgu

SEQ ID NO: 3695904 - RNA, 13 nt, Salmonella enterica enterica serovar Typhi Ty2
aauugauucugug

SEQ ID NO: 3695905 - RNA, 15 nt, Salmonella enterica enterica serovar Typhi Ty2
aauugauucugugau

SEQ ID NO: 3695906 - RNA, 18 nt, Salmonella enterica enterica serovar Typhi Ty2
aauugcagggugcagcaa

SEQ ID NO: 3695907 - RNA, 22 nt, Salmonella enterica enterica serovar Typhi Ty2
aauugccacgaacgauauaaaa

SEQ ID NO: 3695908 - RNA, 13 nt, Salmonella enterica enterica serovar Typhi Ty2
aauugccgcccgu

SEQ ID NO: 3695909 - RNA, 17 nt, Salmonella enterica enterica serovar Typhi Ty2
aauugcgccaggcccag

SEQ ID NO: 3695910 - RNA, 24 nt, Salmonella enterica enterica serovar Typhi Ty2
aauugcgccaggcccagccgcucc

SEQ ID NO: 3695911 - RNA, 20 nt, Salmonella enterica enterica serovar Typhi Ty2
aauugcgguagaugaaaauu

SEQ ID NO: 3695912 - RNA, 23 nt, Salmonella enterica enterica serovar Typhi Ty2
aauugcgguagaugaaaauuugu

SEQ ID NO: 3695913 - RNA, 17 nt, Salmonella enterica enterica serovar Typhi Ty2
aauugcgguucugcaua

SEQ ID NO: 3695914 - RNA, 20 nt, Salmonella enterica enterica serovar Typhi Ty2
aauugcgguuuauccccgcu

SEQ ID NO: 3695915 - RNA, 11 nt, Salmonella enterica enterica serovar Typhi Ty2
aauugcugaag

SEQ ID NO: 3695916 - RNA, 22 nt, Salmonella enterica enterica serovar Typhi Ty2
aauugcugauccuguaaaaaau

SEQ ID NO: 3695917 - RNA, 16 nt, Salmonella enterica enterica serovar Typhi Ty2
aauuguagcugcgcca

SEQ ID NO: 3695918 - RNA, 18 nt, Salmonella enterica enterica serovar Typhi Ty2
aauuguaggcaggaauuc

SEQ ID NO: 3695919 - RNA, 13 nt, Salmonella enterica enterica serovar Typhi Ty2
aauugucagaauc

SEQ ID NO: 3695920 - RNA, 18 nt, Salmonella enterica enterica serovar Typhi Ty2
aauugucuuuuuaaccau

SEQ ID NO: 3695921 - RNA, 20 nt, Salmonella enterica enterica serovar Typhi Ty2
aauuguugcgccauggcuuc

SEQ ID NO: 3695922 - RNA, 16 nt, Salmonella enterica enterica serovar Typhi Ty2
aauuguuuaaaaacag

SEQ ID NO: 3695923 - RNA, 13 nt, Salmonella enterica enterica serovar Typhi Ty2
aauuuaaauagca

SEQ ID NO: 3695924 - RNA, 22 nt, Salmonella enterica enterica serovar Typhi Ty2
aauuuaagccagacgcgcagca

SEQ ID NO: 3695925 - RNA, 22 nt, Salmonella enterica enterica serovar Typhi Ty2
aauuuagcuauuccaaaauaau

SEQ ID NO: 3695926 - RNA, 22 nt, Salmonella enterica enterica serovar Typhi Ty2
aauuuauaagccugagcgcgag

SEQ ID NO: 3695927 - RNA, 22 nt, Salmonella enterica enterica serovar Typhi Ty2
aauuuaucaacaaauuccggca

SEQ ID NO: 3695928 - RNA, 20 nt, Salmonella enterica enterica serovar Typhi Ty2
aauuuaugguuccugaaaua

SEQ ID NO: 3695929 - RNA, 16 nt, Salmonella enterica enterica serovar Typhi Ty2
aauuuauuaacccuuc

SEQ ID NO: 3695930 - RNA, 13 nt, Salmonella enterica enterica serovar Typhi Ty2
aauuuauuucugc

SEQ ID NO: 3695931 - RNA, 21 nt, Salmonella enterica enterica serovar Typhi Ty2
aauuucaaucgccaguuuuug

SEQ ID NO: 3695932 - RNA, 23 nt, Salmonella enterica enterica serovar Typhi Ty2
aauuucaccuuuggcuuccggca

SEQ ID NO: 3695933 - RNA, 18 nt, Salmonella enterica enterica serovar Typhi Ty2
aauuucagggcuuauuca

SEQ ID NO: 3695934 - RNA, 22 nt, Salmonella enterica enterica serovar Typhi Ty2
aauuuccgcacgcgcgcccaug

SEQ ID NO: 3695935 - RNA, 21 nt, Salmonella enterica enterica serovar Typhi Ty2
aauuucgaaacaggaaaaaca

SEQ ID NO: 3695936 - RNA, 20 nt, Salmonella enterica enterica serovar Typhi Ty2
aauuucgcgaauaaucuguu

SEQ ID NO: 3695937 - RNA, 15 nt, Salmonella enterica enterica serovar Typhi Ty2
aauuucggcaaugac

SEQ ID NO: 3695938 - RNA, 14 nt, Salmonella enterica enterica serovar Typhi Ty2
aauuucucgcccgc

SEQ ID NO: 3695939 - RNA, 13 nt, Salmonella enterica enterica serovar Typhi Ty2
aauuucugcugcc

SEQ ID NO: 3695940 - RNA, 18 nt, Salmonella enterica enterica serovar Typhi Ty2
aauuucugguaccagauc

SEQ ID NO: 3695941 - RNA, 17 nt, Salmonella enterica enterica serovar Typhi Ty2
aauuucuuccauuagcu

SEQ ID NO: 3695942 - RNA, 16 nt, Salmonella enterica enterica serovar Typhi Ty2
aauuucuugaucaauc

SEQ ID NO: 3695943 - RNA, 14 nt, Salmonella enterica enterica serovar Typhi Ty2
acaaggaaugacac

SEQ ID NO: 3695944 - RNA, 14 nt, Salmonella enterica enterica serovar Typhi Ty2
acaaggauauguau

SEQ ID NO: 3695945 - RNA, 19 nt, Salmonella enterica enterica serovar Typhi Ty2
acaaggcauucaggccgga

SEQ ID NO: 3695946 - RNA, 22 nt, Salmonella enterica enterica serovar Typhi Ty2
acaaggcgguacgccgccaucc

SEQ ID NO: 3695947 - RNA, 21 nt, Salmonella enterica enterica serovar Typhi Ty2
acaaggucggcuccuggugag

SEQ ID NO: 3695948 - RNA, 16 nt, Salmonella enterica enterica serovar Typhi Ty2
acaaguaauaaaauaa

SEQ ID NO: 3695949 - RNA, 17 nt, Salmonella enterica enterica serovar Typhi Ty2
acaaguaauaaaauaau

SEQ ID NO: 3695950 - RNA, 18 nt, Salmonella enterica enterica serovar Typhi Ty2
acaaguaauaaaauaaua

SEQ ID NO: 3695951 - RNA, 18 nt, Salmonella enterica enterica serovar Typhi Ty2
acaaguagccugccagca

SEQ ID NO: 3695952 - RNA, 17 nt, Salmonella enterica enterica serovar Typhi Ty2
acaaguuuauccagcac

SEQ ID NO: 3695953 - RNA, 19 nt, Salmonella enterica enterica serovar Typhi Ty2
acaauaauucgugugauuu

SEQ ID NO: 3695954 - RNA, 12 nt, Salmonella enterica enterica serovar Typhi Ty2
acaauaccaaua

SEQ ID NO: 3695955 - RNA, 13 nt, Salmonella enterica enterica serovar Typhi Ty2
acaauaccaauaa

SEQ ID NO: 3695956 - RNA, 19 nt, Salmonella enterica enterica serovar Typhi Ty2
acaauaccguuuggaucug

SEQ ID NO: 3695957 - RNA, 14 nt, Salmonella enterica enterica serovar Typhi Ty2
acaauacgccgagc

SEQ ID NO: 3695958 - RNA, 19 nt, Salmonella enterica enterica serovar Typhi Ty2
acaauacuuaaaccugcgc

SEQ ID NO: 3695959 - RNA, 18 nt, Salmonella enterica enterica serovar Typhi Ty2
acaauagcaaucuguaac

SEQ ID NO: 3695960 - RNA, 21 nt, Salmonella enterica enterica serovar Typhi Ty2
acaauagcgcuaaacagcgcc

SEQ ID NO: 3695961 - RNA, 16 nt, Salmonella enterica enterica serovar Typhi Ty2
acaauaucaucgucau

SEQ ID NO: 3695962 - RNA, 18 nt, Salmonella enterica enterica serovar Typhi Ty2
acaauaugaccacuaacu

SEQ ID NO: 3695963 - RNA, 20 nt, Salmonella enterica enterica serovar Typhi Ty2
acaauaugguuauccagcag

SEQ ID NO: 3695964 - RNA, 22 nt, Salmonella enterica enterica serovar Typhi Ty2
acaauauucgccgcgauaauaa

SEQ ID NO: 3695965 - RNA, 23 nt, Salmonella enterica enterica serovar Typhi Ty2
acaaucaaauggcuggcgcuauu

SEQ ID NO: 3695966 - RNA, 23 nt, Salmonella enterica enterica serovar Typhi Ty2
acaaucaauucacguuccauuuc

SEQ ID NO: 3695967 - RNA, 15 nt, Salmonella enterica enterica serovar Typhi Ty2
acaaucacagcgcag

SEQ ID NO: 3695968 - RNA, 16 nt, Salmonella enterica enterica serovar Typhi Ty2
acaaucacagcgcaga

SEQ ID NO: 3695969 - RNA, 13 nt, Salmonella enterica enterica serovar Typhi Ty2
acaaucagcacca

SEQ ID NO: 3695970 - RNA, 14 nt, Salmonella enterica enterica serovar Typhi Ty2
acaaucagcgcaau

SEQ ID NO: 3695971 - RNA, 16 nt, Salmonella enterica enterica serovar Typhi Ty2
acaauccccgaaagcc

SEQ ID NO: 3695972 - RNA, 16 nt, Salmonella enterica enterica serovar Typhi Ty2
acaaucccggcaacug

SEQ ID NO: 3695973 - RNA, 16 nt, Salmonella enterica enterica serovar Typhi Ty2
acaauccgccacgcuc

SEQ ID NO: 3695974 - RNA, 18 nt, Salmonella enterica enterica serovar Typhi Ty2
acaauccgccacgcucgc

SEQ ID NO: 3695975 - RNA, 19 nt, Salmonella enterica enterica serovar Typhi Ty2
acaauccguuauuucacag

SEQ ID NO: 3695976 - RNA, 14 nt, Salmonella enterica enterica serovar Typhi Ty2
acaaucgccagccc

SEQ ID NO: 3695977 - RNA, 21 nt, Salmonella enterica enterica serovar Typhi Ty2
acaaucgccgugaucccaaug

SEQ ID NO: 3695978 - RNA, 13 nt, Salmonella enterica enterica serovar Typhi Ty2
acaaucgcguuuu

SEQ ID NO: 3695979 - RNA, 21 nt, Salmonella enterica enterica serovar Typhi Ty2
acaaucgcguuuuccagcauc

SEQ ID NO: 3695980 - RNA, 15 nt, Salmonella enterica enterica serovar Typhi Ty2
acaaucucaauacca

SEQ ID NO: 3695981 - RNA, 20 nt, Salmonella enterica enterica serovar Typhi Ty2
acaaucucaauaccacgccg

SEQ ID NO: 3695982 - RNA, 20 nt, Salmonella enterica enterica serovar Typhi Ty2
acaaucuccagaccgcugcg

SEQ ID NO: 3695983 - RNA, 23 nt, Salmonella enterica enterica serovar Typhi Ty2
acaaucuccagaccgcugcggaa

SEQ ID NO: 3695984 - RNA, 21 nt, Salmonella enterica enterica serovar Typhi Ty2
acaaucugugugggcacucga

SEQ ID NO: 3695985 - RNA, 15 nt, Salmonella enterica enterica serovar Typhi Ty2
acaauggcccgauac

SEQ ID NO: 3695986 - RNA, 18 nt, Salmonella enterica enterica serovar Typhi Ty2
acaauggcgacgaucagc

SEQ ID NO: 3695987 - RNA, 18 nt, Salmonella enterica enterica serovar Typhi Ty2
acaaugggauaaaaugga

SEQ ID NO: 3695988 - RNA, 15 nt, Salmonella enterica enterica serovar Typhi Ty2
acaauuacgcaagag

SEQ ID NO: 3695989 - RNA, 21 nt, Salmonella enterica enterica serovar Typhi Ty2
acaauuacgcaagagagcaac

SEQ ID NO: 3695990 - RNA, 15 nt, Salmonella enterica enterica serovar Typhi Ty2
acaauucaacucacu

SEQ ID NO: 3695991 - RNA, 15 nt, Salmonella enterica enterica serovar Typhi Ty2
acaauugccagcagg

SEQ ID NO: 3695992 - RNA, 15 nt, Salmonella enterica enterica serovar Typhi Ty2
acaauuuaucagaca

SEQ ID NO: 3695993 - RNA, 19 nt, Salmonella enterica enterica serovar Typhi Ty2
acaauuucaccuuuggcuu

SEQ ID NO: 3695994 - RNA, 22 nt, Salmonella enterica enterica serovar Typhi Ty2
acaauuucgcaaacacccgacg

SEQ ID NO: 3695995 - RNA, 20 nt, Salmonella enterica enterica serovar Typhi Ty2
acaauuuugauaagagaaaa

SEQ ID NO: 3695996 - RNA, 21 nt, Salmonella enterica enterica serovar Typhi Ty2
acaauuuugauaagagaaaau

SEQ ID NO: 3695997 - RNA, 20 nt, Salmonella enterica enterica serovar Typhi Ty2
acacaauaucgccaucguag

SEQ ID NO: 3695998 - RNA, 16 nt, Salmonella enterica enterica serovar Typhi Ty2
acacacaaucgguuau

SEQ ID NO: 3695999 - RNA, 22 nt, Salmonella enterica enterica serovar Typhi Ty2
acacacaguugccuucgauuaa

SEQ ID NO: 3696000 - RNA, 13 nt, Salmonella enterica enterica serovar Typhi Ty2
acacacgcgcuga

SEQ ID NO: 3696001 - RNA, 21 nt, Salmonella enterica enterica serovar Typhi Ty2
acacagaaaaaccaaaaaaua

SEQ ID NO: 3696002 - RNA, 22 nt, Salmonella enterica enterica serovar Typhi Ty2
acacagaaaaaccaaaaaauau

SEQ ID NO: 3696003 - RNA, 12 nt, Salmonella enterica enterica serovar Typhi Ty2
acacagaauuac

SEQ ID NO: 3696004 - RNA, 20 nt, Salmonella enterica enterica serovar Typhi Ty2
acacagacugcuuguuuaau

SEQ ID NO: 3696005 - RNA, 22 nt, Salmonella enterica enterica serovar Typhi Ty2
acacagacuuugcacagucugc

SEQ ID NO: 3696006 - RNA, 13 nt, Salmonella enterica enterica serovar Typhi Ty2
acacagaucgaau

SEQ ID NO: 3696007 - RNA, 14 nt, Salmonella enterica enterica serovar Typhi Ty2
acacagccagcacg

SEQ ID NO: 3696008 - RNA, 15 nt, Salmonella enterica enterica serovar Typhi Ty2
acacaggccugcauu

SEQ ID NO: 3696009 - RNA, 19 nt, Salmonella enterica enterica serovar Typhi Ty2
acacaggcgugguggauau

SEQ ID NO: 3696010 - RNA, 22 nt, Salmonella enterica enterica serovar Typhi Ty2
acacaggcgugguggauaucca

SEQ ID NO: 3696011 - RNA, 13 nt, Salmonella enterica enterica serovar Typhi Ty2
acacaguaaaaaa

SEQ ID NO: 3696012 - RNA, 15 nt, Salmonella enterica enterica serovar Typhi Ty2
acacaguaaaaaaac

SEQ ID NO: 3696013 - RNA, 13 nt, Salmonella enterica enterica serovar Typhi Ty2
acacaguugccuu

SEQ ID NO: 3696014 - RNA, 17 nt, Salmonella enterica enterica serovar Typhi Ty2
acacauaacgcccgaca

SEQ ID NO: 3696015 - RNA, 14 nt, Salmonella enterica enterica serovar Typhi Ty2
acacauagauaaaa

SEQ ID NO: 3696016 - RNA, 19 nt, Salmonella enterica enterica serovar Typhi Ty2
acacauaucgccagccaug

SEQ ID NO: 3696017 - RNA, 17 nt, Salmonella enterica enterica serovar Typhi Ty2
acacaucacaaucucca

SEQ ID NO: 3696018 - RNA, 15 nt, Salmonella enterica enterica serovar Typhi Ty2
acacaucaggaaugc

SEQ ID NO: 3696019 - RNA, 19 nt, Salmonella enterica enterica serovar Typhi Ty2
acacauuaaaaaagauuaa

SEQ ID NO: 3696020 - RNA, 16 nt, Salmonella enterica enterica serovar Typhi Ty2
acacauuucuuuugau

SEQ ID NO: 3696021 - RNA, 19 nt, Salmonella enterica enterica serovar Typhi Ty2
acacauuuucaaugcacgc

SEQ ID NO: 3696022 - RNA, 17 nt, Salmonella enterica enterica serovar Typhi Ty2
acaccaacgcuggcccg

SEQ ID NO: 3696023 - RNA, 18 nt, Salmonella enterica enterica serovar Typhi Ty2
acaccaaugucauauuug

SEQ ID NO: 3696024 - RNA, 23 nt, Salmonella enterica enterica serovar Typhi Ty2
acaccaaugucauauuugugagc

SEQ ID NO: 3696025 - RNA, 14 nt, Salmonella enterica enterica serovar Typhi Ty2
acagccauccgacg

SEQ ID NO: 3696026 - RNA, 15 nt, Salmonella enterica enterica serovar Typhi Ty2
acagccaucuucugc

SEQ ID NO: 3696027 - RNA, 16 nt, Salmonella enterica enterica serovar Typhi Ty2
acagcccuuucaggaa

SEQ ID NO: 3696028 - RNA, 14 nt, Salmonella enterica enterica serovar Typhi Ty2
acagccgcauuuuu

SEQ ID NO: 3696029 - RNA, 19 nt, Salmonella enterica enterica serovar Typhi Ty2
acagccgcguuuugccgcu

SEQ ID NO: 3696030 - RNA, 23 nt, Salmonella enterica enterica serovar Typhi Ty2
acagccgcuguuuuucaucauca

SEQ ID NO: 3696031 - RNA, 12 nt, Salmonella enterica enterica serovar Typhi Ty2
acagccugcgug

SEQ ID NO: 3696032 - RNA, 23 nt, Salmonella enterica enterica serovar Typhi Ty2
acagcgaacaguguaaacgccag

SEQ ID NO: 3696033 - RNA, 15 nt, Salmonella enterica enterica serovar Typhi Ty2
acagcgaccacgcca

SEQ ID NO: 3696034 - RNA, 13 nt, Salmonella enterica enterica serovar Typhi Ty2
acagcgacgccag

SEQ ID NO: 3696035 - RNA, 15 nt, Salmonella enterica enterica serovar Typhi Ty2
acagcgcaauaugca

SEQ ID NO: 3696036 - RNA, 13 nt, Salmonella enterica enterica serovar Typhi Ty2
acagcgccagaca

SEQ ID NO: 3696037 - RNA, 15 nt, Salmonella enterica enterica serovar Typhi Ty2
acagcgccaucagga

SEQ ID NO: 3696038 - RNA, 16 nt, Salmonella enterica enterica serovar Typhi Ty2
acagcgccggcagcag

SEQ ID NO: 3696039 - RNA, 13 nt, Salmonella enterica enterica serovar Typhi Ty2
acagcgcgcgcga

SEQ ID NO: 3696040 - RNA, 14 nt, Salmonella enterica enterica serovar Typhi Ty2
acagcggcgcgcca

SEQ ID NO: 3696041 - RNA, 17 nt, Salmonella enterica enterica serovar Typhi Ty2
acagcguaaugcgccag

SEQ ID NO: 3696042 - RNA, 17 nt, Salmonella enterica enterica serovar Typhi Ty2
acagcguacaauggcag

SEQ ID NO: 3696043 - RNA, 19 nt, Salmonella enterica enterica serovar Typhi Ty2
acagcguacaauggcaggc

SEQ ID NO: 3696044 - RNA, 20 nt, Salmonella enterica enterica serovar Typhi Ty2
acagcguacaauggcaggca

SEQ ID NO: 3696045 - RNA, 21 nt, Salmonella enterica enterica serovar Typhi Ty2
acagcguacaauggcaggcau

SEQ ID NO: 3696046 - RNA, 15 nt, Salmonella enterica enterica serovar Typhi Ty2
acagcguacaggcgg

SEQ ID NO: 3696047 - RNA, 17 nt, Salmonella enterica enterica serovar Typhi Ty2
acagcguaggccaggca

SEQ ID NO: 3696048 - RNA, 22 nt, Salmonella enterica enterica serovar Typhi Ty2
acagcguaguuuauucaucucc

SEQ ID NO: 3696049 - RNA, 14 nt, Salmonella enterica enterica serovar Typhi Ty2
acagcguauuaagc

SEQ ID NO: 3696050 - RNA, 12 nt, Salmonella enterica enterica serovar Typhi Ty2
acagcgugaaca

SEQ ID NO: 3696051 - RNA, 15 nt, Salmonella enterica enterica serovar Typhi Ty2
acagcguguucaugc

SEQ ID NO: 3696052 - RNA, 23 nt, Salmonella enterica enterica serovar Typhi Ty2
acagcguguucaugcgcggcgga

SEQ ID NO: 3696053 - RNA, 15 nt, Salmonella enterica enterica serovar Typhi Ty2
acagcucaccccuau

SEQ ID NO: 3696054 - RNA, 21 nt, Salmonella enterica enterica serovar Typhi Ty2
acagcucggcaaagcccauca

SEQ ID NO: 3696055 - RNA, 21 nt, Salmonella enterica enterica serovar Typhi Ty2
acagcuggcgauauccgugcc

SEQ ID NO: 3696056 - RNA, 21 nt, Salmonella enterica enterica serovar Typhi Ty2
acagcuuaaucaccagcgcau

SEQ ID NO: 3696057 - RNA, 17 nt, Salmonella enterica enterica serovar Typhi Ty2
acagcuuagcuguaauu

SEQ ID NO: 3696058 - RNA, 21 nt, Salmonella enterica enterica serovar Typhi Ty2
acagcuucaggcucaucagcg

SEQ ID NO: 3696059 - RNA, 22 nt, Salmonella enterica enterica serovar Typhi Ty2
acagcuucaugcgccgcgacaa

SEQ ID NO: 3696060 - RNA, 19 nt, Salmonella enterica enterica serovar Typhi Ty2
acagcuucgguccggcgcu

SEQ ID NO: 3696061 - RNA, 20 nt, Salmonella enterica enterica serovar Typhi Ty2
acagcuugcgcccaugcuca

SEQ ID NO: 3696062 - RNA, 14 nt, Salmonella enterica enterica serovar Typhi Ty2
acagcuuuuacaac

SEQ ID NO: 3696063 - RNA, 14 nt, Salmonella enterica enterica serovar Typhi Ty2
acaggacagauguc

SEQ ID NO: 3696064 - RNA, 16 nt, Salmonella enterica enterica serovar Typhi Ty2
acaggaguucaucaug

SEQ ID NO: 3696065 - RNA, 11 nt, Salmonella enterica enterica serovar Typhi Ty2
acaggaugcuu

SEQ ID NO: 3696066 - RNA, 15 nt, Salmonella enterica enterica serovar Typhi Ty2
acaggcacaacaaua

SEQ ID NO: 3696067 - RNA, 20 nt, Salmonella enterica enterica serovar Typhi Ty2
acaggcaccagcguauaauu

SEQ ID NO: 3696068 - RNA, 20 nt, Salmonella enterica enterica serovar Typhi Ty2
acaggcauccgugaccugcu

SEQ ID NO: 3696069 - RNA, 12 nt, Salmonella enterica enterica serovar Typhi Ty2
acaggcauuguc

SEQ ID NO: 3696070 - RNA, 18 nt, Salmonella enterica enterica serovar Typhi Ty2
acaggccauuaagcuucg

SEQ ID NO: 3696071 - RNA, 14 nt, Salmonella enterica enterica serovar Typhi Ty2
acaggccgccgagg

SEQ ID NO: 3696072 - RNA, 15 nt, Salmonella enterica enterica serovar Typhi Ty2
acaggccggacaggc

SEQ ID NO: 3696073 - RNA, 18 nt, Salmonella enterica enterica serovar Typhi Ty2
acaggccguucauucgcc

SEQ ID NO: 3696074 - RNA, 19 nt, Salmonella enterica enterica serovar Typhi Ty2
acaggcgacgccgccaucc

SEQ ID NO: 3696075 - RNA, 19 nt, Salmonella enterica enterica serovar Typhi Ty2
acaggcgcagggcauuauu

SEQ ID NO: 3696076 - RNA, 15 nt, Salmonella enterica enterica serovar Typhi Ty2
acaggcgcaucagaa

SEQ ID NO: 3696077 - RNA, 16 nt, Salmonella enterica enterica serovar Typhi Ty2
acaggcgcaucagaaa

SEQ ID NO: 3696078 - RNA, 21 nt, Salmonella enterica enterica serovar Typhi Ty2
acaggcggaaaucaacaaucc

SEQ ID NO: 3696079 - RNA, 12 nt, Salmonella enterica enterica serovar Typhi Ty2
acaggcggauga

SEQ ID NO: 3696080 - RNA, 17 nt, Salmonella enterica enterica serovar Typhi Ty2
acaggcggcuguugguu

SEQ ID NO: 3696081 - RNA, 18 nt, Salmonella enterica enterica serovar Typhi Ty2
acaggcggcuguugguuu

SEQ ID NO: 3696082 - RNA, 12 nt, Salmonella enterica enterica serovar Typhi Ty2
acaggcgucgcg

SEQ ID NO: 3696083 - RNA, 20 nt, Salmonella enterica enterica serovar Typhi Ty2
acaggcugaacccugccugc

SEQ ID NO: 3696084 - RNA, 21 nt, Salmonella enterica enterica serovar Typhi Ty2
acaggcuggcgggcgucaccg

SEQ ID NO: 3696085 - RNA, 17 nt, Salmonella enterica enterica serovar Typhi Ty2
acaggggggaacagcaa

SEQ ID NO: 3696086 - RNA, 22 nt, Salmonella enterica enterica serovar Typhi Ty2
acagguaaaacaaaaaaacggc

SEQ ID NO: 3696087 - RNA, 22 nt, Salmonella enterica enterica serovar Typhi Ty2
acaggucggcaugcaucucuuc

SEQ ID NO: 3696088 - RNA, 19 nt, Salmonella enterica enterica serovar Typhi Ty2
acaggugaaauaggggaga

SEQ ID NO: 3696089 - RNA, 14 nt, Salmonella enterica enterica serovar Typhi Ty2
acaggugaccaggc

SEQ ID NO: 3696090 - RNA, 14 nt, Salmonella enterica enterica serovar Typhi Ty2
acaggugcgcugug

SEQ ID NO: 3696091 - RNA, 15 nt, Salmonella enterica enterica serovar Typhi Ty2
acagguggaaagugc

SEQ ID NO: 3696092 - RNA, 13 nt, Salmonella enterica enterica serovar Typhi Ty2
acagguuaacucc

SEQ ID NO: 3696093 - RNA, 19 nt, Salmonella enterica enterica serovar Typhi Ty2
acagguuaucgccgcccgu

SEQ ID NO: 3696094 - RNA, 16 nt, Salmonella enterica enterica serovar Typhi Ty2
acagguucgaaucccg

SEQ ID NO: 3696095 - RNA, 16 nt, Salmonella enterica enterica serovar Typhi Ty2
acaguaaccccauaca

SEQ ID NO: 3696096 - RNA, 13 nt, Salmonella enterica enterica serovar Typhi Ty2
acaguacgcccgg

SEQ ID NO: 3696097 - RNA, 18 nt, Salmonella enterica enterica serovar Typhi Ty2
acaguacggucaggcuca

SEQ ID NO: 3696098 - RNA, 16 nt, Salmonella enterica enterica serovar Typhi Ty2
acaguagagggggacc

SEQ ID NO: 3696099 - RNA, 14 nt, Salmonella enterica enterica serovar Typhi Ty2
acaguagcaggggc

SEQ ID NO: 3696100 - RNA, 20 nt, Salmonella enterica enterica serovar Typhi Ty2
acaguagcaggggcuggaga

SEQ ID NO: 3696101 - RNA, 21 nt, Salmonella enterica enterica serovar Typhi Ty2
acaguauuuguucagacacau

SEQ ID NO: 3696102 - RNA, 22 nt, Salmonella enterica enterica serovar Typhi Ty2
acagucaaacacgaccagcgac

SEQ ID NO: 3696103 - RNA, 17 nt, Salmonella enterica enterica serovar Typhi Ty2
acagucgucuggcgcua

SEQ ID NO: 3696104 - RNA, 17 nt, Salmonella enterica enterica serovar Typhi Ty2
acagugacccgccgcca

SEQ ID NO: 3696105 - RNA, 20 nt, Salmonella enterica enterica serovar Typhi Ty2
acagugacccgccgccagca

SEQ ID NO: 3696106 - RNA, 21 nt, Salmonella enterica enterica serovar Typhi Ty2
acagugacccgccgccagcac

SEQ ID NO: 3696107 - RNA, 18 nt, Salmonella enterica enterica serovar Typhi Ty2
acauccugugaaguaaaa

SEQ ID NO: 3696108 - RNA, 20 nt, Salmonella enterica enterica serovar Typhi Ty2
acauccugugaaguaaaaaa

SEQ ID NO: 3696109 - RNA, 16 nt, Salmonella enterica enterica serovar Typhi Ty2
acaucgcaaaauuccg

SEQ ID NO: 3696110 - RNA, 16 nt, Salmonella enterica enterica serovar Typhi Ty2
acaucgccaccaccag

SEQ ID NO: 3696111 - RNA, 17 nt, Salmonella enterica enterica serovar Typhi Ty2
acaucgccagcuucgcu

SEQ ID NO: 3696112 - RNA, 11 nt, Salmonella enterica enterica serovar Typhi Ty2
acaucgccauu

SEQ ID NO: 3696113 - RNA, 17 nt, Salmonella enterica enterica serovar Typhi Ty2
acaucgccggagccgcc

SEQ ID NO: 3696114 - RNA, 19 nt, Salmonella enterica enterica serovar Typhi Ty2
acaucgccugguaaggcaa

SEQ ID NO: 3696115 - RNA, 15 nt, Salmonella enterica enterica serovar Typhi Ty2
acaucgcucccggca

SEQ ID NO: 3696116 - RNA, 18 nt, Salmonella enterica enterica serovar Typhi Ty2
acaucgcucccggcacca

SEQ ID NO: 3696117 - RNA, 14 nt, Salmonella enterica enterica serovar Typhi Ty2
acaucgcuccggca

SEQ ID NO: 3696118 - RNA, 22 nt, Salmonella enterica enterica serovar Typhi Ty2
acaucgcucgcgccacgcagau

SEQ ID NO: 3696119 - RNA, 12 nt, Salmonella enterica enterica serovar Typhi Ty2
acaucgcugaua

SEQ ID NO: 3696120 - RNA, 23 nt, Salmonella enterica enterica serovar Typhi Ty2
acaucgucuuuuaccgcgucgcu

SEQ ID NO: 3696121 - RNA, 11 nt, Salmonella enterica enterica serovar Typhi Ty2
acaucuacuuc

SEQ ID NO: 3696122 - RNA, 22 nt, Salmonella enterica enterica serovar Typhi Ty2
acaucucuucguguaacgcaua

SEQ ID NO: 3696123 - RNA, 16 nt, Salmonella enterica enterica serovar Typhi Ty2
acaucuguuugagaaa

SEQ ID NO: 3696124 - RNA, 16 nt, Salmonella enterica enterica serovar Typhi Ty2
acaucuuccaugccuu

SEQ ID NO: 3696125 - RNA, 15 nt, Salmonella enterica enterica serovar Typhi Ty2
acaucuucggcguug

SEQ ID NO: 3696126 - RNA, 17 nt, Salmonella enterica enterica serovar Typhi Ty2
acaucuucuacaugccc

SEQ ID NO: 3696127 - RNA, 22 nt, Salmonella enterica enterica serovar Typhi Ty2
acaugaaagaagaaucgcccca

SEQ ID NO: 3696128 - RNA, 15 nt, Salmonella enterica enterica serovar Typhi Ty2
acaugaauaauaaua

SEQ ID NO: 3696129 - RNA, 17 nt, Salmonella enterica enterica serovar Typhi Ty2
acaugaauaauaauaca

SEQ ID NO: 3696130 - RNA, 18 nt, Salmonella enterica enterica serovar Typhi Ty2
acaugaccagcgcaaaca

SEQ ID NO: 3696131 - RNA, 19 nt, Salmonella enterica enterica serovar Typhi Ty2
acaugaccgcacagcagac

SEQ ID NO: 3696132 - RNA, 20 nt, Salmonella enterica enterica serovar Typhi Ty2
acaugaccugaauauggcca

SEQ ID NO: 3696133 - RNA, 20 nt, Salmonella enterica enterica serovar Typhi Ty2
acaugacgguucaucgcaga

SEQ ID NO: 3696134 - RNA, 22 nt, Salmonella enterica enterica serovar Typhi Ty2
acaugacguauucaccucccug

SEQ ID NO: 3696135 - RNA, 19 nt, Salmonella enterica enterica serovar Typhi Ty2
acaugccgacggagacgau

SEQ ID NO: 3696136 - RNA, 11 nt, Salmonella enterica enterica serovar Typhi Ty2
acaugccgcca

SEQ ID NO: 3696137 - RNA, 23 nt, Salmonella enterica enterica serovar Typhi Ty2
acaugccgcuaugcggcguuaau

SEQ ID NO: 3696138 - RNA, 20 nt, Salmonella enterica enterica serovar Typhi Ty2
acaugccggugcgagaaaaa

SEQ ID NO: 3696139 - RNA, 21 nt, Salmonella enterica enterica serovar Typhi Ty2
acaugccggugcgagaaaaag

SEQ ID NO: 3696140 - RNA, 22 nt, Salmonella enterica enterica serovar Typhi Ty2
acaugccggugcgagaaaaagc

SEQ ID NO: 3696141 - RNA, 16 nt, Salmonella enterica enterica serovar Typhi Ty2
acaugccguuaauaau

SEQ ID NO: 3696142 - RNA, 17 nt, Salmonella enterica enterica serovar Typhi Ty2
acaugcgcagaaaggcg

SEQ ID NO: 3696143 - RNA, 12 nt, Salmonella enterica enterica serovar Typhi Ty2
acaugcggcuuu

SEQ ID NO: 3696144 - RNA, 17 nt, Salmonella enterica enterica serovar Typhi Ty2
acaugcguaccugcgcg

SEQ ID NO: 3696145 - RNA, 21 nt, Salmonella enterica enterica serovar Typhi Ty2
acaugcuacaggcaaguuuaa

SEQ ID NO: 3696146 - RNA, 16 nt, Salmonella enterica enterica serovar Typhi Ty2
acaugcucaugaaggc

SEQ ID NO: 3696147 - RNA, 16 nt, Salmonella enterica enterica serovar Typhi Ty2
acaugcugugcgcgug

SEQ ID NO: 3696148 - RNA, 21 nt, Salmonella enterica enterica serovar Typhi Ty2
acauggacaccggaagugaau

SEQ ID NO: 3696149 - RNA, 21 nt, Salmonella enterica enterica serovar Typhi Ty2
acauggcggucgccauauguu

SEQ ID NO: 3696150 - RNA, 19 nt, Salmonella enterica enterica serovar Typhi Ty2
acaugguguuugcggcaca

SEQ ID NO: 3696151 - RNA, 12 nt, Salmonella enterica enterica serovar Typhi Ty2
acauguccagau

SEQ ID NO: 3696152 - RNA, 20 nt, Salmonella enterica enterica serovar Typhi Ty2
acauguccuacacucaauac

SEQ ID NO: 3696153 - RNA, 20 nt, Salmonella enterica enterica serovar Typhi Ty2
acaugucggcgaaaauccuu

SEQ ID NO: 3696154 - RNA, 18 nt, Salmonella enterica enterica serovar Typhi Ty2
acauguuuauguagccag

SEQ ID NO: 3696155 - RNA, 17 nt, Salmonella enterica enterica serovar Typhi Ty2
acauuaacgccgcguuc

SEQ ID NO: 3696156 - RNA, 13 nt, Salmonella enterica enterica serovar Typhi Ty2
acauuacauccuc

SEQ ID NO: 3696157 - RNA, 22 nt, Salmonella enterica enterica serovar Typhi Ty2
acauuacccauaucgcggguaa

SEQ ID NO: 3696158 - RNA, 19 nt, Salmonella enterica enterica serovar Typhi Ty2
acauuauaggugucagauc

SEQ ID NO: 3696159 - RNA, 17 nt, Salmonella enterica enterica serovar Typhi Ty2
acauuauuaaaaugucu

SEQ ID NO: 3696160 - RNA, 16 nt, Salmonella enterica enterica serovar Typhi Ty2
acauuauugcacauaa

SEQ ID NO: 3696161 - RNA, 20 nt, Salmonella enterica enterica serovar Typhi Ty2
acauucaaaccuucaagaau

SEQ ID NO: 3696162 - RNA, 17 nt, Salmonella enterica enterica serovar Typhi Ty2
acauuccugacauuuau

SEQ ID NO: 3696163 - RNA, 20 nt, Salmonella enterica enterica serovar Typhi Ty2
acauuccugacauuuauauu

SEQ ID NO: 3696164 - RNA, 15 nt, Salmonella enterica enterica serovar Typhi Ty2
acauucgauaaccgc

SEQ ID NO: 3696165 - RNA, 15 nt, Salmonella enterica enterica serovar Typhi Ty2
acauucguaacaugc

SEQ ID NO: 3696166 - RNA, 18 nt, Salmonella enterica enterica serovar Typhi Ty2
acauucugcuuccagaau

SEQ ID NO: 3696167 - RNA, 21 nt, Salmonella enterica enterica serovar Typhi Ty2
acauugaguaaauaaaucagc

SEQ ID NO: 3696168 - RNA, 12 nt, Salmonella enterica enterica serovar Typhi Ty2
acauugccccuc

SEQ ID NO: 3696169 - RNA, 19 nt, Salmonella enterica enterica serovar Typhi Ty2
acauugccggauggcggcg

SEQ ID NO: 3696170 - RNA, 20 nt, Salmonella enterica enterica serovar Typhi Ty2
acauugcgccgcacuucacg

SEQ ID NO: 3696171 - RNA, 21 nt, Salmonella enterica enterica serovar Typhi Ty2
acauuggcgcggcaggaaugu

SEQ ID NO: 3696172 - RNA, 16 nt, Salmonella enterica enterica serovar Typhi Ty2
acauugggucguaaua

SEQ ID NO: 3696173 - RNA, 22 nt, Salmonella enterica enterica serovar Typhi Ty2
acauuguaugcaagaacgggcu

SEQ ID NO: 3696174 - RNA, 17 nt, Salmonella enterica enterica serovar Typhi Ty2
acauuuaucuuccggca

SEQ ID NO: 3696175 - RNA, 19 nt, Salmonella enterica enterica serovar Typhi Ty2
acauuucagcgcagaauuu

SEQ ID NO: 3696176 - RNA, 12 nt, Salmonella enterica enterica serovar Typhi Ty2
acauuucuuuug

SEQ ID NO: 3696177 - RNA, 13 nt, Salmonella enterica enterica serovar Typhi Ty2
acauuuucccaac

SEQ ID NO: 3696178 - RNA, 15 nt, Salmonella enterica enterica serovar Typhi Ty2
acauuuuuuucuugc

SEQ ID NO: 3696179 - RNA, 17 nt, Salmonella enterica enterica serovar Typhi Ty2
accaaaaacgcccccag

SEQ ID NO: 3696180 - RNA, 21 nt, Salmonella enterica enterica serovar Typhi Ty2
accaaaauggcaaguaaaaua

SEQ ID NO: 3696181 - RNA, 22 nt, Salmonella enterica enterica serovar Typhi Ty2
accaaacccuuuggcaaaaaag

SEQ ID NO: 3696182 - RNA, 14 nt, Salmonella enterica enterica serovar Typhi Ty2
accaaagccaggcc

SEQ ID NO: 3696183 - RNA, 22 nt, Salmonella enterica enterica serovar Typhi Ty2
accaaaugguugguauugcgaa

SEQ ID NO: 3696184 - RNA, 20 nt, Salmonella enterica enterica serovar Typhi Ty2
accaaccaggcaaaccagca

SEQ ID NO: 3696185 - RNA, 18 nt, Salmonella enterica enterica serovar Typhi Ty2
accaacccagccugcgau

SEQ ID NO: 3696186 - RNA, 18 nt, Salmonella enterica enterica serovar Typhi Ty2
accaacgaccaucaagca

SEQ ID NO: 3696187 - RNA, 23 nt, Salmonella enterica enterica serovar Typhi Ty2
accaacggcgacgcccgccaucu

SEQ ID NO: 3696188 - RNA, 22 nt, Salmonella enterica enterica serovar Typhi Ty2
accaacgucgugccagugaugc

SEQ ID NO: 3696189 - RNA, 18 nt, Salmonella enterica enterica serovar Typhi Ty2
accagcccaugaaggagc

SEQ ID NO: 3696190 - RNA, 15 nt, Salmonella enterica enterica serovar Typhi Ty2
accagccccaaaauu

SEQ ID NO: 3696191 - RNA, 14 nt, Salmonella enterica enterica serovar Typhi Ty2
accagccccacggu

SEQ ID NO: 3696192 - RNA, 20 nt, Salmonella enterica enterica serovar Typhi Ty2
accagccgagugcuuaugua

SEQ ID NO: 3696193 - RNA, 18 nt, Salmonella enterica enterica serovar Typhi Ty2
accagccgauaacucuuc

SEQ ID NO: 3696194 - RNA, 15 nt, Salmonella enterica enterica serovar Typhi Ty2
accagccgaucauca

SEQ ID NO: 3696195 - RNA, 24 nt, Salmonella enterica enterica serovar Typhi Ty2
accagccgcgcccuaacaggcgca

SEQ ID NO: 3696196 - RNA, 15 nt, Salmonella enterica enterica serovar Typhi Ty2
accagccugccgucu

SEQ ID NO: 3696197 - RNA, 14 nt, Salmonella enterica enterica serovar Typhi Ty2
accagcgaaaugac

SEQ ID NO: 3696198 - RNA, 22 nt, Salmonella enterica enterica serovar Typhi Ty2
accagcgaugcgcgcgcguuau

SEQ ID NO: 3696199 - RNA, 22 nt, Salmonella enterica enterica serovar Typhi Ty2
accagcgcaagcagcgccccgc

SEQ ID NO: 3696200 - RNA, 16 nt, Salmonella enterica enterica serovar Typhi Ty2
accagcgcaugacggu

SEQ ID NO: 3696201 - RNA, 15 nt, Salmonella enterica enterica serovar Typhi Ty2
accagcgccaggcca

SEQ ID NO: 3696202 - RNA, 18 nt, Salmonella enterica enterica serovar Typhi Ty2
accagcgccauaauccag

SEQ ID NO: 3696203 - RNA, 22 nt, Salmonella enterica enterica serovar Typhi Ty2
accagcgccgccagauaaagcg

SEQ ID NO: 3696204 - RNA, 15 nt, Salmonella enterica enterica serovar Typhi Ty2
accagcgcgccaucc

SEQ ID NO: 3696205 - RNA, 17 nt, Salmonella enterica enterica serovar Typhi Ty2
accagcgcuucgccugc

SEQ ID NO: 3696206 - RNA, 22 nt, Salmonella enterica enterica serovar Typhi Ty2
accagcgcuucuguuaaaaaau

SEQ ID NO: 3696207 - RNA, 16 nt, Salmonella enterica enterica serovar Typhi Ty2
accagcggcaccagca

SEQ ID NO: 3696208 - RNA, 17 nt, Salmonella enterica enterica serovar Typhi Ty2
accagcggcaccagcac

SEQ ID NO: 3696209 - RNA, 17 nt, Salmonella enterica enterica serovar Typhi Ty2
accagcggcagcuucag

SEQ ID NO: 3696210 - RNA, 21 nt, Salmonella enterica enterica serovar Typhi Ty2
accagcgucagccagaacgaa

SEQ ID NO: 3696211 - RNA, 17 nt, Salmonella enterica enterica serovar Typhi Ty2
accagcgugcgcucagg

SEQ ID NO: 3696212 - RNA, 18 nt, Salmonella enterica enterica serovar Typhi Ty2
accagcugacgacgccag

SEQ ID NO: 3696213 - RNA, 20 nt, Salmonella enterica enterica serovar Typhi Ty2
accagcugacgacgccagcc

SEQ ID NO: 3696214 - RNA, 21 nt, Salmonella enterica enterica serovar Typhi Ty2
accagcugacgacgccagccc

SEQ ID NO: 3696215 - RNA, 16 nt, Salmonella enterica enterica serovar Typhi Ty2
accagcuucaugcugg

SEQ ID NO: 3696216 - RNA, 21 nt, Salmonella enterica enterica serovar Typhi Ty2
accagcuucaugcuggauacc

SEQ ID NO: 3696217 - RNA, 18 nt, Salmonella enterica enterica serovar Typhi Ty2
accagcuuguuauccauc

SEQ ID NO: 3696218 - RNA, 15 nt, Salmonella enterica enterica serovar Typhi Ty2
accaggcaaaccagc

SEQ ID NO: 3696219 - RNA, 18 nt, Salmonella enterica enterica serovar Typhi Ty2
accaggcaaugccccgcc

SEQ ID NO: 3696220 - RNA, 20 nt, Salmonella enterica enterica serovar Typhi Ty2
accagggaggacgcaagagc

SEQ ID NO: 3696221 - RNA, 19 nt, Salmonella enterica enterica serovar Typhi Ty2
accagggauuuugcuuuuu

SEQ ID NO: 3696222 - RNA, 18 nt, Salmonella enterica enterica serovar Typhi Ty2
accagguacagcuuagcu

SEQ ID NO: 3696223 - RNA, 14 nt, Salmonella enterica enterica serovar Typhi Ty2
accaggucgccagc

SEQ ID NO: 3696224 - RNA, 16 nt, Salmonella enterica enterica serovar Typhi Ty2
accaggucgccagcgg

SEQ ID NO: 3696225 - RNA, 22 nt, Salmonella enterica enterica serovar Typhi Ty2
accaggucguccguugccaccc

SEQ ID NO: 3696226 - RNA, 16 nt, Salmonella enterica enterica serovar Typhi Ty2
accaggucugcgcguu

SEQ ID NO: 3696227 - RNA, 15 nt, Salmonella enterica enterica serovar Typhi Ty2
accaguaaccgccac

SEQ ID NO: 3696228 - RNA, 15 nt, Salmonella enterica enterica serovar Typhi Ty2
accaguaacggcagu

SEQ ID NO: 3696229 - RNA, 21 nt, Salmonella enterica enterica serovar Typhi Ty2
accaguacaauuucuggcccc

SEQ ID NO: 3696230 - RNA, 16 nt, Salmonella enterica enterica serovar Typhi Ty2
accaguacaucuucac

SEQ ID NO: 3696231 - RNA, 17 nt, Salmonella enterica enterica serovar Typhi Ty2
accaguaccgucauuuc

SEQ ID NO: 3696232 - RNA, 14 nt, Salmonella enterica enterica serovar Typhi Ty2
accagucccagccc

SEQ ID NO: 3696233 - RNA, 17 nt, Salmonella enterica enterica serovar Typhi Ty2
accagucgaccgcagac

SEQ ID NO: 3696234 - RNA, 20 nt, Salmonella enterica enterica serovar Typhi Ty2
accagucgaccgcagaccgg

SEQ ID NO: 3696235 - RNA, 15 nt, Salmonella enterica enterica serovar Typhi Ty2
accagucggcaaaga

SEQ ID NO: 3696236 - RNA, 20 nt, Salmonella enterica enterica serovar Typhi Ty2
accagucggcaaagaccaau

SEQ ID NO: 3696237 - RNA, 23 nt, Salmonella enterica enterica serovar Typhi Ty2
accagucggcaaagaccaauaaa

SEQ ID NO: 3696238 - RNA, 16 nt, Salmonella enterica enterica serovar Typhi Ty2
accaguuaauuucuuu

SEQ ID NO: 3696239 - RNA, 21 nt, Salmonella enterica enterica serovar Typhi Ty2
accaguucacuccuaagagaa

SEQ ID NO: 3696240 - RNA, 18 nt, Salmonella enterica enterica serovar Typhi Ty2
accaguugaccaaacagc

SEQ ID NO: 3696241 - RNA, 15 nt, Salmonella enterica enterica serovar Typhi Ty2
accaguugcgucagc

SEQ ID NO: 3696242 - RNA, 17 nt, Salmonella enterica enterica serovar Typhi Ty2
accauaaacaaaacaac

SEQ ID NO: 3696243 - RNA, 19 nt, Salmonella enterica enterica serovar Typhi Ty2
accauaaacaaaacaacaa

SEQ ID NO: 3696244 - RNA, 13 nt, Salmonella enterica enterica serovar Typhi Ty2
accauaaugaucg

SEQ ID NO: 3696245 - RNA, 22 nt, Salmonella enterica enterica serovar Typhi Ty2
accauaccggugcgccccagca

SEQ ID NO: 3696246 - RNA, 16 nt, Salmonella enterica enterica serovar Typhi Ty2
accauacugacuuaau

SEQ ID NO: 3696247 - RNA, 18 nt, Salmonella enterica enterica serovar Typhi Ty2
accauacugacuuaauaa

SEQ ID NO: 3696248 - RNA, 12 nt, Salmonella enterica enterica serovar Typhi Ty2
accauagcagcc

SEQ ID NO: 3696249 - RNA, 13 nt, Salmonella enterica enterica serovar Typhi Ty2
accauaugcggca

SEQ ID NO: 3696250 - RNA, 14 nt, Salmonella enterica enterica serovar Typhi Ty2
accauaugcggcau

SEQ ID NO: 3696251 - RNA, 15 nt, Salmonella enterica enterica serovar Typhi Ty2
accaucaaaaaaaau

SEQ ID NO: 3696252 - RNA, 16 nt, Salmonella enterica enterica serovar Typhi Ty2
accaucaaaaaaaaua

SEQ ID NO: 3696253 - RNA, 21 nt, Salmonella enterica enterica serovar Typhi Ty2
accaucaaauaauacgccggu

SEQ ID NO: 3696254 - RNA, 12 nt, Salmonella enterica enterica serovar Typhi Ty2
accaucacugaa

SEQ ID NO: 3696255 - RNA, 14 nt, Salmonella enterica enterica serovar Typhi Ty2
accaucaugcaaga

SEQ ID NO: 3696256 - RNA, 19 nt, Salmonella enterica enterica serovar Typhi Ty2
accaucauuaauauaaucc

SEQ ID NO: 3696257 - RNA, 15 nt, Salmonella enterica enterica serovar Typhi Ty2
accauccaugaaaua

SEQ ID NO: 3696258 - RNA, 20 nt, Salmonella enterica enterica serovar Typhi Ty2
accaucccagguuauucagg

SEQ ID NO: 3696259 - RNA, 21 nt, Salmonella enterica enterica serovar Typhi Ty2
accaucccagguuauucaggu

SEQ ID NO: 3696260 - RNA, 13 nt, Salmonella enterica enterica serovar Typhi Ty2
accaucccggcgu

SEQ ID NO: 3696261 - RNA, 16 nt, Salmonella enterica enterica serovar Typhi Ty2
accaucgccagccauu

SEQ ID NO: 3696262 - RNA, 14 nt, Salmonella enterica enterica serovar Typhi Ty2
accaucgcgccgcu

SEQ ID NO: 3696263 - RNA, 14 nt, Salmonella enterica enterica serovar Typhi Ty2
accaucgcguugua

SEQ ID NO: 3696264 - RNA, 23 nt, Salmonella enterica enterica serovar Typhi Ty2
accaucgcguuguaaucgccuga

SEQ ID NO: 3696265 - RNA, 15 nt, Salmonella enterica enterica serovar Typhi Ty2
accaucggcgcuacg

SEQ ID NO: 3696266 - RNA, 22 nt, Salmonella enterica enterica serovar Typhi Ty2
accaucuggcccugacgaaauu

SEQ ID NO: 3696267 - RNA, 21 nt, Salmonella enterica enterica serovar Typhi Ty2
accaucuggccuacgcgcuca

SEQ ID NO: 3696268 - RNA, 19 nt, Salmonella enterica enterica serovar Typhi Ty2
accaucuuuuccggcaggg

SEQ ID NO: 3696269 - RNA, 22 nt, Salmonella enterica enterica serovar Typhi Ty2
accaugacgcagggcaauauua

SEQ ID NO: 3696270 - RNA, 17 nt, Salmonella enterica enterica serovar Typhi Ty2
accaugauaauaaucau

SEQ ID NO: 3696271 - RNA, 12 nt, Salmonella enterica enterica serovar Typhi Ty2
acccgaugcgag

SEQ ID NO: 3696272 - RNA, 19 nt, Salmonella enterica enterica serovar Typhi Ty2
acccgcaaacuaauggcgc

SEQ ID NO: 3696273 - RNA, 18 nt, Salmonella enterica enterica serovar Typhi Ty2
acccgcaauaacgccgau

SEQ ID NO: 3696274 - RNA, 14 nt, Salmonella enterica enterica serovar Typhi Ty2
acccgcaauaccaa

SEQ ID NO: 3696275 - RNA, 15 nt, Salmonella enterica enterica serovar Typhi Ty2
acccgcaaugugcag

SEQ ID NO: 3696276 - RNA, 17 nt, Salmonella enterica enterica serovar Typhi Ty2
acccgcagccagaacag

SEQ ID NO: 3696277 - RNA, 20 nt, Salmonella enterica enterica serovar Typhi Ty2
acccgcagccagaacagaag

SEQ ID NO: 3696278 - RNA, 15 nt, Salmonella enterica enterica serovar Typhi Ty2
acccgcagcggaaga

SEQ ID NO: 3696279 - RNA, 15 nt, Salmonella enterica enterica serovar Typhi Ty2
acccgcccagaucag

SEQ ID NO: 3696280 - RNA, 16 nt, Salmonella enterica enterica serovar Typhi Ty2
acccgccgccagcacc

SEQ ID NO: 3696281 - RNA, 17 nt, Salmonella enterica enterica serovar Typhi Ty2
acccgccggcagcagcu

SEQ ID NO: 3696282 - RNA, 15 nt, Salmonella enterica enterica serovar Typhi Ty2
acccgcgccagcagg

SEQ ID NO: 3696283 - RNA, 18 nt, Salmonella enterica enterica serovar Typhi Ty2
acccgcgcucuccggcac

SEQ ID NO: 3696284 - RNA, 16 nt, Salmonella enterica enterica serovar Typhi Ty2
acccgcgggcggcguu

SEQ ID NO: 3696285 - RNA, 22 nt, Salmonella enterica enterica serovar Typhi Ty2
acccgcuacgcgugaugugccg

SEQ ID NO: 3696286 - RNA, 13 nt, Salmonella enterica enterica serovar Typhi Ty2
acccgcuccagaa

SEQ ID NO: 3696287 - RNA, 16 nt, Salmonella enterica enterica serovar Typhi Ty2
acccgcuccagaagca

SEQ ID NO: 3696288 - RNA, 23 nt, Salmonella enterica enterica serovar Typhi Ty2
acccggcaaaggaauuacgggcg

SEQ ID NO: 3696289 - RNA, 16 nt, Salmonella enterica enterica serovar Typhi Ty2
acccggcaauucaucc

SEQ ID NO: 3696290 - RNA, 19 nt, Salmonella enterica enterica serovar Typhi Ty2
acccggcauugaaacgcau

SEQ ID NO: 3696291 - RNA, 17 nt, Salmonella enterica enterica serovar Typhi Ty2
acccggcgcaaacuuca

SEQ ID NO: 3696292 - RNA, 22 nt, Salmonella enterica enterica serovar Typhi Ty2
acccgggaaaaaugacgccggg

SEQ ID NO: 3696293 - RNA, 16 nt, Salmonella enterica enterica serovar Typhi Ty2
acccgugcgcgucgcc

SEQ ID NO: 3696294 - RNA, 22 nt, Salmonella enterica enterica serovar Typhi Ty2
acccguuacgcagucagcacug

SEQ ID NO: 3696295 - RNA, 17 nt, Salmonella enterica enterica serovar Typhi Ty2
acccguuauucauucac

SEQ ID NO: 3696296 - RNA, 21 nt, Salmonella enterica enterica serovar Typhi Ty2
acccguuauucauucacccaa

SEQ ID NO: 3696297 - RNA, 16 nt, Salmonella enterica enterica serovar Typhi Ty2
acccguucgaaugaga

SEQ ID NO: 3696298 - RNA, 22 nt, Salmonella enterica enterica serovar Typhi Ty2
acccguuuucuccuucauccag

SEQ ID NO: 3696299 - RNA, 16 nt, Salmonella enterica enterica serovar Typhi Ty2
acccucgaaugugaau

SEQ ID NO: 3696300 - RNA, 16 nt, Salmonella enterica enterica serovar Typhi Ty2
acccugaaaaguuaca

SEQ ID NO: 3696301 - RNA, 16 nt, Salmonella enterica enterica serovar Typhi Ty2
acccugaaauccggcu

SEQ ID NO: 3696302 - RNA, 22 nt, Salmonella enterica enterica serovar Typhi Ty2
acccugccguuugcgccagccc

SEQ ID NO: 3696303 - RNA, 22 nt, Salmonella enterica enterica serovar Typhi Ty2
acccuggcauauggauauucau

SEQ ID NO: 3696304 - RNA, 15 nt, Salmonella enterica enterica serovar Typhi Ty2
acccugguuugcugg

SEQ ID NO: 3696305 - RNA, 20 nt, Salmonella enterica enterica serovar Typhi Ty2
acccuguaggccugauaagc

SEQ ID NO: 3696306 - RNA, 20 nt, Salmonella enterica enterica serovar Typhi Ty2
acccuguauuaccugaugag

SEQ ID NO: 3696307 - RNA, 12 nt, Salmonella enterica enterica serovar Typhi Ty2
acccuugcggcu

SEQ ID NO: 3696308 - RNA, 19 nt, Salmonella enterica enterica serovar Typhi Ty2
acccuuuuccggaugcccc

SEQ ID NO: 3696309 - RNA, 22 nt, Salmonella enterica enterica serovar Typhi Ty2
accgaaacgcauacgcaggacu

SEQ ID NO: 3696310 - RNA, 12 nt, Salmonella enterica enterica serovar Typhi Ty2
accgaaagcgac

SEQ ID NO: 3696311 - RNA, 18 nt, Salmonella enterica enterica serovar Typhi Ty2
accgaaauccgcuuugag

SEQ ID NO: 3696312 - RNA, 20 nt, Salmonella enterica enterica serovar Typhi Ty2
accgaaaucgguacgcgucu

SEQ ID NO: 3696313 - RNA, 13 nt, Salmonella enterica enterica serovar Typhi Ty2
accgaaaucuucg

SEQ ID NO: 3696314 - RNA, 16 nt, Salmonella enterica enterica serovar Typhi Ty2
accgaaaucuucgccu

SEQ ID NO: 3696315 - RNA, 17 nt, Salmonella enterica enterica serovar Typhi Ty2
accgaacagccaggcuu

SEQ ID NO: 3696316 - RNA, 16 nt, Salmonella enterica enterica serovar Typhi Ty2
accgacaacguuuuca

SEQ ID NO: 3696317 - RNA, 17 nt, Salmonella enterica enterica serovar Typhi Ty2
accgacaauauucgccg

SEQ ID NO: 3696318 - RNA, 21 nt, Salmonella enterica enterica serovar Typhi Ty2
accgacaauauucgccgcgau

SEQ ID NO: 3696319 - RNA, 15 nt, Salmonella enterica enterica serovar Typhi Ty2
accgacaucgccagu

SEQ ID NO: 3696320 - RNA, 17 nt, Salmonella enterica enterica serovar Typhi Ty2
accgaccgugagaaucg

SEQ ID NO: 3696321 - RNA, 13 nt, Salmonella enterica enterica serovar Typhi Ty2
accgaccugccuu

SEQ ID NO: 3696322 - RNA, 23 nt, Salmonella enterica enterica serovar Typhi Ty2
accgacuaaggggguacgcguaa

SEQ ID NO: 3696323 - RNA, 15 nt, Salmonella enterica enterica serovar Typhi Ty2
accgacuaucagaaa

SEQ ID NO: 3696324 - RNA, 14 nt, Salmonella enterica enterica serovar Typhi Ty2
accgacuuucaaau

SEQ ID NO: 3696325 - RNA, 13 nt, Salmonella enterica enterica serovar Typhi Ty2
accgagacagaga

SEQ ID NO: 3696326 - RNA, 14 nt, Salmonella enterica enterica serovar Typhi Ty2
accgagcauccgcg

SEQ ID NO: 3696327 - RNA, 14 nt, Salmonella enterica enterica serovar Typhi Ty2
accgaggcaggggc

SEQ ID NO: 3696328 - RNA, 13 nt, Salmonella enterica enterica serovar Typhi Ty2
accgauaaauacc

SEQ ID NO: 3696329 - RNA, 20 nt, Salmonella enterica enterica serovar Typhi Ty2
accgauagagacugccgccg

SEQ ID NO: 3696330 - RNA, 19 nt, Salmonella enterica enterica serovar Typhi Ty2
accgauauagagcccucug

SEQ ID NO: 3696331 - RNA, 18 nt, Salmonella enterica enterica serovar Typhi Ty2
accgauauuuugcugcac

SEQ ID NO: 3696332 - RNA, 22 nt, Salmonella enterica enterica serovar Typhi Ty2
accgaugcaaccgcucuccgca

SEQ ID NO: 3696333 - RNA, 11 nt, Salmonella enterica enterica serovar Typhi Ty2
accgaugcagc

SEQ ID NO: 3696334 - RNA, 14 nt, Salmonella enterica enterica serovar Typhi Ty2
accgauuccugguu

SEQ ID NO: 3696335 - RNA, 21 nt, Salmonella enterica enterica serovar Typhi Ty2
accgcaaaccgaauucgucca

SEQ ID NO: 3696336 - RNA, 16 nt, Salmonella enterica enterica serovar Typhi Ty2
accgcacaucacugcc

SEQ ID NO: 3696337 - RNA, 13 nt, Salmonella enterica enterica serovar Typhi Ty2
accgcagaaaaag

SEQ ID NO: 3696338 - RNA, 13 nt, Salmonella enterica enterica serovar Typhi Ty2
accgcagccuuga

SEQ ID NO: 3696339 - RNA, 16 nt, Salmonella enterica enterica serovar Typhi Ty2
accgcagcuuauucca

SEQ ID NO: 3696340 - RNA, 21 nt, Salmonella enterica enterica serovar Typhi Ty2
accgcaucaaugcccagcgca

SEQ ID NO: 3696341 - RNA, 22 nt, Salmonella enterica enterica serovar Typhi Ty2
accgcaucaaugcccagcgcaa

SEQ ID NO: 3696342 - RNA, 21 nt, Salmonella enterica enterica serovar Typhi Ty2
accgcaucacgcgaagcggcg

SEQ ID NO: 3696343 - RNA, 14 nt, Salmonella enterica enterica serovar Typhi Ty2
accgcaucgaccgu

SEQ ID NO: 3696344 - RNA, 15 nt, Salmonella enterica enterica serovar Typhi Ty2
accgcauggaaucga

SEQ ID NO: 3696345 - RNA, 13 nt, Salmonella enterica enterica serovar Typhi Ty2
accgcauuuucag

SEQ ID NO: 3696346 - RNA, 14 nt, Salmonella enterica enterica serovar Typhi Ty2
accgccaagcgcgg

SEQ ID NO: 3696347 - RNA, 18 nt, Salmonella enterica enterica serovar Typhi Ty2
accgccaccauccggcgc

SEQ ID NO: 3696348 - RNA, 17 nt, Salmonella enterica enterica serovar Typhi Ty2
accgccagcagagcgaa

SEQ ID NO: 3696349 - RNA, 18 nt, Salmonella enterica enterica serovar Typhi Ty2
accgccagcaguagcuug

SEQ ID NO: 3696350 - RNA, 14 nt, Salmonella enterica enterica serovar Typhi Ty2
accgccaggucggc

SEQ ID NO: 3696351 - RNA, 15 nt, Salmonella enterica enterica serovar Typhi Ty2
accgccauauauuua

SEQ ID NO: 3696352 - RNA, 15 nt, Salmonella enterica enterica serovar Typhi Ty2
accgccaucaaacgc

SEQ ID NO: 3696353 - RNA, 14 nt, Salmonella enterica enterica serovar Typhi Ty2
accgggcaggauac

SEQ ID NO: 3696354 - RNA, 20 nt, Salmonella enterica enterica serovar Typhi Ty2
accgggcucacgcuggugcu

SEQ ID NO: 3696355 - RNA, 21 nt, Salmonella enterica enterica serovar Typhi Ty2
accgggcucacgcuggugcuu

SEQ ID NO: 3696356 - RNA, 16 nt, Salmonella enterica enterica serovar Typhi Ty2
accgggcugucaucga

SEQ ID NO: 3696357 - RNA, 17 nt, Salmonella enterica enterica serovar Typhi Ty2
accggggcgcgccgcua

SEQ ID NO: 3696358 - RNA, 18 nt, Salmonella enterica enterica serovar Typhi Ty2
accgggucgauaaacagc

SEQ ID NO: 3696359 - RNA, 17 nt, Salmonella enterica enterica serovar Typhi Ty2
accgggucgcagaacau

SEQ ID NO: 3696360 - RNA, 15 nt, Salmonella enterica enterica serovar Typhi Ty2
accggguuaaagccc

SEQ ID NO: 3696361 - RNA, 18 nt, Salmonella enterica enterica serovar Typhi Ty2
accggguuaaagcccuga

SEQ ID NO: 3696362 - RNA, 22 nt, Salmonella enterica enterica serovar Typhi Ty2
accgguaaauuucacuucgccc

SEQ ID NO: 3696363 - RNA, 19 nt, Salmonella enterica enterica serovar Typhi Ty2
accgguaacugucagauca

SEQ ID NO: 3696364 - RNA, 18 nt, Salmonella enterica enterica serovar Typhi Ty2
accgguagccaggcgcga

SEQ ID NO: 3696365 - RNA, 15 nt, Salmonella enterica enterica serovar Typhi Ty2
accggucagaaaucc

SEQ ID NO: 3696366 - RNA, 18 nt, Salmonella enterica enterica serovar Typhi Ty2
accggucuggcucacuga

SEQ ID NO: 3696367 - RNA, 14 nt, Salmonella enterica enterica serovar Typhi Ty2
accggugcgcccca

SEQ ID NO: 3696368 - RNA, 20 nt, Salmonella enterica enterica serovar Typhi Ty2
accggugcggagcaggcaau

SEQ ID NO: 3696369 - RNA, 14 nt, Salmonella enterica enterica serovar Typhi Ty2
accgguugcgcgcu

SEQ ID NO: 3696370 - RNA, 19 nt, Salmonella enterica enterica serovar Typhi Ty2
accguaaaaugcuggugca

SEQ ID NO: 3696371 - RNA, 18 nt, Salmonella enterica enterica serovar Typhi Ty2
accguaaacgccugcacc

SEQ ID NO: 3696372 - RNA, 19 nt, Salmonella enterica enterica serovar Typhi Ty2
accguaaacgccugcacca

SEQ ID NO: 3696373 - RNA, 14 nt, Salmonella enterica enterica serovar Typhi Ty2
accguaauaaguau

SEQ ID NO: 3696374 - RNA, 22 nt, Salmonella enterica enterica serovar Typhi Ty2
accguaauaguuucgacuuuca

SEQ ID NO: 3696375 - RNA, 15 nt, Salmonella enterica enterica serovar Typhi Ty2
accguaaucaucgcg

SEQ ID NO: 3696376 - RNA, 22 nt, Salmonella enterica enterica serovar Typhi Ty2
accguaguagguauccagcaga

SEQ ID NO: 3696377 - RNA, 18 nt, Salmonella enterica enterica serovar Typhi Ty2
accguagugacacgguca

SEQ ID NO: 3696378 - RNA, 19 nt, Salmonella enterica enterica serovar Typhi Ty2
accguauccuuccagcccg

SEQ ID NO: 3696379 - RNA, 21 nt, Salmonella enterica enterica serovar Typhi Ty2
accguaucgcccagcuuaugc

SEQ ID NO: 3696380 - RNA, 22 nt, Salmonella enterica enterica serovar Typhi Ty2
accgucaauaacgggcacgguc

SEQ ID NO: 3696381 - RNA, 17 nt, Salmonella enterica enterica serovar Typhi Ty2
accgucaccacgcgcga

SEQ ID NO: 3696382 - RNA, 21 nt, Salmonella enterica enterica serovar Typhi Ty2
accgucacugaaccugccuuu

SEQ ID NO: 3696383 - RNA, 14 nt, Salmonella enterica enterica serovar Typhi Ty2
accgucagauucug

SEQ ID NO: 3696384 - RNA, 20 nt, Salmonella enterica enterica serovar Typhi Ty2
accgucagauucugcgguaa

SEQ ID NO: 3696385 - RNA, 22 nt, Salmonella enterica enterica serovar Typhi Ty2
accgucagccccguacaagguc

SEQ ID NO: 3696386 - RNA, 16 nt, Salmonella enterica enterica serovar Typhi Ty2
accgucagcuccggua

SEQ ID NO: 3696387 - RNA, 16 nt, Salmonella enterica enterica serovar Typhi Ty2
accgucaguaccagcg

SEQ ID NO: 3696388 - RNA, 13 nt, Salmonella enterica enterica serovar Typhi Ty2
accgucaugacgu

SEQ ID NO: 3696389 - RNA, 21 nt, Salmonella enterica enterica serovar Typhi Ty2
accgucauuuccggcgcgguc

SEQ ID NO: 3696390 - RNA, 13 nt, Salmonella enterica enterica serovar Typhi Ty2
accguccacaucc

SEQ ID NO: 3696391 - RNA, 15 nt, Salmonella enterica enterica serovar Typhi Ty2
accguccccagccag

SEQ ID NO: 3696392 - RNA, 18 nt, Salmonella enterica enterica serovar Typhi Ty2
accgucgagaaaccgcuc

SEQ ID NO: 3696393 - RNA, 17 nt, Salmonella enterica enterica serovar Typhi Ty2
accgucgaucucggcca

SEQ ID NO: 3696394 - RNA, 17 nt, Salmonella enterica enterica serovar Typhi Ty2
accgucgccgacaacgc

SEQ ID NO: 3696395 - RNA, 18 nt, Salmonella enterica enterica serovar Typhi Ty2
accgucgcgcccuccucc

SEQ ID NO: 3696396 - RNA, 21 nt, Salmonella enterica enterica serovar Typhi Ty2
accgucgcgcccuccuccagc

SEQ ID NO: 3696397 - RNA, 16 nt, Salmonella enterica enterica serovar Typhi Ty2
accgucuccaugucac

SEQ ID NO: 3696398 - RNA, 16 nt, Salmonella enterica enterica serovar Typhi Ty2
accgucugcucagaaa

SEQ ID NO: 3696399 - RNA, 22 nt, Salmonella enterica enterica serovar Typhi Ty2
accgucuucaggucauucagga

SEQ ID NO: 3696400 - RNA, 22 nt, Salmonella enterica enterica serovar Typhi Ty2
accgugaauaaugaccagcgcc

SEQ ID NO: 3696401 - RNA, 14 nt, Salmonella enterica enterica serovar Typhi Ty2
accgugacugacca

SEQ ID NO: 3696402 - RNA, 19 nt, Salmonella enterica enterica serovar Typhi Ty2
accgugaugcggacgcuga

SEQ ID NO: 3696403 - RNA, 18 nt, Salmonella enterica enterica serovar Typhi Ty2
accgugauuuuuaccgcc

SEQ ID NO: 3696404 - RNA, 15 nt, Salmonella enterica enterica serovar Typhi Ty2
accgugcacgcugcg

SEQ ID NO: 3696405 - RNA, 23 nt, Salmonella enterica enterica serovar Typhi Ty2
accgugcccggaguccauauccg

SEQ ID NO: 3696406 - RNA, 15 nt, Salmonella enterica enterica serovar Typhi Ty2
accguggccuccggc

SEQ ID NO: 3696407 - RNA, 20 nt, Salmonella enterica enterica serovar Typhi Ty2
accguggccuccggcagaaa

SEQ ID NO: 3696408 - RNA, 16 nt, Salmonella enterica enterica serovar Typhi Ty2
accgugugcagugaca

SEQ ID NO: 3696409 - RNA, 16 nt, Salmonella enterica enterica serovar Typhi Ty2
accguuaggaaagcag

SEQ ID NO: 3696410 - RNA, 22 nt, Salmonella enterica enterica serovar Typhi Ty2
accguucacgcucacgcagaua

SEQ ID NO: 3696411 - RNA, 17 nt, Salmonella enterica enterica serovar Typhi Ty2
accguucagaucgccaa

SEQ ID NO: 3696412 - RNA, 23 nt, Salmonella enterica enterica serovar Typhi Ty2
accguucuggcugccgucaaagu

SEQ ID NO: 3696413 - RNA, 19 nt, Salmonella enterica enterica serovar Typhi Ty2
accguucuuccuggggauc

SEQ ID NO: 3696414 - RNA, 19 nt, Salmonella enterica enterica serovar Typhi Ty2
accguugcgcccaucauca

SEQ ID NO: 3696415 - RNA, 20 nt, Salmonella enterica enterica serovar Typhi Ty2
accguugcgcccaucaucau

SEQ ID NO: 3696416 - RNA, 23 nt, Salmonella enterica enterica serovar Typhi Ty2
accguugcggucggcagcaccgg

SEQ ID NO: 3696417 - RNA, 23 nt, Salmonella enterica enterica serovar Typhi Ty2
accguuggaauaaaucacaacgu

SEQ ID NO: 3696418 - RNA, 23 nt, Salmonella enterica enterica serovar Typhi Ty2
accguugucggggcuuuaaugcu

SEQ ID NO: 3696419 - RNA, 20 nt, Salmonella enterica enterica serovar Typhi Ty2
accguuuaaucgcccugcgg

SEQ ID NO: 3696420 - RNA, 12 nt, Salmonella enterica enterica serovar Typhi Ty2
accguuuuccag

SEQ ID NO: 3696421 - RNA, 20 nt, Salmonella enterica enterica serovar Typhi Ty2
accguuuuuuuaugcagccg

SEQ ID NO: 3696422 - RNA, 16 nt, Salmonella enterica enterica serovar Typhi Ty2
accuaauagccagccc

SEQ ID NO: 3696423 - RNA, 13 nt, Salmonella enterica enterica serovar Typhi Ty2
accuaccggcaua

SEQ ID NO: 3696424 - RNA, 18 nt, Salmonella enterica enterica serovar Typhi Ty2
accuacuguggugugccu

SEQ ID NO: 3696425 - RNA, 19 nt, Salmonella enterica enterica serovar Typhi Ty2
accuacuguggugugccug

SEQ ID NO: 3696426 - RNA, 20 nt, Salmonella enterica enterica serovar Typhi Ty2
accuacuguggugugccugc

SEQ ID NO: 3696427 - RNA, 14 nt, Salmonella enterica enterica serovar Typhi Ty2
accuauugaaaaua

SEQ ID NO: 3696428 - RNA, 13 nt, Salmonella enterica enterica serovar Typhi Ty2
accuauuuuaaau

SEQ ID NO: 3696429 - RNA, 14 nt, Salmonella enterica enterica serovar Typhi Ty2
accuauuuugcaaa

SEQ ID NO: 3696430 - RNA, 20 nt, Salmonella enterica enterica serovar Typhi Ty2
accucaaaauggaaaauaau

SEQ ID NO: 3696431 - RNA, 11 nt, Salmonella enterica enterica serovar Typhi Ty2
accucaauaug

SEQ ID NO: 3696432 - RNA, 18 nt, Salmonella enterica enterica serovar Typhi Ty2
accucagguaaauccgcc

SEQ ID NO: 3696433 - RNA, 13 nt, Salmonella enterica enterica serovar Typhi Ty2
accucaucaaaca

SEQ ID NO: 3696434 - RNA, 17 nt, Salmonella enterica enterica serovar Typhi Ty2
accuccacgcccagcgc

SEQ ID NO: 3696435 - RNA, 19 nt, Salmonella enterica enterica serovar Typhi Ty2
accuuucuucucuucuuca

SEQ ID NO: 3696436 - RNA, 21 nt, Salmonella enterica enterica serovar Typhi Ty2
accuuuggaggagagcgucau

SEQ ID NO: 3696437 - RNA, 13 nt, Salmonella enterica enterica serovar Typhi Ty2
acgaaaaauaaaa

SEQ ID NO: 3696438 - RNA, 14 nt, Salmonella enterica enterica serovar Typhi Ty2
acgaaaaauaaaaa

SEQ ID NO: 3696439 - RNA, 21 nt, Salmonella enterica enterica serovar Typhi Ty2
acgaaaaaugaauaccaaguc

SEQ ID NO: 3696440 - RNA, 14 nt, Salmonella enterica enterica serovar Typhi Ty2
acgaaaauuauuuu

SEQ ID NO: 3696441 - RNA, 22 nt, Salmonella enterica enterica serovar Typhi Ty2
acgaaaauuauuuucgaugccc

SEQ ID NO: 3696442 - RNA, 12 nt, Salmonella enterica enterica serovar Typhi Ty2
acgaaacucagc

SEQ ID NO: 3696443 - RNA, 17 nt, Salmonella enterica enterica serovar Typhi Ty2
acgaaagucuguucgua

SEQ ID NO: 3696444 - RNA, 15 nt, Salmonella enterica enterica serovar Typhi Ty2
acgaaauagcgcagc

SEQ ID NO: 3696445 - RNA, 18 nt, Salmonella enterica enterica serovar Typhi Ty2
acgaacaacaucagacag

SEQ ID NO: 3696446 - RNA, 16 nt, Salmonella enterica enterica serovar Typhi Ty2
acgaaccguggccucc

SEQ ID NO: 3696447 - RNA, 18 nt, Salmonella enterica enterica serovar Typhi Ty2
acgaacgcuaugcgccag

SEQ ID NO: 3696448 - RNA, 23 nt, Salmonella enterica enterica serovar Typhi Ty2
acgaacugauguuccggcacggu

SEQ ID NO: 3696449 - RNA, 23 nt, Salmonella enterica enterica serovar Typhi Ty2
acgaagcgggcaauuccggucau

SEQ ID NO: 3696450 - RNA, 21 nt, Salmonella enterica enterica serovar Typhi Ty2
acgaaguuuaauucuuugagc

SEQ ID NO: 3696451 - RNA, 20 nt, Salmonella enterica enterica serovar Typhi Ty2
acgaaucuggucguaagaau

SEQ ID NO: 3696452 - RNA, 23 nt, Salmonella enterica enterica serovar Typhi Ty2
acgaaugccgauagucuccgcca

SEQ ID NO: 3696453 - RNA, 16 nt, Salmonella enterica enterica serovar Typhi Ty2
acgaauuuaaauagca

SEQ ID NO: 3696454 - RNA, 15 nt, Salmonella enterica enterica serovar Typhi Ty2
acgacaaaaauacca

SEQ ID NO: 3696455 - RNA, 18 nt, Salmonella enterica enterica serovar Typhi Ty2
acgacaacuucuaauuuu

SEQ ID NO: 3696456 - RNA, 12 nt, Salmonella enterica enterica serovar Typhi Ty2
acgacagaauau

SEQ ID NO: 3696457 - RNA, 13 nt, Salmonella enterica enterica serovar Typhi Ty2
acgacagaauaug

SEQ ID NO: 3696458 - RNA, 14 nt, Salmonella enterica enterica serovar Typhi Ty2
acgacagaauaugc

SEQ ID NO: 3696459 - RNA, 16 nt, Salmonella enterica enterica serovar Typhi Ty2
acgacagagaucaggc

SEQ ID NO: 3696460 - RNA, 23 nt, Salmonella enterica enterica serovar Typhi Ty2
acgacauaaccggcaaccaaagu

SEQ ID NO: 3696461 - RNA, 23 nt, Salmonella enterica enterica serovar Typhi Ty2
acgaccacucuuuggacggcauc

SEQ ID NO: 3696462 - RNA, 24 nt, Salmonella enterica enterica serovar Typhi Ty2
acgaccagaaucaucaugucguca

SEQ ID NO: 3696463 - RNA, 17 nt, Salmonella enterica enterica serovar Typhi Ty2
acgaccaugguucccgc

SEQ ID NO: 3696464 - RNA, 23 nt, Salmonella enterica enterica serovar Typhi Ty2
acgaccaugguucccgccacuga

SEQ ID NO: 3696465 - RNA, 21 nt, Salmonella enterica enterica serovar Typhi Ty2
acgaccugguggcgaacaaua

SEQ ID NO: 3696466 - RNA, 20 nt, Salmonella enterica enterica serovar Typhi Ty2
acgaccuuucgccgucaccu

SEQ ID NO: 3696467 - RNA, 19 nt, Salmonella enterica enterica serovar Typhi Ty2
acgacgaggggcuuugugc

SEQ ID NO: 3696468 - RNA, 13 nt, Salmonella enterica enterica serovar Typhi Ty2
acgacgccagcca

SEQ ID NO: 3696469 - RNA, 16 nt, Salmonella enterica enterica serovar Typhi Ty2
acgacgccagccagcc

SEQ ID NO: 3696470 - RNA, 14 nt, Salmonella enterica enterica serovar Typhi Ty2
acgacgccagcccu

SEQ ID NO: 3696471 - RNA, 15 nt, Salmonella enterica enterica serovar Typhi Ty2
acgacgcuccagaau

SEQ ID NO: 3696472 - RNA, 16 nt, Salmonella enterica enterica serovar Typhi Ty2
acgacgcugccacaau

SEQ ID NO: 3696473 - RNA, 19 nt, Salmonella enterica enterica serovar Typhi Ty2
acgacgcugccacaauggc

SEQ ID NO: 3696474 - RNA, 15 nt, Salmonella enterica enterica serovar Typhi Ty2
acgacgggaaaaagc

SEQ ID NO: 3696475 - RNA, 14 nt, Salmonella enterica enterica serovar Typhi Ty2
acgacugaguauug

SEQ ID NO: 3696476 - RNA, 19 nt, Salmonella enterica enterica serovar Typhi Ty2
acgacugcaaaaagguagu

SEQ ID NO: 3696477 - RNA, 19 nt, Salmonella enterica enterica serovar Typhi Ty2
acgacuguagauaccuacu

SEQ ID NO: 3696478 - RNA, 16 nt, Salmonella enterica enterica serovar Typhi Ty2
acgacuucguuaguga

SEQ ID NO: 3696479 - RNA, 19 nt, Salmonella enterica enterica serovar Typhi Ty2
acgagaacccacuuugcuu

SEQ ID NO: 3696480 - RNA, 19 nt, Salmonella enterica enterica serovar Typhi Ty2
acgagaacucggaggcggc

SEQ ID NO: 3696481 - RNA, 16 nt, Salmonella enterica enterica serovar Typhi Ty2
acgagaauaagaccaa

SEQ ID NO: 3696482 - RNA, 16 nt, Salmonella enterica enterica serovar Typhi Ty2
acgagagacugauaau

SEQ ID NO: 3696483 - RNA, 19 nt, Salmonella enterica enterica serovar Typhi Ty2
acgagcacuguagcggcug

SEQ ID NO: 3696484 - RNA, 18 nt, Salmonella enterica enterica serovar Typhi Ty2
acgagcauccagaucggc

SEQ ID NO: 3696485 - RNA, 18 nt, Salmonella enterica enterica serovar Typhi Ty2
acgagcgaaaaacugucg

SEQ ID NO: 3696486 - RNA, 20 nt, Salmonella enterica enterica serovar Typhi Ty2
acgagcgcgucagcgccucc

SEQ ID NO: 3696487 - RNA, 19 nt, Salmonella enterica enterica serovar Typhi Ty2
acgaggauuagacuucuuc

SEQ ID NO: 3696488 - RNA, 21 nt, Salmonella enterica enterica serovar Typhi Ty2
acgaguccccucaaacaggcu

SEQ ID NO: 3696489 - RNA, 19 nt, Salmonella enterica enterica serovar Typhi Ty2
acgagucggaucaugaaaa

SEQ ID NO: 3696490 - RNA, 17 nt, Salmonella enterica enterica serovar Typhi Ty2
acgagugcguucuucca

SEQ ID NO: 3696491 - RNA, 18 nt, Salmonella enterica enterica serovar Typhi Ty2
acgagugcguucuuccac

SEQ ID NO: 3696492 - RNA, 23 nt, Salmonella enterica enterica serovar Typhi Ty2
acgaguugaauaacguguuaugc

SEQ ID NO: 3696493 - RNA, 18 nt, Salmonella enterica enterica serovar Typhi Ty2
acgaguugcggcaacgug

SEQ ID NO: 3696494 - RNA, 22 nt, Salmonella enterica enterica serovar Typhi Ty2
acgaguuucguuaccccgcagc

SEQ ID NO: 3696495 - RNA, 12 nt, Salmonella enterica enterica serovar Typhi Ty2
acgauaaaaugc

SEQ ID NO: 3696496 - RNA, 20 nt, Salmonella enterica enterica serovar Typhi Ty2
acgauaaauuuucagacacu

SEQ ID NO: 3696497 - RNA, 18 nt, Salmonella enterica enterica serovar Typhi Ty2
acgauaaccaugcucagc

SEQ ID NO: 3696498 - RNA, 15 nt, Salmonella enterica enterica serovar Typhi Ty2
acgauaaggccaaua

SEQ ID NO: 3696499 - RNA, 13 nt, Salmonella enterica enterica serovar Typhi Ty2
acgauacccacca

SEQ ID NO: 3696500 - RNA, 12 nt, Salmonella enterica enterica serovar Typhi Ty2
acgauacgucau

SEQ ID NO: 3696501 - RNA, 18 nt, Salmonella enterica enterica serovar Typhi Ty2
acgauacgucauaucauc

SEQ ID NO: 3696502 - RNA, 16 nt, Salmonella enterica enterica serovar Typhi Ty2
acgauacucagcccca

SEQ ID NO: 3696503 - RNA, 21 nt, Salmonella enterica enterica serovar Typhi Ty2
acgauagcaauuaauaaacaa

SEQ ID NO: 3696504 - RNA, 20 nt, Salmonella enterica enterica serovar Typhi Ty2
acgauaguuugccagagaga

SEQ ID NO: 3696505 - RNA, 13 nt, Salmonella enterica enterica serovar Typhi Ty2
acgauauaaaaac

SEQ ID NO: 3696506 - RNA, 21 nt, Salmonella enterica enterica serovar Typhi Ty2
acgauauccagcaccucauca

SEQ ID NO: 3696507 - RNA, 16 nt, Salmonella enterica enterica serovar Typhi Ty2
acgauaugcauaaucg

SEQ ID NO: 3696508 - RNA, 16 nt, Salmonella enterica enterica serovar Typhi Ty2
acgauauuucgccuau

SEQ ID NO: 3696509 - RNA, 23 nt, Salmonella enterica enterica serovar Typhi Ty2
acgaucaauaaaauuauccaguu

SEQ ID NO: 3696510 - RNA, 14 nt, Salmonella enterica enterica serovar Typhi Ty2
acgaucaugccgcc

SEQ ID NO: 3696511 - RNA, 14 nt, Salmonella enterica enterica serovar Typhi Ty2
acgauccccgucaa

SEQ ID NO: 3696512 - RNA, 17 nt, Salmonella enterica enterica serovar Typhi Ty2
acgaucccuaauaaaau

SEQ ID NO: 3696513 - RNA, 15 nt, Salmonella enterica enterica serovar Typhi Ty2
acgaucgauaaagcg

SEQ ID NO: 3696514 - RNA, 18 nt, Salmonella enterica enterica serovar Typhi Ty2
acgaucgccuaauccgcc

SEQ ID NO: 3696515 - RNA, 17 nt, Salmonella enterica enterica serovar Typhi Ty2
acgaucgcgcacaugcu

SEQ ID NO: 3696516 - RNA, 15 nt, Salmonella enterica enterica serovar Typhi Ty2
acgaucguuugccca

SEQ ID NO: 3696517 - RNA, 11 nt, Salmonella enterica enterica serovar Typhi Ty2
acgccagccag

SEQ ID NO: 3696518 - RNA, 18 nt, Salmonella enterica enterica serovar Typhi Ty2
acgccaggguaauacugg

SEQ ID NO: 3696519 - RNA, 23 nt, Salmonella enterica enterica serovar Typhi Ty2
acgccagguuaugcgauaccucu

SEQ ID NO: 3696520 - RNA, 18 nt, Salmonella enterica enterica serovar Typhi Ty2
acgccagugccugguggc

SEQ ID NO: 3696521 - RNA, 21 nt, Salmonella enterica enterica serovar Typhi Ty2
acgccaguucccacagcuuca

SEQ ID NO: 3696522 - RNA, 19 nt, Salmonella enterica enterica serovar Typhi Ty2
acgccauaacacaaacugg

SEQ ID NO: 3696523 - RNA, 19 nt, Salmonella enterica enterica serovar Typhi Ty2
acgccaucgcggcgcaaau

SEQ ID NO: 3696524 - RNA, 15 nt, Salmonella enterica enterica serovar Typhi Ty2
acgccaucggcuaag

SEQ ID NO: 3696525 - RNA, 20 nt, Salmonella enterica enterica serovar Typhi Ty2
acgccaugcucauccaacug

SEQ ID NO: 3696526 - RNA, 15 nt, Salmonella enterica enterica serovar Typhi Ty2
acgccauggccgcag

SEQ ID NO: 3696527 - RNA, 20 nt, Salmonella enterica enterica serovar Typhi Ty2
acgccauggggugaggcauc

SEQ ID NO: 3696528 - RNA, 22 nt, Salmonella enterica enterica serovar Typhi Ty2
acgccauuaucgaacugaaaug

SEQ ID NO: 3696529 - RNA, 16 nt, Salmonella enterica enterica serovar Typhi Ty2
acgcccacgcggcgug

SEQ ID NO: 3696530 - RNA, 12 nt, Salmonella enterica enterica serovar Typhi Ty2
acgcccagcgcc

SEQ ID NO: 3696531 - RNA, 17 nt, Salmonella enterica enterica serovar Typhi Ty2
acgcccauauccagcuc

SEQ ID NO: 3696532 - RNA, 17 nt, Salmonella enterica enterica serovar Typhi Ty2
acgcccaucagcauccc

SEQ ID NO: 3696533 - RNA, 23 nt, Salmonella enterica enterica serovar Typhi Ty2
acgcccaucagcaucccaccgga

SEQ ID NO: 3696534 - RNA, 16 nt, Salmonella enterica enterica serovar Typhi Ty2
acgccccacagaccua

SEQ ID NO: 3696535 - RNA, 16 nt, Salmonella enterica enterica serovar Typhi Ty2
acgccccuaaggcagc

SEQ ID NO: 3696536 - RNA, 22 nt, Salmonella enterica enterica serovar Typhi Ty2
acgcccggcggguauggcaaug

SEQ ID NO: 3696537 - RNA, 16 nt, Salmonella enterica enterica serovar Typhi Ty2
acgcccguccggcuuu

SEQ ID NO: 3696538 - RNA, 13 nt, Salmonella enterica enterica serovar Typhi Ty2
acgcccucaauau

SEQ ID NO: 3696539 - RNA, 14 nt, Salmonella enterica enterica serovar Typhi Ty2
acgcccucaauauc

SEQ ID NO: 3696540 - RNA, 14 nt, Salmonella enterica enterica serovar Typhi Ty2
acgcccugcaaagc

SEQ ID NO: 3696541 - RNA, 16 nt, Salmonella enterica enterica serovar Typhi Ty2
acgcccuucacgccga

SEQ ID NO: 3696542 - RNA, 19 nt, Salmonella enterica enterica serovar Typhi Ty2
acgccgaacaacacggcgg

SEQ ID NO: 3696543 - RNA, 20 nt, Salmonella enterica enterica serovar Typhi Ty2
acgccgaacaacacggcggc

SEQ ID NO: 3696544 - RNA, 19 nt, Salmonella enterica enterica serovar Typhi Ty2
acgccgacucacgcagcgc

SEQ ID NO: 3696545 - RNA, 23 nt, Salmonella enterica enterica serovar Typhi Ty2
acgccgagcaucgcuuuuaggcu

SEQ ID NO: 3696546 - RNA, 18 nt, Salmonella enterica enterica serovar Typhi Ty2
acgccgaggcauucagcc

SEQ ID NO: 3696547 - RNA, 15 nt, Salmonella enterica enterica serovar Typhi Ty2
acgccgauaaccagc

SEQ ID NO: 3696548 - RNA, 13 nt, Salmonella enterica enterica serovar Typhi Ty2
acgccgcaaacgc

SEQ ID NO: 3696549 - RNA, 22 nt, Salmonella enterica enterica serovar Typhi Ty2
acgccgcacacagcagaaagca

SEQ ID NO: 3696550 - RNA, 16 nt, Salmonella enterica enterica serovar Typhi Ty2
acgccgccaaagcgau

SEQ ID NO: 3696551 - RNA, 13 nt, Salmonella enterica enterica serovar Typhi Ty2
acgccgccagcaa

SEQ ID NO: 3696552 - RNA, 15 nt, Salmonella enterica enterica serovar Typhi Ty2
acgccgccagccacu

SEQ ID NO: 3696553 - RNA, 18 nt, Salmonella enterica enterica serovar Typhi Ty2
acgccgccauccggcacg

SEQ ID NO: 3696554 - RNA, 23 nt, Salmonella enterica enterica serovar Typhi Ty2
acgccgcccgcguuggcggcuuu

SEQ ID NO: 3696555 - RNA, 14 nt, Salmonella enterica enterica serovar Typhi Ty2
acgccgccgacaug

SEQ ID NO: 3696556 - RNA, 13 nt, Salmonella enterica enterica serovar Typhi Ty2
acgccgccgccca

SEQ ID NO: 3696557 - RNA, 15 nt, Salmonella enterica enterica serovar Typhi Ty2
acgccgccgcccaga

SEQ ID NO: 3696558 - RNA, 16 nt, Salmonella enterica enterica serovar Typhi Ty2
acgccgcuguuuucac

SEQ ID NO: 3696559 - RNA, 18 nt, Salmonella enterica enterica serovar Typhi Ty2
acgccgcuguuuucacuc

SEQ ID NO: 3696560 - RNA, 23 nt, Salmonella enterica enterica serovar Typhi Ty2
acgccggauauguuugacaagca

SEQ ID NO: 3696561 - RNA, 14 nt, Salmonella enterica enterica serovar Typhi Ty2
acgccggaugcgag

SEQ ID NO: 3696562 - RNA, 21 nt, Salmonella enterica enterica serovar Typhi Ty2
acgccggcgcguaauuccgca

SEQ ID NO: 3696563 - RNA, 21 nt, Salmonella enterica enterica serovar Typhi Ty2
acgccgggcauuaaugguuau

SEQ ID NO: 3696564 - RNA, 14 nt, Salmonella enterica enterica serovar Typhi Ty2
acgccgggccugcc

SEQ ID NO: 3696565 - RNA, 16 nt, Salmonella enterica enterica serovar Typhi Ty2
acgccgggccugccag

SEQ ID NO: 3696566 - RNA, 21 nt, Salmonella enterica enterica serovar Typhi Ty2
acgccggggauaucaaugcgc

SEQ ID NO: 3696567 - RNA, 21 nt, Salmonella enterica enterica serovar Typhi Ty2
acgccgguacuggagaccggc

SEQ ID NO: 3696568 - RNA, 15 nt, Salmonella enterica enterica serovar Typhi Ty2
acgccgguaucauca

SEQ ID NO: 3696569 - RNA, 15 nt, Salmonella enterica enterica serovar Typhi Ty2
acgccggugccugcc

SEQ ID NO: 3696570 - RNA, 20 nt, Salmonella enterica enterica serovar Typhi Ty2
acgccggugccugccgccuc

SEQ ID NO: 3696571 - RNA, 22 nt, Salmonella enterica enterica serovar Typhi Ty2
acgccguagcugcgcgccgcaa

SEQ ID NO: 3696572 - RNA, 16 nt, Salmonella enterica enterica serovar Typhi Ty2
acgccgucacaaagcc

SEQ ID NO: 3696573 - RNA, 21 nt, Salmonella enterica enterica serovar Typhi Ty2
acgccgucacaaagcccaccg

SEQ ID NO: 3696574 - RNA, 14 nt, Salmonella enterica enterica serovar Typhi Ty2
acgccguccagcac

SEQ ID NO: 3696575 - RNA, 15 nt, Salmonella enterica enterica serovar Typhi Ty2
acgccguccaggcuc

SEQ ID NO: 3696576 - RNA, 14 nt, Salmonella enterica enterica serovar Typhi Ty2
acgccgucgacaaa

SEQ ID NO: 3696577 - RNA, 11 nt, Salmonella enterica enterica serovar Typhi Ty2
acgccgucgcg

SEQ ID NO: 3696578 - RNA, 19 nt, Salmonella enterica enterica serovar Typhi Ty2
acgccgucugguacggcca

SEQ ID NO: 3696579 - RNA, 16 nt, Salmonella enterica enterica serovar Typhi Ty2
acgccgugaacgccaa

SEQ ID NO: 3696580 - RNA, 21 nt, Salmonella enterica enterica serovar Typhi Ty2
acgccgugaauuucugcugcc

SEQ ID NO: 3696581 - RNA, 16 nt, Salmonella enterica enterica serovar Typhi Ty2
acgccgugcacuucug

SEQ ID NO: 3696582 - RNA, 16 nt, Salmonella enterica enterica serovar Typhi Ty2
acgccuaaaaaugagg

SEQ ID NO: 3696583 - RNA, 14 nt, Salmonella enterica enterica serovar Typhi Ty2
acgccucauccggc

SEQ ID NO: 3696584 - RNA, 15 nt, Salmonella enterica enterica serovar Typhi Ty2
acgccugaaaacaga

SEQ ID NO: 3696585 - RNA, 21 nt, Salmonella enterica enterica serovar Typhi Ty2
acgccugaauuucgucaggaa

SEQ ID NO: 3696586 - RNA, 13 nt, Salmonella enterica enterica serovar Typhi Ty2
acgccugaugcug

SEQ ID NO: 3696587 - RNA, 14 nt, Salmonella enterica enterica serovar Typhi Ty2
acgccugccagaua

SEQ ID NO: 3696588 - RNA, 22 nt, Salmonella enterica enterica serovar Typhi Ty2
acgccugccagauaguuagcua

SEQ ID NO: 3696589 - RNA, 12 nt, Salmonella enterica enterica serovar Typhi Ty2
acgccuggagug

SEQ ID NO: 3696590 - RNA, 22 nt, Salmonella enterica enterica serovar Typhi Ty2
acgccuggcgcauuuuaaugau

SEQ ID NO: 3696591 - RNA, 18 nt, Salmonella enterica enterica serovar Typhi Ty2
acgccugggcauuuguug

SEQ ID NO: 3696592 - RNA, 19 nt, Salmonella enterica enterica serovar Typhi Ty2
acgccuggugggauaggcu

SEQ ID NO: 3696593 - RNA, 19 nt, Salmonella enterica enterica serovar Typhi Ty2
acgccuuauccgaccuaca

SEQ ID NO: 3696594 - RNA, 21 nt, Salmonella enterica enterica serovar Typhi Ty2
acgccuuauccggccuacaga

SEQ ID NO: 3696595 - RNA, 21 nt, Salmonella enterica enterica serovar Typhi Ty2
acgccuucauauuaaauuccg

SEQ ID NO: 3696596 - RNA, 20 nt, Salmonella enterica enterica serovar Typhi Ty2
acgccuuccggagacuaucu

SEQ ID NO: 3696597 - RNA, 17 nt, Salmonella enterica enterica serovar Typhi Ty2
acgccuuccuccagcau

SEQ ID NO: 3696598 - RNA, 18 nt, Salmonella enterica enterica serovar Typhi Ty2
acgccuuccuccagcauc

SEQ ID NO: 3696599 - RNA, 14 nt, Salmonella enterica enterica serovar Typhi Ty2
acgcuccggcaggc

SEQ ID NO: 3696600 - RNA, 14 nt, Salmonella enterica enterica serovar Typhi Ty2
acgcucgcugaugg

SEQ ID NO: 3696601 - RNA, 19 nt, Salmonella enterica enterica serovar Typhi Ty2
acgcucgcugauggcgaga

SEQ ID NO: 3696602 - RNA, 19 nt, Salmonella enterica enterica serovar Typhi Ty2
acgcucuuuuccacggcgc

SEQ ID NO: 3696603 - RNA, 18 nt, Salmonella enterica enterica serovar Typhi Ty2
acgcugaaaacggcauca

SEQ ID NO: 3696604 - RNA, 13 nt, Salmonella enterica enterica serovar Typhi Ty2
acgcugaagcuug

SEQ ID NO: 3696605 - RNA, 23 nt, Salmonella enterica enterica serovar Typhi Ty2
acgcugaauaucgucaguaugca

SEQ ID NO: 3696606 - RNA, 16 nt, Salmonella enterica enterica serovar Typhi Ty2
acgcugacgcgaucgc

SEQ ID NO: 3696607 - RNA, 16 nt, Salmonella enterica enterica serovar Typhi Ty2
acgcugagucagaaac

SEQ ID NO: 3696608 - RNA, 9 nt, Salmonella enterica enterica serovar Typhi Ty2
acgcugaug

SEQ ID NO: 3696609 - RNA, 15 nt, Salmonella enterica enterica serovar Typhi Ty2
acgcugcgcaacagc

SEQ ID NO: 3696610 - RNA, 22 nt, Salmonella enterica enterica serovar Typhi Ty2
acgcugcuauccggcaacacgu

SEQ ID NO: 3696611 - RNA, 20 nt, Salmonella enterica enterica serovar Typhi Ty2
acgcugcuccggcuuaaugc

SEQ ID NO: 3696612 - RNA, 20 nt, Salmonella enterica enterica serovar Typhi Ty2
acgcuggaaaauuucaguga

SEQ ID NO: 3696613 - RNA, 15 nt, Salmonella enterica enterica serovar Typhi Ty2
acgcuggacaauagc

SEQ ID NO: 3696614 - RNA, 13 nt, Salmonella enterica enterica serovar Typhi Ty2
acgcuggcacagg

SEQ ID NO: 3696615 - RNA, 14 nt, Salmonella enterica enterica serovar Typhi Ty2
acgcuggcacagga

SEQ ID NO: 3696616 - RNA, 20 nt, Salmonella enterica enterica serovar Typhi Ty2
acgcuggcgcaaagaaggca

SEQ ID NO: 3696617 - RNA, 19 nt, Salmonella enterica enterica serovar Typhi Ty2
acgcugguuugugugcagg

SEQ ID NO: 3696618 - RNA, 20 nt, Salmonella enterica enterica serovar Typhi Ty2
acgcuguagcuggcugccgu

SEQ ID NO: 3696619 - RNA, 17 nt, Salmonella enterica enterica serovar Typhi Ty2
acgcugugcgagaccau

SEQ ID NO: 3696620 - RNA, 19 nt, Salmonella enterica enterica serovar Typhi Ty2
acgcuuaucaggccuacaa

SEQ ID NO: 3696621 - RNA, 20 nt, Salmonella enterica enterica serovar Typhi Ty2
acgcuuaucaggccuacauc

SEQ ID NO: 3696622 - RNA, 23 nt, Salmonella enterica enterica serovar Typhi Ty2
acgcuuaucaggccuacauccgg

SEQ ID NO: 3696623 - RNA, 19 nt, Salmonella enterica enterica serovar Typhi Ty2
acgcuuaucaguccccaca

SEQ ID NO: 3696624 - RNA, 14 nt, Salmonella enterica enterica serovar Typhi Ty2
acgcuuaucccagc

SEQ ID NO: 3696625 - RNA, 22 nt, Salmonella enterica enterica serovar Typhi Ty2
acgcuuaucgccaaaccagacc

SEQ ID NO: 3696626 - RNA, 19 nt, Salmonella enterica enterica serovar Typhi Ty2
acgcuuaucgggccuacga

SEQ ID NO: 3696627 - RNA, 19 nt, Salmonella enterica enterica serovar Typhi Ty2
acgcuuaugcugccuacaa

SEQ ID NO: 3696628 - RNA, 15 nt, Salmonella enterica enterica serovar Typhi Ty2
acgcuucagagcagg

SEQ ID NO: 3696629 - RNA, 18 nt, Salmonella enterica enterica serovar Typhi Ty2
acgcuucguugccccgug

SEQ ID NO: 3696630 - RNA, 14 nt, Salmonella enterica enterica serovar Typhi Ty2
acgcuucugcgccg

SEQ ID NO: 3696631 - RNA, 15 nt, Salmonella enterica enterica serovar Typhi Ty2
acgcuucuucgauuu

SEQ ID NO: 3696632 - RNA, 21 nt, Salmonella enterica enterica serovar Typhi Ty2
acgcuugcaugaccauccacg

SEQ ID NO: 3696633 - RNA, 16 nt, Salmonella enterica enterica serovar Typhi Ty2
acgcuugcccgguucg

SEQ ID NO: 3696634 - RNA, 19 nt, Salmonella enterica enterica serovar Typhi Ty2
acgcuuguuguaaagaaau

SEQ ID NO: 3696635 - RNA, 20 nt, Salmonella enterica enterica serovar Typhi Ty2
acgcuuuacgcuuaucccag

SEQ ID NO: 3696636 - RNA, 21 nt, Salmonella enterica enterica serovar Typhi Ty2
acgcuuuccaguugcggcauc

SEQ ID NO: 3696637 - RNA, 17 nt, Salmonella enterica enterica serovar Typhi Ty2
acgcuuuguacagacaa

SEQ ID NO: 3696638 - RNA, 23 nt, Salmonella enterica enterica serovar Typhi Ty2
acgcuuuuaaauucgcuccacug

SEQ ID NO: 3696639 - RNA, 21 nt, Salmonella enterica enterica serovar Typhi Ty2
acgcuuuuuuauuuugugacc

SEQ ID NO: 3696640 - RNA, 21 nt, Salmonella enterica enterica serovar Typhi Ty2
acgcuuuuuugcuggcuggcg

SEQ ID NO: 3696641 - RNA, 17 nt, Salmonella enterica enterica serovar Typhi Ty2
acggaaaagcauugcuu

SEQ ID NO: 3696642 - RNA, 14 nt, Salmonella enterica enterica serovar Typhi Ty2
acggaaaccagaua

SEQ ID NO: 3696643 - RNA, 14 nt, Salmonella enterica enterica serovar Typhi Ty2
acggaaauagcgcc

SEQ ID NO: 3696644 - RNA, 22 nt, Salmonella enterica enterica serovar Typhi Ty2
acggaaaugaucagacgcauca

SEQ ID NO: 3696645 - RNA, 15 nt, Salmonella enterica enterica serovar Typhi Ty2
acggaacaaaacgga

SEQ ID NO: 3696646 - RNA, 19 nt, Salmonella enterica enterica serovar Typhi Ty2
acggaacaaaacggaaugu

SEQ ID NO: 3696647 - RNA, 23 nt, Salmonella enterica enterica serovar Typhi Ty2
acggaacaacggcauacaggccg

SEQ ID NO: 3696648 - RNA, 15 nt, Salmonella enterica enterica serovar Typhi Ty2
acggaaggaaauaac

SEQ ID NO: 3696649 - RNA, 15 nt, Salmonella enterica enterica serovar Typhi Ty2
acggaagguaauagc

SEQ ID NO: 3696650 - RNA, 20 nt, Salmonella enterica enterica serovar Typhi Ty2
acggaagucugaccgucagc

SEQ ID NO: 3696651 - RNA, 22 nt, Salmonella enterica enterica serovar Typhi Ty2
acggacuugaucgugccguccg

SEQ ID NO: 3696652 - RNA, 22 nt, Salmonella enterica enterica serovar Typhi Ty2
acggagaugaucguuuccagca

SEQ ID NO: 3696653 - RNA, 23 nt, Salmonella enterica enterica serovar Typhi Ty2
acggagcauaauuuuccugucgu

SEQ ID NO: 3696654 - RNA, 16 nt, Salmonella enterica enterica serovar Typhi Ty2
acggaggugccagaga

SEQ ID NO: 3696655 - RNA, 20 nt, Salmonella enterica enterica serovar Typhi Ty2
acggaguuggaaccaaacac

SEQ ID NO: 3696656 - RNA, 19 nt, Salmonella enterica enterica serovar Typhi Ty2
acggauacgcugcgucagg

SEQ ID NO: 3696657 - RNA, 17 nt, Salmonella enterica enterica serovar Typhi Ty2
acggaucaugguugaaa

SEQ ID NO: 3696658 - RNA, 13 nt, Salmonella enterica enterica serovar Typhi Ty2
acggauccagaac

SEQ ID NO: 3696659 - RNA, 12 nt, Salmonella enterica enterica serovar Typhi Ty2
acggaucuucca

SEQ ID NO: 3696660 - RNA, 15 nt, Salmonella enterica enterica serovar Typhi Ty2
acggaugcgccaucc

SEQ ID NO: 3696661 - RNA, 19 nt, Salmonella enterica enterica serovar Typhi Ty2
acggcaaaaagcauaugcg

SEQ ID NO: 3696662 - RNA, 22 nt, Salmonella enterica enterica serovar Typhi Ty2
acggcaaaauaaauauccuccg

SEQ ID NO: 3696663 - RNA, 13 nt, Salmonella enterica enterica serovar Typhi Ty2
acggcaaacgcug

SEQ ID NO: 3696664 - RNA, 19 nt, Salmonella enterica enterica serovar Typhi Ty2
acggcaaacgcuggugcug

SEQ ID NO: 3696665 - RNA, 20 nt, Salmonella enterica enterica serovar Typhi Ty2
acggcaaaucgcgguaaaaa

SEQ ID NO: 3696666 - RNA, 18 nt, Salmonella enterica enterica serovar Typhi Ty2
acggcaacaguaccugau

SEQ ID NO: 3696667 - RNA, 16 nt, Salmonella enterica enterica serovar Typhi Ty2
acggcaacgggacggc

SEQ ID NO: 3696668 - RNA, 14 nt, Salmonella enterica enterica serovar Typhi Ty2
acggcaacugaaaa

SEQ ID NO: 3696669 - RNA, 23 nt, Salmonella enterica enterica serovar Typhi Ty2
acggcaacugaaaacaggccugc

SEQ ID NO: 3696670 - RNA, 19 nt, Salmonella enterica enterica serovar Typhi Ty2
acggcaaguauacuuauug

SEQ ID NO: 3696671 - RNA, 16 nt, Salmonella enterica enterica serovar Typhi Ty2
acggcacaacggccag

SEQ ID NO: 3696672 - RNA, 16 nt, Salmonella enterica enterica serovar Typhi Ty2
acggcagccacgccga

SEQ ID NO: 3696673 - RNA, 14 nt, Salmonella enterica enterica serovar Typhi Ty2
acggcagccagcgu

SEQ ID NO: 3696674 - RNA, 13 nt, Salmonella enterica enterica serovar Typhi Ty2
acggcagcgccau

SEQ ID NO: 3696675 - RNA, 20 nt, Salmonella enterica enterica serovar Typhi Ty2
acggcaggcccgauaaacgg

SEQ ID NO: 3696676 - RNA, 23 nt, Salmonella enterica enterica serovar Typhi Ty2
acggcaguguuucccaacaaugc

SEQ ID NO: 3696677 - RNA, 12 nt, Salmonella enterica enterica serovar Typhi Ty2
acggcauaagcc

SEQ ID NO: 3696678 - RNA, 20 nt, Salmonella enterica enterica serovar Typhi Ty2
acggcauagcuguuccgcaa

SEQ ID NO: 3696679 - RNA, 15 nt, Salmonella enterica enterica serovar Typhi Ty2
acggcauauucccug

SEQ ID NO: 3696680 - RNA, 16 nt, Salmonella enterica enterica serovar Typhi Ty2
acggccaccaggccug

SEQ ID NO: 3696681 - RNA, 20 nt, Salmonella enterica enterica serovar Typhi Ty2
acguaacgguguuucaucuu

SEQ ID NO: 3696682 - RNA, 16 nt, Salmonella enterica enterica serovar Typhi Ty2
acguaacgucguaaau

SEQ ID NO: 3696683 - RNA, 21 nt, Salmonella enterica enterica serovar Typhi Ty2
acguaacugcgguaaauaaug

SEQ ID NO: 3696684 - RNA, 15 nt, Salmonella enterica enterica serovar Typhi Ty2
acguaacuuauccac

SEQ ID NO: 3696685 - RNA, 19 nt, Salmonella enterica enterica serovar Typhi Ty2
acguaaguuaaaacgccau

SEQ ID NO: 3696686 - RNA, 22 nt, Salmonella enterica enterica serovar Typhi Ty2
acguaauaaccaccggcgcgcc

SEQ ID NO: 3696687 - RNA, 14 nt, Salmonella enterica enterica serovar Typhi Ty2
acguaauauuaagc

SEQ ID NO: 3696688 - RNA, 18 nt, Salmonella enterica enterica serovar Typhi Ty2
acguaaucccgccagccu

SEQ ID NO: 3696689 - RNA, 16 nt, Salmonella enterica enterica serovar Typhi Ty2
acguaaugugaaaaac

SEQ ID NO: 3696690 - RNA, 22 nt, Salmonella enterica enterica serovar Typhi Ty2
acguacagguugugcaucuccu

SEQ ID NO: 3696691 - RNA, 18 nt, Salmonella enterica enterica serovar Typhi Ty2
acguacccgcucggcaua

SEQ ID NO: 3696692 - RNA, 12 nt, Salmonella enterica enterica serovar Typhi Ty2
acguagcaaaua

SEQ ID NO: 3696693 - RNA, 23 nt, Salmonella enterica enterica serovar Typhi Ty2
acguagcccauugucaucaguau

SEQ ID NO: 3696694 - RNA, 21 nt, Salmonella enterica enterica serovar Typhi Ty2
acguagcuuauaaaucagcuu

SEQ ID NO: 3696695 - RNA, 20 nt, Salmonella enterica enterica serovar Typhi Ty2
acguaggccgaauaagacgc

SEQ ID NO: 3696696 - RNA, 15 nt, Salmonella enterica enterica serovar Typhi Ty2
acguaggccugauaa

SEQ ID NO: 3696697 - RNA, 14 nt, Salmonella enterica enterica serovar Typhi Ty2
acguauuauuauua

SEQ ID NO: 3696698 - RNA, 22 nt, Salmonella enterica enterica serovar Typhi Ty2
acgucaauguaauucaccaaau

SEQ ID NO: 3696699 - RNA, 19 nt, Salmonella enterica enterica serovar Typhi Ty2
acgucacaauacuuccgcu

SEQ ID NO: 3696700 - RNA, 12 nt, Salmonella enterica enterica serovar Typhi Ty2
acgucaccauca

SEQ ID NO: 3696701 - RNA, 11 nt, Salmonella enterica enterica serovar Typhi Ty2
acgucaccaug

SEQ ID NO: 3696702 - RNA, 23 nt, Salmonella enterica enterica serovar Typhi Ty2
acgucagcaucuccuggcgcagc

SEQ ID NO: 3696703 - RNA, 20 nt, Salmonella enterica enterica serovar Typhi Ty2
acgucagccgggauaaucag

SEQ ID NO: 3696704 - RNA, 21 nt, Salmonella enterica enterica serovar Typhi Ty2
acgucagcgaccauugcguau

SEQ ID NO: 3696705 - RNA, 12 nt, Salmonella enterica enterica serovar Typhi Ty2
acgucagcugga

SEQ ID NO: 3696706 - RNA, 17 nt, Salmonella enterica enterica serovar Typhi Ty2
acgucaguggaaaacag

SEQ ID NO: 3696707 - RNA, 19 nt, Salmonella enterica enterica serovar Typhi Ty2
acgucaguggaaaacagca

SEQ ID NO: 3696708 - RNA, 15 nt, Salmonella enterica enterica serovar Typhi Ty2
acgucauaucaucca

SEQ ID NO: 3696709 - RNA, 22 nt, Salmonella enterica enterica serovar Typhi Ty2
acgucauaucauccagccccgg

SEQ ID NO: 3696710 - RNA, 14 nt, Salmonella enterica enterica serovar Typhi Ty2
acgucaucaugaaa

SEQ ID NO: 3696711 - RNA, 15 nt, Salmonella enterica enterica serovar Typhi Ty2
acgucaucaugcugc

SEQ ID NO: 3696712 - RNA, 22 nt, Salmonella enterica enterica serovar Typhi Ty2
acgucauuaccaguugaccaaa

SEQ ID NO: 3696713 - RNA, 18 nt, Salmonella enterica enterica serovar Typhi Ty2
acgucauuuuuucaauuu

SEQ ID NO: 3696714 - RNA, 20 nt, Salmonella enterica enterica serovar Typhi Ty2
acguccauaccgguugcgcg

SEQ ID NO: 3696715 - RNA, 21 nt, Salmonella enterica enterica serovar Typhi Ty2
acguccauaccgguugcgcgc

SEQ ID NO: 3696716 - RNA, 12 nt, Salmonella enterica enterica serovar Typhi Ty2
acguccauccgc

SEQ ID NO: 3696717 - RNA, 14 nt, Salmonella enterica enterica serovar Typhi Ty2
acgucgcaaagauu

SEQ ID NO: 3696718 - RNA, 18 nt, Salmonella enterica enterica serovar Typhi Ty2
acgucgccuuccugcagg

SEQ ID NO: 3696719 - RNA, 20 nt, Salmonella enterica enterica serovar Typhi Ty2
acgucgcucuuuucaggcgc

SEQ ID NO: 3696720 - RNA, 20 nt, Salmonella enterica enterica serovar Typhi Ty2
acgucggcgaauuucgcguu

SEQ ID NO: 3696721 - RNA, 13 nt, Salmonella enterica enterica serovar Typhi Ty2
acgucgucccagg

SEQ ID NO: 3696722 - RNA, 16 nt, Salmonella enterica enterica serovar Typhi Ty2
acgucgucccaggcca

SEQ ID NO: 3696723 - RNA, 20 nt, Salmonella enterica enterica serovar Typhi Ty2
acgucuggaaacccgcucgc

SEQ ID NO: 3696724 - RNA, 15 nt, Salmonella enterica enterica serovar Typhi Ty2
acgugaccuuucaac

SEQ ID NO: 3696725 - RNA, 14 nt, Salmonella enterica enterica serovar Typhi Ty2
acgugacgcgccag

SEQ ID NO: 3696726 - RNA, 14 nt, Salmonella enterica enterica serovar Typhi Ty2
acgugacguaucgc

SEQ ID NO: 3696727 - RNA, 22 nt, Salmonella enterica enterica serovar Typhi Ty2
acgugaugauaggucagcgauu

SEQ ID NO: 3696728 - RNA, 14 nt, Salmonella enterica enterica serovar Typhi Ty2
acgugcauaaaacg

SEQ ID NO: 3696729 - RNA, 22 nt, Salmonella enterica enterica serovar Typhi Ty2
acgugcauuauuuuagugaaaa

SEQ ID NO: 3696730 - RNA, 19 nt, Salmonella enterica enterica serovar Typhi Ty2
acgugcgaaccacggcgua

SEQ ID NO: 3696731 - RNA, 19 nt, Salmonella enterica enterica serovar Typhi Ty2
acgugcggcggccucuuug

SEQ ID NO: 3696732 - RNA, 19 nt, Salmonella enterica enterica serovar Typhi Ty2
acgugcgguauaucacgcc

SEQ ID NO: 3696733 - RNA, 20 nt, Salmonella enterica enterica serovar Typhi Ty2
acgugcgguauaucacgcca

SEQ ID NO: 3696734 - RNA, 21 nt, Salmonella enterica enterica serovar Typhi Ty2
acgugcugaucccgcgcgccu

SEQ ID NO: 3696735 - RNA, 14 nt, Salmonella enterica enterica serovar Typhi Ty2
acguggcuucgccg

SEQ ID NO: 3696736 - RNA, 13 nt, Salmonella enterica enterica serovar Typhi Ty2
acgugggucgaga

SEQ ID NO: 3696737 - RNA, 16 nt, Salmonella enterica enterica serovar Typhi Ty2
acguguuaugcgccug

SEQ ID NO: 3696738 - RNA, 13 nt, Salmonella enterica enterica serovar Typhi Ty2
acguuaauacauc

SEQ ID NO: 3696739 - RNA, 19 nt, Salmonella enterica enterica serovar Typhi Ty2
acguuaauacaucaugcuu

SEQ ID NO: 3696740 - RNA, 16 nt, Salmonella enterica enterica serovar Typhi Ty2
acguuaccgcagcgaa

SEQ ID NO: 3696741 - RNA, 17 nt, Salmonella enterica enterica serovar Typhi Ty2
acguuaccgcagcgaau

SEQ ID NO: 3696742 - RNA, 21 nt, Salmonella enterica enterica serovar Typhi Ty2
acguuacgcggcgcgccguaa

SEQ ID NO: 3696743 - RNA, 14 nt, Salmonella enterica enterica serovar Typhi Ty2
acguuaggcgcaaa

SEQ ID NO: 3696744 - RNA, 23 nt, Salmonella enterica enterica serovar Typhi Ty2
acguuaucuucggucgagcuuuu

SEQ ID NO: 3696745 - RNA, 16 nt, Salmonella enterica enterica serovar Typhi Ty2
acguucagcauaucca

SEQ ID NO: 3696746 - RNA, 17 nt, Salmonella enterica enterica serovar Typhi Ty2
acguucagcauauccag

SEQ ID NO: 3696747 - RNA, 13 nt, Salmonella enterica enterica serovar Typhi Ty2
acguucauccgac

SEQ ID NO: 3696748 - RNA, 23 nt, Salmonella enterica enterica serovar Typhi Ty2
acguucauccgaccacggccaca

SEQ ID NO: 3696749 - RNA, 14 nt, Salmonella enterica enterica serovar Typhi Ty2
acguucauccuccu

SEQ ID NO: 3696750 - RNA, 12 nt, Salmonella enterica enterica serovar Typhi Ty2
acguucaucuuc

SEQ ID NO: 3696751 - RNA, 14 nt, Salmonella enterica enterica serovar Typhi Ty2
acguucaucuuccc

SEQ ID NO: 3696752 - RNA, 21 nt, Salmonella enterica enterica serovar Typhi Ty2
acguuccagcguuuccggaau

SEQ ID NO: 3696753 - RNA, 19 nt, Salmonella enterica enterica serovar Typhi Ty2
acguuccauggucucuuuu

SEQ ID NO: 3696754 - RNA, 19 nt, Salmonella enterica enterica serovar Typhi Ty2
acguuccuucaggagaccu

SEQ ID NO: 3696755 - RNA, 20 nt, Salmonella enterica enterica serovar Typhi Ty2
acguucgcggguaacgucga

SEQ ID NO: 3696756 - RNA, 21 nt, Salmonella enterica enterica serovar Typhi Ty2
acguucggcguguagccaauc

SEQ ID NO: 3696757 - RNA, 22 nt, Salmonella enterica enterica serovar Typhi Ty2
acguucuaucagguaucccgcc

SEQ ID NO: 3696758 - RNA, 19 nt, Salmonella enterica enterica serovar Typhi Ty2
acguucuucgauaaaggga

SEQ ID NO: 3696759 - RNA, 22 nt, Salmonella enterica enterica serovar Typhi Ty2
acguugccguaggcgacgccaa

SEQ ID NO: 3696760 - RNA, 22 nt, Salmonella enterica enterica serovar Typhi Ty2
acguugcggcgcguucagcauc

SEQ ID NO: 3696761 - RNA, 16 nt, Salmonella enterica enterica serovar Typhi Ty2
acguugcuggcgcgcg

SEQ ID NO: 3696762 - RNA, 19 nt, Salmonella enterica enterica serovar Typhi Ty2
acguuggggauaaccagaa

SEQ ID NO: 3696763 - RNA, 19 nt, Salmonella enterica enterica serovar Typhi Ty2
acucaucggccaccacaua

SEQ ID NO: 3696764 - RNA, 13 nt, Salmonella enterica enterica serovar Typhi Ty2
acucaucuuuauu

SEQ ID NO: 3696765 - RNA, 20 nt, Salmonella enterica enterica serovar Typhi Ty2
acucaugccuuuggcaauca

SEQ ID NO: 3696766 - RNA, 14 nt, Salmonella enterica enterica serovar Typhi Ty2
acucauuaccggcu

SEQ ID NO: 3696767 - RNA, 14 nt, Salmonella enterica enterica serovar Typhi Ty2
acuccagaauauug

SEQ ID NO: 3696768 - RNA, 11 nt, Salmonella enterica enterica serovar Typhi Ty2
acuccagaccu

SEQ ID NO: 3696769 - RNA, 20 nt, Salmonella enterica enterica serovar Typhi Ty2
acuccagcagacgcugcuuc

SEQ ID NO: 3696770 - RNA, 14 nt, Salmonella enterica enterica serovar Typhi Ty2
acuccagcggcagg

SEQ ID NO: 3696771 - RNA, 17 nt, Salmonella enterica enterica serovar Typhi Ty2
acuccagcggcaggauc

SEQ ID NO: 3696772 - RNA, 16 nt, Salmonella enterica enterica serovar Typhi Ty2
acuccaugcccacaca

SEQ ID NO: 3696773 - RNA, 16 nt, Salmonella enterica enterica serovar Typhi Ty2
acuccauucccagcuc

SEQ ID NO: 3696774 - RNA, 18 nt, Salmonella enterica enterica serovar Typhi Ty2
acuccauucccagcucuu

SEQ ID NO: 3696775 - RNA, 21 nt, Salmonella enterica enterica serovar Typhi Ty2
acucccaggugugacguccca

SEQ ID NO: 3696776 - RNA, 12 nt, Salmonella enterica enterica serovar Typhi Ty2
acucccaguccg

SEQ ID NO: 3696777 - RNA, 17 nt, Salmonella enterica enterica serovar Typhi Ty2
acuccccggcuugcggg

SEQ ID NO: 3696778 - RNA, 14 nt, Salmonella enterica enterica serovar Typhi Ty2
acuccccuuuuuuc

SEQ ID NO: 3696779 - RNA, 17 nt, Salmonella enterica enterica serovar Typhi Ty2
acucccugcuuuuucag

SEQ ID NO: 3696780 - RNA, 14 nt, Salmonella enterica enterica serovar Typhi Ty2
acuccggugcccau

SEQ ID NO: 3696781 - RNA, 14 nt, Salmonella enterica enterica serovar Typhi Ty2
acuccgucaaagaa

SEQ ID NO: 3696782 - RNA, 15 nt, Salmonella enterica enterica serovar Typhi Ty2
acuccuaagagaaaa

SEQ ID NO: 3696783 - RNA, 18 nt, Salmonella enterica enterica serovar Typhi Ty2
acuccuaagagaaaaccc

SEQ ID NO: 3696784 - RNA, 11 nt, Salmonella enterica enterica serovar Typhi Ty2
acuccugcaac

SEQ ID NO: 3696785 - RNA, 14 nt, Salmonella enterica enterica serovar Typhi Ty2
acuccugccugaca

SEQ ID NO: 3696786 - RNA, 19 nt, Salmonella enterica enterica serovar Typhi Ty2
acuccugccugacaaugac

SEQ ID NO: 3696787 - RNA, 16 nt, Salmonella enterica enterica serovar Typhi Ty2
acuccuucuaauucca

SEQ ID NO: 3696788 - RNA, 19 nt, Salmonella enterica enterica serovar Typhi Ty2
acucgaggaacuguucagc

SEQ ID NO: 3696789 - RNA, 19 nt, Salmonella enterica enterica serovar Typhi Ty2
acucgcacaguacaccugc

SEQ ID NO: 3696790 - RNA, 16 nt, Salmonella enterica enterica serovar Typhi Ty2
acucgccucgcugcug

SEQ ID NO: 3696791 - RNA, 15 nt, Salmonella enterica enterica serovar Typhi Ty2
acucgccuuucucca

SEQ ID NO: 3696792 - RNA, 16 nt, Salmonella enterica enterica serovar Typhi Ty2
acucgcuacgcucgcc

SEQ ID NO: 3696793 - RNA, 17 nt, Salmonella enterica enterica serovar Typhi Ty2
acucgcucauuugcgag

SEQ ID NO: 3696794 - RNA, 17 nt, Salmonella enterica enterica serovar Typhi Ty2
acucgcucccuuccccc

SEQ ID NO: 3696795 - RNA, 22 nt, Salmonella enterica enterica serovar Typhi Ty2
acucgcuccuugauugcaagaa

SEQ ID NO: 3696796 - RNA, 19 nt, Salmonella enterica enterica serovar Typhi Ty2
acucgcuguggccaggcac

SEQ ID NO: 3696797 - RNA, 22 nt, Salmonella enterica enterica serovar Typhi Ty2
acucggugccgcugcugaccuu

SEQ ID NO: 3696798 - RNA, 21 nt, Salmonella enterica enterica serovar Typhi Ty2
acucguaaucuaaaauuauuu

SEQ ID NO: 3696799 - RNA, 17 nt, Salmonella enterica enterica serovar Typhi Ty2
acucgucccgauauaaa

SEQ ID NO: 3696800 - RNA, 19 nt, Salmonella enterica enterica serovar Typhi Ty2
acucgugcagugauucgua

SEQ ID NO: 3696801 - RNA, 16 nt, Salmonella enterica enterica serovar Typhi Ty2
acucuaggcgcugcug

SEQ ID NO: 3696802 - RNA, 17 nt, Salmonella enterica enterica serovar Typhi Ty2
acucuaugcaaaagaaa

SEQ ID NO: 3696803 - RNA, 21 nt, Salmonella enterica enterica serovar Typhi Ty2
acucucaccgaccugccuugc

SEQ ID NO: 3696804 - RNA, 16 nt, Salmonella enterica enterica serovar Typhi Ty2
acucucauguucaagc

SEQ ID NO: 3696805 - RNA, 15 nt, Salmonella enterica enterica serovar Typhi Ty2
acucucccggcgccc

SEQ ID NO: 3696806 - RNA, 16 nt, Salmonella enterica enterica serovar Typhi Ty2
acucucgcagcgaaua

SEQ ID NO: 3696807 - RNA, 20 nt, Salmonella enterica enterica serovar Typhi Ty2
acucucggccuauaaaccac

SEQ ID NO: 3696808 - RNA, 16 nt, Salmonella enterica enterica serovar Typhi Ty2
acucucuccaguuugc

SEQ ID NO: 3696809 - RNA, 17 nt, Salmonella enterica enterica serovar Typhi Ty2
acucugcgacgccaggc

SEQ ID NO: 3696810 - RNA, 23 nt, Salmonella enterica enterica serovar Typhi Ty2
acucugugcguucgcgaauuuca

SEQ ID NO: 3696811 - RNA, 14 nt, Salmonella enterica enterica serovar Typhi Ty2
acucuuaauuauaa

SEQ ID NO: 3696812 - RNA, 15 nt, Salmonella enterica enterica serovar Typhi Ty2
acucuuaauuauaaa

SEQ ID NO: 3696813 - RNA, 18 nt, Salmonella enterica enterica serovar Typhi Ty2
acucuuaauuauaaagca

SEQ ID NO: 3696814 - RNA, 19 nt, Salmonella enterica enterica serovar Typhi Ty2
acucuuaauuauaaagcau

SEQ ID NO: 3696815 - RNA, 15 nt, Salmonella enterica enterica serovar Typhi Ty2
acucuucacccuucu

SEQ ID NO: 3696816 - RNA, 13 nt, Salmonella enterica enterica serovar Typhi Ty2
acucuucaucgcg

SEQ ID NO: 3696817 - RNA, 14 nt, Salmonella enterica enterica serovar Typhi Ty2
acucuucaucgcgc

SEQ ID NO: 3696818 - RNA, 20 nt, Salmonella enterica enterica serovar Typhi Ty2
acucuuccagcugcucuccu

SEQ ID NO: 3696819 - RNA, 15 nt, Salmonella enterica enterica serovar Typhi Ty2
acucuuccgcaauca

SEQ ID NO: 3696820 - RNA, 22 nt, Salmonella enterica enterica serovar Typhi Ty2
acucuuccgggcgcgaucuguu

SEQ ID NO: 3696821 - RNA, 22 nt, Salmonella enterica enterica serovar Typhi Ty2
acucuucgacacauuucagcgc

SEQ ID NO: 3696822 - RNA, 16 nt, Salmonella enterica enterica serovar Typhi Ty2
acucuucgccauuaca

SEQ ID NO: 3696823 - RNA, 11 nt, Salmonella enterica enterica serovar Typhi Ty2
acucuucugac

SEQ ID NO: 3696824 - RNA, 21 nt, Salmonella enterica enterica serovar Typhi Ty2
acucuucugaccaucuuaccu

SEQ ID NO: 3696825 - RNA, 15 nt, Salmonella enterica enterica serovar Typhi Ty2
acucuuugugggacu

SEQ ID NO: 3696826 - RNA, 21 nt, Salmonella enterica enterica serovar Typhi Ty2
acucuuuuccccgacggccuc

SEQ ID NO: 3696827 - RNA, 16 nt, Salmonella enterica enterica serovar Typhi Ty2
acucuuuuuccgcgag

SEQ ID NO: 3696828 - RNA, 23 nt, Salmonella enterica enterica serovar Typhi Ty2
acucuuuuuccgcgagagaaaaa

SEQ ID NO: 3696829 - RNA, 16 nt, Salmonella enterica enterica serovar Typhi Ty2
acucuuuuuucagaau

SEQ ID NO: 3696830 - RNA, 13 nt, Salmonella enterica enterica serovar Typhi Ty2
acugaaaaucaaa

SEQ ID NO: 3696831 - RNA, 15 nt, Salmonella enterica enterica serovar Typhi Ty2
acugaaaaucaaaua

SEQ ID NO: 3696832 - RNA, 22 nt, Salmonella enterica enterica serovar Typhi Ty2
acugaaauggccccaaaucaga

SEQ ID NO: 3696833 - RNA, 16 nt, Salmonella enterica enterica serovar Typhi Ty2
acugaacaucgccguu

SEQ ID NO: 3696834 - RNA, 13 nt, Salmonella enterica enterica serovar Typhi Ty2
acugaagauaaac

SEQ ID NO: 3696835 - RNA, 20 nt, Salmonella enterica enterica serovar Typhi Ty2
acugaagauaaacagcagcg

SEQ ID NO: 3696836 - RNA, 16 nt, Salmonella enterica enterica serovar Typhi Ty2
acugaagguuuuuccc

SEQ ID NO: 3696837 - RNA, 15 nt, Salmonella enterica enterica serovar Typhi Ty2
acugacggcgcucuu

SEQ ID NO: 3696838 - RNA, 18 nt, Salmonella enterica enterica serovar Typhi Ty2
acugacguugcgaaucag

SEQ ID NO: 3696839 - RNA, 23 nt, Salmonella enterica enterica serovar Typhi Ty2
acugacguugcgaaucagguaca

SEQ ID NO: 3696840 - RNA, 12 nt, Salmonella enterica enterica serovar Typhi Ty2
acugacugcugu

SEQ ID NO: 3696841 - RNA, 17 nt, Salmonella enterica enterica serovar Typhi Ty2
acugacuucaucaaaua

SEQ ID NO: 3696842 - RNA, 19 nt, Salmonella enterica enterica serovar Typhi Ty2
acugagacucagcagcgca

SEQ ID NO: 3696843 - RNA, 16 nt, Salmonella enterica enterica serovar Typhi Ty2
acugagcgccaauuga

SEQ ID NO: 3696844 - RNA, 16 nt, Salmonella enterica enterica serovar Typhi Ty2
acugagcuaacgaccc

SEQ ID NO: 3696845 - RNA, 16 nt, Salmonella enterica enterica serovar Typhi Ty2
acuguauucgguggaa

SEQ ID NO: 3696846 - RNA, 16 nt, Salmonella enterica enterica serovar Typhi Ty2
acugucaaaaauaaca

SEQ ID NO: 3696847 - RNA, 21 nt, Salmonella enterica enterica serovar Typhi Ty2
acugucccagggccaaacugg

SEQ ID NO: 3696848 - RNA, 22 nt, Salmonella enterica enterica serovar Typhi Ty2
acugucccagggccaaacuggc

SEQ ID NO: 3696849 - RNA, 18 nt, Salmonella enterica enterica serovar Typhi Ty2
acugucgaaaccagcaua

SEQ ID NO: 3696850 - RNA, 23 nt, Salmonella enterica enterica serovar Typhi Ty2
acugucggcgauauagcgcugaa

SEQ ID NO: 3696851 - RNA, 20 nt, Salmonella enterica enterica serovar Typhi Ty2
acugugccgucguacucacc

SEQ ID NO: 3696852 - RNA, 15 nt, Salmonella enterica enterica serovar Typhi Ty2
acuguggugugccug

SEQ ID NO: 3696853 - RNA, 18 nt, Salmonella enterica enterica serovar Typhi Ty2
acuguggugugccugcgu

SEQ ID NO: 3696854 - RNA, 17 nt, Salmonella enterica enterica serovar Typhi Ty2
acuguuagcgaaacugc

SEQ ID NO: 3696855 - RNA, 13 nt, Salmonella enterica enterica serovar Typhi Ty2
acuguuauugacg

SEQ ID NO: 3696856 - RNA, 13 nt, Salmonella enterica enterica serovar Typhi Ty2
acuguucagccag

SEQ ID NO: 3696857 - RNA, 14 nt, Salmonella enterica enterica serovar Typhi Ty2
acuguucagcugac

SEQ ID NO: 3696858 - RNA, 17 nt, Salmonella enterica enterica serovar Typhi Ty2
acuguucggcggggauc

SEQ ID NO: 3696859 - RNA, 15 nt, Salmonella enterica enterica serovar Typhi Ty2
acuguucggggauua

SEQ ID NO: 3696860 - RNA, 15 nt, Salmonella enterica enterica serovar Typhi Ty2
acuguugaugauaac

SEQ ID NO: 3696861 - RNA, 18 nt, Salmonella enterica enterica serovar Typhi Ty2
acuguuguucuucauaca

SEQ ID NO: 3696862 - RNA, 14 nt, Salmonella enterica enterica serovar Typhi Ty2
acuguuugcugaca

SEQ ID NO: 3696863 - RNA, 14 nt, Salmonella enterica enterica serovar Typhi Ty2
acuguuuuugcuuu

SEQ ID NO: 3696864 - RNA, 15 nt, Salmonella enterica enterica serovar Typhi Ty2
acuuaaaauugaauu

SEQ ID NO: 3696865 - RNA, 20 nt, Salmonella enterica enterica serovar Typhi Ty2
acuuaaaguacuucacaauc

SEQ ID NO: 3696866 - RNA, 20 nt, Salmonella enterica enterica serovar Typhi Ty2
acuuaaauuaaugauuaaaa

SEQ ID NO: 3696867 - RNA, 14 nt, Salmonella enterica enterica serovar Typhi Ty2
acuuaauaucaaua

SEQ ID NO: 3696868 - RNA, 19 nt, Salmonella enterica enterica serovar Typhi Ty2
acuuaaugcaaugcgcgug

SEQ ID NO: 3696869 - RNA, 13 nt, Salmonella enterica enterica serovar Typhi Ty2
acuuacccagcaa

SEQ ID NO: 3696870 - RNA, 16 nt, Salmonella enterica enterica serovar Typhi Ty2
acuuaccgggcaucug

SEQ ID NO: 3696871 - RNA, 12 nt, Salmonella enterica enterica serovar Typhi Ty2
acuuacuuucuu

SEQ ID NO: 3696872 - RNA, 22 nt, Salmonella enterica enterica serovar Typhi Ty2
acuuacuuucuugccacuggcc

SEQ ID NO: 3696873 - RNA, 13 nt, Salmonella enterica enterica serovar Typhi Ty2
acuuauacccuug

SEQ ID NO: 3696874 - RNA, 16 nt, Salmonella enterica enterica serovar Typhi Ty2
acuuaucaguaacaga

SEQ ID NO: 3696875 - RNA, 11 nt, Salmonella enterica enterica serovar Typhi Ty2
acuuaucucuu

SEQ ID NO: 3696876 - RNA, 17 nt, Salmonella enterica enterica serovar Typhi Ty2
acuuauuaccacaguca

SEQ ID NO: 3696877 - RNA, 22 nt, Salmonella enterica enterica serovar Typhi Ty2
acuuauugaaaccuaauuaaau

SEQ ID NO: 3696878 - RNA, 21 nt, Salmonella enterica enterica serovar Typhi Ty2
acuuauuuguauugacgccga

SEQ ID NO: 3696879 - RNA, 23 nt, Salmonella enterica enterica serovar Typhi Ty2
acuucaagguucgacucgagcaa

SEQ ID NO: 3696880 - RNA, 15 nt, Salmonella enterica enterica serovar Typhi Ty2
acuucaauucagaaa

SEQ ID NO: 3696881 - RNA, 18 nt, Salmonella enterica enterica serovar Typhi Ty2
acuucaauucagaaaguu

SEQ ID NO: 3696882 - RNA, 18 nt, Salmonella enterica enterica serovar Typhi Ty2
acuucaauuuuccagaua

SEQ ID NO: 3696883 - RNA, 13 nt, Salmonella enterica enterica serovar Typhi Ty2
acuucacaaacaa

SEQ ID NO: 3696884 - RNA, 14 nt, Salmonella enterica enterica serovar Typhi Ty2
acuucacccaucgc

SEQ ID NO: 3696885 - RNA, 15 nt, Salmonella enterica enterica serovar Typhi Ty2
acuucacccaucgcc

SEQ ID NO: 3696886 - RNA, 16 nt, Salmonella enterica enterica serovar Typhi Ty2
acuucaccucagccaa

SEQ ID NO: 3696887 - RNA, 16 nt, Salmonella enterica enterica serovar Typhi Ty2
acuucagagcugaaaa

SEQ ID NO: 3696888 - RNA, 19 nt, Salmonella enterica enterica serovar Typhi Ty2
acuucagcauacaggucuu

SEQ ID NO: 3696889 - RNA, 15 nt, Salmonella enterica enterica serovar Typhi Ty2
acuucauccggauaa

SEQ ID NO: 3696890 - RNA, 18 nt, Salmonella enterica enterica serovar Typhi Ty2
acuucaugcguuagccua

SEQ ID NO: 3696891 - RNA, 16 nt, Salmonella enterica enterica serovar Typhi Ty2
acuucauuuuccacaa

SEQ ID NO: 3696892 - RNA, 10 nt, Salmonella enterica enterica serovar Typhi Ty2
acuuccagcg

SEQ ID NO: 3696893 - RNA, 20 nt, Salmonella enterica enterica serovar Typhi Ty2
acuuccauucccgccgcaau

SEQ ID NO: 3696894 - RNA, 21 nt, Salmonella enterica enterica serovar Typhi Ty2
acuuccauucggcgaaagaag

SEQ ID NO: 3696895 - RNA, 13 nt, Salmonella enterica enterica serovar Typhi Ty2
acuuccccugcca

SEQ ID NO: 3696896 - RNA, 11 nt, Salmonella enterica enterica serovar Typhi Ty2
acuuccggauc

SEQ ID NO: 3696897 - RNA, 20 nt, Salmonella enterica enterica serovar Typhi Ty2
acuuccgguauccguucauc

SEQ ID NO: 3696898 - RNA, 20 nt, Salmonella enterica enterica serovar Typhi Ty2
acuuccgguugaccgcauaa

SEQ ID NO: 3696899 - RNA, 19 nt, Salmonella enterica enterica serovar Typhi Ty2
acuuccuggaugcuuaaaa

SEQ ID NO: 3696900 - RNA, 15 nt, Salmonella enterica enterica serovar Typhi Ty2
acuuccuguaucacu

SEQ ID NO: 3696901 - RNA, 17 nt, Salmonella enterica enterica serovar Typhi Ty2
acuuccuuugccuuucu

SEQ ID NO: 3696902 - RNA, 19 nt, Salmonella enterica enterica serovar Typhi Ty2
acuucgauggccucaucau

SEQ ID NO: 3696903 - RNA, 19 nt, Salmonella enterica enterica serovar Typhi Ty2
acuucgcaguuggugacau

SEQ ID NO: 3696904 - RNA, 18 nt, Salmonella enterica enterica serovar Typhi Ty2
acuucgcgguuagaaagu

SEQ ID NO: 3696905 - RNA, 20 nt, Salmonella enterica enterica serovar Typhi Ty2
acuucgcgguugcgcccuuc

SEQ ID NO: 3696906 - RNA, 15 nt, Salmonella enterica enterica serovar Typhi Ty2
acuucuaauuuuucc

SEQ ID NO: 3696907 - RNA, 20 nt, Salmonella enterica enterica serovar Typhi Ty2
acuucugacauucagcgcuu

SEQ ID NO: 3696908 - RNA, 16 nt, Salmonella enterica enterica serovar Typhi Ty2
acuucugacccaauca

SEQ ID NO: 3696909 - RNA, 11 nt, Salmonella enterica enterica serovar Typhi Ty2
acuucuucagu

SEQ ID NO: 3696910 - RNA, 17 nt, Salmonella enterica enterica serovar Typhi Ty2
acuugaaguaugaaggg

SEQ ID NO: 3696911 - RNA, 14 nt, Salmonella enterica enterica serovar Typhi Ty2
acuugaccagcacu

SEQ ID NO: 3696912 - RNA, 13 nt, Salmonella enterica enterica serovar Typhi Ty2
acuugaucgugcc

SEQ ID NO: 3696913 - RNA, 14 nt, Salmonella enterica enterica serovar Typhi Ty2
acuugauggaaaac

SEQ ID NO: 3696914 - RNA, 20 nt, Salmonella enterica enterica serovar Typhi Ty2
acuugauuccuggcuugcca

SEQ ID NO: 3696915 - RNA, 23 nt, Salmonella enterica enterica serovar Typhi Ty2
acuuggaaaguugcgccgugccu

SEQ ID NO: 3696916 - RNA, 15 nt, Salmonella enterica enterica serovar Typhi Ty2
acuuguucuucuguu

SEQ ID NO: 3696917 - RNA, 14 nt, Salmonella enterica enterica serovar Typhi Ty2
acuuuaagcggcag

SEQ ID NO: 3696918 - RNA, 20 nt, Salmonella enterica enterica serovar Typhi Ty2
acuuuacccacaucaaucac

SEQ ID NO: 3696919 - RNA, 14 nt, Salmonella enterica enterica serovar Typhi Ty2
acuuuaccgccguu

SEQ ID NO: 3696920 - RNA, 17 nt, Salmonella enterica enterica serovar Typhi Ty2
acuuuaccgccguuagc

SEQ ID NO: 3696921 - RNA, 13 nt, Salmonella enterica enterica serovar Typhi Ty2
acuuuaucaccag

SEQ ID NO: 3696922 - RNA, 13 nt, Salmonella enterica enterica serovar Typhi Ty2
acuuuauuuuucg

SEQ ID NO: 3696923 - RNA, 11 nt, Salmonella enterica enterica serovar Typhi Ty2
acuuucaaaau

SEQ ID NO: 3696924 - RNA, 16 nt, Salmonella enterica enterica serovar Typhi Ty2
acuuuccaaaauccag

SEQ ID NO: 3696925 - RNA, 17 nt, Salmonella enterica enterica serovar Typhi Ty2
acuuuccagcaacugac

SEQ ID NO: 3696926 - RNA, 20 nt, Salmonella enterica enterica serovar Typhi Ty2
acuuuccauucgacaguucc

SEQ ID NO: 3696927 - RNA, 22 nt, Salmonella enterica enterica serovar Typhi Ty2
acuuucucggcuuuccagcuca

SEQ ID NO: 3696928 - RNA, 15 nt, Salmonella enterica enterica serovar Typhi Ty2
agaagcuggcggucg

SEQ ID NO: 3696929 - RNA, 20 nt, Salmonella enterica enterica serovar Typhi Ty2
agaagcugggcgucaacgug

SEQ ID NO: 3696930 - RNA, 15 nt, Salmonella enterica enterica serovar Typhi Ty2
agaagcuuaccaccu

SEQ ID NO: 3696931 - RNA, 16 nt, Salmonella enterica enterica serovar Typhi Ty2
agaaggcgaacauaag

SEQ ID NO: 3696932 - RNA, 19 nt, Salmonella enterica enterica serovar Typhi Ty2
agaagggcaggggaaagcu

SEQ ID NO: 3696933 - RNA, 16 nt, Salmonella enterica enterica serovar Typhi Ty2
agaaggugaguuucgc

SEQ ID NO: 3696934 - RNA, 17 nt, Salmonella enterica enterica serovar Typhi Ty2
agaaguagcagagaaaa

SEQ ID NO: 3696935 - RNA, 18 nt, Salmonella enterica enterica serovar Typhi Ty2
agaaguauggccucuuca

SEQ ID NO: 3696936 - RNA, 14 nt, Salmonella enterica enterica serovar Typhi Ty2
agaagucugugaga

SEQ ID NO: 3696937 - RNA, 23 nt, Salmonella enterica enterica serovar Typhi Ty2
agaauaaaaagugcgcacucaga

SEQ ID NO: 3696938 - RNA, 14 nt, Salmonella enterica enterica serovar Typhi Ty2
agaauaaaacagcu

SEQ ID NO: 3696939 - RNA, 22 nt, Salmonella enterica enterica serovar Typhi Ty2
agaauacacuucucaacauuga

SEQ ID NO: 3696940 - RNA, 23 nt, Salmonella enterica enterica serovar Typhi Ty2
agaauacccuuuacacguuccau

SEQ ID NO: 3696941 - RNA, 23 nt, Salmonella enterica enterica serovar Typhi Ty2
agaauacugaagucgaaauuuuc

SEQ ID NO: 3696942 - RNA, 14 nt, Salmonella enterica enterica serovar Typhi Ty2
agaauagccggaua

SEQ ID NO: 3696943 - RNA, 17 nt, Salmonella enterica enterica serovar Typhi Ty2
agaauagccggauaaaa

SEQ ID NO: 3696944 - RNA, 18 nt, Salmonella enterica enterica serovar Typhi Ty2
agaauagccggauaaaau

SEQ ID NO: 3696945 - RNA, 20 nt, Salmonella enterica enterica serovar Typhi Ty2
agaauagccggauaaaauua

SEQ ID NO: 3696946 - RNA, 17 nt, Salmonella enterica enterica serovar Typhi Ty2
agaauagcgucaauaau

SEQ ID NO: 3696947 - RNA, 16 nt, Salmonella enterica enterica serovar Typhi Ty2
agaauaggaaauaauu

SEQ ID NO: 3696948 - RNA, 16 nt, Salmonella enterica enterica serovar Typhi Ty2
agaauauaggagagcg

SEQ ID NO: 3696949 - RNA, 18 nt, Salmonella enterica enterica serovar Typhi Ty2
agaauauaguuagaaaau

SEQ ID NO: 3696950 - RNA, 13 nt, Salmonella enterica enterica serovar Typhi Ty2
agaauaugccagg

SEQ ID NO: 3696951 - RNA, 22 nt, Salmonella enterica enterica serovar Typhi Ty2
agaauauuggcgaggaacauca

SEQ ID NO: 3696952 - RNA, 23 nt, Salmonella enterica enterica serovar Typhi Ty2
agaauauuuuucucagccagauc

SEQ ID NO: 3696953 - RNA, 12 nt, Salmonella enterica enterica serovar Typhi Ty2
agaaucaccucu

SEQ ID NO: 3696954 - RNA, 13 nt, Salmonella enterica enterica serovar Typhi Ty2
agaaucaccucuu

SEQ ID NO: 3696955 - RNA, 12 nt, Salmonella enterica enterica serovar Typhi Ty2
agaaucacguaa

SEQ ID NO: 3696956 - RNA, 22 nt, Salmonella enterica enterica serovar Typhi Ty2
agaaucauuaauacacugcgua

SEQ ID NO: 3696957 - RNA, 14 nt, Salmonella enterica enterica serovar Typhi Ty2
agaaucccgauaau

SEQ ID NO: 3696958 - RNA, 21 nt, Salmonella enterica enterica serovar Typhi Ty2
agaauccggcgcucaucagac

SEQ ID NO: 3696959 - RNA, 21 nt, Salmonella enterica enterica serovar Typhi Ty2
agaaucgauguaguuguucuu

SEQ ID NO: 3696960 - RNA, 15 nt, Salmonella enterica enterica serovar Typhi Ty2
agaaucucugacagg

SEQ ID NO: 3696961 - RNA, 19 nt, Salmonella enterica enterica serovar Typhi Ty2
agaaucuguauaaaauauu

SEQ ID NO: 3696962 - RNA, 16 nt, Salmonella enterica enterica serovar Typhi Ty2
agaaugaaaaaaaaau

SEQ ID NO: 3696963 - RNA, 18 nt, Salmonella enterica enterica serovar Typhi Ty2
agaaugaaaaaaaaauua

SEQ ID NO: 3696964 - RNA, 15 nt, Salmonella enterica enterica serovar Typhi Ty2
agaaugaccagccga

SEQ ID NO: 3696965 - RNA, 23 nt, Salmonella enterica enterica serovar Typhi Ty2
agaaugccagcgccgucauggca

SEQ ID NO: 3696966 - RNA, 13 nt, Salmonella enterica enterica serovar Typhi Ty2
agaaugcccagca

SEQ ID NO: 3696967 - RNA, 14 nt, Salmonella enterica enterica serovar Typhi Ty2
agaaugcuggucac

SEQ ID NO: 3696968 - RNA, 16 nt, Salmonella enterica enterica serovar Typhi Ty2
agaauggaacaauaga

SEQ ID NO: 3696969 - RNA, 22 nt, Salmonella enterica enterica serovar Typhi Ty2
agaauggucgguauuaucaaua

SEQ ID NO: 3696970 - RNA, 18 nt, Salmonella enterica enterica serovar Typhi Ty2
agaauguguucucccugc

SEQ ID NO: 3696971 - RNA, 13 nt, Salmonella enterica enterica serovar Typhi Ty2
agaauuaucugaa

SEQ ID NO: 3696972 - RNA, 16 nt, Salmonella enterica enterica serovar Typhi Ty2
agaauuauuaccaaug

SEQ ID NO: 3696973 - RNA, 22 nt, Salmonella enterica enterica serovar Typhi Ty2
agaauuauuaccaaugagcugc

SEQ ID NO: 3696974 - RNA, 13 nt, Salmonella enterica enterica serovar Typhi Ty2
agaauuauuucag

SEQ ID NO: 3696975 - RNA, 21 nt, Salmonella enterica enterica serovar Typhi Ty2
agaauucccuauguaaagaau

SEQ ID NO: 3696976 - RNA, 13 nt, Salmonella enterica enterica serovar Typhi Ty2
agaauucgcaaug

SEQ ID NO: 3696977 - RNA, 15 nt, Salmonella enterica enterica serovar Typhi Ty2
agaauucugcgcguc

SEQ ID NO: 3696978 - RNA, 18 nt, Salmonella enterica enterica serovar Typhi Ty2
agaauugcgccaccuuaa

SEQ ID NO: 3696979 - RNA, 13 nt, Salmonella enterica enterica serovar Typhi Ty2
agaauuuauuucu

SEQ ID NO: 3696980 - RNA, 14 nt, Salmonella enterica enterica serovar Typhi Ty2
agaauuucaaucau

SEQ ID NO: 3696981 - RNA, 15 nt, Salmonella enterica enterica serovar Typhi Ty2
agaauuuccaguuca

SEQ ID NO: 3696982 - RNA, 23 nt, Salmonella enterica enterica serovar Typhi Ty2
agaauuuccuucgcuuccuggau

SEQ ID NO: 3696983 - RNA, 18 nt, Salmonella enterica enterica serovar Typhi Ty2
agaauuuguuuaugccgg

SEQ ID NO: 3696984 - RNA, 18 nt, Salmonella enterica enterica serovar Typhi Ty2
agacaaaauucagacuca

SEQ ID NO: 3696985 - RNA, 13 nt, Salmonella enterica enterica serovar Typhi Ty2
agacaacauccca

SEQ ID NO: 3696986 - RNA, 18 nt, Salmonella enterica enterica serovar Typhi Ty2
agacaaccgggcaucacc

SEQ ID NO: 3696987 - RNA, 22 nt, Salmonella enterica enterica serovar Typhi Ty2
agacaauaccagggcgauuccc

SEQ ID NO: 3696988 - RNA, 22 nt, Salmonella enterica enterica serovar Typhi Ty2
agacaaucugugugggcacucg

SEQ ID NO: 3696989 - RNA, 14 nt, Salmonella enterica enterica serovar Typhi Ty2
agacaauuuucuuc

SEQ ID NO: 3696990 - RNA, 16 nt, Salmonella enterica enterica serovar Typhi Ty2
agacacaauauugcug

SEQ ID NO: 3696991 - RNA, 18 nt, Salmonella enterica enterica serovar Typhi Ty2
agacacuggaaacagcca

SEQ ID NO: 3696992 - RNA, 19 nt, Salmonella enterica enterica serovar Typhi Ty2
agacacuggaaacagccaa

SEQ ID NO: 3696993 - RNA, 12 nt, Salmonella enterica enterica serovar Typhi Ty2
agacacuuuccg

SEQ ID NO: 3696994 - RNA, 18 nt, Salmonella enterica enterica serovar Typhi Ty2
agacagaacaggaugcuu

SEQ ID NO: 3696995 - RNA, 18 nt, Salmonella enterica enterica serovar Typhi Ty2
agacagagaaaaucccca

SEQ ID NO: 3696996 - RNA, 22 nt, Salmonella enterica enterica serovar Typhi Ty2
agacagagaaccugaacaauaa

SEQ ID NO: 3696997 - RNA, 20 nt, Salmonella enterica enterica serovar Typhi Ty2
agacagauaacaccagcgau

SEQ ID NO: 3696998 - RNA, 14 nt, Salmonella enterica enterica serovar Typhi Ty2
agacagaucgguuu

SEQ ID NO: 3696999 - RNA, 16 nt, Salmonella enterica enterica serovar Typhi Ty2
agacagauuuggucag

SEQ ID NO: 3697000 - RNA, 16 nt, Salmonella enterica enterica serovar Typhi Ty2
agacaggacgccagcg

SEQ ID NO: 3697001 - RNA, 22 nt, Salmonella enterica enterica serovar Typhi Ty2
agacaggugaacauuacaaugu

SEQ ID NO: 3697002 - RNA, 15 nt, Salmonella enterica enterica serovar Typhi Ty2
agacaguacggauga

SEQ ID NO: 3697003 - RNA, 15 nt, Salmonella enterica enterica serovar Typhi Ty2
agacauauuuucucu

SEQ ID NO: 3697004 - RNA, 23 nt, Salmonella enterica enterica serovar Typhi Ty2
agacaucgauuagaccguaaauc

SEQ ID NO: 3697005 - RNA, 21 nt, Salmonella enterica enterica serovar Typhi Ty2
agacaucggagauuucauccu

SEQ ID NO: 3697006 - RNA, 19 nt, Salmonella enterica enterica serovar Typhi Ty2
agacaugaccgcacagcag

SEQ ID NO: 3697007 - RNA, 16 nt, Salmonella enterica enterica serovar Typhi Ty2
agacaugaucuuaccu

SEQ ID NO: 3697008 - RNA, 15 nt, Salmonella enterica enterica serovar Typhi Ty2
agacauuauugucuu

SEQ ID NO: 3697009 - RNA, 15 nt, Salmonella enterica enterica serovar Typhi Ty2
agacauucgcgcacg

SEQ ID NO: 3697010 - RNA, 16 nt, Salmonella enterica enterica serovar Typhi Ty2
agacuucuucagucag

SEQ ID NO: 3697011 - RNA, 20 nt, Salmonella enterica enterica serovar Typhi Ty2
agacuucuuccauacgacca

SEQ ID NO: 3697012 - RNA, 20 nt, Salmonella enterica enterica serovar Typhi Ty2
agacuuuagauggcguaucg

SEQ ID NO: 3697013 - RNA, 16 nt, Salmonella enterica enterica serovar Typhi Ty2
agacuuuccagcacga

SEQ ID NO: 3697014 - RNA, 18 nt, Salmonella enterica enterica serovar Typhi Ty2
agacuuugcacagucugc

SEQ ID NO: 3697015 - RNA, 21 nt, Salmonella enterica enterica serovar Typhi Ty2
agacuuuggauaaagccaaug

SEQ ID NO: 3697016 - RNA, 12 nt, Salmonella enterica enterica serovar Typhi Ty2
agagaaaaaaau

SEQ ID NO: 3697017 - RNA, 21 nt, Salmonella enterica enterica serovar Typhi Ty2
agagaaaaccccguacaggac

SEQ ID NO: 3697018 - RNA, 18 nt, Salmonella enterica enterica serovar Typhi Ty2
agagaaaauaacaauauu

SEQ ID NO: 3697019 - RNA, 12 nt, Salmonella enterica enterica serovar Typhi Ty2
agagaacagcau

SEQ ID NO: 3697020 - RNA, 21 nt, Salmonella enterica enterica serovar Typhi Ty2
agagaaccaacgcauaaaaac

SEQ ID NO: 3697021 - RNA, 15 nt, Salmonella enterica enterica serovar Typhi Ty2
agagaaccaacguca

SEQ ID NO: 3697022 - RNA, 16 nt, Salmonella enterica enterica serovar Typhi Ty2
agagaaccugaacaau

SEQ ID NO: 3697023 - RNA, 18 nt, Salmonella enterica enterica serovar Typhi Ty2
agagaaccugaacaauaa

SEQ ID NO: 3697024 - RNA, 23 nt, Salmonella enterica enterica serovar Typhi Ty2
agagaacgacgcauaaaaaauga

SEQ ID NO: 3697025 - RNA, 22 nt, Salmonella enterica enterica serovar Typhi Ty2
agagaacguugccgcaggcaac

SEQ ID NO: 3697026 - RNA, 23 nt, Salmonella enterica enterica serovar Typhi Ty2
agagaacguugccgcaggcaacg

SEQ ID NO: 3697027 - RNA, 15 nt, Salmonella enterica enterica serovar Typhi Ty2
agagaauaacgauga

SEQ ID NO: 3697028 - RNA, 16 nt, Salmonella enterica enterica serovar Typhi Ty2
agagaauuaacagcgc

SEQ ID NO: 3697029 - RNA, 22 nt, Salmonella enterica enterica serovar Typhi Ty2
agagacggcgacaguugauauu

SEQ ID NO: 3697030 - RNA, 15 nt, Salmonella enterica enterica serovar Typhi Ty2
agagagaaucggguc

SEQ ID NO: 3697031 - RNA, 16 nt, Salmonella enterica enterica serovar Typhi Ty2
agagagccuuacaggc

SEQ ID NO: 3697032 - RNA, 19 nt, Salmonella enterica enterica serovar Typhi Ty2
agagagcgccaaaaagaaa

SEQ ID NO: 3697033 - RNA, 13 nt, Salmonella enterica enterica serovar Typhi Ty2
agagaguaaaacc

SEQ ID NO: 3697034 - RNA, 18 nt, Salmonella enterica enterica serovar Typhi Ty2
agagaguuccuccuggcu

SEQ ID NO: 3697035 - RNA, 20 nt, Salmonella enterica enterica serovar Typhi Ty2
agagaguucguuaaucucaa

SEQ ID NO: 3697036 - RNA, 18 nt, Salmonella enterica enterica serovar Typhi Ty2
agagauggaacaucuuuu

SEQ ID NO: 3697037 - RNA, 20 nt, Salmonella enterica enterica serovar Typhi Ty2
agagauucgccguucuguuc

SEQ ID NO: 3697038 - RNA, 23 nt, Salmonella enterica enterica serovar Typhi Ty2
agagcaaauacuggaaaaaacgg

SEQ ID NO: 3697039 - RNA, 22 nt, Salmonella enterica enterica serovar Typhi Ty2
agagcaacgccaucagcaaaau

SEQ ID NO: 3697040 - RNA, 19 nt, Salmonella enterica enterica serovar Typhi Ty2
agagcagcgccagcgacag

SEQ ID NO: 3697041 - RNA, 16 nt, Salmonella enterica enterica serovar Typhi Ty2
agagcauaugcgcugc

SEQ ID NO: 3697042 - RNA, 18 nt, Salmonella enterica enterica serovar Typhi Ty2
agagcauaugcgcugcga

SEQ ID NO: 3697043 - RNA, 17 nt, Salmonella enterica enterica serovar Typhi Ty2
agagcaucaauggugaa

SEQ ID NO: 3697044 - RNA, 14 nt, Salmonella enterica enterica serovar Typhi Ty2
agagcaucaucugc

SEQ ID NO: 3697045 - RNA, 22 nt, Salmonella enterica enterica serovar Typhi Ty2
agagccagacgguuaagccggu

SEQ ID NO: 3697046 - RNA, 23 nt, Salmonella enterica enterica serovar Typhi Ty2
agagccgcgcagcgcaacgccuu

SEQ ID NO: 3697047 - RNA, 18 nt, Salmonella enterica enterica serovar Typhi Ty2
agagccggaaccuguccu

SEQ ID NO: 3697048 - RNA, 21 nt, Salmonella enterica enterica serovar Typhi Ty2
agagccuaucccauuagggcu

SEQ ID NO: 3697049 - RNA, 15 nt, Salmonella enterica enterica serovar Typhi Ty2
agagccuuacaggcg

SEQ ID NO: 3697050 - RNA, 22 nt, Salmonella enterica enterica serovar Typhi Ty2
agagcgaacaguacggucaggc

SEQ ID NO: 3697051 - RNA, 17 nt, Salmonella enterica enterica serovar Typhi Ty2
agagcgaaugcgcgcca

SEQ ID NO: 3697052 - RNA, 13 nt, Salmonella enterica enterica serovar Typhi Ty2
agagcgccaaaaa

SEQ ID NO: 3697053 - RNA, 21 nt, Salmonella enterica enterica serovar Typhi Ty2
agagcgcgcucugccuuuuuu

SEQ ID NO: 3697054 - RNA, 23 nt, Salmonella enterica enterica serovar Typhi Ty2
agagcggauaagcgcagcgccau

SEQ ID NO: 3697055 - RNA, 20 nt, Salmonella enterica enterica serovar Typhi Ty2
agagcgggccguggccagga

SEQ ID NO: 3697056 - RNA, 13 nt, Salmonella enterica enterica serovar Typhi Ty2
agagcguauccag

SEQ ID NO: 3697057 - RNA, 15 nt, Salmonella enterica enterica serovar Typhi Ty2
agagcguauccagca

SEQ ID NO: 3697058 - RNA, 16 nt, Salmonella enterica enterica serovar Typhi Ty2
agagcguggucauuag

SEQ ID NO: 3697059 - RNA, 19 nt, Salmonella enterica enterica serovar Typhi Ty2
agagcuaaucaauaaguuu

SEQ ID NO: 3697060 - RNA, 17 nt, Salmonella enterica enterica serovar Typhi Ty2
agagcucgaccaacaua

SEQ ID NO: 3697061 - RNA, 13 nt, Salmonella enterica enterica serovar Typhi Ty2
agagcugaaaaug

SEQ ID NO: 3697062 - RNA, 16 nt, Salmonella enterica enterica serovar Typhi Ty2
agagcuuauuuugacu

SEQ ID NO: 3697063 - RNA, 17 nt, Salmonella enterica enterica serovar Typhi Ty2
agagcuugauaaauauc

SEQ ID NO: 3697064 - RNA, 16 nt, Salmonella enterica enterica serovar Typhi Ty2
agaggacacguuaauu

SEQ ID NO: 3697065 - RNA, 19 nt, Salmonella enterica enterica serovar Typhi Ty2
agaggaggagaugucccac

SEQ ID NO: 3697066 - RNA, 11 nt, Salmonella enterica enterica serovar Typhi Ty2
agaggcagcaa

SEQ ID NO: 3697067 - RNA, 15 nt, Salmonella enterica enterica serovar Typhi Ty2
agaggcagcaaagcu

SEQ ID NO: 3697068 - RNA, 20 nt, Salmonella enterica enterica serovar Typhi Ty2
agaggcauaaaaaaaagccg

SEQ ID NO: 3697069 - RNA, 18 nt, Salmonella enterica enterica serovar Typhi Ty2
agaggccaccagcgccag

SEQ ID NO: 3697070 - RNA, 18 nt, Salmonella enterica enterica serovar Typhi Ty2
agaggcgccuggcaccau

SEQ ID NO: 3697071 - RNA, 18 nt, Salmonella enterica enterica serovar Typhi Ty2
agaggcguugccgggcau

SEQ ID NO: 3697072 - RNA, 19 nt, Salmonella enterica enterica serovar Typhi Ty2
agagguauccugaaccagc

SEQ ID NO: 3697073 - RNA, 22 nt, Salmonella enterica enterica serovar Typhi Ty2
agaggucugcauucaggccucu

SEQ ID NO: 3697074 - RNA, 18 nt, Salmonella enterica enterica serovar Typhi Ty2
agagguguaguuggcgau

SEQ ID NO: 3697075 - RNA, 18 nt, Salmonella enterica enterica serovar Typhi Ty2
agagguguuauggcaggc

SEQ ID NO: 3697076 - RNA, 22 nt, Salmonella enterica enterica serovar Typhi Ty2
agagguuaccgggcuaaaccac

SEQ ID NO: 3697077 - RNA, 18 nt, Salmonella enterica enterica serovar Typhi Ty2
agaguaaaaccggcacau

SEQ ID NO: 3697078 - RNA, 13 nt, Salmonella enterica enterica serovar Typhi Ty2
agaguaacccuuu

SEQ ID NO: 3697079 - RNA, 21 nt, Salmonella enterica enterica serovar Typhi Ty2
agaguaaucguauucauugcc

SEQ ID NO: 3697080 - RNA, 22 nt, Salmonella enterica enterica serovar Typhi Ty2
agaguaaucguauucauugccg

SEQ ID NO: 3697081 - RNA, 16 nt, Salmonella enterica enterica serovar Typhi Ty2
agaguaggccggauaa

SEQ ID NO: 3697082 - RNA, 18 nt, Salmonella enterica enterica serovar Typhi Ty2
agaguauaagcgccgcug

SEQ ID NO: 3697083 - RNA, 13 nt, Salmonella enterica enterica serovar Typhi Ty2
agaguccagccau

SEQ ID NO: 3697084 - RNA, 17 nt, Salmonella enterica enterica serovar Typhi Ty2
agaguccagcgccagcg

SEQ ID NO: 3697085 - RNA, 22 nt, Salmonella enterica enterica serovar Typhi Ty2
agaguccauucggccugcggug

SEQ ID NO: 3697086 - RNA, 10 nt, Salmonella enterica enterica serovar Typhi Ty2
agagucgcca

SEQ ID NO: 3697087 - RNA, 18 nt, Salmonella enterica enterica serovar Typhi Ty2
agagugacgguuuucacu

SEQ ID NO: 3697088 - RNA, 20 nt, Salmonella enterica enterica serovar Typhi Ty2
agagugacgguuuucacugg

SEQ ID NO: 3697089 - RNA, 22 nt, Salmonella enterica enterica serovar Typhi Ty2
agagugagcaggcuaugggaua

SEQ ID NO: 3697090 - RNA, 16 nt, Salmonella enterica enterica serovar Typhi Ty2
agaguguccauaaagu

SEQ ID NO: 3697091 - RNA, 24 nt, Salmonella enterica enterica serovar Typhi Ty2
agaguucauaacgcacaacgucag

SEQ ID NO: 3697092 - RNA, 21 nt, Salmonella enterica enterica serovar Typhi Ty2
agcaauuucagcauccuccgg

SEQ ID NO: 3697093 - RNA, 23 nt, Salmonella enterica enterica serovar Typhi Ty2
agcaauuucucgcccgccagauc

SEQ ID NO: 3697094 - RNA, 21 nt, Salmonella enterica enterica serovar Typhi Ty2
agcacaaagaauucuucugug

SEQ ID NO: 3697095 - RNA, 18 nt, Salmonella enterica enterica serovar Typhi Ty2
agcacaacgaguccccuc

SEQ ID NO: 3697096 - RNA, 21 nt, Salmonella enterica enterica serovar Typhi Ty2
agcacaagaacuuaaauuaau

SEQ ID NO: 3697097 - RNA, 15 nt, Salmonella enterica enterica serovar Typhi Ty2
agcacaccauuucac

SEQ ID NO: 3697098 - RNA, 19 nt, Salmonella enterica enterica serovar Typhi Ty2
agcacaccauuucacaaau

SEQ ID NO: 3697099 - RNA, 17 nt, Salmonella enterica enterica serovar Typhi Ty2
agcacagcccaguaaua

SEQ ID NO: 3697100 - RNA, 12 nt, Salmonella enterica enterica serovar Typhi Ty2
agcacaggccau

SEQ ID NO: 3697101 - RNA, 21 nt, Salmonella enterica enterica serovar Typhi Ty2
agcacaucacucauaaugaug

SEQ ID NO: 3697102 - RNA, 12 nt, Salmonella enterica enterica serovar Typhi Ty2
agcacauccaug

SEQ ID NO: 3697103 - RNA, 15 nt, Salmonella enterica enterica serovar Typhi Ty2
agcacaugcagauau

SEQ ID NO: 3697104 - RNA, 20 nt, Salmonella enterica enterica serovar Typhi Ty2
agcacauuaagcauggcguu

SEQ ID NO: 3697105 - RNA, 19 nt, Salmonella enterica enterica serovar Typhi Ty2
agcacauucgauaaccgcc

SEQ ID NO: 3697106 - RNA, 13 nt, Salmonella enterica enterica serovar Typhi Ty2
agcaccagaccga

SEQ ID NO: 3697107 - RNA, 18 nt, Salmonella enterica enterica serovar Typhi Ty2
agcaccagaccgacaagc

SEQ ID NO: 3697108 - RNA, 13 nt, Salmonella enterica enterica serovar Typhi Ty2
agcaccagcagug

SEQ ID NO: 3697109 - RNA, 13 nt, Salmonella enterica enterica serovar Typhi Ty2
agcaccaggccaa

SEQ ID NO: 3697110 - RNA, 12 nt, Salmonella enterica enterica serovar Typhi Ty2
agcaccaucaug

SEQ ID NO: 3697111 - RNA, 16 nt, Salmonella enterica enterica serovar Typhi Ty2
agcaccauucuucaac

SEQ ID NO: 3697112 - RNA, 14 nt, Salmonella enterica enterica serovar Typhi Ty2
agcaccauuucgcc

SEQ ID NO: 3697113 - RNA, 16 nt, Salmonella enterica enterica serovar Typhi Ty2
agcacccggcccggcg

SEQ ID NO: 3697114 - RNA, 15 nt, Salmonella enterica enterica serovar Typhi Ty2
agcaccgccagcgcc

SEQ ID NO: 3697115 - RNA, 16 nt, Salmonella enterica enterica serovar Typhi Ty2
agcaccgccgggaaga

SEQ ID NO: 3697116 - RNA, 21 nt, Salmonella enterica enterica serovar Typhi Ty2
agcaccgccgggaagaaauua

SEQ ID NO: 3697117 - RNA, 20 nt, Salmonella enterica enterica serovar Typhi Ty2
agcaccggauacaagguauc

SEQ ID NO: 3697118 - RNA, 20 nt, Salmonella enterica enterica serovar Typhi Ty2
agcaccucaucgcuaccuuc

SEQ ID NO: 3697119 - RNA, 13 nt, Salmonella enterica enterica serovar Typhi Ty2
agcaccuccagcg

SEQ ID NO: 3697120 - RNA, 20 nt, Salmonella enterica enterica serovar Typhi Ty2
agcaccuggcggagcugcgc

SEQ ID NO: 3697121 - RNA, 13 nt, Salmonella enterica enterica serovar Typhi Ty2
agcacgacacaaa

SEQ ID NO: 3697122 - RNA, 19 nt, Salmonella enterica enterica serovar Typhi Ty2
agcacgaccuuuucuucau

SEQ ID NO: 3697123 - RNA, 15 nt, Salmonella enterica enterica serovar Typhi Ty2
agcacgaggguaaug

SEQ ID NO: 3697124 - RNA, 15 nt, Salmonella enterica enterica serovar Typhi Ty2
agcacgcccugccau

SEQ ID NO: 3697125 - RNA, 19 nt, Salmonella enterica enterica serovar Typhi Ty2
agcacggcaguacacgcau

SEQ ID NO: 3697126 - RNA, 19 nt, Salmonella enterica enterica serovar Typhi Ty2
agcacggggguuuugugau

SEQ ID NO: 3697127 - RNA, 19 nt, Salmonella enterica enterica serovar Typhi Ty2
agcacgguaaaccucuuug

SEQ ID NO: 3697128 - RNA, 24 nt, Salmonella enterica enterica serovar Typhi Ty2
agcacguagcuuauaaaucagcuu

SEQ ID NO: 3697129 - RNA, 16 nt, Salmonella enterica enterica serovar Typhi Ty2
agcacuaacagcagca

SEQ ID NO: 3697130 - RNA, 18 nt, Salmonella enterica enterica serovar Typhi Ty2
agcacuccccggcuugcg

SEQ ID NO: 3697131 - RNA, 15 nt, Salmonella enterica enterica serovar Typhi Ty2
agcacucggcgccuu

SEQ ID NO: 3697132 - RNA, 18 nt, Salmonella enterica enterica serovar Typhi Ty2
agcacuucacccaucgcc

SEQ ID NO: 3697133 - RNA, 22 nt, Salmonella enterica enterica serovar Typhi Ty2
agcacuucgcugauaccgcccu

SEQ ID NO: 3697134 - RNA, 16 nt, Salmonella enterica enterica serovar Typhi Ty2
agcacuuugguaaaac

SEQ ID NO: 3697135 - RNA, 15 nt, Salmonella enterica enterica serovar Typhi Ty2
agcacuuuuuccucc

SEQ ID NO: 3697136 - RNA, 14 nt, Salmonella enterica enterica serovar Typhi Ty2
agcagaaagcaaca

SEQ ID NO: 3697137 - RNA, 19 nt, Salmonella enterica enterica serovar Typhi Ty2
agcagaaagcaacagcaag

SEQ ID NO: 3697138 - RNA, 23 nt, Salmonella enterica enterica serovar Typhi Ty2
agcagaacguagcccauugucau

SEQ ID NO: 3697139 - RNA, 16 nt, Salmonella enterica enterica serovar Typhi Ty2
agcagaagacggaaac

SEQ ID NO: 3697140 - RNA, 20 nt, Salmonella enterica enterica serovar Typhi Ty2
agcagaagacggaaaccaga

SEQ ID NO: 3697141 - RNA, 14 nt, Salmonella enterica enterica serovar Typhi Ty2
agcagacaggugaa

SEQ ID NO: 3697142 - RNA, 19 nt, Salmonella enterica enterica serovar Typhi Ty2
agcagaccgguacgcgcgu

SEQ ID NO: 3697143 - RNA, 13 nt, Salmonella enterica enterica serovar Typhi Ty2
agcagacguuggu

SEQ ID NO: 3697144 - RNA, 20 nt, Salmonella enterica enterica serovar Typhi Ty2
agcagacucauggacaaaaa

SEQ ID NO: 3697145 - RNA, 15 nt, Salmonella enterica enterica serovar Typhi Ty2
agcagauacugcgcg

SEQ ID NO: 3697146 - RNA, 20 nt, Salmonella enterica enterica serovar Typhi Ty2
agcagauagcccgccagcac

SEQ ID NO: 3697147 - RNA, 19 nt, Salmonella enterica enterica serovar Typhi Ty2
agcagauuuuuauccgucg

SEQ ID NO: 3697148 - RNA, 17 nt, Salmonella enterica enterica serovar Typhi Ty2
agcagcaacccugccgu

SEQ ID NO: 3697149 - RNA, 14 nt, Salmonella enterica enterica serovar Typhi Ty2
agcagcaccggcug

SEQ ID NO: 3697150 - RNA, 10 nt, Salmonella enterica enterica serovar Typhi Ty2
agcagcagaa

SEQ ID NO: 3697151 - RNA, 16 nt, Salmonella enterica enterica serovar Typhi Ty2
agcagcagagccggaa

SEQ ID NO: 3697152 - RNA, 16 nt, Salmonella enterica enterica serovar Typhi Ty2
agcagcagcagcgcuu

SEQ ID NO: 3697153 - RNA, 13 nt, Salmonella enterica enterica serovar Typhi Ty2
agcagcagccggu

SEQ ID NO: 3697154 - RNA, 13 nt, Salmonella enterica enterica serovar Typhi Ty2
agcagcagcgcaa

SEQ ID NO: 3697155 - RNA, 14 nt, Salmonella enterica enterica serovar Typhi Ty2
agcagcaggcugga

SEQ ID NO: 3697156 - RNA, 15 nt, Salmonella enterica enterica serovar Typhi Ty2
agcagcagugaggau

SEQ ID NO: 3697157 - RNA, 17 nt, Salmonella enterica enterica serovar Typhi Ty2
agcagcagugaggauaa

SEQ ID NO: 3697158 - RNA, 19 nt, Salmonella enterica enterica serovar Typhi Ty2
agcagcauaaacaucagcg

SEQ ID NO: 3697159 - RNA, 23 nt, Salmonella enterica enterica serovar Typhi Ty2
agcagcauaaacaucagcgcgga

SEQ ID NO: 3697160 - RNA, 18 nt, Salmonella enterica enterica serovar Typhi Ty2
agcagccagaaaaaggga

SEQ ID NO: 3697161 - RNA, 16 nt, Salmonella enterica enterica serovar Typhi Ty2
agcagccagacccgcg

SEQ ID NO: 3697162 - RNA, 19 nt, Salmonella enterica enterica serovar Typhi Ty2
agcagcgaggugauaauca

SEQ ID NO: 3697163 - RNA, 19 nt, Salmonella enterica enterica serovar Typhi Ty2
agcagcgaugacagcagga

SEQ ID NO: 3697164 - RNA, 12 nt, Salmonella enterica enterica serovar Typhi Ty2
agcagcgcauca

SEQ ID NO: 3697165 - RNA, 16 nt, Salmonella enterica enterica serovar Typhi Ty2
agcagcgccagcgaca

SEQ ID NO: 3697166 - RNA, 23 nt, Salmonella enterica enterica serovar Typhi Ty2
agcagcggcgguuauccgccagc

SEQ ID NO: 3697167 - RNA, 17 nt, Salmonella enterica enterica serovar Typhi Ty2
agcagcggcguaucuuc

SEQ ID NO: 3697168 - RNA, 18 nt, Salmonella enterica enterica serovar Typhi Ty2
agcagcggcguaucuucc

SEQ ID NO: 3697169 - RNA, 18 nt, Salmonella enterica enterica serovar Typhi Ty2
agcagcguuuugcgcgua

SEQ ID NO: 3697170 - RNA, 13 nt, Salmonella enterica enterica serovar Typhi Ty2
agcagcuccgaaa

SEQ ID NO: 3697171 - RNA, 20 nt, Salmonella enterica enterica serovar Typhi Ty2
agcagcuuaucuuuacgcuu

SEQ ID NO: 3697172 - RNA, 23 nt, Salmonella enterica enterica serovar Typhi Ty2
agcaggaaaagaccauccgguuu

SEQ ID NO: 3697173 - RNA, 22 nt, Salmonella enterica enterica serovar Typhi Ty2
agcaggaucuccagaucgccac

SEQ ID NO: 3697174 - RNA, 23 nt, Salmonella enterica enterica serovar Typhi Ty2
agccacgcaagcagcacacgccu

SEQ ID NO: 3697175 - RNA, 22 nt, Salmonella enterica enterica serovar Typhi Ty2
agccacggcguguugaaauccu

SEQ ID NO: 3697176 - RNA, 16 nt, Salmonella enterica enterica serovar Typhi Ty2
agccacguaaagacga

SEQ ID NO: 3697177 - RNA, 19 nt, Salmonella enterica enterica serovar Typhi Ty2
agccacgucugaugcgugg

SEQ ID NO: 3697178 - RNA, 15 nt, Salmonella enterica enterica serovar Typhi Ty2
agccacguucuucca

SEQ ID NO: 3697179 - RNA, 18 nt, Salmonella enterica enterica serovar Typhi Ty2
agccacguucuuccagaa

SEQ ID NO: 3697180 - RNA, 14 nt, Salmonella enterica enterica serovar Typhi Ty2
agccacucacggca

SEQ ID NO: 3697181 - RNA, 22 nt, Salmonella enterica enterica serovar Typhi Ty2
agccacuuaccaaucgcggcga

SEQ ID NO: 3697182 - RNA, 23 nt, Salmonella enterica enterica serovar Typhi Ty2
agccacuucaugcgcuuuuucac

SEQ ID NO: 3697183 - RNA, 23 nt, Salmonella enterica enterica serovar Typhi Ty2
agccagaaaaagggaaaagccau

SEQ ID NO: 3697184 - RNA, 20 nt, Salmonella enterica enterica serovar Typhi Ty2
agccagaacgagaggaggag

SEQ ID NO: 3697185 - RNA, 15 nt, Salmonella enterica enterica serovar Typhi Ty2
agccagaacucaucu

SEQ ID NO: 3697186 - RNA, 16 nt, Salmonella enterica enterica serovar Typhi Ty2
agccagaacucaucuu

SEQ ID NO: 3697187 - RNA, 13 nt, Salmonella enterica enterica serovar Typhi Ty2
agccagaagccug

SEQ ID NO: 3697188 - RNA, 13 nt, Salmonella enterica enterica serovar Typhi Ty2
agccagacaucac

SEQ ID NO: 3697189 - RNA, 18 nt, Salmonella enterica enterica serovar Typhi Ty2
agccagacgccagccacu

SEQ ID NO: 3697190 - RNA, 19 nt, Salmonella enterica enterica serovar Typhi Ty2
agccagacgcgcagcaccg

SEQ ID NO: 3697191 - RNA, 20 nt, Salmonella enterica enterica serovar Typhi Ty2
agccagacggcgcccagccu

SEQ ID NO: 3697192 - RNA, 23 nt, Salmonella enterica enterica serovar Typhi Ty2
agccagacggcgcccagccugcc

SEQ ID NO: 3697193 - RNA, 19 nt, Salmonella enterica enterica serovar Typhi Ty2
agccagagauccacauugg

SEQ ID NO: 3697194 - RNA, 14 nt, Salmonella enterica enterica serovar Typhi Ty2
agccagagcgcgcu

SEQ ID NO: 3697195 - RNA, 14 nt, Salmonella enterica enterica serovar Typhi Ty2
agccagauaaagca

SEQ ID NO: 3697196 - RNA, 18 nt, Salmonella enterica enterica serovar Typhi Ty2
agccagauaaagcagcga

SEQ ID NO: 3697197 - RNA, 18 nt, Salmonella enterica enterica serovar Typhi Ty2
agccagauguaaucugac

SEQ ID NO: 3697198 - RNA, 15 nt, Salmonella enterica enterica serovar Typhi Ty2
agccagcagcucaac

SEQ ID NO: 3697199 - RNA, 15 nt, Salmonella enterica enterica serovar Typhi Ty2
agccagcaucgcuaa

SEQ ID NO: 3697200 - RNA, 16 nt, Salmonella enterica enterica serovar Typhi Ty2
agccagccauggcccu

SEQ ID NO: 3697201 - RNA, 20 nt, Salmonella enterica enterica serovar Typhi Ty2
agccagcccuaaggucacgc

SEQ ID NO: 3697202 - RNA, 15 nt, Salmonella enterica enterica serovar Typhi Ty2
agccagcccucaaca

SEQ ID NO: 3697203 - RNA, 22 nt, Salmonella enterica enterica serovar Typhi Ty2
agccagccguugugcugguuga

SEQ ID NO: 3697204 - RNA, 15 nt, Salmonella enterica enterica serovar Typhi Ty2
agccagcgcagucaa

SEQ ID NO: 3697205 - RNA, 19 nt, Salmonella enterica enterica serovar Typhi Ty2
agccagcgggcgcagucca

SEQ ID NO: 3697206 - RNA, 18 nt, Salmonella enterica enterica serovar Typhi Ty2
agccagcguuucuggaag

SEQ ID NO: 3697207 - RNA, 20 nt, Salmonella enterica enterica serovar Typhi Ty2
agccagcucaccagccaaau

SEQ ID NO: 3697208 - RNA, 20 nt, Salmonella enterica enterica serovar Typhi Ty2
agccaggcccgguggcgcca

SEQ ID NO: 3697209 - RNA, 13 nt, Salmonella enterica enterica serovar Typhi Ty2
agccaggccgcca

SEQ ID NO: 3697210 - RNA, 14 nt, Salmonella enterica enterica serovar Typhi Ty2
agccaggccgccag

SEQ ID NO: 3697211 - RNA, 17 nt, Salmonella enterica enterica serovar Typhi Ty2
agccaggcgauugucac

SEQ ID NO: 3697212 - RNA, 22 nt, Salmonella enterica enterica serovar Typhi Ty2
agccagguauuuagccacgccg

SEQ ID NO: 3697213 - RNA, 19 nt, Salmonella enterica enterica serovar Typhi Ty2
agccagguggcaauauccu

SEQ ID NO: 3697214 - RNA, 20 nt, Salmonella enterica enterica serovar Typhi Ty2
agccagguugcgcccggcgc

SEQ ID NO: 3697215 - RNA, 18 nt, Salmonella enterica enterica serovar Typhi Ty2
agccagucgccaggcaag

SEQ ID NO: 3697216 - RNA, 15 nt, Salmonella enterica enterica serovar Typhi Ty2
agccauauggcauuc

SEQ ID NO: 3697217 - RNA, 14 nt, Salmonella enterica enterica serovar Typhi Ty2
agccaucccggcga

SEQ ID NO: 3697218 - RNA, 14 nt, Salmonella enterica enterica serovar Typhi Ty2
agccauggcccaaa

SEQ ID NO: 3697219 - RNA, 17 nt, Salmonella enterica enterica serovar Typhi Ty2
agccauuaaugcaggca

SEQ ID NO: 3697220 - RNA, 20 nt, Salmonella enterica enterica serovar Typhi Ty2
agccauuccccacgccaucg

SEQ ID NO: 3697221 - RNA, 14 nt, Salmonella enterica enterica serovar Typhi Ty2
agccauucggcugc

SEQ ID NO: 3697222 - RNA, 23 nt, Salmonella enterica enterica serovar Typhi Ty2
agccauugcugcuauauaacaua

SEQ ID NO: 3697223 - RNA, 19 nt, Salmonella enterica enterica serovar Typhi Ty2
agcccaauaucccuauuag

SEQ ID NO: 3697224 - RNA, 23 nt, Salmonella enterica enterica serovar Typhi Ty2
agcccacuggcaaguaugaaaag

SEQ ID NO: 3697225 - RNA, 18 nt, Salmonella enterica enterica serovar Typhi Ty2
agcccagguagaauccca

SEQ ID NO: 3697226 - RNA, 15 nt, Salmonella enterica enterica serovar Typhi Ty2
agcccauaaagcacu

SEQ ID NO: 3697227 - RNA, 14 nt, Salmonella enterica enterica serovar Typhi Ty2
agcccaucagcgcc

SEQ ID NO: 3697228 - RNA, 17 nt, Salmonella enterica enterica serovar Typhi Ty2
agcccaucagcgccagc

SEQ ID NO: 3697229 - RNA, 20 nt, Salmonella enterica enterica serovar Typhi Ty2
agcccaucagcgccagcccu

SEQ ID NO: 3697230 - RNA, 17 nt, Salmonella enterica enterica serovar Typhi Ty2
agcccauggcaggcagc

SEQ ID NO: 3697231 - RNA, 21 nt, Salmonella enterica enterica serovar Typhi Ty2
agcccauggcaggcagcacaa

SEQ ID NO: 3697232 - RNA, 14 nt, Salmonella enterica enterica serovar Typhi Ty2
agccccacgguacg

SEQ ID NO: 3697233 - RNA, 21 nt, Salmonella enterica enterica serovar Typhi Ty2
agccccagcaccaacgccgcu

SEQ ID NO: 3697234 - RNA, 12 nt, Salmonella enterica enterica serovar Typhi Ty2
agccccagcgcc

SEQ ID NO: 3697235 - RNA, 15 nt, Salmonella enterica enterica serovar Typhi Ty2
agccccagcgccagc

SEQ ID NO: 3697236 - RNA, 18 nt, Salmonella enterica enterica serovar Typhi Ty2
agccccagcgccagcgac

SEQ ID NO: 3697237 - RNA, 13 nt, Salmonella enterica enterica serovar Typhi Ty2
agccccccgcaca

SEQ ID NO: 3697238 - RNA, 23 nt, Salmonella enterica enterica serovar Typhi Ty2
agccccccuuugcauuacggcga

SEQ ID NO: 3697239 - RNA, 22 nt, Salmonella enterica enterica serovar Typhi Ty2
agccccgaaagucaucugccag

SEQ ID NO: 3697240 - RNA, 14 nt, Salmonella enterica enterica serovar Typhi Ty2
agccccgaugucgc

SEQ ID NO: 3697241 - RNA, 17 nt, Salmonella enterica enterica serovar Typhi Ty2
agccccggucaacgcgc

SEQ ID NO: 3697242 - RNA, 16 nt, Salmonella enterica enterica serovar Typhi Ty2
agccccugaaauaaca

SEQ ID NO: 3697243 - RNA, 15 nt, Salmonella enterica enterica serovar Typhi Ty2
agccccugacgcugc

SEQ ID NO: 3697244 - RNA, 16 nt, Salmonella enterica enterica serovar Typhi Ty2
agcccgcccacaggcu

SEQ ID NO: 3697245 - RNA, 15 nt, Salmonella enterica enterica serovar Typhi Ty2
agcccgcccagcauu

SEQ ID NO: 3697246 - RNA, 17 nt, Salmonella enterica enterica serovar Typhi Ty2
agcccggccacagcgcc

SEQ ID NO: 3697247 - RNA, 18 nt, Salmonella enterica enterica serovar Typhi Ty2
agcccggccacagcgcca

SEQ ID NO: 3697248 - RNA, 22 nt, Salmonella enterica enterica serovar Typhi Ty2
agcccggccacagcgccagaca

SEQ ID NO: 3697249 - RNA, 17 nt, Salmonella enterica enterica serovar Typhi Ty2
agcccggcggcgcaucg

SEQ ID NO: 3697250 - RNA, 15 nt, Salmonella enterica enterica serovar Typhi Ty2
agcccggcuucccau

SEQ ID NO: 3697251 - RNA, 16 nt, Salmonella enterica enterica serovar Typhi Ty2
agcccgucccuuccgc

SEQ ID NO: 3697252 - RNA, 21 nt, Salmonella enterica enterica serovar Typhi Ty2
agcccgucuuuuuccugcaug

SEQ ID NO: 3697253 - RNA, 17 nt, Salmonella enterica enterica serovar Typhi Ty2
agcccuauaacagcgcu

SEQ ID NO: 3697254 - RNA, 20 nt, Salmonella enterica enterica serovar Typhi Ty2
agcccuauuaggcacuacca

SEQ ID NO: 3697255 - RNA, 13 nt, Salmonella enterica enterica serovar Typhi Ty2
agcccugacagaa

SEQ ID NO: 3697256 - RNA, 16 nt, Salmonella enterica enterica serovar Typhi Ty2
agccugugcaaccagc

SEQ ID NO: 3697257 - RNA, 16 nt, Salmonella enterica enterica serovar Typhi Ty2
agccuguuccagcugc

SEQ ID NO: 3697258 - RNA, 19 nt, Salmonella enterica enterica serovar Typhi Ty2
agccuguuuggacacggac

SEQ ID NO: 3697259 - RNA, 18 nt, Salmonella enterica enterica serovar Typhi Ty2
agccuuaaucaacugcgc

SEQ ID NO: 3697260 - RNA, 22 nt, Salmonella enterica enterica serovar Typhi Ty2
agccuuaaucaacugcgccaca

SEQ ID NO: 3697261 - RNA, 13 nt, Salmonella enterica enterica serovar Typhi Ty2
agccuucaacaaa

SEQ ID NO: 3697262 - RNA, 16 nt, Salmonella enterica enterica serovar Typhi Ty2
agccuucaaguuuuag

SEQ ID NO: 3697263 - RNA, 23 nt, Salmonella enterica enterica serovar Typhi Ty2
agccuucaauuugaccugaccug

SEQ ID NO: 3697264 - RNA, 22 nt, Salmonella enterica enterica serovar Typhi Ty2
agccuucccggggaacagaagc

SEQ ID NO: 3697265 - RNA, 15 nt, Salmonella enterica enterica serovar Typhi Ty2
agccuuccuggucug

SEQ ID NO: 3697266 - RNA, 18 nt, Salmonella enterica enterica serovar Typhi Ty2
agccuuccuggucugcca

SEQ ID NO: 3697267 - RNA, 19 nt, Salmonella enterica enterica serovar Typhi Ty2
agccuuccuggucugccag

SEQ ID NO: 3697268 - RNA, 14 nt, Salmonella enterica enterica serovar Typhi Ty2
agccuuuccgcaug

SEQ ID NO: 3697269 - RNA, 16 nt, Salmonella enterica enterica serovar Typhi Ty2
agcgaaacugauauua

SEQ ID NO: 3697270 - RNA, 21 nt, Salmonella enterica enterica serovar Typhi Ty2
agcgaaaugacggccaccagc

SEQ ID NO: 3697271 - RNA, 15 nt, Salmonella enterica enterica serovar Typhi Ty2
agcgaaaugcgaauc

SEQ ID NO: 3697272 - RNA, 19 nt, Salmonella enterica enterica serovar Typhi Ty2
agcgaaaugcgaauccggc

SEQ ID NO: 3697273 - RNA, 21 nt, Salmonella enterica enterica serovar Typhi Ty2
agcgaacaguguaaacgccag

SEQ ID NO: 3697274 - RNA, 19 nt, Salmonella enterica enterica serovar Typhi Ty2
agcgaacguccagcggcca

SEQ ID NO: 3697275 - RNA, 20 nt, Salmonella enterica enterica serovar Typhi Ty2
agcgaagaagucagugcuga

SEQ ID NO: 3697276 - RNA, 23 nt, Salmonella enterica enterica serovar Typhi Ty2
agcgaagcgucauccggcaauca

SEQ ID NO: 3697277 - RNA, 17 nt, Salmonella enterica enterica serovar Typhi Ty2
agcgaauacuccugcaa

SEQ ID NO: 3697278 - RNA, 19 nt, Salmonella enterica enterica serovar Typhi Ty2
agcgaauccagaucgcccu

SEQ ID NO: 3697279 - RNA, 14 nt, Salmonella enterica enterica serovar Typhi Ty2
agcgaauccagcgc

SEQ ID NO: 3697280 - RNA, 18 nt, Salmonella enterica enterica serovar Typhi Ty2
agcgaaucgaucuggcgc

SEQ ID NO: 3697281 - RNA, 13 nt, Salmonella enterica enterica serovar Typhi Ty2
agcgaaugcugca

SEQ ID NO: 3697282 - RNA, 20 nt, Salmonella enterica enterica serovar Typhi Ty2
agcgaauuccggccaucaga

SEQ ID NO: 3697283 - RNA, 22 nt, Salmonella enterica enterica serovar Typhi Ty2
agcgaauugccgucgccggaau

SEQ ID NO: 3697284 - RNA, 12 nt, Salmonella enterica enterica serovar Typhi Ty2
agcgacaacgcu

SEQ ID NO: 3697285 - RNA, 21 nt, Salmonella enterica enterica serovar Typhi Ty2
agcgacaccugaucuguaggc

SEQ ID NO: 3697286 - RNA, 18 nt, Salmonella enterica enterica serovar Typhi Ty2
agcgacaucgucacaaua

SEQ ID NO: 3697287 - RNA, 20 nt, Salmonella enterica enterica serovar Typhi Ty2
agcgaccggcacucaccucu

SEQ ID NO: 3697288 - RNA, 17 nt, Salmonella enterica enterica serovar Typhi Ty2
agcgaccggcgucauca

SEQ ID NO: 3697289 - RNA, 17 nt, Salmonella enterica enterica serovar Typhi Ty2
agcgaccuuaccggcga

SEQ ID NO: 3697290 - RNA, 11 nt, Salmonella enterica enterica serovar Typhi Ty2
agcgacgcccu

SEQ ID NO: 3697291 - RNA, 12 nt, Salmonella enterica enterica serovar Typhi Ty2
agcgacgcuggc

SEQ ID NO: 3697292 - RNA, 17 nt, Salmonella enterica enterica serovar Typhi Ty2
agcgacgcuggcggccc

SEQ ID NO: 3697293 - RNA, 18 nt, Salmonella enterica enterica serovar Typhi Ty2
agcgacgcugucaaucga

SEQ ID NO: 3697294 - RNA, 15 nt, Salmonella enterica enterica serovar Typhi Ty2
agcgacggcgcgccg

SEQ ID NO: 3697295 - RNA, 14 nt, Salmonella enterica enterica serovar Typhi Ty2
agcgacggcgcugg

SEQ ID NO: 3697296 - RNA, 22 nt, Salmonella enterica enterica serovar Typhi Ty2
agcgacgguuuuauccccuuca

SEQ ID NO: 3697297 - RNA, 21 nt, Salmonella enterica enterica serovar Typhi Ty2
agcgacgucccgucagggcga

SEQ ID NO: 3697298 - RNA, 19 nt, Salmonella enterica enterica serovar Typhi Ty2
agcgacucauucagcaacu

SEQ ID NO: 3697299 - RNA, 23 nt, Salmonella enterica enterica serovar Typhi Ty2
agcgacucuguauuuaauaccug

SEQ ID NO: 3697300 - RNA, 18 nt, Salmonella enterica enterica serovar Typhi Ty2
agcgacuuauccggccua

SEQ ID NO: 3697301 - RNA, 14 nt, Salmonella enterica enterica serovar Typhi Ty2
agcgagacgcugga

SEQ ID NO: 3697302 - RNA, 17 nt, Salmonella enterica enterica serovar Typhi Ty2
agcgagauaaccgggaa

SEQ ID NO: 3697303 - RNA, 19 nt, Salmonella enterica enterica serovar Typhi Ty2
agcgagauaaccgggaaua

SEQ ID NO: 3697304 - RNA, 16 nt, Salmonella enterica enterica serovar Typhi Ty2
agcgagaugaaaaguc

SEQ ID NO: 3697305 - RNA, 22 nt, Salmonella enterica enterica serovar Typhi Ty2
agcgagcgauagagaguuccuc

SEQ ID NO: 3697306 - RNA, 13 nt, Salmonella enterica enterica serovar Typhi Ty2
agcgagcgccuga

SEQ ID NO: 3697307 - RNA, 16 nt, Salmonella enterica enterica serovar Typhi Ty2
agcgagcguagccaac

SEQ ID NO: 3697308 - RNA, 17 nt, Salmonella enterica enterica serovar Typhi Ty2
agcgagcugguuucaau

SEQ ID NO: 3697309 - RNA, 15 nt, Salmonella enterica enterica serovar Typhi Ty2
agcgagguaaaaagc

SEQ ID NO: 3697310 - RNA, 19 nt, Salmonella enterica enterica serovar Typhi Ty2
agcgagguucccgccgcca

SEQ ID NO: 3697311 - RNA, 21 nt, Salmonella enterica enterica serovar Typhi Ty2
agcgaguuacguugcggcgua

SEQ ID NO: 3697312 - RNA, 16 nt, Salmonella enterica enterica serovar Typhi Ty2
agcgauauagcgcaua

SEQ ID NO: 3697313 - RNA, 16 nt, Salmonella enterica enterica serovar Typhi Ty2
agcgaucacgccgucc

SEQ ID NO: 3697314 - RNA, 21 nt, Salmonella enterica enterica serovar Typhi Ty2
agcgauccgccgucggcaaua

SEQ ID NO: 3697315 - RNA, 15 nt, Salmonella enterica enterica serovar Typhi Ty2
agcgaucgagauaag

SEQ ID NO: 3697316 - RNA, 16 nt, Salmonella enterica enterica serovar Typhi Ty2
agcgaugacagcagga

SEQ ID NO: 3697317 - RNA, 22 nt, Salmonella enterica enterica serovar Typhi Ty2
agcgaugagcgccagcaacagc

SEQ ID NO: 3697318 - RNA, 23 nt, Salmonella enterica enterica serovar Typhi Ty2
agcgaugcgguucaacgcgcugc

SEQ ID NO: 3697319 - RNA, 18 nt, Salmonella enterica enterica serovar Typhi Ty2
agcgaugggagagaggac

SEQ ID NO: 3697320 - RNA, 14 nt, Salmonella enterica enterica serovar Typhi Ty2
agcgauuauuucau

SEQ ID NO: 3697321 - RNA, 19 nt, Salmonella enterica enterica serovar Typhi Ty2
agcgauuuuugaucucuuu

SEQ ID NO: 3697322 - RNA, 17 nt, Salmonella enterica enterica serovar Typhi Ty2
agcgcaaaagcgcgccc

SEQ ID NO: 3697323 - RNA, 15 nt, Salmonella enterica enterica serovar Typhi Ty2
agcgcaaacaacccg

SEQ ID NO: 3697324 - RNA, 19 nt, Salmonella enterica enterica serovar Typhi Ty2
agcgcaaauauccuaccac

SEQ ID NO: 3697325 - RNA, 13 nt, Salmonella enterica enterica serovar Typhi Ty2
agcgcaaggccga

SEQ ID NO: 3697326 - RNA, 11 nt, Salmonella enterica enterica serovar Typhi Ty2
agcgcaaugcu

SEQ ID NO: 3697327 - RNA, 22 nt, Salmonella enterica enterica serovar Typhi Ty2
agcgcaccugccccgcucgaaa

SEQ ID NO: 3697328 - RNA, 19 nt, Salmonella enterica enterica serovar Typhi Ty2
agcgcaccuucaacagcuc

SEQ ID NO: 3697329 - RNA, 22 nt, Salmonella enterica enterica serovar Typhi Ty2
agcgcacguuuagcuugcgaag

SEQ ID NO: 3697330 - RNA, 23 nt, Salmonella enterica enterica serovar Typhi Ty2
agcgcacuguuugcugacaaucu

SEQ ID NO: 3697331 - RNA, 13 nt, Salmonella enterica enterica serovar Typhi Ty2
agcgcagcaaaac

SEQ ID NO: 3697332 - RNA, 21 nt, Salmonella enterica enterica serovar Typhi Ty2
agcgcagcgccaccgggcaac

SEQ ID NO: 3697333 - RNA, 13 nt, Salmonella enterica enterica serovar Typhi Ty2
agcgcagcgccau

SEQ ID NO: 3697334 - RNA, 15 nt, Salmonella enterica enterica serovar Typhi Ty2
agcgcagcgccauca

SEQ ID NO: 3697335 - RNA, 20 nt, Salmonella enterica enterica serovar Typhi Ty2
agcgcagcgccaucaggcac

SEQ ID NO: 3697336 - RNA, 15 nt, Salmonella enterica enterica serovar Typhi Ty2
agcgcagcggaaagu

SEQ ID NO: 3697337 - RNA, 18 nt, Salmonella enterica enterica serovar Typhi Ty2
agcgcagcuugguagcgc

SEQ ID NO: 3697338 - RNA, 15 nt, Salmonella enterica enterica serovar Typhi Ty2
agcgcgccgcccugu

SEQ ID NO: 3697339 - RNA, 19 nt, Salmonella enterica enterica serovar Typhi Ty2
agcgcgccgccgcccauaa

SEQ ID NO: 3697340 - RNA, 21 nt, Salmonella enterica enterica serovar Typhi Ty2
agcgcgccggauauggcgucc

SEQ ID NO: 3697341 - RNA, 15 nt, Salmonella enterica enterica serovar Typhi Ty2
agcgcgcgcaguuug

SEQ ID NO: 3697342 - RNA, 13 nt, Salmonella enterica enterica serovar Typhi Ty2
agcgcgcgcgccu

SEQ ID NO: 3697343 - RNA, 21 nt, Salmonella enterica enterica serovar Typhi Ty2
agcgcgcgcgccugaugcgcc

SEQ ID NO: 3697344 - RNA, 16 nt, Salmonella enterica enterica serovar Typhi Ty2
agcgcgcguagcagca

SEQ ID NO: 3697345 - RNA, 16 nt, Salmonella enterica enterica serovar Typhi Ty2
agcgcgcucugccuuu

SEQ ID NO: 3697346 - RNA, 23 nt, Salmonella enterica enterica serovar Typhi Ty2
agcgcggaagccacguucuucca

SEQ ID NO: 3697347 - RNA, 23 nt, Salmonella enterica enterica serovar Typhi Ty2
agcgcggacagcagaauauugcu

SEQ ID NO: 3697348 - RNA, 13 nt, Salmonella enterica enterica serovar Typhi Ty2
agcgcggcaagga

SEQ ID NO: 3697349 - RNA, 19 nt, Salmonella enterica enterica serovar Typhi Ty2
agcgcggcaugaacgcgau

SEQ ID NO: 3697350 - RNA, 15 nt, Salmonella enterica enterica serovar Typhi Ty2
agcgcggccagaaug

SEQ ID NO: 3697351 - RNA, 20 nt, Salmonella enterica enterica serovar Typhi Ty2
agcgcggcgcccauuccgcc

SEQ ID NO: 3697352 - RNA, 23 nt, Salmonella enterica enterica serovar Typhi Ty2
agcgcggcgcccauuccgccugc

SEQ ID NO: 3697353 - RNA, 17 nt, Salmonella enterica enterica serovar Typhi Ty2
agcgcgggccugccugu

SEQ ID NO: 3697354 - RNA, 16 nt, Salmonella enterica enterica serovar Typhi Ty2
agcgcgguggcgcaca

SEQ ID NO: 3697355 - RNA, 19 nt, Salmonella enterica enterica serovar Typhi Ty2
agcgcgguuucuauuaaau

SEQ ID NO: 3697356 - RNA, 17 nt, Salmonella enterica enterica serovar Typhi Ty2
agcgcguaggccagaug

SEQ ID NO: 3697357 - RNA, 13 nt, Salmonella enterica enterica serovar Typhi Ty2
agcgcgucaaugg

SEQ ID NO: 3697358 - RNA, 18 nt, Salmonella enterica enterica serovar Typhi Ty2
agcgcgucagcgccuccg

SEQ ID NO: 3697359 - RNA, 20 nt, Salmonella enterica enterica serovar Typhi Ty2
agcgcgucagcgccuccgcg

SEQ ID NO: 3697360 - RNA, 17 nt, Salmonella enterica enterica serovar Typhi Ty2
agcgcguccccgguaag

SEQ ID NO: 3697361 - RNA, 20 nt, Salmonella enterica enterica serovar Typhi Ty2
agcgcgucguucacgccaaa

SEQ ID NO: 3697362 - RNA, 19 nt, Salmonella enterica enterica serovar Typhi Ty2
agcgcguucgccgucacgc

SEQ ID NO: 3697363 - RNA, 15 nt, Salmonella enterica enterica serovar Typhi Ty2
agcgcuaacgcgaag

SEQ ID NO: 3697364 - RNA, 14 nt, Salmonella enterica enterica serovar Typhi Ty2
agcgcuaagcaaca

SEQ ID NO: 3697365 - RNA, 14 nt, Salmonella enterica enterica serovar Typhi Ty2
agcgcuacgccugu

SEQ ID NO: 3697366 - RNA, 13 nt, Salmonella enterica enterica serovar Typhi Ty2
agcgcuaucaggc

SEQ ID NO: 3697367 - RNA, 16 nt, Salmonella enterica enterica serovar Typhi Ty2
agcgcucaaucagcgc

SEQ ID NO: 3697368 - RNA, 22 nt, Salmonella enterica enterica serovar Typhi Ty2
agcgcuccaccaaccaggcaaa

SEQ ID NO: 3697369 - RNA, 12 nt, Salmonella enterica enterica serovar Typhi Ty2
agcgcuccccac

SEQ ID NO: 3697370 - RNA, 15 nt, Salmonella enterica enterica serovar Typhi Ty2
agcgcuccggcauaa

SEQ ID NO: 3697371 - RNA, 16 nt, Salmonella enterica enterica serovar Typhi Ty2
agcgcugaugcaggca

SEQ ID NO: 3697372 - RNA, 17 nt, Salmonella enterica enterica serovar Typhi Ty2
agcgcugcauuugcugc

SEQ ID NO: 3697373 - RNA, 13 nt, Salmonella enterica enterica serovar Typhi Ty2
agcgcugccgcaa

SEQ ID NO: 3697374 - RNA, 14 nt, Salmonella enterica enterica serovar Typhi Ty2
agcgcugccgcaac

SEQ ID NO: 3697375 - RNA, 15 nt, Salmonella enterica enterica serovar Typhi Ty2
agcgcugcggcuaca

SEQ ID NO: 3697376 - RNA, 20 nt, Salmonella enterica enterica serovar Typhi Ty2
agcgcuggcauuccccaucg

SEQ ID NO: 3697377 - RNA, 20 nt, Salmonella enterica enterica serovar Typhi Ty2
agcgcuggcgccgcaaacca

SEQ ID NO: 3697378 - RNA, 16 nt, Salmonella enterica enterica serovar Typhi Ty2
agcgcuucgccugccg

SEQ ID NO: 3697379 - RNA, 16 nt, Salmonella enterica enterica serovar Typhi Ty2
agcgcuucgcuugccc

SEQ ID NO: 3697380 - RNA, 16 nt, Salmonella enterica enterica serovar Typhi Ty2
agcgcuucuaacgaaa

SEQ ID NO: 3697381 - RNA, 15 nt, Salmonella enterica enterica serovar Typhi Ty2
agcgcuucucuuucc

SEQ ID NO: 3697382 - RNA, 14 nt, Salmonella enterica enterica serovar Typhi Ty2
agcgcuugauccag

SEQ ID NO: 3697383 - RNA, 14 nt, Salmonella enterica enterica serovar Typhi Ty2
agcgcuugugccug

SEQ ID NO: 3697384 - RNA, 19 nt, Salmonella enterica enterica serovar Typhi Ty2
agcgcuuguuaucuggcau

SEQ ID NO: 3697385 - RNA, 23 nt, Salmonella enterica enterica serovar Typhi Ty2
agcgcuuuccagucccugaagaa

SEQ ID NO: 3697386 - RNA, 14 nt, Salmonella enterica enterica serovar Typhi Ty2
agcgcuuucuucuu

SEQ ID NO: 3697387 - RNA, 21 nt, Salmonella enterica enterica serovar Typhi Ty2
agcgcuuuggaggucauuauu

SEQ ID NO: 3697388 - RNA, 13 nt, Salmonella enterica enterica serovar Typhi Ty2
agcgcuuuugccg

SEQ ID NO: 3697389 - RNA, 15 nt, Salmonella enterica enterica serovar Typhi Ty2
agcggaagaggcaua

SEQ ID NO: 3697390 - RNA, 15 nt, Salmonella enterica enterica serovar Typhi Ty2
agcggaauagacggc

SEQ ID NO: 3697391 - RNA, 23 nt, Salmonella enterica enterica serovar Typhi Ty2
agcggacgggcggugccgguaau

SEQ ID NO: 3697392 - RNA, 21 nt, Salmonella enterica enterica serovar Typhi Ty2
agcggauaagauagcaggcga

SEQ ID NO: 3697393 - RNA, 20 nt, Salmonella enterica enterica serovar Typhi Ty2
agcggaucgcguccauuacu

SEQ ID NO: 3697394 - RNA, 18 nt, Salmonella enterica enterica serovar Typhi Ty2
agcggaugucggucauca

SEQ ID NO: 3697395 - RNA, 14 nt, Salmonella enterica enterica serovar Typhi Ty2
agcggcaagacaga

SEQ ID NO: 3697396 - RNA, 22 nt, Salmonella enterica enterica serovar Typhi Ty2
agcggcaagccgaucagcgugu

SEQ ID NO: 3697397 - RNA, 15 nt, Salmonella enterica enterica serovar Typhi Ty2
agcggcaccagcacg

SEQ ID NO: 3697398 - RNA, 21 nt, Salmonella enterica enterica serovar Typhi Ty2
agcggcagaucguuuacgacc

SEQ ID NO: 3697399 - RNA, 23 nt, Salmonella enterica enterica serovar Typhi Ty2
agcggcgauuuauagagcagcac

SEQ ID NO: 3697400 - RNA, 19 nt, Salmonella enterica enterica serovar Typhi Ty2
agcggcgcagacacugcca

SEQ ID NO: 3697401 - RNA, 17 nt, Salmonella enterica enterica serovar Typhi Ty2
agcggcgccaucaccau

SEQ ID NO: 3697402 - RNA, 19 nt, Salmonella enterica enterica serovar Typhi Ty2
agcggcgcgcgguuaugcg

SEQ ID NO: 3697403 - RNA, 18 nt, Salmonella enterica enterica serovar Typhi Ty2
agcggcggcuugccuuca

SEQ ID NO: 3697404 - RNA, 15 nt, Salmonella enterica enterica serovar Typhi Ty2
agcggcguucaaaac

SEQ ID NO: 3697405 - RNA, 22 nt, Salmonella enterica enterica serovar Typhi Ty2
agcggcguugcccaguacggcg

SEQ ID NO: 3697406 - RNA, 22 nt, Salmonella enterica enterica serovar Typhi Ty2
agcggcguuuuuuccugcuggu

SEQ ID NO: 3697407 - RNA, 18 nt, Salmonella enterica enterica serovar Typhi Ty2
agcggcucauccagcaac

SEQ ID NO: 3697408 - RNA, 19 nt, Salmonella enterica enterica serovar Typhi Ty2
agcggcucauccagcaaca

SEQ ID NO: 3697409 - RNA, 14 nt, Salmonella enterica enterica serovar Typhi Ty2
agcggcugcgccug

SEQ ID NO: 3697410 - RNA, 15 nt, Salmonella enterica enterica serovar Typhi Ty2
agcgggcuggugcga

SEQ ID NO: 3697411 - RNA, 13 nt, Salmonella enterica enterica serovar Typhi Ty2
agcgggggccggc

SEQ ID NO: 3697412 - RNA, 16 nt, Salmonella enterica enterica serovar Typhi Ty2
agcggguagagcuuuu

SEQ ID NO: 3697413 - RNA, 22 nt, Salmonella enterica enterica serovar Typhi Ty2
agcgggugcauuuucaccugga

SEQ ID NO: 3697414 - RNA, 19 nt, Salmonella enterica enterica serovar Typhi Ty2
agcgguaaaucgcaaacgg

SEQ ID NO: 3697415 - RNA, 18 nt, Salmonella enterica enterica serovar Typhi Ty2
agcgguaagagccagacg

SEQ ID NO: 3697416 - RNA, 20 nt, Salmonella enterica enterica serovar Typhi Ty2
agcgguccaauaaacgccag

SEQ ID NO: 3697417 - RNA, 16 nt, Salmonella enterica enterica serovar Typhi Ty2
agcggugaaacuguuu

SEQ ID NO: 3697418 - RNA, 19 nt, Salmonella enterica enterica serovar Typhi Ty2
agcgguuaucggcaaacgg

SEQ ID NO: 3697419 - RNA, 22 nt, Salmonella enterica enterica serovar Typhi Ty2
agcguaaccgguugucgcgcca

SEQ ID NO: 3697420 - RNA, 14 nt, Salmonella enterica enterica serovar Typhi Ty2
agcucaggcgggga

SEQ ID NO: 3697421 - RNA, 21 nt, Salmonella enterica enterica serovar Typhi Ty2
agcucaggguccccauauccc

SEQ ID NO: 3697422 - RNA, 22 nt, Salmonella enterica enterica serovar Typhi Ty2
agcucaggguccccauaucccg

SEQ ID NO: 3697423 - RNA, 22 nt, Salmonella enterica enterica serovar Typhi Ty2
agcucaguugguagagcccugg

SEQ ID NO: 3697424 - RNA, 15 nt, Salmonella enterica enterica serovar Typhi Ty2
agcucaguuuccagc

SEQ ID NO: 3697425 - RNA, 18 nt, Salmonella enterica enterica serovar Typhi Ty2
agcucaguuuccagccag

SEQ ID NO: 3697426 - RNA, 17 nt, Salmonella enterica enterica serovar Typhi Ty2
agcucauacccuuccag

SEQ ID NO: 3697427 - RNA, 13 nt, Salmonella enterica enterica serovar Typhi Ty2
agcucauuuuuac

SEQ ID NO: 3697428 - RNA, 21 nt, Salmonella enterica enterica serovar Typhi Ty2
agcucauuuuuacagacacga

SEQ ID NO: 3697429 - RNA, 19 nt, Salmonella enterica enterica serovar Typhi Ty2
agcuccagaccucguucgg

SEQ ID NO: 3697430 - RNA, 16 nt, Salmonella enterica enterica serovar Typhi Ty2
agcuccagcucagggu

SEQ ID NO: 3697431 - RNA, 19 nt, Salmonella enterica enterica serovar Typhi Ty2
agcuccauagaaaucagca

SEQ ID NO: 3697432 - RNA, 22 nt, Salmonella enterica enterica serovar Typhi Ty2
agcucccgccagcgagaugaaa

SEQ ID NO: 3697433 - RNA, 19 nt, Salmonella enterica enterica serovar Typhi Ty2
agcuccgcaaagcccauca

SEQ ID NO: 3697434 - RNA, 19 nt, Salmonella enterica enterica serovar Typhi Ty2
agcuccgcaauuuccugau

SEQ ID NO: 3697435 - RNA, 16 nt, Salmonella enterica enterica serovar Typhi Ty2
agcuccggacgcacca

SEQ ID NO: 3697436 - RNA, 14 nt, Salmonella enterica enterica serovar Typhi Ty2
agcuccuuauuaca

SEQ ID NO: 3697437 - RNA, 21 nt, Salmonella enterica enterica serovar Typhi Ty2
agcuccuuucggacuuccugu

SEQ ID NO: 3697438 - RNA, 18 nt, Salmonella enterica enterica serovar Typhi Ty2
agcuccuuuuaauaaaga

SEQ ID NO: 3697439 - RNA, 20 nt, Salmonella enterica enterica serovar Typhi Ty2
agcucgcaggccauaaaacg

SEQ ID NO: 3697440 - RNA, 15 nt, Salmonella enterica enterica serovar Typhi Ty2
agcucgcccagcacu

SEQ ID NO: 3697441 - RNA, 22 nt, Salmonella enterica enterica serovar Typhi Ty2
agcucgccgaccggcgcgccgu

SEQ ID NO: 3697442 - RNA, 19 nt, Salmonella enterica enterica serovar Typhi Ty2
agcucgcuguagcgccaac

SEQ ID NO: 3697443 - RNA, 20 nt, Salmonella enterica enterica serovar Typhi Ty2
agcucggcaaagcccaucac

SEQ ID NO: 3697444 - RNA, 21 nt, Salmonella enterica enterica serovar Typhi Ty2
agcucggcaaagcccaucacc

SEQ ID NO: 3697445 - RNA, 20 nt, Salmonella enterica enterica serovar Typhi Ty2
agcucggcuucgacauagcc

SEQ ID NO: 3697446 - RNA, 21 nt, Salmonella enterica enterica serovar Typhi Ty2
agcucgguggcgguaucaaug

SEQ ID NO: 3697447 - RNA, 14 nt, Salmonella enterica enterica serovar Typhi Ty2
agcucguuauuucc

SEQ ID NO: 3697448 - RNA, 15 nt, Salmonella enterica enterica serovar Typhi Ty2
agcucuccuggaugc

SEQ ID NO: 3697449 - RNA, 19 nt, Salmonella enterica enterica serovar Typhi Ty2
agcucuggaaaaauuguuu

SEQ ID NO: 3697450 - RNA, 22 nt, Salmonella enterica enterica serovar Typhi Ty2
agcucugguugcagcgccagag

SEQ ID NO: 3697451 - RNA, 14 nt, Salmonella enterica enterica serovar Typhi Ty2
agcucugugugacg

SEQ ID NO: 3697452 - RNA, 16 nt, Salmonella enterica enterica serovar Typhi Ty2
agcucuucaauuucca

SEQ ID NO: 3697453 - RNA, 19 nt, Salmonella enterica enterica serovar Typhi Ty2
agcucuuucauuucugccu

SEQ ID NO: 3697454 - RNA, 21 nt, Salmonella enterica enterica serovar Typhi Ty2
agcucuuucauuucugccugc

SEQ ID NO: 3697455 - RNA, 17 nt, Salmonella enterica enterica serovar Typhi Ty2
agcugaaaagauaaagu

SEQ ID NO: 3697456 - RNA, 18 nt, Salmonella enterica enterica serovar Typhi Ty2
agcugaaugcuucgccac

SEQ ID NO: 3697457 - RNA, 14 nt, Salmonella enterica enterica serovar Typhi Ty2
agcugaaugguaaa

SEQ ID NO: 3697458 - RNA, 18 nt, Salmonella enterica enterica serovar Typhi Ty2
agcugaauguauauaacg

SEQ ID NO: 3697459 - RNA, 18 nt, Salmonella enterica enterica serovar Typhi Ty2
agcugacaaugugccgga

SEQ ID NO: 3697460 - RNA, 13 nt, Salmonella enterica enterica serovar Typhi Ty2
agcugacgcagca

SEQ ID NO: 3697461 - RNA, 21 nt, Salmonella enterica enterica serovar Typhi Ty2
agcugagcgucaggcgcaucc

SEQ ID NO: 3697462 - RNA, 19 nt, Salmonella enterica enterica serovar Typhi Ty2
agcugagcuaaucacccac

SEQ ID NO: 3697463 - RNA, 20 nt, Salmonella enterica enterica serovar Typhi Ty2
agcugauaagcuaguaaaga

SEQ ID NO: 3697464 - RNA, 15 nt, Salmonella enterica enterica serovar Typhi Ty2
agcugauauuuuacu

SEQ ID NO: 3697465 - RNA, 18 nt, Salmonella enterica enterica serovar Typhi Ty2
agcugaugauuggccucc

SEQ ID NO: 3697466 - RNA, 14 nt, Salmonella enterica enterica serovar Typhi Ty2
agcugauugauuuu

SEQ ID NO: 3697467 - RNA, 16 nt, Salmonella enterica enterica serovar Typhi Ty2
agcugcaccaggagca

SEQ ID NO: 3697468 - RNA, 18 nt, Salmonella enterica enterica serovar Typhi Ty2
agcugccacaccacaugc

SEQ ID NO: 3697469 - RNA, 21 nt, Salmonella enterica enterica serovar Typhi Ty2
agcugcccggauaaccgcccg

SEQ ID NO: 3697470 - RNA, 18 nt, Salmonella enterica enterica serovar Typhi Ty2
agcugccguuggcgagcc

SEQ ID NO: 3697471 - RNA, 20 nt, Salmonella enterica enterica serovar Typhi Ty2
agcugcgcaagaaacaucau

SEQ ID NO: 3697472 - RNA, 17 nt, Salmonella enterica enterica serovar Typhi Ty2
agcugcgccagcgugcu

SEQ ID NO: 3697473 - RNA, 14 nt, Salmonella enterica enterica serovar Typhi Ty2
agcugcgcgccgca

SEQ ID NO: 3697474 - RNA, 22 nt, Salmonella enterica enterica serovar Typhi Ty2
agcugcugacguagauucugau

SEQ ID NO: 3697475 - RNA, 16 nt, Salmonella enterica enterica serovar Typhi Ty2
agcugcuuugccugga

SEQ ID NO: 3697476 - RNA, 21 nt, Salmonella enterica enterica serovar Typhi Ty2
agcuggcaagaccgauagaga

SEQ ID NO: 3697477 - RNA, 15 nt, Salmonella enterica enterica serovar Typhi Ty2
agcuggccaaucagc

SEQ ID NO: 3697478 - RNA, 16 nt, Salmonella enterica enterica serovar Typhi Ty2
agcuggccaaucagcg

SEQ ID NO: 3697479 - RNA, 16 nt, Salmonella enterica enterica serovar Typhi Ty2
agcuggccuucuccac

SEQ ID NO: 3697480 - RNA, 20 nt, Salmonella enterica enterica serovar Typhi Ty2
agcuggcgagaaaguggugg

SEQ ID NO: 3697481 - RNA, 21 nt, Salmonella enterica enterica serovar Typhi Ty2
agcuggcgagaaagugguggg

SEQ ID NO: 3697482 - RNA, 12 nt, Salmonella enterica enterica serovar Typhi Ty2
agcuggcgauau

SEQ ID NO: 3697483 - RNA, 22 nt, Salmonella enterica enterica serovar Typhi Ty2
agcuggcggucgggaacgcugu

SEQ ID NO: 3697484 - RNA, 23 nt, Salmonella enterica enterica serovar Typhi Ty2
agcuggcuuuauauaaaaaaugg

SEQ ID NO: 3697485 - RNA, 14 nt, Salmonella enterica enterica serovar Typhi Ty2
agcugggccugcuc

SEQ ID NO: 3697486 - RNA, 18 nt, Salmonella enterica enterica serovar Typhi Ty2
agcugggcguuacuggcg

SEQ ID NO: 3697487 - RNA, 21 nt, Salmonella enterica enterica serovar Typhi Ty2
agcugguggcgaguccugccg

SEQ ID NO: 3697488 - RNA, 12 nt, Salmonella enterica enterica serovar Typhi Ty2
agcugugagaau

SEQ ID NO: 3697489 - RNA, 22 nt, Salmonella enterica enterica serovar Typhi Ty2
agcugugauugcgacaggcugc

SEQ ID NO: 3697490 - RNA, 17 nt, Salmonella enterica enterica serovar Typhi Ty2
agcugugcguugucuac

SEQ ID NO: 3697491 - RNA, 16 nt, Salmonella enterica enterica serovar Typhi Ty2
agcuguuuugucggcc

SEQ ID NO: 3697492 - RNA, 15 nt, Salmonella enterica enterica serovar Typhi Ty2
agcuuaaaaaauccu

SEQ ID NO: 3697493 - RNA, 17 nt, Salmonella enterica enterica serovar Typhi Ty2
agcuuaaaaaauccugc

SEQ ID NO: 3697494 - RNA, 18 nt, Salmonella enterica enterica serovar Typhi Ty2
agcuuaaaaaauccugca

SEQ ID NO: 3697495 - RNA, 15 nt, Salmonella enterica enterica serovar Typhi Ty2
agcuuaaucaccagc

SEQ ID NO: 3697496 - RNA, 20 nt, Salmonella enterica enterica serovar Typhi Ty2
agcuuaggauaagaauaggu

SEQ ID NO: 3697497 - RNA, 13 nt, Salmonella enterica enterica serovar Typhi Ty2
agcuuauccugcc

SEQ ID NO: 3697498 - RNA, 20 nt, Salmonella enterica enterica serovar Typhi Ty2
agcuuaucgccaaagauaua

SEQ ID NO: 3697499 - RNA, 18 nt, Salmonella enterica enterica serovar Typhi Ty2
agcuuaucgggccuacca

SEQ ID NO: 3697500 - RNA, 15 nt, Salmonella enterica enterica serovar Typhi Ty2
agcuuauuccaguca

SEQ ID NO: 3697501 - RNA, 14 nt, Salmonella enterica enterica serovar Typhi Ty2
agcuucaccgccag

SEQ ID NO: 3697502 - RNA, 13 nt, Salmonella enterica enterica serovar Typhi Ty2
aggaugagcguuu

SEQ ID NO: 3697503 - RNA, 18 nt, Salmonella enterica enterica serovar Typhi Ty2
aggaugccacuguucaga

SEQ ID NO: 3697504 - RNA, 22 nt, Salmonella enterica enterica serovar Typhi Ty2
aggaugccccaucucuuucaga

SEQ ID NO: 3697505 - RNA, 17 nt, Salmonella enterica enterica serovar Typhi Ty2
aggaugcgcugcgcgcg

SEQ ID NO: 3697506 - RNA, 20 nt, Salmonella enterica enterica serovar Typhi Ty2
aggauggccagcaccagcau

SEQ ID NO: 3697507 - RNA, 18 nt, Salmonella enterica enterica serovar Typhi Ty2
aggauggggcaauuguca

SEQ ID NO: 3697508 - RNA, 18 nt, Salmonella enterica enterica serovar Typhi Ty2
aggauuagacuucuucca

SEQ ID NO: 3697509 - RNA, 20 nt, Salmonella enterica enterica serovar Typhi Ty2
aggauuauuggcaucauaaa

SEQ ID NO: 3697510 - RNA, 22 nt, Salmonella enterica enterica serovar Typhi Ty2
aggauucgacggccagcgcgcg

SEQ ID NO: 3697511 - RNA, 15 nt, Salmonella enterica enterica serovar Typhi Ty2
aggauucgccauucc

SEQ ID NO: 3697512 - RNA, 13 nt, Salmonella enterica enterica serovar Typhi Ty2
aggauugcuguga

SEQ ID NO: 3697513 - RNA, 20 nt, Salmonella enterica enterica serovar Typhi Ty2
aggcaaaacgggcggcggcu

SEQ ID NO: 3697514 - RNA, 17 nt, Salmonella enterica enterica serovar Typhi Ty2
aggcaaaaugccagccc

SEQ ID NO: 3697515 - RNA, 20 nt, Salmonella enterica enterica serovar Typhi Ty2
aggcaaacaccucagccacc

SEQ ID NO: 3697516 - RNA, 14 nt, Salmonella enterica enterica serovar Typhi Ty2
aggcaaaccagcac

SEQ ID NO: 3697517 - RNA, 15 nt, Salmonella enterica enterica serovar Typhi Ty2
aggcaaaccagcacc

SEQ ID NO: 3697518 - RNA, 14 nt, Salmonella enterica enterica serovar Typhi Ty2
aggcaaagccccag

SEQ ID NO: 3697519 - RNA, 22 nt, Salmonella enterica enterica serovar Typhi Ty2
aggcaaaucaacauuauuaaaa

SEQ ID NO: 3697520 - RNA, 23 nt, Salmonella enterica enterica serovar Typhi Ty2
aggcaaaucaacauuauuaaaau

SEQ ID NO: 3697521 - RNA, 17 nt, Salmonella enterica enterica serovar Typhi Ty2
aggcaacgacccgaagg

SEQ ID NO: 3697522 - RNA, 17 nt, Salmonella enterica enterica serovar Typhi Ty2
aggcaacggcccgaagg

SEQ ID NO: 3697523 - RNA, 23 nt, Salmonella enterica enterica serovar Typhi Ty2
aggcaagauccggacugauaguc

SEQ ID NO: 3697524 - RNA, 19 nt, Salmonella enterica enterica serovar Typhi Ty2
aggcaagcugguaaaugcg

SEQ ID NO: 3697525 - RNA, 19 nt, Salmonella enterica enterica serovar Typhi Ty2
aggcaagguuaacgucaga

SEQ ID NO: 3697526 - RNA, 15 nt, Salmonella enterica enterica serovar Typhi Ty2
aggcaaguucuuguu

SEQ ID NO: 3697527 - RNA, 19 nt, Salmonella enterica enterica serovar Typhi Ty2
aggcaauagaccagcggcc

SEQ ID NO: 3697528 - RNA, 12 nt, Salmonella enterica enterica serovar Typhi Ty2
aggcaauauccu

SEQ ID NO: 3697529 - RNA, 19 nt, Salmonella enterica enterica serovar Typhi Ty2
aggcaauauccuccggcgu

SEQ ID NO: 3697530 - RNA, 18 nt, Salmonella enterica enterica serovar Typhi Ty2
aggcaauaugucuuaaac

SEQ ID NO: 3697531 - RNA, 22 nt, Salmonella enterica enterica serovar Typhi Ty2
aggcaaucuuuaacgcuggcag

SEQ ID NO: 3697532 - RNA, 23 nt, Salmonella enterica enterica serovar Typhi Ty2
aggcaauucuggcgcacauugcu

SEQ ID NO: 3697533 - RNA, 21 nt, Salmonella enterica enterica serovar Typhi Ty2
aggcaccuguaaccuuaaaag

SEQ ID NO: 3697534 - RNA, 18 nt, Salmonella enterica enterica serovar Typhi Ty2
aggcaccugugccauacu

SEQ ID NO: 3697535 - RNA, 14 nt, Salmonella enterica enterica serovar Typhi Ty2
aggcacuguggugu

SEQ ID NO: 3697536 - RNA, 20 nt, Salmonella enterica enterica serovar Typhi Ty2
aggcacuuuccagaccaaga

SEQ ID NO: 3697537 - RNA, 19 nt, Salmonella enterica enterica serovar Typhi Ty2
aggcagccggauuuuaaau

SEQ ID NO: 3697538 - RNA, 16 nt, Salmonella enterica enterica serovar Typhi Ty2
aggcagcgcgccagcg

SEQ ID NO: 3697539 - RNA, 20 nt, Salmonella enterica enterica serovar Typhi Ty2
aggcagcguaauacaggcga

SEQ ID NO: 3697540 - RNA, 11 nt, Salmonella enterica enterica serovar Typhi Ty2
aggcaguuugc

SEQ ID NO: 3697541 - RNA, 14 nt, Salmonella enterica enterica serovar Typhi Ty2
aggcauacacaucu

SEQ ID NO: 3697542 - RNA, 17 nt, Salmonella enterica enterica serovar Typhi Ty2
aggcauaccgcccagaa

SEQ ID NO: 3697543 - RNA, 14 nt, Salmonella enterica enterica serovar Typhi Ty2
aggcaucagauaaa

SEQ ID NO: 3697544 - RNA, 23 nt, Salmonella enterica enterica serovar Typhi Ty2
aggcaucccguuuucgucccagc

SEQ ID NO: 3697545 - RNA, 16 nt, Salmonella enterica enterica serovar Typhi Ty2
aggcaugaugccacga

SEQ ID NO: 3697546 - RNA, 15 nt, Salmonella enterica enterica serovar Typhi Ty2
aggcauggcagcagg

SEQ ID NO: 3697547 - RNA, 15 nt, Salmonella enterica enterica serovar Typhi Ty2
aggcauggccuucaa

SEQ ID NO: 3697548 - RNA, 19 nt, Salmonella enterica enterica serovar Typhi Ty2
aggcauggccuucaaucag

SEQ ID NO: 3697549 - RNA, 20 nt, Salmonella enterica enterica serovar Typhi Ty2
aggcauugauaaagcgcuca

SEQ ID NO: 3697550 - RNA, 16 nt, Salmonella enterica enterica serovar Typhi Ty2
aggcauuuaugccgcc

SEQ ID NO: 3697551 - RNA, 18 nt, Salmonella enterica enterica serovar Typhi Ty2
aggcauuucgccgccauc

SEQ ID NO: 3697552 - RNA, 13 nt, Salmonella enterica enterica serovar Typhi Ty2
aggccaaaaccac

SEQ ID NO: 3697553 - RNA, 20 nt, Salmonella enterica enterica serovar Typhi Ty2
aggccaaaaccacagugacc

SEQ ID NO: 3697554 - RNA, 12 nt, Salmonella enterica enterica serovar Typhi Ty2
aggccaaacccu

SEQ ID NO: 3697555 - RNA, 22 nt, Salmonella enterica enterica serovar Typhi Ty2
aggccaacauagcggcaaggaa

SEQ ID NO: 3697556 - RNA, 15 nt, Salmonella enterica enterica serovar Typhi Ty2
aggccacgcagcgca

SEQ ID NO: 3697557 - RNA, 16 nt, Salmonella enterica enterica serovar Typhi Ty2
aggccagugccaagca

SEQ ID NO: 3697558 - RNA, 15 nt, Salmonella enterica enterica serovar Typhi Ty2
aggccaucauaccgc

SEQ ID NO: 3697559 - RNA, 20 nt, Salmonella enterica enterica serovar Typhi Ty2
aggccauuaagcuucgugag

SEQ ID NO: 3697560 - RNA, 22 nt, Salmonella enterica enterica serovar Typhi Ty2
aggcccaccgcacgggcaaagc

SEQ ID NO: 3697561 - RNA, 13 nt, Salmonella enterica enterica serovar Typhi Ty2
aggcccagccgcu

SEQ ID NO: 3697562 - RNA, 21 nt, Salmonella enterica enterica serovar Typhi Ty2
aggcccauuuucggcaucagc

SEQ ID NO: 3697563 - RNA, 23 nt, Salmonella enterica enterica serovar Typhi Ty2
aggcccauuuucggcaucagcag

SEQ ID NO: 3697564 - RNA, 18 nt, Salmonella enterica enterica serovar Typhi Ty2
aggccgccaccgccucgc

SEQ ID NO: 3697565 - RNA, 16 nt, Salmonella enterica enterica serovar Typhi Ty2
aggccgccgaggcuaa

SEQ ID NO: 3697566 - RNA, 17 nt, Salmonella enterica enterica serovar Typhi Ty2
aggccgccgcacaggcg

SEQ ID NO: 3697567 - RNA, 13 nt, Salmonella enterica enterica serovar Typhi Ty2
aggccgcggcugu

SEQ ID NO: 3697568 - RNA, 15 nt, Salmonella enterica enterica serovar Typhi Ty2
aggccggacaggcga

SEQ ID NO: 3697569 - RNA, 23 nt, Salmonella enterica enterica serovar Typhi Ty2
aggccggauaagcggcagcgcca

SEQ ID NO: 3697570 - RNA, 18 nt, Salmonella enterica enterica serovar Typhi Ty2
aggccggauaaggcgcuu

SEQ ID NO: 3697571 - RNA, 17 nt, Salmonella enterica enterica serovar Typhi Ty2
aggccggaugaggcgca

SEQ ID NO: 3697572 - RNA, 16 nt, Salmonella enterica enterica serovar Typhi Ty2
aggccggcauaaugau

SEQ ID NO: 3697573 - RNA, 22 nt, Salmonella enterica enterica serovar Typhi Ty2
aggccgggaaaucuucuacuuc

SEQ ID NO: 3697574 - RNA, 20 nt, Salmonella enterica enterica serovar Typhi Ty2
aggccgggcaagcgaagcgc

SEQ ID NO: 3697575 - RNA, 23 nt, Salmonella enterica enterica serovar Typhi Ty2
aggccggguaggacauagccgcc

SEQ ID NO: 3697576 - RNA, 20 nt, Salmonella enterica enterica serovar Typhi Ty2
aggccguuauugucaugcua

SEQ ID NO: 3697577 - RNA, 23 nt, Salmonella enterica enterica serovar Typhi Ty2
aggccguuauugucaugcuaaaa

SEQ ID NO: 3697578 - RNA, 20 nt, Salmonella enterica enterica serovar Typhi Ty2
aggccguucauucgccccag

SEQ ID NO: 3697579 - RNA, 19 nt, Salmonella enterica enterica serovar Typhi Ty2
aggccguugugucccugga

SEQ ID NO: 3697580 - RNA, 16 nt, Salmonella enterica enterica serovar Typhi Ty2
aggccuaacacaugca

SEQ ID NO: 3697581 - RNA, 22 nt, Salmonella enterica enterica serovar Typhi Ty2
aggccuacaaucgugugaugca

SEQ ID NO: 3697582 - RNA, 21 nt, Salmonella enterica enterica serovar Typhi Ty2
aggccuacacucugcgcgcga

SEQ ID NO: 3697583 - RNA, 22 nt, Salmonella enterica enterica serovar Typhi Ty2
aggcuccgagacucaaagaaaa

SEQ ID NO: 3697584 - RNA, 16 nt, Salmonella enterica enterica serovar Typhi Ty2
aggcuccgcgcagggu

SEQ ID NO: 3697585 - RNA, 14 nt, Salmonella enterica enterica serovar Typhi Ty2
aggcucgcaaauaa

SEQ ID NO: 3697586 - RNA, 19 nt, Salmonella enterica enterica serovar Typhi Ty2
aggcugacgaagaacuuag

SEQ ID NO: 3697587 - RNA, 21 nt, Salmonella enterica enterica serovar Typhi Ty2
aggcugacgaagaacuuagga

SEQ ID NO: 3697588 - RNA, 21 nt, Salmonella enterica enterica serovar Typhi Ty2
aggcugagcguagaccgccca

SEQ ID NO: 3697589 - RNA, 15 nt, Salmonella enterica enterica serovar Typhi Ty2
aggcugccgccagaa

SEQ ID NO: 3697590 - RNA, 15 nt, Salmonella enterica enterica serovar Typhi Ty2
aggcugcgcguuuuc

SEQ ID NO: 3697591 - RNA, 18 nt, Salmonella enterica enterica serovar Typhi Ty2
aggcugcggacauuaacg

SEQ ID NO: 3697592 - RNA, 13 nt, Salmonella enterica enterica serovar Typhi Ty2
aggcugcggauga

SEQ ID NO: 3697593 - RNA, 11 nt, Salmonella enterica enterica serovar Typhi Ty2
aggcuggaaca

SEQ ID NO: 3697594 - RNA, 14 nt, Salmonella enterica enterica serovar Typhi Ty2
aggcuggagagcaa

SEQ ID NO: 3697595 - RNA, 20 nt, Salmonella enterica enterica serovar Typhi Ty2
aggcuggagagcaacgccau

SEQ ID NO: 3697596 - RNA, 22 nt, Salmonella enterica enterica serovar Typhi Ty2
aggcuggguugauaccggagga

SEQ ID NO: 3697597 - RNA, 21 nt, Salmonella enterica enterica serovar Typhi Ty2
aggcuguugaggaaauucuga

SEQ ID NO: 3697598 - RNA, 17 nt, Salmonella enterica enterica serovar Typhi Ty2
aggcuuaacacccggau

SEQ ID NO: 3697599 - RNA, 19 nt, Salmonella enterica enterica serovar Typhi Ty2
aggcuuaacacccggauau

SEQ ID NO: 3697600 - RNA, 16 nt, Salmonella enterica enterica serovar Typhi Ty2
aggcuucaaccguuuc

SEQ ID NO: 3697601 - RNA, 20 nt, Salmonella enterica enterica serovar Typhi Ty2
aggcuucaucggauagauga

SEQ ID NO: 3697602 - RNA, 15 nt, Salmonella enterica enterica serovar Typhi Ty2
aggcuuccacgcacg

SEQ ID NO: 3697603 - RNA, 20 nt, Salmonella enterica enterica serovar Typhi Ty2
aggcuucggcuuuaucgccc

SEQ ID NO: 3697604 - RNA, 13 nt, Salmonella enterica enterica serovar Typhi Ty2
aggcuugcaggau

SEQ ID NO: 3697605 - RNA, 19 nt, Salmonella enterica enterica serovar Typhi Ty2
aggcuugccgcgccagacg

SEQ ID NO: 3697606 - RNA, 23 nt, Salmonella enterica enterica serovar Typhi Ty2
aggcuuggcagccccugaaauaa

SEQ ID NO: 3697607 - RNA, 16 nt, Salmonella enterica enterica serovar Typhi Ty2
aggcuuuucaggcugu

SEQ ID NO: 3697608 - RNA, 16 nt, Salmonella enterica enterica serovar Typhi Ty2
agggaaaaauagcgau

SEQ ID NO: 3697609 - RNA, 21 nt, Salmonella enterica enterica serovar Typhi Ty2
agggaaaaauguguugcggcc

SEQ ID NO: 3697610 - RNA, 14 nt, Salmonella enterica enterica serovar Typhi Ty2
agggaaaagccauu

SEQ ID NO: 3697611 - RNA, 17 nt, Salmonella enterica enterica serovar Typhi Ty2
agggaaaagccauugcc

SEQ ID NO: 3697612 - RNA, 16 nt, Salmonella enterica enterica serovar Typhi Ty2
agggacacucaaggcu

SEQ ID NO: 3697613 - RNA, 18 nt, Salmonella enterica enterica serovar Typhi Ty2
agggacgcauccugcacu

SEQ ID NO: 3697614 - RNA, 19 nt, Salmonella enterica enterica serovar Typhi Ty2
agggacuauaggcaaugau

SEQ ID NO: 3697615 - RNA, 23 nt, Salmonella enterica enterica serovar Typhi Ty2
agggacuaucgaaagagcaaaua

SEQ ID NO: 3697616 - RNA, 17 nt, Salmonella enterica enterica serovar Typhi Ty2
agggacuuauuaaaaau

SEQ ID NO: 3697617 - RNA, 19 nt, Salmonella enterica enterica serovar Typhi Ty2
agggaggugcucucccagc

SEQ ID NO: 3697618 - RNA, 22 nt, Salmonella enterica enterica serovar Typhi Ty2
agggaggugcucucccagcuga

SEQ ID NO: 3697619 - RNA, 23 nt, Salmonella enterica enterica serovar Typhi Ty2
agggaggugcucucccagcugag

SEQ ID NO: 3697620 - RNA, 18 nt, Salmonella enterica enterica serovar Typhi Ty2
agggagguucgccucccu

SEQ ID NO: 3697621 - RNA, 23 nt, Salmonella enterica enterica serovar Typhi Ty2
agggaguaugcggucaaaagcug

SEQ ID NO: 3697622 - RNA, 16 nt, Salmonella enterica enterica serovar Typhi Ty2
agggagugagucccca

SEQ ID NO: 3697623 - RNA, 23 nt, Salmonella enterica enterica serovar Typhi Ty2
agggauaacaguauuuguucaga

SEQ ID NO: 3697624 - RNA, 16 nt, Salmonella enterica enterica serovar Typhi Ty2
agggaucaauguaaaa

SEQ ID NO: 3697625 - RNA, 16 nt, Salmonella enterica enterica serovar Typhi Ty2
agggaucaucuucacu

SEQ ID NO: 3697626 - RNA, 13 nt, Salmonella enterica enterica serovar Typhi Ty2
agggaugacagaa

SEQ ID NO: 3697627 - RNA, 21 nt, Salmonella enterica enterica serovar Typhi Ty2
agggcaaaguuaucccugcug

SEQ ID NO: 3697628 - RNA, 16 nt, Salmonella enterica enterica serovar Typhi Ty2
agggcaacaaacauaa

SEQ ID NO: 3697629 - RNA, 18 nt, Salmonella enterica enterica serovar Typhi Ty2
agggcaccugggcaauaa

SEQ ID NO: 3697630 - RNA, 13 nt, Salmonella enterica enterica serovar Typhi Ty2
agggcagcgagca

SEQ ID NO: 3697631 - RNA, 15 nt, Salmonella enterica enterica serovar Typhi Ty2
agggcaggcagugaa

SEQ ID NO: 3697632 - RNA, 19 nt, Salmonella enterica enterica serovar Typhi Ty2
agggcaucaauaaaaucac

SEQ ID NO: 3697633 - RNA, 23 nt, Salmonella enterica enterica serovar Typhi Ty2
agggcaugauuacagauauccac

SEQ ID NO: 3697634 - RNA, 18 nt, Salmonella enterica enterica serovar Typhi Ty2
agggcauuuuuuccagua

SEQ ID NO: 3697635 - RNA, 13 nt, Salmonella enterica enterica serovar Typhi Ty2
agggccaggcgcg

SEQ ID NO: 3697636 - RNA, 21 nt, Salmonella enterica enterica serovar Typhi Ty2
agggccgcguuaacgccguug

SEQ ID NO: 3697637 - RNA, 14 nt, Salmonella enterica enterica serovar Typhi Ty2
agggcgacgucaga

SEQ ID NO: 3697638 - RNA, 17 nt, Salmonella enterica enterica serovar Typhi Ty2
agggcgaugccucaccc

SEQ ID NO: 3697639 - RNA, 18 nt, Salmonella enterica enterica serovar Typhi Ty2
agggcgauucccgaucuu

SEQ ID NO: 3697640 - RNA, 18 nt, Salmonella enterica enterica serovar Typhi Ty2
agggcgcggcgcaacuuu

SEQ ID NO: 3697641 - RNA, 13 nt, Salmonella enterica enterica serovar Typhi Ty2
agggcgcggcugg

SEQ ID NO: 3697642 - RNA, 22 nt, Salmonella enterica enterica serovar Typhi Ty2
agggcggaagcagauaccagcc

SEQ ID NO: 3697643 - RNA, 13 nt, Salmonella enterica enterica serovar Typhi Ty2
agggcggcuggau

SEQ ID NO: 3697644 - RNA, 16 nt, Salmonella enterica enterica serovar Typhi Ty2
agggcgugaaccagca

SEQ ID NO: 3697645 - RNA, 17 nt, Salmonella enterica enterica serovar Typhi Ty2
agggcgugacgcgccag

SEQ ID NO: 3697646 - RNA, 18 nt, Salmonella enterica enterica serovar Typhi Ty2
agggcgugccgugagcgc

SEQ ID NO: 3697647 - RNA, 14 nt, Salmonella enterica enterica serovar Typhi Ty2
agggcuuacucccu

SEQ ID NO: 3697648 - RNA, 15 nt, Salmonella enterica enterica serovar Typhi Ty2
aggggcauuuuccgg

SEQ ID NO: 3697649 - RNA, 15 nt, Salmonella enterica enterica serovar Typhi Ty2
aggggcuccugcgcc

SEQ ID NO: 3697650 - RNA, 20 nt, Salmonella enterica enterica serovar Typhi Ty2
aggggcuccugcgccggacg

SEQ ID NO: 3697651 - RNA, 18 nt, Salmonella enterica enterica serovar Typhi Ty2
aggggcucuaaaaaggaa

SEQ ID NO: 3697652 - RNA, 14 nt, Salmonella enterica enterica serovar Typhi Ty2
aggggggaaaugag

SEQ ID NO: 3697653 - RNA, 13 nt, Salmonella enterica enterica serovar Typhi Ty2
agggguauuuauc

SEQ ID NO: 3697654 - RNA, 16 nt, Salmonella enterica enterica serovar Typhi Ty2
agggguguuacgccau

SEQ ID NO: 3697655 - RNA, 22 nt, Salmonella enterica enterica serovar Typhi Ty2
agggguuuucgccagcaacgcc

SEQ ID NO: 3697656 - RNA, 18 nt, Salmonella enterica enterica serovar Typhi Ty2
aggguaacaucgcccgca

SEQ ID NO: 3697657 - RNA, 13 nt, Salmonella enterica enterica serovar Typhi Ty2
aggguagaaaaag

SEQ ID NO: 3697658 - RNA, 14 nt, Salmonella enterica enterica serovar Typhi Ty2
aggguagaaaaagg

SEQ ID NO: 3697659 - RNA, 13 nt, Salmonella enterica enterica serovar Typhi Ty2
aggguauaugagc

SEQ ID NO: 3697660 - RNA, 20 nt, Salmonella enterica enterica serovar Typhi Ty2
agggucgccgcgcccagcag

SEQ ID NO: 3697661 - RNA, 22 nt, Salmonella enterica enterica serovar Typhi Ty2
agggucgccgcgcccagcagca

SEQ ID NO: 3697662 - RNA, 23 nt, Salmonella enterica enterica serovar Typhi Ty2
agggugauuucgcccgcauucgc

SEQ ID NO: 3697663 - RNA, 18 nt, Salmonella enterica enterica serovar Typhi Ty2
agggugcaaagaaacguu

SEQ ID NO: 3697664 - RNA, 17 nt, Salmonella enterica enterica serovar Typhi Ty2
agggugcagcaaauaau

SEQ ID NO: 3697665 - RNA, 15 nt, Salmonella enterica enterica serovar Typhi Ty2
agguucccgccgcca

SEQ ID NO: 3697666 - RNA, 18 nt, Salmonella enterica enterica serovar Typhi Ty2
agguucgacucgagcaau

SEQ ID NO: 3697667 - RNA, 19 nt, Salmonella enterica enterica serovar Typhi Ty2
agguugccugauggcgcug

SEQ ID NO: 3697668 - RNA, 16 nt, Salmonella enterica enterica serovar Typhi Ty2
agguugcguccgccgc

SEQ ID NO: 3697669 - RNA, 21 nt, Salmonella enterica enterica serovar Typhi Ty2
agguugcucagguuauacugu

SEQ ID NO: 3697670 - RNA, 20 nt, Salmonella enterica enterica serovar Typhi Ty2
agguuugcgcggcggguaaa

SEQ ID NO: 3697671 - RNA, 21 nt, Salmonella enterica enterica serovar Typhi Ty2
agguuuucucauccagcuugc

SEQ ID NO: 3697672 - RNA, 11 nt, Salmonella enterica enterica serovar Typhi Ty2
agguuuugcug

SEQ ID NO: 3697673 - RNA, 23 nt, Salmonella enterica enterica serovar Typhi Ty2
agguuuugucaugguaaaugccg

SEQ ID NO: 3697674 - RNA, 23 nt, Salmonella enterica enterica serovar Typhi Ty2
aguaaaaugcccugcuggcgcau

SEQ ID NO: 3697675 - RNA, 15 nt, Salmonella enterica enterica serovar Typhi Ty2
aguaaacagaaucaa

SEQ ID NO: 3697676 - RNA, 17 nt, Salmonella enterica enterica serovar Typhi Ty2
aguaaacgcucaagcaa

SEQ ID NO: 3697677 - RNA, 20 nt, Salmonella enterica enterica serovar Typhi Ty2
aguaaacuccucuuccgaca

SEQ ID NO: 3697678 - RNA, 23 nt, Salmonella enterica enterica serovar Typhi Ty2
aguaaauagaaaauaauucuuaa

SEQ ID NO: 3697679 - RNA, 16 nt, Salmonella enterica enterica serovar Typhi Ty2
aguaaaugaacguuuu

SEQ ID NO: 3697680 - RNA, 20 nt, Salmonella enterica enterica serovar Typhi Ty2
aguaaccccauacaguaguu

SEQ ID NO: 3697681 - RNA, 22 nt, Salmonella enterica enterica serovar Typhi Ty2
aguaacccgauacccugagccc

SEQ ID NO: 3697682 - RNA, 19 nt, Salmonella enterica enterica serovar Typhi Ty2
aguaaccuauuuuacaaaa

SEQ ID NO: 3697683 - RNA, 19 nt, Salmonella enterica enterica serovar Typhi Ty2
aguaacgcacuuuuccagc

SEQ ID NO: 3697684 - RNA, 19 nt, Salmonella enterica enterica serovar Typhi Ty2
aguaacugcccgucggacu

SEQ ID NO: 3697685 - RNA, 17 nt, Salmonella enterica enterica serovar Typhi Ty2
aguaacugguuaccaca

SEQ ID NO: 3697686 - RNA, 16 nt, Salmonella enterica enterica serovar Typhi Ty2
aguaagcgccagccgu

SEQ ID NO: 3697687 - RNA, 21 nt, Salmonella enterica enterica serovar Typhi Ty2
aguaauauaaccaauuuaaaa

SEQ ID NO: 3697688 - RNA, 12 nt, Salmonella enterica enterica serovar Typhi Ty2
aguaauccauag

SEQ ID NO: 3697689 - RNA, 23 nt, Salmonella enterica enterica serovar Typhi Ty2
aguaaugcgcgaauaucuuuguc

SEQ ID NO: 3697690 - RNA, 16 nt, Salmonella enterica enterica serovar Typhi Ty2
aguaauggacagguaa

SEQ ID NO: 3697691 - RNA, 19 nt, Salmonella enterica enterica serovar Typhi Ty2
aguaauggacagguaaacc

SEQ ID NO: 3697692 - RNA, 15 nt, Salmonella enterica enterica serovar Typhi Ty2
aguaauuccauuagc

SEQ ID NO: 3697693 - RNA, 15 nt, Salmonella enterica enterica serovar Typhi Ty2
aguaauucccggcag

SEQ ID NO: 3697694 - RNA, 14 nt, Salmonella enterica enterica serovar Typhi Ty2
aguaauuugaacau

SEQ ID NO: 3697695 - RNA, 13 nt, Salmonella enterica enterica serovar Typhi Ty2
aguaauuuuuccg

SEQ ID NO: 3697696 - RNA, 17 nt, Salmonella enterica enterica serovar Typhi Ty2
aguaauuuuuccgccuc

SEQ ID NO: 3697697 - RNA, 14 nt, Salmonella enterica enterica serovar Typhi Ty2
aguaauuuuucucc

SEQ ID NO: 3697698 - RNA, 15 nt, Salmonella enterica enterica serovar Typhi Ty2
aguacaaacaaauaa

SEQ ID NO: 3697699 - RNA, 17 nt, Salmonella enterica enterica serovar Typhi Ty2
aguacaggcauugucac

SEQ ID NO: 3697700 - RNA, 18 nt, Salmonella enterica enterica serovar Typhi Ty2
aguacagguuaugcaagu

SEQ ID NO: 3697701 - RNA, 22 nt, Salmonella enterica enterica serovar Typhi Ty2
aguaccauaccggugcgcccca

SEQ ID NO: 3697702 - RNA, 15 nt, Salmonella enterica enterica serovar Typhi Ty2
aguacccucugcacc

SEQ ID NO: 3697703 - RNA, 19 nt, Salmonella enterica enterica serovar Typhi Ty2
aguaccgaacagccaggcu

SEQ ID NO: 3697704 - RNA, 21 nt, Salmonella enterica enterica serovar Typhi Ty2
aguaccgaacagccaggcuuu

SEQ ID NO: 3697705 - RNA, 17 nt, Salmonella enterica enterica serovar Typhi Ty2
aguaccgccgccgggcc

SEQ ID NO: 3697706 - RNA, 18 nt, Salmonella enterica enterica serovar Typhi Ty2
aguaccgguuagcucaac

SEQ ID NO: 3697707 - RNA, 17 nt, Salmonella enterica enterica serovar Typhi Ty2
aguaccugacuuuucca

SEQ ID NO: 3697708 - RNA, 23 nt, Salmonella enterica enterica serovar Typhi Ty2
aguaccugcccggcaacgggcaa

SEQ ID NO: 3697709 - RNA, 23 nt, Salmonella enterica enterica serovar Typhi Ty2
aguacgauagcaauuaauaaaca

SEQ ID NO: 3697710 - RNA, 15 nt, Salmonella enterica enterica serovar Typhi Ty2
aguacgcaaggaaau

SEQ ID NO: 3697711 - RNA, 22 nt, Salmonella enterica enterica serovar Typhi Ty2
aguacgcccgugacgccaggca

SEQ ID NO: 3697712 - RNA, 15 nt, Salmonella enterica enterica serovar Typhi Ty2
aguacgccugaaaac

SEQ ID NO: 3697713 - RNA, 21 nt, Salmonella enterica enterica serovar Typhi Ty2
aguacgccugaaaacagaaau

SEQ ID NO: 3697714 - RNA, 15 nt, Salmonella enterica enterica serovar Typhi Ty2
aguacgcgaccgccg

SEQ ID NO: 3697715 - RNA, 18 nt, Salmonella enterica enterica serovar Typhi Ty2
aguacggcgcgaaucccg

SEQ ID NO: 3697716 - RNA, 15 nt, Salmonella enterica enterica serovar Typhi Ty2
aguacgggcagaugg

SEQ ID NO: 3697717 - RNA, 23 nt, Salmonella enterica enterica serovar Typhi Ty2
aguacgguuugcggauuggauaa

SEQ ID NO: 3697718 - RNA, 17 nt, Salmonella enterica enterica serovar Typhi Ty2
aguacuauuuucgccga

SEQ ID NO: 3697719 - RNA, 18 nt, Salmonella enterica enterica serovar Typhi Ty2
aguagaugucaucaacau

SEQ ID NO: 3697720 - RNA, 17 nt, Salmonella enterica enterica serovar Typhi Ty2
aguagccaugcauaaug

SEQ ID NO: 3697721 - RNA, 22 nt, Salmonella enterica enterica serovar Typhi Ty2
aguagccaugcauaaugcagcc

SEQ ID NO: 3697722 - RNA, 19 nt, Salmonella enterica enterica serovar Typhi Ty2
aguagcccugacgaacaga

SEQ ID NO: 3697723 - RNA, 13 nt, Salmonella enterica enterica serovar Typhi Ty2
aguagcggaauau

SEQ ID NO: 3697724 - RNA, 20 nt, Salmonella enterica enterica serovar Typhi Ty2
aguagcguucuuuccaguuc

SEQ ID NO: 3697725 - RNA, 21 nt, Salmonella enterica enterica serovar Typhi Ty2
aguagcguucuuuccaguucu

SEQ ID NO: 3697726 - RNA, 20 nt, Salmonella enterica enterica serovar Typhi Ty2
aguagcugagcgucaggcgc

SEQ ID NO: 3697727 - RNA, 16 nt, Salmonella enterica enterica serovar Typhi Ty2
aguagguauccagcag

SEQ ID NO: 3697728 - RNA, 15 nt, Salmonella enterica enterica serovar Typhi Ty2
aguaguuccagcaua

SEQ ID NO: 3697729 - RNA, 12 nt, Salmonella enterica enterica serovar Typhi Ty2
aguauaaaacuc

SEQ ID NO: 3697730 - RNA, 12 nt, Salmonella enterica enterica serovar Typhi Ty2
aguauaaagcug

SEQ ID NO: 3697731 - RNA, 14 nt, Salmonella enterica enterica serovar Typhi Ty2
aguauaaauaccuu

SEQ ID NO: 3697732 - RNA, 14 nt, Salmonella enterica enterica serovar Typhi Ty2
aguauaacgaugau

SEQ ID NO: 3697733 - RNA, 22 nt, Salmonella enterica enterica serovar Typhi Ty2
aguauaauucgucaauaccuaa

SEQ ID NO: 3697734 - RNA, 20 nt, Salmonella enterica enterica serovar Typhi Ty2
aguaucgagauaaugcucau

SEQ ID NO: 3697735 - RNA, 15 nt, Salmonella enterica enterica serovar Typhi Ty2
aguaucgcgccgcca

SEQ ID NO: 3697736 - RNA, 17 nt, Salmonella enterica enterica serovar Typhi Ty2
aguaucgcucuauaucc

SEQ ID NO: 3697737 - RNA, 19 nt, Salmonella enterica enterica serovar Typhi Ty2
aguaucgcucuauauccug

SEQ ID NO: 3697738 - RNA, 20 nt, Salmonella enterica enterica serovar Typhi Ty2
aguaucgcucuauauccugc

SEQ ID NO: 3697739 - RNA, 17 nt, Salmonella enterica enterica serovar Typhi Ty2
aguaucgggauggcgau

SEQ ID NO: 3697740 - RNA, 21 nt, Salmonella enterica enterica serovar Typhi Ty2
aguaucucgccaguaaagaca

SEQ ID NO: 3697741 - RNA, 22 nt, Salmonella enterica enterica serovar Typhi Ty2
aguaucucgccaguaaagacac

SEQ ID NO: 3697742 - RNA, 23 nt, Salmonella enterica enterica serovar Typhi Ty2
aguaugaaggguauauaaaucaa

SEQ ID NO: 3697743 - RNA, 15 nt, Salmonella enterica enterica serovar Typhi Ty2
aguaugccucgcgca

SEQ ID NO: 3697744 - RNA, 19 nt, Salmonella enterica enterica serovar Typhi Ty2
aguauggccucuucaaauu

SEQ ID NO: 3697745 - RNA, 21 nt, Salmonella enterica enterica serovar Typhi Ty2
aguauggccucuucaaauuug

SEQ ID NO: 3697746 - RNA, 20 nt, Salmonella enterica enterica serovar Typhi Ty2
agugaacacguaauuuauua

SEQ ID NO: 3697747 - RNA, 20 nt, Salmonella enterica enterica serovar Typhi Ty2
agugaagcgccggaugagga

SEQ ID NO: 3697748 - RNA, 17 nt, Salmonella enterica enterica serovar Typhi Ty2
agugaaucgacggcaau

SEQ ID NO: 3697749 - RNA, 14 nt, Salmonella enterica enterica serovar Typhi Ty2
agugaauuuaaacg

SEQ ID NO: 3697750 - RNA, 22 nt, Salmonella enterica enterica serovar Typhi Ty2
agugacaaacucacguucccca

SEQ ID NO: 3697751 - RNA, 13 nt, Salmonella enterica enterica serovar Typhi Ty2
agugaccagcauc

SEQ ID NO: 3697752 - RNA, 18 nt, Salmonella enterica enterica serovar Typhi Ty2
agugacgaggccuguccc

SEQ ID NO: 3697753 - RNA, 17 nt, Salmonella enterica enterica serovar Typhi Ty2
agugacgccaguuccca

SEQ ID NO: 3697754 - RNA, 13 nt, Salmonella enterica enterica serovar Typhi Ty2
agugacgccgcca

SEQ ID NO: 3697755 - RNA, 15 nt, Salmonella enterica enterica serovar Typhi Ty2
agugacggcaauaga

SEQ ID NO: 3697756 - RNA, 22 nt, Salmonella enterica enterica serovar Typhi Ty2
agugacguggcuucgccgagaa

SEQ ID NO: 3697757 - RNA, 16 nt, Salmonella enterica enterica serovar Typhi Ty2
agugacugacacccau

SEQ ID NO: 3697758 - RNA, 20 nt, Salmonella enterica enterica serovar Typhi Ty2
agugaggaccguacucagau

SEQ ID NO: 3697759 - RNA, 15 nt, Salmonella enterica enterica serovar Typhi Ty2
agugaguaacguuaa

SEQ ID NO: 3697760 - RNA, 13 nt, Salmonella enterica enterica serovar Typhi Ty2
agugauaaagcac

SEQ ID NO: 3697761 - RNA, 21 nt, Salmonella enterica enterica serovar Typhi Ty2
agugauagcgccauggagaaa

SEQ ID NO: 3697762 - RNA, 19 nt, Salmonella enterica enterica serovar Typhi Ty2
agugaucccccagaaucgg

SEQ ID NO: 3697763 - RNA, 16 nt, Salmonella enterica enterica serovar Typhi Ty2
agugauuauaaaucaa

SEQ ID NO: 3697764 - RNA, 17 nt, Salmonella enterica enterica serovar Typhi Ty2
agugauuauaaaucaau

SEQ ID NO: 3697765 - RNA, 17 nt, Salmonella enterica enterica serovar Typhi Ty2
agugauucggguaaaca

SEQ ID NO: 3697766 - RNA, 23 nt, Salmonella enterica enterica serovar Typhi Ty2
agugauuuacuccaaaaauaaac

SEQ ID NO: 3697767 - RNA, 12 nt, Salmonella enterica enterica serovar Typhi Ty2
agugcaacggcu

SEQ ID NO: 3697768 - RNA, 12 nt, Salmonella enterica enterica serovar Typhi Ty2
agugcagaaagu

SEQ ID NO: 3697769 - RNA, 18 nt, Salmonella enterica enterica serovar Typhi Ty2
agugcaguauugcaccag

SEQ ID NO: 3697770 - RNA, 22 nt, Salmonella enterica enterica serovar Typhi Ty2
agugccaguccgguauaaaacg

SEQ ID NO: 3697771 - RNA, 19 nt, Salmonella enterica enterica serovar Typhi Ty2
agugcccagcgcgaccugc

SEQ ID NO: 3697772 - RNA, 15 nt, Salmonella enterica enterica serovar Typhi Ty2
agugcccgaaagcaa

SEQ ID NO: 3697773 - RNA, 20 nt, Salmonella enterica enterica serovar Typhi Ty2
agugcccgaaagcaauacug

SEQ ID NO: 3697774 - RNA, 23 nt, Salmonella enterica enterica serovar Typhi Ty2
agugcccguuugcgagacggcga

SEQ ID NO: 3697775 - RNA, 11 nt, Salmonella enterica enterica serovar Typhi Ty2
agugccugccg

SEQ ID NO: 3697776 - RNA, 17 nt, Salmonella enterica enterica serovar Typhi Ty2
agugcgaaguagcugaa

SEQ ID NO: 3697777 - RNA, 15 nt, Salmonella enterica enterica serovar Typhi Ty2
agugcgcacucagaa

SEQ ID NO: 3697778 - RNA, 17 nt, Salmonella enterica enterica serovar Typhi Ty2
agugcgcauacuaccgc

SEQ ID NO: 3697779 - RNA, 20 nt, Salmonella enterica enterica serovar Typhi Ty2
agugcuauacaguaaaacgc

SEQ ID NO: 3697780 - RNA, 23 nt, Salmonella enterica enterica serovar Typhi Ty2
agugcuauacaguaaaacgccaa

SEQ ID NO: 3697781 - RNA, 14 nt, Salmonella enterica enterica serovar Typhi Ty2
agugcugaaaaucg

SEQ ID NO: 3697782 - RNA, 20 nt, Salmonella enterica enterica serovar Typhi Ty2
agugcugaaaaucgucucuc

SEQ ID NO: 3697783 - RNA, 22 nt, Salmonella enterica enterica serovar Typhi Ty2
agugcuguuccacgggaucguu

SEQ ID NO: 3697784 - RNA, 16 nt, Salmonella enterica enterica serovar Typhi Ty2
agugcuugcauuuuac

SEQ ID NO: 3697785 - RNA, 23 nt, Salmonella enterica enterica serovar Typhi Ty2
aguggaaaacagcauaauaaagc

SEQ ID NO: 3697786 - RNA, 13 nt, Salmonella enterica enterica serovar Typhi Ty2
aguggaaucagcc

SEQ ID NO: 3697787 - RNA, 22 nt, Salmonella enterica enterica serovar Typhi Ty2
aguggagaggccaccagcgcca

SEQ ID NO: 3697788 - RNA, 14 nt, Salmonella enterica enterica serovar Typhi Ty2
aguggaucagcaga

SEQ ID NO: 3697789 - RNA, 19 nt, Salmonella enterica enterica serovar Typhi Ty2
aguggcauccgaagaacca

SEQ ID NO: 3697790 - RNA, 14 nt, Salmonella enterica enterica serovar Typhi Ty2
aguggcggcaaaaa

SEQ ID NO: 3697791 - RNA, 15 nt, Salmonella enterica enterica serovar Typhi Ty2
aguggcggcaaaaaa

SEQ ID NO: 3697792 - RNA, 23 nt, Salmonella enterica enterica serovar Typhi Ty2
aguggcggcaaaaaauauagcca

SEQ ID NO: 3697793 - RNA, 12 nt, Salmonella enterica enterica serovar Typhi Ty2
aguggcggcaau

SEQ ID NO: 3697794 - RNA, 17 nt, Salmonella enterica enterica serovar Typhi Ty2
aguggcuuuaacgucag

SEQ ID NO: 3697795 - RNA, 22 nt, Salmonella enterica enterica serovar Typhi Ty2
agugggcgucaaaaucccggcu

SEQ ID NO: 3697796 - RNA, 19 nt, Salmonella enterica enterica serovar Typhi Ty2
agugguaaaaaagucacuu

SEQ ID NO: 3697797 - RNA, 12 nt, Salmonella enterica enterica serovar Typhi Ty2
agugguggguga

SEQ ID NO: 3697798 - RNA, 13 nt, Salmonella enterica enterica serovar Typhi Ty2
aguggugggugau

SEQ ID NO: 3697799 - RNA, 14 nt, Salmonella enterica enterica serovar Typhi Ty2
aguggugggugaug

SEQ ID NO: 3697800 - RNA, 17 nt, Salmonella enterica enterica serovar Typhi Ty2
agugguuccaggcgcgc

SEQ ID NO: 3697801 - RNA, 15 nt, Salmonella enterica enterica serovar Typhi Ty2
agugguuccauucca

SEQ ID NO: 3697802 - RNA, 12 nt, Salmonella enterica enterica serovar Typhi Ty2
agugguucgcca

SEQ ID NO: 3697803 - RNA, 22 nt, Salmonella enterica enterica serovar Typhi Ty2
agugguucguccaucaguucuu

SEQ ID NO: 3697804 - RNA, 13 nt, Salmonella enterica enterica serovar Typhi Ty2
agugucaacugcg

SEQ ID NO: 3697805 - RNA, 23 nt, Salmonella enterica enterica serovar Typhi Ty2
aguguccuuacggacgugggggu

SEQ ID NO: 3697806 - RNA, 21 nt, Salmonella enterica enterica serovar Typhi Ty2
agugugccagcagaugaacgg

SEQ ID NO: 3697807 - RNA, 22 nt, Salmonella enterica enterica serovar Typhi Ty2
aguguggaaaacagcgccggca

SEQ ID NO: 3697808 - RNA, 15 nt, Salmonella enterica enterica serovar Typhi Ty2
aguguguaccagcag

SEQ ID NO: 3697809 - RNA, 16 nt, Salmonella enterica enterica serovar Typhi Ty2
aguguguaccagcagc

SEQ ID NO: 3697810 - RNA, 19 nt, Salmonella enterica enterica serovar Typhi Ty2
aguguuaacuuccucuuuc

SEQ ID NO: 3697811 - RNA, 19 nt, Salmonella enterica enterica serovar Typhi Ty2
aguguuaaucucacgcuca

SEQ ID NO: 3697812 - RNA, 21 nt, Salmonella enterica enterica serovar Typhi Ty2
aguguuauauucccgaaaggu

SEQ ID NO: 3697813 - RNA, 21 nt, Salmonella enterica enterica serovar Typhi Ty2
aguuaacgcguuaaucacuac

SEQ ID NO: 3697814 - RNA, 19 nt, Salmonella enterica enterica serovar Typhi Ty2
aguuaagcaacugauuaau

SEQ ID NO: 3697815 - RNA, 17 nt, Salmonella enterica enterica serovar Typhi Ty2
aguuaauacaguggaaa

SEQ ID NO: 3697816 - RNA, 14 nt, Salmonella enterica enterica serovar Typhi Ty2
aguuaaucagcgcc

SEQ ID NO: 3697817 - RNA, 23 nt, Salmonella enterica enterica serovar Typhi Ty2
aguuaaugccaucaucaguaaca

SEQ ID NO: 3697818 - RNA, 16 nt, Salmonella enterica enterica serovar Typhi Ty2
aguuaauuaaaugcuu

SEQ ID NO: 3697819 - RNA, 24 nt, Salmonella enterica enterica serovar Typhi Ty2
aguuaccguaaucaucgcgaucgc

SEQ ID NO: 3697820 - RNA, 15 nt, Salmonella enterica enterica serovar Typhi Ty2
aguuacgcucucagc

SEQ ID NO: 3697821 - RNA, 16 nt, Salmonella enterica enterica serovar Typhi Ty2
aguuacggacaugcga

SEQ ID NO: 3697822 - RNA, 16 nt, Salmonella enterica enterica serovar Typhi Ty2
aguuacguugcggcgu

SEQ ID NO: 3697823 - RNA, 16 nt, Salmonella enterica enterica serovar Typhi Ty2
aguuagcgaucgcgcc

SEQ ID NO: 3697824 - RNA, 16 nt, Salmonella enterica enterica serovar Typhi Ty2
aguuagcuaucgcgcc

SEQ ID NO: 3697825 - RNA, 16 nt, Salmonella enterica enterica serovar Typhi Ty2
aguuagcuuuuuuaug

SEQ ID NO: 3697826 - RNA, 23 nt, Salmonella enterica enterica serovar Typhi Ty2
aguuauaaauccccgccgccauc

SEQ ID NO: 3697827 - RNA, 14 nt, Salmonella enterica enterica serovar Typhi Ty2
aguuauaaauuuau

SEQ ID NO: 3697828 - RNA, 13 nt, Salmonella enterica enterica serovar Typhi Ty2
aguuuuuuuaaaa

SEQ ID NO: 3697829 - RNA, 21 nt, Salmonella enterica enterica serovar Typhi Ty2
auaaaaaagccguauuuuauu

SEQ ID NO: 3697830 - RNA, 13 nt, Salmonella enterica enterica serovar Typhi Ty2
auaaaaaaggcag

SEQ ID NO: 3697831 - RNA, 17 nt, Salmonella enterica enterica serovar Typhi Ty2
auaaaaacaauaaauaa

SEQ ID NO: 3697832 - RNA, 22 nt, Salmonella enterica enterica serovar Typhi Ty2
auaaaaacgcgcucgccagcgc

SEQ ID NO: 3697833 - RNA, 13 nt, Salmonella enterica enterica serovar Typhi Ty2
auaaaaacgggua

SEQ ID NO: 3697834 - RNA, 13 nt, Salmonella enterica enterica serovar Typhi Ty2
auaaaaagcacau

SEQ ID NO: 3697835 - RNA, 16 nt, Salmonella enterica enterica serovar Typhi Ty2
auaaaaagccagggaa

SEQ ID NO: 3697836 - RNA, 21 nt, Salmonella enterica enterica serovar Typhi Ty2
auaaaaagugcgcacucagaa

SEQ ID NO: 3697837 - RNA, 14 nt, Salmonella enterica enterica serovar Typhi Ty2
auaaaaauagcugg

SEQ ID NO: 3697838 - RNA, 14 nt, Salmonella enterica enterica serovar Typhi Ty2
auaaaaccggcaua

SEQ ID NO: 3697839 - RNA, 20 nt, Salmonella enterica enterica serovar Typhi Ty2
auaaaagagagcgccaaaaa

SEQ ID NO: 3697840 - RNA, 21 nt, Salmonella enterica enterica serovar Typhi Ty2
auaaaagagagcgccaaaaag

SEQ ID NO: 3697841 - RNA, 18 nt, Salmonella enterica enterica serovar Typhi Ty2
auaaaagcccuuaucgcc

SEQ ID NO: 3697842 - RNA, 21 nt, Salmonella enterica enterica serovar Typhi Ty2
auaaaagggaucuacggaucc

SEQ ID NO: 3697843 - RNA, 11 nt, Salmonella enterica enterica serovar Typhi Ty2
auaaaauaaac

SEQ ID NO: 3697844 - RNA, 19 nt, Salmonella enterica enterica serovar Typhi Ty2
auaaaauagugaucaucau

SEQ ID NO: 3697845 - RNA, 23 nt, Salmonella enterica enterica serovar Typhi Ty2
auaaaaucaucgcgcugauauuu

SEQ ID NO: 3697846 - RNA, 14 nt, Salmonella enterica enterica serovar Typhi Ty2
auaaaauccucuac

SEQ ID NO: 3697847 - RNA, 16 nt, Salmonella enterica enterica serovar Typhi Ty2
auaaaauccugcacgc

SEQ ID NO: 3697848 - RNA, 14 nt, Salmonella enterica enterica serovar Typhi Ty2
auaaaaugucuguu

SEQ ID NO: 3697849 - RNA, 13 nt, Salmonella enterica enterica serovar Typhi Ty2
auaaaauuauaaa

SEQ ID NO: 3697850 - RNA, 17 nt, Salmonella enterica enterica serovar Typhi Ty2
auaaaauuauuggcuuu

SEQ ID NO: 3697851 - RNA, 13 nt, Salmonella enterica enterica serovar Typhi Ty2
auaaaauucacuu

SEQ ID NO: 3697852 - RNA, 20 nt, Salmonella enterica enterica serovar Typhi Ty2
auaaacagauaugaaaugag

SEQ ID NO: 3697853 - RNA, 17 nt, Salmonella enterica enterica serovar Typhi Ty2
auaaacagcagcgcggc

SEQ ID NO: 3697854 - RNA, 22 nt, Salmonella enterica enterica serovar Typhi Ty2
auaaacagcucggcaaagccca

SEQ ID NO: 3697855 - RNA, 15 nt, Salmonella enterica enterica serovar Typhi Ty2
auaaacauaaagaca

SEQ ID NO: 3697856 - RNA, 16 nt, Salmonella enterica enterica serovar Typhi Ty2
auaaaccaaagcagag

SEQ ID NO: 3697857 - RNA, 15 nt, Salmonella enterica enterica serovar Typhi Ty2
auaaaccggcggccu

SEQ ID NO: 3697858 - RNA, 21 nt, Salmonella enterica enterica serovar Typhi Ty2
auaaacgccaguggaugcgcu

SEQ ID NO: 3697859 - RNA, 18 nt, Salmonella enterica enterica serovar Typhi Ty2
auaaacgcgccaaguaaa

SEQ ID NO: 3697860 - RNA, 16 nt, Salmonella enterica enterica serovar Typhi Ty2
auaaacgcuugacucu

SEQ ID NO: 3697861 - RNA, 18 nt, Salmonella enterica enterica serovar Typhi Ty2
auaaacggcgcguccagc

SEQ ID NO: 3697862 - RNA, 14 nt, Salmonella enterica enterica serovar Typhi Ty2
auaaacgggaagua

SEQ ID NO: 3697863 - RNA, 22 nt, Salmonella enterica enterica serovar Typhi Ty2
auaaacgggcccggcuuucugu

SEQ ID NO: 3697864 - RNA, 16 nt, Salmonella enterica enterica serovar Typhi Ty2
auaaacgguuucagua

SEQ ID NO: 3697865 - RNA, 21 nt, Salmonella enterica enterica serovar Typhi Ty2
auaaacucaaucaggcuaucg

SEQ ID NO: 3697866 - RNA, 14 nt, Salmonella enterica enterica serovar Typhi Ty2
auaaacucagcaau

SEQ ID NO: 3697867 - RNA, 21 nt, Salmonella enterica enterica serovar Typhi Ty2
auaaacucuguguuaugaaug

SEQ ID NO: 3697868 - RNA, 22 nt, Salmonella enterica enterica serovar Typhi Ty2
auaaacuucaauucagaaaguu

SEQ ID NO: 3697869 - RNA, 18 nt, Salmonella enterica enterica serovar Typhi Ty2
auaaagaaagcauuaaau

SEQ ID NO: 3697870 - RNA, 21 nt, Salmonella enterica enterica serovar Typhi Ty2
auaaagaaaguagaucaccag

SEQ ID NO: 3697871 - RNA, 13 nt, Salmonella enterica enterica serovar Typhi Ty2
auaaagaaauauu

SEQ ID NO: 3697872 - RNA, 17 nt, Salmonella enterica enterica serovar Typhi Ty2
auaaagauauucuccuc

SEQ ID NO: 3697873 - RNA, 17 nt, Salmonella enterica enterica serovar Typhi Ty2
auaaagcagcgacaaua

SEQ ID NO: 3697874 - RNA, 12 nt, Salmonella enterica enterica serovar Typhi Ty2
auaaagcagggc

SEQ ID NO: 3697875 - RNA, 18 nt, Salmonella enterica enterica serovar Typhi Ty2
auaaagcccuguuauuca

SEQ ID NO: 3697876 - RNA, 21 nt, Salmonella enterica enterica serovar Typhi Ty2
auaaagcggacugccuaacug

SEQ ID NO: 3697877 - RNA, 22 nt, Salmonella enterica enterica serovar Typhi Ty2
auaaagcugguugagauccaua

SEQ ID NO: 3697878 - RNA, 19 nt, Salmonella enterica enterica serovar Typhi Ty2
auaaaggccggcagccgcu

SEQ ID NO: 3697879 - RNA, 23 nt, Salmonella enterica enterica serovar Typhi Ty2
auaaaggccggcagccgcugaua

SEQ ID NO: 3697880 - RNA, 16 nt, Salmonella enterica enterica serovar Typhi Ty2
auaaagguauagugga

SEQ ID NO: 3697881 - RNA, 14 nt, Salmonella enterica enterica serovar Typhi Ty2
auaaaggucacauc

SEQ ID NO: 3697882 - RNA, 21 nt, Salmonella enterica enterica serovar Typhi Ty2
auaaaggucacaucaucgcca

SEQ ID NO: 3697883 - RNA, 21 nt, Salmonella enterica enterica serovar Typhi Ty2
auaaagugcugaacaauaaca

SEQ ID NO: 3697884 - RNA, 13 nt, Salmonella enterica enterica serovar Typhi Ty2
auaaaguuuauuu

SEQ ID NO: 3697885 - RNA, 21 nt, Salmonella enterica enterica serovar Typhi Ty2
auaaauaacauuucagucuaa

SEQ ID NO: 3697886 - RNA, 19 nt, Salmonella enterica enterica serovar Typhi Ty2
auaaauaaccgguaacugu

SEQ ID NO: 3697887 - RNA, 13 nt, Salmonella enterica enterica serovar Typhi Ty2
auaaauaauaucg

SEQ ID NO: 3697888 - RNA, 14 nt, Salmonella enterica enterica serovar Typhi Ty2
auaaauaaugccgu

SEQ ID NO: 3697889 - RNA, 16 nt, Salmonella enterica enterica serovar Typhi Ty2
auaaauacaauucaac

SEQ ID NO: 3697890 - RNA, 18 nt, Salmonella enterica enterica serovar Typhi Ty2
auaaauagccagcaucau

SEQ ID NO: 3697891 - RNA, 13 nt, Salmonella enterica enterica serovar Typhi Ty2
auaaauagccgac

SEQ ID NO: 3697892 - RNA, 14 nt, Salmonella enterica enterica serovar Typhi Ty2
auaaauaguaaaua

SEQ ID NO: 3697893 - RNA, 23 nt, Salmonella enterica enterica serovar Typhi Ty2
auaaauaguaaauagaaaauaau

SEQ ID NO: 3697894 - RNA, 16 nt, Salmonella enterica enterica serovar Typhi Ty2
auaaauauguuauuua

SEQ ID NO: 3697895 - RNA, 18 nt, Salmonella enterica enterica serovar Typhi Ty2
auaaauauuaaugaauaa

SEQ ID NO: 3697896 - RNA, 18 nt, Salmonella enterica enterica serovar Typhi Ty2
auaaauauucaucaaaau

SEQ ID NO: 3697897 - RNA, 23 nt, Salmonella enterica enterica serovar Typhi Ty2
auaaauauugcaacgaucccuaa

SEQ ID NO: 3697898 - RNA, 17 nt, Salmonella enterica enterica serovar Typhi Ty2
auaaaucaaaagugcac

SEQ ID NO: 3697899 - RNA, 19 nt, Salmonella enterica enterica serovar Typhi Ty2
auaaaucaacauacugauu

SEQ ID NO: 3697900 - RNA, 13 nt, Salmonella enterica enterica serovar Typhi Ty2
auaaaucagcaca

SEQ ID NO: 3697901 - RNA, 12 nt, Salmonella enterica enterica serovar Typhi Ty2
auaaaucauuac

SEQ ID NO: 3697902 - RNA, 18 nt, Salmonella enterica enterica serovar Typhi Ty2
auaaauccccgccgccau

SEQ ID NO: 3697903 - RNA, 20 nt, Salmonella enterica enterica serovar Typhi Ty2
auaaauccccgccgccauca

SEQ ID NO: 3697904 - RNA, 21 nt, Salmonella enterica enterica serovar Typhi Ty2
auaaaucccggcgauuaauaa

SEQ ID NO: 3697905 - RNA, 20 nt, Salmonella enterica enterica serovar Typhi Ty2
auaaaucgucggcaggguuu

SEQ ID NO: 3697906 - RNA, 18 nt, Salmonella enterica enterica serovar Typhi Ty2
auaaaugaauuauuuuuu

SEQ ID NO: 3697907 - RNA, 21 nt, Salmonella enterica enterica serovar Typhi Ty2
auaaaugguacuuuucaucca

SEQ ID NO: 3697908 - RNA, 15 nt, Salmonella enterica enterica serovar Typhi Ty2
auaaauucgaaauaa

SEQ ID NO: 3697909 - RNA, 21 nt, Salmonella enterica enterica serovar Typhi Ty2
auaaauucugucucaauaaaa

SEQ ID NO: 3697910 - RNA, 23 nt, Salmonella enterica enterica serovar Typhi Ty2
auaauacgccgguaucaucagau

SEQ ID NO: 3697911 - RNA, 13 nt, Salmonella enterica enterica serovar Typhi Ty2
auaauacgcgcga

SEQ ID NO: 3697912 - RNA, 20 nt, Salmonella enterica enterica serovar Typhi Ty2
auaauacuuaauucauaacg

SEQ ID NO: 3697913 - RNA, 15 nt, Salmonella enterica enterica serovar Typhi Ty2
auaauagaacccaaa

SEQ ID NO: 3697914 - RNA, 21 nt, Salmonella enterica enterica serovar Typhi Ty2
auaauagacaacaucccagaa

SEQ ID NO: 3697915 - RNA, 23 nt, Salmonella enterica enterica serovar Typhi Ty2
auaauaucaaucagcaaggcggc

SEQ ID NO: 3697916 - RNA, 20 nt, Salmonella enterica enterica serovar Typhi Ty2
auaauaucguuaagccuuca

SEQ ID NO: 3697917 - RNA, 17 nt, Salmonella enterica enterica serovar Typhi Ty2
auaauaugcaacacgcc

SEQ ID NO: 3697918 - RNA, 16 nt, Salmonella enterica enterica serovar Typhi Ty2
auaauaugcucaacuu

SEQ ID NO: 3697919 - RNA, 16 nt, Salmonella enterica enterica serovar Typhi Ty2
auaauauuaucauaau

SEQ ID NO: 3697920 - RNA, 18 nt, Salmonella enterica enterica serovar Typhi Ty2
auaauauuaucauaaugu

SEQ ID NO: 3697921 - RNA, 12 nt, Salmonella enterica enterica serovar Typhi Ty2
auaaucaaccau

SEQ ID NO: 3697922 - RNA, 14 nt, Salmonella enterica enterica serovar Typhi Ty2
auaaucaaccauac

SEQ ID NO: 3697923 - RNA, 20 nt, Salmonella enterica enterica serovar Typhi Ty2
auaaucacauuaugcugggu

SEQ ID NO: 3697924 - RNA, 12 nt, Salmonella enterica enterica serovar Typhi Ty2
auaaucaccacg

SEQ ID NO: 3697925 - RNA, 13 nt, Salmonella enterica enterica serovar Typhi Ty2
auaaucagcagcg

SEQ ID NO: 3697926 - RNA, 19 nt, Salmonella enterica enterica serovar Typhi Ty2
auaaucagcgcuccgacaa

SEQ ID NO: 3697927 - RNA, 11 nt, Salmonella enterica enterica serovar Typhi Ty2
auaaucaggag

SEQ ID NO: 3697928 - RNA, 13 nt, Salmonella enterica enterica serovar Typhi Ty2
auaaucauccgcu

SEQ ID NO: 3697929 - RNA, 20 nt, Salmonella enterica enterica serovar Typhi Ty2
auaauccgccuuuuccccca

SEQ ID NO: 3697930 - RNA, 20 nt, Salmonella enterica enterica serovar Typhi Ty2
auaauccggaauaagaauau

SEQ ID NO: 3697931 - RNA, 20 nt, Salmonella enterica enterica serovar Typhi Ty2
auaauccuuccuuucauuuu

SEQ ID NO: 3697932 - RNA, 18 nt, Salmonella enterica enterica serovar Typhi Ty2
auaauccuuguccaugua

SEQ ID NO: 3697933 - RNA, 16 nt, Salmonella enterica enterica serovar Typhi Ty2
auaaucgaccguaucc

SEQ ID NO: 3697934 - RNA, 14 nt, Salmonella enterica enterica serovar Typhi Ty2
auaaucgauauaau

SEQ ID NO: 3697935 - RNA, 22 nt, Salmonella enterica enterica serovar Typhi Ty2
auaaucgguagcacuuuaaaca

SEQ ID NO: 3697936 - RNA, 15 nt, Salmonella enterica enterica serovar Typhi Ty2
auaaucguuuuaugc

SEQ ID NO: 3697937 - RNA, 22 nt, Salmonella enterica enterica serovar Typhi Ty2
auaaucucugcgacaaucaggu

SEQ ID NO: 3697938 - RNA, 14 nt, Salmonella enterica enterica serovar Typhi Ty2
auaaugaauacaca

SEQ ID NO: 3697939 - RNA, 17 nt, Salmonella enterica enterica serovar Typhi Ty2
auaaugaauacgcucca

SEQ ID NO: 3697940 - RNA, 20 nt, Salmonella enterica enterica serovar Typhi Ty2
auaaugacgcuauucaugcc

SEQ ID NO: 3697941 - RNA, 11 nt, Salmonella enterica enterica serovar Typhi Ty2
auaaugcaauc

SEQ ID NO: 3697942 - RNA, 21 nt, Salmonella enterica enterica serovar Typhi Ty2
auaaugcaaucaguuccaauc

SEQ ID NO: 3697943 - RNA, 19 nt, Salmonella enterica enterica serovar Typhi Ty2
auaaugcacaauacgccga

SEQ ID NO: 3697944 - RNA, 12 nt, Salmonella enterica enterica serovar Typhi Ty2
auaaugcuuacg

SEQ ID NO: 3697945 - RNA, 19 nt, Salmonella enterica enterica serovar Typhi Ty2
auaauggagaugaaaauaa

SEQ ID NO: 3697946 - RNA, 21 nt, Salmonella enterica enterica serovar Typhi Ty2
auaauggagaugaaaauaauu

SEQ ID NO: 3697947 - RNA, 19 nt, Salmonella enterica enterica serovar Typhi Ty2
auaauggcgcgaaaacagc

SEQ ID NO: 3697948 - RNA, 21 nt, Salmonella enterica enterica serovar Typhi Ty2
auaauggggauuaucaggaug

SEQ ID NO: 3697949 - RNA, 15 nt, Salmonella enterica enterica serovar Typhi Ty2
auaaugucauuacua

SEQ ID NO: 3697950 - RNA, 18 nt, Salmonella enterica enterica serovar Typhi Ty2
auaaugucggauggcggc

SEQ ID NO: 3697951 - RNA, 18 nt, Salmonella enterica enterica serovar Typhi Ty2
auaauguuugcgccaucg

SEQ ID NO: 3697952 - RNA, 22 nt, Salmonella enterica enterica serovar Typhi Ty2
auaauuaagaccauacuuugca

SEQ ID NO: 3697953 - RNA, 22 nt, Salmonella enterica enterica serovar Typhi Ty2
auaauuaugccugucaucauca

SEQ ID NO: 3697954 - RNA, 19 nt, Salmonella enterica enterica serovar Typhi Ty2
auaauucauaacaccaaua

SEQ ID NO: 3697955 - RNA, 15 nt, Salmonella enterica enterica serovar Typhi Ty2
auaauugauaauaac

SEQ ID NO: 3697956 - RNA, 20 nt, Salmonella enterica enterica serovar Typhi Ty2
auaauugcucacccauuuua

SEQ ID NO: 3697957 - RNA, 11 nt, Salmonella enterica enterica serovar Typhi Ty2
auaauugcucu

SEQ ID NO: 3697958 - RNA, 12 nt, Salmonella enterica enterica serovar Typhi Ty2
auaauugcugcc

SEQ ID NO: 3697959 - RNA, 19 nt, Salmonella enterica enterica serovar Typhi Ty2
auaauuuuauuauauuuaa

SEQ ID NO: 3697960 - RNA, 15 nt, Salmonella enterica enterica serovar Typhi Ty2
auaauuuuugccuuu

SEQ ID NO: 3697961 - RNA, 13 nt, Salmonella enterica enterica serovar Typhi Ty2
auacaaauauccc

SEQ ID NO: 3697962 - RNA, 18 nt, Salmonella enterica enterica serovar Typhi Ty2
auacaccaaacgaauuua

SEQ ID NO: 3697963 - RNA, 14 nt, Salmonella enterica enterica serovar Typhi Ty2
auacaccgccagcg

SEQ ID NO: 3697964 - RNA, 11 nt, Salmonella enterica enterica serovar Typhi Ty2
auacaccuuca

SEQ ID NO: 3697965 - RNA, 15 nt, Salmonella enterica enterica serovar Typhi Ty2
auacaccuuugcccg

SEQ ID NO: 3697966 - RNA, 21 nt, Salmonella enterica enterica serovar Typhi Ty2
auacacgccuuccuccagcau

SEQ ID NO: 3697967 - RNA, 15 nt, Salmonella enterica enterica serovar Typhi Ty2
auacacgcgacaaug

SEQ ID NO: 3697968 - RNA, 15 nt, Salmonella enterica enterica serovar Typhi Ty2
auacacguaauacau

SEQ ID NO: 3697969 - RNA, 17 nt, Salmonella enterica enterica serovar Typhi Ty2
auacacucaaccaacca

SEQ ID NO: 3697970 - RNA, 14 nt, Salmonella enterica enterica serovar Typhi Ty2
auacacucaaccau

SEQ ID NO: 3697971 - RNA, 22 nt, Salmonella enterica enterica serovar Typhi Ty2
auacacucaaccaucaaaaaaa

SEQ ID NO: 3697972 - RNA, 20 nt, Salmonella enterica enterica serovar Typhi Ty2
auacacugcauaaauaucug

SEQ ID NO: 3697973 - RNA, 21 nt, Salmonella enterica enterica serovar Typhi Ty2
auacacuuuccauucgacagu

SEQ ID NO: 3697974 - RNA, 19 nt, Salmonella enterica enterica serovar Typhi Ty2
auacagaugcugucuuagu

SEQ ID NO: 3697975 - RNA, 14 nt, Salmonella enterica enterica serovar Typhi Ty2
auacagccagguug

SEQ ID NO: 3697976 - RNA, 20 nt, Salmonella enterica enterica serovar Typhi Ty2
auacagccgacuauuccgca

SEQ ID NO: 3697977 - RNA, 18 nt, Salmonella enterica enterica serovar Typhi Ty2
auacagcggcgcgccaau

SEQ ID NO: 3697978 - RNA, 16 nt, Salmonella enterica enterica serovar Typhi Ty2
auacaggaagccggug

SEQ ID NO: 3697979 - RNA, 14 nt, Salmonella enterica enterica serovar Typhi Ty2
auacaggcuuaaca

SEQ ID NO: 3697980 - RNA, 13 nt, Salmonella enterica enterica serovar Typhi Ty2
auacaguaccuuu

SEQ ID NO: 3697981 - RNA, 17 nt, Salmonella enterica enterica serovar Typhi Ty2
auacaguaguuuucauc

SEQ ID NO: 3697982 - RNA, 11 nt, Salmonella enterica enterica serovar Typhi Ty2
auacauaaauc

SEQ ID NO: 3697983 - RNA, 13 nt, Salmonella enterica enterica serovar Typhi Ty2
auacauaaauccg

SEQ ID NO: 3697984 - RNA, 16 nt, Salmonella enterica enterica serovar Typhi Ty2
auacauaaauccggau

SEQ ID NO: 3697985 - RNA, 21 nt, Salmonella enterica enterica serovar Typhi Ty2
auacauaccacgcagcggcau

SEQ ID NO: 3697986 - RNA, 20 nt, Salmonella enterica enterica serovar Typhi Ty2
auacauauuguuuucuauuu

SEQ ID NO: 3697987 - RNA, 18 nt, Salmonella enterica enterica serovar Typhi Ty2
auacaucaugcuugcuuu

SEQ ID NO: 3697988 - RNA, 15 nt, Salmonella enterica enterica serovar Typhi Ty2
auacauccugauuau

SEQ ID NO: 3697989 - RNA, 23 nt, Salmonella enterica enterica serovar Typhi Ty2
auacauccugauuauuacaauaa

SEQ ID NO: 3697990 - RNA, 21 nt, Salmonella enterica enterica serovar Typhi Ty2
auacaugaggauuuugagcac

SEQ ID NO: 3697991 - RNA, 13 nt, Salmonella enterica enterica serovar Typhi Ty2
auacauuaacgcu

SEQ ID NO: 3697992 - RNA, 21 nt, Salmonella enterica enterica serovar Typhi Ty2
auacugaagauaaacagcagc

SEQ ID NO: 3697993 - RNA, 12 nt, Salmonella enterica enterica serovar Typhi Ty2
auacugaccaac

SEQ ID NO: 3697994 - RNA, 18 nt, Salmonella enterica enterica serovar Typhi Ty2
auacugaccaacaacaga

SEQ ID NO: 3697995 - RNA, 21 nt, Salmonella enterica enterica serovar Typhi Ty2
auacugaccaacaacagauau

SEQ ID NO: 3697996 - RNA, 13 nt, Salmonella enterica enterica serovar Typhi Ty2
auacugauaaaaa

SEQ ID NO: 3697997 - RNA, 13 nt, Salmonella enterica enterica serovar Typhi Ty2
auacugccgccgu

SEQ ID NO: 3697998 - RNA, 22 nt, Salmonella enterica enterica serovar Typhi Ty2
auacuggccgguuuuaaaaaua

SEQ ID NO: 3697999 - RNA, 13 nt, Salmonella enterica enterica serovar Typhi Ty2
auacugucuugug

SEQ ID NO: 3698000 - RNA, 18 nt, Salmonella enterica enterica serovar Typhi Ty2
auacugugggauuuuugg

SEQ ID NO: 3698001 - RNA, 16 nt, Salmonella enterica enterica serovar Typhi Ty2
auacuguuuuugcuuu

SEQ ID NO: 3698002 - RNA, 14 nt, Salmonella enterica enterica serovar Typhi Ty2
auacuuacugcugu

SEQ ID NO: 3698003 - RNA, 19 nt, Salmonella enterica enterica serovar Typhi Ty2
auacuuauugauccacgga

SEQ ID NO: 3698004 - RNA, 13 nt, Salmonella enterica enterica serovar Typhi Ty2
auacuucaucagg

SEQ ID NO: 3698005 - RNA, 17 nt, Salmonella enterica enterica serovar Typhi Ty2
auacuuccgcuggcuuu

SEQ ID NO: 3698006 - RNA, 12 nt, Salmonella enterica enterica serovar Typhi Ty2
auacuuuuacuc

SEQ ID NO: 3698007 - RNA, 20 nt, Salmonella enterica enterica serovar Typhi Ty2
auagaagcucaugugcagca

SEQ ID NO: 3698008 - RNA, 20 nt, Salmonella enterica enterica serovar Typhi Ty2
auagaauaggaaauaauuaa

SEQ ID NO: 3698009 - RNA, 21 nt, Salmonella enterica enterica serovar Typhi Ty2
auagacagcggcuaauuuauu

SEQ ID NO: 3698010 - RNA, 16 nt, Salmonella enterica enterica serovar Typhi Ty2
auagacagugauuuac

SEQ ID NO: 3698011 - RNA, 15 nt, Salmonella enterica enterica serovar Typhi Ty2
auagacauccagcau

SEQ ID NO: 3698012 - RNA, 13 nt, Salmonella enterica enterica serovar Typhi Ty2
auagaccacgcca

SEQ ID NO: 3698013 - RNA, 16 nt, Salmonella enterica enterica serovar Typhi Ty2
auagaccacgccauca

SEQ ID NO: 3698014 - RNA, 22 nt, Salmonella enterica enterica serovar Typhi Ty2
auagacgacaucuuuuccugaa

SEQ ID NO: 3698015 - RNA, 18 nt, Salmonella enterica enterica serovar Typhi Ty2
auagacgcccugcaaagc

SEQ ID NO: 3698016 - RNA, 22 nt, Salmonella enterica enterica serovar Typhi Ty2
auagacgcccugcaaagcaaaa

SEQ ID NO: 3698017 - RNA, 15 nt, Salmonella enterica enterica serovar Typhi Ty2
auagacuuaggaaug

SEQ ID NO: 3698018 - RNA, 21 nt, Salmonella enterica enterica serovar Typhi Ty2
auagacuucacuuucccggaa

SEQ ID NO: 3698019 - RNA, 14 nt, Salmonella enterica enterica serovar Typhi Ty2
auagagaaaucaac

SEQ ID NO: 3698020 - RNA, 17 nt, Salmonella enterica enterica serovar Typhi Ty2
auagagagcgacagccc

SEQ ID NO: 3698021 - RNA, 14 nt, Salmonella enterica enterica serovar Typhi Ty2
auagagaguuccuc

SEQ ID NO: 3698022 - RNA, 15 nt, Salmonella enterica enterica serovar Typhi Ty2
auagaguaauacauc

SEQ ID NO: 3698023 - RNA, 15 nt, Salmonella enterica enterica serovar Typhi Ty2
auagauaaguccuaa

SEQ ID NO: 3698024 - RNA, 20 nt, Salmonella enterica enterica serovar Typhi Ty2
auagauauaacccaguucaa

SEQ ID NO: 3698025 - RNA, 22 nt, Salmonella enterica enterica serovar Typhi Ty2
auagauaucaaacacaaauuuc

SEQ ID NO: 3698026 - RNA, 15 nt, Salmonella enterica enterica serovar Typhi Ty2
auagauaugaaagaa

SEQ ID NO: 3698027 - RNA, 23 nt, Salmonella enterica enterica serovar Typhi Ty2
auagaucagacgaccauccacca

SEQ ID NO: 3698028 - RNA, 13 nt, Salmonella enterica enterica serovar Typhi Ty2
auagauuugauuc

SEQ ID NO: 3698029 - RNA, 17 nt, Salmonella enterica enterica serovar Typhi Ty2
auagcaaacccucaucg

SEQ ID NO: 3698030 - RNA, 18 nt, Salmonella enterica enterica serovar Typhi Ty2
auagcaacccacuuucgg

SEQ ID NO: 3698031 - RNA, 18 nt, Salmonella enterica enterica serovar Typhi Ty2
auagcaacguccgcagcc

SEQ ID NO: 3698032 - RNA, 17 nt, Salmonella enterica enterica serovar Typhi Ty2
auagcaauacuuuccag

SEQ ID NO: 3698033 - RNA, 19 nt, Salmonella enterica enterica serovar Typhi Ty2
auagcaaucauccugauuu

SEQ ID NO: 3698034 - RNA, 13 nt, Salmonella enterica enterica serovar Typhi Ty2
auagcaauuaaua

SEQ ID NO: 3698035 - RNA, 13 nt, Salmonella enterica enterica serovar Typhi Ty2
auagcaauuucag

SEQ ID NO: 3698036 - RNA, 15 nt, Salmonella enterica enterica serovar Typhi Ty2
auagcaccucgcaau

SEQ ID NO: 3698037 - RNA, 15 nt, Salmonella enterica enterica serovar Typhi Ty2
auagcagcaaauuua

SEQ ID NO: 3698038 - RNA, 13 nt, Salmonella enterica enterica serovar Typhi Ty2
auagcaucaccag

SEQ ID NO: 3698039 - RNA, 20 nt, Salmonella enterica enterica serovar Typhi Ty2
auagcaucggucaacugaau

SEQ ID NO: 3698040 - RNA, 17 nt, Salmonella enterica enterica serovar Typhi Ty2
auagcaucguaagccgc

SEQ ID NO: 3698041 - RNA, 22 nt, Salmonella enterica enterica serovar Typhi Ty2
auagcauggcguguaguaaugc

SEQ ID NO: 3698042 - RNA, 19 nt, Salmonella enterica enterica serovar Typhi Ty2
auagcauuaagcugauauu

SEQ ID NO: 3698043 - RNA, 13 nt, Salmonella enterica enterica serovar Typhi Ty2
auagccaaaagcu

SEQ ID NO: 3698044 - RNA, 16 nt, Salmonella enterica enterica serovar Typhi Ty2
auagccaacacauaag

SEQ ID NO: 3698045 - RNA, 14 nt, Salmonella enterica enterica serovar Typhi Ty2
auagccacaggcug

SEQ ID NO: 3698046 - RNA, 22 nt, Salmonella enterica enterica serovar Typhi Ty2
auagccagccccagaaaauuaa

SEQ ID NO: 3698047 - RNA, 11 nt, Salmonella enterica enterica serovar Typhi Ty2
auagccaggca

SEQ ID NO: 3698048 - RNA, 13 nt, Salmonella enterica enterica serovar Typhi Ty2
auagccauuuaau

SEQ ID NO: 3698049 - RNA, 22 nt, Salmonella enterica enterica serovar Typhi Ty2
auagcccggcauguccaucaga

SEQ ID NO: 3698050 - RNA, 16 nt, Salmonella enterica enterica serovar Typhi Ty2
auagcccuauucguga

SEQ ID NO: 3698051 - RNA, 17 nt, Salmonella enterica enterica serovar Typhi Ty2
auagccgacccgcaucg

SEQ ID NO: 3698052 - RNA, 23 nt, Salmonella enterica enterica serovar Typhi Ty2
auagccggauaauuuauccagua

SEQ ID NO: 3698053 - RNA, 16 nt, Salmonella enterica enterica serovar Typhi Ty2
auagccgguaacuuuc

SEQ ID NO: 3698054 - RNA, 21 nt, Salmonella enterica enterica serovar Typhi Ty2
auagccgguaacuuucccgcu

SEQ ID NO: 3698055 - RNA, 19 nt, Salmonella enterica enterica serovar Typhi Ty2
auagcgaccuuaccggcga

SEQ ID NO: 3698056 - RNA, 13 nt, Salmonella enterica enterica serovar Typhi Ty2
auagcgagaggca

SEQ ID NO: 3698057 - RNA, 18 nt, Salmonella enterica enterica serovar Typhi Ty2
auagcgaggcagcaggau

SEQ ID NO: 3698058 - RNA, 22 nt, Salmonella enterica enterica serovar Typhi Ty2
auagcgaggcguuuugguccgc

SEQ ID NO: 3698059 - RNA, 12 nt, Salmonella enterica enterica serovar Typhi Ty2
auagcgccaucc

SEQ ID NO: 3698060 - RNA, 15 nt, Salmonella enterica enterica serovar Typhi Ty2
auagcgccauccugc

SEQ ID NO: 3698061 - RNA, 11 nt, Salmonella enterica enterica serovar Typhi Ty2
auagcgcccca

SEQ ID NO: 3698062 - RNA, 19 nt, Salmonella enterica enterica serovar Typhi Ty2
auagcgccuucaggcauca

SEQ ID NO: 3698063 - RNA, 14 nt, Salmonella enterica enterica serovar Typhi Ty2
auagcgcggaauau

SEQ ID NO: 3698064 - RNA, 17 nt, Salmonella enterica enterica serovar Typhi Ty2
auagcgcugaaguccgc

SEQ ID NO: 3698065 - RNA, 22 nt, Salmonella enterica enterica serovar Typhi Ty2
auagcgcuggcgccgcaaacca

SEQ ID NO: 3698066 - RNA, 15 nt, Salmonella enterica enterica serovar Typhi Ty2
auagcgcuuuccugc

SEQ ID NO: 3698067 - RNA, 23 nt, Salmonella enterica enterica serovar Typhi Ty2
auagcggcguuuauauaaaaaua

SEQ ID NO: 3698068 - RNA, 11 nt, Salmonella enterica enterica serovar Typhi Ty2
auagcguauuu

SEQ ID NO: 3698069 - RNA, 13 nt, Salmonella enterica enterica serovar Typhi Ty2
auagcguuuucca

SEQ ID NO: 3698070 - RNA, 20 nt, Salmonella enterica enterica serovar Typhi Ty2
auagcguuuuuucaucggca

SEQ ID NO: 3698071 - RNA, 15 nt, Salmonella enterica enterica serovar Typhi Ty2
auagcuaaugcaaua

SEQ ID NO: 3698072 - RNA, 20 nt, Salmonella enterica enterica serovar Typhi Ty2
auagcuaaugcgguugcgau

SEQ ID NO: 3698073 - RNA, 12 nt, Salmonella enterica enterica serovar Typhi Ty2
auagcuggcugu

SEQ ID NO: 3698074 - RNA, 15 nt, Salmonella enterica enterica serovar Typhi Ty2
auaucccuauuagca

SEQ ID NO: 3698075 - RNA, 20 nt, Salmonella enterica enterica serovar Typhi Ty2
auaucccuauuagcacgccc

SEQ ID NO: 3698076 - RNA, 22 nt, Salmonella enterica enterica serovar Typhi Ty2
auauccgcugcggucaggaaug

SEQ ID NO: 3698077 - RNA, 15 nt, Salmonella enterica enterica serovar Typhi Ty2
auauccgguacacca

SEQ ID NO: 3698078 - RNA, 23 nt, Salmonella enterica enterica serovar Typhi Ty2
auauccgugcgcaauuccagcaa

SEQ ID NO: 3698079 - RNA, 13 nt, Salmonella enterica enterica serovar Typhi Ty2
auauccuccggca

SEQ ID NO: 3698080 - RNA, 19 nt, Salmonella enterica enterica serovar Typhi Ty2
auauccucgcauccuccau

SEQ ID NO: 3698081 - RNA, 22 nt, Salmonella enterica enterica serovar Typhi Ty2
auauccugcuuaauauccaguu

SEQ ID NO: 3698082 - RNA, 20 nt, Salmonella enterica enterica serovar Typhi Ty2
auauccuggcgagaauagaa

SEQ ID NO: 3698083 - RNA, 22 nt, Salmonella enterica enterica serovar Typhi Ty2
auaucgacauaaguaaauaaca

SEQ ID NO: 3698084 - RNA, 17 nt, Salmonella enterica enterica serovar Typhi Ty2
auaucgauagcauuuuu

SEQ ID NO: 3698085 - RNA, 19 nt, Salmonella enterica enterica serovar Typhi Ty2
auaucgccuugcugcggca

SEQ ID NO: 3698086 - RNA, 17 nt, Salmonella enterica enterica serovar Typhi Ty2
auaucgcgauaaacuga

SEQ ID NO: 3698087 - RNA, 22 nt, Salmonella enterica enterica serovar Typhi Ty2
auaucgcggguaaacucaccca

SEQ ID NO: 3698088 - RNA, 15 nt, Salmonella enterica enterica serovar Typhi Ty2
auaucgcgucaucaa

SEQ ID NO: 3698089 - RNA, 15 nt, Salmonella enterica enterica serovar Typhi Ty2
auaucgcuaaaccaa

SEQ ID NO: 3698090 - RNA, 18 nt, Salmonella enterica enterica serovar Typhi Ty2
auaucgcuaaaccaaacu

SEQ ID NO: 3698091 - RNA, 18 nt, Salmonella enterica enterica serovar Typhi Ty2
auaucgcuaaccaaacca

SEQ ID NO: 3698092 - RNA, 18 nt, Salmonella enterica enterica serovar Typhi Ty2
auaucggccggaugccag

SEQ ID NO: 3698093 - RNA, 14 nt, Salmonella enterica enterica serovar Typhi Ty2
auaucggcugcugu

SEQ ID NO: 3698094 - RNA, 15 nt, Salmonella enterica enterica serovar Typhi Ty2
auaucguugccgccg

SEQ ID NO: 3698095 - RNA, 21 nt, Salmonella enterica enterica serovar Typhi Ty2
auaucugagcugguuucuccg

SEQ ID NO: 3698096 - RNA, 19 nt, Salmonella enterica enterica serovar Typhi Ty2
auaucuggacgggccgcca

SEQ ID NO: 3698097 - RNA, 16 nt, Salmonella enterica enterica serovar Typhi Ty2
auaucuggcgaggcuu

SEQ ID NO: 3698098 - RNA, 20 nt, Salmonella enterica enterica serovar Typhi Ty2
auaucuguuucauggagauc

SEQ ID NO: 3698099 - RNA, 22 nt, Salmonella enterica enterica serovar Typhi Ty2
auaucuuccaggcuauccaaca

SEQ ID NO: 3698100 - RNA, 17 nt, Salmonella enterica enterica serovar Typhi Ty2
auaugaaccaagauaag

SEQ ID NO: 3698101 - RNA, 20 nt, Salmonella enterica enterica serovar Typhi Ty2
auaugaauaauuucggcggc

SEQ ID NO: 3698102 - RNA, 17 nt, Salmonella enterica enterica serovar Typhi Ty2
auaugaaucaucagaau

SEQ ID NO: 3698103 - RNA, 18 nt, Salmonella enterica enterica serovar Typhi Ty2
auaugacguauugaaaau

SEQ ID NO: 3698104 - RNA, 23 nt, Salmonella enterica enterica serovar Typhi Ty2
auaugauauguguaucuugcuuu

SEQ ID NO: 3698105 - RNA, 21 nt, Salmonella enterica enterica serovar Typhi Ty2
auaugaucgaaaaugcgcaug

SEQ ID NO: 3698106 - RNA, 18 nt, Salmonella enterica enterica serovar Typhi Ty2
auaugaucugcacaacau

SEQ ID NO: 3698107 - RNA, 19 nt, Salmonella enterica enterica serovar Typhi Ty2
auaugaucugcgcaacauu

SEQ ID NO: 3698108 - RNA, 13 nt, Salmonella enterica enterica serovar Typhi Ty2
auaugauuuaaaa

SEQ ID NO: 3698109 - RNA, 14 nt, Salmonella enterica enterica serovar Typhi Ty2
auaugauuuaaaaa

SEQ ID NO: 3698110 - RNA, 16 nt, Salmonella enterica enterica serovar Typhi Ty2
auaugauuuaaaaaag

SEQ ID NO: 3698111 - RNA, 16 nt, Salmonella enterica enterica serovar Typhi Ty2
auaugcagcagccagu

SEQ ID NO: 3698112 - RNA, 21 nt, Salmonella enterica enterica serovar Typhi Ty2
auaugcaggcauaaaaaagag

SEQ ID NO: 3698113 - RNA, 14 nt, Salmonella enterica enterica serovar Typhi Ty2
auaugccaaguaau

SEQ ID NO: 3698114 - RNA, 13 nt, Salmonella enterica enterica serovar Typhi Ty2
auaugccaggcau

SEQ ID NO: 3698115 - RNA, 17 nt, Salmonella enterica enterica serovar Typhi Ty2
auaugccccgacaucag

SEQ ID NO: 3698116 - RNA, 18 nt, Salmonella enterica enterica serovar Typhi Ty2
auaugccccgacaucaga

SEQ ID NO: 3698117 - RNA, 19 nt, Salmonella enterica enterica serovar Typhi Ty2
auaugcgacagaaauugaa

SEQ ID NO: 3698118 - RNA, 13 nt, Salmonella enterica enterica serovar Typhi Ty2
auaugcgcaauca

SEQ ID NO: 3698119 - RNA, 12 nt, Salmonella enterica enterica serovar Typhi Ty2
auaugcgcauca

SEQ ID NO: 3698120 - RNA, 13 nt, Salmonella enterica enterica serovar Typhi Ty2
auaugcgcaucag

SEQ ID NO: 3698121 - RNA, 23 nt, Salmonella enterica enterica serovar Typhi Ty2
auaugcggucguauuaccaaccc

SEQ ID NO: 3698122 - RNA, 19 nt, Salmonella enterica enterica serovar Typhi Ty2
auaugcguguagcagauag

SEQ ID NO: 3698123 - RNA, 18 nt, Salmonella enterica enterica serovar Typhi Ty2
auaugcuguuuauggcgc

SEQ ID NO: 3698124 - RNA, 20 nt, Salmonella enterica enterica serovar Typhi Ty2
auauggauauucaucgccgu

SEQ ID NO: 3698125 - RNA, 13 nt, Salmonella enterica enterica serovar Typhi Ty2
auauguaaaucgg

SEQ ID NO: 3698126 - RNA, 18 nt, Salmonella enterica enterica serovar Typhi Ty2
auauguggauguaccaga

SEQ ID NO: 3698127 - RNA, 18 nt, Salmonella enterica enterica serovar Typhi Ty2
auauguuccggcgucgcg

SEQ ID NO: 3698128 - RNA, 17 nt, Salmonella enterica enterica serovar Typhi Ty2
auauguuugacaagcag

SEQ ID NO: 3698129 - RNA, 24 nt, Salmonella enterica enterica serovar Typhi Ty2
auauguuugauaaacugcgccaug

SEQ ID NO: 3698130 - RNA, 14 nt, Salmonella enterica enterica serovar Typhi Ty2
auauuaaaagccgc

SEQ ID NO: 3698131 - RNA, 13 nt, Salmonella enterica enterica serovar Typhi Ty2
auauuaaauaaau

SEQ ID NO: 3698132 - RNA, 21 nt, Salmonella enterica enterica serovar Typhi Ty2
auauuaaauaaauaguaaaua

SEQ ID NO: 3698133 - RNA, 14 nt, Salmonella enterica enterica serovar Typhi Ty2
auauuauaaaauaa

SEQ ID NO: 3698134 - RNA, 14 nt, Salmonella enterica enterica serovar Typhi Ty2
auauuaucauaaug

SEQ ID NO: 3698135 - RNA, 13 nt, Salmonella enterica enterica serovar Typhi Ty2
auauuauuauaua

SEQ ID NO: 3698136 - RNA, 22 nt, Salmonella enterica enterica serovar Typhi Ty2
auauuauugacgcuuucuuccc

SEQ ID NO: 3698137 - RNA, 15 nt, Salmonella enterica enterica serovar Typhi Ty2
auauucaaaauccgc

SEQ ID NO: 3698138 - RNA, 22 nt, Salmonella enterica enterica serovar Typhi Ty2
auauucaacgaaugccugcaua

SEQ ID NO: 3698139 - RNA, 22 nt, Salmonella enterica enterica serovar Typhi Ty2
auauucagaauuuuuaaccauc

SEQ ID NO: 3698140 - RNA, 19 nt, Salmonella enterica enterica serovar Typhi Ty2
auauucaucaguuuaaccg

SEQ ID NO: 3698141 - RNA, 21 nt, Salmonella enterica enterica serovar Typhi Ty2
auauucaugccagaagcaaau

SEQ ID NO: 3698142 - RNA, 11 nt, Salmonella enterica enterica serovar Typhi Ty2
auauuccagaa

SEQ ID NO: 3698143 - RNA, 11 nt, Salmonella enterica enterica serovar Typhi Ty2
auauuccccac

SEQ ID NO: 3698144 - RNA, 22 nt, Salmonella enterica enterica serovar Typhi Ty2
auauucccguuccagcuugaau

SEQ ID NO: 3698145 - RNA, 18 nt, Salmonella enterica enterica serovar Typhi Ty2
auauuccgccucguguaa

SEQ ID NO: 3698146 - RNA, 16 nt, Salmonella enterica enterica serovar Typhi Ty2
auauuccgcgcuaucg

SEQ ID NO: 3698147 - RNA, 20 nt, Salmonella enterica enterica serovar Typhi Ty2
auauuccucuuccucgauau

SEQ ID NO: 3698148 - RNA, 14 nt, Salmonella enterica enterica serovar Typhi Ty2
auauucgauuuaau

SEQ ID NO: 3698149 - RNA, 18 nt, Salmonella enterica enterica serovar Typhi Ty2
auauucgcagcucugugu

SEQ ID NO: 3698150 - RNA, 23 nt, Salmonella enterica enterica serovar Typhi Ty2
auauucgcgaugcucaaccagua

SEQ ID NO: 3698151 - RNA, 14 nt, Salmonella enterica enterica serovar Typhi Ty2
auauucgcggcuuu

SEQ ID NO: 3698152 - RNA, 20 nt, Salmonella enterica enterica serovar Typhi Ty2
auauucuguuagcgcccucu

SEQ ID NO: 3698153 - RNA, 21 nt, Salmonella enterica enterica serovar Typhi Ty2
auauucuucuuagaauagaau

SEQ ID NO: 3698154 - RNA, 20 nt, Salmonella enterica enterica serovar Typhi Ty2
auauugccauaaauacaauu

SEQ ID NO: 3698155 - RNA, 21 nt, Salmonella enterica enterica serovar Typhi Ty2
auauugccgaccgccagcaga

SEQ ID NO: 3698156 - RNA, 17 nt, Salmonella enterica enterica serovar Typhi Ty2
aucaccauucccagcgc

SEQ ID NO: 3698157 - RNA, 18 nt, Salmonella enterica enterica serovar Typhi Ty2
aucaccauucccagcgcc

SEQ ID NO: 3698158 - RNA, 22 nt, Salmonella enterica enterica serovar Typhi Ty2
aucacccaacguucaugucggc

SEQ ID NO: 3698159 - RNA, 18 nt, Salmonella enterica enterica serovar Typhi Ty2
aucaccgccagucccagc

SEQ ID NO: 3698160 - RNA, 20 nt, Salmonella enterica enterica serovar Typhi Ty2
aucaccgcccaaugccccca

SEQ ID NO: 3698161 - RNA, 21 nt, Salmonella enterica enterica serovar Typhi Ty2
aucaccgcggcaaccagccca

SEQ ID NO: 3698162 - RNA, 22 nt, Salmonella enterica enterica serovar Typhi Ty2
aucaccgcugacugaacucauc

SEQ ID NO: 3698163 - RNA, 13 nt, Salmonella enterica enterica serovar Typhi Ty2
aucaccggcauuu

SEQ ID NO: 3698164 - RNA, 15 nt, Salmonella enterica enterica serovar Typhi Ty2
aucaccggcauuuca

SEQ ID NO: 3698165 - RNA, 16 nt, Salmonella enterica enterica serovar Typhi Ty2
aucaccguuuuccagg

SEQ ID NO: 3698166 - RNA, 22 nt, Salmonella enterica enterica serovar Typhi Ty2
aucaccugaccgauauagccac

SEQ ID NO: 3698167 - RNA, 22 nt, Salmonella enterica enterica serovar Typhi Ty2
aucaccugauugauacgcgccc

SEQ ID NO: 3698168 - RNA, 23 nt, Salmonella enterica enterica serovar Typhi Ty2
aucaccugcuggcggcguaagcg

SEQ ID NO: 3698169 - RNA, 14 nt, Salmonella enterica enterica serovar Typhi Ty2
aucacgaaauaacg

SEQ ID NO: 3698170 - RNA, 15 nt, Salmonella enterica enterica serovar Typhi Ty2
aucacgaaauaacgc

SEQ ID NO: 3698171 - RNA, 21 nt, Salmonella enterica enterica serovar Typhi Ty2
aucacgccacaguauuccggc

SEQ ID NO: 3698172 - RNA, 18 nt, Salmonella enterica enterica serovar Typhi Ty2
aucacgccacgucaccau

SEQ ID NO: 3698173 - RNA, 23 nt, Salmonella enterica enterica serovar Typhi Ty2
aucacgcccgcagcaauagaaua

SEQ ID NO: 3698174 - RNA, 17 nt, Salmonella enterica enterica serovar Typhi Ty2
aucacgccguccagcac

SEQ ID NO: 3698175 - RNA, 18 nt, Salmonella enterica enterica serovar Typhi Ty2
aucacgccguccagcacc

SEQ ID NO: 3698176 - RNA, 19 nt, Salmonella enterica enterica serovar Typhi Ty2
aucacgcguaucuggucau

SEQ ID NO: 3698177 - RNA, 22 nt, Salmonella enterica enterica serovar Typhi Ty2
aucacgcuaagucaacucaugc

SEQ ID NO: 3698178 - RNA, 23 nt, Salmonella enterica enterica serovar Typhi Ty2
aucacgcugaaaacggcaucaag

SEQ ID NO: 3698179 - RNA, 18 nt, Salmonella enterica enterica serovar Typhi Ty2
aucacgcuggauaagacg

SEQ ID NO: 3698180 - RNA, 16 nt, Salmonella enterica enterica serovar Typhi Ty2
aucacgguaaaccugu

SEQ ID NO: 3698181 - RNA, 15 nt, Salmonella enterica enterica serovar Typhi Ty2
aucacgguacgcauc

SEQ ID NO: 3698182 - RNA, 16 nt, Salmonella enterica enterica serovar Typhi Ty2
aucacgguacgcauca

SEQ ID NO: 3698183 - RNA, 22 nt, Salmonella enterica enterica serovar Typhi Ty2
aucacgguauucguuaccagca

SEQ ID NO: 3698184 - RNA, 17 nt, Salmonella enterica enterica serovar Typhi Ty2
aucacguuccuuuacuu

SEQ ID NO: 3698185 - RNA, 19 nt, Salmonella enterica enterica serovar Typhi Ty2
aucacguuuugcagcgcca

SEQ ID NO: 3698186 - RNA, 14 nt, Salmonella enterica enterica serovar Typhi Ty2
aucacuaauuugcg

SEQ ID NO: 3698187 - RNA, 13 nt, Salmonella enterica enterica serovar Typhi Ty2
aucacuaccgcca

SEQ ID NO: 3698188 - RNA, 21 nt, Salmonella enterica enterica serovar Typhi Ty2
aucacuaucaguuuuggcaau

SEQ ID NO: 3698189 - RNA, 19 nt, Salmonella enterica enterica serovar Typhi Ty2
aucacuauuugugcggcau

SEQ ID NO: 3698190 - RNA, 17 nt, Salmonella enterica enterica serovar Typhi Ty2
aucacugauauaacccu

SEQ ID NO: 3698191 - RNA, 13 nt, Salmonella enterica enterica serovar Typhi Ty2
aucacugcaccuc

SEQ ID NO: 3698192 - RNA, 14 nt, Salmonella enterica enterica serovar Typhi Ty2
aucacugccgccac

SEQ ID NO: 3698193 - RNA, 20 nt, Salmonella enterica enterica serovar Typhi Ty2
aucacuggagcgcauuuuac

SEQ ID NO: 3698194 - RNA, 21 nt, Salmonella enterica enterica serovar Typhi Ty2
aucacuggagcgcauuuuacu

SEQ ID NO: 3698195 - RNA, 17 nt, Salmonella enterica enterica serovar Typhi Ty2
aucacuuacuaagguaa

SEQ ID NO: 3698196 - RNA, 18 nt, Salmonella enterica enterica serovar Typhi Ty2
aucacuuaucaaaccagc

SEQ ID NO: 3698197 - RNA, 20 nt, Salmonella enterica enterica serovar Typhi Ty2
aucacuuaucaaaccagcuu

SEQ ID NO: 3698198 - RNA, 10 nt, Salmonella enterica enterica serovar Typhi Ty2
aucacuucca

SEQ ID NO: 3698199 - RNA, 13 nt, Salmonella enterica enterica serovar Typhi Ty2
aucacuuccgcca

SEQ ID NO: 3698200 - RNA, 20 nt, Salmonella enterica enterica serovar Typhi Ty2
aucacuuccgccaccacgcc

SEQ ID NO: 3698201 - RNA, 17 nt, Salmonella enterica enterica serovar Typhi Ty2
aucacuuucacccaugc

SEQ ID NO: 3698202 - RNA, 13 nt, Salmonella enterica enterica serovar Typhi Ty2
aucacuuucaguu

SEQ ID NO: 3698203 - RNA, 14 nt, Salmonella enterica enterica serovar Typhi Ty2
aucacuuuugauaa

SEQ ID NO: 3698204 - RNA, 13 nt, Salmonella enterica enterica serovar Typhi Ty2
aucacuuuuggcg

SEQ ID NO: 3698205 - RNA, 23 nt, Salmonella enterica enterica serovar Typhi Ty2
aucacuuuuuauuuguuccucuu

SEQ ID NO: 3698206 - RNA, 19 nt, Salmonella enterica enterica serovar Typhi Ty2
aucagaaaaaagccaagca

SEQ ID NO: 3698207 - RNA, 20 nt, Salmonella enterica enterica serovar Typhi Ty2
aucagaaaaaauuacagccg

SEQ ID NO: 3698208 - RNA, 15 nt, Salmonella enterica enterica serovar Typhi Ty2
aucagaaaaaccucc

SEQ ID NO: 3698209 - RNA, 18 nt, Salmonella enterica enterica serovar Typhi Ty2
aucagaaaaaccuccggc

SEQ ID NO: 3698210 - RNA, 19 nt, Salmonella enterica enterica serovar Typhi Ty2
aucagaaaaaccuccggcu

SEQ ID NO: 3698211 - RNA, 23 nt, Salmonella enterica enterica serovar Typhi Ty2
aucagaacaaacuuaucccacaa

SEQ ID NO: 3698212 - RNA, 19 nt, Salmonella enterica enterica serovar Typhi Ty2
aucagaagcuaagggaugc

SEQ ID NO: 3698213 - RNA, 22 nt, Salmonella enterica enterica serovar Typhi Ty2
aucagaccaucggccgcuaucu

SEQ ID NO: 3698214 - RNA, 13 nt, Salmonella enterica enterica serovar Typhi Ty2
aucagaccgacaa

SEQ ID NO: 3698215 - RNA, 16 nt, Salmonella enterica enterica serovar Typhi Ty2
aucagaccgacaaaac

SEQ ID NO: 3698216 - RNA, 18 nt, Salmonella enterica enterica serovar Typhi Ty2
aucagaccgagacccagc

SEQ ID NO: 3698217 - RNA, 20 nt, Salmonella enterica enterica serovar Typhi Ty2
aucagaccgagacccagcgc

SEQ ID NO: 3698218 - RNA, 16 nt, Salmonella enterica enterica serovar Typhi Ty2
aucagaccgauaaaua

SEQ ID NO: 3698219 - RNA, 17 nt, Salmonella enterica enterica serovar Typhi Ty2
aucagaccuguaaaaaa

SEQ ID NO: 3698220 - RNA, 12 nt, Salmonella enterica enterica serovar Typhi Ty2
aucagacgcauc

SEQ ID NO: 3698221 - RNA, 14 nt, Salmonella enterica enterica serovar Typhi Ty2
aucagacgcaucag

SEQ ID NO: 3698222 - RNA, 14 nt, Salmonella enterica enterica serovar Typhi Ty2
aucagacuaucuuc

SEQ ID NO: 3698223 - RNA, 18 nt, Salmonella enterica enterica serovar Typhi Ty2
aucagagacaaauacaug

SEQ ID NO: 3698224 - RNA, 18 nt, Salmonella enterica enterica serovar Typhi Ty2
aucagauaucccugcaaa

SEQ ID NO: 3698225 - RNA, 23 nt, Salmonella enterica enterica serovar Typhi Ty2
aucagaucaugaggaugagcguu

SEQ ID NO: 3698226 - RNA, 16 nt, Salmonella enterica enterica serovar Typhi Ty2
aucagauucgcuacug

SEQ ID NO: 3698227 - RNA, 20 nt, Salmonella enterica enterica serovar Typhi Ty2
aucagauugauacggguaau

SEQ ID NO: 3698228 - RNA, 14 nt, Salmonella enterica enterica serovar Typhi Ty2
aucagauuuaggau

SEQ ID NO: 3698229 - RNA, 12 nt, Salmonella enterica enterica serovar Typhi Ty2
aucagcaaaaua

SEQ ID NO: 3698230 - RNA, 20 nt, Salmonella enterica enterica serovar Typhi Ty2
aucagcaaacgaccuuucgc

SEQ ID NO: 3698231 - RNA, 15 nt, Salmonella enterica enterica serovar Typhi Ty2
aucagcaacgcgcca

SEQ ID NO: 3698232 - RNA, 18 nt, Salmonella enterica enterica serovar Typhi Ty2
aucagcacauucagcagc

SEQ ID NO: 3698233 - RNA, 15 nt, Salmonella enterica enterica serovar Typhi Ty2
aucagcaccacgccc

SEQ ID NO: 3698234 - RNA, 18 nt, Salmonella enterica enterica serovar Typhi Ty2
aucagcagccgggccaga

SEQ ID NO: 3698235 - RNA, 16 nt, Salmonella enterica enterica serovar Typhi Ty2
aucagcaggauagcga

SEQ ID NO: 3698236 - RNA, 17 nt, Salmonella enterica enterica serovar Typhi Ty2
aucagcaguugcgacug

SEQ ID NO: 3698237 - RNA, 21 nt, Salmonella enterica enterica serovar Typhi Ty2
aucagcauuacccccgccaua

SEQ ID NO: 3698238 - RNA, 19 nt, Salmonella enterica enterica serovar Typhi Ty2
aucauccgggcauaaaaaa

SEQ ID NO: 3698239 - RNA, 20 nt, Salmonella enterica enterica serovar Typhi Ty2
aucauccgggcauaaaaaaa

SEQ ID NO: 3698240 - RNA, 22 nt, Salmonella enterica enterica serovar Typhi Ty2
aucaucgcgcugauauuuuuac

SEQ ID NO: 3698241 - RNA, 20 nt, Salmonella enterica enterica serovar Typhi Ty2
aucaucgcuugcccagcaua

SEQ ID NO: 3698242 - RNA, 15 nt, Salmonella enterica enterica serovar Typhi Ty2
aucaucguaccaaua

SEQ ID NO: 3698243 - RNA, 12 nt, Salmonella enterica enterica serovar Typhi Ty2
aucaucuaccuu

SEQ ID NO: 3698244 - RNA, 16 nt, Salmonella enterica enterica serovar Typhi Ty2
aucaucuauaauaccu

SEQ ID NO: 3698245 - RNA, 18 nt, Salmonella enterica enterica serovar Typhi Ty2
aucaucuauagacgcuga

SEQ ID NO: 3698246 - RNA, 12 nt, Salmonella enterica enterica serovar Typhi Ty2
aucaucuauagu

SEQ ID NO: 3698247 - RNA, 20 nt, Salmonella enterica enterica serovar Typhi Ty2
aucaucucugucgaccaucg

SEQ ID NO: 3698248 - RNA, 14 nt, Salmonella enterica enterica serovar Typhi Ty2
aucaucuucacuuc

SEQ ID NO: 3698249 - RNA, 19 nt, Salmonella enterica enterica serovar Typhi Ty2
aucaucuucacuucacaaa

SEQ ID NO: 3698250 - RNA, 21 nt, Salmonella enterica enterica serovar Typhi Ty2
aucaucuucacuucacaaaca

SEQ ID NO: 3698251 - RNA, 18 nt, Salmonella enterica enterica serovar Typhi Ty2
aucaucuuuuaccgccug

SEQ ID NO: 3698252 - RNA, 16 nt, Salmonella enterica enterica serovar Typhi Ty2
aucaugaaaaauauaa

SEQ ID NO: 3698253 - RNA, 18 nt, Salmonella enterica enterica serovar Typhi Ty2
aucaugauguucauccau

SEQ ID NO: 3698254 - RNA, 22 nt, Salmonella enterica enterica serovar Typhi Ty2
aucaugauuucuugagcggcau

SEQ ID NO: 3698255 - RNA, 21 nt, Salmonella enterica enterica serovar Typhi Ty2
aucaugcccaaaccugagcau

SEQ ID NO: 3698256 - RNA, 18 nt, Salmonella enterica enterica serovar Typhi Ty2
aucaugcccacaggcagg

SEQ ID NO: 3698257 - RNA, 13 nt, Salmonella enterica enterica serovar Typhi Ty2
aucaugcccggca

SEQ ID NO: 3698258 - RNA, 21 nt, Salmonella enterica enterica serovar Typhi Ty2
aucaugcguccgcccagaaag

SEQ ID NO: 3698259 - RNA, 16 nt, Salmonella enterica enterica serovar Typhi Ty2
aucaugcugaugacua

SEQ ID NO: 3698260 - RNA, 20 nt, Salmonella enterica enterica serovar Typhi Ty2
aucaugcugcaccgcaucaa

SEQ ID NO: 3698261 - RNA, 13 nt, Salmonella enterica enterica serovar Typhi Ty2
aucaugcuugcaa

SEQ ID NO: 3698262 - RNA, 18 nt, Salmonella enterica enterica serovar Typhi Ty2
aucauggacagauuucca

SEQ ID NO: 3698263 - RNA, 22 nt, Salmonella enterica enterica serovar Typhi Ty2
aucauggcucagauugaacgcu

SEQ ID NO: 3698264 - RNA, 22 nt, Salmonella enterica enterica serovar Typhi Ty2
aucauggcuugaucgcgcagca

SEQ ID NO: 3698265 - RNA, 20 nt, Salmonella enterica enterica serovar Typhi Ty2
aucaugguugaaaaaagccg

SEQ ID NO: 3698266 - RNA, 21 nt, Salmonella enterica enterica serovar Typhi Ty2
aucaugguugacuuacaaaaa

SEQ ID NO: 3698267 - RNA, 16 nt, Salmonella enterica enterica serovar Typhi Ty2
aucauguuuuucuccc

SEQ ID NO: 3698268 - RNA, 13 nt, Salmonella enterica enterica serovar Typhi Ty2
aucauuaccauag

SEQ ID NO: 3698269 - RNA, 19 nt, Salmonella enterica enterica serovar Typhi Ty2
aucauuaccugucgcccau

SEQ ID NO: 3698270 - RNA, 18 nt, Salmonella enterica enterica serovar Typhi Ty2
aucauuacuuauauuuau

SEQ ID NO: 3698271 - RNA, 19 nt, Salmonella enterica enterica serovar Typhi Ty2
aucauuauauagucuuaau

SEQ ID NO: 3698272 - RNA, 15 nt, Salmonella enterica enterica serovar Typhi Ty2
aucauuaucgccaaa

SEQ ID NO: 3698273 - RNA, 16 nt, Salmonella enterica enterica serovar Typhi Ty2
aucauuauuccccucc

SEQ ID NO: 3698274 - RNA, 17 nt, Salmonella enterica enterica serovar Typhi Ty2
aucauucaacgcaucaa

SEQ ID NO: 3698275 - RNA, 18 nt, Salmonella enterica enterica serovar Typhi Ty2
aucauucaacgcaucaaa

SEQ ID NO: 3698276 - RNA, 20 nt, Salmonella enterica enterica serovar Typhi Ty2
aucauucaacgcaucaaaua

SEQ ID NO: 3698277 - RNA, 12 nt, Salmonella enterica enterica serovar Typhi Ty2
aucauucaucuc

SEQ ID NO: 3698278 - RNA, 13 nt, Salmonella enterica enterica serovar Typhi Ty2
aucauucccgccc

SEQ ID NO: 3698279 - RNA, 20 nt, Salmonella enterica enterica serovar Typhi Ty2
aucauucccgcccaguauuc

SEQ ID NO: 3698280 - RNA, 16 nt, Salmonella enterica enterica serovar Typhi Ty2
aucauucuaaggccgc

SEQ ID NO: 3698281 - RNA, 23 nt, Salmonella enterica enterica serovar Typhi Ty2
aucauugccuguaucgcuauccg

SEQ ID NO: 3698282 - RNA, 14 nt, Salmonella enterica enterica serovar Typhi Ty2
aucauugcgccaag

SEQ ID NO: 3698283 - RNA, 15 nt, Salmonella enterica enterica serovar Typhi Ty2
aucauugcgccaaga

SEQ ID NO: 3698284 - RNA, 19 nt, Salmonella enterica enterica serovar Typhi Ty2
aucauuggauuaacggcaa

SEQ ID NO: 3698285 - RNA, 18 nt, Salmonella enterica enterica serovar Typhi Ty2
aucauuggggggaaauua

SEQ ID NO: 3698286 - RNA, 11 nt, Salmonella enterica enterica serovar Typhi Ty2
aucauuuccac

SEQ ID NO: 3698287 - RNA, 22 nt, Salmonella enterica enterica serovar Typhi Ty2
auccaaacggaccggcgacuau

SEQ ID NO: 3698288 - RNA, 15 nt, Salmonella enterica enterica serovar Typhi Ty2
auccaacgaaacgca

SEQ ID NO: 3698289 - RNA, 17 nt, Salmonella enterica enterica serovar Typhi Ty2
auccaacgcggaaaugu

SEQ ID NO: 3698290 - RNA, 18 nt, Salmonella enterica enterica serovar Typhi Ty2
auccaacgcggaaaugua

SEQ ID NO: 3698291 - RNA, 13 nt, Salmonella enterica enterica serovar Typhi Ty2
auccaagccccuc

SEQ ID NO: 3698292 - RNA, 19 nt, Salmonella enterica enterica serovar Typhi Ty2
auccaauagacuucacuuu

SEQ ID NO: 3698293 - RNA, 13 nt, Salmonella enterica enterica serovar Typhi Ty2
auccacagcgcca

SEQ ID NO: 3698294 - RNA, 17 nt, Salmonella enterica enterica serovar Typhi Ty2
auccacagguuaucgcc

SEQ ID NO: 3698295 - RNA, 18 nt, Salmonella enterica enterica serovar Typhi Ty2
auccacagguuaucgccg

SEQ ID NO: 3698296 - RNA, 19 nt, Salmonella enterica enterica serovar Typhi Ty2
auccacaguaaccccauac

SEQ ID NO: 3698297 - RNA, 17 nt, Salmonella enterica enterica serovar Typhi Ty2
auccaccaccagcauca

SEQ ID NO: 3698298 - RNA, 19 nt, Salmonella enterica enterica serovar Typhi Ty2
auccaccaccagcaucacg

SEQ ID NO: 3698299 - RNA, 17 nt, Salmonella enterica enterica serovar Typhi Ty2
auccaccacguaaugcg

SEQ ID NO: 3698300 - RNA, 20 nt, Salmonella enterica enterica serovar Typhi Ty2
auccaccagcccaucuuucg

SEQ ID NO: 3698301 - RNA, 13 nt, Salmonella enterica enterica serovar Typhi Ty2
auccaccaggcau

SEQ ID NO: 3698302 - RNA, 16 nt, Salmonella enterica enterica serovar Typhi Ty2
auccaccaggcaugca

SEQ ID NO: 3698303 - RNA, 23 nt, Salmonella enterica enterica serovar Typhi Ty2
auccaccccuugcgcguuucuga

SEQ ID NO: 3698304 - RNA, 17 nt, Salmonella enterica enterica serovar Typhi Ty2
auccacccgguuuacca

SEQ ID NO: 3698305 - RNA, 18 nt, Salmonella enterica enterica serovar Typhi Ty2
auccacccgguuuaccau

SEQ ID NO: 3698306 - RNA, 14 nt, Salmonella enterica enterica serovar Typhi Ty2
auccaccuuauccu

SEQ ID NO: 3698307 - RNA, 15 nt, Salmonella enterica enterica serovar Typhi Ty2
auccaccuuauccug

SEQ ID NO: 3698308 - RNA, 15 nt, Salmonella enterica enterica serovar Typhi Ty2
auccacgccuggcag

SEQ ID NO: 3698309 - RNA, 20 nt, Salmonella enterica enterica serovar Typhi Ty2
auccacgcggugcccugggu

SEQ ID NO: 3698310 - RNA, 22 nt, Salmonella enterica enterica serovar Typhi Ty2
auccacgucauaacgcgcauuc

SEQ ID NO: 3698311 - RNA, 19 nt, Salmonella enterica enterica serovar Typhi Ty2
auccacucccugcuuuuuc

SEQ ID NO: 3698312 - RNA, 23 nt, Salmonella enterica enterica serovar Typhi Ty2
auccacucggcgcugucguucca

SEQ ID NO: 3698313 - RNA, 20 nt, Salmonella enterica enterica serovar Typhi Ty2
auccacugagcgcgccauga

SEQ ID NO: 3698314 - RNA, 16 nt, Salmonella enterica enterica serovar Typhi Ty2
auccacuuuucgcgga

SEQ ID NO: 3698315 - RNA, 23 nt, Salmonella enterica enterica serovar Typhi Ty2
auccagaacugcgaaaucaccga

SEQ ID NO: 3698316 - RNA, 24 nt, Salmonella enterica enterica serovar Typhi Ty2
auccagaacugcgaaaucaccgac

SEQ ID NO: 3698317 - RNA, 21 nt, Salmonella enterica enterica serovar Typhi Ty2
auccagaauacgccgccgccc

SEQ ID NO: 3698318 - RNA, 22 nt, Salmonella enterica enterica serovar Typhi Ty2
auccagagcggauaaauaguga

SEQ ID NO: 3698319 - RNA, 22 nt, Salmonella enterica enterica serovar Typhi Ty2
auccagaggguaauuucuucca

SEQ ID NO: 3698320 - RNA, 19 nt, Salmonella enterica enterica serovar Typhi Ty2
auccgacaugaugccaaau

SEQ ID NO: 3698321 - RNA, 15 nt, Salmonella enterica enterica serovar Typhi Ty2
auccgacgccuuuac

SEQ ID NO: 3698322 - RNA, 18 nt, Salmonella enterica enterica serovar Typhi Ty2
auccgacgcucaaccggu

SEQ ID NO: 3698323 - RNA, 20 nt, Salmonella enterica enterica serovar Typhi Ty2
auccgauuucaugcgcagca

SEQ ID NO: 3698324 - RNA, 23 nt, Salmonella enterica enterica serovar Typhi Ty2
auccgauuucaugcgcagcauga

SEQ ID NO: 3698325 - RNA, 20 nt, Salmonella enterica enterica serovar Typhi Ty2
auccgcaaauuacugugccc

SEQ ID NO: 3698326 - RNA, 22 nt, Salmonella enterica enterica serovar Typhi Ty2
auccgcagacuuuaaccauucc

SEQ ID NO: 3698327 - RNA, 17 nt, Salmonella enterica enterica serovar Typhi Ty2
auccgcagauccagcac

SEQ ID NO: 3698328 - RNA, 18 nt, Salmonella enterica enterica serovar Typhi Ty2
auccgcagauccagcacg

SEQ ID NO: 3698329 - RNA, 22 nt, Salmonella enterica enterica serovar Typhi Ty2
auccgcagauccagcacggccu

SEQ ID NO: 3698330 - RNA, 19 nt, Salmonella enterica enterica serovar Typhi Ty2
auccgccaccgcgcgcaga

SEQ ID NO: 3698331 - RNA, 19 nt, Salmonella enterica enterica serovar Typhi Ty2
auccgccgagggcauugau

SEQ ID NO: 3698332 - RNA, 16 nt, Salmonella enterica enterica serovar Typhi Ty2
auccgccgccagccau

SEQ ID NO: 3698333 - RNA, 19 nt, Salmonella enterica enterica serovar Typhi Ty2
auccgccgcccagcgggua

SEQ ID NO: 3698334 - RNA, 13 nt, Salmonella enterica enterica serovar Typhi Ty2
auccgccgccgca

SEQ ID NO: 3698335 - RNA, 22 nt, Salmonella enterica enterica serovar Typhi Ty2
auccgcgcauacucuuccguca

SEQ ID NO: 3698336 - RNA, 14 nt, Salmonella enterica enterica serovar Typhi Ty2
auccgcgccgccgc

SEQ ID NO: 3698337 - RNA, 18 nt, Salmonella enterica enterica serovar Typhi Ty2
auccgcuccacauccugu

SEQ ID NO: 3698338 - RNA, 15 nt, Salmonella enterica enterica serovar Typhi Ty2
auccggaaaaugggu

SEQ ID NO: 3698339 - RNA, 14 nt, Salmonella enterica enterica serovar Typhi Ty2
auccggcaaaauua

SEQ ID NO: 3698340 - RNA, 15 nt, Salmonella enterica enterica serovar Typhi Ty2
auccggcaaacucag

SEQ ID NO: 3698341 - RNA, 11 nt, Salmonella enterica enterica serovar Typhi Ty2
auccggcacug

SEQ ID NO: 3698342 - RNA, 14 nt, Salmonella enterica enterica serovar Typhi Ty2
auccggcagccaau

SEQ ID NO: 3698343 - RNA, 23 nt, Salmonella enterica enterica serovar Typhi Ty2
auccggcaguuauuuuacgggcg

SEQ ID NO: 3698344 - RNA, 15 nt, Salmonella enterica enterica serovar Typhi Ty2
auccggcauuaccgc

SEQ ID NO: 3698345 - RNA, 16 nt, Salmonella enterica enterica serovar Typhi Ty2
auccggcauuaccgcu

SEQ ID NO: 3698346 - RNA, 17 nt, Salmonella enterica enterica serovar Typhi Ty2
auccggccuacaaaaac

SEQ ID NO: 3698347 - RNA, 19 nt, Salmonella enterica enterica serovar Typhi Ty2
auccggccuccaccaccuc

SEQ ID NO: 3698348 - RNA, 21 nt, Salmonella enterica enterica serovar Typhi Ty2
auccggccugcacaagaaaca

SEQ ID NO: 3698349 - RNA, 14 nt, Salmonella enterica enterica serovar Typhi Ty2
auccggccuggcgc

SEQ ID NO: 3698350 - RNA, 20 nt, Salmonella enterica enterica serovar Typhi Ty2
auccggccuguaaggucuca

SEQ ID NO: 3698351 - RNA, 19 nt, Salmonella enterica enterica serovar Typhi Ty2
auccggcugccugccggau

SEQ ID NO: 3698352 - RNA, 14 nt, Salmonella enterica enterica serovar Typhi Ty2
auccggcuguucga

SEQ ID NO: 3698353 - RNA, 12 nt, Salmonella enterica enterica serovar Typhi Ty2
auccgguaaacg

SEQ ID NO: 3698354 - RNA, 23 nt, Salmonella enterica enterica serovar Typhi Ty2
auccguacauaacagcagcagac

SEQ ID NO: 3698355 - RNA, 19 nt, Salmonella enterica enterica serovar Typhi Ty2
auccgucaaaaugaucaga

SEQ ID NO: 3698356 - RNA, 15 nt, Salmonella enterica enterica serovar Typhi Ty2
auccguccucuuucc

SEQ ID NO: 3698357 - RNA, 16 nt, Salmonella enterica enterica serovar Typhi Ty2
auccguuaagcccuga

SEQ ID NO: 3698358 - RNA, 18 nt, Salmonella enterica enterica serovar Typhi Ty2
auccguuauuucacagca

SEQ ID NO: 3698359 - RNA, 15 nt, Salmonella enterica enterica serovar Typhi Ty2
auccucaauguuaac

SEQ ID NO: 3698360 - RNA, 16 nt, Salmonella enterica enterica serovar Typhi Ty2
auccucgcauccucca

SEQ ID NO: 3698361 - RNA, 21 nt, Salmonella enterica enterica serovar Typhi Ty2
auccucuauuuuuuauauucg

SEQ ID NO: 3698362 - RNA, 18 nt, Salmonella enterica enterica serovar Typhi Ty2
auccucuuggguuauuuc

SEQ ID NO: 3698363 - RNA, 20 nt, Salmonella enterica enterica serovar Typhi Ty2
auccucuuggguuauuucga

SEQ ID NO: 3698364 - RNA, 18 nt, Salmonella enterica enterica serovar Typhi Ty2
auccugacuauugcugag

SEQ ID NO: 3698365 - RNA, 22 nt, Salmonella enterica enterica serovar Typhi Ty2
auccugauccugcaacagcacc

SEQ ID NO: 3698366 - RNA, 10 nt, Salmonella enterica enterica serovar Typhi Ty2
auccugaucu

SEQ ID NO: 3698367 - RNA, 20 nt, Salmonella enterica enterica serovar Typhi Ty2
auccugcaaauagcgcugau

SEQ ID NO: 3698368 - RNA, 13 nt, Salmonella enterica enterica serovar Typhi Ty2
auccugcacccgc

SEQ ID NO: 3698369 - RNA, 19 nt, Salmonella enterica enterica serovar Typhi Ty2
auccugcaccgccugcggc

SEQ ID NO: 3698370 - RNA, 14 nt, Salmonella enterica enterica serovar Typhi Ty2
auccugcacuucca

SEQ ID NO: 3698371 - RNA, 17 nt, Salmonella enterica enterica serovar Typhi Ty2
auccugcaggguaauua

SEQ ID NO: 3698372 - RNA, 12 nt, Salmonella enterica enterica serovar Typhi Ty2
auccugccgcac

SEQ ID NO: 3698373 - RNA, 14 nt, Salmonella enterica enterica serovar Typhi Ty2
auccugccgcacca

SEQ ID NO: 3698374 - RNA, 21 nt, Salmonella enterica enterica serovar Typhi Ty2
auccugcgccauugcgggagc

SEQ ID NO: 3698375 - RNA, 20 nt, Salmonella enterica enterica serovar Typhi Ty2
auccugcgggaugcguaauc

SEQ ID NO: 3698376 - RNA, 21 nt, Salmonella enterica enterica serovar Typhi Ty2
auccugcggguucaucgccac

SEQ ID NO: 3698377 - RNA, 22 nt, Salmonella enterica enterica serovar Typhi Ty2
auccugcguuaacgacccauca

SEQ ID NO: 3698378 - RNA, 22 nt, Salmonella enterica enterica serovar Typhi Ty2
auccuggaagauguugccguaa

SEQ ID NO: 3698379 - RNA, 23 nt, Salmonella enterica enterica serovar Typhi Ty2
auccuguaacaacuguuuuucac

SEQ ID NO: 3698380 - RNA, 18 nt, Salmonella enterica enterica serovar Typhi Ty2
auccuguagguucgguau

SEQ ID NO: 3698381 - RNA, 22 nt, Salmonella enterica enterica serovar Typhi Ty2
auccuuacuucgauggccucau

SEQ ID NO: 3698382 - RNA, 14 nt, Salmonella enterica enterica serovar Typhi Ty2
auccuuaucagacu

SEQ ID NO: 3698383 - RNA, 21 nt, Salmonella enterica enterica serovar Typhi Ty2
auccuucaaucgguacgccaa

SEQ ID NO: 3698384 - RNA, 14 nt, Salmonella enterica enterica serovar Typhi Ty2
auccuuccagcccg

SEQ ID NO: 3698385 - RNA, 11 nt, Salmonella enterica enterica serovar Typhi Ty2
auccuucgccg

SEQ ID NO: 3698386 - RNA, 16 nt, Salmonella enterica enterica serovar Typhi Ty2
auccuugcacgccaaa

SEQ ID NO: 3698387 - RNA, 22 nt, Salmonella enterica enterica serovar Typhi Ty2
auccuuuaaucgccgugcccaa

SEQ ID NO: 3698388 - RNA, 13 nt, Salmonella enterica enterica serovar Typhi Ty2
aucgaaaaccggu

SEQ ID NO: 3698389 - RNA, 16 nt, Salmonella enterica enterica serovar Typhi Ty2
aucgaaagagcaaaua

SEQ ID NO: 3698390 - RNA, 21 nt, Salmonella enterica enterica serovar Typhi Ty2
aucgaacgcuuccgggcucau

SEQ ID NO: 3698391 - RNA, 15 nt, Salmonella enterica enterica serovar Typhi Ty2
aucgaacugaaaugg

SEQ ID NO: 3698392 - RNA, 22 nt, Salmonella enterica enterica serovar Typhi Ty2
aucgaaggcaucuucagacagu

SEQ ID NO: 3698393 - RNA, 16 nt, Salmonella enterica enterica serovar Typhi Ty2
aucgaauccagcaggc

SEQ ID NO: 3698394 - RNA, 22 nt, Salmonella enterica enterica serovar Typhi Ty2
aucgaaucguucgccagugaca

SEQ ID NO: 3698395 - RNA, 18 nt, Salmonella enterica enterica serovar Typhi Ty2
aucgaauggggaaauaaa

SEQ ID NO: 3698396 - RNA, 18 nt, Salmonella enterica enterica serovar Typhi Ty2
aucgacaaaacacggcua

SEQ ID NO: 3698397 - RNA, 23 nt, Salmonella enterica enterica serovar Typhi Ty2
aucgacaaaauagucaguuaacg

SEQ ID NO: 3698398 - RNA, 18 nt, Salmonella enterica enterica serovar Typhi Ty2
aucgacaacgcguuuauu

SEQ ID NO: 3698399 - RNA, 20 nt, Salmonella enterica enterica serovar Typhi Ty2
aucgacagaacggauaucca

SEQ ID NO: 3698400 - RNA, 18 nt, Salmonella enterica enterica serovar Typhi Ty2
aucgacaguggcuuuaac

SEQ ID NO: 3698401 - RNA, 19 nt, Salmonella enterica enterica serovar Typhi Ty2
aucgacauaaguaaauaac

SEQ ID NO: 3698402 - RNA, 16 nt, Salmonella enterica enterica serovar Typhi Ty2
aucgcucaacuccugc

SEQ ID NO: 3698403 - RNA, 23 nt, Salmonella enterica enterica serovar Typhi Ty2
aucgcucaggagcgccugacagg

SEQ ID NO: 3698404 - RNA, 13 nt, Salmonella enterica enterica serovar Typhi Ty2
aucgcuccggaac

SEQ ID NO: 3698405 - RNA, 20 nt, Salmonella enterica enterica serovar Typhi Ty2
aucgcugaccaacgucagca

SEQ ID NO: 3698406 - RNA, 22 nt, Salmonella enterica enterica serovar Typhi Ty2
aucgcugaccaacgucagcauc

SEQ ID NO: 3698407 - RNA, 17 nt, Salmonella enterica enterica serovar Typhi Ty2
aucgcugauauuguuga

SEQ ID NO: 3698408 - RNA, 17 nt, Salmonella enterica enterica serovar Typhi Ty2
aucgcuuaacggcccag

SEQ ID NO: 3698409 - RNA, 21 nt, Salmonella enterica enterica serovar Typhi Ty2
aucgcuuaacggcccaggcau

SEQ ID NO: 3698410 - RNA, 22 nt, Salmonella enterica enterica serovar Typhi Ty2
aucgcuucaaucagcguggcgu

SEQ ID NO: 3698411 - RNA, 15 nt, Salmonella enterica enterica serovar Typhi Ty2
aucgcuugcccagca

SEQ ID NO: 3698412 - RNA, 22 nt, Salmonella enterica enterica serovar Typhi Ty2
aucgcuuugcagaaaauccuuc

SEQ ID NO: 3698413 - RNA, 23 nt, Salmonella enterica enterica serovar Typhi Ty2
aucggaaacuauccuggccugau

SEQ ID NO: 3698414 - RNA, 22 nt, Salmonella enterica enterica serovar Typhi Ty2
aucggacgguuuugcgccaucc

SEQ ID NO: 3698415 - RNA, 15 nt, Salmonella enterica enterica serovar Typhi Ty2
aucggaguccagcaa

SEQ ID NO: 3698416 - RNA, 13 nt, Salmonella enterica enterica serovar Typhi Ty2
aucggauccaucg

SEQ ID NO: 3698417 - RNA, 20 nt, Salmonella enterica enterica serovar Typhi Ty2
aucggauuauuuucacgcca

SEQ ID NO: 3698418 - RNA, 11 nt, Salmonella enterica enterica serovar Typhi Ty2
aucggcaaaca

SEQ ID NO: 3698419 - RNA, 17 nt, Salmonella enterica enterica serovar Typhi Ty2
aucggcaaacgccgccu

SEQ ID NO: 3698420 - RNA, 19 nt, Salmonella enterica enterica serovar Typhi Ty2
aucggcaaacgccgccugg

SEQ ID NO: 3698421 - RNA, 19 nt, Salmonella enterica enterica serovar Typhi Ty2
aucggcaauauugccgcac

SEQ ID NO: 3698422 - RNA, 16 nt, Salmonella enterica enterica serovar Typhi Ty2
aucggcacacagccag

SEQ ID NO: 3698423 - RNA, 16 nt, Salmonella enterica enterica serovar Typhi Ty2
aucggcaccuggagcg

SEQ ID NO: 3698424 - RNA, 17 nt, Salmonella enterica enterica serovar Typhi Ty2
aucggcaugauggcgaa

SEQ ID NO: 3698425 - RNA, 20 nt, Salmonella enterica enterica serovar Typhi Ty2
aucggccagauaguggcuga

SEQ ID NO: 3698426 - RNA, 18 nt, Salmonella enterica enterica serovar Typhi Ty2
aucggccagcgaaaacca

SEQ ID NO: 3698427 - RNA, 14 nt, Salmonella enterica enterica serovar Typhi Ty2
aucggccugcucuu

SEQ ID NO: 3698428 - RNA, 23 nt, Salmonella enterica enterica serovar Typhi Ty2
aucggcgccggggugcuguucuu

SEQ ID NO: 3698429 - RNA, 16 nt, Salmonella enterica enterica serovar Typhi Ty2
aucggcgcgcuggcgu

SEQ ID NO: 3698430 - RNA, 22 nt, Salmonella enterica enterica serovar Typhi Ty2
aucggcgcuacggcguuucacu

SEQ ID NO: 3698431 - RNA, 16 nt, Salmonella enterica enterica serovar Typhi Ty2
aucggcgggguuuaac

SEQ ID NO: 3698432 - RNA, 14 nt, Salmonella enterica enterica serovar Typhi Ty2
aucggcguaccgca

SEQ ID NO: 3698433 - RNA, 19 nt, Salmonella enterica enterica serovar Typhi Ty2
aucggcgucgcggcaauag

SEQ ID NO: 3698434 - RNA, 15 nt, Salmonella enterica enterica serovar Typhi Ty2
aucggcguugcccau

SEQ ID NO: 3698435 - RNA, 16 nt, Salmonella enterica enterica serovar Typhi Ty2
aucgggaaucaucgag

SEQ ID NO: 3698436 - RNA, 22 nt, Salmonella enterica enterica serovar Typhi Ty2
aucgggacaaucaccaucccau

SEQ ID NO: 3698437 - RNA, 16 nt, Salmonella enterica enterica serovar Typhi Ty2
aucgggcaauccauua

SEQ ID NO: 3698438 - RNA, 18 nt, Salmonella enterica enterica serovar Typhi Ty2
aucgggcuguugaauauc

SEQ ID NO: 3698439 - RNA, 15 nt, Salmonella enterica enterica serovar Typhi Ty2
aucgggcuuccagcg

SEQ ID NO: 3698440 - RNA, 17 nt, Salmonella enterica enterica serovar Typhi Ty2
aucgggcuuccagcguu

SEQ ID NO: 3698441 - RNA, 19 nt, Salmonella enterica enterica serovar Typhi Ty2
aucggguauguuuuagcag

SEQ ID NO: 3698442 - RNA, 23 nt, Salmonella enterica enterica serovar Typhi Ty2
aucgggugacgagggaaggggau

SEQ ID NO: 3698443 - RNA, 17 nt, Salmonella enterica enterica serovar Typhi Ty2
aucgggugauaaaauaa

SEQ ID NO: 3698444 - RNA, 17 nt, Salmonella enterica enterica serovar Typhi Ty2
aucggguuuuccugaau

SEQ ID NO: 3698445 - RNA, 20 nt, Salmonella enterica enterica serovar Typhi Ty2
aucgguaaaggucgccgcau

SEQ ID NO: 3698446 - RNA, 23 nt, Salmonella enterica enterica serovar Typhi Ty2
aucgguaggccggauaaggcauu

SEQ ID NO: 3698447 - RNA, 18 nt, Salmonella enterica enterica serovar Typhi Ty2
aucgguauaacuggucau

SEQ ID NO: 3698448 - RNA, 19 nt, Salmonella enterica enterica serovar Typhi Ty2
aucggugauccagcaaucg

SEQ ID NO: 3698449 - RNA, 16 nt, Salmonella enterica enterica serovar Typhi Ty2
aucgguguacaucgcg

SEQ ID NO: 3698450 - RNA, 14 nt, Salmonella enterica enterica serovar Typhi Ty2
aucgguucucugcc

SEQ ID NO: 3698451 - RNA, 16 nt, Salmonella enterica enterica serovar Typhi Ty2
aucgguucucugccau

SEQ ID NO: 3698452 - RNA, 14 nt, Salmonella enterica enterica serovar Typhi Ty2
aucgguuucgcggc

SEQ ID NO: 3698453 - RNA, 18 nt, Salmonella enterica enterica serovar Typhi Ty2
aucgguuugagcaccacg

SEQ ID NO: 3698454 - RNA, 20 nt, Salmonella enterica enterica serovar Typhi Ty2
aucgguuugagcaccacgcg

SEQ ID NO: 3698455 - RNA, 19 nt, Salmonella enterica enterica serovar Typhi Ty2
aucguaaaaucaacagcaa

SEQ ID NO: 3698456 - RNA, 17 nt, Salmonella enterica enterica serovar Typhi Ty2
aucguaaaaugaaaaac

SEQ ID NO: 3698457 - RNA, 18 nt, Salmonella enterica enterica serovar Typhi Ty2
aucguaaaucaaaugaga

SEQ ID NO: 3698458 - RNA, 14 nt, Salmonella enterica enterica serovar Typhi Ty2
aucguaagccaccg

SEQ ID NO: 3698459 - RNA, 19 nt, Salmonella enterica enterica serovar Typhi Ty2
aucguaagccgcauuacaa

SEQ ID NO: 3698460 - RNA, 22 nt, Salmonella enterica enterica serovar Typhi Ty2
aucguaccaauacccagcgcca

SEQ ID NO: 3698461 - RNA, 20 nt, Salmonella enterica enterica serovar Typhi Ty2
aucguagacuaagguuuugu

SEQ ID NO: 3698462 - RNA, 23 nt, Salmonella enterica enterica serovar Typhi Ty2
aucguagcaucucuucgacaucu

SEQ ID NO: 3698463 - RNA, 22 nt, Salmonella enterica enterica serovar Typhi Ty2
aucguagcgugcgcaauauggu

SEQ ID NO: 3698464 - RNA, 19 nt, Salmonella enterica enterica serovar Typhi Ty2
aucguaugcagccaggcca

SEQ ID NO: 3698465 - RNA, 14 nt, Salmonella enterica enterica serovar Typhi Ty2
aucguaugcgccug

SEQ ID NO: 3698466 - RNA, 23 nt, Salmonella enterica enterica serovar Typhi Ty2
aucgucaaaaccaaacagcgaca

SEQ ID NO: 3698467 - RNA, 13 nt, Salmonella enterica enterica serovar Typhi Ty2
aucguccagccau

SEQ ID NO: 3698468 - RNA, 16 nt, Salmonella enterica enterica serovar Typhi Ty2
aucguccggcaucgug

SEQ ID NO: 3698469 - RNA, 16 nt, Salmonella enterica enterica serovar Typhi Ty2
aucguccggcgaaaac

SEQ ID NO: 3698470 - RNA, 17 nt, Salmonella enterica enterica serovar Typhi Ty2
aucguccucacaaacgg

SEQ ID NO: 3698471 - RNA, 23 nt, Salmonella enterica enterica serovar Typhi Ty2
aucgucgaggaagcugcgcagca

SEQ ID NO: 3698472 - RNA, 16 nt, Salmonella enterica enterica serovar Typhi Ty2
aucgucgcgaucgcgc

SEQ ID NO: 3698473 - RNA, 19 nt, Salmonella enterica enterica serovar Typhi Ty2
aucgucgcgguugccguca

SEQ ID NO: 3698474 - RNA, 20 nt, Salmonella enterica enterica serovar Typhi Ty2
aucgucgcgguugccgucaa

SEQ ID NO: 3698475 - RNA, 16 nt, Salmonella enterica enterica serovar Typhi Ty2
aucgucgggauaagcg

SEQ ID NO: 3698476 - RNA, 16 nt, Salmonella enterica enterica serovar Typhi Ty2
aucgucgugucucaga

SEQ ID NO: 3698477 - RNA, 16 nt, Salmonella enterica enterica serovar Typhi Ty2
aucgucguuccgccag

SEQ ID NO: 3698478 - RNA, 19 nt, Salmonella enterica enterica serovar Typhi Ty2
aucgucguuccgccaggcg

SEQ ID NO: 3698479 - RNA, 16 nt, Salmonella enterica enterica serovar Typhi Ty2
aucgucguugcugcaa

SEQ ID NO: 3698480 - RNA, 18 nt, Salmonella enterica enterica serovar Typhi Ty2
aucgucucucauccgcca

SEQ ID NO: 3698481 - RNA, 18 nt, Salmonella enterica enterica serovar Typhi Ty2
aucgugaccaccgccaua

SEQ ID NO: 3698482 - RNA, 22 nt, Salmonella enterica enterica serovar Typhi Ty2
aucgugacgcgaauuucaacgc

SEQ ID NO: 3698483 - RNA, 15 nt, Salmonella enterica enterica serovar Typhi Ty2
aucugcgcauuaacg

SEQ ID NO: 3698484 - RNA, 15 nt, Salmonella enterica enterica serovar Typhi Ty2
aucugcgccauugag

SEQ ID NO: 3698485 - RNA, 21 nt, Salmonella enterica enterica serovar Typhi Ty2
aucugcgccgacauucccugc

SEQ ID NO: 3698486 - RNA, 22 nt, Salmonella enterica enterica serovar Typhi Ty2
aucugcgugaugcaucagaaca

SEQ ID NO: 3698487 - RNA, 22 nt, Salmonella enterica enterica serovar Typhi Ty2
aucugcuaccgccacuuugcuu

SEQ ID NO: 3698488 - RNA, 23 nt, Salmonella enterica enterica serovar Typhi Ty2
aucugcuaccgccacuuugcuuu

SEQ ID NO: 3698489 - RNA, 18 nt, Salmonella enterica enterica serovar Typhi Ty2
aucugcuccgccagcaau

SEQ ID NO: 3698490 - RNA, 13 nt, Salmonella enterica enterica serovar Typhi Ty2
aucugcuccgcgc

SEQ ID NO: 3698491 - RNA, 13 nt, Salmonella enterica enterica serovar Typhi Ty2
aucugcuccggcg

SEQ ID NO: 3698492 - RNA, 20 nt, Salmonella enterica enterica serovar Typhi Ty2
aucugcugacacccucugcg

SEQ ID NO: 3698493 - RNA, 14 nt, Salmonella enterica enterica serovar Typhi Ty2
aucuggacgccaau

SEQ ID NO: 3698494 - RNA, 19 nt, Salmonella enterica enterica serovar Typhi Ty2
aucuggauagucaggcgau

SEQ ID NO: 3698495 - RNA, 18 nt, Salmonella enterica enterica serovar Typhi Ty2
aucuggaugaaggagaaa

SEQ ID NO: 3698496 - RNA, 21 nt, Salmonella enterica enterica serovar Typhi Ty2
aucuggcgcuuuuccagcacg

SEQ ID NO: 3698497 - RNA, 20 nt, Salmonella enterica enterica serovar Typhi Ty2
aucuggcggcgaaagagaaa

SEQ ID NO: 3698498 - RNA, 19 nt, Salmonella enterica enterica serovar Typhi Ty2
aucuggcuguggcguuuua

SEQ ID NO: 3698499 - RNA, 19 nt, Salmonella enterica enterica serovar Typhi Ty2
aucugggcugagaaaaauu

SEQ ID NO: 3698500 - RNA, 22 nt, Salmonella enterica enterica serovar Typhi Ty2
aucuggucaggugauugcccuc

SEQ ID NO: 3698501 - RNA, 20 nt, Salmonella enterica enterica serovar Typhi Ty2
aucuggugacgaugauaaca

SEQ ID NO: 3698502 - RNA, 14 nt, Salmonella enterica enterica serovar Typhi Ty2
aucuggugauaaag

SEQ ID NO: 3698503 - RNA, 15 nt, Salmonella enterica enterica serovar Typhi Ty2
aucuggugauaaagc

SEQ ID NO: 3698504 - RNA, 17 nt, Salmonella enterica enterica serovar Typhi Ty2
aucugguggaaaagaaa

SEQ ID NO: 3698505 - RNA, 17 nt, Salmonella enterica enterica serovar Typhi Ty2
aucugguuugguaaaga

SEQ ID NO: 3698506 - RNA, 21 nt, Salmonella enterica enterica serovar Typhi Ty2
aucuguaauugacgcgucagg

SEQ ID NO: 3698507 - RNA, 20 nt, Salmonella enterica enterica serovar Typhi Ty2
aucuguaggcccgguaagcg

SEQ ID NO: 3698508 - RNA, 13 nt, Salmonella enterica enterica serovar Typhi Ty2
aucuguauaaaau

SEQ ID NO: 3698509 - RNA, 15 nt, Salmonella enterica enterica serovar Typhi Ty2
aucuguauaaauaac

SEQ ID NO: 3698510 - RNA, 12 nt, Salmonella enterica enterica serovar Typhi Ty2
aucugucaugcg

SEQ ID NO: 3698511 - RNA, 15 nt, Salmonella enterica enterica serovar Typhi Ty2
aucugucccagccuu

SEQ ID NO: 3698512 - RNA, 14 nt, Salmonella enterica enterica serovar Typhi Ty2
aucugucugcugua

SEQ ID NO: 3698513 - RNA, 17 nt, Salmonella enterica enterica serovar Typhi Ty2
aucugugccagcccaau

SEQ ID NO: 3698514 - RNA, 18 nt, Salmonella enterica enterica serovar Typhi Ty2
aucugugccagcccaaua

SEQ ID NO: 3698515 - RNA, 22 nt, Salmonella enterica enterica serovar Typhi Ty2
aucugugugggcacucgaagau

SEQ ID NO: 3698516 - RNA, 21 nt, Salmonella enterica enterica serovar Typhi Ty2
aucuguuccacagaucuaucu

SEQ ID NO: 3698517 - RNA, 22 nt, Salmonella enterica enterica serovar Typhi Ty2
aucuguuccacagaucuaucug

SEQ ID NO: 3698518 - RNA, 14 nt, Salmonella enterica enterica serovar Typhi Ty2
aucuguuccagcga

SEQ ID NO: 3698519 - RNA, 16 nt, Salmonella enterica enterica serovar Typhi Ty2
aucuguucguugcugu

SEQ ID NO: 3698520 - RNA, 16 nt, Salmonella enterica enterica serovar Typhi Ty2
aucuguugcgcaagca

SEQ ID NO: 3698521 - RNA, 18 nt, Salmonella enterica enterica serovar Typhi Ty2
aucuguuugagaaaaaca

SEQ ID NO: 3698522 - RNA, 15 nt, Salmonella enterica enterica serovar Typhi Ty2
aucuuauuagcgauu

SEQ ID NO: 3698523 - RNA, 23 nt, Salmonella enterica enterica serovar Typhi Ty2
aucuuauuuuccguuagccaaug

SEQ ID NO: 3698524 - RNA, 21 nt, Salmonella enterica enterica serovar Typhi Ty2
aucuucaaucgugaccaccgc

SEQ ID NO: 3698525 - RNA, 17 nt, Salmonella enterica enterica serovar Typhi Ty2
aucuucacgcagcguga

SEQ ID NO: 3698526 - RNA, 15 nt, Salmonella enterica enterica serovar Typhi Ty2
aucuucacuguuauc

SEQ ID NO: 3698527 - RNA, 18 nt, Salmonella enterica enterica serovar Typhi Ty2
aucuucacuucacaaaca

SEQ ID NO: 3698528 - RNA, 15 nt, Salmonella enterica enterica serovar Typhi Ty2
aucuucagcccguuc

SEQ ID NO: 3698529 - RNA, 12 nt, Salmonella enterica enterica serovar Typhi Ty2
aucuucaguaag

SEQ ID NO: 3698530 - RNA, 22 nt, Salmonella enterica enterica serovar Typhi Ty2
aucuucauaaauagccagcauc

SEQ ID NO: 3698531 - RNA, 14 nt, Salmonella enterica enterica serovar Typhi Ty2
aucuucaucgucgc

SEQ ID NO: 3698532 - RNA, 20 nt, Salmonella enterica enterica serovar Typhi Ty2
aucuucauguucuaacagau

SEQ ID NO: 3698533 - RNA, 23 nt, Salmonella enterica enterica serovar Typhi Ty2
aucuuccacccgcgcgcuuucca

SEQ ID NO: 3698534 - RNA, 17 nt, Salmonella enterica enterica serovar Typhi Ty2
aucuuccacgguaaaac

SEQ ID NO: 3698535 - RNA, 22 nt, Salmonella enterica enterica serovar Typhi Ty2
aucuuccagcgucgggccgcgc

SEQ ID NO: 3698536 - RNA, 15 nt, Salmonella enterica enterica serovar Typhi Ty2
aucuuccagguagug

SEQ ID NO: 3698537 - RNA, 19 nt, Salmonella enterica enterica serovar Typhi Ty2
aucuuccccgaacucgcga

SEQ ID NO: 3698538 - RNA, 13 nt, Salmonella enterica enterica serovar Typhi Ty2
aucuucccgcaga

SEQ ID NO: 3698539 - RNA, 20 nt, Salmonella enterica enterica serovar Typhi Ty2
aucuuccgggucaguuuuuu

SEQ ID NO: 3698540 - RNA, 21 nt, Salmonella enterica enterica serovar Typhi Ty2
aucuuccucacagccuugcca

SEQ ID NO: 3698541 - RNA, 13 nt, Salmonella enterica enterica serovar Typhi Ty2
aucuuccugcgcg

SEQ ID NO: 3698542 - RNA, 20 nt, Salmonella enterica enterica serovar Typhi Ty2
aucuucggcgcgccgcuggc

SEQ ID NO: 3698543 - RNA, 21 nt, Salmonella enterica enterica serovar Typhi Ty2
aucuucggcgggaucuccaga

SEQ ID NO: 3698544 - RNA, 22 nt, Salmonella enterica enterica serovar Typhi Ty2
aucuucggcgggaucuccagaa

SEQ ID NO: 3698545 - RNA, 21 nt, Salmonella enterica enterica serovar Typhi Ty2
aucuucguuggcgcugccgga

SEQ ID NO: 3698546 - RNA, 17 nt, Salmonella enterica enterica serovar Typhi Ty2
aucuucuaccuggaacc

SEQ ID NO: 3698547 - RNA, 13 nt, Salmonella enterica enterica serovar Typhi Ty2
aucuucugcugcu

SEQ ID NO: 3698548 - RNA, 17 nt, Salmonella enterica enterica serovar Typhi Ty2
aucuucugcugcucccu

SEQ ID NO: 3698549 - RNA, 11 nt, Salmonella enterica enterica serovar Typhi Ty2
aucuucuuccg

SEQ ID NO: 3698550 - RNA, 17 nt, Salmonella enterica enterica serovar Typhi Ty2
aucuugaguuuggccug

SEQ ID NO: 3698551 - RNA, 14 nt, Salmonella enterica enterica serovar Typhi Ty2
aucuugcguuaugu

SEQ ID NO: 3698552 - RNA, 17 nt, Salmonella enterica enterica serovar Typhi Ty2
aucuugcuuuauuuuua

SEQ ID NO: 3698553 - RNA, 12 nt, Salmonella enterica enterica serovar Typhi Ty2
aucuugggaaua

SEQ ID NO: 3698554 - RNA, 22 nt, Salmonella enterica enterica serovar Typhi Ty2
aucuugucacaauaacgccgga

SEQ ID NO: 3698555 - RNA, 23 nt, Salmonella enterica enterica serovar Typhi Ty2
aucuugucacaauaacgccggau

SEQ ID NO: 3698556 - RNA, 13 nt, Salmonella enterica enterica serovar Typhi Ty2
aucuuguccucau

SEQ ID NO: 3698557 - RNA, 22 nt, Salmonella enterica enterica serovar Typhi Ty2
aucuuguccucaucauucgguu

SEQ ID NO: 3698558 - RNA, 21 nt, Salmonella enterica enterica serovar Typhi Ty2
aucuuuaccagggaauaugau

SEQ ID NO: 3698559 - RNA, 17 nt, Salmonella enterica enterica serovar Typhi Ty2
aucuuuaugucaguaau

SEQ ID NO: 3698560 - RNA, 18 nt, Salmonella enterica enterica serovar Typhi Ty2
aucuuucagcgccggaaa

SEQ ID NO: 3698561 - RNA, 14 nt, Salmonella enterica enterica serovar Typhi Ty2
aucuuuccggaacg

SEQ ID NO: 3698562 - RNA, 13 nt, Salmonella enterica enterica serovar Typhi Ty2
aucuuuccuuuuu

SEQ ID NO: 3698563 - RNA, 14 nt, Salmonella enterica enterica serovar Typhi Ty2
aucuuucuccuggu

SEQ ID NO: 3698564 - RNA, 12 nt, Salmonella enterica enterica serovar Typhi Ty2
aucuuucuuuuu

SEQ ID NO: 3698565 - RNA, 13 nt, Salmonella enterica enterica serovar Typhi Ty2
augacgggggcga

SEQ ID NO: 3698566 - RNA, 16 nt, Salmonella enterica enterica serovar Typhi Ty2
augacggguaacgcca

SEQ ID NO: 3698567 - RNA, 18 nt, Salmonella enterica enterica serovar Typhi Ty2
augacgguauucccgguc

SEQ ID NO: 3698568 - RNA, 17 nt, Salmonella enterica enterica serovar Typhi Ty2
augacgguucaucgcag

SEQ ID NO: 3698569 - RNA, 19 nt, Salmonella enterica enterica serovar Typhi Ty2
augacguauucaccucccu

SEQ ID NO: 3698570 - RNA, 15 nt, Salmonella enterica enterica serovar Typhi Ty2
augacguggccagca

SEQ ID NO: 3698571 - RNA, 13 nt, Salmonella enterica enterica serovar Typhi Ty2
augacguucaauu

SEQ ID NO: 3698572 - RNA, 20 nt, Salmonella enterica enterica serovar Typhi Ty2
augacugcgaauuuccugcc

SEQ ID NO: 3698573 - RNA, 14 nt, Salmonella enterica enterica serovar Typhi Ty2
augacugguuuuuc

SEQ ID NO: 3698574 - RNA, 12 nt, Salmonella enterica enterica serovar Typhi Ty2
augagaagaaaa

SEQ ID NO: 3698575 - RNA, 18 nt, Salmonella enterica enterica serovar Typhi Ty2
augagagacggagaaaaa

SEQ ID NO: 3698576 - RNA, 14 nt, Salmonella enterica enterica serovar Typhi Ty2
augagauaauaaau

SEQ ID NO: 3698577 - RNA, 16 nt, Salmonella enterica enterica serovar Typhi Ty2
augagauacgucauca

SEQ ID NO: 3698578 - RNA, 15 nt, Salmonella enterica enterica serovar Typhi Ty2
augagcaggccaggg

SEQ ID NO: 3698579 - RNA, 12 nt, Salmonella enterica enterica serovar Typhi Ty2
augagcaggccc

SEQ ID NO: 3698580 - RNA, 18 nt, Salmonella enterica enterica serovar Typhi Ty2
augagccagauggauaac

SEQ ID NO: 3698581 - RNA, 12 nt, Salmonella enterica enterica serovar Typhi Ty2
augagccagccc

SEQ ID NO: 3698582 - RNA, 13 nt, Salmonella enterica enterica serovar Typhi Ty2
augagccgucgcu

SEQ ID NO: 3698583 - RNA, 16 nt, Salmonella enterica enterica serovar Typhi Ty2
augagcgcaggcgagc

SEQ ID NO: 3698584 - RNA, 22 nt, Salmonella enterica enterica serovar Typhi Ty2
augagcgcgaaaucaaagaccu

SEQ ID NO: 3698585 - RNA, 19 nt, Salmonella enterica enterica serovar Typhi Ty2
augaggauauugguaucaa

SEQ ID NO: 3698586 - RNA, 12 nt, Salmonella enterica enterica serovar Typhi Ty2
augaguaaaauu

SEQ ID NO: 3698587 - RNA, 14 nt, Salmonella enterica enterica serovar Typhi Ty2
augaguaaaugaac

SEQ ID NO: 3698588 - RNA, 20 nt, Salmonella enterica enterica serovar Typhi Ty2
augaguagaacguauuauua

SEQ ID NO: 3698589 - RNA, 20 nt, Salmonella enterica enterica serovar Typhi Ty2
augauaaccgccgccaaacu

SEQ ID NO: 3698590 - RNA, 23 nt, Salmonella enterica enterica serovar Typhi Ty2
augauaaccgccgccaaacugcg

SEQ ID NO: 3698591 - RNA, 16 nt, Salmonella enterica enterica serovar Typhi Ty2
augauaagugauaccg

SEQ ID NO: 3698592 - RNA, 16 nt, Salmonella enterica enterica serovar Typhi Ty2
augauaauaugcucaa

SEQ ID NO: 3698593 - RNA, 13 nt, Salmonella enterica enterica serovar Typhi Ty2
augauaaugccgc

SEQ ID NO: 3698594 - RNA, 14 nt, Salmonella enterica enterica serovar Typhi Ty2
augauaaugccgcu

SEQ ID NO: 3698595 - RNA, 20 nt, Salmonella enterica enterica serovar Typhi Ty2
augauagcgccauauaaaua

SEQ ID NO: 3698596 - RNA, 16 nt, Salmonella enterica enterica serovar Typhi Ty2
augauauauucaugau

SEQ ID NO: 3698597 - RNA, 16 nt, Salmonella enterica enterica serovar Typhi Ty2
augauauccagcacgc

SEQ ID NO: 3698598 - RNA, 18 nt, Salmonella enterica enterica serovar Typhi Ty2
augauauccagcacgccu

SEQ ID NO: 3698599 - RNA, 22 nt, Salmonella enterica enterica serovar Typhi Ty2
augauaucggccggaugccagu

SEQ ID NO: 3698600 - RNA, 17 nt, Salmonella enterica enterica serovar Typhi Ty2
augaucaccaucuucac

SEQ ID NO: 3698601 - RNA, 16 nt, Salmonella enterica enterica serovar Typhi Ty2
augaucagacgcacaa

SEQ ID NO: 3698602 - RNA, 24 nt, Salmonella enterica enterica serovar Typhi Ty2
augaucagcgacgguccuggccag

SEQ ID NO: 3698603 - RNA, 15 nt, Salmonella enterica enterica serovar Typhi Ty2
augaucgccucuucg

SEQ ID NO: 3698604 - RNA, 16 nt, Salmonella enterica enterica serovar Typhi Ty2
augaucguaugcagcc

SEQ ID NO: 3698605 - RNA, 20 nt, Salmonella enterica enterica serovar Typhi Ty2
augaucguaugcagccaggc

SEQ ID NO: 3698606 - RNA, 21 nt, Salmonella enterica enterica serovar Typhi Ty2
augaucguaugcagccaggcc

SEQ ID NO: 3698607 - RNA, 14 nt, Salmonella enterica enterica serovar Typhi Ty2
augaucgucaacga

SEQ ID NO: 3698608 - RNA, 21 nt, Salmonella enterica enterica serovar Typhi Ty2
augaucugcgcaacauucugc

SEQ ID NO: 3698609 - RNA, 14 nt, Salmonella enterica enterica serovar Typhi Ty2
augaucuucauaaa

SEQ ID NO: 3698610 - RNA, 13 nt, Salmonella enterica enterica serovar Typhi Ty2
augaugaaaaaga

SEQ ID NO: 3698611 - RNA, 15 nt, Salmonella enterica enterica serovar Typhi Ty2
augaugaaaaagaau

SEQ ID NO: 3698612 - RNA, 17 nt, Salmonella enterica enterica serovar Typhi Ty2
augaugaccgaagcagg

SEQ ID NO: 3698613 - RNA, 21 nt, Salmonella enterica enterica serovar Typhi Ty2
augaugaccuggugcaucaua

SEQ ID NO: 3698614 - RNA, 19 nt, Salmonella enterica enterica serovar Typhi Ty2
augaugagauacgucauca

SEQ ID NO: 3698615 - RNA, 21 nt, Salmonella enterica enterica serovar Typhi Ty2
augaugagaugcaggccaagc

SEQ ID NO: 3698616 - RNA, 16 nt, Salmonella enterica enterica serovar Typhi Ty2
augaugcauuugauuu

SEQ ID NO: 3698617 - RNA, 18 nt, Salmonella enterica enterica serovar Typhi Ty2
augaugccaggaccaggu

SEQ ID NO: 3698618 - RNA, 13 nt, Salmonella enterica enterica serovar Typhi Ty2
augaugcguuacu

SEQ ID NO: 3698619 - RNA, 17 nt, Salmonella enterica enterica serovar Typhi Ty2
augaugcucgcucauca

SEQ ID NO: 3698620 - RNA, 19 nt, Salmonella enterica enterica serovar Typhi Ty2
augaugggcgcacagcgcc

SEQ ID NO: 3698621 - RNA, 20 nt, Salmonella enterica enterica serovar Typhi Ty2
augaugggcgcacagcgcca

SEQ ID NO: 3698622 - RNA, 20 nt, Salmonella enterica enterica serovar Typhi Ty2
augauggggucacagguucg

SEQ ID NO: 3698623 - RNA, 17 nt, Salmonella enterica enterica serovar Typhi Ty2
augauguacaggugaaa

SEQ ID NO: 3698624 - RNA, 23 nt, Salmonella enterica enterica serovar Typhi Ty2
augauguccgccuugaggcguuu

SEQ ID NO: 3698625 - RNA, 19 nt, Salmonella enterica enterica serovar Typhi Ty2
augauguucauccauauau

SEQ ID NO: 3698626 - RNA, 15 nt, Salmonella enterica enterica serovar Typhi Ty2
augauuaauuguacc

SEQ ID NO: 3698627 - RNA, 15 nt, Salmonella enterica enterica serovar Typhi Ty2
augauuauuguuaaa

SEQ ID NO: 3698628 - RNA, 19 nt, Salmonella enterica enterica serovar Typhi Ty2
augauuauuguuaaaaaga

SEQ ID NO: 3698629 - RNA, 17 nt, Salmonella enterica enterica serovar Typhi Ty2
augauucaaucggcgau

SEQ ID NO: 3698630 - RNA, 13 nt, Salmonella enterica enterica serovar Typhi Ty2
augauuuaaaaaa

SEQ ID NO: 3698631 - RNA, 19 nt, Salmonella enterica enterica serovar Typhi Ty2
augauuuaaaaaaggccgc

SEQ ID NO: 3698632 - RNA, 14 nt, Salmonella enterica enterica serovar Typhi Ty2
augauuuuaacauc

SEQ ID NO: 3698633 - RNA, 22 nt, Salmonella enterica enterica serovar Typhi Ty2
augauuuucuuauuacaagaaa

SEQ ID NO: 3698634 - RNA, 20 nt, Salmonella enterica enterica serovar Typhi Ty2
augcaaaaaagcccauccgu

SEQ ID NO: 3698635 - RNA, 14 nt, Salmonella enterica enterica serovar Typhi Ty2
augcaaaagaaaaa

SEQ ID NO: 3698636 - RNA, 15 nt, Salmonella enterica enterica serovar Typhi Ty2
augcaaaagaaaaaa

SEQ ID NO: 3698637 - RNA, 16 nt, Salmonella enterica enterica serovar Typhi Ty2
augcaaaagaaaaaac

SEQ ID NO: 3698638 - RNA, 21 nt, Salmonella enterica enterica serovar Typhi Ty2
augcaaagaagggcaggggaa

SEQ ID NO: 3698639 - RNA, 19 nt, Salmonella enterica enterica serovar Typhi Ty2
augcaaucaguuccaaucu

SEQ ID NO: 3698640 - RNA, 15 nt, Salmonella enterica enterica serovar Typhi Ty2
augcacaacacgcuu

SEQ ID NO: 3698641 - RNA, 19 nt, Salmonella enterica enterica serovar Typhi Ty2
augcacaggcggcgguuca

SEQ ID NO: 3698642 - RNA, 20 nt, Salmonella enterica enterica serovar Typhi Ty2
augcacauuagcaauugcca

SEQ ID NO: 3698643 - RNA, 12 nt, Salmonella enterica enterica serovar Typhi Ty2
augcaccgccuu

SEQ ID NO: 3698644 - RNA, 16 nt, Salmonella enterica enterica serovar Typhi Ty2
augcaccgccuugccc

SEQ ID NO: 3698645 - RNA, 15 nt, Salmonella enterica enterica serovar Typhi Ty2
augcaccucgccaaa

SEQ ID NO: 3698646 - RNA, 18 nt, Salmonella enterica enterica serovar Typhi Ty2
augcacgcgauuugcagc

SEQ ID NO: 3698647 - RNA, 17 nt, Salmonella enterica enterica serovar Typhi Ty2
augcgccagcggccagc

SEQ ID NO: 3698648 - RNA, 18 nt, Salmonella enterica enterica serovar Typhi Ty2
augcgccaggcagcaccu

SEQ ID NO: 3698649 - RNA, 13 nt, Salmonella enterica enterica serovar Typhi Ty2
augcgccauccca

SEQ ID NO: 3698650 - RNA, 13 nt, Salmonella enterica enterica serovar Typhi Ty2
augcgcccacaau

SEQ ID NO: 3698651 - RNA, 17 nt, Salmonella enterica enterica serovar Typhi Ty2
augcgccccugcaggcg

SEQ ID NO: 3698652 - RNA, 17 nt, Salmonella enterica enterica serovar Typhi Ty2
augcgcccggagcggug

SEQ ID NO: 3698653 - RNA, 18 nt, Salmonella enterica enterica serovar Typhi Ty2
augcgccgacugaacaua

SEQ ID NO: 3698654 - RNA, 18 nt, Salmonella enterica enterica serovar Typhi Ty2
augcgccgcccaccgcca

SEQ ID NO: 3698655 - RNA, 22 nt, Salmonella enterica enterica serovar Typhi Ty2
augcgccgccuuggcgaccuga

SEQ ID NO: 3698656 - RNA, 21 nt, Salmonella enterica enterica serovar Typhi Ty2
augcgccugguugacccgcau

SEQ ID NO: 3698657 - RNA, 16 nt, Salmonella enterica enterica serovar Typhi Ty2
augcgccugucuuaaa

SEQ ID NO: 3698658 - RNA, 21 nt, Salmonella enterica enterica serovar Typhi Ty2
augcgcgcgugaccccaggca

SEQ ID NO: 3698659 - RNA, 19 nt, Salmonella enterica enterica serovar Typhi Ty2
augcgcggaauagcggcua

SEQ ID NO: 3698660 - RNA, 14 nt, Salmonella enterica enterica serovar Typhi Ty2
augcgcggugucau

SEQ ID NO: 3698661 - RNA, 16 nt, Salmonella enterica enterica serovar Typhi Ty2
augcgcguaauuugcg

SEQ ID NO: 3698662 - RNA, 18 nt, Salmonella enterica enterica serovar Typhi Ty2
augcgcgucaggccaggg

SEQ ID NO: 3698663 - RNA, 20 nt, Salmonella enterica enterica serovar Typhi Ty2
augcgcgucccggcagugca

SEQ ID NO: 3698664 - RNA, 15 nt, Salmonella enterica enterica serovar Typhi Ty2
augcgcguugccgcc

SEQ ID NO: 3698665 - RNA, 17 nt, Salmonella enterica enterica serovar Typhi Ty2
augcgcguuuagcgcca

SEQ ID NO: 3698666 - RNA, 20 nt, Salmonella enterica enterica serovar Typhi Ty2
augcgcguuuagcgccagca

SEQ ID NO: 3698667 - RNA, 22 nt, Salmonella enterica enterica serovar Typhi Ty2
augcgcguuuagcgccagcagc

SEQ ID NO: 3698668 - RNA, 16 nt, Salmonella enterica enterica serovar Typhi Ty2
augcgcucauaaccgc

SEQ ID NO: 3698669 - RNA, 17 nt, Salmonella enterica enterica serovar Typhi Ty2
augcgcugcacaaucgc

SEQ ID NO: 3698670 - RNA, 13 nt, Salmonella enterica enterica serovar Typhi Ty2
augcgcugggcac

SEQ ID NO: 3698671 - RNA, 16 nt, Salmonella enterica enterica serovar Typhi Ty2
augcgcuuccagcaug

SEQ ID NO: 3698672 - RNA, 13 nt, Salmonella enterica enterica serovar Typhi Ty2
augcggauaaagc

SEQ ID NO: 3698673 - RNA, 23 nt, Salmonella enterica enterica serovar Typhi Ty2
augcggcaaaaauccuucuucca

SEQ ID NO: 3698674 - RNA, 16 nt, Salmonella enterica enterica serovar Typhi Ty2
augcggcgccaucaau

SEQ ID NO: 3698675 - RNA, 21 nt, Salmonella enterica enterica serovar Typhi Ty2
augcggcugacgauacucagc

SEQ ID NO: 3698676 - RNA, 16 nt, Salmonella enterica enterica serovar Typhi Ty2
augcggcuuugcgccg

SEQ ID NO: 3698677 - RNA, 12 nt, Salmonella enterica enterica serovar Typhi Ty2
augcgggcucgu

SEQ ID NO: 3698678 - RNA, 16 nt, Salmonella enterica enterica serovar Typhi Ty2
augcgggggagaugau

SEQ ID NO: 3698679 - RNA, 17 nt, Salmonella enterica enterica serovar Typhi Ty2
augcgggguuugcagau

SEQ ID NO: 3698680 - RNA, 14 nt, Salmonella enterica enterica serovar Typhi Ty2
augcggguccugau

SEQ ID NO: 3698681 - RNA, 19 nt, Salmonella enterica enterica serovar Typhi Ty2
augcgguaaccguauugca

SEQ ID NO: 3698682 - RNA, 21 nt, Salmonella enterica enterica serovar Typhi Ty2
augcggucguauuaccaaccc

SEQ ID NO: 3698683 - RNA, 15 nt, Salmonella enterica enterica serovar Typhi Ty2
augcgguuaaaccag

SEQ ID NO: 3698684 - RNA, 18 nt, Salmonella enterica enterica serovar Typhi Ty2
augcgguucucccggcau

SEQ ID NO: 3698685 - RNA, 20 nt, Salmonella enterica enterica serovar Typhi Ty2
augcguaauccggccuggcg

SEQ ID NO: 3698686 - RNA, 13 nt, Salmonella enterica enterica serovar Typhi Ty2
augcguaccgcua

SEQ ID NO: 3698687 - RNA, 17 nt, Salmonella enterica enterica serovar Typhi Ty2
augcguauuuccaccuu

SEQ ID NO: 3698688 - RNA, 22 nt, Salmonella enterica enterica serovar Typhi Ty2
augcguauuuccaccuucucuu

SEQ ID NO: 3698689 - RNA, 15 nt, Salmonella enterica enterica serovar Typhi Ty2
augcguccgcccaga

SEQ ID NO: 3698690 - RNA, 21 nt, Salmonella enterica enterica serovar Typhi Ty2
augcgucggcaccauucccac

SEQ ID NO: 3698691 - RNA, 12 nt, Salmonella enterica enterica serovar Typhi Ty2
augcguucaaaa

SEQ ID NO: 3698692 - RNA, 21 nt, Salmonella enterica enterica serovar Typhi Ty2
augcguucuagcuuaucgcca

SEQ ID NO: 3698693 - RNA, 22 nt, Salmonella enterica enterica serovar Typhi Ty2
augcguuguccuauugcaacgc

SEQ ID NO: 3698694 - RNA, 17 nt, Salmonella enterica enterica serovar Typhi Ty2
augcguugucgcugauu

SEQ ID NO: 3698695 - RNA, 19 nt, Salmonella enterica enterica serovar Typhi Ty2
augcguuuuuaucuuucuu

SEQ ID NO: 3698696 - RNA, 17 nt, Salmonella enterica enterica serovar Typhi Ty2
augcuauccgccgccag

SEQ ID NO: 3698697 - RNA, 19 nt, Salmonella enterica enterica serovar Typhi Ty2
augcuaucgcggauaagcc

SEQ ID NO: 3698698 - RNA, 23 nt, Salmonella enterica enterica serovar Typhi Ty2
augcuaucgguaguguuaucgcc

SEQ ID NO: 3698699 - RNA, 14 nt, Salmonella enterica enterica serovar Typhi Ty2
augcuauucagcag

SEQ ID NO: 3698700 - RNA, 22 nt, Salmonella enterica enterica serovar Typhi Ty2
augcuauucagcaguucauucg

SEQ ID NO: 3698701 - RNA, 12 nt, Salmonella enterica enterica serovar Typhi Ty2
augcucaaccag

SEQ ID NO: 3698702 - RNA, 22 nt, Salmonella enterica enterica serovar Typhi Ty2
augcucaaccaguaccgggccu

SEQ ID NO: 3698703 - RNA, 23 nt, Salmonella enterica enterica serovar Typhi Ty2
augcucagggcauccgccgccgc

SEQ ID NO: 3698704 - RNA, 16 nt, Salmonella enterica enterica serovar Typhi Ty2
augcucaugaaggcau

SEQ ID NO: 3698705 - RNA, 17 nt, Salmonella enterica enterica serovar Typhi Ty2
augcucauuuugauaaa

SEQ ID NO: 3698706 - RNA, 17 nt, Salmonella enterica enterica serovar Typhi Ty2
augcuccaauaaauauu

SEQ ID NO: 3698707 - RNA, 22 nt, Salmonella enterica enterica serovar Typhi Ty2
augcucgccgucggcagacugg

SEQ ID NO: 3698708 - RNA, 13 nt, Salmonella enterica enterica serovar Typhi Ty2
augcucuccagca

SEQ ID NO: 3698709 - RNA, 20 nt, Salmonella enterica enterica serovar Typhi Ty2
augcugaauagccagccccc

SEQ ID NO: 3698710 - RNA, 19 nt, Salmonella enterica enterica serovar Typhi Ty2
augcugacgcguuuuuuca

SEQ ID NO: 3698711 - RNA, 21 nt, Salmonella enterica enterica serovar Typhi Ty2
augcugacggauucuuccucu

SEQ ID NO: 3698712 - RNA, 15 nt, Salmonella enterica enterica serovar Typhi Ty2
augcugauacaaagc

SEQ ID NO: 3698713 - RNA, 15 nt, Salmonella enterica enterica serovar Typhi Ty2
augcugcaccgcauc

SEQ ID NO: 3698714 - RNA, 13 nt, Salmonella enterica enterica serovar Typhi Ty2
augcugcagggcc

SEQ ID NO: 3698715 - RNA, 22 nt, Salmonella enterica enterica serovar Typhi Ty2
augcugccauuuuaucgacgcu

SEQ ID NO: 3698716 - RNA, 23 nt, Salmonella enterica enterica serovar Typhi Ty2
augcugcgguuauaauaauaauu

SEQ ID NO: 3698717 - RNA, 21 nt, Salmonella enterica enterica serovar Typhi Ty2
augcugcguacaaucgcguuu

SEQ ID NO: 3698718 - RNA, 21 nt, Salmonella enterica enterica serovar Typhi Ty2
augcuggugaagacgcugcaa

SEQ ID NO: 3698719 - RNA, 22 nt, Salmonella enterica enterica serovar Typhi Ty2
augcugguuuuagcuuauccca

SEQ ID NO: 3698720 - RNA, 23 nt, Salmonella enterica enterica serovar Typhi Ty2
augcuguuaccguaagcgggaug

SEQ ID NO: 3698721 - RNA, 21 nt, Salmonella enterica enterica serovar Typhi Ty2
augcuuaaaaucccgccgcug

SEQ ID NO: 3698722 - RNA, 22 nt, Salmonella enterica enterica serovar Typhi Ty2
augcuuccagccguuuaaucuc

SEQ ID NO: 3698723 - RNA, 14 nt, Salmonella enterica enterica serovar Typhi Ty2
augcuucuucgcca

SEQ ID NO: 3698724 - RNA, 20 nt, Salmonella enterica enterica serovar Typhi Ty2
augcuugccauauugccgca

SEQ ID NO: 3698725 - RNA, 20 nt, Salmonella enterica enterica serovar Typhi Ty2
augcuugcuuugcggcauaa

SEQ ID NO: 3698726 - RNA, 14 nt, Salmonella enterica enterica serovar Typhi Ty2
augcuuuaaaugcc

SEQ ID NO: 3698727 - RNA, 15 nt, Salmonella enterica enterica serovar Typhi Ty2
augcuuuaaaugccu

SEQ ID NO: 3698728 - RNA, 17 nt, Salmonella enterica enterica serovar Typhi Ty2
augcuuuaaaugccugu

SEQ ID NO: 3698729 - RNA, 15 nt, Salmonella enterica enterica serovar Typhi Ty2
auggucgguauuauc

SEQ ID NO: 3698730 - RNA, 23 nt, Salmonella enterica enterica serovar Typhi Ty2
auggucucaaucgcaaauugcug

SEQ ID NO: 3698731 - RNA, 13 nt, Salmonella enterica enterica serovar Typhi Ty2
auggucuuaaaug

SEQ ID NO: 3698732 - RNA, 23 nt, Salmonella enterica enterica serovar Typhi Ty2
auggugauagcgcgccagcacca

SEQ ID NO: 3698733 - RNA, 18 nt, Salmonella enterica enterica serovar Typhi Ty2
auggugcggcgcacugcc

SEQ ID NO: 3698734 - RNA, 18 nt, Salmonella enterica enterica serovar Typhi Ty2
augguggucgcggccacc

SEQ ID NO: 3698735 - RNA, 22 nt, Salmonella enterica enterica serovar Typhi Ty2
augguggucgcggccaccgcca

SEQ ID NO: 3698736 - RNA, 22 nt, Salmonella enterica enterica serovar Typhi Ty2
augguguuggcaaucagcggca

SEQ ID NO: 3698737 - RNA, 14 nt, Salmonella enterica enterica serovar Typhi Ty2
augguuaaauucau

SEQ ID NO: 3698738 - RNA, 17 nt, Salmonella enterica enterica serovar Typhi Ty2
augguuaagcagacgcu

SEQ ID NO: 3698739 - RNA, 18 nt, Salmonella enterica enterica serovar Typhi Ty2
augguuauaguccacuuu

SEQ ID NO: 3698740 - RNA, 17 nt, Salmonella enterica enterica serovar Typhi Ty2
augguuauccagcaggu

SEQ ID NO: 3698741 - RNA, 19 nt, Salmonella enterica enterica serovar Typhi Ty2
augguuauuaauuacgcug

SEQ ID NO: 3698742 - RNA, 11 nt, Salmonella enterica enterica serovar Typhi Ty2
augguuauuuu

SEQ ID NO: 3698743 - RNA, 20 nt, Salmonella enterica enterica serovar Typhi Ty2
augguucaggcggauauaug

SEQ ID NO: 3698744 - RNA, 20 nt, Salmonella enterica enterica serovar Typhi Ty2
augguugacuuacaaaaaau

SEQ ID NO: 3698745 - RNA, 15 nt, Salmonella enterica enterica serovar Typhi Ty2
augguugguauugcg

SEQ ID NO: 3698746 - RNA, 19 nt, Salmonella enterica enterica serovar Typhi Ty2
auguaaaacgguaugaaac

SEQ ID NO: 3698747 - RNA, 23 nt, Salmonella enterica enterica serovar Typhi Ty2
auguaaacuccauuaaauuacuu

SEQ ID NO: 3698748 - RNA, 16 nt, Salmonella enterica enterica serovar Typhi Ty2
auguaaaggugagcuc

SEQ ID NO: 3698749 - RNA, 11 nt, Salmonella enterica enterica serovar Typhi Ty2
auguaaaugac

SEQ ID NO: 3698750 - RNA, 16 nt, Salmonella enterica enterica serovar Typhi Ty2
auguaacgccuuugcc

SEQ ID NO: 3698751 - RNA, 24 nt, Salmonella enterica enterica serovar Typhi Ty2
auguaagcgucuauuacacgauca

SEQ ID NO: 3698752 - RNA, 16 nt, Salmonella enterica enterica serovar Typhi Ty2
auguaaucugacagau

SEQ ID NO: 3698753 - RNA, 16 nt, Salmonella enterica enterica serovar Typhi Ty2
auguaauucaccaaau

SEQ ID NO: 3698754 - RNA, 16 nt, Salmonella enterica enterica serovar Typhi Ty2
auguacaacuucauga

SEQ ID NO: 3698755 - RNA, 20 nt, Salmonella enterica enterica serovar Typhi Ty2
auguacacgaaauagcgcag

SEQ ID NO: 3698756 - RNA, 13 nt, Salmonella enterica enterica serovar Typhi Ty2
auguacaggugaa

SEQ ID NO: 3698757 - RNA, 23 nt, Salmonella enterica enterica serovar Typhi Ty2
auguacaggugaaauaggggaga

SEQ ID NO: 3698758 - RNA, 20 nt, Salmonella enterica enterica serovar Typhi Ty2
auguacauaggcaauauccu

SEQ ID NO: 3698759 - RNA, 20 nt, Salmonella enterica enterica serovar Typhi Ty2
auguaccauugucaaaaaua

SEQ ID NO: 3698760 - RNA, 17 nt, Salmonella enterica enterica serovar Typhi Ty2
auguaccugcguuaaac

SEQ ID NO: 3698761 - RNA, 16 nt, Salmonella enterica enterica serovar Typhi Ty2
auguacgccuaaaaau

SEQ ID NO: 3698762 - RNA, 17 nt, Salmonella enterica enterica serovar Typhi Ty2
auguacgccuaaaaaug

SEQ ID NO: 3698763 - RNA, 20 nt, Salmonella enterica enterica serovar Typhi Ty2
auguacgccuaaaaaugagg

SEQ ID NO: 3698764 - RNA, 22 nt, Salmonella enterica enterica serovar Typhi Ty2
auguacuguauucgguggaaac

SEQ ID NO: 3698765 - RNA, 15 nt, Salmonella enterica enterica serovar Typhi Ty2
auguagcaaauuuca

SEQ ID NO: 3698766 - RNA, 14 nt, Salmonella enterica enterica serovar Typhi Ty2
auguaguaaauagg

SEQ ID NO: 3698767 - RNA, 21 nt, Salmonella enterica enterica serovar Typhi Ty2
auguaguaaauaggagaugca

SEQ ID NO: 3698768 - RNA, 17 nt, Salmonella enterica enterica serovar Typhi Ty2
auguaucgcgcggauuc

SEQ ID NO: 3698769 - RNA, 20 nt, Salmonella enterica enterica serovar Typhi Ty2
auguaucgcgcggauuccgc

SEQ ID NO: 3698770 - RNA, 13 nt, Salmonella enterica enterica serovar Typhi Ty2
auguauuuaaguc

SEQ ID NO: 3698771 - RNA, 14 nt, Salmonella enterica enterica serovar Typhi Ty2
augucaacuuaaac

SEQ ID NO: 3698772 - RNA, 19 nt, Salmonella enterica enterica serovar Typhi Ty2
augucacccacgccggaaa

SEQ ID NO: 3698773 - RNA, 12 nt, Salmonella enterica enterica serovar Typhi Ty2
augucaggauca

SEQ ID NO: 3698774 - RNA, 17 nt, Salmonella enterica enterica serovar Typhi Ty2
augucaggaucagauau

SEQ ID NO: 3698775 - RNA, 22 nt, Salmonella enterica enterica serovar Typhi Ty2
augucagugacgguaucgugac

SEQ ID NO: 3698776 - RNA, 16 nt, Salmonella enterica enterica serovar Typhi Ty2
augucauauuugugag

SEQ ID NO: 3698777 - RNA, 22 nt, Salmonella enterica enterica serovar Typhi Ty2
augucaucaacauuggaaaacu

SEQ ID NO: 3698778 - RNA, 20 nt, Salmonella enterica enterica serovar Typhi Ty2
augucaucaggcgguguugu

SEQ ID NO: 3698779 - RNA, 14 nt, Salmonella enterica enterica serovar Typhi Ty2
augucaucggcuuu

SEQ ID NO: 3698780 - RNA, 17 nt, Salmonella enterica enterica serovar Typhi Ty2
augucaugacugguuuu

SEQ ID NO: 3698781 - RNA, 17 nt, Salmonella enterica enterica serovar Typhi Ty2
augucauucaggucuau

SEQ ID NO: 3698782 - RNA, 21 nt, Salmonella enterica enterica serovar Typhi Ty2
augucauucaggucuauugcc

SEQ ID NO: 3698783 - RNA, 14 nt, Salmonella enterica enterica serovar Typhi Ty2
auguccagaccaau

SEQ ID NO: 3698784 - RNA, 18 nt, Salmonella enterica enterica serovar Typhi Ty2
auguccauccauugcgcc

SEQ ID NO: 3698785 - RNA, 15 nt, Salmonella enterica enterica serovar Typhi Ty2
auguccgccuaccag

SEQ ID NO: 3698786 - RNA, 20 nt, Salmonella enterica enterica serovar Typhi Ty2
auguccgccuaccagcacau

SEQ ID NO: 3698787 - RNA, 20 nt, Salmonella enterica enterica serovar Typhi Ty2
auguccugccgcaaacgccu

SEQ ID NO: 3698788 - RNA, 23 nt, Salmonella enterica enterica serovar Typhi Ty2
auguccuuuacugcgccagccug

SEQ ID NO: 3698789 - RNA, 19 nt, Salmonella enterica enterica serovar Typhi Ty2
augucgauaauacagccug

SEQ ID NO: 3698790 - RNA, 23 nt, Salmonella enterica enterica serovar Typhi Ty2
augucgauucacguagcguauca

SEQ ID NO: 3698791 - RNA, 17 nt, Salmonella enterica enterica serovar Typhi Ty2
augucggcgaaaauccu

SEQ ID NO: 3698792 - RNA, 22 nt, Salmonella enterica enterica serovar Typhi Ty2
augucggcguaaauccagccuc

SEQ ID NO: 3698793 - RNA, 20 nt, Salmonella enterica enterica serovar Typhi Ty2
augucguuguaguuaucgcc

SEQ ID NO: 3698794 - RNA, 21 nt, Salmonella enterica enterica serovar Typhi Ty2
augucguuguaguuaucgccg

SEQ ID NO: 3698795 - RNA, 12 nt, Salmonella enterica enterica serovar Typhi Ty2
augucuggcgcu

SEQ ID NO: 3698796 - RNA, 17 nt, Salmonella enterica enterica serovar Typhi Ty2
augucuggcgcuaaaau

SEQ ID NO: 3698797 - RNA, 22 nt, Salmonella enterica enterica serovar Typhi Ty2
augucuggcgcuaaaauccacu

SEQ ID NO: 3698798 - RNA, 18 nt, Salmonella enterica enterica serovar Typhi Ty2
augucuggugcagcaagc

SEQ ID NO: 3698799 - RNA, 15 nt, Salmonella enterica enterica serovar Typhi Ty2
augucuuccuuuucu

SEQ ID NO: 3698800 - RNA, 15 nt, Salmonella enterica enterica serovar Typhi Ty2
augucuuuacggaug

SEQ ID NO: 3698801 - RNA, 17 nt, Salmonella enterica enterica serovar Typhi Ty2
augugaaauacagccag

SEQ ID NO: 3698802 - RNA, 13 nt, Salmonella enterica enterica serovar Typhi Ty2
augugacaaucac

SEQ ID NO: 3698803 - RNA, 15 nt, Salmonella enterica enterica serovar Typhi Ty2
augugacaaucacuc

SEQ ID NO: 3698804 - RNA, 12 nt, Salmonella enterica enterica serovar Typhi Ty2
augugagcgcau

SEQ ID NO: 3698805 - RNA, 13 nt, Salmonella enterica enterica serovar Typhi Ty2
augugagcgcauc

SEQ ID NO: 3698806 - RNA, 14 nt, Salmonella enterica enterica serovar Typhi Ty2
augugagcgcaucc

SEQ ID NO: 3698807 - RNA, 22 nt, Salmonella enterica enterica serovar Typhi Ty2
augugauacgcuuuaggguauc

SEQ ID NO: 3698808 - RNA, 17 nt, Salmonella enterica enterica serovar Typhi Ty2
augugauauggaaagug

SEQ ID NO: 3698809 - RNA, 18 nt, Salmonella enterica enterica serovar Typhi Ty2
augugauauggaaagugg

SEQ ID NO: 3698810 - RNA, 16 nt, Salmonella enterica enterica serovar Typhi Ty2
augugaucuauauauu

SEQ ID NO: 3698811 - RNA, 18 nt, Salmonella enterica enterica serovar Typhi Ty2
auuaaguuuuuuuaaaaa

SEQ ID NO: 3698812 - RNA, 12 nt, Salmonella enterica enterica serovar Typhi Ty2
auuaauaaaauc

SEQ ID NO: 3698813 - RNA, 23 nt, Salmonella enterica enterica serovar Typhi Ty2
auuaauaaccccagcugcggcau

SEQ ID NO: 3698814 - RNA, 16 nt, Salmonella enterica enterica serovar Typhi Ty2
auuaauacaucacuuu

SEQ ID NO: 3698815 - RNA, 16 nt, Salmonella enterica enterica serovar Typhi Ty2
auuaauauuuaacaca

SEQ ID NO: 3698816 - RNA, 16 nt, Salmonella enterica enterica serovar Typhi Ty2
auuaaucccgccaucg

SEQ ID NO: 3698817 - RNA, 14 nt, Salmonella enterica enterica serovar Typhi Ty2
auuaauccugcgcu

SEQ ID NO: 3698818 - RNA, 14 nt, Salmonella enterica enterica serovar Typhi Ty2
auuaaucgccagca

SEQ ID NO: 3698819 - RNA, 18 nt, Salmonella enterica enterica serovar Typhi Ty2
auuaaucugucgaugcgg

SEQ ID NO: 3698820 - RNA, 15 nt, Salmonella enterica enterica serovar Typhi Ty2
auuaaugauuaaaau

SEQ ID NO: 3698821 - RNA, 16 nt, Salmonella enterica enterica serovar Typhi Ty2
auuaaugauuugcuuu

SEQ ID NO: 3698822 - RNA, 16 nt, Salmonella enterica enterica serovar Typhi Ty2
auuaaugcgacgccca

SEQ ID NO: 3698823 - RNA, 17 nt, Salmonella enterica enterica serovar Typhi Ty2
auuaaugcuccaauaaa

SEQ ID NO: 3698824 - RNA, 18 nt, Salmonella enterica enterica serovar Typhi Ty2
auuaaugcuccaauaaau

SEQ ID NO: 3698825 - RNA, 19 nt, Salmonella enterica enterica serovar Typhi Ty2
auuaaugcuccaauaaaua

SEQ ID NO: 3698826 - RNA, 21 nt, Salmonella enterica enterica serovar Typhi Ty2
auuaaugcuccaauaaauauu

SEQ ID NO: 3698827 - RNA, 19 nt, Salmonella enterica enterica serovar Typhi Ty2
auuaauggcgcaauguccc

SEQ ID NO: 3698828 - RNA, 19 nt, Salmonella enterica enterica serovar Typhi Ty2
auuaauucuuuuaacauaa

SEQ ID NO: 3698829 - RNA, 15 nt, Salmonella enterica enterica serovar Typhi Ty2
auuaauugcuuugca

SEQ ID NO: 3698830 - RNA, 16 nt, Salmonella enterica enterica serovar Typhi Ty2
auuaauuuacugauaa

SEQ ID NO: 3698831 - RNA, 17 nt, Salmonella enterica enterica serovar Typhi Ty2
auuaauuuacugauaaa

SEQ ID NO: 3698832 - RNA, 18 nt, Salmonella enterica enterica serovar Typhi Ty2
auuaauuuauccaacagg

SEQ ID NO: 3698833 - RNA, 15 nt, Salmonella enterica enterica serovar Typhi Ty2
auuaauuuucacgcu

SEQ ID NO: 3698834 - RNA, 14 nt, Salmonella enterica enterica serovar Typhi Ty2
auuacaaaaauaga

SEQ ID NO: 3698835 - RNA, 16 nt, Salmonella enterica enterica serovar Typhi Ty2
auuacaaaaugugcaa

SEQ ID NO: 3698836 - RNA, 21 nt, Salmonella enterica enterica serovar Typhi Ty2
auuacaaacaggcuuuauaca

SEQ ID NO: 3698837 - RNA, 14 nt, Salmonella enterica enterica serovar Typhi Ty2
auuacaacaugucc

SEQ ID NO: 3698838 - RNA, 21 nt, Salmonella enterica enterica serovar Typhi Ty2
auuacaacgccugaugacgcu

SEQ ID NO: 3698839 - RNA, 23 nt, Salmonella enterica enterica serovar Typhi Ty2
auuacaacguucggucauggaua

SEQ ID NO: 3698840 - RNA, 13 nt, Salmonella enterica enterica serovar Typhi Ty2
auuacaagaaagu

SEQ ID NO: 3698841 - RNA, 16 nt, Salmonella enterica enterica serovar Typhi Ty2
auuacagcguguucau

SEQ ID NO: 3698842 - RNA, 10 nt, Salmonella enterica enterica serovar Typhi Ty2
auuaccagua

SEQ ID NO: 3698843 - RNA, 20 nt, Salmonella enterica enterica serovar Typhi Ty2
auuacccaacaccagacuga

SEQ ID NO: 3698844 - RNA, 16 nt, Salmonella enterica enterica serovar Typhi Ty2
auuaccccgugguggg

SEQ ID NO: 3698845 - RNA, 16 nt, Salmonella enterica enterica serovar Typhi Ty2
auuaccggcugccgau

SEQ ID NO: 3698846 - RNA, 22 nt, Salmonella enterica enterica serovar Typhi Ty2
auuaccgggauuuccauauuaa

SEQ ID NO: 3698847 - RNA, 23 nt, Salmonella enterica enterica serovar Typhi Ty2
auuaccgggauuuccauauuaac

SEQ ID NO: 3698848 - RNA, 15 nt, Salmonella enterica enterica serovar Typhi Ty2
auuaccugccagggu

SEQ ID NO: 3698849 - RNA, 16 nt, Salmonella enterica enterica serovar Typhi Ty2
auuaccugccagggug

SEQ ID NO: 3698850 - RNA, 18 nt, Salmonella enterica enterica serovar Typhi Ty2
auuacgacccacaaugag

SEQ ID NO: 3698851 - RNA, 19 nt, Salmonella enterica enterica serovar Typhi Ty2
auuacgcuauaaaguuccc

SEQ ID NO: 3698852 - RNA, 21 nt, Salmonella enterica enterica serovar Typhi Ty2
auuacgcuauaaaguucccau

SEQ ID NO: 3698853 - RNA, 19 nt, Salmonella enterica enterica serovar Typhi Ty2
auuacggcgaaugcgguaa

SEQ ID NO: 3698854 - RNA, 21 nt, Salmonella enterica enterica serovar Typhi Ty2
auuacuaucuucaaagccaca

SEQ ID NO: 3698855 - RNA, 14 nt, Salmonella enterica enterica serovar Typhi Ty2
auuacucuuuaugc

SEQ ID NO: 3698856 - RNA, 21 nt, Salmonella enterica enterica serovar Typhi Ty2
auuacugaccgagaucaggcc

SEQ ID NO: 3698857 - RNA, 12 nt, Salmonella enterica enterica serovar Typhi Ty2
auuacugauaaa

SEQ ID NO: 3698858 - RNA, 13 nt, Salmonella enterica enterica serovar Typhi Ty2
auuacugauaaag

SEQ ID NO: 3698859 - RNA, 20 nt, Salmonella enterica enterica serovar Typhi Ty2
auuacugcgugcuggcggcc

SEQ ID NO: 3698860 - RNA, 14 nt, Salmonella enterica enterica serovar Typhi Ty2
auuacuuauauuua

SEQ ID NO: 3698861 - RNA, 16 nt, Salmonella enterica enterica serovar Typhi Ty2
auuacuuauauuuauu

SEQ ID NO: 3698862 - RNA, 15 nt, Salmonella enterica enterica serovar Typhi Ty2
auuacuuaugauaua

SEQ ID NO: 3698863 - RNA, 15 nt, Salmonella enterica enterica serovar Typhi Ty2
auuacuuuccagcaa

SEQ ID NO: 3698864 - RNA, 14 nt, Salmonella enterica enterica serovar Typhi Ty2
auuagaaacccaua

SEQ ID NO: 3698865 - RNA, 20 nt, Salmonella enterica enterica serovar Typhi Ty2
auuagaaacccauauuccug

SEQ ID NO: 3698866 - RNA, 16 nt, Salmonella enterica enterica serovar Typhi Ty2
auuagaggucagaaua

SEQ ID NO: 3698867 - RNA, 21 nt, Salmonella enterica enterica serovar Typhi Ty2
auuagaggucagaauaacuca

SEQ ID NO: 3698868 - RNA, 19 nt, Salmonella enterica enterica serovar Typhi Ty2
auuagcauccagcacgagc

SEQ ID NO: 3698869 - RNA, 14 nt, Salmonella enterica enterica serovar Typhi Ty2
auuagccgccaucc

SEQ ID NO: 3698870 - RNA, 18 nt, Salmonella enterica enterica serovar Typhi Ty2
auuagccgccauccggca

SEQ ID NO: 3698871 - RNA, 22 nt, Salmonella enterica enterica serovar Typhi Ty2
auuagccgccauccggcaucuc

SEQ ID NO: 3698872 - RNA, 22 nt, Salmonella enterica enterica serovar Typhi Ty2
auuagcgacgcauacucuugga

SEQ ID NO: 3698873 - RNA, 20 nt, Salmonella enterica enterica serovar Typhi Ty2
auuagcguuuuuaccggcuc

SEQ ID NO: 3698874 - RNA, 13 nt, Salmonella enterica enterica serovar Typhi Ty2
auuagcuggcugc

SEQ ID NO: 3698875 - RNA, 23 nt, Salmonella enterica enterica serovar Typhi Ty2
auuagcuuuuuacucucuuucug

SEQ ID NO: 3698876 - RNA, 19 nt, Salmonella enterica enterica serovar Typhi Ty2
auuaggcguaaaauugccg

SEQ ID NO: 3698877 - RNA, 15 nt, Salmonella enterica enterica serovar Typhi Ty2
auuagggugcaguga

SEQ ID NO: 3698878 - RNA, 14 nt, Salmonella enterica enterica serovar Typhi Ty2
auuagucagcaaca

SEQ ID NO: 3698879 - RNA, 16 nt, Salmonella enterica enterica serovar Typhi Ty2
auuaguccugccgcua

SEQ ID NO: 3698880 - RNA, 20 nt, Salmonella enterica enterica serovar Typhi Ty2
auuaguucaaguuuagaaaa

SEQ ID NO: 3698881 - RNA, 16 nt, Salmonella enterica enterica serovar Typhi Ty2
auuauacauucgcuca

SEQ ID NO: 3698882 - RNA, 22 nt, Salmonella enterica enterica serovar Typhi Ty2
auuauacuugcugcuauguaaa

SEQ ID NO: 3698883 - RNA, 18 nt, Salmonella enterica enterica serovar Typhi Ty2
auuauauagacuccguca

SEQ ID NO: 3698884 - RNA, 17 nt, Salmonella enterica enterica serovar Typhi Ty2
auuauauugcguaaaaa

SEQ ID NO: 3698885 - RNA, 15 nt, Salmonella enterica enterica serovar Typhi Ty2
auuauauuuaaaauu

SEQ ID NO: 3698886 - RNA, 14 nt, Salmonella enterica enterica serovar Typhi Ty2
auuauauuuuaugg

SEQ ID NO: 3698887 - RNA, 11 nt, Salmonella enterica enterica serovar Typhi Ty2
auuaucaccau

SEQ ID NO: 3698888 - RNA, 12 nt, Salmonella enterica enterica serovar Typhi Ty2
auuaucaccauu

SEQ ID NO: 3698889 - RNA, 18 nt, Salmonella enterica enterica serovar Typhi Ty2
auuaucaggaugaauaug

SEQ ID NO: 3698890 - RNA, 18 nt, Salmonella enterica enterica serovar Typhi Ty2
auuauccgccgcaaauuc

SEQ ID NO: 3698891 - RNA, 16 nt, Salmonella enterica enterica serovar Typhi Ty2
auuaucgaacugaaau

SEQ ID NO: 3698892 - RNA, 22 nt, Salmonella enterica enterica serovar Typhi Ty2
auuaucgauuugguaaauaacu

SEQ ID NO: 3698893 - RNA, 14 nt, Salmonella enterica enterica serovar Typhi Ty2
auuccagaaaggau

SEQ ID NO: 3698894 - RNA, 21 nt, Salmonella enterica enterica serovar Typhi Ty2
auuccagaaaggaugcccgua

SEQ ID NO: 3698895 - RNA, 15 nt, Salmonella enterica enterica serovar Typhi Ty2
auuccagaaucuggc

SEQ ID NO: 3698896 - RNA, 11 nt, Salmonella enterica enterica serovar Typhi Ty2
auuccagaccc

SEQ ID NO: 3698897 - RNA, 22 nt, Salmonella enterica enterica serovar Typhi Ty2
auuccagccgguguuaaccaga

SEQ ID NO: 3698898 - RNA, 22 nt, Salmonella enterica enterica serovar Typhi Ty2
auuccagggcauuuuuuccagu

SEQ ID NO: 3698899 - RNA, 23 nt, Salmonella enterica enterica serovar Typhi Ty2
auuccagggcauuuuuuccagua

SEQ ID NO: 3698900 - RNA, 19 nt, Salmonella enterica enterica serovar Typhi Ty2
auuccaguagcgcgcccau

SEQ ID NO: 3698901 - RNA, 12 nt, Salmonella enterica enterica serovar Typhi Ty2
auuccagucauu

SEQ ID NO: 3698902 - RNA, 15 nt, Salmonella enterica enterica serovar Typhi Ty2
auuccagucgcucca

SEQ ID NO: 3698903 - RNA, 13 nt, Salmonella enterica enterica serovar Typhi Ty2
auuccaucggcau

SEQ ID NO: 3698904 - RNA, 15 nt, Salmonella enterica enterica serovar Typhi Ty2
auuccaucggcaucg

SEQ ID NO: 3698905 - RNA, 20 nt, Salmonella enterica enterica serovar Typhi Ty2
auuccauuagcauucccuua

SEQ ID NO: 3698906 - RNA, 13 nt, Salmonella enterica enterica serovar Typhi Ty2
auuccauuggcca

SEQ ID NO: 3698907 - RNA, 20 nt, Salmonella enterica enterica serovar Typhi Ty2
auucccacgcauaguccugc

SEQ ID NO: 3698908 - RNA, 12 nt, Salmonella enterica enterica serovar Typhi Ty2
auucccaggcaa

SEQ ID NO: 3698909 - RNA, 14 nt, Salmonella enterica enterica serovar Typhi Ty2
auucccaggcaaau

SEQ ID NO: 3698910 - RNA, 21 nt, Salmonella enterica enterica serovar Typhi Ty2
auucccccauccgcgccggac

SEQ ID NO: 3698911 - RNA, 16 nt, Salmonella enterica enterica serovar Typhi Ty2
auuccccguccugaau

SEQ ID NO: 3698912 - RNA, 14 nt, Salmonella enterica enterica serovar Typhi Ty2
auucccgccgcaau

SEQ ID NO: 3698913 - RNA, 14 nt, Salmonella enterica enterica serovar Typhi Ty2
auucccgccuuaag

SEQ ID NO: 3698914 - RNA, 17 nt, Salmonella enterica enterica serovar Typhi Ty2
auucccguaucuucaug

SEQ ID NO: 3698915 - RNA, 15 nt, Salmonella enterica enterica serovar Typhi Ty2
auucccgucccugca

SEQ ID NO: 3698916 - RNA, 16 nt, Salmonella enterica enterica serovar Typhi Ty2
auucccgucccugcau

SEQ ID NO: 3698917 - RNA, 22 nt, Salmonella enterica enterica serovar Typhi Ty2
auucccugcgcauacgucaugc

SEQ ID NO: 3698918 - RNA, 19 nt, Salmonella enterica enterica serovar Typhi Ty2
auucccugguucgaaucca

SEQ ID NO: 3698919 - RNA, 21 nt, Salmonella enterica enterica serovar Typhi Ty2
auucccugguucgaauccagg

SEQ ID NO: 3698920 - RNA, 22 nt, Salmonella enterica enterica serovar Typhi Ty2
auuccgaaagaaagacgcugaa

SEQ ID NO: 3698921 - RNA, 21 nt, Salmonella enterica enterica serovar Typhi Ty2
auuccgacagugaacggcaua

SEQ ID NO: 3698922 - RNA, 15 nt, Salmonella enterica enterica serovar Typhi Ty2
auuccgcagaagccg

SEQ ID NO: 3698923 - RNA, 17 nt, Salmonella enterica enterica serovar Typhi Ty2
auuccgccaacgguaag

SEQ ID NO: 3698924 - RNA, 14 nt, Salmonella enterica enterica serovar Typhi Ty2
auuccgccugcugu

SEQ ID NO: 3698925 - RNA, 13 nt, Salmonella enterica enterica serovar Typhi Ty2
auuccgcgcauaa

SEQ ID NO: 3698926 - RNA, 23 nt, Salmonella enterica enterica serovar Typhi Ty2
auuccgcguguuuguaaaaauag

SEQ ID NO: 3698927 - RNA, 16 nt, Salmonella enterica enterica serovar Typhi Ty2
auuccgcuuccagaau

SEQ ID NO: 3698928 - RNA, 22 nt, Salmonella enterica enterica serovar Typhi Ty2
auuccgcuuccagaauucguac

SEQ ID NO: 3698929 - RNA, 21 nt, Salmonella enterica enterica serovar Typhi Ty2
auuccgcuuucuucccggcag

SEQ ID NO: 3698930 - RNA, 13 nt, Salmonella enterica enterica serovar Typhi Ty2
auuccggcacaac

SEQ ID NO: 3698931 - RNA, 20 nt, Salmonella enterica enterica serovar Typhi Ty2
auuccggcaucguacgggca

SEQ ID NO: 3698932 - RNA, 16 nt, Salmonella enterica enterica serovar Typhi Ty2
auuccguuugcgccgg

SEQ ID NO: 3698933 - RNA, 22 nt, Salmonella enterica enterica serovar Typhi Ty2
auuccuccgccgaucagcacca

SEQ ID NO: 3698934 - RNA, 19 nt, Salmonella enterica enterica serovar Typhi Ty2
auuccugacauuuauauua

SEQ ID NO: 3698935 - RNA, 16 nt, Salmonella enterica enterica serovar Typhi Ty2
auuccugacgcacagu

SEQ ID NO: 3698936 - RNA, 14 nt, Salmonella enterica enterica serovar Typhi Ty2
auuccugacugcgc

SEQ ID NO: 3698937 - RNA, 14 nt, Salmonella enterica enterica serovar Typhi Ty2
auuccugaguuuau

SEQ ID NO: 3698938 - RNA, 14 nt, Salmonella enterica enterica serovar Typhi Ty2
auuccugccgccgc

SEQ ID NO: 3698939 - RNA, 20 nt, Salmonella enterica enterica serovar Typhi Ty2
auuccugccgccgcaccacu

SEQ ID NO: 3698940 - RNA, 14 nt, Salmonella enterica enterica serovar Typhi Ty2
auuccuggauuaaa

SEQ ID NO: 3698941 - RNA, 21 nt, Salmonella enterica enterica serovar Typhi Ty2
auuccuuuuuccgccaccugu

SEQ ID NO: 3698942 - RNA, 19 nt, Salmonella enterica enterica serovar Typhi Ty2
auucgacaguucccggcaa

SEQ ID NO: 3698943 - RNA, 22 nt, Salmonella enterica enterica serovar Typhi Ty2
auucgacaguucccggcaacag

SEQ ID NO: 3698944 - RNA, 22 nt, Salmonella enterica enterica serovar Typhi Ty2
auucgacugcggucguauuuac

SEQ ID NO: 3698945 - RNA, 18 nt, Salmonella enterica enterica serovar Typhi Ty2
auucgaucuguguacuuu

SEQ ID NO: 3698946 - RNA, 16 nt, Salmonella enterica enterica serovar Typhi Ty2
auucgccaccaggcuc

SEQ ID NO: 3698947 - RNA, 23 nt, Salmonella enterica enterica serovar Typhi Ty2
auucgccaccgcgcgcuuaaucg

SEQ ID NO: 3698948 - RNA, 18 nt, Salmonella enterica enterica serovar Typhi Ty2
auucgccaguaaggggau

SEQ ID NO: 3698949 - RNA, 13 nt, Salmonella enterica enterica serovar Typhi Ty2
auucgcccggcag

SEQ ID NO: 3698950 - RNA, 15 nt, Salmonella enterica enterica serovar Typhi Ty2
auucgccguucuguu

SEQ ID NO: 3698951 - RNA, 20 nt, Salmonella enterica enterica serovar Typhi Ty2
auucgccuuucacgcguuca

SEQ ID NO: 3698952 - RNA, 18 nt, Salmonella enterica enterica serovar Typhi Ty2
auucgcgaugcucaacca

SEQ ID NO: 3698953 - RNA, 23 nt, Salmonella enterica enterica serovar Typhi Ty2
auucgcgcuaaaugacaaauaga

SEQ ID NO: 3698954 - RNA, 14 nt, Salmonella enterica enterica serovar Typhi Ty2
auucgcuaauaauu

SEQ ID NO: 3698955 - RNA, 19 nt, Salmonella enterica enterica serovar Typhi Ty2
auucgcuaauccccccuuu

SEQ ID NO: 3698956 - RNA, 12 nt, Salmonella enterica enterica serovar Typhi Ty2
auucgcuugccc

SEQ ID NO: 3698957 - RNA, 17 nt, Salmonella enterica enterica serovar Typhi Ty2
auucgcuuguuucacug

SEQ ID NO: 3698958 - RNA, 22 nt, Salmonella enterica enterica serovar Typhi Ty2
auucggcgcuucgcagcgauau

SEQ ID NO: 3698959 - RNA, 23 nt, Salmonella enterica enterica serovar Typhi Ty2
auucgggacaaacccccagccau

SEQ ID NO: 3698960 - RNA, 15 nt, Salmonella enterica enterica serovar Typhi Ty2
auucgucaauaccua

SEQ ID NO: 3698961 - RNA, 16 nt, Salmonella enterica enterica serovar Typhi Ty2
auucgucaccgaauag

SEQ ID NO: 3698962 - RNA, 15 nt, Salmonella enterica enterica serovar Typhi Ty2
auucgucuucaucuu

SEQ ID NO: 3698963 - RNA, 13 nt, Salmonella enterica enterica serovar Typhi Ty2
auucuaaggccgc

SEQ ID NO: 3698964 - RNA, 19 nt, Salmonella enterica enterica serovar Typhi Ty2
auucuacaguuugucauca

SEQ ID NO: 3698965 - RNA, 22 nt, Salmonella enterica enterica serovar Typhi Ty2
auucuacaguuugucaucaguc

SEQ ID NO: 3698966 - RNA, 12 nt, Salmonella enterica enterica serovar Typhi Ty2
auucuaugccag

SEQ ID NO: 3698967 - RNA, 23 nt, Salmonella enterica enterica serovar Typhi Ty2
auucucacagaaucaucaggcua

SEQ ID NO: 3698968 - RNA, 20 nt, Salmonella enterica enterica serovar Typhi Ty2
auucucagccagguauuuag

SEQ ID NO: 3698969 - RNA, 19 nt, Salmonella enterica enterica serovar Typhi Ty2
auucucaucagaccgugaa

SEQ ID NO: 3698970 - RNA, 14 nt, Salmonella enterica enterica serovar Typhi Ty2
auucucccaaauuu

SEQ ID NO: 3698971 - RNA, 17 nt, Salmonella enterica enterica serovar Typhi Ty2
auucucugucgccgccc

SEQ ID NO: 3698972 - RNA, 20 nt, Salmonella enterica enterica serovar Typhi Ty2
auucucuucuaccacgcugc

SEQ ID NO: 3698973 - RNA, 12 nt, Salmonella enterica enterica serovar Typhi Ty2
auucugcagcga

SEQ ID NO: 3698974 - RNA, 15 nt, Salmonella enterica enterica serovar Typhi Ty2
auucugccaguucac

SEQ ID NO: 3698975 - RNA, 17 nt, Salmonella enterica enterica serovar Typhi Ty2
auugccuuccaggcggu

SEQ ID NO: 3698976 - RNA, 18 nt, Salmonella enterica enterica serovar Typhi Ty2
auugcgaauaaaacugcc

SEQ ID NO: 3698977 - RNA, 15 nt, Salmonella enterica enterica serovar Typhi Ty2
auugcgagaaaaaac

SEQ ID NO: 3698978 - RNA, 14 nt, Salmonella enterica enterica serovar Typhi Ty2
auugcgccaccuua

SEQ ID NO: 3698979 - RNA, 14 nt, Salmonella enterica enterica serovar Typhi Ty2
auugcgccagcuuu

SEQ ID NO: 3698980 - RNA, 15 nt, Salmonella enterica enterica serovar Typhi Ty2
auugcgccccagcac

SEQ ID NO: 3698981 - RNA, 21 nt, Salmonella enterica enterica serovar Typhi Ty2
auugcgccugggauaagcaga

SEQ ID NO: 3698982 - RNA, 19 nt, Salmonella enterica enterica serovar Typhi Ty2
auugcggggguuguuuuac

SEQ ID NO: 3698983 - RNA, 15 nt, Salmonella enterica enterica serovar Typhi Ty2
auugcgguucugcau

SEQ ID NO: 3698984 - RNA, 16 nt, Salmonella enterica enterica serovar Typhi Ty2
auugcguaaugagcgu

SEQ ID NO: 3698985 - RNA, 22 nt, Salmonella enterica enterica serovar Typhi Ty2
auugcguaucguaagccaccgc

SEQ ID NO: 3698986 - RNA, 13 nt, Salmonella enterica enterica serovar Typhi Ty2
auugcucacccau

SEQ ID NO: 3698987 - RNA, 20 nt, Salmonella enterica enterica serovar Typhi Ty2
auugcucuuccggcauaaaa

SEQ ID NO: 3698988 - RNA, 22 nt, Salmonella enterica enterica serovar Typhi Ty2
auugcucuuccggcauaaaaag

SEQ ID NO: 3698989 - RNA, 15 nt, Salmonella enterica enterica serovar Typhi Ty2
auugcugaagauaaa

SEQ ID NO: 3698990 - RNA, 16 nt, Salmonella enterica enterica serovar Typhi Ty2
auugcugaagauaaaa

SEQ ID NO: 3698991 - RNA, 19 nt, Salmonella enterica enterica serovar Typhi Ty2
auugcugacgcgcuuuuuc

SEQ ID NO: 3698992 - RNA, 14 nt, Salmonella enterica enterica serovar Typhi Ty2
auugcugccuuauc

SEQ ID NO: 3698993 - RNA, 14 nt, Salmonella enterica enterica serovar Typhi Ty2
auugcugcuauuuc

SEQ ID NO: 3698994 - RNA, 20 nt, Salmonella enterica enterica serovar Typhi Ty2
auugcugugaaguaauucuu

SEQ ID NO: 3698995 - RNA, 22 nt, Salmonella enterica enterica serovar Typhi Ty2
auugcuucguggcaaucagcaa

SEQ ID NO: 3698996 - RNA, 18 nt, Salmonella enterica enterica serovar Typhi Ty2
auugcuuuuggcaacggc

SEQ ID NO: 3698997 - RNA, 18 nt, Salmonella enterica enterica serovar Typhi Ty2
auuggaaaacuccagcag

SEQ ID NO: 3698998 - RNA, 20 nt, Salmonella enterica enterica serovar Typhi Ty2
auuggcaaaccccugcucgc

SEQ ID NO: 3698999 - RNA, 14 nt, Salmonella enterica enterica serovar Typhi Ty2
auuggcaucauaaa

SEQ ID NO: 3699000 - RNA, 15 nt, Salmonella enterica enterica serovar Typhi Ty2
auuggccccuggccg

SEQ ID NO: 3699001 - RNA, 15 nt, Salmonella enterica enterica serovar Typhi Ty2
auuggcggcaaagaa

SEQ ID NO: 3699002 - RNA, 16 nt, Salmonella enterica enterica serovar Typhi Ty2
auuggcggcaaagaaa

SEQ ID NO: 3699003 - RNA, 15 nt, Salmonella enterica enterica serovar Typhi Ty2
auuggcguuuuauga

SEQ ID NO: 3699004 - RNA, 15 nt, Salmonella enterica enterica serovar Typhi Ty2
auuggcugccgacaa

SEQ ID NO: 3699005 - RNA, 15 nt, Salmonella enterica enterica serovar Typhi Ty2
auugggcguaagaaa

SEQ ID NO: 3699006 - RNA, 19 nt, Salmonella enterica enterica serovar Typhi Ty2
auuggguaguaauauuaaa

SEQ ID NO: 3699007 - RNA, 15 nt, Salmonella enterica enterica serovar Typhi Ty2
auugguagacgcacc

SEQ ID NO: 3699008 - RNA, 17 nt, Salmonella enterica enterica serovar Typhi Ty2
auuggucauucggcggu

SEQ ID NO: 3699009 - RNA, 14 nt, Salmonella enterica enterica serovar Typhi Ty2
auuggucugauuca

SEQ ID NO: 3699010 - RNA, 12 nt, Salmonella enterica enterica serovar Typhi Ty2
auuguaaaaccg

SEQ ID NO: 3699011 - RNA, 14 nt, Salmonella enterica enterica serovar Typhi Ty2
auugucaaaaauag

SEQ ID NO: 3699012 - RNA, 21 nt, Salmonella enterica enterica serovar Typhi Ty2
auugucaccuguaaccccagc

SEQ ID NO: 3699013 - RNA, 21 nt, Salmonella enterica enterica serovar Typhi Ty2
auugucagcucuuuguuuagc

SEQ ID NO: 3699014 - RNA, 20 nt, Salmonella enterica enterica serovar Typhi Ty2
auugucaugcuaaaacagau

SEQ ID NO: 3699015 - RNA, 21 nt, Salmonella enterica enterica serovar Typhi Ty2
auuguccgcauucuugccgca

SEQ ID NO: 3699016 - RNA, 23 nt, Salmonella enterica enterica serovar Typhi Ty2
auuguccuuuaucugcccuuucu

SEQ ID NO: 3699017 - RNA, 17 nt, Salmonella enterica enterica serovar Typhi Ty2
auugucuuaaauaugaa

SEQ ID NO: 3699018 - RNA, 13 nt, Salmonella enterica enterica serovar Typhi Ty2
auugugaaauucg

SEQ ID NO: 3699019 - RNA, 16 nt, Salmonella enterica enterica serovar Typhi Ty2
auugugagaaaagcag

SEQ ID NO: 3699020 - RNA, 18 nt, Salmonella enterica enterica serovar Typhi Ty2
auugugagaaaagcagag

SEQ ID NO: 3699021 - RNA, 15 nt, Salmonella enterica enterica serovar Typhi Ty2
auugugauuccaguu

SEQ ID NO: 3699022 - RNA, 18 nt, Salmonella enterica enterica serovar Typhi Ty2
auugugcacagguaaacg

SEQ ID NO: 3699023 - RNA, 21 nt, Salmonella enterica enterica serovar Typhi Ty2
auugugguguuccauugcugc

SEQ ID NO: 3699024 - RNA, 13 nt, Salmonella enterica enterica serovar Typhi Ty2
auuguuaaaaaga

SEQ ID NO: 3699025 - RNA, 13 nt, Salmonella enterica enterica serovar Typhi Ty2
auuguuccagguu

SEQ ID NO: 3699026 - RNA, 13 nt, Salmonella enterica enterica serovar Typhi Ty2
auuguugccccgc

SEQ ID NO: 3699027 - RNA, 14 nt, Salmonella enterica enterica serovar Typhi Ty2
auuguugcgccaug

SEQ ID NO: 3699028 - RNA, 19 nt, Salmonella enterica enterica serovar Typhi Ty2
auuguuggugaguggccug

SEQ ID NO: 3699029 - RNA, 19 nt, Salmonella enterica enterica serovar Typhi Ty2
auuguuucggauaauucug

SEQ ID NO: 3699030 - RNA, 13 nt, Salmonella enterica enterica serovar Typhi Ty2
auuguuuuacuuu

SEQ ID NO: 3699031 - RNA, 13 nt, Salmonella enterica enterica serovar Typhi Ty2
auuguuuucuauu

SEQ ID NO: 3699032 - RNA, 18 nt, Salmonella enterica enterica serovar Typhi Ty2
auuuaaacgggguaaacu

SEQ ID NO: 3699033 - RNA, 15 nt, Salmonella enterica enterica serovar Typhi Ty2
auuuaaauacuuuuu

SEQ ID NO: 3699034 - RNA, 15 nt, Salmonella enterica enterica serovar Typhi Ty2
auuuaaauagcaauu

SEQ ID NO: 3699035 - RNA, 22 nt, Salmonella enterica enterica serovar Typhi Ty2
auuuaacagagagggaaaaaaa

SEQ ID NO: 3699036 - RNA, 19 nt, Salmonella enterica enterica serovar Typhi Ty2
auuuaagccagauguaauc

SEQ ID NO: 3699037 - RNA, 13 nt, Salmonella enterica enterica serovar Typhi Ty2
auuuaauacauca

SEQ ID NO: 3699038 - RNA, 21 nt, Salmonella enterica enterica serovar Typhi Ty2
auuuaaugaaccgggagauaa

SEQ ID NO: 3699039 - RNA, 13 nt, Salmonella enterica enterica serovar Typhi Ty2
auuuaauguuuca

SEQ ID NO: 3699040 - RNA, 22 nt, Salmonella enterica enterica serovar Typhi Ty2
auuuacaaaugaccucaagaau

SEQ ID NO: 3699041 - RNA, 20 nt, Salmonella enterica enterica serovar Typhi Ty2
auuuacggcgauuugccccg

SEQ ID NO: 3699042 - RNA, 20 nt, Salmonella enterica enterica serovar Typhi Ty2
auuuacgguuggccagcaug

SEQ ID NO: 3699043 - RNA, 15 nt, Salmonella enterica enterica serovar Typhi Ty2
auuuacuccaaaaau

SEQ ID NO: 3699044 - RNA, 16 nt, Salmonella enterica enterica serovar Typhi Ty2
auuuacuccaaaaaua

SEQ ID NO: 3699045 - RNA, 11 nt, Salmonella enterica enterica serovar Typhi Ty2
auuuacugccg

SEQ ID NO: 3699046 - RNA, 15 nt, Salmonella enterica enterica serovar Typhi Ty2
auuuacugugaucca

SEQ ID NO: 3699047 - RNA, 23 nt, Salmonella enterica enterica serovar Typhi Ty2
auuuagcuauuccaaaauaauaa

SEQ ID NO: 3699048 - RNA, 14 nt, Salmonella enterica enterica serovar Typhi Ty2
auuuaggauuuguc

SEQ ID NO: 3699049 - RNA, 15 nt, Salmonella enterica enterica serovar Typhi Ty2
auuuauagagcagca

SEQ ID NO: 3699050 - RNA, 14 nt, Salmonella enterica enterica serovar Typhi Ty2
auuuauauuagggc

SEQ ID NO: 3699051 - RNA, 16 nt, Salmonella enterica enterica serovar Typhi Ty2
auuuaucaauuuuuaa

SEQ ID NO: 3699052 - RNA, 23 nt, Salmonella enterica enterica serovar Typhi Ty2
auuuauccaccgccagacgcccc

SEQ ID NO: 3699053 - RNA, 13 nt, Salmonella enterica enterica serovar Typhi Ty2
auuuauccaguaa

SEQ ID NO: 3699054 - RNA, 20 nt, Salmonella enterica enterica serovar Typhi Ty2
auuuauccauguuuguuuaa

SEQ ID NO: 3699055 - RNA, 18 nt, Salmonella enterica enterica serovar Typhi Ty2
auuuaucuuccggcauca

SEQ ID NO: 3699056 - RNA, 15 nt, Salmonella enterica enterica serovar Typhi Ty2
auuuaucuucucuau

SEQ ID NO: 3699057 - RNA, 15 nt, Salmonella enterica enterica serovar Typhi Ty2
auuucuuugucgcca

SEQ ID NO: 3699058 - RNA, 20 nt, Salmonella enterica enterica serovar Typhi Ty2
auuugaauaauucuguacca

SEQ ID NO: 3699059 - RNA, 14 nt, Salmonella enterica enterica serovar Typhi Ty2
auuugacguuaucc

SEQ ID NO: 3699060 - RNA, 10 nt, Salmonella enterica enterica serovar Typhi Ty2
auuugauuua

SEQ ID NO: 3699061 - RNA, 17 nt, Salmonella enterica enterica serovar Typhi Ty2
auuugauuuauuuugaa

SEQ ID NO: 3699062 - RNA, 22 nt, Salmonella enterica enterica serovar Typhi Ty2
auuugcgacaucagccagccgc

SEQ ID NO: 3699063 - RNA, 17 nt, Salmonella enterica enterica serovar Typhi Ty2
auuugcgcauccaccgc

SEQ ID NO: 3699064 - RNA, 15 nt, Salmonella enterica enterica serovar Typhi Ty2
auuugcgugucauca

SEQ ID NO: 3699065 - RNA, 14 nt, Salmonella enterica enterica serovar Typhi Ty2
auuugcuguuuuau

SEQ ID NO: 3699066 - RNA, 13 nt, Salmonella enterica enterica serovar Typhi Ty2
auuugcuguuuuu

SEQ ID NO: 3699067 - RNA, 20 nt, Salmonella enterica enterica serovar Typhi Ty2
auuugcuguuuuuuguugau

SEQ ID NO: 3699068 - RNA, 23 nt, Salmonella enterica enterica serovar Typhi Ty2
auuugcuguuuuuuguugauuuu

SEQ ID NO: 3699069 - RNA, 22 nt, Salmonella enterica enterica serovar Typhi Ty2
auuuggcguaaucgauaagcuc

SEQ ID NO: 3699070 - RNA, 13 nt, Salmonella enterica enterica serovar Typhi Ty2
auuuggucggcgu

SEQ ID NO: 3699071 - RNA, 23 nt, Salmonella enterica enterica serovar Typhi Ty2
auuugguuagggaucaucuucac

SEQ ID NO: 3699072 - RNA, 16 nt, Salmonella enterica enterica serovar Typhi Ty2
auuuguacuucagagc

SEQ ID NO: 3699073 - RNA, 17 nt, Salmonella enterica enterica serovar Typhi Ty2
auuuguagcugcgccug

SEQ ID NO: 3699074 - RNA, 19 nt, Salmonella enterica enterica serovar Typhi Ty2
auuuguagcugcgccugaa

SEQ ID NO: 3699075 - RNA, 16 nt, Salmonella enterica enterica serovar Typhi Ty2
auuugucagacaugau

SEQ ID NO: 3699076 - RNA, 19 nt, Salmonella enterica enterica serovar Typhi Ty2
auuugucgucaugcgccag

SEQ ID NO: 3699077 - RNA, 17 nt, Salmonella enterica enterica serovar Typhi Ty2
auuugugagcuauacgg

SEQ ID NO: 3699078 - RNA, 22 nt, Salmonella enterica enterica serovar Typhi Ty2
auuugugagcuauacgguaaau

SEQ ID NO: 3699079 - RNA, 19 nt, Salmonella enterica enterica serovar Typhi Ty2
auuugugauugcagauaau

SEQ ID NO: 3699080 - RNA, 13 nt, Salmonella enterica enterica serovar Typhi Ty2
auuuguuaucuac

SEQ ID NO: 3699081 - RNA, 15 nt, Salmonella enterica enterica serovar Typhi Ty2
auuuguuaucuacag

SEQ ID NO: 3699082 - RNA, 15 nt, Salmonella enterica enterica serovar Typhi Ty2
auuuguuucaucgcc

SEQ ID NO: 3699083 - RNA, 14 nt, Salmonella enterica enterica serovar Typhi Ty2
auuuuaaaaauauc

SEQ ID NO: 3699084 - RNA, 20 nt, Salmonella enterica enterica serovar Typhi Ty2
auuuuaaauugguuauauua

SEQ ID NO: 3699085 - RNA, 18 nt, Salmonella enterica enterica serovar Typhi Ty2
auuuuaaauuuccucuug

SEQ ID NO: 3699086 - RNA, 21 nt, Salmonella enterica enterica serovar Typhi Ty2
auuuuaaauuuccucuuguca

SEQ ID NO: 3699087 - RNA, 21 nt, Salmonella enterica enterica serovar Typhi Ty2
auuuuacccgcgcaucccaca

SEQ ID NO: 3699088 - RNA, 15 nt, Salmonella enterica enterica serovar Typhi Ty2
auuuuacuaaugaau

SEQ ID NO: 3699089 - RNA, 22 nt, Salmonella enterica enterica serovar Typhi Ty2
auuuuacugcguaaucuuuuca

SEQ ID NO: 3699090 - RNA, 14 nt, Salmonella enterica enterica serovar Typhi Ty2
auuuuacuuucauu

SEQ ID NO: 3699091 - RNA, 21 nt, Salmonella enterica enterica serovar Typhi Ty2
auuuuagaaauagaaauugca

SEQ ID NO: 3699092 - RNA, 18 nt, Salmonella enterica enterica serovar Typhi Ty2
auuuuauuauauuuaaaa

SEQ ID NO: 3699093 - RNA, 12 nt, Salmonella enterica enterica serovar Typhi Ty2
auuuuauuuuua

SEQ ID NO: 3699094 - RNA, 20 nt, Salmonella enterica enterica serovar Typhi Ty2
auuuuauuuuucaaugccau

SEQ ID NO: 3699095 - RNA, 17 nt, Salmonella enterica enterica serovar Typhi Ty2
auuuucaaaaacaaggg

SEQ ID NO: 3699096 - RNA, 22 nt, Salmonella enterica enterica serovar Typhi Ty2
auuuucaacggcaucaauaauu

SEQ ID NO: 3699097 - RNA, 17 nt, Salmonella enterica enterica serovar Typhi Ty2
auuuucaaugcacgcca

SEQ ID NO: 3699098 - RNA, 14 nt, Salmonella enterica enterica serovar Typhi Ty2
auuuucaccuggau

SEQ ID NO: 3699099 - RNA, 21 nt, Salmonella enterica enterica serovar Typhi Ty2
auuuucaccuggaugcugccu

SEQ ID NO: 3699100 - RNA, 22 nt, Salmonella enterica enterica serovar Typhi Ty2
auuuucacgccauugccaggac

SEQ ID NO: 3699101 - RNA, 22 nt, Salmonella enterica enterica serovar Typhi Ty2
auuuucagaggucaggauuuuc

SEQ ID NO: 3699102 - RNA, 14 nt, Salmonella enterica enterica serovar Typhi Ty2
auuuucaguuuuac

SEQ ID NO: 3699103 - RNA, 14 nt, Salmonella enterica enterica serovar Typhi Ty2
auuuucaucauauc

SEQ ID NO: 3699104 - RNA, 16 nt, Salmonella enterica enterica serovar Typhi Ty2
auuuuccaggccgcca

SEQ ID NO: 3699105 - RNA, 22 nt, Salmonella enterica enterica serovar Typhi Ty2
auuuuccaugccuuuauuucaa

SEQ ID NO: 3699106 - RNA, 15 nt, Salmonella enterica enterica serovar Typhi Ty2
auuuuccccagaauc

SEQ ID NO: 3699107 - RNA, 23 nt, Salmonella enterica enterica serovar Typhi Ty2
auuuuccguuaauggaggcagug

SEQ ID NO: 3699108 - RNA, 16 nt, Salmonella enterica enterica serovar Typhi Ty2
auuuuccugaaaaaau

SEQ ID NO: 3699109 - RNA, 20 nt, Salmonella enterica enterica serovar Typhi Ty2
auuuucgcaaacugaucgag

SEQ ID NO: 3699110 - RNA, 17 nt, Salmonella enterica enterica serovar Typhi Ty2
auuuucggcaucagcag

SEQ ID NO: 3699111 - RNA, 14 nt, Salmonella enterica enterica serovar Typhi Ty2
auuuucguaaaaua

SEQ ID NO: 3699112 - RNA, 19 nt, Salmonella enterica enterica serovar Typhi Ty2
auuuucucguguagccagu

SEQ ID NO: 3699113 - RNA, 20 nt, Salmonella enterica enterica serovar Typhi Ty2
auuuucucguguagccagua

SEQ ID NO: 3699114 - RNA, 16 nt, Salmonella enterica enterica serovar Typhi Ty2
auuuucuguaauucuc

SEQ ID NO: 3699115 - RNA, 18 nt, Salmonella enterica enterica serovar Typhi Ty2
auuuucuuucaucaaacg

SEQ ID NO: 3699116 - RNA, 20 nt, Salmonella enterica enterica serovar Typhi Ty2
auuuucuuucaucaaacgga

SEQ ID NO: 3699117 - RNA, 16 nt, Salmonella enterica enterica serovar Typhi Ty2
auuuugauacucauca

SEQ ID NO: 3699118 - RNA, 16 nt, Salmonella enterica enterica serovar Typhi Ty2
auuuugcacuguuuuu

SEQ ID NO: 3699119 - RNA, 12 nt, Salmonella enterica enterica serovar Typhi Ty2
auuuugcgccua

SEQ ID NO: 3699120 - RNA, 17 nt, Salmonella enterica enterica serovar Typhi Ty2
auuuugcgguuuuaauu

SEQ ID NO: 3699121 - RNA, 13 nt, Salmonella enterica enterica serovar Typhi Ty2
auuuugcuuuuuc

SEQ ID NO: 3699122 - RNA, 17 nt, Salmonella enterica enterica serovar Typhi Ty2
auuuuggacgaggaaaa

SEQ ID NO: 3699123 - RNA, 19 nt, Salmonella enterica enterica serovar Typhi Ty2
auuuuggacgaggaaaaau

SEQ ID NO: 3699124 - RNA, 19 nt, Salmonella enterica enterica serovar Typhi Ty2
auuuuggacggcgucacca

SEQ ID NO: 3699125 - RNA, 21 nt, Salmonella enterica enterica serovar Typhi Ty2
auuuuggggaaaauaccggua

SEQ ID NO: 3699126 - RNA, 21 nt, Salmonella enterica enterica serovar Typhi Ty2
auuuuguaguuguuuuaugug

SEQ ID NO: 3699127 - RNA, 18 nt, Salmonella enterica enterica serovar Typhi Ty2
auuuuguugcuccagcau

SEQ ID NO: 3699128 - RNA, 22 nt, Salmonella enterica enterica serovar Typhi Ty2
auuuuguugcuccagcaucaca

SEQ ID NO: 3699129 - RNA, 24 nt, Salmonella enterica enterica serovar Typhi Ty2
auuuuguugcuccagcaucacauc

SEQ ID NO: 3699130 - RNA, 14 nt, Salmonella enterica enterica serovar Typhi Ty2
auuuuuaauugcug

SEQ ID NO: 3699131 - RNA, 15 nt, Salmonella enterica enterica serovar Typhi Ty2
auuuuuacaaauuua

SEQ ID NO: 3699132 - RNA, 19 nt, Salmonella enterica enterica serovar Typhi Ty2
auuuuuaccgcauuauaaa

SEQ ID NO: 3699133 - RNA, 15 nt, Salmonella enterica enterica serovar Typhi Ty2
auuuuuaguaacuua

SEQ ID NO: 3699134 - RNA, 16 nt, Salmonella enterica enterica serovar Typhi Ty2
auuuuuauauuccgca

SEQ ID NO: 3699135 - RNA, 17 nt, Salmonella enterica enterica serovar Typhi Ty2
auuuuuaugucauuuau

SEQ ID NO: 3699136 - RNA, 12 nt, Salmonella enterica enterica serovar Typhi Ty2
auuuuucacaug

SEQ ID NO: 3699137 - RNA, 18 nt, Salmonella enterica enterica serovar Typhi Ty2
auuuuucauggcauagcc

SEQ ID NO: 3699138 - RNA, 17 nt, Salmonella enterica enterica serovar Typhi Ty2
auuuuuccagcucagaa

SEQ ID NO: 3699139 - RNA, 21 nt, Salmonella enterica enterica serovar Typhi Ty2
caaaccccagauuacugcccu

SEQ ID NO: 3699140 - RNA, 15 nt, Salmonella enterica enterica serovar Typhi Ty2
caaaccccggacaca

SEQ ID NO: 3699141 - RNA, 16 nt, Salmonella enterica enterica serovar Typhi Ty2
caaaccgacccaaaaa

SEQ ID NO: 3699142 - RNA, 23 nt, Salmonella enterica enterica serovar Typhi Ty2
caaaccgauagcuaucacacaua

SEQ ID NO: 3699143 - RNA, 17 nt, Salmonella enterica enterica serovar Typhi Ty2
caaaccgcuuucaucau

SEQ ID NO: 3699144 - RNA, 17 nt, Salmonella enterica enterica serovar Typhi Ty2
caaaccggcgaauagcg

SEQ ID NO: 3699145 - RNA, 19 nt, Salmonella enterica enterica serovar Typhi Ty2
caaaccugagcauauaaau

SEQ ID NO: 3699146 - RNA, 15 nt, Salmonella enterica enterica serovar Typhi Ty2
caaaccugccacagg

SEQ ID NO: 3699147 - RNA, 21 nt, Salmonella enterica enterica serovar Typhi Ty2
caaaccugccacaggccaaca

SEQ ID NO: 3699148 - RNA, 14 nt, Salmonella enterica enterica serovar Typhi Ty2
caaaccuuccgcca

SEQ ID NO: 3699149 - RNA, 15 nt, Salmonella enterica enterica serovar Typhi Ty2
caaacgauaaaagcu

SEQ ID NO: 3699150 - RNA, 16 nt, Salmonella enterica enterica serovar Typhi Ty2
caaacgauaaaagcuc

SEQ ID NO: 3699151 - RNA, 13 nt, Salmonella enterica enterica serovar Typhi Ty2
caaacgccaccgc

SEQ ID NO: 3699152 - RNA, 16 nt, Salmonella enterica enterica serovar Typhi Ty2
caaacgccaccgccac

SEQ ID NO: 3699153 - RNA, 11 nt, Salmonella enterica enterica serovar Typhi Ty2
caaacgccagc

SEQ ID NO: 3699154 - RNA, 20 nt, Salmonella enterica enterica serovar Typhi Ty2
caaacgccauagcaucgacc

SEQ ID NO: 3699155 - RNA, 17 nt, Salmonella enterica enterica serovar Typhi Ty2
caaacgccgauggcgcc

SEQ ID NO: 3699156 - RNA, 15 nt, Salmonella enterica enterica serovar Typhi Ty2
caaacgccugcuccg

SEQ ID NO: 3699157 - RNA, 14 nt, Salmonella enterica enterica serovar Typhi Ty2
caaacgcgacaacg

SEQ ID NO: 3699158 - RNA, 14 nt, Salmonella enterica enterica serovar Typhi Ty2
caaacgcgccgcua

SEQ ID NO: 3699159 - RNA, 18 nt, Salmonella enterica enterica serovar Typhi Ty2
caaacggaauagcgccuu

SEQ ID NO: 3699160 - RNA, 16 nt, Salmonella enterica enterica serovar Typhi Ty2
caaacggaucuuccac

SEQ ID NO: 3699161 - RNA, 23 nt, Salmonella enterica enterica serovar Typhi Ty2
caaacggcacuacagcccuuuca

SEQ ID NO: 3699162 - RNA, 19 nt, Salmonella enterica enterica serovar Typhi Ty2
caaacggcagcucuuucaa

SEQ ID NO: 3699163 - RNA, 21 nt, Salmonella enterica enterica serovar Typhi Ty2
caaacggccugcgcuggaacu

SEQ ID NO: 3699164 - RNA, 15 nt, Salmonella enterica enterica serovar Typhi Ty2
caaacggcuggauaa

SEQ ID NO: 3699165 - RNA, 17 nt, Salmonella enterica enterica serovar Typhi Ty2
caaacgucguaaaaccu

SEQ ID NO: 3699166 - RNA, 17 nt, Salmonella enterica enterica serovar Typhi Ty2
caaacgugccuggauaa

SEQ ID NO: 3699167 - RNA, 23 nt, Salmonella enterica enterica serovar Typhi Ty2
caaacuaauggcgcagcgguugc

SEQ ID NO: 3699168 - RNA, 16 nt, Salmonella enterica enterica serovar Typhi Ty2
caaacuauuuuuagcc

SEQ ID NO: 3699169 - RNA, 22 nt, Salmonella enterica enterica serovar Typhi Ty2
caaacucacguuccccagcacc

SEQ ID NO: 3699170 - RNA, 23 nt, Salmonella enterica enterica serovar Typhi Ty2
caaacucacguuccccagcaccg

SEQ ID NO: 3699171 - RNA, 12 nt, Salmonella enterica enterica serovar Typhi Ty2
caaacuccagcu

SEQ ID NO: 3699172 - RNA, 21 nt, Salmonella enterica enterica serovar Typhi Ty2
caaacuccagcucgcaugcau

SEQ ID NO: 3699173 - RNA, 22 nt, Salmonella enterica enterica serovar Typhi Ty2
caaacucgcugccgaccuggcu

SEQ ID NO: 3699174 - RNA, 19 nt, Salmonella enterica enterica serovar Typhi Ty2
caaacucuuuuucaauaaa

SEQ ID NO: 3699175 - RNA, 19 nt, Salmonella enterica enterica serovar Typhi Ty2
caaacugaaaaucaaauaa

SEQ ID NO: 3699176 - RNA, 19 nt, Salmonella enterica enterica serovar Typhi Ty2
caaacugcgcgcccgccuc

SEQ ID NO: 3699177 - RNA, 16 nt, Salmonella enterica enterica serovar Typhi Ty2
caaacugcgcgccgcc

SEQ ID NO: 3699178 - RNA, 22 nt, Salmonella enterica enterica serovar Typhi Ty2
caaacugcgcuagccgccgugu

SEQ ID NO: 3699179 - RNA, 11 nt, Salmonella enterica enterica serovar Typhi Ty2
caaacugcugg

SEQ ID NO: 3699180 - RNA, 18 nt, Salmonella enterica enterica serovar Typhi Ty2
caaacuggcaaauaaaau

SEQ ID NO: 3699181 - RNA, 15 nt, Salmonella enterica enterica serovar Typhi Ty2
caaacuggccacagc

SEQ ID NO: 3699182 - RNA, 16 nt, Salmonella enterica enterica serovar Typhi Ty2
caaacuggccacagca

SEQ ID NO: 3699183 - RNA, 20 nt, Salmonella enterica enterica serovar Typhi Ty2
caaacuuaucucuuuuucuc

SEQ ID NO: 3699184 - RNA, 12 nt, Salmonella enterica enterica serovar Typhi Ty2
caaagaaaacca

SEQ ID NO: 3699185 - RNA, 17 nt, Salmonella enterica enterica serovar Typhi Ty2
caaagaagaauccaggg

SEQ ID NO: 3699186 - RNA, 16 nt, Salmonella enterica enterica serovar Typhi Ty2
caaagacaggugacca

SEQ ID NO: 3699187 - RNA, 13 nt, Salmonella enterica enterica serovar Typhi Ty2
caaagaccaauaa

SEQ ID NO: 3699188 - RNA, 14 nt, Salmonella enterica enterica serovar Typhi Ty2
caaagacgaauaag

SEQ ID NO: 3699189 - RNA, 23 nt, Salmonella enterica enterica serovar Typhi Ty2
caaagacgguuucagugauaaag

SEQ ID NO: 3699190 - RNA, 19 nt, Salmonella enterica enterica serovar Typhi Ty2
caaagagguugcugauuaa

SEQ ID NO: 3699191 - RNA, 17 nt, Salmonella enterica enterica serovar Typhi Ty2
caaagauaaucugaaua

SEQ ID NO: 3699192 - RNA, 15 nt, Salmonella enterica enterica serovar Typhi Ty2
caaagauuagcccca

SEQ ID NO: 3699193 - RNA, 19 nt, Salmonella enterica enterica serovar Typhi Ty2
caaagauuagccccagcgc

SEQ ID NO: 3699194 - RNA, 19 nt, Salmonella enterica enterica serovar Typhi Ty2
caaagcaauaccacgcccg

SEQ ID NO: 3699195 - RNA, 19 nt, Salmonella enterica enterica serovar Typhi Ty2
caaagcaccauucuucaac

SEQ ID NO: 3699196 - RNA, 15 nt, Salmonella enterica enterica serovar Typhi Ty2
caaagcagcugcugg

SEQ ID NO: 3699197 - RNA, 13 nt, Salmonella enterica enterica serovar Typhi Ty2
caaagccaggccg

SEQ ID NO: 3699198 - RNA, 19 nt, Salmonella enterica enterica serovar Typhi Ty2
caaagccaggccgccagca

SEQ ID NO: 3699199 - RNA, 21 nt, Salmonella enterica enterica serovar Typhi Ty2
caaagccaggccgccagcaac

SEQ ID NO: 3699200 - RNA, 16 nt, Salmonella enterica enterica serovar Typhi Ty2
caaagcccacgcccug

SEQ ID NO: 3699201 - RNA, 16 nt, Salmonella enterica enterica serovar Typhi Ty2
caaagcccaucagcgc

SEQ ID NO: 3699202 - RNA, 17 nt, Salmonella enterica enterica serovar Typhi Ty2
caaagcccaucagcgcc

SEQ ID NO: 3699203 - RNA, 15 nt, Salmonella enterica enterica serovar Typhi Ty2
caaagccccagucau

SEQ ID NO: 3699204 - RNA, 19 nt, Salmonella enterica enterica serovar Typhi Ty2
caaagccgccauccggccu

SEQ ID NO: 3699205 - RNA, 17 nt, Salmonella enterica enterica serovar Typhi Ty2
caaagccugcuggaaag

SEQ ID NO: 3699206 - RNA, 16 nt, Salmonella enterica enterica serovar Typhi Ty2
caaagcgagguaaaaa

SEQ ID NO: 3699207 - RNA, 19 nt, Salmonella enterica enterica serovar Typhi Ty2
caaagcgagguaaaaagcg

SEQ ID NO: 3699208 - RNA, 16 nt, Salmonella enterica enterica serovar Typhi Ty2
caaagcgguaaaucgc

SEQ ID NO: 3699209 - RNA, 22 nt, Salmonella enterica enterica serovar Typhi Ty2
caaagcguucugaacuguaacc

SEQ ID NO: 3699210 - RNA, 20 nt, Salmonella enterica enterica serovar Typhi Ty2
caaaggggccacaggcggca

SEQ ID NO: 3699211 - RNA, 24 nt, Salmonella enterica enterica serovar Typhi Ty2
caaagguguuauuucucuugcaga

SEQ ID NO: 3699212 - RNA, 16 nt, Salmonella enterica enterica serovar Typhi Ty2
caaagucuucaugguc

SEQ ID NO: 3699213 - RNA, 15 nt, Salmonella enterica enterica serovar Typhi Ty2
caaagucuuuuguau

SEQ ID NO: 3699214 - RNA, 22 nt, Salmonella enterica enterica serovar Typhi Ty2
caaagucuuuuguauugcgcgu

SEQ ID NO: 3699215 - RNA, 22 nt, Salmonella enterica enterica serovar Typhi Ty2
caaaguggguauauuugccgaa

SEQ ID NO: 3699216 - RNA, 23 nt, Salmonella enterica enterica serovar Typhi Ty2
caaagugguuccaggcgcgcacc

SEQ ID NO: 3699217 - RNA, 14 nt, Salmonella enterica enterica serovar Typhi Ty2
caaaguuaaucagc

SEQ ID NO: 3699218 - RNA, 17 nt, Salmonella enterica enterica serovar Typhi Ty2
caaaguuaaucagcgcc

SEQ ID NO: 3699219 - RNA, 19 nt, Salmonella enterica enterica serovar Typhi Ty2
caaaguuaccggcauuaau

SEQ ID NO: 3699220 - RNA, 21 nt, Salmonella enterica enterica serovar Typhi Ty2
caaauaaauccaugagaagaa

SEQ ID NO: 3699221 - RNA, 13 nt, Salmonella enterica enterica serovar Typhi Ty2
caacauacaugcc

SEQ ID NO: 3699222 - RNA, 23 nt, Salmonella enterica enterica serovar Typhi Ty2
caacauagcggcaaggaaaacca

SEQ ID NO: 3699223 - RNA, 23 nt, Salmonella enterica enterica serovar Typhi Ty2
caacauagcuaaauaaaaauaau

SEQ ID NO: 3699224 - RNA, 16 nt, Salmonella enterica enterica serovar Typhi Ty2
caacauauuugcccug

SEQ ID NO: 3699225 - RNA, 17 nt, Salmonella enterica enterica serovar Typhi Ty2
caacauauuuuucacac

SEQ ID NO: 3699226 - RNA, 19 nt, Salmonella enterica enterica serovar Typhi Ty2
caacaucagcgcuaccagc

SEQ ID NO: 3699227 - RNA, 16 nt, Salmonella enterica enterica serovar Typhi Ty2
caacaucaguucagaa

SEQ ID NO: 3699228 - RNA, 17 nt, Salmonella enterica enterica serovar Typhi Ty2
caacaucaucggaucca

SEQ ID NO: 3699229 - RNA, 13 nt, Salmonella enterica enterica serovar Typhi Ty2
caacaucuuugcc

SEQ ID NO: 3699230 - RNA, 22 nt, Salmonella enterica enterica serovar Typhi Ty2
caacaugccugauggcgcugcg

SEQ ID NO: 3699231 - RNA, 15 nt, Salmonella enterica enterica serovar Typhi Ty2
caacaugcugaccga

SEQ ID NO: 3699232 - RNA, 22 nt, Salmonella enterica enterica serovar Typhi Ty2
caacauggacaccggaagugaa

SEQ ID NO: 3699233 - RNA, 20 nt, Salmonella enterica enterica serovar Typhi Ty2
caacauuaucaaaagugauc

SEQ ID NO: 3699234 - RNA, 18 nt, Salmonella enterica enterica serovar Typhi Ty2
caacauuauuaaaauguc

SEQ ID NO: 3699235 - RNA, 15 nt, Salmonella enterica enterica serovar Typhi Ty2
caacauucugcuucc

SEQ ID NO: 3699236 - RNA, 19 nt, Salmonella enterica enterica serovar Typhi Ty2
caacauugaggcuacccag

SEQ ID NO: 3699237 - RNA, 20 nt, Salmonella enterica enterica serovar Typhi Ty2
caacauugaggcuacccaga

SEQ ID NO: 3699238 - RNA, 14 nt, Salmonella enterica enterica serovar Typhi Ty2
caacauugccggca

SEQ ID NO: 3699239 - RNA, 16 nt, Salmonella enterica enterica serovar Typhi Ty2
caacauugccggcauc

SEQ ID NO: 3699240 - RNA, 23 nt, Salmonella enterica enterica serovar Typhi Ty2
caacauugccggcaucauucugc

SEQ ID NO: 3699241 - RNA, 18 nt, Salmonella enterica enterica serovar Typhi Ty2
caaccaaccaacccaaaa

SEQ ID NO: 3699242 - RNA, 14 nt, Salmonella enterica enterica serovar Typhi Ty2
caaccaaugcaacg

SEQ ID NO: 3699243 - RNA, 13 nt, Salmonella enterica enterica serovar Typhi Ty2
caaccaccaaaaa

SEQ ID NO: 3699244 - RNA, 14 nt, Salmonella enterica enterica serovar Typhi Ty2
caaccaccagcagu

SEQ ID NO: 3699245 - RNA, 23 nt, Salmonella enterica enterica serovar Typhi Ty2
caaccaccggauggaucaucggc

SEQ ID NO: 3699246 - RNA, 16 nt, Salmonella enterica enterica serovar Typhi Ty2
caaccagaauaauggg

SEQ ID NO: 3699247 - RNA, 12 nt, Salmonella enterica enterica serovar Typhi Ty2
caaccagcaaug

SEQ ID NO: 3699248 - RNA, 18 nt, Salmonella enterica enterica serovar Typhi Ty2
caaccagccgaucagcgc

SEQ ID NO: 3699249 - RNA, 16 nt, Salmonella enterica enterica serovar Typhi Ty2
caaccagccgaucauc

SEQ ID NO: 3699250 - RNA, 17 nt, Salmonella enterica enterica serovar Typhi Ty2
caaccagcgaaaugacg

SEQ ID NO: 3699251 - RNA, 23 nt, Salmonella enterica enterica serovar Typhi Ty2
caaccagcgcggccagaaugccc

SEQ ID NO: 3699252 - RNA, 14 nt, Salmonella enterica enterica serovar Typhi Ty2
caaccaggauucaa

SEQ ID NO: 3699253 - RNA, 22 nt, Salmonella enterica enterica serovar Typhi Ty2
caaccaguggcggggcagaacc

SEQ ID NO: 3699254 - RNA, 21 nt, Salmonella enterica enterica serovar Typhi Ty2
caaccaguuaauuucuuucca

SEQ ID NO: 3699255 - RNA, 18 nt, Salmonella enterica enterica serovar Typhi Ty2
caaccaucacugaaccca

SEQ ID NO: 3699256 - RNA, 20 nt, Salmonella enterica enterica serovar Typhi Ty2
caaccaucacugaacccaaa

SEQ ID NO: 3699257 - RNA, 20 nt, Salmonella enterica enterica serovar Typhi Ty2
caaccaugauaaccagcccc

SEQ ID NO: 3699258 - RNA, 22 nt, Salmonella enterica enterica serovar Typhi Ty2
caaccaugauaaccagccccgg

SEQ ID NO: 3699259 - RNA, 23 nt, Salmonella enterica enterica serovar Typhi Ty2
caaccaugauaaccagccccggg

SEQ ID NO: 3699260 - RNA, 14 nt, Salmonella enterica enterica serovar Typhi Ty2
caaccaugaucacc

SEQ ID NO: 3699261 - RNA, 14 nt, Salmonella enterica enterica serovar Typhi Ty2
caacccaaaggcca

SEQ ID NO: 3699262 - RNA, 15 nt, Salmonella enterica enterica serovar Typhi Ty2
caaccccguggugac

SEQ ID NO: 3699263 - RNA, 19 nt, Salmonella enterica enterica serovar Typhi Ty2
caacccguaccuccagcga

SEQ ID NO: 3699264 - RNA, 19 nt, Salmonella enterica enterica serovar Typhi Ty2
caacccuauugccacaaua

SEQ ID NO: 3699265 - RNA, 18 nt, Salmonella enterica enterica serovar Typhi Ty2
caacccuggcgcuuuaaa

SEQ ID NO: 3699266 - RNA, 16 nt, Salmonella enterica enterica serovar Typhi Ty2
caacccuuuggccacc

SEQ ID NO: 3699267 - RNA, 15 nt, Salmonella enterica enterica serovar Typhi Ty2
caaccgcaccggauc

SEQ ID NO: 3699268 - RNA, 14 nt, Salmonella enterica enterica serovar Typhi Ty2
caaccgccacaaua

SEQ ID NO: 3699269 - RNA, 16 nt, Salmonella enterica enterica serovar Typhi Ty2
caaccgccugcguuug

SEQ ID NO: 3699270 - RNA, 14 nt, Salmonella enterica enterica serovar Typhi Ty2
caaccgcgcggcgu

SEQ ID NO: 3699271 - RNA, 14 nt, Salmonella enterica enterica serovar Typhi Ty2
caaccggaugccga

SEQ ID NO: 3699272 - RNA, 21 nt, Salmonella enterica enterica serovar Typhi Ty2
caaccggcuccggguugccug

SEQ ID NO: 3699273 - RNA, 14 nt, Salmonella enterica enterica serovar Typhi Ty2
caaccgggaucuuu

SEQ ID NO: 3699274 - RNA, 17 nt, Salmonella enterica enterica serovar Typhi Ty2
caaccggguaaacgcca

SEQ ID NO: 3699275 - RNA, 19 nt, Salmonella enterica enterica serovar Typhi Ty2
caaccgguaucaaacccuu

SEQ ID NO: 3699276 - RNA, 19 nt, Salmonella enterica enterica serovar Typhi Ty2
caaccguuggggaaaauau

SEQ ID NO: 3699277 - RNA, 17 nt, Salmonella enterica enterica serovar Typhi Ty2
caaccucacuguugaua

SEQ ID NO: 3699278 - RNA, 22 nt, Salmonella enterica enterica serovar Typhi Ty2
caaccuccgcggggaucgguuu

SEQ ID NO: 3699279 - RNA, 18 nt, Salmonella enterica enterica serovar Typhi Ty2
caaccucggcuugcuuca

SEQ ID NO: 3699280 - RNA, 11 nt, Salmonella enterica enterica serovar Typhi Ty2
caaccugauau

SEQ ID NO: 3699281 - RNA, 20 nt, Salmonella enterica enterica serovar Typhi Ty2
caaccugccgaugaaagagc

SEQ ID NO: 3699282 - RNA, 21 nt, Salmonella enterica enterica serovar Typhi Ty2
caaccugccguuuuccagccg

SEQ ID NO: 3699283 - RNA, 12 nt, Salmonella enterica enterica serovar Typhi Ty2
caaccugcgcug

SEQ ID NO: 3699284 - RNA, 15 nt, Salmonella enterica enterica serovar Typhi Ty2
caaccugcgcugacg

SEQ ID NO: 3699285 - RNA, 17 nt, Salmonella enterica enterica serovar Typhi Ty2
caaccugcgcugacggc

SEQ ID NO: 3699286 - RNA, 18 nt, Salmonella enterica enterica serovar Typhi Ty2
caacgaagagaccugugu

SEQ ID NO: 3699287 - RNA, 20 nt, Salmonella enterica enterica serovar Typhi Ty2
caacgaccggcgcagcgccc

SEQ ID NO: 3699288 - RNA, 23 nt, Salmonella enterica enterica serovar Typhi Ty2
caacgaccgucgugccugcggua

SEQ ID NO: 3699289 - RNA, 21 nt, Salmonella enterica enterica serovar Typhi Ty2
caacgacgucuuucuucgcug

SEQ ID NO: 3699290 - RNA, 21 nt, Salmonella enterica enterica serovar Typhi Ty2
caacgaggugaauaaauccuu

SEQ ID NO: 3699291 - RNA, 18 nt, Salmonella enterica enterica serovar Typhi Ty2
caacgcaaacuguauccg

SEQ ID NO: 3699292 - RNA, 22 nt, Salmonella enterica enterica serovar Typhi Ty2
caacgcaaugcgauaagcgucu

SEQ ID NO: 3699293 - RNA, 23 nt, Salmonella enterica enterica serovar Typhi Ty2
caacgcaaugcgauaagcgucuu

SEQ ID NO: 3699294 - RNA, 16 nt, Salmonella enterica enterica serovar Typhi Ty2
caacgcaggcuggaga

SEQ ID NO: 3699295 - RNA, 19 nt, Salmonella enterica enterica serovar Typhi Ty2
caacgcaggcuggagagcg

SEQ ID NO: 3699296 - RNA, 15 nt, Salmonella enterica enterica serovar Typhi Ty2
caacgcauaaaaacg

SEQ ID NO: 3699297 - RNA, 15 nt, Salmonella enterica enterica serovar Typhi Ty2
caacgcauccagcgu

SEQ ID NO: 3699298 - RNA, 12 nt, Salmonella enterica enterica serovar Typhi Ty2
caacgccaagcg

SEQ ID NO: 3699299 - RNA, 15 nt, Salmonella enterica enterica serovar Typhi Ty2
caacgccaagcgcgg

SEQ ID NO: 3699300 - RNA, 19 nt, Salmonella enterica enterica serovar Typhi Ty2
caacgccaucagcaaaaua

SEQ ID NO: 3699301 - RNA, 17 nt, Salmonella enterica enterica serovar Typhi Ty2
caacgccaucagccgcg

SEQ ID NO: 3699302 - RNA, 18 nt, Salmonella enterica enterica serovar Typhi Ty2
caacgccgccgacaugac

SEQ ID NO: 3699303 - RNA, 14 nt, Salmonella enterica enterica serovar Typhi Ty2
caagcaguaugacc

SEQ ID NO: 3699304 - RNA, 15 nt, Salmonella enterica enterica serovar Typhi Ty2
caagcaguuccagca

SEQ ID NO: 3699305 - RNA, 13 nt, Salmonella enterica enterica serovar Typhi Ty2
caagcaguucuga

SEQ ID NO: 3699306 - RNA, 22 nt, Salmonella enterica enterica serovar Typhi Ty2
caagcauaaaaaacaucaugcc

SEQ ID NO: 3699307 - RNA, 16 nt, Salmonella enterica enterica serovar Typhi Ty2
caagccagcauacagc

SEQ ID NO: 3699308 - RNA, 22 nt, Salmonella enterica enterica serovar Typhi Ty2
caagccaggcccgguggcgcca

SEQ ID NO: 3699309 - RNA, 18 nt, Salmonella enterica enterica serovar Typhi Ty2
caagccagguugcgcccg

SEQ ID NO: 3699310 - RNA, 11 nt, Salmonella enterica enterica serovar Typhi Ty2
caagcccagcu

SEQ ID NO: 3699311 - RNA, 14 nt, Salmonella enterica enterica serovar Typhi Ty2
caagcccagcucag

SEQ ID NO: 3699312 - RNA, 21 nt, Salmonella enterica enterica serovar Typhi Ty2
caagccccccgcacagcacau

SEQ ID NO: 3699313 - RNA, 22 nt, Salmonella enterica enterica serovar Typhi Ty2
caagccgaacucuuccaccacg

SEQ ID NO: 3699314 - RNA, 17 nt, Salmonella enterica enterica serovar Typhi Ty2
caagccgaccuuauucc

SEQ ID NO: 3699315 - RNA, 17 nt, Salmonella enterica enterica serovar Typhi Ty2
caagccgccaacgccag

SEQ ID NO: 3699316 - RNA, 20 nt, Salmonella enterica enterica serovar Typhi Ty2
caagccgguaaucgcgcgca

SEQ ID NO: 3699317 - RNA, 23 nt, Salmonella enterica enterica serovar Typhi Ty2
caagcgaagcgccgucggcaucg

SEQ ID NO: 3699318 - RNA, 18 nt, Salmonella enterica enterica serovar Typhi Ty2
caagcgccuguucaacau

SEQ ID NO: 3699319 - RNA, 18 nt, Salmonella enterica enterica serovar Typhi Ty2
caagcgcggacagcagaa

SEQ ID NO: 3699320 - RNA, 21 nt, Salmonella enterica enterica serovar Typhi Ty2
caagcgcggacagcagaauau

SEQ ID NO: 3699321 - RNA, 14 nt, Salmonella enterica enterica serovar Typhi Ty2
caagcgcggcagca

SEQ ID NO: 3699322 - RNA, 20 nt, Salmonella enterica enterica serovar Typhi Ty2
caagcgcggcgaaauaggcc

SEQ ID NO: 3699323 - RNA, 16 nt, Salmonella enterica enterica serovar Typhi Ty2
caagcgcuaagcaaca

SEQ ID NO: 3699324 - RNA, 15 nt, Salmonella enterica enterica serovar Typhi Ty2
caagcgcuucguuga

SEQ ID NO: 3699325 - RNA, 20 nt, Salmonella enterica enterica serovar Typhi Ty2
caagcgguuugaaaauggcg

SEQ ID NO: 3699326 - RNA, 23 nt, Salmonella enterica enterica serovar Typhi Ty2
caagcguaguacguuccagcguu

SEQ ID NO: 3699327 - RNA, 17 nt, Salmonella enterica enterica serovar Typhi Ty2
caagcguuuaauuccau

SEQ ID NO: 3699328 - RNA, 22 nt, Salmonella enterica enterica serovar Typhi Ty2
caagcuaauccccagcgcucca

SEQ ID NO: 3699329 - RNA, 20 nt, Salmonella enterica enterica serovar Typhi Ty2
caagcucaucgggcaacuga

SEQ ID NO: 3699330 - RNA, 13 nt, Salmonella enterica enterica serovar Typhi Ty2
caagcucauuucc

SEQ ID NO: 3699331 - RNA, 15 nt, Salmonella enterica enterica serovar Typhi Ty2
caagcugauuuuucg

SEQ ID NO: 3699332 - RNA, 23 nt, Salmonella enterica enterica serovar Typhi Ty2
caagcugcuggcgagcaggaaaa

SEQ ID NO: 3699333 - RNA, 14 nt, Salmonella enterica enterica serovar Typhi Ty2
caagcuggaauacc

SEQ ID NO: 3699334 - RNA, 20 nt, Salmonella enterica enterica serovar Typhi Ty2
caagcugguaaaugcgccua

SEQ ID NO: 3699335 - RNA, 12 nt, Salmonella enterica enterica serovar Typhi Ty2
caaggaaagaaa

SEQ ID NO: 3699336 - RNA, 12 nt, Salmonella enterica enterica serovar Typhi Ty2
caaggaaggaaa

SEQ ID NO: 3699337 - RNA, 19 nt, Salmonella enterica enterica serovar Typhi Ty2
caaggaaugacacauuucu

SEQ ID NO: 3699338 - RNA, 22 nt, Salmonella enterica enterica serovar Typhi Ty2
caaggauauguauuuguucucg

SEQ ID NO: 3699339 - RNA, 18 nt, Salmonella enterica enterica serovar Typhi Ty2
caaggcaucgucggcgau

SEQ ID NO: 3699340 - RNA, 15 nt, Salmonella enterica enterica serovar Typhi Ty2
caaggcauucaggcc

SEQ ID NO: 3699341 - RNA, 16 nt, Salmonella enterica enterica serovar Typhi Ty2
caaggcgacgcuucac

SEQ ID NO: 3699342 - RNA, 15 nt, Salmonella enterica enterica serovar Typhi Ty2
caaggcgacucaaaa

SEQ ID NO: 3699343 - RNA, 15 nt, Salmonella enterica enterica serovar Typhi Ty2
caaggcgcaaaacca

SEQ ID NO: 3699344 - RNA, 19 nt, Salmonella enterica enterica serovar Typhi Ty2
caaggcuauuagccaaagc

SEQ ID NO: 3699345 - RNA, 17 nt, Salmonella enterica enterica serovar Typhi Ty2
caagggagugagucccc

SEQ ID NO: 3699346 - RNA, 12 nt, Salmonella enterica enterica serovar Typhi Ty2
caagggcuuucu

SEQ ID NO: 3699347 - RNA, 19 nt, Salmonella enterica enterica serovar Typhi Ty2
caagguggaaaaaagauaa

SEQ ID NO: 3699348 - RNA, 22 nt, Salmonella enterica enterica serovar Typhi Ty2
caagguuauuaaaaagccagcg

SEQ ID NO: 3699349 - RNA, 21 nt, Salmonella enterica enterica serovar Typhi Ty2
caagguucgacucgagcaaua

SEQ ID NO: 3699350 - RNA, 15 nt, Salmonella enterica enterica serovar Typhi Ty2
caaguaauaaaauaa

SEQ ID NO: 3699351 - RNA, 14 nt, Salmonella enterica enterica serovar Typhi Ty2
caaguaauaaagag

SEQ ID NO: 3699352 - RNA, 19 nt, Salmonella enterica enterica serovar Typhi Ty2
caaguacgccuuucaccau

SEQ ID NO: 3699353 - RNA, 14 nt, Salmonella enterica enterica serovar Typhi Ty2
caaguaguuguuau

SEQ ID NO: 3699354 - RNA, 23 nt, Salmonella enterica enterica serovar Typhi Ty2
caaguaguuguuauagcgcgccc

SEQ ID NO: 3699355 - RNA, 14 nt, Salmonella enterica enterica serovar Typhi Ty2
caagucaccaucag

SEQ ID NO: 3699356 - RNA, 15 nt, Salmonella enterica enterica serovar Typhi Ty2
caaguccaaguaugu

SEQ ID NO: 3699357 - RNA, 21 nt, Salmonella enterica enterica serovar Typhi Ty2
caaguccgccgcuauuacccc

SEQ ID NO: 3699358 - RNA, 17 nt, Salmonella enterica enterica serovar Typhi Ty2
caaguccuucuuccccc

SEQ ID NO: 3699359 - RNA, 16 nt, Salmonella enterica enterica serovar Typhi Ty2
caaguugcgccacugc

SEQ ID NO: 3699360 - RNA, 14 nt, Salmonella enterica enterica serovar Typhi Ty2
caaguuuagaaaaa

SEQ ID NO: 3699361 - RNA, 16 nt, Salmonella enterica enterica serovar Typhi Ty2
caaguuuagaaaaaau

SEQ ID NO: 3699362 - RNA, 14 nt, Salmonella enterica enterica serovar Typhi Ty2
caaguuuagaaaau

SEQ ID NO: 3699363 - RNA, 12 nt, Salmonella enterica enterica serovar Typhi Ty2
caaguuuaucca

SEQ ID NO: 3699364 - RNA, 21 nt, Salmonella enterica enterica serovar Typhi Ty2
caaguuuggcaaucaaaucca

SEQ ID NO: 3699365 - RNA, 21 nt, Salmonella enterica enterica serovar Typhi Ty2
caauaaaacgcccccugccag

SEQ ID NO: 3699366 - RNA, 14 nt, Salmonella enterica enterica serovar Typhi Ty2
caauaaacagcucc

SEQ ID NO: 3699367 - RNA, 16 nt, Salmonella enterica enterica serovar Typhi Ty2
caauaaacgccagguu

SEQ ID NO: 3699368 - RNA, 20 nt, Salmonella enterica enterica serovar Typhi Ty2
caauaaacucccgcauauau

SEQ ID NO: 3699369 - RNA, 13 nt, Salmonella enterica enterica serovar Typhi Ty2
caauaaagcaggg

SEQ ID NO: 3699370 - RNA, 15 nt, Salmonella enterica enterica serovar Typhi Ty2
caauaaaguuuauuu

SEQ ID NO: 3699371 - RNA, 12 nt, Salmonella enterica enterica serovar Typhi Ty2
caauaaauaaua

SEQ ID NO: 3699372 - RNA, 23 nt, Salmonella enterica enterica serovar Typhi Ty2
caauaaauaauaucguuaagccu

SEQ ID NO: 3699373 - RNA, 19 nt, Salmonella enterica enterica serovar Typhi Ty2
caauaaaucaacauacuga

SEQ ID NO: 3699374 - RNA, 17 nt, Salmonella enterica enterica serovar Typhi Ty2
caauaacagccagcggg

SEQ ID NO: 3699375 - RNA, 20 nt, Salmonella enterica enterica serovar Typhi Ty2
caauaacgaccccaauagcg

SEQ ID NO: 3699376 - RNA, 13 nt, Salmonella enterica enterica serovar Typhi Ty2
caauaagccagac

SEQ ID NO: 3699377 - RNA, 21 nt, Salmonella enterica enterica serovar Typhi Ty2
caauaauauguuccacaauca

SEQ ID NO: 3699378 - RNA, 18 nt, Salmonella enterica enterica serovar Typhi Ty2
caauaaucccuucuuuua

SEQ ID NO: 3699379 - RNA, 18 nt, Salmonella enterica enterica serovar Typhi Ty2
caauaaucgaaauaaagu

SEQ ID NO: 3699380 - RNA, 19 nt, Salmonella enterica enterica serovar Typhi Ty2
caauaauggagaugaaaau

SEQ ID NO: 3699381 - RNA, 22 nt, Salmonella enterica enterica serovar Typhi Ty2
caauaauuuuaccauucagcuu

SEQ ID NO: 3699382 - RNA, 22 nt, Salmonella enterica enterica serovar Typhi Ty2
caauacagcccgccagcaccag

SEQ ID NO: 3699383 - RNA, 18 nt, Salmonella enterica enterica serovar Typhi Ty2
caauaccacaaccggaau

SEQ ID NO: 3699384 - RNA, 14 nt, Salmonella enterica enterica serovar Typhi Ty2
caauaccacgcccg

SEQ ID NO: 3699385 - RNA, 14 nt, Salmonella enterica enterica serovar Typhi Ty2
caaucuccuccggc

SEQ ID NO: 3699386 - RNA, 22 nt, Salmonella enterica enterica serovar Typhi Ty2
caaucucgcaagauuccagaua

SEQ ID NO: 3699387 - RNA, 13 nt, Salmonella enterica enterica serovar Typhi Ty2
caaucucuauacc

SEQ ID NO: 3699388 - RNA, 20 nt, Salmonella enterica enterica serovar Typhi Ty2
caaucucuggccaggcauug

SEQ ID NO: 3699389 - RNA, 15 nt, Salmonella enterica enterica serovar Typhi Ty2
caaucucuuccgccc

SEQ ID NO: 3699390 - RNA, 21 nt, Salmonella enterica enterica serovar Typhi Ty2
caaucugcgucaguaccugau

SEQ ID NO: 3699391 - RNA, 18 nt, Salmonella enterica enterica serovar Typhi Ty2
caaucugguggcguuccu

SEQ ID NO: 3699392 - RNA, 20 nt, Salmonella enterica enterica serovar Typhi Ty2
caaucugguggcguuccuua

SEQ ID NO: 3699393 - RNA, 22 nt, Salmonella enterica enterica serovar Typhi Ty2
caaucugguggcguuccuuauc

SEQ ID NO: 3699394 - RNA, 18 nt, Salmonella enterica enterica serovar Typhi Ty2
caaucuguucguugcugu

SEQ ID NO: 3699395 - RNA, 19 nt, Salmonella enterica enterica serovar Typhi Ty2
caaucuguucguugcugua

SEQ ID NO: 3699396 - RNA, 14 nt, Salmonella enterica enterica serovar Typhi Ty2
caaugaaauaauug

SEQ ID NO: 3699397 - RNA, 19 nt, Salmonella enterica enterica serovar Typhi Ty2
caaugaacagcacguuacc

SEQ ID NO: 3699398 - RNA, 19 nt, Salmonella enterica enterica serovar Typhi Ty2
caaugaacucgccucgcug

SEQ ID NO: 3699399 - RNA, 17 nt, Salmonella enterica enterica serovar Typhi Ty2
caaugaccauuaacgcc

SEQ ID NO: 3699400 - RNA, 20 nt, Salmonella enterica enterica serovar Typhi Ty2
caaugagauccacugagcgc

SEQ ID NO: 3699401 - RNA, 13 nt, Salmonella enterica enterica serovar Typhi Ty2
caaugagcaggcc

SEQ ID NO: 3699402 - RNA, 16 nt, Salmonella enterica enterica serovar Typhi Ty2
caaugaucagacgcac

SEQ ID NO: 3699403 - RNA, 18 nt, Salmonella enterica enterica serovar Typhi Ty2
caaugauucaagcgggug

SEQ ID NO: 3699404 - RNA, 15 nt, Salmonella enterica enterica serovar Typhi Ty2
caaugauuuuuagcc

SEQ ID NO: 3699405 - RNA, 18 nt, Salmonella enterica enterica serovar Typhi Ty2
caaugccaaaaaaacuaa

SEQ ID NO: 3699406 - RNA, 14 nt, Salmonella enterica enterica serovar Typhi Ty2
caaugccaccacac

SEQ ID NO: 3699407 - RNA, 19 nt, Salmonella enterica enterica serovar Typhi Ty2
caaugccaccagcgccaua

SEQ ID NO: 3699408 - RNA, 22 nt, Salmonella enterica enterica serovar Typhi Ty2
caaugccauauuuaccuuuucc

SEQ ID NO: 3699409 - RNA, 13 nt, Salmonella enterica enterica serovar Typhi Ty2
caaugcccaaaau

SEQ ID NO: 3699410 - RNA, 13 nt, Salmonella enterica enterica serovar Typhi Ty2
caaugcccagcgc

SEQ ID NO: 3699411 - RNA, 15 nt, Salmonella enterica enterica serovar Typhi Ty2
caaugcccagcgcaa

SEQ ID NO: 3699412 - RNA, 21 nt, Salmonella enterica enterica serovar Typhi Ty2
caaugcccccaucacuuuacc

SEQ ID NO: 3699413 - RNA, 22 nt, Salmonella enterica enterica serovar Typhi Ty2
caaugcccgguuuuuuaaugag

SEQ ID NO: 3699414 - RNA, 14 nt, Salmonella enterica enterica serovar Typhi Ty2
caaugcccuuaaau

SEQ ID NO: 3699415 - RNA, 15 nt, Salmonella enterica enterica serovar Typhi Ty2
caaugcccuuaaauc

SEQ ID NO: 3699416 - RNA, 22 nt, Salmonella enterica enterica serovar Typhi Ty2
caaugcccuuaaauccggccuc

SEQ ID NO: 3699417 - RNA, 16 nt, Salmonella enterica enterica serovar Typhi Ty2
caaugccgcagcgcgg

SEQ ID NO: 3699418 - RNA, 20 nt, Salmonella enterica enterica serovar Typhi Ty2
caaugccgcgggaaauacca

SEQ ID NO: 3699419 - RNA, 21 nt, Salmonella enterica enterica serovar Typhi Ty2
caaugccgcgggaaauaccaa

SEQ ID NO: 3699420 - RNA, 18 nt, Salmonella enterica enterica serovar Typhi Ty2
caaugccggacgccacca

SEQ ID NO: 3699421 - RNA, 15 nt, Salmonella enterica enterica serovar Typhi Ty2
caaugccgucggcaa

SEQ ID NO: 3699422 - RNA, 19 nt, Salmonella enterica enterica serovar Typhi Ty2
caaugccuaacccuuuucc

SEQ ID NO: 3699423 - RNA, 15 nt, Salmonella enterica enterica serovar Typhi Ty2
caaugcgaauaacau

SEQ ID NO: 3699424 - RNA, 14 nt, Salmonella enterica enterica serovar Typhi Ty2
caaugcgcuuuuuu

SEQ ID NO: 3699425 - RNA, 21 nt, Salmonella enterica enterica serovar Typhi Ty2
caaugcgcuuuuuuugcccuu

SEQ ID NO: 3699426 - RNA, 18 nt, Salmonella enterica enterica serovar Typhi Ty2
caaugcggcaucucgcca

SEQ ID NO: 3699427 - RNA, 15 nt, Salmonella enterica enterica serovar Typhi Ty2
caaugcgguaaccgu

SEQ ID NO: 3699428 - RNA, 14 nt, Salmonella enterica enterica serovar Typhi Ty2
caaugcuggcaggc

SEQ ID NO: 3699429 - RNA, 23 nt, Salmonella enterica enterica serovar Typhi Ty2
caauggauuuauggcacaucagg

SEQ ID NO: 3699430 - RNA, 18 nt, Salmonella enterica enterica serovar Typhi Ty2
caauggccagaugaaacu

SEQ ID NO: 3699431 - RNA, 13 nt, Salmonella enterica enterica serovar Typhi Ty2
caauggcgacgau

SEQ ID NO: 3699432 - RNA, 20 nt, Salmonella enterica enterica serovar Typhi Ty2
caauggcgacgaucagcgcc

SEQ ID NO: 3699433 - RNA, 19 nt, Salmonella enterica enterica serovar Typhi Ty2
caauggcuagggaaacgcu

SEQ ID NO: 3699434 - RNA, 19 nt, Salmonella enterica enterica serovar Typhi Ty2
caauguaaaacugacuaaa

SEQ ID NO: 3699435 - RNA, 22 nt, Salmonella enterica enterica serovar Typhi Ty2
caauguaacaccuguaacguca

SEQ ID NO: 3699436 - RNA, 17 nt, Salmonella enterica enterica serovar Typhi Ty2
caauguacguaaaacca

SEQ ID NO: 3699437 - RNA, 18 nt, Salmonella enterica enterica serovar Typhi Ty2
caauguacguaaaaccag

SEQ ID NO: 3699438 - RNA, 21 nt, Salmonella enterica enterica serovar Typhi Ty2
caauguauuguucaugcaauu

SEQ ID NO: 3699439 - RNA, 22 nt, Salmonella enterica enterica serovar Typhi Ty2
caauguuaaauucagcauuagg

SEQ ID NO: 3699440 - RNA, 18 nt, Salmonella enterica enterica serovar Typhi Ty2
caauguucauacaccgca

SEQ ID NO: 3699441 - RNA, 20 nt, Salmonella enterica enterica serovar Typhi Ty2
caauguuccccugaugcgua

SEQ ID NO: 3699442 - RNA, 21 nt, Salmonella enterica enterica serovar Typhi Ty2
caauguugaaucccacgccgc

SEQ ID NO: 3699443 - RNA, 23 nt, Salmonella enterica enterica serovar Typhi Ty2
caauguugaaucccacgccgcug

SEQ ID NO: 3699444 - RNA, 17 nt, Salmonella enterica enterica serovar Typhi Ty2
caauguugagcaucgcu

SEQ ID NO: 3699445 - RNA, 12 nt, Salmonella enterica enterica serovar Typhi Ty2
caauuaacauuu

SEQ ID NO: 3699446 - RNA, 12 nt, Salmonella enterica enterica serovar Typhi Ty2
caauuacguugg

SEQ ID NO: 3699447 - RNA, 22 nt, Salmonella enterica enterica serovar Typhi Ty2
caauuacguuggggauaaccag

SEQ ID NO: 3699448 - RNA, 17 nt, Salmonella enterica enterica serovar Typhi Ty2
caauuagcgacgcauac

SEQ ID NO: 3699449 - RNA, 18 nt, Salmonella enterica enterica serovar Typhi Ty2
caauuauacgcuggugca

SEQ ID NO: 3699450 - RNA, 21 nt, Salmonella enterica enterica serovar Typhi Ty2
caauuauauugcguaaaaacc

SEQ ID NO: 3699451 - RNA, 22 nt, Salmonella enterica enterica serovar Typhi Ty2
caauuauauugcguaaaaaccc

SEQ ID NO: 3699452 - RNA, 14 nt, Salmonella enterica enterica serovar Typhi Ty2
caauucaaucacuu

SEQ ID NO: 3699453 - RNA, 13 nt, Salmonella enterica enterica serovar Typhi Ty2
caauucagaaagu

SEQ ID NO: 3699454 - RNA, 14 nt, Salmonella enterica enterica serovar Typhi Ty2
caauuccacaggcg

SEQ ID NO: 3699455 - RNA, 14 nt, Salmonella enterica enterica serovar Typhi Ty2
caauuccgccauaa

SEQ ID NO: 3699456 - RNA, 17 nt, Salmonella enterica enterica serovar Typhi Ty2
caauuccuaucaguacg

SEQ ID NO: 3699457 - RNA, 16 nt, Salmonella enterica enterica serovar Typhi Ty2
caauuccugacugcgc

SEQ ID NO: 3699458 - RNA, 16 nt, Salmonella enterica enterica serovar Typhi Ty2
caauucuggaaucaau

SEQ ID NO: 3699459 - RNA, 18 nt, Salmonella enterica enterica serovar Typhi Ty2
caauucuggaaucaauuu

SEQ ID NO: 3699460 - RNA, 22 nt, Salmonella enterica enterica serovar Typhi Ty2
caauucuggaaucaauuucccu

SEQ ID NO: 3699461 - RNA, 20 nt, Salmonella enterica enterica serovar Typhi Ty2
caauucuggcgcacauugcu

SEQ ID NO: 3699462 - RNA, 24 nt, Salmonella enterica enterica serovar Typhi Ty2
caauugaugaaccgcuguagcgua

SEQ ID NO: 3699463 - RNA, 24 nt, Salmonella enterica enterica serovar Typhi Ty2
caauugccacauagcauccagacc

SEQ ID NO: 3699464 - RNA, 23 nt, Salmonella enterica enterica serovar Typhi Ty2
caauugguaauuaaaggcagcgu

SEQ ID NO: 3699465 - RNA, 12 nt, Salmonella enterica enterica serovar Typhi Ty2
caauuuaucugc

SEQ ID NO: 3699466 - RNA, 17 nt, Salmonella enterica enterica serovar Typhi Ty2
caauuuaucugcgugau

SEQ ID NO: 3699467 - RNA, 16 nt, Salmonella enterica enterica serovar Typhi Ty2
caauuucauauuauua

SEQ ID NO: 3699468 - RNA, 20 nt, Salmonella enterica enterica serovar Typhi Ty2
caauuuccccugcgaacagc

SEQ ID NO: 3699469 - RNA, 17 nt, Salmonella enterica enterica serovar Typhi Ty2
caauuucccuucaauca

SEQ ID NO: 3699470 - RNA, 20 nt, Salmonella enterica enterica serovar Typhi Ty2
caauuuccgcugaaauagcc

SEQ ID NO: 3699471 - RNA, 21 nt, Salmonella enterica enterica serovar Typhi Ty2
caauuugguuagggaucaucu

SEQ ID NO: 3699472 - RNA, 16 nt, Salmonella enterica enterica serovar Typhi Ty2
caauuuuaauaacggc

SEQ ID NO: 3699473 - RNA, 15 nt, Salmonella enterica enterica serovar Typhi Ty2
caauuuucaguuuua

SEQ ID NO: 3699474 - RNA, 19 nt, Salmonella enterica enterica serovar Typhi Ty2
caauuuugauaagagaaaa

SEQ ID NO: 3699475 - RNA, 21 nt, Salmonella enterica enterica serovar Typhi Ty2
caauuuuuacaaauuuaaaca

SEQ ID NO: 3699476 - RNA, 20 nt, Salmonella enterica enterica serovar Typhi Ty2
cacaaaaaaaccgcucaacu

SEQ ID NO: 3699477 - RNA, 20 nt, Salmonella enterica enterica serovar Typhi Ty2
cacaaaaacacccgcagccg

SEQ ID NO: 3699478 - RNA, 13 nt, Salmonella enterica enterica serovar Typhi Ty2
cacaaaacaggau

SEQ ID NO: 3699479 - RNA, 16 nt, Salmonella enterica enterica serovar Typhi Ty2
cacaaaacccgcagcc

SEQ ID NO: 3699480 - RNA, 22 nt, Salmonella enterica enterica serovar Typhi Ty2
cacaaaacuauuuuccccuucu

SEQ ID NO: 3699481 - RNA, 16 nt, Salmonella enterica enterica serovar Typhi Ty2
cacaaaauggcugaua

SEQ ID NO: 3699482 - RNA, 14 nt, Salmonella enterica enterica serovar Typhi Ty2
cacaaacaauuucc

SEQ ID NO: 3699483 - RNA, 22 nt, Salmonella enterica enterica serovar Typhi Ty2
cacaaacgccgucacaaagccc

SEQ ID NO: 3699484 - RNA, 18 nt, Salmonella enterica enterica serovar Typhi Ty2
cacaaacggcaucgauau

SEQ ID NO: 3699485 - RNA, 21 nt, Salmonella enterica enterica serovar Typhi Ty2
cacaaacuccagacgaugaua

SEQ ID NO: 3699486 - RNA, 15 nt, Salmonella enterica enterica serovar Typhi Ty2
cacaaacuggaccca

SEQ ID NO: 3699487 - RNA, 16 nt, Salmonella enterica enterica serovar Typhi Ty2
cacaaacuggacccac

SEQ ID NO: 3699488 - RNA, 17 nt, Salmonella enterica enterica serovar Typhi Ty2
cacaaagacgaauaagg

SEQ ID NO: 3699489 - RNA, 18 nt, Salmonella enterica enterica serovar Typhi Ty2
cacaaaucuguuaucugg

SEQ ID NO: 3699490 - RNA, 22 nt, Salmonella enterica enterica serovar Typhi Ty2
cacaaaucuguuaucuggaugu

SEQ ID NO: 3699491 - RNA, 20 nt, Salmonella enterica enterica serovar Typhi Ty2
cacaaauuuugauaaaaaca

SEQ ID NO: 3699492 - RNA, 17 nt, Salmonella enterica enterica serovar Typhi Ty2
cacaacagaagcggccu

SEQ ID NO: 3699493 - RNA, 12 nt, Salmonella enterica enterica serovar Typhi Ty2
cacaacccaaag

SEQ ID NO: 3699494 - RNA, 13 nt, Salmonella enterica enterica serovar Typhi Ty2
cacaaccuccacg

SEQ ID NO: 3699495 - RNA, 19 nt, Salmonella enterica enterica serovar Typhi Ty2
cacaaccuccacgcccagc

SEQ ID NO: 3699496 - RNA, 14 nt, Salmonella enterica enterica serovar Typhi Ty2
cacaacgcauuggc

SEQ ID NO: 3699497 - RNA, 16 nt, Salmonella enterica enterica serovar Typhi Ty2
cacaacgcgaguauuc

SEQ ID NO: 3699498 - RNA, 16 nt, Salmonella enterica enterica serovar Typhi Ty2
cacaacguaaucauca

SEQ ID NO: 3699499 - RNA, 14 nt, Salmonella enterica enterica serovar Typhi Ty2
cacaacgucauccc

SEQ ID NO: 3699500 - RNA, 22 nt, Salmonella enterica enterica serovar Typhi Ty2
cacaacgugccagaaacaagaa

SEQ ID NO: 3699501 - RNA, 18 nt, Salmonella enterica enterica serovar Typhi Ty2
cacaacuguagcaggaua

SEQ ID NO: 3699502 - RNA, 13 nt, Salmonella enterica enterica serovar Typhi Ty2
cacaacuguucuu

SEQ ID NO: 3699503 - RNA, 17 nt, Salmonella enterica enterica serovar Typhi Ty2
cacaagccccacgcccg

SEQ ID NO: 3699504 - RNA, 20 nt, Salmonella enterica enterica serovar Typhi Ty2
cacaagccccacgcccgcca

SEQ ID NO: 3699505 - RNA, 17 nt, Salmonella enterica enterica serovar Typhi Ty2
cacaagcuguuucuccg

SEQ ID NO: 3699506 - RNA, 16 nt, Salmonella enterica enterica serovar Typhi Ty2
cacaaguuuauccagc

SEQ ID NO: 3699507 - RNA, 17 nt, Salmonella enterica enterica serovar Typhi Ty2
cacaaguuuauccagca

SEQ ID NO: 3699508 - RNA, 14 nt, Salmonella enterica enterica serovar Typhi Ty2
cacaauauccgccc

SEQ ID NO: 3699509 - RNA, 20 nt, Salmonella enterica enterica serovar Typhi Ty2
cacaaucaaauggcuggcgc

SEQ ID NO: 3699510 - RNA, 13 nt, Salmonella enterica enterica serovar Typhi Ty2
cacaaucacagcg

SEQ ID NO: 3699511 - RNA, 16 nt, Salmonella enterica enterica serovar Typhi Ty2
cacaaucccgccagac

SEQ ID NO: 3699512 - RNA, 21 nt, Salmonella enterica enterica serovar Typhi Ty2
cacaaucccgccagacccgca

SEQ ID NO: 3699513 - RNA, 20 nt, Salmonella enterica enterica serovar Typhi Ty2
cacaaucgccgugaucccaa

SEQ ID NO: 3699514 - RNA, 19 nt, Salmonella enterica enterica serovar Typhi Ty2
cacaaucgucgugccuucc

SEQ ID NO: 3699515 - RNA, 19 nt, Salmonella enterica enterica serovar Typhi Ty2
cacaaucuccagaccgcug

SEQ ID NO: 3699516 - RNA, 22 nt, Salmonella enterica enterica serovar Typhi Ty2
cacaaugcgacuuaucagaacu

SEQ ID NO: 3699517 - RNA, 19 nt, Salmonella enterica enterica serovar Typhi Ty2
cacacaaucgguuaugcga

SEQ ID NO: 3699518 - RNA, 13 nt, Salmonella enterica enterica serovar Typhi Ty2
cacacacuguuua

SEQ ID NO: 3699519 - RNA, 20 nt, Salmonella enterica enterica serovar Typhi Ty2
cacacagcagaaagcaacag

SEQ ID NO: 3699520 - RNA, 18 nt, Salmonella enterica enterica serovar Typhi Ty2
cacacaggaguucaucau

SEQ ID NO: 3699521 - RNA, 18 nt, Salmonella enterica enterica serovar Typhi Ty2
cacacauaagcacaccau

SEQ ID NO: 3699522 - RNA, 19 nt, Salmonella enterica enterica serovar Typhi Ty2
cacacauaucgccagccau

SEQ ID NO: 3699523 - RNA, 14 nt, Salmonella enterica enterica serovar Typhi Ty2
cacacaucacaauc

SEQ ID NO: 3699524 - RNA, 13 nt, Salmonella enterica enterica serovar Typhi Ty2
cacacaugcaaaa

SEQ ID NO: 3699525 - RNA, 15 nt, Salmonella enterica enterica serovar Typhi Ty2
cacaccaacgcuggc

SEQ ID NO: 3699526 - RNA, 18 nt, Salmonella enterica enterica serovar Typhi Ty2
cacaccacaugcgagcag

SEQ ID NO: 3699527 - RNA, 15 nt, Salmonella enterica enterica serovar Typhi Ty2
cacaccauuucacaa

SEQ ID NO: 3699528 - RNA, 18 nt, Salmonella enterica enterica serovar Typhi Ty2
cacaccauuucacaaauu

SEQ ID NO: 3699529 - RNA, 14 nt, Salmonella enterica enterica serovar Typhi Ty2
cacacccauagcag

SEQ ID NO: 3699530 - RNA, 17 nt, Salmonella enterica enterica serovar Typhi Ty2
cacacccgcacgccugg

SEQ ID NO: 3699531 - RNA, 21 nt, Salmonella enterica enterica serovar Typhi Ty2
cacaccggguucguaauaagg

SEQ ID NO: 3699532 - RNA, 21 nt, Salmonella enterica enterica serovar Typhi Ty2
cacaccguuacgaccccauua

SEQ ID NO: 3699533 - RNA, 18 nt, Salmonella enterica enterica serovar Typhi Ty2
cacacgccaaaaucgccc

SEQ ID NO: 3699534 - RNA, 19 nt, Salmonella enterica enterica serovar Typhi Ty2
cacacgucugagcaggcgg

SEQ ID NO: 3699535 - RNA, 22 nt, Salmonella enterica enterica serovar Typhi Ty2
cacacucggugcauuugucgcu

SEQ ID NO: 3699536 - RNA, 14 nt, Salmonella enterica enterica serovar Typhi Ty2
cacacugcaucgaa

SEQ ID NO: 3699537 - RNA, 14 nt, Salmonella enterica enterica serovar Typhi Ty2
cacacugcgccgcc

SEQ ID NO: 3699538 - RNA, 22 nt, Salmonella enterica enterica serovar Typhi Ty2
cacacuguuuaaugcuuucaau

SEQ ID NO: 3699539 - RNA, 15 nt, Salmonella enterica enterica serovar Typhi Ty2
cacacuuucugcuuu

SEQ ID NO: 3699540 - RNA, 13 nt, Salmonella enterica enterica serovar Typhi Ty2
cacagaagcgccu

SEQ ID NO: 3699541 - RNA, 16 nt, Salmonella enterica enterica serovar Typhi Ty2
cacagacagaugcagg

SEQ ID NO: 3699542 - RNA, 19 nt, Salmonella enterica enterica serovar Typhi Ty2
cacagaucgaaugaaaaug

SEQ ID NO: 3699543 - RNA, 22 nt, Salmonella enterica enterica serovar Typhi Ty2
cacagauuaugcaguucuucgc

SEQ ID NO: 3699544 - RNA, 16 nt, Salmonella enterica enterica serovar Typhi Ty2
cacagcacaauaccuu

SEQ ID NO: 3699545 - RNA, 14 nt, Salmonella enterica enterica serovar Typhi Ty2
cacagcagaaagca

SEQ ID NO: 3699546 - RNA, 22 nt, Salmonella enterica enterica serovar Typhi Ty2
cacagcaugaauaaccucccgc

SEQ ID NO: 3699547 - RNA, 14 nt, Salmonella enterica enterica serovar Typhi Ty2
cacagccccagcac

SEQ ID NO: 3699548 - RNA, 16 nt, Salmonella enterica enterica serovar Typhi Ty2
cacagccccagcacca

SEQ ID NO: 3699549 - RNA, 16 nt, Salmonella enterica enterica serovar Typhi Ty2
caccacgguguacccc

SEQ ID NO: 3699550 - RNA, 18 nt, Salmonella enterica enterica serovar Typhi Ty2
caccacgguguaccccgc

SEQ ID NO: 3699551 - RNA, 22 nt, Salmonella enterica enterica serovar Typhi Ty2
caccacguaacucggcagcgcg

SEQ ID NO: 3699552 - RNA, 19 nt, Salmonella enterica enterica serovar Typhi Ty2
caccacguaaugcgccccg

SEQ ID NO: 3699553 - RNA, 21 nt, Salmonella enterica enterica serovar Typhi Ty2
caccacguaaugcgccccggc

SEQ ID NO: 3699554 - RNA, 16 nt, Salmonella enterica enterica serovar Typhi Ty2
caccacgucauccucc

SEQ ID NO: 3699555 - RNA, 19 nt, Salmonella enterica enterica serovar Typhi Ty2
caccacuggcagcgccuga

SEQ ID NO: 3699556 - RNA, 23 nt, Salmonella enterica enterica serovar Typhi Ty2
caccacuggcagcgccugacggc

SEQ ID NO: 3699557 - RNA, 18 nt, Salmonella enterica enterica serovar Typhi Ty2
caccagaacucccuguuc

SEQ ID NO: 3699558 - RNA, 21 nt, Salmonella enterica enterica serovar Typhi Ty2
caccagaacucccuguuccug

SEQ ID NO: 3699559 - RNA, 19 nt, Salmonella enterica enterica serovar Typhi Ty2
caccagaaucgccagcauc

SEQ ID NO: 3699560 - RNA, 20 nt, Salmonella enterica enterica serovar Typhi Ty2
caccagaaucgccagcaucg

SEQ ID NO: 3699561 - RNA, 21 nt, Salmonella enterica enterica serovar Typhi Ty2
caccagaccgacaagcccccc

SEQ ID NO: 3699562 - RNA, 12 nt, Salmonella enterica enterica serovar Typhi Ty2
caccagacgcug

SEQ ID NO: 3699563 - RNA, 21 nt, Salmonella enterica enterica serovar Typhi Ty2
caccagacgcuggcacuggca

SEQ ID NO: 3699564 - RNA, 20 nt, Salmonella enterica enterica serovar Typhi Ty2
caccagacuaaaacgugcug

SEQ ID NO: 3699565 - RNA, 23 nt, Salmonella enterica enterica serovar Typhi Ty2
caccagcaacguaaucccgccag

SEQ ID NO: 3699566 - RNA, 13 nt, Salmonella enterica enterica serovar Typhi Ty2
caccagcacagcc

SEQ ID NO: 3699567 - RNA, 14 nt, Salmonella enterica enterica serovar Typhi Ty2
caccagcacagccc

SEQ ID NO: 3699568 - RNA, 16 nt, Salmonella enterica enterica serovar Typhi Ty2
caccagcacagcccag

SEQ ID NO: 3699569 - RNA, 17 nt, Salmonella enterica enterica serovar Typhi Ty2
caccagccaggccgcca

SEQ ID NO: 3699570 - RNA, 12 nt, Salmonella enterica enterica serovar Typhi Ty2
caccagcccauc

SEQ ID NO: 3699571 - RNA, 21 nt, Salmonella enterica enterica serovar Typhi Ty2
caccagcccaucuuucgccag

SEQ ID NO: 3699572 - RNA, 14 nt, Salmonella enterica enterica serovar Typhi Ty2
caccagccguucac

SEQ ID NO: 3699573 - RNA, 20 nt, Salmonella enterica enterica serovar Typhi Ty2
caccagccguucaccagcca

SEQ ID NO: 3699574 - RNA, 24 nt, Salmonella enterica enterica serovar Typhi Ty2
caccagcgauuacgccagacagca

SEQ ID NO: 3699575 - RNA, 11 nt, Salmonella enterica enterica serovar Typhi Ty2
caccagcgcca

SEQ ID NO: 3699576 - RNA, 12 nt, Salmonella enterica enterica serovar Typhi Ty2
caccagcgccag

SEQ ID NO: 3699577 - RNA, 13 nt, Salmonella enterica enterica serovar Typhi Ty2
caccagcgccaga

SEQ ID NO: 3699578 - RNA, 11 nt, Salmonella enterica enterica serovar Typhi Ty2
caccagcgccg

SEQ ID NO: 3699579 - RNA, 17 nt, Salmonella enterica enterica serovar Typhi Ty2
caccagcgccugcgcug

SEQ ID NO: 3699580 - RNA, 17 nt, Salmonella enterica enterica serovar Typhi Ty2
caccagcgcgccgccgc

SEQ ID NO: 3699581 - RNA, 19 nt, Salmonella enterica enterica serovar Typhi Ty2
caccagcgcgccgccgccc

SEQ ID NO: 3699582 - RNA, 15 nt, Salmonella enterica enterica serovar Typhi Ty2
caccagcgucgcaug

SEQ ID NO: 3699583 - RNA, 16 nt, Salmonella enterica enterica serovar Typhi Ty2
caccagcgucgcaugg

SEQ ID NO: 3699584 - RNA, 20 nt, Salmonella enterica enterica serovar Typhi Ty2
caccagcuuaucgggaugau

SEQ ID NO: 3699585 - RNA, 15 nt, Salmonella enterica enterica serovar Typhi Ty2
caccagcuuaucuga

SEQ ID NO: 3699586 - RNA, 20 nt, Salmonella enterica enterica serovar Typhi Ty2
caccaggaagacuauccagc

SEQ ID NO: 3699587 - RNA, 23 nt, Salmonella enterica enterica serovar Typhi Ty2
caccaggauacguucauccuccu

SEQ ID NO: 3699588 - RNA, 21 nt, Salmonella enterica enterica serovar Typhi Ty2
caccaguaaccgccacagcau

SEQ ID NO: 3699589 - RNA, 19 nt, Salmonella enterica enterica serovar Typhi Ty2
caccaguagcgcgacgcca

SEQ ID NO: 3699590 - RNA, 15 nt, Salmonella enterica enterica serovar Typhi Ty2
caccagucccagccc

SEQ ID NO: 3699591 - RNA, 18 nt, Salmonella enterica enterica serovar Typhi Ty2
caccagucgaccgcagac

SEQ ID NO: 3699592 - RNA, 20 nt, Salmonella enterica enterica serovar Typhi Ty2
caccagugauuggcuggaca

SEQ ID NO: 3699593 - RNA, 21 nt, Salmonella enterica enterica serovar Typhi Ty2
caccaguucacuccuaagaga

SEQ ID NO: 3699594 - RNA, 16 nt, Salmonella enterica enterica serovar Typhi Ty2
caccaguucauauuug

SEQ ID NO: 3699595 - RNA, 15 nt, Salmonella enterica enterica serovar Typhi Ty2
caccauaaaaccauu

SEQ ID NO: 3699596 - RNA, 20 nt, Salmonella enterica enterica serovar Typhi Ty2
caccauaaagcgaauaauua

SEQ ID NO: 3699597 - RNA, 16 nt, Salmonella enterica enterica serovar Typhi Ty2
caccauaaaucauuac

SEQ ID NO: 3699598 - RNA, 20 nt, Salmonella enterica enterica serovar Typhi Ty2
caccauaauuaccggcacac

SEQ ID NO: 3699599 - RNA, 18 nt, Salmonella enterica enterica serovar Typhi Ty2
caccauaccuauaaaaau

SEQ ID NO: 3699600 - RNA, 17 nt, Salmonella enterica enterica serovar Typhi Ty2
caccauaucgcagacca

SEQ ID NO: 3699601 - RNA, 14 nt, Salmonella enterica enterica serovar Typhi Ty2
caccauaucuucca

SEQ ID NO: 3699602 - RNA, 14 nt, Salmonella enterica enterica serovar Typhi Ty2
caccauaucuuuca

SEQ ID NO: 3699603 - RNA, 17 nt, Salmonella enterica enterica serovar Typhi Ty2
caccauauucgccaccg

SEQ ID NO: 3699604 - RNA, 23 nt, Salmonella enterica enterica serovar Typhi Ty2
caccaucacuaccauuuccggcg

SEQ ID NO: 3699605 - RNA, 13 nt, Salmonella enterica enterica serovar Typhi Ty2
caccaucccgcuc

SEQ ID NO: 3699606 - RNA, 17 nt, Salmonella enterica enterica serovar Typhi Ty2
caccauccggcgcugcg

SEQ ID NO: 3699607 - RNA, 23 nt, Salmonella enterica enterica serovar Typhi Ty2
caccauccggcgcugcgcggcgu

SEQ ID NO: 3699608 - RNA, 14 nt, Salmonella enterica enterica serovar Typhi Ty2
caccaucgccggag

SEQ ID NO: 3699609 - RNA, 19 nt, Salmonella enterica enterica serovar Typhi Ty2
caccaucgucgccagaccc

SEQ ID NO: 3699610 - RNA, 21 nt, Salmonella enterica enterica serovar Typhi Ty2
caccaucgucgccagacccag

SEQ ID NO: 3699611 - RNA, 16 nt, Salmonella enterica enterica serovar Typhi Ty2
caccaucuuuuccggc

SEQ ID NO: 3699612 - RNA, 13 nt, Salmonella enterica enterica serovar Typhi Ty2
caccaucuuuuug

SEQ ID NO: 3699613 - RNA, 13 nt, Salmonella enterica enterica serovar Typhi Ty2
caccaucuuuuuu

SEQ ID NO: 3699614 - RNA, 18 nt, Salmonella enterica enterica serovar Typhi Ty2
caccauguggcgcggccu

SEQ ID NO: 3699615 - RNA, 18 nt, Salmonella enterica enterica serovar Typhi Ty2
caccauguugaccagguc

SEQ ID NO: 3699616 - RNA, 15 nt, Salmonella enterica enterica serovar Typhi Ty2
caccauguugcgcag

SEQ ID NO: 3699617 - RNA, 18 nt, Salmonella enterica enterica serovar Typhi Ty2
caccauuaucgcuccgga

SEQ ID NO: 3699618 - RNA, 13 nt, Salmonella enterica enterica serovar Typhi Ty2
caccauucccagc

SEQ ID NO: 3699619 - RNA, 14 nt, Salmonella enterica enterica serovar Typhi Ty2
caccauucuucaac

SEQ ID NO: 3699620 - RNA, 14 nt, Salmonella enterica enterica serovar Typhi Ty2
caccauuucacaaa

SEQ ID NO: 3699621 - RNA, 19 nt, Salmonella enterica enterica serovar Typhi Ty2
caccauuucacaaauuaaa

SEQ ID NO: 3699622 - RNA, 14 nt, Salmonella enterica enterica serovar Typhi Ty2
cacccacaggagcc

SEQ ID NO: 3699623 - RNA, 16 nt, Salmonella enterica enterica serovar Typhi Ty2
cacccagugccaccag

SEQ ID NO: 3699624 - RNA, 16 nt, Salmonella enterica enterica serovar Typhi Ty2
cacccauugaacccga

SEQ ID NO: 3699625 - RNA, 22 nt, Salmonella enterica enterica serovar Typhi Ty2
cacccauugaacccgaccgucu

SEQ ID NO: 3699626 - RNA, 21 nt, Salmonella enterica enterica serovar Typhi Ty2
cacccauuuuauccucuucaa

SEQ ID NO: 3699627 - RNA, 14 nt, Salmonella enterica enterica serovar Typhi Ty2
caccccaacaaaua

SEQ ID NO: 3699628 - RNA, 14 nt, Salmonella enterica enterica serovar Typhi Ty2
cacccccaucgccc

SEQ ID NO: 3699629 - RNA, 15 nt, Salmonella enterica enterica serovar Typhi Ty2
caccccuugcgcguu

SEQ ID NO: 3699630 - RNA, 20 nt, Salmonella enterica enterica serovar Typhi Ty2
cacccgaacaacaauacgcg

SEQ ID NO: 3699631 - RNA, 20 nt, Salmonella enterica enterica serovar Typhi Ty2
caccugaauaacccgcagcc

SEQ ID NO: 3699632 - RNA, 15 nt, Salmonella enterica enterica serovar Typhi Ty2
caccugaaugcaaag

SEQ ID NO: 3699633 - RNA, 15 nt, Salmonella enterica enterica serovar Typhi Ty2
caccugacggcagcc

SEQ ID NO: 3699634 - RNA, 14 nt, Salmonella enterica enterica serovar Typhi Ty2
caccugaucgccaa

SEQ ID NO: 3699635 - RNA, 21 nt, Salmonella enterica enterica serovar Typhi Ty2
caccugaucgugccaugacca

SEQ ID NO: 3699636 - RNA, 13 nt, Salmonella enterica enterica serovar Typhi Ty2
caccugauucugc

SEQ ID NO: 3699637 - RNA, 16 nt, Salmonella enterica enterica serovar Typhi Ty2
caccugcaacuccugg

SEQ ID NO: 3699638 - RNA, 18 nt, Salmonella enterica enterica serovar Typhi Ty2
caccugccaguccgcccg

SEQ ID NO: 3699639 - RNA, 23 nt, Salmonella enterica enterica serovar Typhi Ty2
caccugcccuuucagagcgucuu

SEQ ID NO: 3699640 - RNA, 19 nt, Salmonella enterica enterica serovar Typhi Ty2
caccugcuggucaccuggc

SEQ ID NO: 3699641 - RNA, 17 nt, Salmonella enterica enterica serovar Typhi Ty2
caccuggaugcugccug

SEQ ID NO: 3699642 - RNA, 18 nt, Salmonella enterica enterica serovar Typhi Ty2
caccuggaugcugccugc

SEQ ID NO: 3699643 - RNA, 21 nt, Salmonella enterica enterica serovar Typhi Ty2
caccuggucuauucguucucu

SEQ ID NO: 3699644 - RNA, 23 nt, Salmonella enterica enterica serovar Typhi Ty2
caccuggucuauucguucucuga

SEQ ID NO: 3699645 - RNA, 17 nt, Salmonella enterica enterica serovar Typhi Ty2
caccuguaaccgcuauc

SEQ ID NO: 3699646 - RNA, 14 nt, Salmonella enterica enterica serovar Typhi Ty2
caccuuaaccgucu

SEQ ID NO: 3699647 - RNA, 22 nt, Salmonella enterica enterica serovar Typhi Ty2
caccuucggucccaucgcgcca

SEQ ID NO: 3699648 - RNA, 23 nt, Salmonella enterica enterica serovar Typhi Ty2
caccuuuacuuaauucugcugcc

SEQ ID NO: 3699649 - RNA, 22 nt, Salmonella enterica enterica serovar Typhi Ty2
caccuuugaacgucgcugauag

SEQ ID NO: 3699650 - RNA, 17 nt, Salmonella enterica enterica serovar Typhi Ty2
cacgaaaaauaaaaaaa

SEQ ID NO: 3699651 - RNA, 21 nt, Salmonella enterica enterica serovar Typhi Ty2
cacgaaauaacgcacuaccag

SEQ ID NO: 3699652 - RNA, 21 nt, Salmonella enterica enterica serovar Typhi Ty2
cacgaauaagaaucagaugcu

SEQ ID NO: 3699653 - RNA, 18 nt, Salmonella enterica enterica serovar Typhi Ty2
cacgaaugucgcgucagg

SEQ ID NO: 3699654 - RNA, 13 nt, Salmonella enterica enterica serovar Typhi Ty2
cacgacacaaaag

SEQ ID NO: 3699655 - RNA, 15 nt, Salmonella enterica enterica serovar Typhi Ty2
cacgacagugcuaua

SEQ ID NO: 3699656 - RNA, 19 nt, Salmonella enterica enterica serovar Typhi Ty2
cacgacgcucauuaacgac

SEQ ID NO: 3699657 - RNA, 15 nt, Salmonella enterica enterica serovar Typhi Ty2
cacgacuuucaccag

SEQ ID NO: 3699658 - RNA, 16 nt, Salmonella enterica enterica serovar Typhi Ty2
cacgaggccacgcagc

SEQ ID NO: 3699659 - RNA, 13 nt, Salmonella enterica enterica serovar Typhi Ty2
cacgagugauccc

SEQ ID NO: 3699660 - RNA, 18 nt, Salmonella enterica enterica serovar Typhi Ty2
cacgauaaauugccugau

SEQ ID NO: 3699661 - RNA, 20 nt, Salmonella enterica enterica serovar Typhi Ty2
cacgauacuguugcaguuua

SEQ ID NO: 3699662 - RNA, 17 nt, Salmonella enterica enterica serovar Typhi Ty2
cacgauagacagcacca

SEQ ID NO: 3699663 - RNA, 24 nt, Salmonella enterica enterica serovar Typhi Ty2
cacgauagacagcaccaucaugca

SEQ ID NO: 3699664 - RNA, 16 nt, Salmonella enterica enterica serovar Typhi Ty2
cacgaucgaugcccug

SEQ ID NO: 3699665 - RNA, 20 nt, Salmonella enterica enterica serovar Typhi Ty2
cacgaucuugucacaauaac

SEQ ID NO: 3699666 - RNA, 15 nt, Salmonella enterica enterica serovar Typhi Ty2
cacgaugcauaugca

SEQ ID NO: 3699667 - RNA, 22 nt, Salmonella enterica enterica serovar Typhi Ty2
cacgauggcgauuuucaccggc

SEQ ID NO: 3699668 - RNA, 19 nt, Salmonella enterica enterica serovar Typhi Ty2
cacgauguucaacgucagc

SEQ ID NO: 3699669 - RNA, 16 nt, Salmonella enterica enterica serovar Typhi Ty2
cacgcaaaauggccug

SEQ ID NO: 3699670 - RNA, 15 nt, Salmonella enterica enterica serovar Typhi Ty2
cacgcaaaugcagcg

SEQ ID NO: 3699671 - RNA, 14 nt, Salmonella enterica enterica serovar Typhi Ty2
cacgcaacaggccg

SEQ ID NO: 3699672 - RNA, 22 nt, Salmonella enterica enterica serovar Typhi Ty2
cacgcaaugccugaccaacguc

SEQ ID NO: 3699673 - RNA, 22 nt, Salmonella enterica enterica serovar Typhi Ty2
cacgcaaugcguccgucggcga

SEQ ID NO: 3699674 - RNA, 19 nt, Salmonella enterica enterica serovar Typhi Ty2
cacgcacgacagugcuaua

SEQ ID NO: 3699675 - RNA, 15 nt, Salmonella enterica enterica serovar Typhi Ty2
cacgcagacccaggc

SEQ ID NO: 3699676 - RNA, 12 nt, Salmonella enterica enterica serovar Typhi Ty2
cacgcagacgcc

SEQ ID NO: 3699677 - RNA, 24 nt, Salmonella enterica enterica serovar Typhi Ty2
cacgcagacgccgcgguugacggc

SEQ ID NO: 3699678 - RNA, 24 nt, Salmonella enterica enterica serovar Typhi Ty2
cacgcagcgcagaccgagcgcaug

SEQ ID NO: 3699679 - RNA, 19 nt, Salmonella enterica enterica serovar Typhi Ty2
cacgcagggggucgcgggu

SEQ ID NO: 3699680 - RNA, 15 nt, Salmonella enterica enterica serovar Typhi Ty2
cacgcaguccaacaa

SEQ ID NO: 3699681 - RNA, 17 nt, Salmonella enterica enterica serovar Typhi Ty2
cacgcagugcgaugcga

SEQ ID NO: 3699682 - RNA, 21 nt, Salmonella enterica enterica serovar Typhi Ty2
cacgcauaaaaaaggcucgca

SEQ ID NO: 3699683 - RNA, 21 nt, Salmonella enterica enterica serovar Typhi Ty2
cacgcaucgggucgcgcgccg

SEQ ID NO: 3699684 - RNA, 18 nt, Salmonella enterica enterica serovar Typhi Ty2
cacgcauugccacagccu

SEQ ID NO: 3699685 - RNA, 17 nt, Salmonella enterica enterica serovar Typhi Ty2
cacgccaaaaagugaau

SEQ ID NO: 3699686 - RNA, 21 nt, Salmonella enterica enterica serovar Typhi Ty2
cacgccacaguauuccggcau

SEQ ID NO: 3699687 - RNA, 14 nt, Salmonella enterica enterica serovar Typhi Ty2
cacgccacauugac

SEQ ID NO: 3699688 - RNA, 11 nt, Salmonella enterica enterica serovar Typhi Ty2
cacgccaccgg

SEQ ID NO: 3699689 - RNA, 14 nt, Salmonella enterica enterica serovar Typhi Ty2
cacgccaccgggcc

SEQ ID NO: 3699690 - RNA, 19 nt, Salmonella enterica enterica serovar Typhi Ty2
cacgccagauaaaucagcc

SEQ ID NO: 3699691 - RNA, 19 nt, Salmonella enterica enterica serovar Typhi Ty2
cacgccagggagggccaac

SEQ ID NO: 3699692 - RNA, 16 nt, Salmonella enterica enterica serovar Typhi Ty2
cacgccaucagggacg

SEQ ID NO: 3699693 - RNA, 20 nt, Salmonella enterica enterica serovar Typhi Ty2
cacgccaucgacaaaggcaa

SEQ ID NO: 3699694 - RNA, 16 nt, Salmonella enterica enterica serovar Typhi Ty2
cacgccaucgccugau

SEQ ID NO: 3699695 - RNA, 17 nt, Salmonella enterica enterica serovar Typhi Ty2
cacgccauggccgcagc

SEQ ID NO: 3699696 - RNA, 17 nt, Salmonella enterica enterica serovar Typhi Ty2
cacgccauugccaggac

SEQ ID NO: 3699697 - RNA, 14 nt, Salmonella enterica enterica serovar Typhi Ty2
cacgcccacgcuga

SEQ ID NO: 3699698 - RNA, 11 nt, Salmonella enterica enterica serovar Typhi Ty2
cacgcccagcg

SEQ ID NO: 3699699 - RNA, 15 nt, Salmonella enterica enterica serovar Typhi Ty2
cacgcccagcgccga

SEQ ID NO: 3699700 - RNA, 17 nt, Salmonella enterica enterica serovar Typhi Ty2
cacgcccauauccagcu

SEQ ID NO: 3699701 - RNA, 17 nt, Salmonella enterica enterica serovar Typhi Ty2
cacgccccuaaggcagc

SEQ ID NO: 3699702 - RNA, 15 nt, Salmonella enterica enterica serovar Typhi Ty2
cacgcccugaagggc

SEQ ID NO: 3699703 - RNA, 21 nt, Salmonella enterica enterica serovar Typhi Ty2
cacgcccugccauucccagcc

SEQ ID NO: 3699704 - RNA, 19 nt, Salmonella enterica enterica serovar Typhi Ty2
cacgccgacgcauccgcca

SEQ ID NO: 3699705 - RNA, 17 nt, Salmonella enterica enterica serovar Typhi Ty2
cacgccgcacacagcag

SEQ ID NO: 3699706 - RNA, 19 nt, Salmonella enterica enterica serovar Typhi Ty2
cacgccgccauccggcacu

SEQ ID NO: 3699707 - RNA, 18 nt, Salmonella enterica enterica serovar Typhi Ty2
cacgccgcccgccugagc

SEQ ID NO: 3699708 - RNA, 23 nt, Salmonella enterica enterica serovar Typhi Ty2
cacgccgcccgccugagcgcgca

SEQ ID NO: 3699709 - RNA, 16 nt, Salmonella enterica enterica serovar Typhi Ty2
cacgccgccgccgacc

SEQ ID NO: 3699710 - RNA, 16 nt, Salmonella enterica enterica serovar Typhi Ty2
cacgccgcuacugccg

SEQ ID NO: 3699711 - RNA, 16 nt, Salmonella enterica enterica serovar Typhi Ty2
cacgccgcuccacagc

SEQ ID NO: 3699712 - RNA, 18 nt, Salmonella enterica enterica serovar Typhi Ty2
cacgccggaaagaauaau

SEQ ID NO: 3699713 - RNA, 16 nt, Salmonella enterica enterica serovar Typhi Ty2
cacuucacaaacaauu

SEQ ID NO: 3699714 - RNA, 19 nt, Salmonella enterica enterica serovar Typhi Ty2
cacuucacacgaacuuuau

SEQ ID NO: 3699715 - RNA, 11 nt, Salmonella enterica enterica serovar Typhi Ty2
cacuucaucau

SEQ ID NO: 3699716 - RNA, 14 nt, Salmonella enterica enterica serovar Typhi Ty2
cacuucaucaucau

SEQ ID NO: 3699717 - RNA, 16 nt, Salmonella enterica enterica serovar Typhi Ty2
cacuucauccggauaa

SEQ ID NO: 3699718 - RNA, 17 nt, Salmonella enterica enterica serovar Typhi Ty2
cacuucauccggauaaa

SEQ ID NO: 3699719 - RNA, 21 nt, Salmonella enterica enterica serovar Typhi Ty2
cacuucaugccgaacagguua

SEQ ID NO: 3699720 - RNA, 16 nt, Salmonella enterica enterica serovar Typhi Ty2
cacuuccagccacggc

SEQ ID NO: 3699721 - RNA, 12 nt, Salmonella enterica enterica serovar Typhi Ty2
cacuuccagcgc

SEQ ID NO: 3699722 - RNA, 15 nt, Salmonella enterica enterica serovar Typhi Ty2
cacuuccauccaugu

SEQ ID NO: 3699723 - RNA, 15 nt, Salmonella enterica enterica serovar Typhi Ty2
cacuuccccugccag

SEQ ID NO: 3699724 - RNA, 15 nt, Salmonella enterica enterica serovar Typhi Ty2
cacuuccgccaccac

SEQ ID NO: 3699725 - RNA, 18 nt, Salmonella enterica enterica serovar Typhi Ty2
cacuuccgccaccacgcc

SEQ ID NO: 3699726 - RNA, 15 nt, Salmonella enterica enterica serovar Typhi Ty2
cacuuccggugucca

SEQ ID NO: 3699727 - RNA, 22 nt, Salmonella enterica enterica serovar Typhi Ty2
cacuuccgguguccauguugcc

SEQ ID NO: 3699728 - RNA, 15 nt, Salmonella enterica enterica serovar Typhi Ty2
cacuucgaaacgauc

SEQ ID NO: 3699729 - RNA, 13 nt, Salmonella enterica enterica serovar Typhi Ty2
cacuucgauaaac

SEQ ID NO: 3699730 - RNA, 14 nt, Salmonella enterica enterica serovar Typhi Ty2
cacuucgauaaacg

SEQ ID NO: 3699731 - RNA, 17 nt, Salmonella enterica enterica serovar Typhi Ty2
cacuucgcgcauugcga

SEQ ID NO: 3699732 - RNA, 22 nt, Salmonella enterica enterica serovar Typhi Ty2
cacuucgcgccauugaucauug

SEQ ID NO: 3699733 - RNA, 21 nt, Salmonella enterica enterica serovar Typhi Ty2
cacuucgcugauaccgcccuc

SEQ ID NO: 3699734 - RNA, 19 nt, Salmonella enterica enterica serovar Typhi Ty2
cacuucucgcgcaucagga

SEQ ID NO: 3699735 - RNA, 23 nt, Salmonella enterica enterica serovar Typhi Ty2
cacuucugaguucggcauggggu

SEQ ID NO: 3699736 - RNA, 13 nt, Salmonella enterica enterica serovar Typhi Ty2
cacuucugcggua

SEQ ID NO: 3699737 - RNA, 23 nt, Salmonella enterica enterica serovar Typhi Ty2
cacuucuucgcgaucgugauaaa

SEQ ID NO: 3699738 - RNA, 14 nt, Salmonella enterica enterica serovar Typhi Ty2
cacuugagaaauua

SEQ ID NO: 3699739 - RNA, 21 nt, Salmonella enterica enterica serovar Typhi Ty2
cacuugagaaauuauuuuaaa

SEQ ID NO: 3699740 - RNA, 22 nt, Salmonella enterica enterica serovar Typhi Ty2
cacuugagaaauuauuuuaaau

SEQ ID NO: 3699741 - RNA, 17 nt, Salmonella enterica enterica serovar Typhi Ty2
cacuuuaaagcccagca

SEQ ID NO: 3699742 - RNA, 22 nt, Salmonella enterica enterica serovar Typhi Ty2
cacuuuaauacccgauagcggc

SEQ ID NO: 3699743 - RNA, 19 nt, Salmonella enterica enterica serovar Typhi Ty2
cacuuuacugaauaacagc

SEQ ID NO: 3699744 - RNA, 20 nt, Salmonella enterica enterica serovar Typhi Ty2
cacuuuacugaauaacagca

SEQ ID NO: 3699745 - RNA, 19 nt, Salmonella enterica enterica serovar Typhi Ty2
cacuuuccagaccaagauc

SEQ ID NO: 3699746 - RNA, 17 nt, Salmonella enterica enterica serovar Typhi Ty2
cacuuuccgaaucaggc

SEQ ID NO: 3699747 - RNA, 18 nt, Salmonella enterica enterica serovar Typhi Ty2
cacuuuccgaaucaggcg

SEQ ID NO: 3699748 - RNA, 14 nt, Salmonella enterica enterica serovar Typhi Ty2
cacuuuccgacguu

SEQ ID NO: 3699749 - RNA, 17 nt, Salmonella enterica enterica serovar Typhi Ty2
cacuuucgcccggcgcc

SEQ ID NO: 3699750 - RNA, 12 nt, Salmonella enterica enterica serovar Typhi Ty2
cacuuucucggc

SEQ ID NO: 3699751 - RNA, 17 nt, Salmonella enterica enterica serovar Typhi Ty2
cacuuucucggcuuucc

SEQ ID NO: 3699752 - RNA, 21 nt, Salmonella enterica enterica serovar Typhi Ty2
cacuuucucggcuuuccagcu

SEQ ID NO: 3699753 - RNA, 22 nt, Salmonella enterica enterica serovar Typhi Ty2
cacuuucucggcuuuccagcuc

SEQ ID NO: 3699754 - RNA, 20 nt, Salmonella enterica enterica serovar Typhi Ty2
cacuuuugucggccuguucu

SEQ ID NO: 3699755 - RNA, 18 nt, Salmonella enterica enterica serovar Typhi Ty2
cacuuuuuauuuguuccu

SEQ ID NO: 3699756 - RNA, 13 nt, Salmonella enterica enterica serovar Typhi Ty2
cacuuuuuccucc

SEQ ID NO: 3699757 - RNA, 22 nt, Salmonella enterica enterica serovar Typhi Ty2
cacuuuuucucuuaucgccgcc

SEQ ID NO: 3699758 - RNA, 16 nt, Salmonella enterica enterica serovar Typhi Ty2
cagaaaaaaaagcgcc

SEQ ID NO: 3699759 - RNA, 18 nt, Salmonella enterica enterica serovar Typhi Ty2
cagaaaaaccaaaaaaua

SEQ ID NO: 3699760 - RNA, 11 nt, Salmonella enterica enterica serovar Typhi Ty2
cagaaaaaccu

SEQ ID NO: 3699761 - RNA, 18 nt, Salmonella enterica enterica serovar Typhi Ty2
cagaaaaaccuccggcua

SEQ ID NO: 3699762 - RNA, 14 nt, Salmonella enterica enterica serovar Typhi Ty2
cagaaaaagccccc

SEQ ID NO: 3699763 - RNA, 19 nt, Salmonella enterica enterica serovar Typhi Ty2
cagaaaaagggaaaagcca

SEQ ID NO: 3699764 - RNA, 13 nt, Salmonella enterica enterica serovar Typhi Ty2
cagaaaaccggca

SEQ ID NO: 3699765 - RNA, 15 nt, Salmonella enterica enterica serovar Typhi Ty2
cagaaaaccggcaaa

SEQ ID NO: 3699766 - RNA, 16 nt, Salmonella enterica enterica serovar Typhi Ty2
cagaaaagaaccgacu

SEQ ID NO: 3699767 - RNA, 19 nt, Salmonella enterica enterica serovar Typhi Ty2
cagaaaauccuucagcguu

SEQ ID NO: 3699768 - RNA, 21 nt, Salmonella enterica enterica serovar Typhi Ty2
cagaaaaucuggcgagagcau

SEQ ID NO: 3699769 - RNA, 22 nt, Salmonella enterica enterica serovar Typhi Ty2
cagaaacaacgcgggccauaca

SEQ ID NO: 3699770 - RNA, 18 nt, Salmonella enterica enterica serovar Typhi Ty2
cagaaagcggaccaaugc

SEQ ID NO: 3699771 - RNA, 14 nt, Salmonella enterica enterica serovar Typhi Ty2
cagaaaggaugccc

SEQ ID NO: 3699772 - RNA, 23 nt, Salmonella enterica enterica serovar Typhi Ty2
cagaaauaaaauacgcucaauau

SEQ ID NO: 3699773 - RNA, 15 nt, Salmonella enterica enterica serovar Typhi Ty2
cagaaauaaaauacu

SEQ ID NO: 3699774 - RNA, 19 nt, Salmonella enterica enterica serovar Typhi Ty2
cagaaauaaaauacuucca

SEQ ID NO: 3699775 - RNA, 20 nt, Salmonella enterica enterica serovar Typhi Ty2
cagaaauaaaauacuuccau

SEQ ID NO: 3699776 - RNA, 17 nt, Salmonella enterica enterica serovar Typhi Ty2
cagaaauauucaguacu

SEQ ID NO: 3699777 - RNA, 22 nt, Salmonella enterica enterica serovar Typhi Ty2
cagaaauccgcgaauaccuucc

SEQ ID NO: 3699778 - RNA, 14 nt, Salmonella enterica enterica serovar Typhi Ty2
cagaaauccgcguc

SEQ ID NO: 3699779 - RNA, 18 nt, Salmonella enterica enterica serovar Typhi Ty2
cagaaaucggcagcaccc

SEQ ID NO: 3699780 - RNA, 18 nt, Salmonella enterica enterica serovar Typhi Ty2
cagaacaaacuuauccca

SEQ ID NO: 3699781 - RNA, 14 nt, Salmonella enterica enterica serovar Typhi Ty2
cagaacaacgggaa

SEQ ID NO: 3699782 - RNA, 21 nt, Salmonella enterica enterica serovar Typhi Ty2
cagaacaucaagcgguagcgu

SEQ ID NO: 3699783 - RNA, 14 nt, Salmonella enterica enterica serovar Typhi Ty2
cagaaccacuugaa

SEQ ID NO: 3699784 - RNA, 15 nt, Salmonella enterica enterica serovar Typhi Ty2
cagaaccacuugaac

SEQ ID NO: 3699785 - RNA, 13 nt, Salmonella enterica enterica serovar Typhi Ty2
cagaaccauuucc

SEQ ID NO: 3699786 - RNA, 13 nt, Salmonella enterica enterica serovar Typhi Ty2
cagaacgagagga

SEQ ID NO: 3699787 - RNA, 15 nt, Salmonella enterica enterica serovar Typhi Ty2
cagaacgagaggagg

SEQ ID NO: 3699788 - RNA, 19 nt, Salmonella enterica enterica serovar Typhi Ty2
cagaacgcuuuugcgcacu

SEQ ID NO: 3699789 - RNA, 16 nt, Salmonella enterica enterica serovar Typhi Ty2
cagaacguagcccauu

SEQ ID NO: 3699790 - RNA, 21 nt, Salmonella enterica enterica serovar Typhi Ty2
cagaacucacauauucaauaa

SEQ ID NO: 3699791 - RNA, 15 nt, Salmonella enterica enterica serovar Typhi Ty2
cagaagaaucugccu

SEQ ID NO: 3699792 - RNA, 16 nt, Salmonella enterica enterica serovar Typhi Ty2
cagaagaaucugccuu

SEQ ID NO: 3699793 - RNA, 13 nt, Salmonella enterica enterica serovar Typhi Ty2
cagaagauaugug

SEQ ID NO: 3699794 - RNA, 22 nt, Salmonella enterica enterica serovar Typhi Ty2
cagaagaucuaaagccaguuuc

SEQ ID NO: 3699795 - RNA, 16 nt, Salmonella enterica enterica serovar Typhi Ty2
cagaagcacuucucca

SEQ ID NO: 3699796 - RNA, 15 nt, Salmonella enterica enterica serovar Typhi Ty2
cagaaggcaugggga

SEQ ID NO: 3699797 - RNA, 19 nt, Salmonella enterica enterica serovar Typhi Ty2
cagaaggccagugguaaaa

SEQ ID NO: 3699798 - RNA, 14 nt, Salmonella enterica enterica serovar Typhi Ty2
cagaaggcgaacau

SEQ ID NO: 3699799 - RNA, 19 nt, Salmonella enterica enterica serovar Typhi Ty2
cagaaggcgaacauaagag

SEQ ID NO: 3699800 - RNA, 15 nt, Salmonella enterica enterica serovar Typhi Ty2
cagaaggcuaacagc

SEQ ID NO: 3699801 - RNA, 18 nt, Salmonella enterica enterica serovar Typhi Ty2
cagaagguuauucgccuu

SEQ ID NO: 3699802 - RNA, 20 nt, Salmonella enterica enterica serovar Typhi Ty2
cagaagugccaguaacucau

SEQ ID NO: 3699803 - RNA, 18 nt, Salmonella enterica enterica serovar Typhi Ty2
cagaauacgaccucaaau

SEQ ID NO: 3699804 - RNA, 12 nt, Salmonella enterica enterica serovar Typhi Ty2
cagaauacggcc

SEQ ID NO: 3699805 - RNA, 18 nt, Salmonella enterica enterica serovar Typhi Ty2
cagaauauccgguacacc

SEQ ID NO: 3699806 - RNA, 13 nt, Salmonella enterica enterica serovar Typhi Ty2
cagaaucacccca

SEQ ID NO: 3699807 - RNA, 15 nt, Salmonella enterica enterica serovar Typhi Ty2
cagaaucaccucuuu

SEQ ID NO: 3699808 - RNA, 14 nt, Salmonella enterica enterica serovar Typhi Ty2
cagaaucagccgac

SEQ ID NO: 3699809 - RNA, 19 nt, Salmonella enterica enterica serovar Typhi Ty2
cagaaucagcgugccggua

SEQ ID NO: 3699810 - RNA, 23 nt, Salmonella enterica enterica serovar Typhi Ty2
cagaaugauaaugccgcugauaa

SEQ ID NO: 3699811 - RNA, 14 nt, Salmonella enterica enterica serovar Typhi Ty2
cagaaugcaaaacu

SEQ ID NO: 3699812 - RNA, 16 nt, Salmonella enterica enterica serovar Typhi Ty2
cagaaugccagcgccg

SEQ ID NO: 3699813 - RNA, 20 nt, Salmonella enterica enterica serovar Typhi Ty2
cagaaugcccugcuguucca

SEQ ID NO: 3699814 - RNA, 18 nt, Salmonella enterica enterica serovar Typhi Ty2
cagaauuaacucaucaca

SEQ ID NO: 3699815 - RNA, 19 nt, Salmonella enterica enterica serovar Typhi Ty2
cagaauuaacucaucacag

SEQ ID NO: 3699816 - RNA, 21 nt, Salmonella enterica enterica serovar Typhi Ty2
cagaauuaacucaucacagcc

SEQ ID NO: 3699817 - RNA, 21 nt, Salmonella enterica enterica serovar Typhi Ty2
cagaauucguacguuuuucca

SEQ ID NO: 3699818 - RNA, 16 nt, Salmonella enterica enterica serovar Typhi Ty2
cagaauugcgccaccu

SEQ ID NO: 3699819 - RNA, 20 nt, Salmonella enterica enterica serovar Typhi Ty2
cagacaagcacauaacugag

SEQ ID NO: 3699820 - RNA, 20 nt, Salmonella enterica enterica serovar Typhi Ty2
cagacaauuagcgacgcaua

SEQ ID NO: 3699821 - RNA, 20 nt, Salmonella enterica enterica serovar Typhi Ty2
cagacaauuuccgccgccag

SEQ ID NO: 3699822 - RNA, 21 nt, Salmonella enterica enterica serovar Typhi Ty2
cagacacggugugccgccauc

SEQ ID NO: 3699823 - RNA, 13 nt, Salmonella enterica enterica serovar Typhi Ty2
cagacacugcacc

SEQ ID NO: 3699824 - RNA, 14 nt, Salmonella enterica enterica serovar Typhi Ty2
cagacacugcacca

SEQ ID NO: 3699825 - RNA, 12 nt, Salmonella enterica enterica serovar Typhi Ty2
cagacacugcca

SEQ ID NO: 3699826 - RNA, 13 nt, Salmonella enterica enterica serovar Typhi Ty2
cagacacugccac

SEQ ID NO: 3699827 - RNA, 18 nt, Salmonella enterica enterica serovar Typhi Ty2
cagacacugccaccgcuc

SEQ ID NO: 3699828 - RNA, 22 nt, Salmonella enterica enterica serovar Typhi Ty2
cagacacuggaaacagccaauc

SEQ ID NO: 3699829 - RNA, 17 nt, Salmonella enterica enterica serovar Typhi Ty2
cagacagaucgguuuau

SEQ ID NO: 3699830 - RNA, 17 nt, Salmonella enterica enterica serovar Typhi Ty2
cagacagccauauuuau

SEQ ID NO: 3699831 - RNA, 19 nt, Salmonella enterica enterica serovar Typhi Ty2
cagacagccauauuuaugc

SEQ ID NO: 3699832 - RNA, 12 nt, Salmonella enterica enterica serovar Typhi Ty2
cagacagccgac

SEQ ID NO: 3699833 - RNA, 20 nt, Salmonella enterica enterica serovar Typhi Ty2
cagacagccgacggcaaaaa

SEQ ID NO: 3699834 - RNA, 21 nt, Salmonella enterica enterica serovar Typhi Ty2
cagacagccgaucaggccgca

SEQ ID NO: 3699835 - RNA, 15 nt, Salmonella enterica enterica serovar Typhi Ty2
cagacaggacgccag

SEQ ID NO: 3699836 - RNA, 17 nt, Salmonella enterica enterica serovar Typhi Ty2
cagacauauuuucucug

SEQ ID NO: 3699837 - RNA, 18 nt, Salmonella enterica enterica serovar Typhi Ty2
cagacaucaucgaacgcc

SEQ ID NO: 3699838 - RNA, 23 nt, Salmonella enterica enterica serovar Typhi Ty2
cagacaucggagauuucauccuc

SEQ ID NO: 3699839 - RNA, 13 nt, Salmonella enterica enterica serovar Typhi Ty2
cagacaugaccgc

SEQ ID NO: 3699840 - RNA, 15 nt, Salmonella enterica enterica serovar Typhi Ty2
cagacaugcacaugg

SEQ ID NO: 3699841 - RNA, 15 nt, Salmonella enterica enterica serovar Typhi Ty2
cagacaugcgccgga

SEQ ID NO: 3699842 - RNA, 17 nt, Salmonella enterica enterica serovar Typhi Ty2
cagacaugcgccggacg

SEQ ID NO: 3699843 - RNA, 17 nt, Salmonella enterica enterica serovar Typhi Ty2
cagaccaaacaugcggc

SEQ ID NO: 3699844 - RNA, 18 nt, Salmonella enterica enterica serovar Typhi Ty2
cagaccaauagagagcga

SEQ ID NO: 3699845 - RNA, 22 nt, Salmonella enterica enterica serovar Typhi Ty2
cagaccaauagagagcgacagc

SEQ ID NO: 3699846 - RNA, 13 nt, Salmonella enterica enterica serovar Typhi Ty2
cagaccaccagcg

SEQ ID NO: 3699847 - RNA, 19 nt, Salmonella enterica enterica serovar Typhi Ty2
cagaccaccccacaguaau

SEQ ID NO: 3699848 - RNA, 17 nt, Salmonella enterica enterica serovar Typhi Ty2
cagaccacgaaucagga

SEQ ID NO: 3699849 - RNA, 20 nt, Salmonella enterica enterica serovar Typhi Ty2
cagaccacgaaucaggauau

SEQ ID NO: 3699850 - RNA, 18 nt, Salmonella enterica enterica serovar Typhi Ty2
cagaccauucaaccagcc

SEQ ID NO: 3699851 - RNA, 23 nt, Salmonella enterica enterica serovar Typhi Ty2
cagacccaguacaaacaaauaaa

SEQ ID NO: 3699852 - RNA, 22 nt, Salmonella enterica enterica serovar Typhi Ty2
cagaccccaguaauccggcaac

SEQ ID NO: 3699853 - RNA, 13 nt, Salmonella enterica enterica serovar Typhi Ty2
cagacccgcaaua

SEQ ID NO: 3699854 - RNA, 20 nt, Salmonella enterica enterica serovar Typhi Ty2
cagaccgauauuuugcugca

SEQ ID NO: 3699855 - RNA, 14 nt, Salmonella enterica enterica serovar Typhi Ty2
cagaccgaucucau

SEQ ID NO: 3699856 - RNA, 20 nt, Salmonella enterica enterica serovar Typhi Ty2
cagaccgaucucaugcaacu

SEQ ID NO: 3699857 - RNA, 22 nt, Salmonella enterica enterica serovar Typhi Ty2
cagaccgaucucaugcaacugg

SEQ ID NO: 3699858 - RNA, 14 nt, Salmonella enterica enterica serovar Typhi Ty2
cagaccgcugcgga

SEQ ID NO: 3699859 - RNA, 21 nt, Salmonella enterica enterica serovar Typhi Ty2
cagaccgcugcggaacaccag

SEQ ID NO: 3699860 - RNA, 16 nt, Salmonella enterica enterica serovar Typhi Ty2
cagaccggcaaaaauu

SEQ ID NO: 3699861 - RNA, 14 nt, Salmonella enterica enterica serovar Typhi Ty2
cagaccggcagccu

SEQ ID NO: 3699862 - RNA, 15 nt, Salmonella enterica enterica serovar Typhi Ty2
cagaccggcagccug

SEQ ID NO: 3699863 - RNA, 17 nt, Salmonella enterica enterica serovar Typhi Ty2
cagaccggcaucucauc

SEQ ID NO: 3699864 - RNA, 21 nt, Salmonella enterica enterica serovar Typhi Ty2
cagaccgggcgaaguuugccg

SEQ ID NO: 3699865 - RNA, 21 nt, Salmonella enterica enterica serovar Typhi Ty2
cagaccucguucggcgcaccu

SEQ ID NO: 3699866 - RNA, 13 nt, Salmonella enterica enterica serovar Typhi Ty2
cagaccucugcaa

SEQ ID NO: 3699867 - RNA, 16 nt, Salmonella enterica enterica serovar Typhi Ty2
cagaccuguaaaaaaa

SEQ ID NO: 3699868 - RNA, 19 nt, Salmonella enterica enterica serovar Typhi Ty2
cagaccuuaucgcagucag

SEQ ID NO: 3699869 - RNA, 21 nt, Salmonella enterica enterica serovar Typhi Ty2
cagaccuuaucgcagucagcc

SEQ ID NO: 3699870 - RNA, 23 nt, Salmonella enterica enterica serovar Typhi Ty2
cagaccuuuauaagguuagccag

SEQ ID NO: 3699871 - RNA, 17 nt, Salmonella enterica enterica serovar Typhi Ty2
cagacgccaacgcgcga

SEQ ID NO: 3699872 - RNA, 18 nt, Salmonella enterica enterica serovar Typhi Ty2
cagacgccgcgcugcggc

SEQ ID NO: 3699873 - RNA, 14 nt, Salmonella enterica enterica serovar Typhi Ty2
cagacgcgcagcac

SEQ ID NO: 3699874 - RNA, 15 nt, Salmonella enterica enterica serovar Typhi Ty2
cagacgcgcagcacc

SEQ ID NO: 3699875 - RNA, 16 nt, Salmonella enterica enterica serovar Typhi Ty2
cagacgcgcagcaccg

SEQ ID NO: 3699876 - RNA, 19 nt, Salmonella enterica enterica serovar Typhi Ty2
cagacgcuccgcaguaauc

SEQ ID NO: 3699877 - RNA, 15 nt, Salmonella enterica enterica serovar Typhi Ty2
cagaucgaccagcgc

SEQ ID NO: 3699878 - RNA, 20 nt, Salmonella enterica enterica serovar Typhi Ty2
cagaucgccaaagucauugc

SEQ ID NO: 3699879 - RNA, 13 nt, Salmonella enterica enterica serovar Typhi Ty2
cagaucgccgccg

SEQ ID NO: 3699880 - RNA, 15 nt, Salmonella enterica enterica serovar Typhi Ty2
cagaucgcgcagcgu

SEQ ID NO: 3699881 - RNA, 16 nt, Salmonella enterica enterica serovar Typhi Ty2
cagaucgcgcugcgca

SEQ ID NO: 3699882 - RNA, 15 nt, Salmonella enterica enterica serovar Typhi Ty2
cagaucggcaucuuu

SEQ ID NO: 3699883 - RNA, 18 nt, Salmonella enterica enterica serovar Typhi Ty2
cagaucggcaugauggcg

SEQ ID NO: 3699884 - RNA, 19 nt, Salmonella enterica enterica serovar Typhi Ty2
cagaucgguaaaagcguuu

SEQ ID NO: 3699885 - RNA, 16 nt, Salmonella enterica enterica serovar Typhi Ty2
cagaucgguuuauccc

SEQ ID NO: 3699886 - RNA, 18 nt, Salmonella enterica enterica serovar Typhi Ty2
cagaucguagccauguuc

SEQ ID NO: 3699887 - RNA, 13 nt, Salmonella enterica enterica serovar Typhi Ty2
cagaucguaugcg

SEQ ID NO: 3699888 - RNA, 20 nt, Salmonella enterica enterica serovar Typhi Ty2
cagaucguaugcgccuguua

SEQ ID NO: 3699889 - RNA, 14 nt, Salmonella enterica enterica serovar Typhi Ty2
cagaucuaucugaa

SEQ ID NO: 3699890 - RNA, 16 nt, Salmonella enterica enterica serovar Typhi Ty2
cagaucugucgccaug

SEQ ID NO: 3699891 - RNA, 16 nt, Salmonella enterica enterica serovar Typhi Ty2
cagaucuucacgcguc

SEQ ID NO: 3699892 - RNA, 15 nt, Salmonella enterica enterica serovar Typhi Ty2
cagaucuucagaggc

SEQ ID NO: 3699893 - RNA, 17 nt, Salmonella enterica enterica serovar Typhi Ty2
cagaucuuuuugcuccu

SEQ ID NO: 3699894 - RNA, 15 nt, Salmonella enterica enterica serovar Typhi Ty2
cagaugaacggcaag

SEQ ID NO: 3699895 - RNA, 17 nt, Salmonella enterica enterica serovar Typhi Ty2
cagaugagcgguaaguc

SEQ ID NO: 3699896 - RNA, 14 nt, Salmonella enterica enterica serovar Typhi Ty2
cagaugcaaugcag

SEQ ID NO: 3699897 - RNA, 17 nt, Salmonella enterica enterica serovar Typhi Ty2
cagaugcagcaacguuu

SEQ ID NO: 3699898 - RNA, 16 nt, Salmonella enterica enterica serovar Typhi Ty2
cagaugcaguucaccc

SEQ ID NO: 3699899 - RNA, 20 nt, Salmonella enterica enterica serovar Typhi Ty2
cagaugcgaaucuucaucgu

SEQ ID NO: 3699900 - RNA, 16 nt, Salmonella enterica enterica serovar Typhi Ty2
cagaugcguuuucugc

SEQ ID NO: 3699901 - RNA, 14 nt, Salmonella enterica enterica serovar Typhi Ty2
cagaugcugcguuu

SEQ ID NO: 3699902 - RNA, 20 nt, Salmonella enterica enterica serovar Typhi Ty2
cagaugcuuaaugcucugcu

SEQ ID NO: 3699903 - RNA, 18 nt, Salmonella enterica enterica serovar Typhi Ty2
cagauggauaaccugccg

SEQ ID NO: 3699904 - RNA, 13 nt, Salmonella enterica enterica serovar Typhi Ty2
cagauggcugcac

SEQ ID NO: 3699905 - RNA, 18 nt, Salmonella enterica enterica serovar Typhi Ty2
cagauggcuuuacgcuua

SEQ ID NO: 3699906 - RNA, 22 nt, Salmonella enterica enterica serovar Typhi Ty2
cagaugguauaaaucacgcuga

SEQ ID NO: 3699907 - RNA, 20 nt, Salmonella enterica enterica serovar Typhi Ty2
cagauggugauagcgcgcca

SEQ ID NO: 3699908 - RNA, 17 nt, Salmonella enterica enterica serovar Typhi Ty2
cagauguaucgcgcuua

SEQ ID NO: 3699909 - RNA, 16 nt, Salmonella enterica enterica serovar Typhi Ty2
cagauguccaccgauu

SEQ ID NO: 3699910 - RNA, 14 nt, Salmonella enterica enterica serovar Typhi Ty2
cagauguugauaca

SEQ ID NO: 3699911 - RNA, 15 nt, Salmonella enterica enterica serovar Typhi Ty2
cagauguugauacag

SEQ ID NO: 3699912 - RNA, 17 nt, Salmonella enterica enterica serovar Typhi Ty2
cagauguuuacgcugcu

SEQ ID NO: 3699913 - RNA, 18 nt, Salmonella enterica enterica serovar Typhi Ty2
cagauuacgcauggucaa

SEQ ID NO: 3699914 - RNA, 14 nt, Salmonella enterica enterica serovar Typhi Ty2
cagauuacuaugag

SEQ ID NO: 3699915 - RNA, 17 nt, Salmonella enterica enterica serovar Typhi Ty2
cagauuaugcaguucuu

SEQ ID NO: 3699916 - RNA, 17 nt, Salmonella enterica enterica serovar Typhi Ty2
cagauuccgaacucaug

SEQ ID NO: 3699917 - RNA, 18 nt, Salmonella enterica enterica serovar Typhi Ty2
cagauucuuaguccucag

SEQ ID NO: 3699918 - RNA, 14 nt, Salmonella enterica enterica serovar Typhi Ty2
cagauugagacaaa

SEQ ID NO: 3699919 - RNA, 18 nt, Salmonella enterica enterica serovar Typhi Ty2
cagauuucgcagcagcau

SEQ ID NO: 3699920 - RNA, 15 nt, Salmonella enterica enterica serovar Typhi Ty2
cagauuuucuuuaau

SEQ ID NO: 3699921 - RNA, 21 nt, Salmonella enterica enterica serovar Typhi Ty2
cagcaaaacggcuaccgucau

SEQ ID NO: 3699922 - RNA, 18 nt, Salmonella enterica enterica serovar Typhi Ty2
cagcaaaauaccggcagc

SEQ ID NO: 3699923 - RNA, 22 nt, Salmonella enterica enterica serovar Typhi Ty2
cagcaaaaucacgcacacgucu

SEQ ID NO: 3699924 - RNA, 12 nt, Salmonella enterica enterica serovar Typhi Ty2
cagcaaaauggc

SEQ ID NO: 3699925 - RNA, 18 nt, Salmonella enterica enterica serovar Typhi Ty2
cagcaaaccgauaaucac

SEQ ID NO: 3699926 - RNA, 22 nt, Salmonella enterica enterica serovar Typhi Ty2
cagcaaacgccauagcaucgac

SEQ ID NO: 3699927 - RNA, 23 nt, Salmonella enterica enterica serovar Typhi Ty2
cagcaaacgccuuccggagacua

SEQ ID NO: 3699928 - RNA, 11 nt, Salmonella enterica enterica serovar Typhi Ty2
cagcaaauaau

SEQ ID NO: 3699929 - RNA, 15 nt, Salmonella enterica enterica serovar Typhi Ty2
cagcaaauacagaug

SEQ ID NO: 3699930 - RNA, 16 nt, Salmonella enterica enterica serovar Typhi Ty2
cagcaacagaaguuca

SEQ ID NO: 3699931 - RNA, 20 nt, Salmonella enterica enterica serovar Typhi Ty2
cagcaacagugggcuaugaa

SEQ ID NO: 3699932 - RNA, 16 nt, Salmonella enterica enterica serovar Typhi Ty2
cagcaacaguugcugg

SEQ ID NO: 3699933 - RNA, 13 nt, Salmonella enterica enterica serovar Typhi Ty2
cagcaacccugcc

SEQ ID NO: 3699934 - RNA, 18 nt, Salmonella enterica enterica serovar Typhi Ty2
cagcaacgagcuuuuuuc

SEQ ID NO: 3699935 - RNA, 17 nt, Salmonella enterica enterica serovar Typhi Ty2
cagcaacgccuccagcg

SEQ ID NO: 3699936 - RNA, 13 nt, Salmonella enterica enterica serovar Typhi Ty2
cagcaacgcgcca

SEQ ID NO: 3699937 - RNA, 17 nt, Salmonella enterica enterica serovar Typhi Ty2
cagcaacggcugauggc

SEQ ID NO: 3699938 - RNA, 15 nt, Salmonella enterica enterica serovar Typhi Ty2
cagcaacugcugcgc

SEQ ID NO: 3699939 - RNA, 22 nt, Salmonella enterica enterica serovar Typhi Ty2
cagcaacugcugcgcgugcugu

SEQ ID NO: 3699940 - RNA, 23 nt, Salmonella enterica enterica serovar Typhi Ty2
cagcaacugcugcgcgugcugua

SEQ ID NO: 3699941 - RNA, 22 nt, Salmonella enterica enterica serovar Typhi Ty2
cagcaagaaguuccgcuuuucu

SEQ ID NO: 3699942 - RNA, 15 nt, Salmonella enterica enterica serovar Typhi Ty2
cagcaagcggcuguc

SEQ ID NO: 3699943 - RNA, 18 nt, Salmonella enterica enterica serovar Typhi Ty2
cagcaagucgcgggcgcu

SEQ ID NO: 3699944 - RNA, 13 nt, Salmonella enterica enterica serovar Typhi Ty2
cagcaauacccag

SEQ ID NO: 3699945 - RNA, 15 nt, Salmonella enterica enterica serovar Typhi Ty2
cagcaauauaugagc

SEQ ID NO: 3699946 - RNA, 17 nt, Salmonella enterica enterica serovar Typhi Ty2
cagcaauaucagccauu

SEQ ID NO: 3699947 - RNA, 20 nt, Salmonella enterica enterica serovar Typhi Ty2
cagcaaucacuuccgccucg

SEQ ID NO: 3699948 - RNA, 12 nt, Salmonella enterica enterica serovar Typhi Ty2
cagcaaucaggu

SEQ ID NO: 3699949 - RNA, 20 nt, Salmonella enterica enterica serovar Typhi Ty2
cagcaaugauaacggcgcca

SEQ ID NO: 3699950 - RNA, 15 nt, Salmonella enterica enterica serovar Typhi Ty2
cagcaaugcccaaaa

SEQ ID NO: 3699951 - RNA, 17 nt, Salmonella enterica enterica serovar Typhi Ty2
cagcaaugccgccgcca

SEQ ID NO: 3699952 - RNA, 20 nt, Salmonella enterica enterica serovar Typhi Ty2
cagcaaugccgccgccaggu

SEQ ID NO: 3699953 - RNA, 14 nt, Salmonella enterica enterica serovar Typhi Ty2
cagcaauuccgcca

SEQ ID NO: 3699954 - RNA, 20 nt, Salmonella enterica enterica serovar Typhi Ty2
cagcaauuccgccaucucau

SEQ ID NO: 3699955 - RNA, 23 nt, Salmonella enterica enterica serovar Typhi Ty2
cagcaauuccgccaucucauucg

SEQ ID NO: 3699956 - RNA, 23 nt, Salmonella enterica enterica serovar Typhi Ty2
cagcaauuucucgcccgccagau

SEQ ID NO: 3699957 - RNA, 22 nt, Salmonella enterica enterica serovar Typhi Ty2
cagcacaauaccuucugcgccc

SEQ ID NO: 3699958 - RNA, 21 nt, Salmonella enterica enterica serovar Typhi Ty2
cagcacaaucccggcgccgau

SEQ ID NO: 3699959 - RNA, 17 nt, Salmonella enterica enterica serovar Typhi Ty2
cagcaucggcagcgcca

SEQ ID NO: 3699960 - RNA, 18 nt, Salmonella enterica enterica serovar Typhi Ty2
cagcaucgggaaucaucg

SEQ ID NO: 3699961 - RNA, 16 nt, Salmonella enterica enterica serovar Typhi Ty2
cagcaucgugccggaa

SEQ ID NO: 3699962 - RNA, 22 nt, Salmonella enterica enterica serovar Typhi Ty2
cagcaucugcauaauggcgacg

SEQ ID NO: 3699963 - RNA, 17 nt, Salmonella enterica enterica serovar Typhi Ty2
cagcaucuuaugcgcaa

SEQ ID NO: 3699964 - RNA, 21 nt, Salmonella enterica enterica serovar Typhi Ty2
cagcaugaauaaccucccgcc

SEQ ID NO: 3699965 - RNA, 16 nt, Salmonella enterica enterica serovar Typhi Ty2
cagcaugagccagccc

SEQ ID NO: 3699966 - RNA, 14 nt, Salmonella enterica enterica serovar Typhi Ty2
cagcaugcccgcca

SEQ ID NO: 3699967 - RNA, 16 nt, Salmonella enterica enterica serovar Typhi Ty2
cagcaugcccgccagc

SEQ ID NO: 3699968 - RNA, 19 nt, Salmonella enterica enterica serovar Typhi Ty2
cagcaugcccgccagcggg

SEQ ID NO: 3699969 - RNA, 15 nt, Salmonella enterica enterica serovar Typhi Ty2
cagcauggcgccugc

SEQ ID NO: 3699970 - RNA, 17 nt, Salmonella enterica enterica serovar Typhi Ty2
cagcauuaacccggccc

SEQ ID NO: 3699971 - RNA, 21 nt, Salmonella enterica enterica serovar Typhi Ty2
cagcauuggugagagaguugc

SEQ ID NO: 3699972 - RNA, 15 nt, Salmonella enterica enterica serovar Typhi Ty2
cagcauuucaaucgc

SEQ ID NO: 3699973 - RNA, 19 nt, Salmonella enterica enterica serovar Typhi Ty2
cagcauuucaaucgcgccc

SEQ ID NO: 3699974 - RNA, 13 nt, Salmonella enterica enterica serovar Typhi Ty2
cagcauuuccagc

SEQ ID NO: 3699975 - RNA, 14 nt, Salmonella enterica enterica serovar Typhi Ty2
cagcauuucgucga

SEQ ID NO: 3699976 - RNA, 12 nt, Salmonella enterica enterica serovar Typhi Ty2
cagcauuucuuc

SEQ ID NO: 3699977 - RNA, 21 nt, Salmonella enterica enterica serovar Typhi Ty2
cagccaaaaauaacgcccugc

SEQ ID NO: 3699978 - RNA, 22 nt, Salmonella enterica enterica serovar Typhi Ty2
cagccaaaaauaacgcccugcg

SEQ ID NO: 3699979 - RNA, 22 nt, Salmonella enterica enterica serovar Typhi Ty2
cagccaaagucuggccaccgau

SEQ ID NO: 3699980 - RNA, 19 nt, Salmonella enterica enterica serovar Typhi Ty2
cagccaaauagcgccagac

SEQ ID NO: 3699981 - RNA, 15 nt, Salmonella enterica enterica serovar Typhi Ty2
cagccaaaucagcag

SEQ ID NO: 3699982 - RNA, 19 nt, Salmonella enterica enterica serovar Typhi Ty2
cagccaacaacaggccgcc

SEQ ID NO: 3699983 - RNA, 17 nt, Salmonella enterica enterica serovar Typhi Ty2
cagccaacccacgcgcc

SEQ ID NO: 3699984 - RNA, 19 nt, Salmonella enterica enterica serovar Typhi Ty2
cagccaauuuaggcguggu

SEQ ID NO: 3699985 - RNA, 19 nt, Salmonella enterica enterica serovar Typhi Ty2
cagccacaagagcagcaac

SEQ ID NO: 3699986 - RNA, 15 nt, Salmonella enterica enterica serovar Typhi Ty2
cagccacacacuguu

SEQ ID NO: 3699987 - RNA, 17 nt, Salmonella enterica enterica serovar Typhi Ty2
cagccacaugccuucuu

SEQ ID NO: 3699988 - RNA, 12 nt, Salmonella enterica enterica serovar Typhi Ty2
cagccacccacu

SEQ ID NO: 3699989 - RNA, 17 nt, Salmonella enterica enterica serovar Typhi Ty2
cagccacggcaacgccg

SEQ ID NO: 3699990 - RNA, 12 nt, Salmonella enterica enterica serovar Typhi Ty2
cagccacucccg

SEQ ID NO: 3699991 - RNA, 20 nt, Salmonella enterica enterica serovar Typhi Ty2
cagccacuucuuccagcggc

SEQ ID NO: 3699992 - RNA, 15 nt, Salmonella enterica enterica serovar Typhi Ty2
cagccagacgccagc

SEQ ID NO: 3699993 - RNA, 11 nt, Salmonella enterica enterica serovar Typhi Ty2
cagccagcagc

SEQ ID NO: 3699994 - RNA, 12 nt, Salmonella enterica enterica serovar Typhi Ty2
cagccagcagcg

SEQ ID NO: 3699995 - RNA, 15 nt, Salmonella enterica enterica serovar Typhi Ty2
cagccagcauuucca

SEQ ID NO: 3699996 - RNA, 14 nt, Salmonella enterica enterica serovar Typhi Ty2
cagccagccgccaa

SEQ ID NO: 3699997 - RNA, 19 nt, Salmonella enterica enterica serovar Typhi Ty2
cagccagccguugugcugg

SEQ ID NO: 3699998 - RNA, 20 nt, Salmonella enterica enterica serovar Typhi Ty2
cagccagcgccaccaaagcc

SEQ ID NO: 3699999 - RNA, 14 nt, Salmonella enterica enterica serovar Typhi Ty2
cagccagcgccccu

SEQ ID NO: 3700000 - RNA, 19 nt, Salmonella enterica enterica serovar Typhi Ty2
cagccagcgccccugcggg

SEQ ID NO: 3700001 - RNA, 23 nt, Salmonella enterica enterica serovar Typhi Ty2
cagccaggcgaucgcacagagau

SEQ ID NO: 3700002 - RNA, 17 nt, Salmonella enterica enterica serovar Typhi Ty2
cagccaggcggcaaagu

SEQ ID NO: 3700003 - RNA, 14 nt, Salmonella enterica enterica serovar Typhi Ty2
cagccaggucugca

SEQ ID NO: 3700004 - RNA, 11 nt, Salmonella enterica enterica serovar Typhi Ty2
cagccaggugg

SEQ ID NO: 3700005 - RNA, 13 nt, Salmonella enterica enterica serovar Typhi Ty2
cagccagguggca

SEQ ID NO: 3700006 - RNA, 18 nt, Salmonella enterica enterica serovar Typhi Ty2
cagccagguugccagaaa

SEQ ID NO: 3700007 - RNA, 18 nt, Salmonella enterica enterica serovar Typhi Ty2
cagccagguuuugcucug

SEQ ID NO: 3700008 - RNA, 23 nt, Salmonella enterica enterica serovar Typhi Ty2
cagccagucgccaggcaagguua

SEQ ID NO: 3700009 - RNA, 21 nt, Salmonella enterica enterica serovar Typhi Ty2
cagccaguuggcuucagcaaa

SEQ ID NO: 3700010 - RNA, 22 nt, Salmonella enterica enterica serovar Typhi Ty2
cagccauaaucaguacugcgcc

SEQ ID NO: 3700011 - RNA, 22 nt, Salmonella enterica enterica serovar Typhi Ty2
cagccauaauggauuagguugc

SEQ ID NO: 3700012 - RNA, 15 nt, Salmonella enterica enterica serovar Typhi Ty2
cagccauagcgcgcc

SEQ ID NO: 3700013 - RNA, 16 nt, Salmonella enterica enterica serovar Typhi Ty2
cagccauagcgcgccg

SEQ ID NO: 3700014 - RNA, 17 nt, Salmonella enterica enterica serovar Typhi Ty2
cagccaugccauauggc

SEQ ID NO: 3700015 - RNA, 23 nt, Salmonella enterica enterica serovar Typhi Ty2
cagccauggcccaaaagguagcg

SEQ ID NO: 3700016 - RNA, 14 nt, Salmonella enterica enterica serovar Typhi Ty2
cagccauggcccuu

SEQ ID NO: 3700017 - RNA, 15 nt, Salmonella enterica enterica serovar Typhi Ty2
cagccauucaccacu

SEQ ID NO: 3700018 - RNA, 18 nt, Salmonella enterica enterica serovar Typhi Ty2
cagccauucggcugccuu

SEQ ID NO: 3700019 - RNA, 20 nt, Salmonella enterica enterica serovar Typhi Ty2
cagcccauaccacaacagaa

SEQ ID NO: 3700020 - RNA, 22 nt, Salmonella enterica enterica serovar Typhi Ty2
cagcccaucggucgcgcgcagg

SEQ ID NO: 3700021 - RNA, 19 nt, Salmonella enterica enterica serovar Typhi Ty2
cagcccaucuuucgccagc

SEQ ID NO: 3700022 - RNA, 16 nt, Salmonella enterica enterica serovar Typhi Ty2
cagccccaccgccaga

SEQ ID NO: 3700023 - RNA, 16 nt, Salmonella enterica enterica serovar Typhi Ty2
cagccccagcaccaga

SEQ ID NO: 3700024 - RNA, 14 nt, Salmonella enterica enterica serovar Typhi Ty2
cagccccagcgcca

SEQ ID NO: 3700025 - RNA, 15 nt, Salmonella enterica enterica serovar Typhi Ty2
cagccccagcgccag

SEQ ID NO: 3700026 - RNA, 16 nt, Salmonella enterica enterica serovar Typhi Ty2
cagccccagcgccagc

SEQ ID NO: 3700027 - RNA, 20 nt, Salmonella enterica enterica serovar Typhi Ty2
cagccccugaaauaacagac

SEQ ID NO: 3700028 - RNA, 17 nt, Salmonella enterica enterica serovar Typhi Ty2
cagccccuucgcugucc

SEQ ID NO: 3700029 - RNA, 22 nt, Salmonella enterica enterica serovar Typhi Ty2
cagcccgacuaccggcaccagc

SEQ ID NO: 3700030 - RNA, 16 nt, Salmonella enterica enterica serovar Typhi Ty2
cagcccgauacccgcc

SEQ ID NO: 3700031 - RNA, 16 nt, Salmonella enterica enterica serovar Typhi Ty2
cagcccgaucaucucc

SEQ ID NO: 3700032 - RNA, 19 nt, Salmonella enterica enterica serovar Typhi Ty2
cagcccgaucaucuccugu

SEQ ID NO: 3700033 - RNA, 20 nt, Salmonella enterica enterica serovar Typhi Ty2
cagcccgaucaucuccugua

SEQ ID NO: 3700034 - RNA, 20 nt, Salmonella enterica enterica serovar Typhi Ty2
cagcccgccagcaccaggcu

SEQ ID NO: 3700035 - RNA, 14 nt, Salmonella enterica enterica serovar Typhi Ty2
cagcccgccgcccu

SEQ ID NO: 3700036 - RNA, 19 nt, Salmonella enterica enterica serovar Typhi Ty2
cagcccguagauaagcgcc

SEQ ID NO: 3700037 - RNA, 23 nt, Salmonella enterica enterica serovar Typhi Ty2
cagcccgucggcgucugcgcgcu

SEQ ID NO: 3700038 - RNA, 21 nt, Salmonella enterica enterica serovar Typhi Ty2
cagcccguucugugcgccgcu

SEQ ID NO: 3700039 - RNA, 23 nt, Salmonella enterica enterica serovar Typhi Ty2
cagcccuaucgcugcgcugcggu

SEQ ID NO: 3700040 - RNA, 20 nt, Salmonella enterica enterica serovar Typhi Ty2
cagcccucgguacugcgggu

SEQ ID NO: 3700041 - RNA, 17 nt, Salmonella enterica enterica serovar Typhi Ty2
cagcgauugcgccagac

SEQ ID NO: 3700042 - RNA, 22 nt, Salmonella enterica enterica serovar Typhi Ty2
cagcgcaaacaacccggcugcc

SEQ ID NO: 3700043 - RNA, 22 nt, Salmonella enterica enterica serovar Typhi Ty2
cagcgcaaacgacgcugacuca

SEQ ID NO: 3700044 - RNA, 20 nt, Salmonella enterica enterica serovar Typhi Ty2
cagcgcaaaguuuucuuccg

SEQ ID NO: 3700045 - RNA, 12 nt, Salmonella enterica enterica serovar Typhi Ty2
cagcgcaacgcg

SEQ ID NO: 3700046 - RNA, 17 nt, Salmonella enterica enterica serovar Typhi Ty2
cagcgcaacgcgcauca

SEQ ID NO: 3700047 - RNA, 16 nt, Salmonella enterica enterica serovar Typhi Ty2
cagcgcaaucugcucg

SEQ ID NO: 3700048 - RNA, 17 nt, Salmonella enterica enterica serovar Typhi Ty2
cagcgcaaucugcucga

SEQ ID NO: 3700049 - RNA, 17 nt, Salmonella enterica enterica serovar Typhi Ty2
cagcgcaccuucaacag

SEQ ID NO: 3700050 - RNA, 13 nt, Salmonella enterica enterica serovar Typhi Ty2
cagcgcagcaacg

SEQ ID NO: 3700051 - RNA, 21 nt, Salmonella enterica enterica serovar Typhi Ty2
cagcgcagucaaaacgacaua

SEQ ID NO: 3700052 - RNA, 15 nt, Salmonella enterica enterica serovar Typhi Ty2
cagcgcaguuuccau

SEQ ID NO: 3700053 - RNA, 18 nt, Salmonella enterica enterica serovar Typhi Ty2
cagcgcaguuuccaucgc

SEQ ID NO: 3700054 - RNA, 16 nt, Salmonella enterica enterica serovar Typhi Ty2
cagcgcauaccggcca

SEQ ID NO: 3700055 - RNA, 21 nt, Salmonella enterica enterica serovar Typhi Ty2
cagcgcaucucccugccagug

SEQ ID NO: 3700056 - RNA, 23 nt, Salmonella enterica enterica serovar Typhi Ty2
cagcgcauugccuuucgcgcgau

SEQ ID NO: 3700057 - RNA, 17 nt, Salmonella enterica enterica serovar Typhi Ty2
cagcgcauuuuucuuca

SEQ ID NO: 3700058 - RNA, 16 nt, Salmonella enterica enterica serovar Typhi Ty2
cagcgccaacgccacu

SEQ ID NO: 3700059 - RNA, 19 nt, Salmonella enterica enterica serovar Typhi Ty2
cagcgccaccaaagccagg

SEQ ID NO: 3700060 - RNA, 11 nt, Salmonella enterica enterica serovar Typhi Ty2
cagcgccaccg

SEQ ID NO: 3700061 - RNA, 21 nt, Salmonella enterica enterica serovar Typhi Ty2
cagcgccacggagcauaauuu

SEQ ID NO: 3700062 - RNA, 17 nt, Salmonella enterica enterica serovar Typhi Ty2
cagcgccagauagucac

SEQ ID NO: 3700063 - RNA, 14 nt, Salmonella enterica enterica serovar Typhi Ty2
cagcgccagcagca

SEQ ID NO: 3700064 - RNA, 13 nt, Salmonella enterica enterica serovar Typhi Ty2
cagcgccagccgc

SEQ ID NO: 3700065 - RNA, 14 nt, Salmonella enterica enterica serovar Typhi Ty2
cagcgccagccgcg

SEQ ID NO: 3700066 - RNA, 13 nt, Salmonella enterica enterica serovar Typhi Ty2
cagcgccagcgac

SEQ ID NO: 3700067 - RNA, 17 nt, Salmonella enterica enterica serovar Typhi Ty2
cagcgccagcggcggcu

SEQ ID NO: 3700068 - RNA, 19 nt, Salmonella enterica enterica serovar Typhi Ty2
cagcgccagcgugcgcagc

SEQ ID NO: 3700069 - RNA, 15 nt, Salmonella enterica enterica serovar Typhi Ty2
cagcgccagcuccau

SEQ ID NO: 3700070 - RNA, 14 nt, Salmonella enterica enterica serovar Typhi Ty2
cagcgccaggccau

SEQ ID NO: 3700071 - RNA, 22 nt, Salmonella enterica enterica serovar Typhi Ty2
cagcgccauauaaauuucaucc

SEQ ID NO: 3700072 - RNA, 16 nt, Salmonella enterica enterica serovar Typhi Ty2
cagcgccaucaggcau

SEQ ID NO: 3700073 - RNA, 22 nt, Salmonella enterica enterica serovar Typhi Ty2
cagcgccauccacggccccggg

SEQ ID NO: 3700074 - RNA, 19 nt, Salmonella enterica enterica serovar Typhi Ty2
cagcgccauccggcaaaau

SEQ ID NO: 3700075 - RNA, 12 nt, Salmonella enterica enterica serovar Typhi Ty2
cagcgccaugaa

SEQ ID NO: 3700076 - RNA, 20 nt, Salmonella enterica enterica serovar Typhi Ty2
cagcgccauugcuaggaaca

SEQ ID NO: 3700077 - RNA, 20 nt, Salmonella enterica enterica serovar Typhi Ty2
cagcgcccacaccauaccgc

SEQ ID NO: 3700078 - RNA, 15 nt, Salmonella enterica enterica serovar Typhi Ty2
cagcgcccagcagcu

SEQ ID NO: 3700079 - RNA, 15 nt, Salmonella enterica enterica serovar Typhi Ty2
cagcgcccccagcaa

SEQ ID NO: 3700080 - RNA, 14 nt, Salmonella enterica enterica serovar Typhi Ty2
cagcgccccgccgc

SEQ ID NO: 3700081 - RNA, 20 nt, Salmonella enterica enterica serovar Typhi Ty2
cagcgcccgauaaaucgcau

SEQ ID NO: 3700082 - RNA, 14 nt, Salmonella enterica enterica serovar Typhi Ty2
cagcgcccgcuuca

SEQ ID NO: 3700083 - RNA, 13 nt, Salmonella enterica enterica serovar Typhi Ty2
cagcgccgccaga

SEQ ID NO: 3700084 - RNA, 18 nt, Salmonella enterica enterica serovar Typhi Ty2
cagcgccgcgaaugugcc

SEQ ID NO: 3700085 - RNA, 15 nt, Salmonella enterica enterica serovar Typhi Ty2
cagcgccgcgcaagc

SEQ ID NO: 3700086 - RNA, 14 nt, Salmonella enterica enterica serovar Typhi Ty2
cagcgccgcgccga

SEQ ID NO: 3700087 - RNA, 13 nt, Salmonella enterica enterica serovar Typhi Ty2
cagcgccgcgcga

SEQ ID NO: 3700088 - RNA, 21 nt, Salmonella enterica enterica serovar Typhi Ty2
cagcgccggaucgggcuucca

SEQ ID NO: 3700089 - RNA, 16 nt, Salmonella enterica enterica serovar Typhi Ty2
cagcgccggcagcagu

SEQ ID NO: 3700090 - RNA, 17 nt, Salmonella enterica enterica serovar Typhi Ty2
cagcgccguagcggcag

SEQ ID NO: 3700091 - RNA, 19 nt, Salmonella enterica enterica serovar Typhi Ty2
cagcgccguagcggcaggg

SEQ ID NO: 3700092 - RNA, 19 nt, Salmonella enterica enterica serovar Typhi Ty2
cagcgccgucauaccgccc

SEQ ID NO: 3700093 - RNA, 22 nt, Salmonella enterica enterica serovar Typhi Ty2
cagcgccuccgcguagcccagc

SEQ ID NO: 3700094 - RNA, 14 nt, Salmonella enterica enterica serovar Typhi Ty2
cagcgccugaaugu

SEQ ID NO: 3700095 - RNA, 13 nt, Salmonella enterica enterica serovar Typhi Ty2
cagcgccugcgcu

SEQ ID NO: 3700096 - RNA, 15 nt, Salmonella enterica enterica serovar Typhi Ty2
cagcgccuguugauu

SEQ ID NO: 3700097 - RNA, 22 nt, Salmonella enterica enterica serovar Typhi Ty2
cagcgcgaauuugccccagaua

SEQ ID NO: 3700098 - RNA, 14 nt, Salmonella enterica enterica serovar Typhi Ty2
cagcgcgacauaga

SEQ ID NO: 3700099 - RNA, 14 nt, Salmonella enterica enterica serovar Typhi Ty2
cagcgcgauacgcg

SEQ ID NO: 3700100 - RNA, 15 nt, Salmonella enterica enterica serovar Typhi Ty2
cagcgcgcaaaaacc

SEQ ID NO: 3700101 - RNA, 21 nt, Salmonella enterica enterica serovar Typhi Ty2
cagcgcgccaauggccgcccc

SEQ ID NO: 3700102 - RNA, 14 nt, Salmonella enterica enterica serovar Typhi Ty2
cagcgcgccagcgc

SEQ ID NO: 3700103 - RNA, 14 nt, Salmonella enterica enterica serovar Typhi Ty2
cagcgcgccgcagc

SEQ ID NO: 3700104 - RNA, 15 nt, Salmonella enterica enterica serovar Typhi Ty2
cagcgcgcgacccag

SEQ ID NO: 3700105 - RNA, 18 nt, Salmonella enterica enterica serovar Typhi Ty2
cagcgcgcgacccagcgc

SEQ ID NO: 3700106 - RNA, 19 nt, Salmonella enterica enterica serovar Typhi Ty2
cagcgcgcgacccagcgca

SEQ ID NO: 3700107 - RNA, 21 nt, Salmonella enterica enterica serovar Typhi Ty2
cagcgcgcgcgacggcagccu

SEQ ID NO: 3700108 - RNA, 19 nt, Salmonella enterica enterica serovar Typhi Ty2
cagcgcgcgcuuucaccgc

SEQ ID NO: 3700109 - RNA, 15 nt, Salmonella enterica enterica serovar Typhi Ty2
cagcgcgcuccagac

SEQ ID NO: 3700110 - RNA, 17 nt, Salmonella enterica enterica serovar Typhi Ty2
cagcgcgcuccagacca

SEQ ID NO: 3700111 - RNA, 19 nt, Salmonella enterica enterica serovar Typhi Ty2
cagcgcggaagccacguuc

SEQ ID NO: 3700112 - RNA, 13 nt, Salmonella enterica enterica serovar Typhi Ty2
cagcgcggcagcc

SEQ ID NO: 3700113 - RNA, 24 nt, Salmonella enterica enterica serovar Typhi Ty2
cagcgcggccugcgugcgccguga

SEQ ID NO: 3700114 - RNA, 18 nt, Salmonella enterica enterica serovar Typhi Ty2
cagcgcgggaucgagcgc

SEQ ID NO: 3700115 - RNA, 20 nt, Salmonella enterica enterica serovar Typhi Ty2
cagcgcgggcgaggccucgu

SEQ ID NO: 3700116 - RNA, 23 nt, Salmonella enterica enterica serovar Typhi Ty2
cagcgcggguucuuuccacaauc

SEQ ID NO: 3700117 - RNA, 20 nt, Salmonella enterica enterica serovar Typhi Ty2
cagcgcguccaauagccccu

SEQ ID NO: 3700118 - RNA, 18 nt, Salmonella enterica enterica serovar Typhi Ty2
cagcgcguccagcccgcu

SEQ ID NO: 3700119 - RNA, 15 nt, Salmonella enterica enterica serovar Typhi Ty2
cagcgcgucggccgg

SEQ ID NO: 3700120 - RNA, 15 nt, Salmonella enterica enterica serovar Typhi Ty2
cagcgcgugaaccgu

SEQ ID NO: 3700121 - RNA, 17 nt, Salmonella enterica enterica serovar Typhi Ty2
cagcgcuaacgcgaaga

SEQ ID NO: 3700122 - RNA, 19 nt, Salmonella enterica enterica serovar Typhi Ty2
cagcgcuaacggcgguacc

SEQ ID NO: 3700123 - RNA, 22 nt, Salmonella enterica enterica serovar Typhi Ty2
cagcucaaccgcgcggcguucu

SEQ ID NO: 3700124 - RNA, 16 nt, Salmonella enterica enterica serovar Typhi Ty2
cagcucaagcgccgcg

SEQ ID NO: 3700125 - RNA, 17 nt, Salmonella enterica enterica serovar Typhi Ty2
cagcucacgcgccagca

SEQ ID NO: 3700126 - RNA, 20 nt, Salmonella enterica enterica serovar Typhi Ty2
cagcucacgcgccagcacca

SEQ ID NO: 3700127 - RNA, 19 nt, Salmonella enterica enterica serovar Typhi Ty2
cagcucagaaauaaaacca

SEQ ID NO: 3700128 - RNA, 19 nt, Salmonella enterica enterica serovar Typhi Ty2
cagcucagcuuuaaugcuu

SEQ ID NO: 3700129 - RNA, 17 nt, Salmonella enterica enterica serovar Typhi Ty2
cagcucauacccuucca

SEQ ID NO: 3700130 - RNA, 20 nt, Salmonella enterica enterica serovar Typhi Ty2
cagcucauacccuuccaguu

SEQ ID NO: 3700131 - RNA, 20 nt, Salmonella enterica enterica serovar Typhi Ty2
cagcuccagccgcugccuuc

SEQ ID NO: 3700132 - RNA, 23 nt, Salmonella enterica enterica serovar Typhi Ty2
cagcuccagcucaggguccccau

SEQ ID NO: 3700133 - RNA, 15 nt, Salmonella enterica enterica serovar Typhi Ty2
cagcuccauccacca

SEQ ID NO: 3700134 - RNA, 20 nt, Salmonella enterica enterica serovar Typhi Ty2
cagcuccauccaccagcccc

SEQ ID NO: 3700135 - RNA, 13 nt, Salmonella enterica enterica serovar Typhi Ty2
cagcuccaugucu

SEQ ID NO: 3700136 - RNA, 14 nt, Salmonella enterica enterica serovar Typhi Ty2
cagcucccgcguca

SEQ ID NO: 3700137 - RNA, 18 nt, Salmonella enterica enterica serovar Typhi Ty2
cagcucccgcgucacgac

SEQ ID NO: 3700138 - RNA, 18 nt, Salmonella enterica enterica serovar Typhi Ty2
cagcuccuuuuaauaaag

SEQ ID NO: 3700139 - RNA, 18 nt, Salmonella enterica enterica serovar Typhi Ty2
cagcucggcaaagcccau

SEQ ID NO: 3700140 - RNA, 22 nt, Salmonella enterica enterica serovar Typhi Ty2
cagcucugccgguugaccggcc

SEQ ID NO: 3700141 - RNA, 22 nt, Salmonella enterica enterica serovar Typhi Ty2
cagcucugccuguagcagcgcc

SEQ ID NO: 3700142 - RNA, 14 nt, Salmonella enterica enterica serovar Typhi Ty2
cagcucuucaggcg

SEQ ID NO: 3700143 - RNA, 21 nt, Salmonella enterica enterica serovar Typhi Ty2
cagcugacgcagcaguucccc

SEQ ID NO: 3700144 - RNA, 15 nt, Salmonella enterica enterica serovar Typhi Ty2
cagcugcgucagcgc

SEQ ID NO: 3700145 - RNA, 12 nt, Salmonella enterica enterica serovar Typhi Ty2
cagcuggcgaua

SEQ ID NO: 3700146 - RNA, 18 nt, Salmonella enterica enterica serovar Typhi Ty2
cagcuggcgauauccgug

SEQ ID NO: 3700147 - RNA, 22 nt, Salmonella enterica enterica serovar Typhi Ty2
cagcuggcgauauccgugccgc

SEQ ID NO: 3700148 - RNA, 18 nt, Salmonella enterica enterica serovar Typhi Ty2
cagcugggccugcuccgu

SEQ ID NO: 3700149 - RNA, 17 nt, Salmonella enterica enterica serovar Typhi Ty2
cagcugggucgcgcuuu

SEQ ID NO: 3700150 - RNA, 21 nt, Salmonella enterica enterica serovar Typhi Ty2
cagcuguuuaagcgccuccac

SEQ ID NO: 3700151 - RNA, 16 nt, Salmonella enterica enterica serovar Typhi Ty2
cagcuuaaaucgcggc

SEQ ID NO: 3700152 - RNA, 18 nt, Salmonella enterica enterica serovar Typhi Ty2
cagcuuaaucaccagcgc

SEQ ID NO: 3700153 - RNA, 14 nt, Salmonella enterica enterica serovar Typhi Ty2
cagcuuaccccugu

SEQ ID NO: 3700154 - RNA, 16 nt, Salmonella enterica enterica serovar Typhi Ty2
cagcuuaucuuuuucg

SEQ ID NO: 3700155 - RNA, 18 nt, Salmonella enterica enterica serovar Typhi Ty2
cagcuuauuccagucauu

SEQ ID NO: 3700156 - RNA, 16 nt, Salmonella enterica enterica serovar Typhi Ty2
cagcuuauucgucguu

SEQ ID NO: 3700157 - RNA, 19 nt, Salmonella enterica enterica serovar Typhi Ty2
cagcuucaggcucaucagc

SEQ ID NO: 3700158 - RNA, 21 nt, Salmonella enterica enterica serovar Typhi Ty2
cagcuuccugcacgccugcuu

SEQ ID NO: 3700159 - RNA, 20 nt, Salmonella enterica enterica serovar Typhi Ty2
cagcuucgcugcgcgggcgu

SEQ ID NO: 3700160 - RNA, 22 nt, Salmonella enterica enterica serovar Typhi Ty2
cagcuucgcugcgcgggcgucu

SEQ ID NO: 3700161 - RNA, 17 nt, Salmonella enterica enterica serovar Typhi Ty2
cagcuucgguccggcgc

SEQ ID NO: 3700162 - RNA, 14 nt, Salmonella enterica enterica serovar Typhi Ty2
cagcuucugauacu

SEQ ID NO: 3700163 - RNA, 16 nt, Salmonella enterica enterica serovar Typhi Ty2
cagcuucugucagccu

SEQ ID NO: 3700164 - RNA, 18 nt, Salmonella enterica enterica serovar Typhi Ty2
cagcuugaucaucagggc

SEQ ID NO: 3700165 - RNA, 14 nt, Salmonella enterica enterica serovar Typhi Ty2
cagcuugcaggcaa

SEQ ID NO: 3700166 - RNA, 15 nt, Salmonella enterica enterica serovar Typhi Ty2
cagcuugcuggccgc

SEQ ID NO: 3700167 - RNA, 21 nt, Salmonella enterica enterica serovar Typhi Ty2
cagcuuguagaaaggcagcga

SEQ ID NO: 3700168 - RNA, 14 nt, Salmonella enterica enterica serovar Typhi Ty2
cagcuuguuuacgc

SEQ ID NO: 3700169 - RNA, 19 nt, Salmonella enterica enterica serovar Typhi Ty2
cagcuuuucauuuguuccu

SEQ ID NO: 3700170 - RNA, 15 nt, Salmonella enterica enterica serovar Typhi Ty2
cagcuuuugcgcguu

SEQ ID NO: 3700171 - RNA, 13 nt, Salmonella enterica enterica serovar Typhi Ty2
caggaaaaacaug

SEQ ID NO: 3700172 - RNA, 21 nt, Salmonella enterica enterica serovar Typhi Ty2
caggaaaccgguaaaggcgac

SEQ ID NO: 3700173 - RNA, 16 nt, Salmonella enterica enterica serovar Typhi Ty2
caggaaagagccgcgc

SEQ ID NO: 3700174 - RNA, 20 nt, Salmonella enterica enterica serovar Typhi Ty2
caggaaauccagcagaauaa

SEQ ID NO: 3700175 - RNA, 14 nt, Salmonella enterica enterica serovar Typhi Ty2
caggaaaucuucca

SEQ ID NO: 3700176 - RNA, 16 nt, Salmonella enterica enterica serovar Typhi Ty2
caggaacagauacugg

SEQ ID NO: 3700177 - RNA, 15 nt, Salmonella enterica enterica serovar Typhi Ty2
caggaaccgccgaug

SEQ ID NO: 3700178 - RNA, 18 nt, Salmonella enterica enterica serovar Typhi Ty2
caggaacgcggcgccgaa

SEQ ID NO: 3700179 - RNA, 19 nt, Salmonella enterica enterica serovar Typhi Ty2
caggaacugcggccagaca

SEQ ID NO: 3700180 - RNA, 20 nt, Salmonella enterica enterica serovar Typhi Ty2
caggaagaacacgccgccua

SEQ ID NO: 3700181 - RNA, 15 nt, Salmonella enterica enterica serovar Typhi Ty2
caggaagaguaucuc

SEQ ID NO: 3700182 - RNA, 16 nt, Salmonella enterica enterica serovar Typhi Ty2
caggaagccgguguac

SEQ ID NO: 3700183 - RNA, 13 nt, Salmonella enterica enterica serovar Typhi Ty2
caggaagggcagc

SEQ ID NO: 3700184 - RNA, 14 nt, Salmonella enterica enterica serovar Typhi Ty2
caggaagucagcuu

SEQ ID NO: 3700185 - RNA, 20 nt, Salmonella enterica enterica serovar Typhi Ty2
caggaauaacaucguaaauc

SEQ ID NO: 3700186 - RNA, 22 nt, Salmonella enterica enterica serovar Typhi Ty2
caggaaucgcguuaauuuuccc

SEQ ID NO: 3700187 - RNA, 14 nt, Salmonella enterica enterica serovar Typhi Ty2
caggaaugcggcca

SEQ ID NO: 3700188 - RNA, 22 nt, Salmonella enterica enterica serovar Typhi Ty2
caggaaugcggccauccugcgu

SEQ ID NO: 3700189 - RNA, 13 nt, Salmonella enterica enterica serovar Typhi Ty2
caggacaaccccu

SEQ ID NO: 3700190 - RNA, 17 nt, Salmonella enterica enterica serovar Typhi Ty2
caggacaucaaaggcag

SEQ ID NO: 3700191 - RNA, 19 nt, Salmonella enterica enterica serovar Typhi Ty2
caggacauggucaccauga

SEQ ID NO: 3700192 - RNA, 20 nt, Salmonella enterica enterica serovar Typhi Ty2
caggacauggucaccaugac

SEQ ID NO: 3700193 - RNA, 19 nt, Salmonella enterica enterica serovar Typhi Ty2
caggaccaaaacaguacug

SEQ ID NO: 3700194 - RNA, 18 nt, Salmonella enterica enterica serovar Typhi Ty2
caggacgagagacugaua

SEQ ID NO: 3700195 - RNA, 19 nt, Salmonella enterica enterica serovar Typhi Ty2
caggacgagagacugauaa

SEQ ID NO: 3700196 - RNA, 12 nt, Salmonella enterica enterica serovar Typhi Ty2
caggacgccagc

SEQ ID NO: 3700197 - RNA, 12 nt, Salmonella enterica enterica serovar Typhi Ty2
caggacgccagu

SEQ ID NO: 3700198 - RNA, 17 nt, Salmonella enterica enterica serovar Typhi Ty2
caggacgccagugaaag

SEQ ID NO: 3700199 - RNA, 15 nt, Salmonella enterica enterica serovar Typhi Ty2
caggacgcuccauca

SEQ ID NO: 3700200 - RNA, 17 nt, Salmonella enterica enterica serovar Typhi Ty2
caggacgguggucaucu

SEQ ID NO: 3700201 - RNA, 22 nt, Salmonella enterica enterica serovar Typhi Ty2
caggacgguggucaucugguca

SEQ ID NO: 3700202 - RNA, 16 nt, Salmonella enterica enterica serovar Typhi Ty2
caggacugacugcugu

SEQ ID NO: 3700203 - RNA, 14 nt, Salmonella enterica enterica serovar Typhi Ty2
caggagacuauucg

SEQ ID NO: 3700204 - RNA, 12 nt, Salmonella enterica enterica serovar Typhi Ty2
caggagcauggu

SEQ ID NO: 3700205 - RNA, 15 nt, Salmonella enterica enterica serovar Typhi Ty2
caggccggauaagag

SEQ ID NO: 3700206 - RNA, 18 nt, Salmonella enterica enterica serovar Typhi Ty2
caggccggauaaggcagc

SEQ ID NO: 3700207 - RNA, 21 nt, Salmonella enterica enterica serovar Typhi Ty2
caggccggauaaggcagcaau

SEQ ID NO: 3700208 - RNA, 22 nt, Salmonella enterica enterica serovar Typhi Ty2
caggccggauggcggcuuugaa

SEQ ID NO: 3700209 - RNA, 20 nt, Salmonella enterica enterica serovar Typhi Ty2
caggccuacacguucgcuua

SEQ ID NO: 3700210 - RNA, 16 nt, Salmonella enterica enterica serovar Typhi Ty2
caggccuccugacgaa

SEQ ID NO: 3700211 - RNA, 18 nt, Salmonella enterica enterica serovar Typhi Ty2
caggccucugcuuuucuc

SEQ ID NO: 3700212 - RNA, 16 nt, Salmonella enterica enterica serovar Typhi Ty2
caggccugagccgaac

SEQ ID NO: 3700213 - RNA, 20 nt, Salmonella enterica enterica serovar Typhi Ty2
caggccugauaagcacaggc

SEQ ID NO: 3700214 - RNA, 22 nt, Salmonella enterica enterica serovar Typhi Ty2
caggccugauaagcacaggcca

SEQ ID NO: 3700215 - RNA, 19 nt, Salmonella enterica enterica serovar Typhi Ty2
caggccugaugagcgcagc

SEQ ID NO: 3700216 - RNA, 21 nt, Salmonella enterica enterica serovar Typhi Ty2
caggccugcauuugcuggcgu

SEQ ID NO: 3700217 - RNA, 15 nt, Salmonella enterica enterica serovar Typhi Ty2
caggccugcggaaaa

SEQ ID NO: 3700218 - RNA, 17 nt, Salmonella enterica enterica serovar Typhi Ty2
caggccugguuaacaau

SEQ ID NO: 3700219 - RNA, 16 nt, Salmonella enterica enterica serovar Typhi Ty2
caggccuguaaaccgc

SEQ ID NO: 3700220 - RNA, 18 nt, Salmonella enterica enterica serovar Typhi Ty2
caggcgaauagcgcgcua

SEQ ID NO: 3700221 - RNA, 17 nt, Salmonella enterica enterica serovar Typhi Ty2
caggcgaccagaugcag

SEQ ID NO: 3700222 - RNA, 16 nt, Salmonella enterica enterica serovar Typhi Ty2
caggcgaccgggcaga

SEQ ID NO: 3700223 - RNA, 13 nt, Salmonella enterica enterica serovar Typhi Ty2
caggcgacgccgc

SEQ ID NO: 3700224 - RNA, 16 nt, Salmonella enterica enterica serovar Typhi Ty2
caggcgacgccgccau

SEQ ID NO: 3700225 - RNA, 17 nt, Salmonella enterica enterica serovar Typhi Ty2
caggcgacgccgccauc

SEQ ID NO: 3700226 - RNA, 20 nt, Salmonella enterica enterica serovar Typhi Ty2
caggcgauagccguccaugu

SEQ ID NO: 3700227 - RNA, 18 nt, Salmonella enterica enterica serovar Typhi Ty2
caggcgauccuguucaaa

SEQ ID NO: 3700228 - RNA, 19 nt, Salmonella enterica enterica serovar Typhi Ty2
caggcgauucggacucaua

SEQ ID NO: 3700229 - RNA, 14 nt, Salmonella enterica enterica serovar Typhi Ty2
caggcgcaggcauu

SEQ ID NO: 3700230 - RNA, 16 nt, Salmonella enterica enterica serovar Typhi Ty2
caggcgcaucagaaaa

SEQ ID NO: 3700231 - RNA, 22 nt, Salmonella enterica enterica serovar Typhi Ty2
caggcgcgaaucgacaauccgc

SEQ ID NO: 3700232 - RNA, 22 nt, Salmonella enterica enterica serovar Typhi Ty2
caggcgcgaccucaucaaacag

SEQ ID NO: 3700233 - RNA, 14 nt, Salmonella enterica enterica serovar Typhi Ty2
caggcgcggcgcgu

SEQ ID NO: 3700234 - RNA, 22 nt, Salmonella enterica enterica serovar Typhi Ty2
caggcgcuaucuucaauacgaa

SEQ ID NO: 3700235 - RNA, 19 nt, Salmonella enterica enterica serovar Typhi Ty2
caggcgcuauucccaggca

SEQ ID NO: 3700236 - RNA, 19 nt, Salmonella enterica enterica serovar Typhi Ty2
caggcgcuuaucgccguaa

SEQ ID NO: 3700237 - RNA, 17 nt, Salmonella enterica enterica serovar Typhi Ty2
caggcggaugaaacagu

SEQ ID NO: 3700238 - RNA, 16 nt, Salmonella enterica enterica serovar Typhi Ty2
caggcggcaaaaaacg

SEQ ID NO: 3700239 - RNA, 17 nt, Salmonella enterica enterica serovar Typhi Ty2
caggcggcauggguaaa

SEQ ID NO: 3700240 - RNA, 18 nt, Salmonella enterica enterica serovar Typhi Ty2
caggcggcguuauacgcc

SEQ ID NO: 3700241 - RNA, 19 nt, Salmonella enterica enterica serovar Typhi Ty2
caggcggcuuuuucaucau

SEQ ID NO: 3700242 - RNA, 16 nt, Salmonella enterica enterica serovar Typhi Ty2
caggcggggaggguca

SEQ ID NO: 3700243 - RNA, 21 nt, Salmonella enterica enterica serovar Typhi Ty2
caggcggggagggucagcagg

SEQ ID NO: 3700244 - RNA, 23 nt, Salmonella enterica enterica serovar Typhi Ty2
caggcggguggugagcucaucca

SEQ ID NO: 3700245 - RNA, 17 nt, Salmonella enterica enterica serovar Typhi Ty2
caggcguaagaucccag

SEQ ID NO: 3700246 - RNA, 17 nt, Salmonella enterica enterica serovar Typhi Ty2
caggcguagagaggcau

SEQ ID NO: 3700247 - RNA, 20 nt, Salmonella enterica enterica serovar Typhi Ty2
caggcgucagcauggugugu

SEQ ID NO: 3700248 - RNA, 18 nt, Salmonella enterica enterica serovar Typhi Ty2
caggcgucauagccgcgc

SEQ ID NO: 3700249 - RNA, 17 nt, Salmonella enterica enterica serovar Typhi Ty2
caggcgugauugagcag

SEQ ID NO: 3700250 - RNA, 20 nt, Salmonella enterica enterica serovar Typhi Ty2
caggcgugccccgcaacgcc

SEQ ID NO: 3700251 - RNA, 20 nt, Salmonella enterica enterica serovar Typhi Ty2
caggcguguggccagggcag

SEQ ID NO: 3700252 - RNA, 15 nt, Salmonella enterica enterica serovar Typhi Ty2
caggcguuacagacg

SEQ ID NO: 3700253 - RNA, 16 nt, Salmonella enterica enterica serovar Typhi Ty2
caggcguuagccgcca

SEQ ID NO: 3700254 - RNA, 15 nt, Salmonella enterica enterica serovar Typhi Ty2
caggcguugugcaga

SEQ ID NO: 3700255 - RNA, 22 nt, Salmonella enterica enterica serovar Typhi Ty2
caggcuaaagugcgucuggcga

SEQ ID NO: 3700256 - RNA, 15 nt, Salmonella enterica enterica serovar Typhi Ty2
caggcuaaggcgucg

SEQ ID NO: 3700257 - RNA, 14 nt, Salmonella enterica enterica serovar Typhi Ty2
caggcuaccccccc

SEQ ID NO: 3700258 - RNA, 19 nt, Salmonella enterica enterica serovar Typhi Ty2
caggcucaggaaaacaaau

SEQ ID NO: 3700259 - RNA, 17 nt, Salmonella enterica enterica serovar Typhi Ty2
caggcuccaaguauuga

SEQ ID NO: 3700260 - RNA, 22 nt, Salmonella enterica enterica serovar Typhi Ty2
caggcuccgcgcagggugaaga

SEQ ID NO: 3700261 - RNA, 17 nt, Salmonella enterica enterica serovar Typhi Ty2
caggcucucgguggugg

SEQ ID NO: 3700262 - RNA, 13 nt, Salmonella enterica enterica serovar Typhi Ty2
caggcugaacccu

SEQ ID NO: 3700263 - RNA, 19 nt, Salmonella enterica enterica serovar Typhi Ty2
caggcugaacccugccugc

SEQ ID NO: 3700264 - RNA, 23 nt, Salmonella enterica enterica serovar Typhi Ty2
caggcugagcguagaccgcccag

SEQ ID NO: 3700265 - RNA, 15 nt, Salmonella enterica enterica serovar Typhi Ty2
caggcugccaaccag

SEQ ID NO: 3700266 - RNA, 12 nt, Salmonella enterica enterica serovar Typhi Ty2
caggcuggaaau

SEQ ID NO: 3700267 - RNA, 15 nt, Salmonella enterica enterica serovar Typhi Ty2
caggcuggagagcaa

SEQ ID NO: 3700268 - RNA, 16 nt, Salmonella enterica enterica serovar Typhi Ty2
caggcugggcgauaaa

SEQ ID NO: 3700269 - RNA, 22 nt, Salmonella enterica enterica serovar Typhi Ty2
caggcugggcgauaaaccgcug

SEQ ID NO: 3700270 - RNA, 14 nt, Salmonella enterica enterica serovar Typhi Ty2
caggcugucugcca

SEQ ID NO: 3700271 - RNA, 14 nt, Salmonella enterica enterica serovar Typhi Ty2
caggcugugcaaca

SEQ ID NO: 3700272 - RNA, 23 nt, Salmonella enterica enterica serovar Typhi Ty2
caggcuguugaggaaauucugac

SEQ ID NO: 3700273 - RNA, 15 nt, Salmonella enterica enterica serovar Typhi Ty2
caggcuguugcgcau

SEQ ID NO: 3700274 - RNA, 17 nt, Salmonella enterica enterica serovar Typhi Ty2
caggcuuaacacccgga

SEQ ID NO: 3700275 - RNA, 18 nt, Salmonella enterica enterica serovar Typhi Ty2
caggcuucaucggauaga

SEQ ID NO: 3700276 - RNA, 21 nt, Salmonella enterica enterica serovar Typhi Ty2
caggcuucaucggauagauga

SEQ ID NO: 3700277 - RNA, 18 nt, Salmonella enterica enterica serovar Typhi Ty2
caggcuucccaauacggc

SEQ ID NO: 3700278 - RNA, 18 nt, Salmonella enterica enterica serovar Typhi Ty2
caggcuucgcgcagccag

SEQ ID NO: 3700279 - RNA, 18 nt, Salmonella enterica enterica serovar Typhi Ty2
caggcuuuaaauucagca

SEQ ID NO: 3700280 - RNA, 16 nt, Salmonella enterica enterica serovar Typhi Ty2
caggcuuuccacguuc

SEQ ID NO: 3700281 - RNA, 20 nt, Salmonella enterica enterica serovar Typhi Ty2
cagggaaaagaaguggacuu

SEQ ID NO: 3700282 - RNA, 23 nt, Salmonella enterica enterica serovar Typhi Ty2
cagggaaaagaaguggacuucca

SEQ ID NO: 3700283 - RNA, 14 nt, Salmonella enterica enterica serovar Typhi Ty2
cagggaaagccagu

SEQ ID NO: 3700284 - RNA, 13 nt, Salmonella enterica enterica serovar Typhi Ty2
cagggaaucagcg

SEQ ID NO: 3700285 - RNA, 20 nt, Salmonella enterica enterica serovar Typhi Ty2
cagggacgauaggcgcguca

SEQ ID NO: 3700286 - RNA, 17 nt, Salmonella enterica enterica serovar Typhi Ty2
cagggacuauaggcaau

SEQ ID NO: 3700287 - RNA, 22 nt, Salmonella enterica enterica serovar Typhi Ty2
cagguggauuuuugcugguugu

SEQ ID NO: 3700288 - RNA, 18 nt, Salmonella enterica enterica serovar Typhi Ty2
cagguguacuguuccgga

SEQ ID NO: 3700289 - RNA, 18 nt, Salmonella enterica enterica serovar Typhi Ty2
cagguguuaaucauuuuc

SEQ ID NO: 3700290 - RNA, 17 nt, Salmonella enterica enterica serovar Typhi Ty2
cagguuaaagccucuuu

SEQ ID NO: 3700291 - RNA, 12 nt, Salmonella enterica enterica serovar Typhi Ty2
cagguuaacucc

SEQ ID NO: 3700292 - RNA, 15 nt, Salmonella enterica enterica serovar Typhi Ty2
cagguuaaucagcac

SEQ ID NO: 3700293 - RNA, 15 nt, Salmonella enterica enterica serovar Typhi Ty2
cagguuacucuucca

SEQ ID NO: 3700294 - RNA, 13 nt, Salmonella enterica enterica serovar Typhi Ty2
cagguuagcagcc

SEQ ID NO: 3700295 - RNA, 15 nt, Salmonella enterica enterica serovar Typhi Ty2
cagguuauacuguga

SEQ ID NO: 3700296 - RNA, 20 nt, Salmonella enterica enterica serovar Typhi Ty2
cagguuccccaaugaucaau

SEQ ID NO: 3700297 - RNA, 15 nt, Salmonella enterica enterica serovar Typhi Ty2
cagguucgaaucccg

SEQ ID NO: 3700298 - RNA, 18 nt, Salmonella enterica enterica serovar Typhi Ty2
cagguugccagaaacaac

SEQ ID NO: 3700299 - RNA, 21 nt, Salmonella enterica enterica serovar Typhi Ty2
cagguugccgaugacucccag

SEQ ID NO: 3700300 - RNA, 19 nt, Salmonella enterica enterica serovar Typhi Ty2
cagguugcguaacgccaca

SEQ ID NO: 3700301 - RNA, 16 nt, Salmonella enterica enterica serovar Typhi Ty2
cagguugcguccgccg

SEQ ID NO: 3700302 - RNA, 18 nt, Salmonella enterica enterica serovar Typhi Ty2
cagguugcguccgccgcu

SEQ ID NO: 3700303 - RNA, 16 nt, Salmonella enterica enterica serovar Typhi Ty2
cagguugugcaucucc

SEQ ID NO: 3700304 - RNA, 19 nt, Salmonella enterica enterica serovar Typhi Ty2
cagguuuaaacgaacgaga

SEQ ID NO: 3700305 - RNA, 21 nt, Salmonella enterica enterica serovar Typhi Ty2
cagguuuacccugauuuucaa

SEQ ID NO: 3700306 - RNA, 17 nt, Salmonella enterica enterica serovar Typhi Ty2
cagguuuacguagcagc

SEQ ID NO: 3700307 - RNA, 22 nt, Salmonella enterica enterica serovar Typhi Ty2
cagguuuacguagcagcgcgcg

SEQ ID NO: 3700308 - RNA, 13 nt, Salmonella enterica enterica serovar Typhi Ty2
cagguuucaucgc

SEQ ID NO: 3700309 - RNA, 23 nt, Salmonella enterica enterica serovar Typhi Ty2
cagguuucaucgccgauuccugc

SEQ ID NO: 3700310 - RNA, 13 nt, Salmonella enterica enterica serovar Typhi Ty2
cagguuuuacuuc

SEQ ID NO: 3700311 - RNA, 15 nt, Salmonella enterica enterica serovar Typhi Ty2
cagguuuuuaagcug

SEQ ID NO: 3700312 - RNA, 17 nt, Salmonella enterica enterica serovar Typhi Ty2
cagguuuuuaagcugcc

SEQ ID NO: 3700313 - RNA, 22 nt, Salmonella enterica enterica serovar Typhi Ty2
cagguuuuuugugaguucauaa

SEQ ID NO: 3700314 - RNA, 13 nt, Salmonella enterica enterica serovar Typhi Ty2
caguaaaaaaacg

SEQ ID NO: 3700315 - RNA, 12 nt, Salmonella enterica enterica serovar Typhi Ty2
caguaaaagccc

SEQ ID NO: 3700316 - RNA, 17 nt, Salmonella enterica enterica serovar Typhi Ty2
caguaaaagcccgccca

SEQ ID NO: 3700317 - RNA, 21 nt, Salmonella enterica enterica serovar Typhi Ty2
caguaaaagcccgcccagcau

SEQ ID NO: 3700318 - RNA, 22 nt, Salmonella enterica enterica serovar Typhi Ty2
caguaaaagcccgcccagcauu

SEQ ID NO: 3700319 - RNA, 22 nt, Salmonella enterica enterica serovar Typhi Ty2
caguaaagauuuguuucaucgc

SEQ ID NO: 3700320 - RNA, 13 nt, Salmonella enterica enterica serovar Typhi Ty2
caguaaaggggag

SEQ ID NO: 3700321 - RNA, 20 nt, Salmonella enterica enterica serovar Typhi Ty2
caguaaaucccgcaucaccc

SEQ ID NO: 3700322 - RNA, 16 nt, Salmonella enterica enterica serovar Typhi Ty2
caguaaauuaaacagc

SEQ ID NO: 3700323 - RNA, 17 nt, Salmonella enterica enterica serovar Typhi Ty2
caguaaauuaaacagcu

SEQ ID NO: 3700324 - RNA, 21 nt, Salmonella enterica enterica serovar Typhi Ty2
caguaacacccgcgccuucgc

SEQ ID NO: 3700325 - RNA, 19 nt, Salmonella enterica enterica serovar Typhi Ty2
caguaacaucgaaugucga

SEQ ID NO: 3700326 - RNA, 16 nt, Salmonella enterica enterica serovar Typhi Ty2
caguaaccgccacagc

SEQ ID NO: 3700327 - RNA, 17 nt, Salmonella enterica enterica serovar Typhi Ty2
caguaaccgccacagca

SEQ ID NO: 3700328 - RNA, 14 nt, Salmonella enterica enterica serovar Typhi Ty2
caguaacguucuuc

SEQ ID NO: 3700329 - RNA, 18 nt, Salmonella enterica enterica serovar Typhi Ty2
caguaacucaucgccagc

SEQ ID NO: 3700330 - RNA, 13 nt, Salmonella enterica enterica serovar Typhi Ty2
caguaacugcaaa

SEQ ID NO: 3700331 - RNA, 13 nt, Salmonella enterica enterica serovar Typhi Ty2
caguaagaucacc

SEQ ID NO: 3700332 - RNA, 20 nt, Salmonella enterica enterica serovar Typhi Ty2
caguaagcgaguccugccau

SEQ ID NO: 3700333 - RNA, 22 nt, Salmonella enterica enterica serovar Typhi Ty2
caguaagcguaccauuccauuc

SEQ ID NO: 3700334 - RNA, 12 nt, Salmonella enterica enterica serovar Typhi Ty2
caguaaggggau

SEQ ID NO: 3700335 - RNA, 22 nt, Salmonella enterica enterica serovar Typhi Ty2
caguaauauaaccaauuuaaaa

SEQ ID NO: 3700336 - RNA, 22 nt, Salmonella enterica enterica serovar Typhi Ty2
caguaaucaccgucuccggcgc

SEQ ID NO: 3700337 - RNA, 22 nt, Salmonella enterica enterica serovar Typhi Ty2
caguaaucccggucgcgccagc

SEQ ID NO: 3700338 - RNA, 15 nt, Salmonella enterica enterica serovar Typhi Ty2
caguaauccggcaac

SEQ ID NO: 3700339 - RNA, 17 nt, Salmonella enterica enterica serovar Typhi Ty2
caguaauccggcaacug

SEQ ID NO: 3700340 - RNA, 16 nt, Salmonella enterica enterica serovar Typhi Ty2
caguaaucgcacggcu

SEQ ID NO: 3700341 - RNA, 23 nt, Salmonella enterica enterica serovar Typhi Ty2
caguaauggacagguaaaccggu

SEQ ID NO: 3700342 - RNA, 18 nt, Salmonella enterica enterica serovar Typhi Ty2
caguaauguccagauuac

SEQ ID NO: 3700343 - RNA, 20 nt, Salmonella enterica enterica serovar Typhi Ty2
caguaauuuuucucccagca

SEQ ID NO: 3700344 - RNA, 22 nt, Salmonella enterica enterica serovar Typhi Ty2
caguaauuuuucucccagcaga

SEQ ID NO: 3700345 - RNA, 23 nt, Salmonella enterica enterica serovar Typhi Ty2
caguaauuuuucucccagcagac

SEQ ID NO: 3700346 - RNA, 15 nt, Salmonella enterica enterica serovar Typhi Ty2
caguacaaacaaaua

SEQ ID NO: 3700347 - RNA, 16 nt, Salmonella enterica enterica serovar Typhi Ty2
caguacaaacaaauaa

SEQ ID NO: 3700348 - RNA, 17 nt, Salmonella enterica enterica serovar Typhi Ty2
caguacaaacaaauaaa

SEQ ID NO: 3700349 - RNA, 21 nt, Salmonella enterica enterica serovar Typhi Ty2
caguacaaacaaauaaaucca

SEQ ID NO: 3700350 - RNA, 23 nt, Salmonella enterica enterica serovar Typhi Ty2
caguacaaacaaauaaauccaug

SEQ ID NO: 3700351 - RNA, 13 nt, Salmonella enterica enterica serovar Typhi Ty2
caguacagcagcg

SEQ ID NO: 3700352 - RNA, 14 nt, Salmonella enterica enterica serovar Typhi Ty2
caguacagcagcga

SEQ ID NO: 3700353 - RNA, 13 nt, Salmonella enterica enterica serovar Typhi Ty2
caguacagccaaa

SEQ ID NO: 3700354 - RNA, 17 nt, Salmonella enterica enterica serovar Typhi Ty2
caguacagccaaaaaua

SEQ ID NO: 3700355 - RNA, 19 nt, Salmonella enterica enterica serovar Typhi Ty2
caguacagccaaaaauaac

SEQ ID NO: 3700356 - RNA, 17 nt, Salmonella enterica enterica serovar Typhi Ty2
caguacccgcacgcuuu

SEQ ID NO: 3700357 - RNA, 17 nt, Salmonella enterica enterica serovar Typhi Ty2
caguaccgaaaucauca

SEQ ID NO: 3700358 - RNA, 17 nt, Salmonella enterica enterica serovar Typhi Ty2
caguaccgccuucagcg

SEQ ID NO: 3700359 - RNA, 22 nt, Salmonella enterica enterica serovar Typhi Ty2
caguaccgccuucagcgcgccc

SEQ ID NO: 3700360 - RNA, 17 nt, Salmonella enterica enterica serovar Typhi Ty2
caguaccggcaggacaa

SEQ ID NO: 3700361 - RNA, 21 nt, Salmonella enterica enterica serovar Typhi Ty2
caguaccgggccuccuuuccu

SEQ ID NO: 3700362 - RNA, 22 nt, Salmonella enterica enterica serovar Typhi Ty2
caguaccgggccuccuuuccug

SEQ ID NO: 3700363 - RNA, 20 nt, Salmonella enterica enterica serovar Typhi Ty2
caguaccgucauuuccggcg

SEQ ID NO: 3700364 - RNA, 22 nt, Salmonella enterica enterica serovar Typhi Ty2
caguaccugacuuuuccauacu

SEQ ID NO: 3700365 - RNA, 14 nt, Salmonella enterica enterica serovar Typhi Ty2
caguacgaucauga

SEQ ID NO: 3700366 - RNA, 21 nt, Salmonella enterica enterica serovar Typhi Ty2
caguacgcguucuacgguauc

SEQ ID NO: 3700367 - RNA, 15 nt, Salmonella enterica enterica serovar Typhi Ty2
caguacgcugccauc

SEQ ID NO: 3700368 - RNA, 23 nt, Salmonella enterica enterica serovar Typhi Ty2
caguacggaaaugaucagacgca

SEQ ID NO: 3700369 - RNA, 16 nt, Salmonella enterica enterica serovar Typhi Ty2
caguggccaucuucca

SEQ ID NO: 3700370 - RNA, 13 nt, Salmonella enterica enterica serovar Typhi Ty2
cagugggaaaauu

SEQ ID NO: 3700371 - RNA, 20 nt, Salmonella enterica enterica serovar Typhi Ty2
cagugggcgucaaaaucccg

SEQ ID NO: 3700372 - RNA, 22 nt, Salmonella enterica enterica serovar Typhi Ty2
caguggucguuagccagauggc

SEQ ID NO: 3700373 - RNA, 16 nt, Salmonella enterica enterica serovar Typhi Ty2
caguguaaacgccaga

SEQ ID NO: 3700374 - RNA, 24 nt, Salmonella enterica enterica serovar Typhi Ty2
caguguacauagcuuugccacugg

SEQ ID NO: 3700375 - RNA, 14 nt, Salmonella enterica enterica serovar Typhi Ty2
cagugugccgucau

SEQ ID NO: 3700376 - RNA, 19 nt, Salmonella enterica enterica serovar Typhi Ty2
caguguucccugcgcugga

SEQ ID NO: 3700377 - RNA, 17 nt, Salmonella enterica enterica serovar Typhi Ty2
caguguugauugaaacu

SEQ ID NO: 3700378 - RNA, 22 nt, Salmonella enterica enterica serovar Typhi Ty2
caguguuucccaacaaugccac

SEQ ID NO: 3700379 - RNA, 21 nt, Salmonella enterica enterica serovar Typhi Ty2
caguuaacgcguaaucuucca

SEQ ID NO: 3700380 - RNA, 23 nt, Salmonella enterica enterica serovar Typhi Ty2
caguuauagcgcagauugaggcu

SEQ ID NO: 3700381 - RNA, 14 nt, Salmonella enterica enterica serovar Typhi Ty2
caguuauuuuuuuu

SEQ ID NO: 3700382 - RNA, 19 nt, Salmonella enterica enterica serovar Typhi Ty2
caguucaaacggcccggcg

SEQ ID NO: 3700383 - RNA, 20 nt, Salmonella enterica enterica serovar Typhi Ty2
caguucaaacggcccggcgu

SEQ ID NO: 3700384 - RNA, 16 nt, Salmonella enterica enterica serovar Typhi Ty2
caguucaccggcggcc

SEQ ID NO: 3700385 - RNA, 20 nt, Salmonella enterica enterica serovar Typhi Ty2
caguucacgacugauagguu

SEQ ID NO: 3700386 - RNA, 19 nt, Salmonella enterica enterica serovar Typhi Ty2
caguucacuccuaagagaa

SEQ ID NO: 3700387 - RNA, 21 nt, Salmonella enterica enterica serovar Typhi Ty2
caguucacuccuaagagaaaa

SEQ ID NO: 3700388 - RNA, 23 nt, Salmonella enterica enterica serovar Typhi Ty2
caguucagcagcaccacucccca

SEQ ID NO: 3700389 - RNA, 16 nt, Salmonella enterica enterica serovar Typhi Ty2
caguucagcggucaua

SEQ ID NO: 3700390 - RNA, 17 nt, Salmonella enterica enterica serovar Typhi Ty2
caguucauccacgcggg

SEQ ID NO: 3700391 - RNA, 12 nt, Salmonella enterica enterica serovar Typhi Ty2
caguucauuaac

SEQ ID NO: 3700392 - RNA, 17 nt, Salmonella enterica enterica serovar Typhi Ty2
caguucauuucaggcaa

SEQ ID NO: 3700393 - RNA, 19 nt, Salmonella enterica enterica serovar Typhi Ty2
caguucauuucaggcaaag

SEQ ID NO: 3700394 - RNA, 23 nt, Salmonella enterica enterica serovar Typhi Ty2
caguuccaccguaugugcgccgu

SEQ ID NO: 3700395 - RNA, 14 nt, Salmonella enterica enterica serovar Typhi Ty2
caguuccccgccgc

SEQ ID NO: 3700396 - RNA, 22 nt, Salmonella enterica enterica serovar Typhi Ty2
caguucgauaaucccggcgcgc

SEQ ID NO: 3700397 - RNA, 20 nt, Salmonella enterica enterica serovar Typhi Ty2
caguucgccacgaucggcaa

SEQ ID NO: 3700398 - RNA, 17 nt, Salmonella enterica enterica serovar Typhi Ty2
caguucgccuucuucau

SEQ ID NO: 3700399 - RNA, 18 nt, Salmonella enterica enterica serovar Typhi Ty2
caguucgccuucuucauc

SEQ ID NO: 3700400 - RNA, 21 nt, Salmonella enterica enterica serovar Typhi Ty2
caguucgccuucuucaucuuc

SEQ ID NO: 3700401 - RNA, 22 nt, Salmonella enterica enterica serovar Typhi Ty2
caguucgccuucuucaucuuca

SEQ ID NO: 3700402 - RNA, 21 nt, Salmonella enterica enterica serovar Typhi Ty2
caguucggcgauuuccagcgc

SEQ ID NO: 3700403 - RNA, 23 nt, Salmonella enterica enterica serovar Typhi Ty2
caguucggcgauuuccagcgccg

SEQ ID NO: 3700404 - RNA, 16 nt, Salmonella enterica enterica serovar Typhi Ty2
caguucuggcugcgcu

SEQ ID NO: 3700405 - RNA, 16 nt, Salmonella enterica enterica serovar Typhi Ty2
caguugaccaaacagc

SEQ ID NO: 3700406 - RNA, 17 nt, Salmonella enterica enterica serovar Typhi Ty2
caguugaccaaacagca

SEQ ID NO: 3700407 - RNA, 12 nt, Salmonella enterica enterica serovar Typhi Ty2
caguugcagcgc

SEQ ID NO: 3700408 - RNA, 16 nt, Salmonella enterica enterica serovar Typhi Ty2
caguugcccauuuucc

SEQ ID NO: 3700409 - RNA, 20 nt, Salmonella enterica enterica serovar Typhi Ty2
caguugcgacuguucaucaa

SEQ ID NO: 3700410 - RNA, 16 nt, Salmonella enterica enterica serovar Typhi Ty2
caguugcggcaucaga

SEQ ID NO: 3700411 - RNA, 19 nt, Salmonella enterica enterica serovar Typhi Ty2
caguuggcguaccaucagc

SEQ ID NO: 3700412 - RNA, 23 nt, Salmonella enterica enterica serovar Typhi Ty2
caguugguuagagcacaucacuc

SEQ ID NO: 3700413 - RNA, 21 nt, Salmonella enterica enterica serovar Typhi Ty2
caguugguuguagcacagccc

SEQ ID NO: 3700414 - RNA, 21 nt, Salmonella enterica enterica serovar Typhi Ty2
caguuguaguagccacagcgg

SEQ ID NO: 3700415 - RNA, 19 nt, Salmonella enterica enterica serovar Typhi Ty2
caguugucguggguucgaa

SEQ ID NO: 3700416 - RNA, 18 nt, Salmonella enterica enterica serovar Typhi Ty2
caguuuaaaucacagggg

SEQ ID NO: 3700417 - RNA, 23 nt, Salmonella enterica enterica serovar Typhi Ty2
caguuuacgagugcguucuucca

SEQ ID NO: 3700418 - RNA, 23 nt, Salmonella enterica enterica serovar Typhi Ty2
caguuuagagguuccccagccgc

SEQ ID NO: 3700419 - RNA, 14 nt, Salmonella enterica enterica serovar Typhi Ty2
caguuucaucaucg

SEQ ID NO: 3700420 - RNA, 15 nt, Salmonella enterica enterica serovar Typhi Ty2
caguuucgccagcgc

SEQ ID NO: 3700421 - RNA, 13 nt, Salmonella enterica enterica serovar Typhi Ty2
caguuucggcccc

SEQ ID NO: 3700422 - RNA, 19 nt, Salmonella enterica enterica serovar Typhi Ty2
caguuucucgucauaguga

SEQ ID NO: 3700423 - RNA, 18 nt, Salmonella enterica enterica serovar Typhi Ty2
caguuuguaaccaacaaa

SEQ ID NO: 3700424 - RNA, 13 nt, Salmonella enterica enterica serovar Typhi Ty2
caguuugucauca

SEQ ID NO: 3700425 - RNA, 16 nt, Salmonella enterica enterica serovar Typhi Ty2
caguuuugucaucaga

SEQ ID NO: 3700426 - RNA, 15 nt, Salmonella enterica enterica serovar Typhi Ty2
caguuuuuauaacua

SEQ ID NO: 3700427 - RNA, 15 nt, Salmonella enterica enterica serovar Typhi Ty2
caguuuuuccuuucu

SEQ ID NO: 3700428 - RNA, 15 nt, Salmonella enterica enterica serovar Typhi Ty2
caguuuuugaacaua

SEQ ID NO: 3700429 - RNA, 18 nt, Salmonella enterica enterica serovar Typhi Ty2
caguuuuugcauuauauu

SEQ ID NO: 3700430 - RNA, 16 nt, Salmonella enterica enterica serovar Typhi Ty2
caguuuuuuccagcgc

SEQ ID NO: 3700431 - RNA, 19 nt, Salmonella enterica enterica serovar Typhi Ty2
caguuuuuugaccauucca

SEQ ID NO: 3700432 - RNA, 12 nt, Salmonella enterica enterica serovar Typhi Ty2
cauaaaaaaacg

SEQ ID NO: 3700433 - RNA, 18 nt, Salmonella enterica enterica serovar Typhi Ty2
cauaaaaaacaucaugcc

SEQ ID NO: 3700434 - RNA, 12 nt, Salmonella enterica enterica serovar Typhi Ty2
cauaaaaaagag

SEQ ID NO: 3700435 - RNA, 13 nt, Salmonella enterica enterica serovar Typhi Ty2
cauaaaaacguga

SEQ ID NO: 3700436 - RNA, 14 nt, Salmonella enterica enterica serovar Typhi Ty2
cauaaaaagccauc

SEQ ID NO: 3700437 - RNA, 12 nt, Salmonella enterica enterica serovar Typhi Ty2
cauaaaaccauu

SEQ ID NO: 3700438 - RNA, 20 nt, Salmonella enterica enterica serovar Typhi Ty2
cauaaaauccugguaacggc

SEQ ID NO: 3700439 - RNA, 15 nt, Salmonella enterica enterica serovar Typhi Ty2
cauaaagccucucuu

SEQ ID NO: 3700440 - RNA, 16 nt, Salmonella enterica enterica serovar Typhi Ty2
cauaaagcgucuuaga

SEQ ID NO: 3700441 - RNA, 17 nt, Salmonella enterica enterica serovar Typhi Ty2
cauaaaguagccaaugc

SEQ ID NO: 3700442 - RNA, 18 nt, Salmonella enterica enterica serovar Typhi Ty2
cauaaagucagacaagua

SEQ ID NO: 3700443 - RNA, 16 nt, Salmonella enterica enterica serovar Typhi Ty2
cauaaauaacauuuca

SEQ ID NO: 3700444 - RNA, 22 nt, Salmonella enterica enterica serovar Typhi Ty2
cauaaauaaugccguuuuagcg

SEQ ID NO: 3700445 - RNA, 20 nt, Salmonella enterica enterica serovar Typhi Ty2
cauaaauacaauucaacuca

SEQ ID NO: 3700446 - RNA, 16 nt, Salmonella enterica enterica serovar Typhi Ty2
cauaaauacguaacac

SEQ ID NO: 3700447 - RNA, 21 nt, Salmonella enterica enterica serovar Typhi Ty2
cauaaauauuggcggcaaaga

SEQ ID NO: 3700448 - RNA, 22 nt, Salmonella enterica enterica serovar Typhi Ty2
cauaaauauuggcggcaaagaa

SEQ ID NO: 3700449 - RNA, 21 nt, Salmonella enterica enterica serovar Typhi Ty2
cauaaaucauuacuuauauuu

SEQ ID NO: 3700450 - RNA, 21 nt, Salmonella enterica enterica serovar Typhi Ty2
cauaaaugcgaugaacaucga

SEQ ID NO: 3700451 - RNA, 15 nt, Salmonella enterica enterica serovar Typhi Ty2
cauaccguuucaacu

SEQ ID NO: 3700452 - RNA, 16 nt, Salmonella enterica enterica serovar Typhi Ty2
cauaccuauaaaaaug

SEQ ID NO: 3700453 - RNA, 21 nt, Salmonella enterica enterica serovar Typhi Ty2
cauaccuauaaaaaugaggua

SEQ ID NO: 3700454 - RNA, 17 nt, Salmonella enterica enterica serovar Typhi Ty2
cauaccuguuccucuuu

SEQ ID NO: 3700455 - RNA, 20 nt, Salmonella enterica enterica serovar Typhi Ty2
cauaccuguuccucuuuccc

SEQ ID NO: 3700456 - RNA, 22 nt, Salmonella enterica enterica serovar Typhi Ty2
cauacgaucgcgcacaugcugu

SEQ ID NO: 3700457 - RNA, 12 nt, Salmonella enterica enterica serovar Typhi Ty2
cauacgccgcca

SEQ ID NO: 3700458 - RNA, 18 nt, Salmonella enterica enterica serovar Typhi Ty2
cauacgccgccagccacu

SEQ ID NO: 3700459 - RNA, 19 nt, Salmonella enterica enterica serovar Typhi Ty2
cauacgccgcggucgagca

SEQ ID NO: 3700460 - RNA, 15 nt, Salmonella enterica enterica serovar Typhi Ty2
cauacggaugaaaua

SEQ ID NO: 3700461 - RNA, 18 nt, Salmonella enterica enterica serovar Typhi Ty2
cauacggaugaaauacuc

SEQ ID NO: 3700462 - RNA, 20 nt, Salmonella enterica enterica serovar Typhi Ty2
cauacgggcaugaagaaaau

SEQ ID NO: 3700463 - RNA, 23 nt, Salmonella enterica enterica serovar Typhi Ty2
cauacgggcaugaagaaaauacu

SEQ ID NO: 3700464 - RNA, 17 nt, Salmonella enterica enterica serovar Typhi Ty2
cauacguuuaaagcgcu

SEQ ID NO: 3700465 - RNA, 13 nt, Salmonella enterica enterica serovar Typhi Ty2
cauacguuuuuau

SEQ ID NO: 3700466 - RNA, 13 nt, Salmonella enterica enterica serovar Typhi Ty2
cauacuaccgcug

SEQ ID NO: 3700467 - RNA, 16 nt, Salmonella enterica enterica serovar Typhi Ty2
cauacuaccgcugcga

SEQ ID NO: 3700468 - RNA, 12 nt, Salmonella enterica enterica serovar Typhi Ty2
cauacuauuucc

SEQ ID NO: 3700469 - RNA, 23 nt, Salmonella enterica enterica serovar Typhi Ty2
cauacucacauucauaaaagauc

SEQ ID NO: 3700470 - RNA, 16 nt, Salmonella enterica enterica serovar Typhi Ty2
cauacucacgaauaag

SEQ ID NO: 3700471 - RNA, 22 nt, Salmonella enterica enterica serovar Typhi Ty2
cauacucauuaccggcugccga

SEQ ID NO: 3700472 - RNA, 15 nt, Salmonella enterica enterica serovar Typhi Ty2
cauacucuccuccau

SEQ ID NO: 3700473 - RNA, 22 nt, Salmonella enterica enterica serovar Typhi Ty2
cauacugaaauuucuuuuccag

SEQ ID NO: 3700474 - RNA, 15 nt, Salmonella enterica enterica serovar Typhi Ty2
cauacugaagauaaa

SEQ ID NO: 3700475 - RNA, 16 nt, Salmonella enterica enterica serovar Typhi Ty2
cauacugccaaccauu

SEQ ID NO: 3700476 - RNA, 18 nt, Salmonella enterica enterica serovar Typhi Ty2
cauacugcccagccgcca

SEQ ID NO: 3700477 - RNA, 20 nt, Salmonella enterica enterica serovar Typhi Ty2
cauacugcuuuuucggcuca

SEQ ID NO: 3700478 - RNA, 14 nt, Salmonella enterica enterica serovar Typhi Ty2
cauacuguuuauca

SEQ ID NO: 3700479 - RNA, 23 nt, Salmonella enterica enterica serovar Typhi Ty2
cauagaaaaagaacugcaaauac

SEQ ID NO: 3700480 - RNA, 18 nt, Salmonella enterica enterica serovar Typhi Ty2
cauagaaagauuucauca

SEQ ID NO: 3700481 - RNA, 16 nt, Salmonella enterica enterica serovar Typhi Ty2
cauagaaauagccccg

SEQ ID NO: 3700482 - RNA, 17 nt, Salmonella enterica enterica serovar Typhi Ty2
cauagaaccacuuauuu

SEQ ID NO: 3700483 - RNA, 13 nt, Salmonella enterica enterica serovar Typhi Ty2
cauagaauuucag

SEQ ID NO: 3700484 - RNA, 21 nt, Salmonella enterica enterica serovar Typhi Ty2
cauagacgcccugcaaagcaa

SEQ ID NO: 3700485 - RNA, 23 nt, Salmonella enterica enterica serovar Typhi Ty2
cauagacgcccugcaaagcaaaa

SEQ ID NO: 3700486 - RNA, 17 nt, Salmonella enterica enterica serovar Typhi Ty2
cauagacuuuggcgcag

SEQ ID NO: 3700487 - RNA, 17 nt, Salmonella enterica enterica serovar Typhi Ty2
cauagaguaucgccugu

SEQ ID NO: 3700488 - RNA, 13 nt, Salmonella enterica enterica serovar Typhi Ty2
cauagauaacuau

SEQ ID NO: 3700489 - RNA, 15 nt, Salmonella enterica enterica serovar Typhi Ty2
cauagauaccuucuu

SEQ ID NO: 3700490 - RNA, 17 nt, Salmonella enterica enterica serovar Typhi Ty2
cauagauaccuucuuca

SEQ ID NO: 3700491 - RNA, 19 nt, Salmonella enterica enterica serovar Typhi Ty2
cauagcagaguacuggaau

SEQ ID NO: 3700492 - RNA, 13 nt, Salmonella enterica enterica serovar Typhi Ty2
cauagcaucacca

SEQ ID NO: 3700493 - RNA, 18 nt, Salmonella enterica enterica serovar Typhi Ty2
cauagccacagcgcgcga

SEQ ID NO: 3700494 - RNA, 14 nt, Salmonella enterica enterica serovar Typhi Ty2
cauagccgccaccc

SEQ ID NO: 3700495 - RNA, 14 nt, Salmonella enterica enterica serovar Typhi Ty2
cauagccggauaau

SEQ ID NO: 3700496 - RNA, 15 nt, Salmonella enterica enterica serovar Typhi Ty2
cauagcgccaucagg

SEQ ID NO: 3700497 - RNA, 19 nt, Salmonella enterica enterica serovar Typhi Ty2
cauagcgccccaguaacgu

SEQ ID NO: 3700498 - RNA, 14 nt, Salmonella enterica enterica serovar Typhi Ty2
cauagcgccuucag

SEQ ID NO: 3700499 - RNA, 15 nt, Salmonella enterica enterica serovar Typhi Ty2
cauagcgcgaaugau

SEQ ID NO: 3700500 - RNA, 19 nt, Salmonella enterica enterica serovar Typhi Ty2
cauagcgcgaaugauuuua

SEQ ID NO: 3700501 - RNA, 20 nt, Salmonella enterica enterica serovar Typhi Ty2
cauagcggacuaaauuccug

SEQ ID NO: 3700502 - RNA, 16 nt, Salmonella enterica enterica serovar Typhi Ty2
cauagcggccagaugg

SEQ ID NO: 3700503 - RNA, 19 nt, Salmonella enterica enterica serovar Typhi Ty2
cauagcgggcagcauugac

SEQ ID NO: 3700504 - RNA, 18 nt, Salmonella enterica enterica serovar Typhi Ty2
cauagcgucaucaacaua

SEQ ID NO: 3700505 - RNA, 18 nt, Salmonella enterica enterica serovar Typhi Ty2
cauagcguuaucuggucg

SEQ ID NO: 3700506 - RNA, 16 nt, Salmonella enterica enterica serovar Typhi Ty2
cauagcguugauaugc

SEQ ID NO: 3700507 - RNA, 17 nt, Salmonella enterica enterica serovar Typhi Ty2
cauagcguugauaugcu

SEQ ID NO: 3700508 - RNA, 22 nt, Salmonella enterica enterica serovar Typhi Ty2
cauagcguugauaugcucgaca

SEQ ID NO: 3700509 - RNA, 21 nt, Salmonella enterica enterica serovar Typhi Ty2
cauagcguuuaaaaagcugca

SEQ ID NO: 3700510 - RNA, 16 nt, Salmonella enterica enterica serovar Typhi Ty2
cauagcuaccgcgcga

SEQ ID NO: 3700511 - RNA, 21 nt, Salmonella enterica enterica serovar Typhi Ty2
cauagcuguuccgcaacacgg

SEQ ID NO: 3700512 - RNA, 19 nt, Salmonella enterica enterica serovar Typhi Ty2
cauaggccagcgucaccuc

SEQ ID NO: 3700513 - RNA, 19 nt, Salmonella enterica enterica serovar Typhi Ty2
cauaggcuuugcugagcgc

SEQ ID NO: 3700514 - RNA, 15 nt, Salmonella enterica enterica serovar Typhi Ty2
cauaggugaacauga

SEQ ID NO: 3700515 - RNA, 15 nt, Salmonella enterica enterica serovar Typhi Ty2
cauaguuuuccagcc

SEQ ID NO: 3700516 - RNA, 18 nt, Salmonella enterica enterica serovar Typhi Ty2
cauauaaauuucauccau

SEQ ID NO: 3700517 - RNA, 15 nt, Salmonella enterica enterica serovar Typhi Ty2
cauauaaggcccaua

SEQ ID NO: 3700518 - RNA, 20 nt, Salmonella enterica enterica serovar Typhi Ty2
cauauaauuaacauuuaaga

SEQ ID NO: 3700519 - RNA, 23 nt, Salmonella enterica enterica serovar Typhi Ty2
cauauacccugcggcgaaacaga

SEQ ID NO: 3700520 - RNA, 22 nt, Salmonella enterica enterica serovar Typhi Ty2
cauauacgccacggccagcagc

SEQ ID NO: 3700521 - RNA, 14 nt, Salmonella enterica enterica serovar Typhi Ty2
cauauacucacuga

SEQ ID NO: 3700522 - RNA, 18 nt, Salmonella enterica enterica serovar Typhi Ty2
cauauacucuucgccauu

SEQ ID NO: 3700523 - RNA, 22 nt, Salmonella enterica enterica serovar Typhi Ty2
cauauacugucuuguggaacac

SEQ ID NO: 3700524 - RNA, 14 nt, Salmonella enterica enterica serovar Typhi Ty2
cauauagccgcgca

SEQ ID NO: 3700525 - RNA, 12 nt, Salmonella enterica enterica serovar Typhi Ty2
cauauauuauua

SEQ ID NO: 3700526 - RNA, 21 nt, Salmonella enterica enterica serovar Typhi Ty2
cauauauuuacugaauaaaua

SEQ ID NO: 3700527 - RNA, 16 nt, Salmonella enterica enterica serovar Typhi Ty2
cauaucaaacugaaaa

SEQ ID NO: 3700528 - RNA, 14 nt, Salmonella enterica enterica serovar Typhi Ty2
cauaucaaucaacg

SEQ ID NO: 3700529 - RNA, 18 nt, Salmonella enterica enterica serovar Typhi Ty2
cauaucaaucaacgguuc

SEQ ID NO: 3700530 - RNA, 23 nt, Salmonella enterica enterica serovar Typhi Ty2
cauaucaccgcugacugaacuca

SEQ ID NO: 3700531 - RNA, 22 nt, Salmonella enterica enterica serovar Typhi Ty2
cauaucaguggggccuuuuuaa

SEQ ID NO: 3700532 - RNA, 15 nt, Salmonella enterica enterica serovar Typhi Ty2
cauauccaagccccu

SEQ ID NO: 3700533 - RNA, 16 nt, Salmonella enterica enterica serovar Typhi Ty2
caucagcgccagcccu

SEQ ID NO: 3700534 - RNA, 16 nt, Salmonella enterica enterica serovar Typhi Ty2
caucagcgcgggauaa

SEQ ID NO: 3700535 - RNA, 18 nt, Salmonella enterica enterica serovar Typhi Ty2
caucagcgcuaccagcgc

SEQ ID NO: 3700536 - RNA, 17 nt, Salmonella enterica enterica serovar Typhi Ty2
caucaggaucuucaucc

SEQ ID NO: 3700537 - RNA, 20 nt, Salmonella enterica enterica serovar Typhi Ty2
caucaggaucuucaucccau

SEQ ID NO: 3700538 - RNA, 14 nt, Salmonella enterica enterica serovar Typhi Ty2
caucaggcacaaug

SEQ ID NO: 3700539 - RNA, 13 nt, Salmonella enterica enterica serovar Typhi Ty2
caucaggcaucug

SEQ ID NO: 3700540 - RNA, 18 nt, Salmonella enterica enterica serovar Typhi Ty2
caucaggccugcaaaccu

SEQ ID NO: 3700541 - RNA, 13 nt, Salmonella enterica enterica serovar Typhi Ty2
caucaggcgugcc

SEQ ID NO: 3700542 - RNA, 11 nt, Salmonella enterica enterica serovar Typhi Ty2
caucaggcuga

SEQ ID NO: 3700543 - RNA, 20 nt, Salmonella enterica enterica serovar Typhi Ty2
caucagguaauacaggguuu

SEQ ID NO: 3700544 - RNA, 18 nt, Salmonella enterica enterica serovar Typhi Ty2
caucaguaacacccgcgc

SEQ ID NO: 3700545 - RNA, 21 nt, Salmonella enterica enterica serovar Typhi Ty2
caucaguaugagcgaacggcu

SEQ ID NO: 3700546 - RNA, 16 nt, Salmonella enterica enterica serovar Typhi Ty2
caucauagugcgcgcg

SEQ ID NO: 3700547 - RNA, 22 nt, Salmonella enterica enterica serovar Typhi Ty2
caucauauaaccacgaaaauua

SEQ ID NO: 3700548 - RNA, 22 nt, Salmonella enterica enterica serovar Typhi Ty2
caucauccccggcaggcucacc

SEQ ID NO: 3700549 - RNA, 13 nt, Salmonella enterica enterica serovar Typhi Ty2
caucauccgcgcu

SEQ ID NO: 3700550 - RNA, 22 nt, Salmonella enterica enterica serovar Typhi Ty2
caucaucgaacgccgccugcgc

SEQ ID NO: 3700551 - RNA, 12 nt, Salmonella enterica enterica serovar Typhi Ty2
caucaucgccaa

SEQ ID NO: 3700552 - RNA, 22 nt, Salmonella enterica enterica serovar Typhi Ty2
caucaucgcuggugugcagcca

SEQ ID NO: 3700553 - RNA, 23 nt, Salmonella enterica enterica serovar Typhi Ty2
caucaucgcuggugugcagccag

SEQ ID NO: 3700554 - RNA, 17 nt, Salmonella enterica enterica serovar Typhi Ty2
caucaucggcacagcca

SEQ ID NO: 3700555 - RNA, 19 nt, Salmonella enterica enterica serovar Typhi Ty2
caucaucggcacagccagu

SEQ ID NO: 3700556 - RNA, 18 nt, Salmonella enterica enterica serovar Typhi Ty2
caucaucguuugcgcgca

SEQ ID NO: 3700557 - RNA, 14 nt, Salmonella enterica enterica serovar Typhi Ty2
caucaucucauaaa

SEQ ID NO: 3700558 - RNA, 13 nt, Salmonella enterica enterica serovar Typhi Ty2
caucaucuugucc

SEQ ID NO: 3700559 - RNA, 21 nt, Salmonella enterica enterica serovar Typhi Ty2
caucaucuuguccucaucauu

SEQ ID NO: 3700560 - RNA, 14 nt, Salmonella enterica enterica serovar Typhi Ty2
caucaugauauaau

SEQ ID NO: 3700561 - RNA, 21 nt, Salmonella enterica enterica serovar Typhi Ty2
caucaugcaagagucccagaa

SEQ ID NO: 3700562 - RNA, 20 nt, Salmonella enterica enterica serovar Typhi Ty2
caucaugcgcagaaacugau

SEQ ID NO: 3700563 - RNA, 15 nt, Salmonella enterica enterica serovar Typhi Ty2
caucaugcgccaggu

SEQ ID NO: 3700564 - RNA, 19 nt, Salmonella enterica enterica serovar Typhi Ty2
caucaugcugcaccgcauc

SEQ ID NO: 3700565 - RNA, 18 nt, Salmonella enterica enterica serovar Typhi Ty2
caucauuaauauaauccu

SEQ ID NO: 3700566 - RNA, 21 nt, Salmonella enterica enterica serovar Typhi Ty2
caucauuacaggcgaauagcg

SEQ ID NO: 3700567 - RNA, 15 nt, Salmonella enterica enterica serovar Typhi Ty2
caucauucaacgcau

SEQ ID NO: 3700568 - RNA, 14 nt, Salmonella enterica enterica serovar Typhi Ty2
caucauucccauug

SEQ ID NO: 3700569 - RNA, 15 nt, Salmonella enterica enterica serovar Typhi Ty2
caucauucugcaggc

SEQ ID NO: 3700570 - RNA, 18 nt, Salmonella enterica enterica serovar Typhi Ty2
caucauugacuucaacgc

SEQ ID NO: 3700571 - RNA, 15 nt, Salmonella enterica enterica serovar Typhi Ty2
caucauugauacugu

SEQ ID NO: 3700572 - RNA, 23 nt, Salmonella enterica enterica serovar Typhi Ty2
caucauugauacuguacgcccag

SEQ ID NO: 3700573 - RNA, 14 nt, Salmonella enterica enterica serovar Typhi Ty2
caucauuuccggcg

SEQ ID NO: 3700574 - RNA, 17 nt, Salmonella enterica enterica serovar Typhi Ty2
cauccaacugcgccuga

SEQ ID NO: 3700575 - RNA, 12 nt, Salmonella enterica enterica serovar Typhi Ty2
cauccacauucg

SEQ ID NO: 3700576 - RNA, 22 nt, Salmonella enterica enterica serovar Typhi Ty2
cauccaccccgguuguggcgua

SEQ ID NO: 3700577 - RNA, 20 nt, Salmonella enterica enterica serovar Typhi Ty2
cauccaccgcccgcguauug

SEQ ID NO: 3700578 - RNA, 14 nt, Salmonella enterica enterica serovar Typhi Ty2
cauccacggccccg

SEQ ID NO: 3700579 - RNA, 13 nt, Salmonella enterica enterica serovar Typhi Ty2
cauccagaaggca

SEQ ID NO: 3700580 - RNA, 14 nt, Salmonella enterica enterica serovar Typhi Ty2
cauccagaucggca

SEQ ID NO: 3700581 - RNA, 21 nt, Salmonella enterica enterica serovar Typhi Ty2
cauccagcaauaacaccggcg

SEQ ID NO: 3700582 - RNA, 22 nt, Salmonella enterica enterica serovar Typhi Ty2
cauccagcacagguacaggccg

SEQ ID NO: 3700583 - RNA, 18 nt, Salmonella enterica enterica serovar Typhi Ty2
cauccagcacgagcgcca

SEQ ID NO: 3700584 - RNA, 13 nt, Salmonella enterica enterica serovar Typhi Ty2
cauccagcgccag

SEQ ID NO: 3700585 - RNA, 17 nt, Salmonella enterica enterica serovar Typhi Ty2
cauccagcgcucaauca

SEQ ID NO: 3700586 - RNA, 14 nt, Salmonella enterica enterica serovar Typhi Ty2
cauccagcucaugu

SEQ ID NO: 3700587 - RNA, 22 nt, Salmonella enterica enterica serovar Typhi Ty2
cauccaggguuuaaucacgcca

SEQ ID NO: 3700588 - RNA, 15 nt, Salmonella enterica enterica serovar Typhi Ty2
cauccagucagcaau

SEQ ID NO: 3700589 - RNA, 15 nt, Salmonella enterica enterica serovar Typhi Ty2
cauccaucacuccuu

SEQ ID NO: 3700590 - RNA, 14 nt, Salmonella enterica enterica serovar Typhi Ty2
cauccaucagcgcg

SEQ ID NO: 3700591 - RNA, 13 nt, Salmonella enterica enterica serovar Typhi Ty2
cauccaucaucua

SEQ ID NO: 3700592 - RNA, 14 nt, Salmonella enterica enterica serovar Typhi Ty2
cauccaucaucuau

SEQ ID NO: 3700593 - RNA, 17 nt, Salmonella enterica enterica serovar Typhi Ty2
cauccaucuccggcauc

SEQ ID NO: 3700594 - RNA, 17 nt, Salmonella enterica enterica serovar Typhi Ty2
cauccauguacuccuga

SEQ ID NO: 3700595 - RNA, 16 nt, Salmonella enterica enterica serovar Typhi Ty2
caucccaccggaaaug

SEQ ID NO: 3700596 - RNA, 10 nt, Salmonella enterica enterica serovar Typhi Ty2
caucccagac

SEQ ID NO: 3700597 - RNA, 16 nt, Salmonella enterica enterica serovar Typhi Ty2
caucccauccgggcca

SEQ ID NO: 3700598 - RNA, 16 nt, Salmonella enterica enterica serovar Typhi Ty2
caucccaugcaccagu

SEQ ID NO: 3700599 - RNA, 14 nt, Salmonella enterica enterica serovar Typhi Ty2
cauccccggcgccc

SEQ ID NO: 3700600 - RNA, 20 nt, Salmonella enterica enterica serovar Typhi Ty2
caucccguuuucgucccagc

SEQ ID NO: 3700601 - RNA, 14 nt, Salmonella enterica enterica serovar Typhi Ty2
caucccugauuuau

SEQ ID NO: 3700602 - RNA, 15 nt, Salmonella enterica enterica serovar Typhi Ty2
cauccgaccacggcc

SEQ ID NO: 3700603 - RNA, 22 nt, Salmonella enterica enterica serovar Typhi Ty2
cauccgaccacggccacagcca

SEQ ID NO: 3700604 - RNA, 19 nt, Salmonella enterica enterica serovar Typhi Ty2
cauccgcaagacacgcuuc

SEQ ID NO: 3700605 - RNA, 16 nt, Salmonella enterica enterica serovar Typhi Ty2
cauccgcauccgucaa

SEQ ID NO: 3700606 - RNA, 17 nt, Salmonella enterica enterica serovar Typhi Ty2
cauccgccagccgccau

SEQ ID NO: 3700607 - RNA, 15 nt, Salmonella enterica enterica serovar Typhi Ty2
cauccgccagcgccu

SEQ ID NO: 3700608 - RNA, 19 nt, Salmonella enterica enterica serovar Typhi Ty2
cauccgccagcgccucuuc

SEQ ID NO: 3700609 - RNA, 18 nt, Salmonella enterica enterica serovar Typhi Ty2
cauccgcccggcaucaag

SEQ ID NO: 3700610 - RNA, 22 nt, Salmonella enterica enterica serovar Typhi Ty2
cauccgcgcuuucuggcgcaga

SEQ ID NO: 3700611 - RNA, 18 nt, Salmonella enterica enterica serovar Typhi Ty2
cauccgcguaaucgcgaa

SEQ ID NO: 3700612 - RNA, 15 nt, Salmonella enterica enterica serovar Typhi Ty2
cauccgcucccgcuu

SEQ ID NO: 3700613 - RNA, 14 nt, Salmonella enterica enterica serovar Typhi Ty2
cauccggacgccag

SEQ ID NO: 3700614 - RNA, 15 nt, Salmonella enterica enterica serovar Typhi Ty2
cauccggacgccagu

SEQ ID NO: 3700615 - RNA, 20 nt, Salmonella enterica enterica serovar Typhi Ty2
caucgcuggcgcgcgcgccu

SEQ ID NO: 3700616 - RNA, 16 nt, Salmonella enterica enterica serovar Typhi Ty2
caucgcuuagcggcuc

SEQ ID NO: 3700617 - RNA, 20 nt, Salmonella enterica enterica serovar Typhi Ty2
caucgcuucuauuaccgcag

SEQ ID NO: 3700618 - RNA, 16 nt, Salmonella enterica enterica serovar Typhi Ty2
caucgcuugcccagca

SEQ ID NO: 3700619 - RNA, 21 nt, Salmonella enterica enterica serovar Typhi Ty2
caucgcuuuuaggcugaaagc

SEQ ID NO: 3700620 - RNA, 15 nt, Salmonella enterica enterica serovar Typhi Ty2
caucggauagaugaa

SEQ ID NO: 3700621 - RNA, 14 nt, Salmonella enterica enterica serovar Typhi Ty2
caucggauuauuuu

SEQ ID NO: 3700622 - RNA, 21 nt, Salmonella enterica enterica serovar Typhi Ty2
caucggauucauuugauacgu

SEQ ID NO: 3700623 - RNA, 16 nt, Salmonella enterica enterica serovar Typhi Ty2
caucggcacagccagu

SEQ ID NO: 3700624 - RNA, 15 nt, Salmonella enterica enterica serovar Typhi Ty2
caucggcacagcgug

SEQ ID NO: 3700625 - RNA, 21 nt, Salmonella enterica enterica serovar Typhi Ty2
caucggcacguaguaaugcau

SEQ ID NO: 3700626 - RNA, 15 nt, Salmonella enterica enterica serovar Typhi Ty2
caucggcagcgccag

SEQ ID NO: 3700627 - RNA, 13 nt, Salmonella enterica enterica serovar Typhi Ty2
caucggcaucaaa

SEQ ID NO: 3700628 - RNA, 12 nt, Salmonella enterica enterica serovar Typhi Ty2
caucggccucgc

SEQ ID NO: 3700629 - RNA, 24 nt, Salmonella enterica enterica serovar Typhi Ty2
caucggcgaguuuggugcccgcgu

SEQ ID NO: 3700630 - RNA, 16 nt, Salmonella enterica enterica serovar Typhi Ty2
caucggcgcgcuggcg

SEQ ID NO: 3700631 - RNA, 21 nt, Salmonella enterica enterica serovar Typhi Ty2
caucgggcuguuauucagcag

SEQ ID NO: 3700632 - RNA, 18 nt, Salmonella enterica enterica serovar Typhi Ty2
caucgggucgcgcgccgc

SEQ ID NO: 3700633 - RNA, 23 nt, Salmonella enterica enterica serovar Typhi Ty2
caucgguaaagguuuucacgcua

SEQ ID NO: 3700634 - RNA, 17 nt, Salmonella enterica enterica serovar Typhi Ty2
caucggucaguuugccc

SEQ ID NO: 3700635 - RNA, 18 nt, Salmonella enterica enterica serovar Typhi Ty2
caucgguguacggcguca

SEQ ID NO: 3700636 - RNA, 14 nt, Salmonella enterica enterica serovar Typhi Ty2
caucgguucucugc

SEQ ID NO: 3700637 - RNA, 14 nt, Salmonella enterica enterica serovar Typhi Ty2
caucgguuucgcgg

SEQ ID NO: 3700638 - RNA, 18 nt, Salmonella enterica enterica serovar Typhi Ty2
caucguagucguagaaca

SEQ ID NO: 3700639 - RNA, 18 nt, Salmonella enterica enterica serovar Typhi Ty2
caucgucccaucgucguu

SEQ ID NO: 3700640 - RNA, 22 nt, Salmonella enterica enterica serovar Typhi Ty2
caucgucgcgccaauggcgauc

SEQ ID NO: 3700641 - RNA, 22 nt, Salmonella enterica enterica serovar Typhi Ty2
caucgucuuuuaccgcgucgcu

SEQ ID NO: 3700642 - RNA, 16 nt, Salmonella enterica enterica serovar Typhi Ty2
caucgugagcgcguca

SEQ ID NO: 3700643 - RNA, 14 nt, Salmonella enterica enterica serovar Typhi Ty2
caucgugauaaacg

SEQ ID NO: 3700644 - RNA, 23 nt, Salmonella enterica enterica serovar Typhi Ty2
caucgugauagacggcugaaugu

SEQ ID NO: 3700645 - RNA, 21 nt, Salmonella enterica enterica serovar Typhi Ty2
caucguggccgauauugccuu

SEQ ID NO: 3700646 - RNA, 18 nt, Salmonella enterica enterica serovar Typhi Ty2
caucguuaccgcuucaca

SEQ ID NO: 3700647 - RNA, 12 nt, Salmonella enterica enterica serovar Typhi Ty2
caucguuaucau

SEQ ID NO: 3700648 - RNA, 19 nt, Salmonella enterica enterica serovar Typhi Ty2
caucguugccagcggccag

SEQ ID NO: 3700649 - RNA, 17 nt, Salmonella enterica enterica serovar Typhi Ty2
caucguuugcaguuccg

SEQ ID NO: 3700650 - RNA, 14 nt, Salmonella enterica enterica serovar Typhi Ty2
caucguuugcgcua

SEQ ID NO: 3700651 - RNA, 15 nt, Salmonella enterica enterica serovar Typhi Ty2
caucuaacacaaauu

SEQ ID NO: 3700652 - RNA, 16 nt, Salmonella enterica enterica serovar Typhi Ty2
caucuaccgcauacug

SEQ ID NO: 3700653 - RNA, 15 nt, Salmonella enterica enterica serovar Typhi Ty2
caucuacuucagcac

SEQ ID NO: 3700654 - RNA, 13 nt, Salmonella enterica enterica serovar Typhi Ty2
caucuaucgccag

SEQ ID NO: 3700655 - RNA, 21 nt, Salmonella enterica enterica serovar Typhi Ty2
caucucaauaucguugccgcc

SEQ ID NO: 3700656 - RNA, 22 nt, Salmonella enterica enterica serovar Typhi Ty2
caucucaauaucguugccgccg

SEQ ID NO: 3700657 - RNA, 16 nt, Salmonella enterica enterica serovar Typhi Ty2
caucucaucuugcagg

SEQ ID NO: 3700658 - RNA, 14 nt, Salmonella enterica enterica serovar Typhi Ty2
caucuccagcgcau

SEQ ID NO: 3700659 - RNA, 19 nt, Salmonella enterica enterica serovar Typhi Ty2
caucucccaggccgccacc

SEQ ID NO: 3700660 - RNA, 20 nt, Salmonella enterica enterica serovar Typhi Ty2
caucucccaggccgccaccg

SEQ ID NO: 3700661 - RNA, 17 nt, Salmonella enterica enterica serovar Typhi Ty2
caucuccucgcacuggc

SEQ ID NO: 3700662 - RNA, 23 nt, Salmonella enterica enterica serovar Typhi Ty2
caucuccucgcgcguuugcaaua

SEQ ID NO: 3700663 - RNA, 15 nt, Salmonella enterica enterica serovar Typhi Ty2
caucucgauaccggu

SEQ ID NO: 3700664 - RNA, 23 nt, Salmonella enterica enterica serovar Typhi Ty2
caucucgauaccgguaaucaaac

SEQ ID NO: 3700665 - RNA, 15 nt, Salmonella enterica enterica serovar Typhi Ty2
caucucuggcggcgu

SEQ ID NO: 3700666 - RNA, 16 nt, Salmonella enterica enterica serovar Typhi Ty2
caucucuucaaacaau

SEQ ID NO: 3700667 - RNA, 14 nt, Salmonella enterica enterica serovar Typhi Ty2
caucucuuugcccg

SEQ ID NO: 3700668 - RNA, 21 nt, Salmonella enterica enterica serovar Typhi Ty2
caucugaacucuuccagauac

SEQ ID NO: 3700669 - RNA, 19 nt, Salmonella enterica enterica serovar Typhi Ty2
caucugauaauuacgaugc

SEQ ID NO: 3700670 - RNA, 22 nt, Salmonella enterica enterica serovar Typhi Ty2
caucugauagcccauccagcac

SEQ ID NO: 3700671 - RNA, 18 nt, Salmonella enterica enterica serovar Typhi Ty2
caucugcaauucggcggc

SEQ ID NO: 3700672 - RNA, 16 nt, Salmonella enterica enterica serovar Typhi Ty2
caucugcaugcgcugg

SEQ ID NO: 3700673 - RNA, 17 nt, Salmonella enterica enterica serovar Typhi Ty2
caucugcggcuuucauc

SEQ ID NO: 3700674 - RNA, 16 nt, Salmonella enterica enterica serovar Typhi Ty2
caucugcuucaacagc

SEQ ID NO: 3700675 - RNA, 13 nt, Salmonella enterica enterica serovar Typhi Ty2
caucuggcacagg

SEQ ID NO: 3700676 - RNA, 16 nt, Salmonella enterica enterica serovar Typhi Ty2
caucugggggaagaua

SEQ ID NO: 3700677 - RNA, 22 nt, Salmonella enterica enterica serovar Typhi Ty2
caucuuauauuuugguguaaca

SEQ ID NO: 3700678 - RNA, 20 nt, Salmonella enterica enterica serovar Typhi Ty2
caucuucacauaucccagac

SEQ ID NO: 3700679 - RNA, 21 nt, Salmonella enterica enterica serovar Typhi Ty2
caucuucaccgaugcccagcu

SEQ ID NO: 3700680 - RNA, 16 nt, Salmonella enterica enterica serovar Typhi Ty2
caucuucaccuuucca

SEQ ID NO: 3700681 - RNA, 16 nt, Salmonella enterica enterica serovar Typhi Ty2
caucuucacgcagcgu

SEQ ID NO: 3700682 - RNA, 17 nt, Salmonella enterica enterica serovar Typhi Ty2
caucuucacuucacaaa

SEQ ID NO: 3700683 - RNA, 14 nt, Salmonella enterica enterica serovar Typhi Ty2
caucuuccagcauc

SEQ ID NO: 3700684 - RNA, 16 nt, Salmonella enterica enterica serovar Typhi Ty2
caucuuccagcaucag

SEQ ID NO: 3700685 - RNA, 14 nt, Salmonella enterica enterica serovar Typhi Ty2
caucuuccaugccu

SEQ ID NO: 3700686 - RNA, 22 nt, Salmonella enterica enterica serovar Typhi Ty2
caucuucgagggugggcgcaca

SEQ ID NO: 3700687 - RNA, 15 nt, Salmonella enterica enterica serovar Typhi Ty2
caucuucuaccugga

SEQ ID NO: 3700688 - RNA, 21 nt, Salmonella enterica enterica serovar Typhi Ty2
caucuucuuugacccacgcca

SEQ ID NO: 3700689 - RNA, 14 nt, Salmonella enterica enterica serovar Typhi Ty2
caucuucuuuuucc

SEQ ID NO: 3700690 - RNA, 18 nt, Salmonella enterica enterica serovar Typhi Ty2
caucuugaaugauuuugu

SEQ ID NO: 3700691 - RNA, 12 nt, Salmonella enterica enterica serovar Typhi Ty2
caucuugcguua

SEQ ID NO: 3700692 - RNA, 13 nt, Salmonella enterica enterica serovar Typhi Ty2
caucuugcguuau

SEQ ID NO: 3700693 - RNA, 19 nt, Salmonella enterica enterica serovar Typhi Ty2
caucuuuaaccgccugcuc

SEQ ID NO: 3700694 - RNA, 13 nt, Salmonella enterica enterica serovar Typhi Ty2
caucuuucuuuuc

SEQ ID NO: 3700695 - RNA, 13 nt, Salmonella enterica enterica serovar Typhi Ty2
caucuuuguucug

SEQ ID NO: 3700696 - RNA, 22 nt, Salmonella enterica enterica serovar Typhi Ty2
caucuuuuacaggccggacagg

SEQ ID NO: 3700697 - RNA, 17 nt, Salmonella enterica enterica serovar Typhi Ty2
cauggcccuuuugcccg

SEQ ID NO: 3700698 - RNA, 21 nt, Salmonella enterica enterica serovar Typhi Ty2
cauggcgaauccguugaucgu

SEQ ID NO: 3700699 - RNA, 20 nt, Salmonella enterica enterica serovar Typhi Ty2
cauggcgcauuaucgauuug

SEQ ID NO: 3700700 - RNA, 17 nt, Salmonella enterica enterica serovar Typhi Ty2
cauggcgcgacauggcg

SEQ ID NO: 3700701 - RNA, 14 nt, Salmonella enterica enterica serovar Typhi Ty2
cauggcuaaaagaa

SEQ ID NO: 3700702 - RNA, 18 nt, Salmonella enterica enterica serovar Typhi Ty2
cauggcuugaucgcgcag

SEQ ID NO: 3700703 - RNA, 19 nt, Salmonella enterica enterica serovar Typhi Ty2
caugggacgggucuccauc

SEQ ID NO: 3700704 - RNA, 20 nt, Salmonella enterica enterica serovar Typhi Ty2
caugggcagcuugccgccaa

SEQ ID NO: 3700705 - RNA, 23 nt, Salmonella enterica enterica serovar Typhi Ty2
cauggggugaggcaucgcccugu

SEQ ID NO: 3700706 - RNA, 16 nt, Salmonella enterica enterica serovar Typhi Ty2
caugguagucaaauuc

SEQ ID NO: 3700707 - RNA, 15 nt, Salmonella enterica enterica serovar Typhi Ty2
cauggugaugaucgc

SEQ ID NO: 3700708 - RNA, 16 nt, Salmonella enterica enterica serovar Typhi Ty2
caugguguguucccgc

SEQ ID NO: 3700709 - RNA, 24 nt, Salmonella enterica enterica serovar Typhi Ty2
caugguguugguacacagcacaau

SEQ ID NO: 3700710 - RNA, 15 nt, Salmonella enterica enterica serovar Typhi Ty2
caugguugacuuaca

SEQ ID NO: 3700711 - RNA, 22 nt, Salmonella enterica enterica serovar Typhi Ty2
caugguugacuuacaaaaaaua

SEQ ID NO: 3700712 - RNA, 17 nt, Salmonella enterica enterica serovar Typhi Ty2
cauguaaauaaggcugc

SEQ ID NO: 3700713 - RNA, 20 nt, Salmonella enterica enterica serovar Typhi Ty2
cauguaaccaaagcaccauu

SEQ ID NO: 3700714 - RNA, 19 nt, Salmonella enterica enterica serovar Typhi Ty2
cauguacaacuucaugagu

SEQ ID NO: 3700715 - RNA, 20 nt, Salmonella enterica enterica serovar Typhi Ty2
cauguacggguccuuuuuug

SEQ ID NO: 3700716 - RNA, 18 nt, Salmonella enterica enterica serovar Typhi Ty2
cauguagaauagcgccgu

SEQ ID NO: 3700717 - RNA, 19 nt, Salmonella enterica enterica serovar Typhi Ty2
cauguagcgcggcagcgcg

SEQ ID NO: 3700718 - RNA, 21 nt, Salmonella enterica enterica serovar Typhi Ty2
cauguagcgcggcagcgcgca

SEQ ID NO: 3700719 - RNA, 23 nt, Salmonella enterica enterica serovar Typhi Ty2
cauguccgauagcauuauugcca

SEQ ID NO: 3700720 - RNA, 17 nt, Salmonella enterica enterica serovar Typhi Ty2
cauguccggcgacucca

SEQ ID NO: 3700721 - RNA, 23 nt, Salmonella enterica enterica serovar Typhi Ty2
caugucggccuuuuugcgccgcg

SEQ ID NO: 3700722 - RNA, 19 nt, Salmonella enterica enterica serovar Typhi Ty2
caugucucacccguuuucu

SEQ ID NO: 3700723 - RNA, 12 nt, Salmonella enterica enterica serovar Typhi Ty2
caugucuucacu

SEQ ID NO: 3700724 - RNA, 14 nt, Salmonella enterica enterica serovar Typhi Ty2
caugugcagcaucc

SEQ ID NO: 3700725 - RNA, 22 nt, Salmonella enterica enterica serovar Typhi Ty2
cauguuaauaccagcgccaauc

SEQ ID NO: 3700726 - RNA, 22 nt, Salmonella enterica enterica serovar Typhi Ty2
cauguuaauugucagcucuuug

SEQ ID NO: 3700727 - RNA, 22 nt, Salmonella enterica enterica serovar Typhi Ty2
cauguuagcaaaaaugccguua

SEQ ID NO: 3700728 - RNA, 15 nt, Salmonella enterica enterica serovar Typhi Ty2
cauguucgaacaugc

SEQ ID NO: 3700729 - RNA, 14 nt, Salmonella enterica enterica serovar Typhi Ty2
cauguugaccaggu

SEQ ID NO: 3700730 - RNA, 22 nt, Salmonella enterica enterica serovar Typhi Ty2
cauguugaucguaaaaugaaaa

SEQ ID NO: 3700731 - RNA, 14 nt, Salmonella enterica enterica serovar Typhi Ty2
cauguugccaugau

SEQ ID NO: 3700732 - RNA, 17 nt, Salmonella enterica enterica serovar Typhi Ty2
cauguugcguaaauaaa

SEQ ID NO: 3700733 - RNA, 18 nt, Salmonella enterica enterica serovar Typhi Ty2
cauguugcguaaauaaau

SEQ ID NO: 3700734 - RNA, 17 nt, Salmonella enterica enterica serovar Typhi Ty2
cauguuuccccuucugg

SEQ ID NO: 3700735 - RNA, 19 nt, Salmonella enterica enterica serovar Typhi Ty2
cauguuuuuuaauugugau

SEQ ID NO: 3700736 - RNA, 12 nt, Salmonella enterica enterica serovar Typhi Ty2
cauuaaaaaaac

SEQ ID NO: 3700737 - RNA, 15 nt, Salmonella enterica enterica serovar Typhi Ty2
cauuaaaaaaacaug

SEQ ID NO: 3700738 - RNA, 13 nt, Salmonella enterica enterica serovar Typhi Ty2
cauuaaaaaaacg

SEQ ID NO: 3700739 - RNA, 18 nt, Salmonella enterica enterica serovar Typhi Ty2
cauuaaaauugaacggac

SEQ ID NO: 3700740 - RNA, 19 nt, Salmonella enterica enterica serovar Typhi Ty2
cauuaaaugcgcccagccc

SEQ ID NO: 3700741 - RNA, 17 nt, Salmonella enterica enterica serovar Typhi Ty2
cauuaacaaaucauuuc

SEQ ID NO: 3700742 - RNA, 22 nt, Salmonella enterica enterica serovar Typhi Ty2
cauuaacaucagaaaaaagcca

SEQ ID NO: 3700743 - RNA, 15 nt, Salmonella enterica enterica serovar Typhi Ty2
cauuaacccggcccc

SEQ ID NO: 3700744 - RNA, 17 nt, Salmonella enterica enterica serovar Typhi Ty2
cauuaacccggccccga

SEQ ID NO: 3700745 - RNA, 17 nt, Salmonella enterica enterica serovar Typhi Ty2
cauuaaccuugcccaug

SEQ ID NO: 3700746 - RNA, 17 nt, Salmonella enterica enterica serovar Typhi Ty2
cauuaacgggaaacugu

SEQ ID NO: 3700747 - RNA, 13 nt, Salmonella enterica enterica serovar Typhi Ty2
cauuaacguccau

SEQ ID NO: 3700748 - RNA, 20 nt, Salmonella enterica enterica serovar Typhi Ty2
cauuaacuccggacguaccc

SEQ ID NO: 3700749 - RNA, 22 nt, Salmonella enterica enterica serovar Typhi Ty2
cauuaagcccauaaagcacugg

SEQ ID NO: 3700750 - RNA, 23 nt, Salmonella enterica enterica serovar Typhi Ty2
cauuaagcccauaaagcacuggu

SEQ ID NO: 3700751 - RNA, 13 nt, Salmonella enterica enterica serovar Typhi Ty2
cauuaauaccauc

SEQ ID NO: 3700752 - RNA, 19 nt, Salmonella enterica enterica serovar Typhi Ty2
cauuaauaugcgcaaucac

SEQ ID NO: 3700753 - RNA, 23 nt, Salmonella enterica enterica serovar Typhi Ty2
cauuaauccccggcgaaagaaaa

SEQ ID NO: 3700754 - RNA, 16 nt, Salmonella enterica enterica serovar Typhi Ty2
cauuaaucuauuuaau

SEQ ID NO: 3700755 - RNA, 23 nt, Salmonella enterica enterica serovar Typhi Ty2
cauuaauggcgauaauagaaccg

SEQ ID NO: 3700756 - RNA, 13 nt, Salmonella enterica enterica serovar Typhi Ty2
cauuacaaacagg

SEQ ID NO: 3700757 - RNA, 18 nt, Salmonella enterica enterica serovar Typhi Ty2
cauuacaauguacagaau

SEQ ID NO: 3700758 - RNA, 17 nt, Salmonella enterica enterica serovar Typhi Ty2
cauuacaggcaucuucc

SEQ ID NO: 3700759 - RNA, 22 nt, Salmonella enterica enterica serovar Typhi Ty2
cauuacaggcaucuuccagcgu

SEQ ID NO: 3700760 - RNA, 23 nt, Salmonella enterica enterica serovar Typhi Ty2
cauuacccggccaggcgugauug

SEQ ID NO: 3700761 - RNA, 21 nt, Salmonella enterica enterica serovar Typhi Ty2
cauuaccgcccuguccuccau

SEQ ID NO: 3700762 - RNA, 15 nt, Salmonella enterica enterica serovar Typhi Ty2
cauuaccgcuaacau

SEQ ID NO: 3700763 - RNA, 16 nt, Salmonella enterica enterica serovar Typhi Ty2
cauuaccuggcaacau

SEQ ID NO: 3700764 - RNA, 12 nt, Salmonella enterica enterica serovar Typhi Ty2
cauuacgcuggc

SEQ ID NO: 3700765 - RNA, 14 nt, Salmonella enterica enterica serovar Typhi Ty2
cauuacucguccuu

SEQ ID NO: 3700766 - RNA, 22 nt, Salmonella enterica enterica serovar Typhi Ty2
cauuacugaccgagaucaggcc

SEQ ID NO: 3700767 - RNA, 21 nt, Salmonella enterica enterica serovar Typhi Ty2
cauuagaccggacguugaaaa

SEQ ID NO: 3700768 - RNA, 15 nt, Salmonella enterica enterica serovar Typhi Ty2
cauuagcaauugcca

SEQ ID NO: 3700769 - RNA, 22 nt, Salmonella enterica enterica serovar Typhi Ty2
cauuagcaugggcuaaagcauc

SEQ ID NO: 3700770 - RNA, 19 nt, Salmonella enterica enterica serovar Typhi Ty2
cauuagcauucccuuaucu

SEQ ID NO: 3700771 - RNA, 15 nt, Salmonella enterica enterica serovar Typhi Ty2
cauuagcgcgauaaa

SEQ ID NO: 3700772 - RNA, 19 nt, Salmonella enterica enterica serovar Typhi Ty2
cauuagcgcgauaaaacca

SEQ ID NO: 3700773 - RNA, 21 nt, Salmonella enterica enterica serovar Typhi Ty2
cauuagggggcgggcugaaau

SEQ ID NO: 3700774 - RNA, 23 nt, Salmonella enterica enterica serovar Typhi Ty2
cauuaguucaaguuuagaaaaaa

SEQ ID NO: 3700775 - RNA, 15 nt, Salmonella enterica enterica serovar Typhi Ty2
cauuauaagcgccaa

SEQ ID NO: 3700776 - RNA, 17 nt, Salmonella enterica enterica serovar Typhi Ty2
cauuauauagucuuaau

SEQ ID NO: 3700777 - RNA, 12 nt, Salmonella enterica enterica serovar Typhi Ty2
cauuaucaccau

SEQ ID NO: 3700778 - RNA, 20 nt, Salmonella enterica enterica serovar Typhi Ty2
cauugcugccuuauccggcc

SEQ ID NO: 3700779 - RNA, 15 nt, Salmonella enterica enterica serovar Typhi Ty2
cauugcugucgacaa

SEQ ID NO: 3700780 - RNA, 16 nt, Salmonella enterica enterica serovar Typhi Ty2
cauugcugucgacaau

SEQ ID NO: 3700781 - RNA, 22 nt, Salmonella enterica enterica serovar Typhi Ty2
cauugcuguuaauuucccgcug

SEQ ID NO: 3700782 - RNA, 15 nt, Salmonella enterica enterica serovar Typhi Ty2
cauugcuuucuugaa

SEQ ID NO: 3700783 - RNA, 17 nt, Salmonella enterica enterica serovar Typhi Ty2
cauugcuuucuugaauc

SEQ ID NO: 3700784 - RNA, 23 nt, Salmonella enterica enterica serovar Typhi Ty2
cauugcuuuuggcaacggcagcc

SEQ ID NO: 3700785 - RNA, 20 nt, Salmonella enterica enterica serovar Typhi Ty2
cauuggaagagacacgcuga

SEQ ID NO: 3700786 - RNA, 16 nt, Salmonella enterica enterica serovar Typhi Ty2
cauuggcaaaccccug

SEQ ID NO: 3700787 - RNA, 12 nt, Salmonella enterica enterica serovar Typhi Ty2
cauuggcaucug

SEQ ID NO: 3700788 - RNA, 16 nt, Salmonella enterica enterica serovar Typhi Ty2
cauuggcgucugcugg

SEQ ID NO: 3700789 - RNA, 18 nt, Salmonella enterica enterica serovar Typhi Ty2
cauuggcgucugcuggcc

SEQ ID NO: 3700790 - RNA, 20 nt, Salmonella enterica enterica serovar Typhi Ty2
cauugggauggauaaauagg

SEQ ID NO: 3700791 - RNA, 18 nt, Salmonella enterica enterica serovar Typhi Ty2
cauuggggaaccuggcag

SEQ ID NO: 3700792 - RNA, 21 nt, Salmonella enterica enterica serovar Typhi Ty2
cauuggggacgcgcaaacgcu

SEQ ID NO: 3700793 - RNA, 14 nt, Salmonella enterica enterica serovar Typhi Ty2
cauuguaaaaccga

SEQ ID NO: 3700794 - RNA, 23 nt, Salmonella enterica enterica serovar Typhi Ty2
cauuguacuuuuaaaucaucagg

SEQ ID NO: 3700795 - RNA, 21 nt, Salmonella enterica enterica serovar Typhi Ty2
cauugucaucaguaugagcga

SEQ ID NO: 3700796 - RNA, 17 nt, Salmonella enterica enterica serovar Typhi Ty2
cauugucggcgcuaucu

SEQ ID NO: 3700797 - RNA, 14 nt, Salmonella enterica enterica serovar Typhi Ty2
cauugucgggcaga

SEQ ID NO: 3700798 - RNA, 13 nt, Salmonella enterica enterica serovar Typhi Ty2
cauugucuuuuuc

SEQ ID NO: 3700799 - RNA, 20 nt, Salmonella enterica enterica serovar Typhi Ty2
cauuguuauguuuuuagaca

SEQ ID NO: 3700800 - RNA, 22 nt, Salmonella enterica enterica serovar Typhi Ty2
cauuguuccugcuggcaaaacg

SEQ ID NO: 3700801 - RNA, 22 nt, Salmonella enterica enterica serovar Typhi Ty2
cauuuaacaggacgcuccauca

SEQ ID NO: 3700802 - RNA, 20 nt, Salmonella enterica enterica serovar Typhi Ty2
cauuuaagauuuaaaacaag

SEQ ID NO: 3700803 - RNA, 17 nt, Salmonella enterica enterica serovar Typhi Ty2
cauuuaaucgccugcgc

SEQ ID NO: 3700804 - RNA, 17 nt, Salmonella enterica enterica serovar Typhi Ty2
cauuuacgccagccaga

SEQ ID NO: 3700805 - RNA, 13 nt, Salmonella enterica enterica serovar Typhi Ty2
cauuuagcgccug

SEQ ID NO: 3700806 - RNA, 14 nt, Salmonella enterica enterica serovar Typhi Ty2
cauuuaugccgcca

SEQ ID NO: 3700807 - RNA, 15 nt, Salmonella enterica enterica serovar Typhi Ty2
cauuuaugccgccau

SEQ ID NO: 3700808 - RNA, 21 nt, Salmonella enterica enterica serovar Typhi Ty2
cauuuauggguuccaguugca

SEQ ID NO: 3700809 - RNA, 15 nt, Salmonella enterica enterica serovar Typhi Ty2
cauuuauguuugccc

SEQ ID NO: 3700810 - RNA, 21 nt, Salmonella enterica enterica serovar Typhi Ty2
cauuucaagcaggcgaucggc

SEQ ID NO: 3700811 - RNA, 23 nt, Salmonella enterica enterica serovar Typhi Ty2
cauuucaaucgccaccacauuca

SEQ ID NO: 3700812 - RNA, 16 nt, Salmonella enterica enterica serovar Typhi Ty2
cauuucacaaauuaaa

SEQ ID NO: 3700813 - RNA, 16 nt, Salmonella enterica enterica serovar Typhi Ty2
cauuucacuuguucuu

SEQ ID NO: 3700814 - RNA, 19 nt, Salmonella enterica enterica serovar Typhi Ty2
cauuucagcgcagaauuua

SEQ ID NO: 3700815 - RNA, 18 nt, Salmonella enterica enterica serovar Typhi Ty2
cauuucaggcaaaggaau

SEQ ID NO: 3700816 - RNA, 17 nt, Salmonella enterica enterica serovar Typhi Ty2
cauuucaggcacuggcu

SEQ ID NO: 3700817 - RNA, 14 nt, Salmonella enterica enterica serovar Typhi Ty2
cauuucagucuaau

SEQ ID NO: 3700818 - RNA, 19 nt, Salmonella enterica enterica serovar Typhi Ty2
cauuucauauucaaaaucc

SEQ ID NO: 3700819 - RNA, 23 nt, Salmonella enterica enterica serovar Typhi Ty2
cauuucaucuaucugcuucuggc

SEQ ID NO: 3700820 - RNA, 14 nt, Salmonella enterica enterica serovar Typhi Ty2
cauuuccgcagcca

SEQ ID NO: 3700821 - RNA, 15 nt, Salmonella enterica enterica serovar Typhi Ty2
cauuuccgcagccaa

SEQ ID NO: 3700822 - RNA, 23 nt, Salmonella enterica enterica serovar Typhi Ty2
cauuuccggcgcgccuaaaccaa

SEQ ID NO: 3700823 - RNA, 17 nt, Salmonella enterica enterica serovar Typhi Ty2
cauuuccggcggcaacc

SEQ ID NO: 3700824 - RNA, 13 nt, Salmonella enterica enterica serovar Typhi Ty2
cauuuccucugcg

SEQ ID NO: 3700825 - RNA, 14 nt, Salmonella enterica enterica serovar Typhi Ty2
cauuuccugcauua

SEQ ID NO: 3700826 - RNA, 16 nt, Salmonella enterica enterica serovar Typhi Ty2
cauuucgcccucgcca

SEQ ID NO: 3700827 - RNA, 20 nt, Salmonella enterica enterica serovar Typhi Ty2
cauuucugucugacgacccg

SEQ ID NO: 3700828 - RNA, 16 nt, Salmonella enterica enterica serovar Typhi Ty2
cauuucuucuucaagc

SEQ ID NO: 3700829 - RNA, 15 nt, Salmonella enterica enterica serovar Typhi Ty2
cauuugauuuguuuu

SEQ ID NO: 3700830 - RNA, 21 nt, Salmonella enterica enterica serovar Typhi Ty2
cauuugauuuguuuuuuauau

SEQ ID NO: 3700831 - RNA, 23 nt, Salmonella enterica enterica serovar Typhi Ty2
cauuugcgacaucagccagccgc

SEQ ID NO: 3700832 - RNA, 16 nt, Salmonella enterica enterica serovar Typhi Ty2
cauuugcgcauauucc

SEQ ID NO: 3700833 - RNA, 21 nt, Salmonella enterica enterica serovar Typhi Ty2
cauuugcggcgucugcaccgg

SEQ ID NO: 3700834 - RNA, 16 nt, Salmonella enterica enterica serovar Typhi Ty2
cauuugcuguuuuauu

SEQ ID NO: 3700835 - RNA, 16 nt, Salmonella enterica enterica serovar Typhi Ty2
cauuugcuuucaucaa

SEQ ID NO: 3700836 - RNA, 16 nt, Salmonella enterica enterica serovar Typhi Ty2
cauuuguacaaaaaau

SEQ ID NO: 3700837 - RNA, 19 nt, Salmonella enterica enterica serovar Typhi Ty2
cauuuguagcggcaacagc

SEQ ID NO: 3700838 - RNA, 22 nt, Salmonella enterica enterica serovar Typhi Ty2
cauuugucgcuguuaaucucau

SEQ ID NO: 3700839 - RNA, 13 nt, Salmonella enterica enterica serovar Typhi Ty2
cauuuuaaaaaua

SEQ ID NO: 3700840 - RNA, 14 nt, Salmonella enterica enterica serovar Typhi Ty2
cauuuuaaauacac

SEQ ID NO: 3700841 - RNA, 23 nt, Salmonella enterica enterica serovar Typhi Ty2
cauuuuaaauacaccaaacgaau

SEQ ID NO: 3700842 - RNA, 20 nt, Salmonella enterica enterica serovar Typhi Ty2
cauuuuaccuuuaaacuguu

SEQ ID NO: 3700843 - RNA, 16 nt, Salmonella enterica enterica serovar Typhi Ty2
cauuuuauccaacagc

SEQ ID NO: 3700844 - RNA, 21 nt, Salmonella enterica enterica serovar Typhi Ty2
cauuuuaucgacgcuauuuuu

SEQ ID NO: 3700845 - RNA, 15 nt, Salmonella enterica enterica serovar Typhi Ty2
cauuuuaucuuuugu

SEQ ID NO: 3700846 - RNA, 15 nt, Salmonella enterica enterica serovar Typhi Ty2
cauuuuauuuaaaaa

SEQ ID NO: 3700847 - RNA, 18 nt, Salmonella enterica enterica serovar Typhi Ty2
cauuuucaccuggaugcu

SEQ ID NO: 3700848 - RNA, 17 nt, Salmonella enterica enterica serovar Typhi Ty2
cauuuuccgcugucuau

SEQ ID NO: 3700849 - RNA, 22 nt, Salmonella enterica enterica serovar Typhi Ty2
cauuuuccgcugucuauccacu

SEQ ID NO: 3700850 - RNA, 16 nt, Salmonella enterica enterica serovar Typhi Ty2
cauuuucggcagcgcg

SEQ ID NO: 3700851 - RNA, 15 nt, Salmonella enterica enterica serovar Typhi Ty2
cauuuucuuuacgcu

SEQ ID NO: 3700852 - RNA, 17 nt, Salmonella enterica enterica serovar Typhi Ty2
cauuuucuuucaucaaa

SEQ ID NO: 3700853 - RNA, 16 nt, Salmonella enterica enterica serovar Typhi Ty2
cauuuucuuugcagcu

SEQ ID NO: 3700854 - RNA, 22 nt, Salmonella enterica enterica serovar Typhi Ty2
cauuuugcgguuuuaauuucca

SEQ ID NO: 3700855 - RNA, 21 nt, Salmonella enterica enterica serovar Typhi Ty2
cauuuugcuggaaaaauaaga

SEQ ID NO: 3700856 - RNA, 18 nt, Salmonella enterica enterica serovar Typhi Ty2
cauuuuggccgcuuuagu

SEQ ID NO: 3700857 - RNA, 18 nt, Salmonella enterica enterica serovar Typhi Ty2
cauuuuggggaaaauacc

SEQ ID NO: 3700858 - RNA, 20 nt, Salmonella enterica enterica serovar Typhi Ty2
cauuuuguugcuccagcauc

SEQ ID NO: 3700859 - RNA, 14 nt, Salmonella enterica enterica serovar Typhi Ty2
cauuuuuaucagcu

SEQ ID NO: 3700860 - RNA, 15 nt, Salmonella enterica enterica serovar Typhi Ty2
ccaagauuuuucaga

SEQ ID NO: 3700861 - RNA, 18 nt, Salmonella enterica enterica serovar Typhi Ty2
ccaagcaacacggcgaca

SEQ ID NO: 3700862 - RNA, 14 nt, Salmonella enterica enterica serovar Typhi Ty2
ccaagcacaaaaag

SEQ ID NO: 3700863 - RNA, 22 nt, Salmonella enterica enterica serovar Typhi Ty2
ccaagcgcgguaaauuucuuga

SEQ ID NO: 3700864 - RNA, 19 nt, Salmonella enterica enterica serovar Typhi Ty2
ccaagcggcaucucgccaa

SEQ ID NO: 3700865 - RNA, 15 nt, Salmonella enterica enterica serovar Typhi Ty2
ccaagcguaguacgu

SEQ ID NO: 3700866 - RNA, 16 nt, Salmonella enterica enterica serovar Typhi Ty2
ccaagcgucagcaugg

SEQ ID NO: 3700867 - RNA, 17 nt, Salmonella enterica enterica serovar Typhi Ty2
ccaagcgucagcauggu

SEQ ID NO: 3700868 - RNA, 20 nt, Salmonella enterica enterica serovar Typhi Ty2
ccaagcuguggaaacugugc

SEQ ID NO: 3700869 - RNA, 17 nt, Salmonella enterica enterica serovar Typhi Ty2
ccaaguaaauuugcugu

SEQ ID NO: 3700870 - RNA, 14 nt, Salmonella enterica enterica serovar Typhi Ty2
ccaauaaacgccag

SEQ ID NO: 3700871 - RNA, 16 nt, Salmonella enterica enterica serovar Typhi Ty2
ccaauaacguaaccgc

SEQ ID NO: 3700872 - RNA, 12 nt, Salmonella enterica enterica serovar Typhi Ty2
ccaauaagaacu

SEQ ID NO: 3700873 - RNA, 16 nt, Salmonella enterica enterica serovar Typhi Ty2
ccaauaauaaucccaa

SEQ ID NO: 3700874 - RNA, 14 nt, Salmonella enterica enterica serovar Typhi Ty2
ccaauaauuuuaga

SEQ ID NO: 3700875 - RNA, 20 nt, Salmonella enterica enterica serovar Typhi Ty2
ccaauacccagcgccaacgc

SEQ ID NO: 3700876 - RNA, 23 nt, Salmonella enterica enterica serovar Typhi Ty2
ccaauacccagcgccaacgccac

SEQ ID NO: 3700877 - RNA, 23 nt, Salmonella enterica enterica serovar Typhi Ty2
ccaauacgccagccuaucgccau

SEQ ID NO: 3700878 - RNA, 13 nt, Salmonella enterica enterica serovar Typhi Ty2
ccaauagcgcuga

SEQ ID NO: 3700879 - RNA, 16 nt, Salmonella enterica enterica serovar Typhi Ty2
ccaauaguauccauaa

SEQ ID NO: 3700880 - RNA, 14 nt, Salmonella enterica enterica serovar Typhi Ty2
ccaauauccccagc

SEQ ID NO: 3700881 - RNA, 20 nt, Salmonella enterica enterica serovar Typhi Ty2
ccaauauugacguuaaaaug

SEQ ID NO: 3700882 - RNA, 12 nt, Salmonella enterica enterica serovar Typhi Ty2
ccaauauuuauu

SEQ ID NO: 3700883 - RNA, 16 nt, Salmonella enterica enterica serovar Typhi Ty2
ccaaucaacgccgcca

SEQ ID NO: 3700884 - RNA, 17 nt, Salmonella enterica enterica serovar Typhi Ty2
ccaaucagcggguauug

SEQ ID NO: 3700885 - RNA, 22 nt, Salmonella enterica enterica serovar Typhi Ty2
ccaaucaugucaaauucaagcc

SEQ ID NO: 3700886 - RNA, 15 nt, Salmonella enterica enterica serovar Typhi Ty2
ccaaucgagaagcca

SEQ ID NO: 3700887 - RNA, 19 nt, Salmonella enterica enterica serovar Typhi Ty2
ccaaucgagaagccaucaa

SEQ ID NO: 3700888 - RNA, 13 nt, Salmonella enterica enterica serovar Typhi Ty2
ccaaucuccagca

SEQ ID NO: 3700889 - RNA, 15 nt, Salmonella enterica enterica serovar Typhi Ty2
ccaaucuccagcauc

SEQ ID NO: 3700890 - RNA, 21 nt, Salmonella enterica enterica serovar Typhi Ty2
ccaaugaaauaauuguguaau

SEQ ID NO: 3700891 - RNA, 19 nt, Salmonella enterica enterica serovar Typhi Ty2
ccaaugaacccucgaaugu

SEQ ID NO: 3700892 - RNA, 16 nt, Salmonella enterica enterica serovar Typhi Ty2
ccaaugaugcgcugua

SEQ ID NO: 3700893 - RNA, 13 nt, Salmonella enterica enterica serovar Typhi Ty2
ccaaugcagcgcg

SEQ ID NO: 3700894 - RNA, 22 nt, Salmonella enterica enterica serovar Typhi Ty2
ccaaugcuuagucagccuuaau

SEQ ID NO: 3700895 - RNA, 21 nt, Salmonella enterica enterica serovar Typhi Ty2
ccaauggcgcgucuuaaaauu

SEQ ID NO: 3700896 - RNA, 17 nt, Salmonella enterica enterica serovar Typhi Ty2
ccaauguacacgaaaua

SEQ ID NO: 3700897 - RNA, 18 nt, Salmonella enterica enterica serovar Typhi Ty2
ccaaugucauauuuguga

SEQ ID NO: 3700898 - RNA, 15 nt, Salmonella enterica enterica serovar Typhi Ty2
ccaauguuaauaagc

SEQ ID NO: 3700899 - RNA, 21 nt, Salmonella enterica enterica serovar Typhi Ty2
ccaauugccacauagcaucca

SEQ ID NO: 3700900 - RNA, 12 nt, Salmonella enterica enterica serovar Typhi Ty2
ccaauuuuucac

SEQ ID NO: 3700901 - RNA, 15 nt, Salmonella enterica enterica serovar Typhi Ty2
ccacaaaggcgcgua

SEQ ID NO: 3700902 - RNA, 21 nt, Salmonella enterica enterica serovar Typhi Ty2
ccacaaauuuugauaaaaaca

SEQ ID NO: 3700903 - RNA, 22 nt, Salmonella enterica enterica serovar Typhi Ty2
ccacaaauuuugauaaaaacac

SEQ ID NO: 3700904 - RNA, 23 nt, Salmonella enterica enterica serovar Typhi Ty2
ccacaaccgcccccaacugagcg

SEQ ID NO: 3700905 - RNA, 16 nt, Salmonella enterica enterica serovar Typhi Ty2
ccacaaccggcuggcu

SEQ ID NO: 3700906 - RNA, 18 nt, Salmonella enterica enterica serovar Typhi Ty2
ccacaacgugauaaccaa

SEQ ID NO: 3700907 - RNA, 22 nt, Salmonella enterica enterica serovar Typhi Ty2
ccacaacgugauaaccaacagg

SEQ ID NO: 3700908 - RNA, 23 nt, Salmonella enterica enterica serovar Typhi Ty2
ccacaagagcagcaacccugccg

SEQ ID NO: 3700909 - RNA, 14 nt, Salmonella enterica enterica serovar Typhi Ty2
ccacaagcccggau

SEQ ID NO: 3700910 - RNA, 18 nt, Salmonella enterica enterica serovar Typhi Ty2
ccacaaucacagcgcaga

SEQ ID NO: 3700911 - RNA, 14 nt, Salmonella enterica enterica serovar Typhi Ty2
ccacaaucccgcca

SEQ ID NO: 3700912 - RNA, 19 nt, Salmonella enterica enterica serovar Typhi Ty2
ccacaauggcaggcagcag

SEQ ID NO: 3700913 - RNA, 21 nt, Salmonella enterica enterica serovar Typhi Ty2
ccacacgcuuauccugccacu

SEQ ID NO: 3700914 - RNA, 21 nt, Salmonella enterica enterica serovar Typhi Ty2
ccacacggaauccccggcuuc

SEQ ID NO: 3700915 - RNA, 16 nt, Salmonella enterica enterica serovar Typhi Ty2
ccacacggcauucacg

SEQ ID NO: 3700916 - RNA, 15 nt, Salmonella enterica enterica serovar Typhi Ty2
ccacacugcaucgaa

SEQ ID NO: 3700917 - RNA, 13 nt, Salmonella enterica enterica serovar Typhi Ty2
ccacacugcugug

SEQ ID NO: 3700918 - RNA, 18 nt, Salmonella enterica enterica serovar Typhi Ty2
ccacagccaccgccagca

SEQ ID NO: 3700919 - RNA, 14 nt, Salmonella enterica enterica serovar Typhi Ty2
ccacagccucagca

SEQ ID NO: 3700920 - RNA, 15 nt, Salmonella enterica enterica serovar Typhi Ty2
ccacaggccaacaua

SEQ ID NO: 3700921 - RNA, 21 nt, Salmonella enterica enterica serovar Typhi Ty2
ccacaggccguucauucgccc

SEQ ID NO: 3700922 - RNA, 20 nt, Salmonella enterica enterica serovar Typhi Ty2
ccacaggcgcuaauuaauuc

SEQ ID NO: 3700923 - RNA, 14 nt, Salmonella enterica enterica serovar Typhi Ty2
ccacaggcgucgcg

SEQ ID NO: 3700924 - RNA, 20 nt, Salmonella enterica enterica serovar Typhi Ty2
ccacaguaauggacagguaa

SEQ ID NO: 3700925 - RNA, 18 nt, Salmonella enterica enterica serovar Typhi Ty2
ccacagucgucuggcgcu

SEQ ID NO: 3700926 - RNA, 19 nt, Salmonella enterica enterica serovar Typhi Ty2
ccacagugacccgccgcca

SEQ ID NO: 3700927 - RNA, 20 nt, Salmonella enterica enterica serovar Typhi Ty2
ccacagugacccgccgccag

SEQ ID NO: 3700928 - RNA, 22 nt, Salmonella enterica enterica serovar Typhi Ty2
ccacagugacccgccgccagca

SEQ ID NO: 3700929 - RNA, 16 nt, Salmonella enterica enterica serovar Typhi Ty2
ccacaguuaacgccaa

SEQ ID NO: 3700930 - RNA, 17 nt, Salmonella enterica enterica serovar Typhi Ty2
ccacauacugaaauuuc

SEQ ID NO: 3700931 - RNA, 16 nt, Salmonella enterica enterica serovar Typhi Ty2
ccacauagcauccaga

SEQ ID NO: 3700932 - RNA, 16 nt, Salmonella enterica enterica serovar Typhi Ty2
ccacauauaaguaacu

SEQ ID NO: 3700933 - RNA, 14 nt, Salmonella enterica enterica serovar Typhi Ty2
ccacaucagaccgc

SEQ ID NO: 3700934 - RNA, 23 nt, Salmonella enterica enterica serovar Typhi Ty2
ccacauccagcgccagcgccacc

SEQ ID NO: 3700935 - RNA, 23 nt, Salmonella enterica enterica serovar Typhi Ty2
ccacaucgcgagcacuuuuuccu

SEQ ID NO: 3700936 - RNA, 21 nt, Salmonella enterica enterica serovar Typhi Ty2
ccacaucggaucgauaugugu

SEQ ID NO: 3700937 - RNA, 13 nt, Salmonella enterica enterica serovar Typhi Ty2
ccacaugaccagc

SEQ ID NO: 3700938 - RNA, 14 nt, Salmonella enterica enterica serovar Typhi Ty2
ccacaugaccagcg

SEQ ID NO: 3700939 - RNA, 21 nt, Salmonella enterica enterica serovar Typhi Ty2
ccacaugagaagggcaauauc

SEQ ID NO: 3700940 - RNA, 15 nt, Salmonella enterica enterica serovar Typhi Ty2
ccacauuaaagagcg

SEQ ID NO: 3700941 - RNA, 16 nt, Salmonella enterica enterica serovar Typhi Ty2
ccacauuccagaccug

SEQ ID NO: 3700942 - RNA, 19 nt, Salmonella enterica enterica serovar Typhi Ty2
ccacgcgaugcaaccccug

SEQ ID NO: 3700943 - RNA, 20 nt, Salmonella enterica enterica serovar Typhi Ty2
ccacgcgaugcaaccccuga

SEQ ID NO: 3700944 - RNA, 14 nt, Salmonella enterica enterica serovar Typhi Ty2
ccacgcgccgccga

SEQ ID NO: 3700945 - RNA, 21 nt, Salmonella enterica enterica serovar Typhi Ty2
ccacgcguacgguuacaaccc

SEQ ID NO: 3700946 - RNA, 14 nt, Salmonella enterica enterica serovar Typhi Ty2
ccacgcucacuuuu

SEQ ID NO: 3700947 - RNA, 17 nt, Salmonella enterica enterica serovar Typhi Ty2
ccacgcucgcuggugcc

SEQ ID NO: 3700948 - RNA, 22 nt, Salmonella enterica enterica serovar Typhi Ty2
ccacgcugauacguaacaugac

SEQ ID NO: 3700949 - RNA, 14 nt, Salmonella enterica enterica serovar Typhi Ty2
ccacgcuuuuccuu

SEQ ID NO: 3700950 - RNA, 16 nt, Salmonella enterica enterica serovar Typhi Ty2
ccacgcuuuuuuauuu

SEQ ID NO: 3700951 - RNA, 15 nt, Salmonella enterica enterica serovar Typhi Ty2
ccacggaaugaaugu

SEQ ID NO: 3700952 - RNA, 22 nt, Salmonella enterica enterica serovar Typhi Ty2
ccacggacaucggccucgcugg

SEQ ID NO: 3700953 - RNA, 19 nt, Salmonella enterica enterica serovar Typhi Ty2
ccacggauaagccagcccu

SEQ ID NO: 3700954 - RNA, 20 nt, Salmonella enterica enterica serovar Typhi Ty2
ccacggauauuuaccgccgc

SEQ ID NO: 3700955 - RNA, 15 nt, Salmonella enterica enterica serovar Typhi Ty2
ccacggccacagcca

SEQ ID NO: 3700956 - RNA, 15 nt, Salmonella enterica enterica serovar Typhi Ty2
ccacggcuucagcgg

SEQ ID NO: 3700957 - RNA, 12 nt, Salmonella enterica enterica serovar Typhi Ty2
ccacgggcgcac

SEQ ID NO: 3700958 - RNA, 13 nt, Salmonella enterica enterica serovar Typhi Ty2
ccacgggcgccac

SEQ ID NO: 3700959 - RNA, 21 nt, Salmonella enterica enterica serovar Typhi Ty2
ccacgggcgcguuaaugcauu

SEQ ID NO: 3700960 - RNA, 17 nt, Salmonella enterica enterica serovar Typhi Ty2
ccacgggguuggcccuc

SEQ ID NO: 3700961 - RNA, 15 nt, Salmonella enterica enterica serovar Typhi Ty2
ccacgguguaccccg

SEQ ID NO: 3700962 - RNA, 17 nt, Salmonella enterica enterica serovar Typhi Ty2
ccacgguucacggccaa

SEQ ID NO: 3700963 - RNA, 16 nt, Salmonella enterica enterica serovar Typhi Ty2
ccacguacugcuuacc

SEQ ID NO: 3700964 - RNA, 20 nt, Salmonella enterica enterica serovar Typhi Ty2
ccacguauuucgcagcgguc

SEQ ID NO: 3700965 - RNA, 14 nt, Salmonella enterica enterica serovar Typhi Ty2
ccacgucauccggc

SEQ ID NO: 3700966 - RNA, 17 nt, Salmonella enterica enterica serovar Typhi Ty2
ccacgucauccuccuga

SEQ ID NO: 3700967 - RNA, 13 nt, Salmonella enterica enterica serovar Typhi Ty2
ccacgucggauaa

SEQ ID NO: 3700968 - RNA, 14 nt, Salmonella enterica enterica serovar Typhi Ty2
ccacguuaccgcgc

SEQ ID NO: 3700969 - RNA, 21 nt, Salmonella enterica enterica serovar Typhi Ty2
ccacguucggcguguagccaa

SEQ ID NO: 3700970 - RNA, 17 nt, Salmonella enterica enterica serovar Typhi Ty2
ccacguucuuccagaac

SEQ ID NO: 3700971 - RNA, 13 nt, Salmonella enterica enterica serovar Typhi Ty2
ccacuacgcagcu

SEQ ID NO: 3700972 - RNA, 15 nt, Salmonella enterica enterica serovar Typhi Ty2
ccacuacgcagcucc

SEQ ID NO: 3700973 - RNA, 12 nt, Salmonella enterica enterica serovar Typhi Ty2
ccacuagcgcuu

SEQ ID NO: 3700974 - RNA, 21 nt, Salmonella enterica enterica serovar Typhi Ty2
ccacuauaguugacgccccau

SEQ ID NO: 3700975 - RNA, 15 nt, Salmonella enterica enterica serovar Typhi Ty2
ccacucauccagcaa

SEQ ID NO: 3700976 - RNA, 16 nt, Salmonella enterica enterica serovar Typhi Ty2
ccacuccccaacguaa

SEQ ID NO: 3700977 - RNA, 18 nt, Salmonella enterica enterica serovar Typhi Ty2
ccacuccgccaguacaua

SEQ ID NO: 3700978 - RNA, 16 nt, Salmonella enterica enterica serovar Typhi Ty2
ccacuccggugcccau

SEQ ID NO: 3700979 - RNA, 17 nt, Salmonella enterica enterica serovar Typhi Ty2
ccacucuuuuaaggccc

SEQ ID NO: 3700980 - RNA, 20 nt, Salmonella enterica enterica serovar Typhi Ty2
ccacugauaguccaucaccu

SEQ ID NO: 3700981 - RNA, 14 nt, Salmonella enterica enterica serovar Typhi Ty2
ccacugcacgccag

SEQ ID NO: 3700982 - RNA, 17 nt, Salmonella enterica enterica serovar Typhi Ty2
ccacugcccgccgccac

SEQ ID NO: 3700983 - RNA, 21 nt, Salmonella enterica enterica serovar Typhi Ty2
ccacuggcagcgccugacggc

SEQ ID NO: 3700984 - RNA, 14 nt, Salmonella enterica enterica serovar Typhi Ty2
ccacuggccuccca

SEQ ID NO: 3700985 - RNA, 18 nt, Salmonella enterica enterica serovar Typhi Ty2
ccacuggguuucccauug

SEQ ID NO: 3700986 - RNA, 12 nt, Salmonella enterica enterica serovar Typhi Ty2
ccacuucagcag

SEQ ID NO: 3700987 - RNA, 20 nt, Salmonella enterica enterica serovar Typhi Ty2
ccacuucuuccagcggcaga

SEQ ID NO: 3700988 - RNA, 19 nt, Salmonella enterica enterica serovar Typhi Ty2
ccacuuucuguaauuugaa

SEQ ID NO: 3700989 - RNA, 13 nt, Salmonella enterica enterica serovar Typhi Ty2
ccacuuugcgcuc

SEQ ID NO: 3700990 - RNA, 16 nt, Salmonella enterica enterica serovar Typhi Ty2
ccacuuugcgcuccug

SEQ ID NO: 3700991 - RNA, 16 nt, Salmonella enterica enterica serovar Typhi Ty2
ccagaaaaaaaagcgc

SEQ ID NO: 3700992 - RNA, 16 nt, Salmonella enterica enterica serovar Typhi Ty2
ccagaaaaagggaaaa

SEQ ID NO: 3700993 - RNA, 12 nt, Salmonella enterica enterica serovar Typhi Ty2
ccagaacagaag

SEQ ID NO: 3700994 - RNA, 17 nt, Salmonella enterica enterica serovar Typhi Ty2
ccagaaccguugcgccc

SEQ ID NO: 3700995 - RNA, 23 nt, Salmonella enterica enterica serovar Typhi Ty2
ccagaacgaauuuacucgccaau

SEQ ID NO: 3700996 - RNA, 13 nt, Salmonella enterica enterica serovar Typhi Ty2
ccagaacggcagc

SEQ ID NO: 3700997 - RNA, 14 nt, Salmonella enterica enterica serovar Typhi Ty2
ccagaacggcagcg

SEQ ID NO: 3700998 - RNA, 13 nt, Salmonella enterica enterica serovar Typhi Ty2
ccagaacucaucu

SEQ ID NO: 3700999 - RNA, 19 nt, Salmonella enterica enterica serovar Typhi Ty2
ccagaacugcgaaaucacc

SEQ ID NO: 3701000 - RNA, 14 nt, Salmonella enterica enterica serovar Typhi Ty2
ccagaagcacuucu

SEQ ID NO: 3701001 - RNA, 17 nt, Salmonella enterica enterica serovar Typhi Ty2
ccagaagcacuucucca

SEQ ID NO: 3701002 - RNA, 20 nt, Salmonella enterica enterica serovar Typhi Ty2
ccagaagcgcuuugccaaug

SEQ ID NO: 3701003 - RNA, 19 nt, Salmonella enterica enterica serovar Typhi Ty2
ccagaaguagcagagaaaa

SEQ ID NO: 3701004 - RNA, 16 nt, Salmonella enterica enterica serovar Typhi Ty2
ccagaauacaccgccu

SEQ ID NO: 3701005 - RNA, 15 nt, Salmonella enterica enterica serovar Typhi Ty2
ccagaauacgccgcc

SEQ ID NO: 3701006 - RNA, 18 nt, Salmonella enterica enterica serovar Typhi Ty2
ccagaauagcgcagucaa

SEQ ID NO: 3701007 - RNA, 18 nt, Salmonella enterica enterica serovar Typhi Ty2
ccagaaucaccgacagca

SEQ ID NO: 3701008 - RNA, 19 nt, Salmonella enterica enterica serovar Typhi Ty2
ccagaaucaccgacagcac

SEQ ID NO: 3701009 - RNA, 14 nt, Salmonella enterica enterica serovar Typhi Ty2
ccagaaucaccucu

SEQ ID NO: 3701010 - RNA, 16 nt, Salmonella enterica enterica serovar Typhi Ty2
ccagaaucaccucuuu

SEQ ID NO: 3701011 - RNA, 22 nt, Salmonella enterica enterica serovar Typhi Ty2
ccagaaucaucgcuaucaugcu

SEQ ID NO: 3701012 - RNA, 19 nt, Salmonella enterica enterica serovar Typhi Ty2
ccagaaucccacggagaaa

SEQ ID NO: 3701013 - RNA, 13 nt, Salmonella enterica enterica serovar Typhi Ty2
ccagaauucagca

SEQ ID NO: 3701014 - RNA, 18 nt, Salmonella enterica enterica serovar Typhi Ty2
ccagaauucagcauguac

SEQ ID NO: 3701015 - RNA, 22 nt, Salmonella enterica enterica serovar Typhi Ty2
ccagaauuuccuucgcuuccug

SEQ ID NO: 3701016 - RNA, 13 nt, Salmonella enterica enterica serovar Typhi Ty2
ccagacaauccgc

SEQ ID NO: 3701017 - RNA, 23 nt, Salmonella enterica enterica serovar Typhi Ty2
ccagacaauccgcggcaaacccc

SEQ ID NO: 3701018 - RNA, 13 nt, Salmonella enterica enterica serovar Typhi Ty2
ccagacacuggaa

SEQ ID NO: 3701019 - RNA, 20 nt, Salmonella enterica enterica serovar Typhi Ty2
ccagacacuggaaacagcca

SEQ ID NO: 3701020 - RNA, 22 nt, Salmonella enterica enterica serovar Typhi Ty2
ccagacacuggaaacagccaau

SEQ ID NO: 3701021 - RNA, 15 nt, Salmonella enterica enterica serovar Typhi Ty2
ccagacagauaacac

SEQ ID NO: 3701022 - RNA, 18 nt, Salmonella enterica enterica serovar Typhi Ty2
ccagacagauaacaccag

SEQ ID NO: 3701023 - RNA, 19 nt, Salmonella enterica enterica serovar Typhi Ty2
ccagacagauaacaccagc

SEQ ID NO: 3701024 - RNA, 19 nt, Salmonella enterica enterica serovar Typhi Ty2
ccagcgacgguaauaccaa

SEQ ID NO: 3701025 - RNA, 20 nt, Salmonella enterica enterica serovar Typhi Ty2
ccagcgacgguaauaccaac

SEQ ID NO: 3701026 - RNA, 20 nt, Salmonella enterica enterica serovar Typhi Ty2
ccagcgacuccggauagaga

SEQ ID NO: 3701027 - RNA, 16 nt, Salmonella enterica enterica serovar Typhi Ty2
ccagcgaugagcgcca

SEQ ID NO: 3701028 - RNA, 18 nt, Salmonella enterica enterica serovar Typhi Ty2
ccagcgaugagcgccagc

SEQ ID NO: 3701029 - RNA, 17 nt, Salmonella enterica enterica serovar Typhi Ty2
ccagcgauuacgccaga

SEQ ID NO: 3701030 - RNA, 19 nt, Salmonella enterica enterica serovar Typhi Ty2
ccagcgauuacgccagaca

SEQ ID NO: 3701031 - RNA, 16 nt, Salmonella enterica enterica serovar Typhi Ty2
ccagcgauuauuucau

SEQ ID NO: 3701032 - RNA, 23 nt, Salmonella enterica enterica serovar Typhi Ty2
ccagcgauuuuuacgccauucau

SEQ ID NO: 3701033 - RNA, 22 nt, Salmonella enterica enterica serovar Typhi Ty2
ccagcgcaagcagcgccccgcc

SEQ ID NO: 3701034 - RNA, 15 nt, Salmonella enterica enterica serovar Typhi Ty2
ccagcgcagucaaaa

SEQ ID NO: 3701035 - RNA, 13 nt, Salmonella enterica enterica serovar Typhi Ty2
ccagcgcauccac

SEQ ID NO: 3701036 - RNA, 21 nt, Salmonella enterica enterica serovar Typhi Ty2
ccagcgcauguuucgcuucaa

SEQ ID NO: 3701037 - RNA, 22 nt, Salmonella enterica enterica serovar Typhi Ty2
ccagcgcauguuucgcuucaau

SEQ ID NO: 3701038 - RNA, 15 nt, Salmonella enterica enterica serovar Typhi Ty2
ccagcgccagcguag

SEQ ID NO: 3701039 - RNA, 14 nt, Salmonella enterica enterica serovar Typhi Ty2
ccagcgccagcucc

SEQ ID NO: 3701040 - RNA, 17 nt, Salmonella enterica enterica serovar Typhi Ty2
ccagcgcccacaccaua

SEQ ID NO: 3701041 - RNA, 15 nt, Salmonella enterica enterica serovar Typhi Ty2
ccagcgcccccagca

SEQ ID NO: 3701042 - RNA, 13 nt, Salmonella enterica enterica serovar Typhi Ty2
ccagcgccccugc

SEQ ID NO: 3701043 - RNA, 14 nt, Salmonella enterica enterica serovar Typhi Ty2
ccagcgcccgcuuc

SEQ ID NO: 3701044 - RNA, 13 nt, Salmonella enterica enterica serovar Typhi Ty2
ccagcgcccuauc

SEQ ID NO: 3701045 - RNA, 22 nt, Salmonella enterica enterica serovar Typhi Ty2
ccagcgccgaaggauuauuggc

SEQ ID NO: 3701046 - RNA, 13 nt, Salmonella enterica enterica serovar Typhi Ty2
ccagcgccgccag

SEQ ID NO: 3701047 - RNA, 18 nt, Salmonella enterica enterica serovar Typhi Ty2
ccagcgccgccagaauca

SEQ ID NO: 3701048 - RNA, 12 nt, Salmonella enterica enterica serovar Typhi Ty2
ccagcgccgccg

SEQ ID NO: 3701049 - RNA, 13 nt, Salmonella enterica enterica serovar Typhi Ty2
ccagcgccgccgc

SEQ ID NO: 3701050 - RNA, 12 nt, Salmonella enterica enterica serovar Typhi Ty2
ccagcgccgccu

SEQ ID NO: 3701051 - RNA, 12 nt, Salmonella enterica enterica serovar Typhi Ty2
ccagcgccgcgc

SEQ ID NO: 3701052 - RNA, 20 nt, Salmonella enterica enterica serovar Typhi Ty2
ccagcgccgcggccuccgga

SEQ ID NO: 3701053 - RNA, 12 nt, Salmonella enterica enterica serovar Typhi Ty2
ccagcgccggac

SEQ ID NO: 3701054 - RNA, 12 nt, Salmonella enterica enterica serovar Typhi Ty2
ccagcgccggau

SEQ ID NO: 3701055 - RNA, 20 nt, Salmonella enterica enterica serovar Typhi Ty2
ccagcgccugcgcugcaaua

SEQ ID NO: 3701056 - RNA, 16 nt, Salmonella enterica enterica serovar Typhi Ty2
ccagcgccuucuucac

SEQ ID NO: 3701057 - RNA, 16 nt, Salmonella enterica enterica serovar Typhi Ty2
ccagcgcgaauuugcc

SEQ ID NO: 3701058 - RNA, 21 nt, Salmonella enterica enterica serovar Typhi Ty2
ccagcgcgaauuugccccaga

SEQ ID NO: 3701059 - RNA, 20 nt, Salmonella enterica enterica serovar Typhi Ty2
ccagcgcgaccugcaucccu

SEQ ID NO: 3701060 - RNA, 17 nt, Salmonella enterica enterica serovar Typhi Ty2
ccagcgcgccauccuga

SEQ ID NO: 3701061 - RNA, 18 nt, Salmonella enterica enterica serovar Typhi Ty2
ccagcgcgccgcagcgcc

SEQ ID NO: 3701062 - RNA, 19 nt, Salmonella enterica enterica serovar Typhi Ty2
ccagcgcgccgcagcgccg

SEQ ID NO: 3701063 - RNA, 21 nt, Salmonella enterica enterica serovar Typhi Ty2
ccagcgcgccgccaacgccaa

SEQ ID NO: 3701064 - RNA, 13 nt, Salmonella enterica enterica serovar Typhi Ty2
ccagcgcggccca

SEQ ID NO: 3701065 - RNA, 19 nt, Salmonella enterica enterica serovar Typhi Ty2
ccagcgcgggcgaggccuc

SEQ ID NO: 3701066 - RNA, 16 nt, Salmonella enterica enterica serovar Typhi Ty2
ccagcgcgugaaccgu

SEQ ID NO: 3701067 - RNA, 16 nt, Salmonella enterica enterica serovar Typhi Ty2
ccagcgcguuuuccau

SEQ ID NO: 3701068 - RNA, 18 nt, Salmonella enterica enterica serovar Typhi Ty2
ccagcgcuauccaggccg

SEQ ID NO: 3701069 - RNA, 19 nt, Salmonella enterica enterica serovar Typhi Ty2
ccagcgcugagaugaccau

SEQ ID NO: 3701070 - RNA, 17 nt, Salmonella enterica enterica serovar Typhi Ty2
ccagcgcuucuguuaaa

SEQ ID NO: 3701071 - RNA, 22 nt, Salmonella enterica enterica serovar Typhi Ty2
ccagcgcuucuguuaaaaaauu

SEQ ID NO: 3701072 - RNA, 13 nt, Salmonella enterica enterica serovar Typhi Ty2
ccagcggccagcc

SEQ ID NO: 3701073 - RNA, 14 nt, Salmonella enterica enterica serovar Typhi Ty2
ccagcggcccgcgc

SEQ ID NO: 3701074 - RNA, 12 nt, Salmonella enterica enterica serovar Typhi Ty2
ccagcggccgcu

SEQ ID NO: 3701075 - RNA, 19 nt, Salmonella enterica enterica serovar Typhi Ty2
ccagcggcgccaucaccau

SEQ ID NO: 3701076 - RNA, 18 nt, Salmonella enterica enterica serovar Typhi Ty2
ccagcggcggcuugccuu

SEQ ID NO: 3701077 - RNA, 23 nt, Salmonella enterica enterica serovar Typhi Ty2
ccagcggcguuuuuuccugcugg

SEQ ID NO: 3701078 - RNA, 18 nt, Salmonella enterica enterica serovar Typhi Ty2
ccagcgggcgcaguccag

SEQ ID NO: 3701079 - RNA, 18 nt, Salmonella enterica enterica serovar Typhi Ty2
ccagcguacaucuuccau

SEQ ID NO: 3701080 - RNA, 17 nt, Salmonella enterica enterica serovar Typhi Ty2
ccagcguaccacgccgc

SEQ ID NO: 3701081 - RNA, 19 nt, Salmonella enterica enterica serovar Typhi Ty2
ccagcguagauucacugug

SEQ ID NO: 3701082 - RNA, 20 nt, Salmonella enterica enterica serovar Typhi Ty2
ccagcguagcuaaacccgua

SEQ ID NO: 3701083 - RNA, 21 nt, Salmonella enterica enterica serovar Typhi Ty2
ccagcguauaauuaagcugcg

SEQ ID NO: 3701084 - RNA, 22 nt, Salmonella enterica enterica serovar Typhi Ty2
ccagcguaucgcucugcuucgg

SEQ ID NO: 3701085 - RNA, 20 nt, Salmonella enterica enterica serovar Typhi Ty2
ccagcguaugauagcgagca

SEQ ID NO: 3701086 - RNA, 23 nt, Salmonella enterica enterica serovar Typhi Ty2
ccagcguaugauagcgagcaaga

SEQ ID NO: 3701087 - RNA, 15 nt, Salmonella enterica enterica serovar Typhi Ty2
ccagcgucacaggcu

SEQ ID NO: 3701088 - RNA, 15 nt, Salmonella enterica enterica serovar Typhi Ty2
ccagcgucagccaga

SEQ ID NO: 3701089 - RNA, 22 nt, Salmonella enterica enterica serovar Typhi Ty2
ccagcgucgucauagcguugau

SEQ ID NO: 3701090 - RNA, 16 nt, Salmonella enterica enterica serovar Typhi Ty2
ccagcgugacccagac

SEQ ID NO: 3701091 - RNA, 17 nt, Salmonella enterica enterica serovar Typhi Ty2
ccagcgugacccagaca

SEQ ID NO: 3701092 - RNA, 19 nt, Salmonella enterica enterica serovar Typhi Ty2
ccagcgugccgagcaacag

SEQ ID NO: 3701093 - RNA, 23 nt, Salmonella enterica enterica serovar Typhi Ty2
ccagcgugccgagcaacagaaac

SEQ ID NO: 3701094 - RNA, 15 nt, Salmonella enterica enterica serovar Typhi Ty2
ccagcgugcgcagcg

SEQ ID NO: 3701095 - RNA, 16 nt, Salmonella enterica enterica serovar Typhi Ty2
ccagcguugaccagcc

SEQ ID NO: 3701096 - RNA, 19 nt, Salmonella enterica enterica serovar Typhi Ty2
ccagcuauuuuucaccaua

SEQ ID NO: 3701097 - RNA, 15 nt, Salmonella enterica enterica serovar Typhi Ty2
ccagcucaaccgcgc

SEQ ID NO: 3701098 - RNA, 13 nt, Salmonella enterica enterica serovar Typhi Ty2
ccagcucauagga

SEQ ID NO: 3701099 - RNA, 15 nt, Salmonella enterica enterica serovar Typhi Ty2
ccagcucauguaguc

SEQ ID NO: 3701100 - RNA, 22 nt, Salmonella enterica enterica serovar Typhi Ty2
ccagcucauuuuuacagacacg

SEQ ID NO: 3701101 - RNA, 15 nt, Salmonella enterica enterica serovar Typhi Ty2
ccagcuccauagaaa

SEQ ID NO: 3701102 - RNA, 22 nt, Salmonella enterica enterica serovar Typhi Ty2
ccagcuccauagaaaucagcag

SEQ ID NO: 3701103 - RNA, 19 nt, Salmonella enterica enterica serovar Typhi Ty2
ccagcuccgcgcuuauuga

SEQ ID NO: 3701104 - RNA, 16 nt, Salmonella enterica enterica serovar Typhi Ty2
ccagcucuacaucgcc

SEQ ID NO: 3701105 - RNA, 20 nt, Salmonella enterica enterica serovar Typhi Ty2
ccagcucuacaucgccgcga

SEQ ID NO: 3701106 - RNA, 17 nt, Salmonella enterica enterica serovar Typhi Ty2
ccagguucaagcuggaa

SEQ ID NO: 3701107 - RNA, 12 nt, Salmonella enterica enterica serovar Typhi Ty2
ccagguucagca

SEQ ID NO: 3701108 - RNA, 20 nt, Salmonella enterica enterica serovar Typhi Ty2
ccaguaaaaucggaccuccg

SEQ ID NO: 3701109 - RNA, 22 nt, Salmonella enterica enterica serovar Typhi Ty2
ccaguaaaaucggaccuccgcg

SEQ ID NO: 3701110 - RNA, 19 nt, Salmonella enterica enterica serovar Typhi Ty2
ccaguaaagacacgacgau

SEQ ID NO: 3701111 - RNA, 19 nt, Salmonella enterica enterica serovar Typhi Ty2
ccaguaauaucgccucccu

SEQ ID NO: 3701112 - RNA, 23 nt, Salmonella enterica enterica serovar Typhi Ty2
ccaguaaucggcgcgaaacaggu

SEQ ID NO: 3701113 - RNA, 17 nt, Salmonella enterica enterica serovar Typhi Ty2
ccaguaaugccgugccg

SEQ ID NO: 3701114 - RNA, 15 nt, Salmonella enterica enterica serovar Typhi Ty2
ccaguaauuuuuccg

SEQ ID NO: 3701115 - RNA, 14 nt, Salmonella enterica enterica serovar Typhi Ty2
ccaguaauuuuucu

SEQ ID NO: 3701116 - RNA, 17 nt, Salmonella enterica enterica serovar Typhi Ty2
ccaguacaaacaaauaa

SEQ ID NO: 3701117 - RNA, 22 nt, Salmonella enterica enterica serovar Typhi Ty2
ccaguacaaacaaauaaaucca

SEQ ID NO: 3701118 - RNA, 22 nt, Salmonella enterica enterica serovar Typhi Ty2
ccaguacaauuucuggccccug

SEQ ID NO: 3701119 - RNA, 13 nt, Salmonella enterica enterica serovar Typhi Ty2
ccaguaccagcac

SEQ ID NO: 3701120 - RNA, 15 nt, Salmonella enterica enterica serovar Typhi Ty2
ccaguaccgccgccg

SEQ ID NO: 3701121 - RNA, 17 nt, Salmonella enterica enterica serovar Typhi Ty2
ccaguacggcgcgaauc

SEQ ID NO: 3701122 - RNA, 21 nt, Salmonella enterica enterica serovar Typhi Ty2
ccaguacgucaacaaugcuuu

SEQ ID NO: 3701123 - RNA, 15 nt, Salmonella enterica enterica serovar Typhi Ty2
ccaguacuuucuuuu

SEQ ID NO: 3701124 - RNA, 12 nt, Salmonella enterica enterica serovar Typhi Ty2
ccaguagcagcg

SEQ ID NO: 3701125 - RNA, 13 nt, Salmonella enterica enterica serovar Typhi Ty2
ccaguagcagcga

SEQ ID NO: 3701126 - RNA, 18 nt, Salmonella enterica enterica serovar Typhi Ty2
ccaguagcgcgacgccaa

SEQ ID NO: 3701127 - RNA, 14 nt, Salmonella enterica enterica serovar Typhi Ty2
ccaguagcgcgccc

SEQ ID NO: 3701128 - RNA, 14 nt, Salmonella enterica enterica serovar Typhi Ty2
ccaguagcugcucc

SEQ ID NO: 3701129 - RNA, 18 nt, Salmonella enterica enterica serovar Typhi Ty2
ccaguaguugaccugauc

SEQ ID NO: 3701130 - RNA, 21 nt, Salmonella enterica enterica serovar Typhi Ty2
ccagucaaaaugucaguaucg

SEQ ID NO: 3701131 - RNA, 21 nt, Salmonella enterica enterica serovar Typhi Ty2
ccagucaacgaggugaauaaa

SEQ ID NO: 3701132 - RNA, 18 nt, Salmonella enterica enterica serovar Typhi Ty2
ccagucaucauaauucag

SEQ ID NO: 3701133 - RNA, 14 nt, Salmonella enterica enterica serovar Typhi Ty2
ccagucaucgccgc

SEQ ID NO: 3701134 - RNA, 14 nt, Salmonella enterica enterica serovar Typhi Ty2
ccaguccccuuuuc

SEQ ID NO: 3701135 - RNA, 23 nt, Salmonella enterica enterica serovar Typhi Ty2
ccagucccugaagaaaaggaaug

SEQ ID NO: 3701136 - RNA, 13 nt, Salmonella enterica enterica serovar Typhi Ty2
ccaguccggcaga

SEQ ID NO: 3701137 - RNA, 21 nt, Salmonella enterica enterica serovar Typhi Ty2
ccaguccuccggcugaagccc

SEQ ID NO: 3701138 - RNA, 17 nt, Salmonella enterica enterica serovar Typhi Ty2
ccaguccugccaccagc

SEQ ID NO: 3701139 - RNA, 18 nt, Salmonella enterica enterica serovar Typhi Ty2
ccaguccugucccugcca

SEQ ID NO: 3701140 - RNA, 13 nt, Salmonella enterica enterica serovar Typhi Ty2
ccagucgcagcca

SEQ ID NO: 3701141 - RNA, 15 nt, Salmonella enterica enterica serovar Typhi Ty2
ccagucgcuccacca

SEQ ID NO: 3701142 - RNA, 16 nt, Salmonella enterica enterica serovar Typhi Ty2
ccagucgcuccaccac

SEQ ID NO: 3701143 - RNA, 17 nt, Salmonella enterica enterica serovar Typhi Ty2
ccagucgcuccaccacu

SEQ ID NO: 3701144 - RNA, 21 nt, Salmonella enterica enterica serovar Typhi Ty2
ccagucgcucuaacugaugug

SEQ ID NO: 3701145 - RNA, 22 nt, Salmonella enterica enterica serovar Typhi Ty2
ccagucggcaaagaccaauaaa

SEQ ID NO: 3701146 - RNA, 15 nt, Salmonella enterica enterica serovar Typhi Ty2
ccagucgggcgugcc

SEQ ID NO: 3701147 - RNA, 16 nt, Salmonella enterica enterica serovar Typhi Ty2
ccagucgggcgugccg

SEQ ID NO: 3701148 - RNA, 14 nt, Salmonella enterica enterica serovar Typhi Ty2
ccagucguaauuca

SEQ ID NO: 3701149 - RNA, 16 nt, Salmonella enterica enterica serovar Typhi Ty2
ccagucuuccugcggu

SEQ ID NO: 3701150 - RNA, 14 nt, Salmonella enterica enterica serovar Typhi Ty2
ccagugaaaaaaag

SEQ ID NO: 3701151 - RNA, 15 nt, Salmonella enterica enterica serovar Typhi Ty2
ccagugaaauaaaug

SEQ ID NO: 3701152 - RNA, 14 nt, Salmonella enterica enterica serovar Typhi Ty2
ccagugaauacugc

SEQ ID NO: 3701153 - RNA, 16 nt, Salmonella enterica enterica serovar Typhi Ty2
ccagugaauccaccac

SEQ ID NO: 3701154 - RNA, 19 nt, Salmonella enterica enterica serovar Typhi Ty2
ccagugcagaaagugugau

SEQ ID NO: 3701155 - RNA, 21 nt, Salmonella enterica enterica serovar Typhi Ty2
ccagugccaccagccggagcc

SEQ ID NO: 3701156 - RNA, 23 nt, Salmonella enterica enterica serovar Typhi Ty2
ccagugccaccagccggagccgg

SEQ ID NO: 3701157 - RNA, 17 nt, Salmonella enterica enterica serovar Typhi Ty2
ccagugccaguuaagca

SEQ ID NO: 3701158 - RNA, 22 nt, Salmonella enterica enterica serovar Typhi Ty2
ccagugcgcauacuaccgcugc

SEQ ID NO: 3701159 - RNA, 13 nt, Salmonella enterica enterica serovar Typhi Ty2
ccaguggcaaaau

SEQ ID NO: 3701160 - RNA, 21 nt, Salmonella enterica enterica serovar Typhi Ty2
ccaguggucguuagccagaug

SEQ ID NO: 3701161 - RNA, 20 nt, Salmonella enterica enterica serovar Typhi Ty2
ccagugguuccauuccagaa

SEQ ID NO: 3701162 - RNA, 21 nt, Salmonella enterica enterica serovar Typhi Ty2
ccagugugcgguggcaacgcu

SEQ ID NO: 3701163 - RNA, 16 nt, Salmonella enterica enterica serovar Typhi Ty2
ccaguuauagcgcaga

SEQ ID NO: 3701164 - RNA, 14 nt, Salmonella enterica enterica serovar Typhi Ty2
ccaguucaaucagg

SEQ ID NO: 3701165 - RNA, 21 nt, Salmonella enterica enterica serovar Typhi Ty2
ccaguucauaagucauccaga

SEQ ID NO: 3701166 - RNA, 16 nt, Salmonella enterica enterica serovar Typhi Ty2
ccaguucccacagcuu

SEQ ID NO: 3701167 - RNA, 19 nt, Salmonella enterica enterica serovar Typhi Ty2
ccaguucgccuucuucauc

SEQ ID NO: 3701168 - RNA, 23 nt, Salmonella enterica enterica serovar Typhi Ty2
ccaguucucaaucgccgcauggg

SEQ ID NO: 3701169 - RNA, 14 nt, Salmonella enterica enterica serovar Typhi Ty2
ccaguucucuucuu

SEQ ID NO: 3701170 - RNA, 17 nt, Salmonella enterica enterica serovar Typhi Ty2
ccaguugcauacauaaa

SEQ ID NO: 3701171 - RNA, 18 nt, Salmonella enterica enterica serovar Typhi Ty2
ccaguugcgccagcguaa

SEQ ID NO: 3701172 - RNA, 18 nt, Salmonella enterica enterica serovar Typhi Ty2
ccaguugcgucagcguac

SEQ ID NO: 3701173 - RNA, 20 nt, Salmonella enterica enterica serovar Typhi Ty2
ccaguugcucauaacggcua

SEQ ID NO: 3701174 - RNA, 15 nt, Salmonella enterica enterica serovar Typhi Ty2
ccaguugcugcaucg

SEQ ID NO: 3701175 - RNA, 14 nt, Salmonella enterica enterica serovar Typhi Ty2
ccaguuggcaacgu

SEQ ID NO: 3701176 - RNA, 18 nt, Salmonella enterica enterica serovar Typhi Ty2
ccaguuggcgaccgcugc

SEQ ID NO: 3701177 - RNA, 17 nt, Salmonella enterica enterica serovar Typhi Ty2
ccaguuguuccagcagc

SEQ ID NO: 3701178 - RNA, 14 nt, Salmonella enterica enterica serovar Typhi Ty2
ccaguuguuuauuc

SEQ ID NO: 3701179 - RNA, 22 nt, Salmonella enterica enterica serovar Typhi Ty2
ccaguuguuuauuccauucauc

SEQ ID NO: 3701180 - RNA, 14 nt, Salmonella enterica enterica serovar Typhi Ty2
ccaguuuacgcgua

SEQ ID NO: 3701181 - RNA, 15 nt, Salmonella enterica enterica serovar Typhi Ty2
ccaguuucaaugccc

SEQ ID NO: 3701182 - RNA, 18 nt, Salmonella enterica enterica serovar Typhi Ty2
ccaguuucaaugcccagg

SEQ ID NO: 3701183 - RNA, 19 nt, Salmonella enterica enterica serovar Typhi Ty2
ccaguuuccugacccgcuc

SEQ ID NO: 3701184 - RNA, 22 nt, Salmonella enterica enterica serovar Typhi Ty2
ccaguuucugacguaacuuauc

SEQ ID NO: 3701185 - RNA, 19 nt, Salmonella enterica enterica serovar Typhi Ty2
ccaguuugcguucacagca

SEQ ID NO: 3701186 - RNA, 21 nt, Salmonella enterica enterica serovar Typhi Ty2
ccaguuugcguucacagcacc

SEQ ID NO: 3701187 - RNA, 18 nt, Salmonella enterica enterica serovar Typhi Ty2
ccaguuuuccgccugaau

SEQ ID NO: 3701188 - RNA, 14 nt, Salmonella enterica enterica serovar Typhi Ty2
ccauccggcacugu

SEQ ID NO: 3701189 - RNA, 15 nt, Salmonella enterica enterica serovar Typhi Ty2
ccauccggcaucucu

SEQ ID NO: 3701190 - RNA, 16 nt, Salmonella enterica enterica serovar Typhi Ty2
ccauccggcauuuuuu

SEQ ID NO: 3701191 - RNA, 19 nt, Salmonella enterica enterica serovar Typhi Ty2
ccauccgggccacucucca

SEQ ID NO: 3701192 - RNA, 22 nt, Salmonella enterica enterica serovar Typhi Ty2
ccauccucauuuuguugcucca

SEQ ID NO: 3701193 - RNA, 16 nt, Salmonella enterica enterica serovar Typhi Ty2
ccaucgacgaaauggu

SEQ ID NO: 3701194 - RNA, 14 nt, Salmonella enterica enterica serovar Typhi Ty2
ccaucgccagauaa

SEQ ID NO: 3701195 - RNA, 19 nt, Salmonella enterica enterica serovar Typhi Ty2
ccaucgcccgggcgauauc

SEQ ID NO: 3701196 - RNA, 23 nt, Salmonella enterica enterica serovar Typhi Ty2
ccaucgcgaauuucaaucgccag

SEQ ID NO: 3701197 - RNA, 23 nt, Salmonella enterica enterica serovar Typhi Ty2
ccaucgcggcgcaaaucgccauc

SEQ ID NO: 3701198 - RNA, 17 nt, Salmonella enterica enterica serovar Typhi Ty2
ccaucggcaaacgccgc

SEQ ID NO: 3701199 - RNA, 19 nt, Salmonella enterica enterica serovar Typhi Ty2
ccaucggcaaacgccgccu

SEQ ID NO: 3701200 - RNA, 21 nt, Salmonella enterica enterica serovar Typhi Ty2
ccaucggcacgucgucccagg

SEQ ID NO: 3701201 - RNA, 23 nt, Salmonella enterica enterica serovar Typhi Ty2
ccaucggcaucggucucgcuaua

SEQ ID NO: 3701202 - RNA, 17 nt, Salmonella enterica enterica serovar Typhi Ty2
ccaucggcgggcguauc

SEQ ID NO: 3701203 - RNA, 16 nt, Salmonella enterica enterica serovar Typhi Ty2
ccaucggucgcgcgca

SEQ ID NO: 3701204 - RNA, 15 nt, Salmonella enterica enterica serovar Typhi Ty2
ccaucgguucucugc

SEQ ID NO: 3701205 - RNA, 16 nt, Salmonella enterica enterica serovar Typhi Ty2
ccaucguaggcgcaaa

SEQ ID NO: 3701206 - RNA, 14 nt, Salmonella enterica enterica serovar Typhi Ty2
ccaucguccagcca

SEQ ID NO: 3701207 - RNA, 15 nt, Salmonella enterica enterica serovar Typhi Ty2
ccaucgucgccagac

SEQ ID NO: 3701208 - RNA, 16 nt, Salmonella enterica enterica serovar Typhi Ty2
ccaucuccggcagcgu

SEQ ID NO: 3701209 - RNA, 16 nt, Salmonella enterica enterica serovar Typhi Ty2
ccaucucuuccgcggu

SEQ ID NO: 3701210 - RNA, 21 nt, Salmonella enterica enterica serovar Typhi Ty2
ccaucuggcguugccugcuau

SEQ ID NO: 3701211 - RNA, 15 nt, Salmonella enterica enterica serovar Typhi Ty2
ccaucuuccagcauc

SEQ ID NO: 3701212 - RNA, 12 nt, Salmonella enterica enterica serovar Typhi Ty2
ccaucuuccuca

SEQ ID NO: 3701213 - RNA, 16 nt, Salmonella enterica enterica serovar Typhi Ty2
ccaucuuuaccaaugu

SEQ ID NO: 3701214 - RNA, 13 nt, Salmonella enterica enterica serovar Typhi Ty2
ccaucuuucuuuu

SEQ ID NO: 3701215 - RNA, 17 nt, Salmonella enterica enterica serovar Typhi Ty2
ccaucuuucuuuucgcg

SEQ ID NO: 3701216 - RNA, 14 nt, Salmonella enterica enterica serovar Typhi Ty2
ccaucuuuuuucac

SEQ ID NO: 3701217 - RNA, 12 nt, Salmonella enterica enterica serovar Typhi Ty2
ccaugaaaaaaa

SEQ ID NO: 3701218 - RNA, 22 nt, Salmonella enterica enterica serovar Typhi Ty2
ccaugaccaccagcgcgaccgg

SEQ ID NO: 3701219 - RNA, 17 nt, Salmonella enterica enterica serovar Typhi Ty2
ccaugacgaccacagcc

SEQ ID NO: 3701220 - RNA, 19 nt, Salmonella enterica enterica serovar Typhi Ty2
ccaugacgcagggcaauau

SEQ ID NO: 3701221 - RNA, 19 nt, Salmonella enterica enterica serovar Typhi Ty2
ccaugacggguaacgccaa

SEQ ID NO: 3701222 - RNA, 14 nt, Salmonella enterica enterica serovar Typhi Ty2
ccaugacguucaau

SEQ ID NO: 3701223 - RNA, 14 nt, Salmonella enterica enterica serovar Typhi Ty2
ccaugauaauaauc

SEQ ID NO: 3701224 - RNA, 14 nt, Salmonella enterica enterica serovar Typhi Ty2
ccaugauaaucagc

SEQ ID NO: 3701225 - RNA, 21 nt, Salmonella enterica enterica serovar Typhi Ty2
ccaugaucaccaucuucacau

SEQ ID NO: 3701226 - RNA, 15 nt, Salmonella enterica enterica serovar Typhi Ty2
ccaugaucgccgcca

SEQ ID NO: 3701227 - RNA, 18 nt, Salmonella enterica enterica serovar Typhi Ty2
ccaugaucgucaggcgcc

SEQ ID NO: 3701228 - RNA, 17 nt, Salmonella enterica enterica serovar Typhi Ty2
ccaugcaaaaugcuucu

SEQ ID NO: 3701229 - RNA, 22 nt, Salmonella enterica enterica serovar Typhi Ty2
ccaugcaccagucccagcccca

SEQ ID NO: 3701230 - RNA, 16 nt, Salmonella enterica enterica serovar Typhi Ty2
ccaugcauaaugcagc

SEQ ID NO: 3701231 - RNA, 18 nt, Salmonella enterica enterica serovar Typhi Ty2
ccaugcauaaugcagcca

SEQ ID NO: 3701232 - RNA, 22 nt, Salmonella enterica enterica serovar Typhi Ty2
ccaugccacaacagaagcggcc

SEQ ID NO: 3701233 - RNA, 13 nt, Salmonella enterica enterica serovar Typhi Ty2
ccaugccagcagu

SEQ ID NO: 3701234 - RNA, 22 nt, Salmonella enterica enterica serovar Typhi Ty2
ccaugccggcuuuccgcaccgc

SEQ ID NO: 3701235 - RNA, 15 nt, Salmonella enterica enterica serovar Typhi Ty2
ccaugccuuuauuuc

SEQ ID NO: 3701236 - RNA, 19 nt, Salmonella enterica enterica serovar Typhi Ty2
ccaugcgacuaaccugauc

SEQ ID NO: 3701237 - RNA, 21 nt, Salmonella enterica enterica serovar Typhi Ty2
ccaugcggcugaguucaggca

SEQ ID NO: 3701238 - RNA, 15 nt, Salmonella enterica enterica serovar Typhi Ty2
ccaugcuauucagca

SEQ ID NO: 3701239 - RNA, 21 nt, Salmonella enterica enterica serovar Typhi Ty2
ccaugcucauccaacugcgcc

SEQ ID NO: 3701240 - RNA, 23 nt, Salmonella enterica enterica serovar Typhi Ty2
ccaugcugucgucgacagcgccc

SEQ ID NO: 3701241 - RNA, 15 nt, Salmonella enterica enterica serovar Typhi Ty2
ccaugcuuucaauaa

SEQ ID NO: 3701242 - RNA, 16 nt, Salmonella enterica enterica serovar Typhi Ty2
ccaugcuuucaauaaa

SEQ ID NO: 3701243 - RNA, 19 nt, Salmonella enterica enterica serovar Typhi Ty2
ccauggaacauccucuccu

SEQ ID NO: 3701244 - RNA, 20 nt, Salmonella enterica enterica serovar Typhi Ty2
ccauggaacauccucuccug

SEQ ID NO: 3701245 - RNA, 21 nt, Salmonella enterica enterica serovar Typhi Ty2
ccauggaacauccucuccuga

SEQ ID NO: 3701246 - RNA, 17 nt, Salmonella enterica enterica serovar Typhi Ty2
ccauggagagugagcca

SEQ ID NO: 3701247 - RNA, 15 nt, Salmonella enterica enterica serovar Typhi Ty2
ccauggccgcagccc

SEQ ID NO: 3701248 - RNA, 23 nt, Salmonella enterica enterica serovar Typhi Ty2
ccaugguucacaauacagaacau

SEQ ID NO: 3701249 - RNA, 19 nt, Salmonella enterica enterica serovar Typhi Ty2
ccaugguucccgccacuga

SEQ ID NO: 3701250 - RNA, 15 nt, Salmonella enterica enterica serovar Typhi Ty2
ccauguacuccugau

SEQ ID NO: 3701251 - RNA, 14 nt, Salmonella enterica enterica serovar Typhi Ty2
ccauguugagcgcu

SEQ ID NO: 3701252 - RNA, 21 nt, Salmonella enterica enterica serovar Typhi Ty2
ccauguugagcgcuugcugcg

SEQ ID NO: 3701253 - RNA, 18 nt, Salmonella enterica enterica serovar Typhi Ty2
ccauguugcguaaauaaa

SEQ ID NO: 3701254 - RNA, 14 nt, Salmonella enterica enterica serovar Typhi Ty2
ccauuaagacaggu

SEQ ID NO: 3701255 - RNA, 16 nt, Salmonella enterica enterica serovar Typhi Ty2
ccauuaagcaauccgc

SEQ ID NO: 3701256 - RNA, 15 nt, Salmonella enterica enterica serovar Typhi Ty2
ccauuaauacccaua

SEQ ID NO: 3701257 - RNA, 21 nt, Salmonella enterica enterica serovar Typhi Ty2
ccauuaccuggcaacauagca

SEQ ID NO: 3701258 - RNA, 12 nt, Salmonella enterica enterica serovar Typhi Ty2
ccauuacucuca

SEQ ID NO: 3701259 - RNA, 13 nt, Salmonella enterica enterica serovar Typhi Ty2
ccauuagcuguug

SEQ ID NO: 3701260 - RNA, 17 nt, Salmonella enterica enterica serovar Typhi Ty2
ccauuaggcuauuuuau

SEQ ID NO: 3701261 - RNA, 17 nt, Salmonella enterica enterica serovar Typhi Ty2
ccauuauuguguucuca

SEQ ID NO: 3701262 - RNA, 16 nt, Salmonella enterica enterica serovar Typhi Ty2
ccauuauuuauuuuca

SEQ ID NO: 3701263 - RNA, 24 nt, Salmonella enterica enterica serovar Typhi Ty2
ccauuauuuauuuucauacuauuu

SEQ ID NO: 3701264 - RNA, 15 nt, Salmonella enterica enterica serovar Typhi Ty2
ccauucaacacauuc

SEQ ID NO: 3701265 - RNA, 14 nt, Salmonella enterica enterica serovar Typhi Ty2
ccauucaaccagcc

SEQ ID NO: 3701266 - RNA, 18 nt, Salmonella enterica enterica serovar Typhi Ty2
ccauucagcuuauucguc

SEQ ID NO: 3701267 - RNA, 13 nt, Salmonella enterica enterica serovar Typhi Ty2
ccauucccagccg

SEQ ID NO: 3701268 - RNA, 15 nt, Salmonella enterica enterica serovar Typhi Ty2
ccauucccagcgccc

SEQ ID NO: 3701269 - RNA, 15 nt, Salmonella enterica enterica serovar Typhi Ty2
ccauuccccacgcca

SEQ ID NO: 3701270 - RNA, 16 nt, Salmonella enterica enterica serovar Typhi Ty2
cccagaaugccgccca

SEQ ID NO: 3701271 - RNA, 14 nt, Salmonella enterica enterica serovar Typhi Ty2
cccagacagcaaaa

SEQ ID NO: 3701272 - RNA, 17 nt, Salmonella enterica enterica serovar Typhi Ty2
cccagacugugauggcg

SEQ ID NO: 3701273 - RNA, 13 nt, Salmonella enterica enterica serovar Typhi Ty2
cccagauaucagg

SEQ ID NO: 3701274 - RNA, 20 nt, Salmonella enterica enterica serovar Typhi Ty2
cccagauaucagucugcaag

SEQ ID NO: 3701275 - RNA, 13 nt, Salmonella enterica enterica serovar Typhi Ty2
cccagauauccgc

SEQ ID NO: 3701276 - RNA, 13 nt, Salmonella enterica enterica serovar Typhi Ty2
cccagaucaggcc

SEQ ID NO: 3701277 - RNA, 12 nt, Salmonella enterica enterica serovar Typhi Ty2
cccagaucgccc

SEQ ID NO: 3701278 - RNA, 19 nt, Salmonella enterica enterica serovar Typhi Ty2
cccagauguugauacagaa

SEQ ID NO: 3701279 - RNA, 20 nt, Salmonella enterica enterica serovar Typhi Ty2
cccagauguugauacagaaa

SEQ ID NO: 3701280 - RNA, 21 nt, Salmonella enterica enterica serovar Typhi Ty2
cccagcauauuuuccggcguc

SEQ ID NO: 3701281 - RNA, 21 nt, Salmonella enterica enterica serovar Typhi Ty2
cccagcaucccgcuggcgcca

SEQ ID NO: 3701282 - RNA, 17 nt, Salmonella enterica enterica serovar Typhi Ty2
cccagcaugagccagcc

SEQ ID NO: 3701283 - RNA, 13 nt, Salmonella enterica enterica serovar Typhi Ty2
cccagcauuacug

SEQ ID NO: 3701284 - RNA, 14 nt, Salmonella enterica enterica serovar Typhi Ty2
cccagccagacgcc

SEQ ID NO: 3701285 - RNA, 21 nt, Salmonella enterica enterica serovar Typhi Ty2
cccagccgugaauggucacau

SEQ ID NO: 3701286 - RNA, 22 nt, Salmonella enterica enterica serovar Typhi Ty2
cccagccuuccuggucugccag

SEQ ID NO: 3701287 - RNA, 14 nt, Salmonella enterica enterica serovar Typhi Ty2
cccagccuucuccc

SEQ ID NO: 3701288 - RNA, 13 nt, Salmonella enterica enterica serovar Typhi Ty2
cccagcgccagcc

SEQ ID NO: 3701289 - RNA, 18 nt, Salmonella enterica enterica serovar Typhi Ty2
cccagcgccagccgcgcc

SEQ ID NO: 3701290 - RNA, 19 nt, Salmonella enterica enterica serovar Typhi Ty2
cccagcgccagccgcgcca

SEQ ID NO: 3701291 - RNA, 12 nt, Salmonella enterica enterica serovar Typhi Ty2
cccagcgccccc

SEQ ID NO: 3701292 - RNA, 12 nt, Salmonella enterica enterica serovar Typhi Ty2
cccagcgcgccg

SEQ ID NO: 3701293 - RNA, 15 nt, Salmonella enterica enterica serovar Typhi Ty2
cccagcgcuggcaga

SEQ ID NO: 3701294 - RNA, 23 nt, Salmonella enterica enterica serovar Typhi Ty2
cccagcggaugucggucaucagg

SEQ ID NO: 3701295 - RNA, 21 nt, Salmonella enterica enterica serovar Typhi Ty2
cccagcucaugauagggcagc

SEQ ID NO: 3701296 - RNA, 22 nt, Salmonella enterica enterica serovar Typhi Ty2
cccagcucaugauagggcagca

SEQ ID NO: 3701297 - RNA, 20 nt, Salmonella enterica enterica serovar Typhi Ty2
cccagcugagcuaaucaccc

SEQ ID NO: 3701298 - RNA, 18 nt, Salmonella enterica enterica serovar Typhi Ty2
cccaggauaguacugacc

SEQ ID NO: 3701299 - RNA, 19 nt, Salmonella enterica enterica serovar Typhi Ty2
cccaggauaguacugacca

SEQ ID NO: 3701300 - RNA, 22 nt, Salmonella enterica enterica serovar Typhi Ty2
cccaggauaguacugaccagac

SEQ ID NO: 3701301 - RNA, 21 nt, Salmonella enterica enterica serovar Typhi Ty2
cccaggcaaaugauuaucucc

SEQ ID NO: 3701302 - RNA, 13 nt, Salmonella enterica enterica serovar Typhi Ty2
cccaggccaaaac

SEQ ID NO: 3701303 - RNA, 22 nt, Salmonella enterica enterica serovar Typhi Ty2
cccaggccaaaaccacagugac

SEQ ID NO: 3701304 - RNA, 18 nt, Salmonella enterica enterica serovar Typhi Ty2
cccaggccaugcgccgcg

SEQ ID NO: 3701305 - RNA, 15 nt, Salmonella enterica enterica serovar Typhi Ty2
cccaggccgccaccg

SEQ ID NO: 3701306 - RNA, 21 nt, Salmonella enterica enterica serovar Typhi Ty2
cccaggccgccaccgccucgc

SEQ ID NO: 3701307 - RNA, 22 nt, Salmonella enterica enterica serovar Typhi Ty2
cccaggccugaugagcgcagcg

SEQ ID NO: 3701308 - RNA, 19 nt, Salmonella enterica enterica serovar Typhi Ty2
cccaggcgcgcagcugcca

SEQ ID NO: 3701309 - RNA, 23 nt, Salmonella enterica enterica serovar Typhi Ty2
cccaggcgcguuguccaacuguc

SEQ ID NO: 3701310 - RNA, 18 nt, Salmonella enterica enterica serovar Typhi Ty2
cccaggcgcuauucccag

SEQ ID NO: 3701311 - RNA, 19 nt, Salmonella enterica enterica serovar Typhi Ty2
cccaggcggguagucccag

SEQ ID NO: 3701312 - RNA, 13 nt, Salmonella enterica enterica serovar Typhi Ty2
cccaggguuuagc

SEQ ID NO: 3701313 - RNA, 20 nt, Salmonella enterica enterica serovar Typhi Ty2
cccaggguuuagccccagac

SEQ ID NO: 3701314 - RNA, 19 nt, Salmonella enterica enterica serovar Typhi Ty2
cccagguuauucaggugga

SEQ ID NO: 3701315 - RNA, 23 nt, Salmonella enterica enterica serovar Typhi Ty2
cccagguuguaucauguuccggc

SEQ ID NO: 3701316 - RNA, 22 nt, Salmonella enterica enterica serovar Typhi Ty2
cccaguaauauccccaucccag

SEQ ID NO: 3701317 - RNA, 16 nt, Salmonella enterica enterica serovar Typhi Ty2
cccaguaauccggcaa

SEQ ID NO: 3701318 - RNA, 18 nt, Salmonella enterica enterica serovar Typhi Ty2
cccaguaauccggcaacu

SEQ ID NO: 3701319 - RNA, 17 nt, Salmonella enterica enterica serovar Typhi Ty2
cccaguacaaacaaaua

SEQ ID NO: 3701320 - RNA, 14 nt, Salmonella enterica enterica serovar Typhi Ty2
cccaguaccagcac

SEQ ID NO: 3701321 - RNA, 17 nt, Salmonella enterica enterica serovar Typhi Ty2
cccaguagcagacagcc

SEQ ID NO: 3701322 - RNA, 18 nt, Salmonella enterica enterica serovar Typhi Ty2
cccaguauugcaccuggg

SEQ ID NO: 3701323 - RNA, 14 nt, Salmonella enterica enterica serovar Typhi Ty2
cccagucacggcuc

SEQ ID NO: 3701324 - RNA, 18 nt, Salmonella enterica enterica serovar Typhi Ty2
cccagucuuccugcggua

SEQ ID NO: 3701325 - RNA, 16 nt, Salmonella enterica enterica serovar Typhi Ty2
cccagugcccgaaagc

SEQ ID NO: 3701326 - RNA, 14 nt, Salmonella enterica enterica serovar Typhi Ty2
cccaguggcaaaau

SEQ ID NO: 3701327 - RNA, 19 nt, Salmonella enterica enterica serovar Typhi Ty2
cccaguuauuaaguuuuac

SEQ ID NO: 3701328 - RNA, 22 nt, Salmonella enterica enterica serovar Typhi Ty2
cccaguugaucggccagcaagc

SEQ ID NO: 3701329 - RNA, 21 nt, Salmonella enterica enterica serovar Typhi Ty2
cccaguuucaucaucgccgau

SEQ ID NO: 3701330 - RNA, 18 nt, Salmonella enterica enterica serovar Typhi Ty2
cccaguuuuuuucugcca

SEQ ID NO: 3701331 - RNA, 13 nt, Salmonella enterica enterica serovar Typhi Ty2
cccauacguuuuu

SEQ ID NO: 3701332 - RNA, 23 nt, Salmonella enterica enterica serovar Typhi Ty2
cccauagcagcuccgaaacaauc

SEQ ID NO: 3701333 - RNA, 15 nt, Salmonella enterica enterica serovar Typhi Ty2
cccauaguagcuaau

SEQ ID NO: 3701334 - RNA, 19 nt, Salmonella enterica enterica serovar Typhi Ty2
cccauauuccagaaaggau

SEQ ID NO: 3701335 - RNA, 13 nt, Salmonella enterica enterica serovar Typhi Ty2
cccauauuccugc

SEQ ID NO: 3701336 - RNA, 20 nt, Salmonella enterica enterica serovar Typhi Ty2
cccauauugauggccacauc

SEQ ID NO: 3701337 - RNA, 22 nt, Salmonella enterica enterica serovar Typhi Ty2
cccaucaauaacgauaauuuua

SEQ ID NO: 3701338 - RNA, 14 nt, Salmonella enterica enterica serovar Typhi Ty2
cccaucagcgccag

SEQ ID NO: 3701339 - RNA, 14 nt, Salmonella enterica enterica serovar Typhi Ty2
cccaucauugacuu

SEQ ID NO: 3701340 - RNA, 11 nt, Salmonella enterica enterica serovar Typhi Ty2
cccaucccaga

SEQ ID NO: 3701341 - RNA, 11 nt, Salmonella enterica enterica serovar Typhi Ty2
cccauccgcgc

SEQ ID NO: 3701342 - RNA, 21 nt, Salmonella enterica enterica serovar Typhi Ty2
cccauccgggccacucuccag

SEQ ID NO: 3701343 - RNA, 14 nt, Salmonella enterica enterica serovar Typhi Ty2
cccaucgagccaac

SEQ ID NO: 3701344 - RNA, 18 nt, Salmonella enterica enterica serovar Typhi Ty2
cccaucgccacagcggaa

SEQ ID NO: 3701345 - RNA, 20 nt, Salmonella enterica enterica serovar Typhi Ty2
cccaucgcuuugcagaaaau

SEQ ID NO: 3701346 - RNA, 18 nt, Salmonella enterica enterica serovar Typhi Ty2
cccaucguaacgccgucg

SEQ ID NO: 3701347 - RNA, 20 nt, Salmonella enterica enterica serovar Typhi Ty2
cccaucuaaccgggccugau

SEQ ID NO: 3701348 - RNA, 13 nt, Salmonella enterica enterica serovar Typhi Ty2
cccaucugauaau

SEQ ID NO: 3701349 - RNA, 15 nt, Salmonella enterica enterica serovar Typhi Ty2
cccaugcaaccagug

SEQ ID NO: 3701350 - RNA, 23 nt, Salmonella enterica enterica serovar Typhi Ty2
cccaugcaccagucccagcccca

SEQ ID NO: 3701351 - RNA, 21 nt, Salmonella enterica enterica serovar Typhi Ty2
cccaugccgccugccgcgccg

SEQ ID NO: 3701352 - RNA, 13 nt, Salmonella enterica enterica serovar Typhi Ty2
ccccuccggccag

SEQ ID NO: 3701353 - RNA, 23 nt, Salmonella enterica enterica serovar Typhi Ty2
ccccucgacaggaguauagcggc

SEQ ID NO: 3701354 - RNA, 18 nt, Salmonella enterica enterica serovar Typhi Ty2
ccccucggcagcaauacg

SEQ ID NO: 3701355 - RNA, 20 nt, Salmonella enterica enterica serovar Typhi Ty2
ccccucggcagcaauacgcc

SEQ ID NO: 3701356 - RNA, 21 nt, Salmonella enterica enterica serovar Typhi Ty2
ccccugaaauaacagacuccg

SEQ ID NO: 3701357 - RNA, 19 nt, Salmonella enterica enterica serovar Typhi Ty2
ccccugcgcggccugcgcc

SEQ ID NO: 3701358 - RNA, 23 nt, Salmonella enterica enterica serovar Typhi Ty2
ccccugcgguuucuaccacccag

SEQ ID NO: 3701359 - RNA, 15 nt, Salmonella enterica enterica serovar Typhi Ty2
ccccugcuccugcca

SEQ ID NO: 3701360 - RNA, 14 nt, Salmonella enterica enterica serovar Typhi Ty2
ccccugggccgggu

SEQ ID NO: 3701361 - RNA, 20 nt, Salmonella enterica enterica serovar Typhi Ty2
ccccuguuccagggcuucca

SEQ ID NO: 3701362 - RNA, 22 nt, Salmonella enterica enterica serovar Typhi Ty2
ccccuucuuuaucuucugcugc

SEQ ID NO: 3701363 - RNA, 20 nt, Salmonella enterica enterica serovar Typhi Ty2
ccccuuucgguucgccgcgc

SEQ ID NO: 3701364 - RNA, 12 nt, Salmonella enterica enterica serovar Typhi Ty2
ccccuuuuucaa

SEQ ID NO: 3701365 - RNA, 18 nt, Salmonella enterica enterica serovar Typhi Ty2
ccccuuuuuugcuggcaa

SEQ ID NO: 3701366 - RNA, 21 nt, Salmonella enterica enterica serovar Typhi Ty2
cccgaaaagcguaacgccccc

SEQ ID NO: 3701367 - RNA, 19 nt, Salmonella enterica enterica serovar Typhi Ty2
cccgaaagucaucugccag

SEQ ID NO: 3701368 - RNA, 12 nt, Salmonella enterica enterica serovar Typhi Ty2
cccgaaccugcg

SEQ ID NO: 3701369 - RNA, 19 nt, Salmonella enterica enterica serovar Typhi Ty2
cccgacaaaaccguucuga

SEQ ID NO: 3701370 - RNA, 20 nt, Salmonella enterica enterica serovar Typhi Ty2
cccgacacggcucgccuuug

SEQ ID NO: 3701371 - RNA, 22 nt, Salmonella enterica enterica serovar Typhi Ty2
cccgacaggguuugccagcacc

SEQ ID NO: 3701372 - RNA, 19 nt, Salmonella enterica enterica serovar Typhi Ty2
cccgacucugacgccggua

SEQ ID NO: 3701373 - RNA, 16 nt, Salmonella enterica enterica serovar Typhi Ty2
cccgaguuuuaacacu

SEQ ID NO: 3701374 - RNA, 23 nt, Salmonella enterica enterica serovar Typhi Ty2
cccgauaaaaucaucgcgcugau

SEQ ID NO: 3701375 - RNA, 16 nt, Salmonella enterica enterica serovar Typhi Ty2
cccgauaaaucgcauu

SEQ ID NO: 3701376 - RNA, 13 nt, Salmonella enterica enterica serovar Typhi Ty2
cccgauaaccgcg

SEQ ID NO: 3701377 - RNA, 18 nt, Salmonella enterica enterica serovar Typhi Ty2
cccgauaaccgcguucau

SEQ ID NO: 3701378 - RNA, 11 nt, Salmonella enterica enterica serovar Typhi Ty2
cccgauacccu

SEQ ID NO: 3701379 - RNA, 12 nt, Salmonella enterica enterica serovar Typhi Ty2
cccgauacgcgg

SEQ ID NO: 3701380 - RNA, 22 nt, Salmonella enterica enterica serovar Typhi Ty2
cccgauauaccacccgcuauga

SEQ ID NO: 3701381 - RNA, 16 nt, Salmonella enterica enterica serovar Typhi Ty2
cccgaucaucuccugu

SEQ ID NO: 3701382 - RNA, 18 nt, Salmonella enterica enterica serovar Typhi Ty2
cccgaucuucaucguuac

SEQ ID NO: 3701383 - RNA, 15 nt, Salmonella enterica enterica serovar Typhi Ty2
cccgauucgcaugaa

SEQ ID NO: 3701384 - RNA, 20 nt, Salmonella enterica enterica serovar Typhi Ty2
cccgauucgcaugaauucaa

SEQ ID NO: 3701385 - RNA, 15 nt, Salmonella enterica enterica serovar Typhi Ty2
cccgcaaaccagguc

SEQ ID NO: 3701386 - RNA, 21 nt, Salmonella enterica enterica serovar Typhi Ty2
cccgcaaacuggccacagcaa

SEQ ID NO: 3701387 - RNA, 21 nt, Salmonella enterica enterica serovar Typhi Ty2
cccgcaauguuuggauuucgu

SEQ ID NO: 3701388 - RNA, 16 nt, Salmonella enterica enterica serovar Typhi Ty2
cccgcacgcuuucuuc

SEQ ID NO: 3701389 - RNA, 13 nt, Salmonella enterica enterica serovar Typhi Ty2
cccgcagccagaa

SEQ ID NO: 3701390 - RNA, 17 nt, Salmonella enterica enterica serovar Typhi Ty2
cccgcaucgccgcggcg

SEQ ID NO: 3701391 - RNA, 17 nt, Salmonella enterica enterica serovar Typhi Ty2
cccgcaugguaaacgca

SEQ ID NO: 3701392 - RNA, 16 nt, Salmonella enterica enterica serovar Typhi Ty2
cccgcauuuuaaacga

SEQ ID NO: 3701393 - RNA, 12 nt, Salmonella enterica enterica serovar Typhi Ty2
cccgccagcacc

SEQ ID NO: 3701394 - RNA, 13 nt, Salmonella enterica enterica serovar Typhi Ty2
cccgccagcacca

SEQ ID NO: 3701395 - RNA, 23 nt, Salmonella enterica enterica serovar Typhi Ty2
cccgccagcaccaggcucgcaga

SEQ ID NO: 3701396 - RNA, 13 nt, Salmonella enterica enterica serovar Typhi Ty2
cccgccagcauac

SEQ ID NO: 3701397 - RNA, 14 nt, Salmonella enterica enterica serovar Typhi Ty2
cccgccagcggcgc

SEQ ID NO: 3701398 - RNA, 13 nt, Salmonella enterica enterica serovar Typhi Ty2
cccgccaggguau

SEQ ID NO: 3701399 - RNA, 17 nt, Salmonella enterica enterica serovar Typhi Ty2
cccgccaucguccagcc

SEQ ID NO: 3701400 - RNA, 19 nt, Salmonella enterica enterica serovar Typhi Ty2
cccgccaucguccagccau

SEQ ID NO: 3701401 - RNA, 14 nt, Salmonella enterica enterica serovar Typhi Ty2
cccgcccacaggcu

SEQ ID NO: 3701402 - RNA, 15 nt, Salmonella enterica enterica serovar Typhi Ty2
cccgcccagcauuac

SEQ ID NO: 3701403 - RNA, 15 nt, Salmonella enterica enterica serovar Typhi Ty2
cccgcccugcccgcc

SEQ ID NO: 3701404 - RNA, 16 nt, Salmonella enterica enterica serovar Typhi Ty2
cccgcccugcccgcca

SEQ ID NO: 3701405 - RNA, 22 nt, Salmonella enterica enterica serovar Typhi Ty2
cccgccgaaggcaacgccgcca

SEQ ID NO: 3701406 - RNA, 19 nt, Salmonella enterica enterica serovar Typhi Ty2
cccgccgcacacgccgugc

SEQ ID NO: 3701407 - RNA, 21 nt, Salmonella enterica enterica serovar Typhi Ty2
cccgccgcacacgccgugcac

SEQ ID NO: 3701408 - RNA, 15 nt, Salmonella enterica enterica serovar Typhi Ty2
cccgccgccaccaug

SEQ ID NO: 3701409 - RNA, 17 nt, Salmonella enterica enterica serovar Typhi Ty2
cccgccgccagcaccgc

SEQ ID NO: 3701410 - RNA, 23 nt, Salmonella enterica enterica serovar Typhi Ty2
cccgccgcgauguuugcucgcca

SEQ ID NO: 3701411 - RNA, 15 nt, Salmonella enterica enterica serovar Typhi Ty2
cccgccgcgcggccc

SEQ ID NO: 3701412 - RNA, 16 nt, Salmonella enterica enterica serovar Typhi Ty2
cccgccgcgcggcccc

SEQ ID NO: 3701413 - RNA, 15 nt, Salmonella enterica enterica serovar Typhi Ty2
cccgccgcuggcggg

SEQ ID NO: 3701414 - RNA, 19 nt, Salmonella enterica enterica serovar Typhi Ty2
cccgccgggcgucacccgc

SEQ ID NO: 3701415 - RNA, 20 nt, Salmonella enterica enterica serovar Typhi Ty2
cccgccgggcgucacccgcc

SEQ ID NO: 3701416 - RNA, 23 nt, Salmonella enterica enterica serovar Typhi Ty2
cccgccgggcgucacccgccggc

SEQ ID NO: 3701417 - RNA, 21 nt, Salmonella enterica enterica serovar Typhi Ty2
cccgccuugcggcgccaggac

SEQ ID NO: 3701418 - RNA, 18 nt, Salmonella enterica enterica serovar Typhi Ty2
cccgcgauaaaaauccug

SEQ ID NO: 3701419 - RNA, 20 nt, Salmonella enterica enterica serovar Typhi Ty2
cccgcggucauugagccgcu

SEQ ID NO: 3701420 - RNA, 15 nt, Salmonella enterica enterica serovar Typhi Ty2
cccgcguuuccacgc

SEQ ID NO: 3701421 - RNA, 15 nt, Salmonella enterica enterica serovar Typhi Ty2
cccgcuaucaccgcc

SEQ ID NO: 3701422 - RNA, 16 nt, Salmonella enterica enterica serovar Typhi Ty2
cccgcuaucaccgccc

SEQ ID NO: 3701423 - RNA, 23 nt, Salmonella enterica enterica serovar Typhi Ty2
cccgcuccagaagcacuucucca

SEQ ID NO: 3701424 - RNA, 16 nt, Salmonella enterica enterica serovar Typhi Ty2
cccgcuggcgccaccg

SEQ ID NO: 3701425 - RNA, 14 nt, Salmonella enterica enterica serovar Typhi Ty2
cccgcuuuaccgaa

SEQ ID NO: 3701426 - RNA, 22 nt, Salmonella enterica enterica serovar Typhi Ty2
cccggaaauggguaucuucauc

SEQ ID NO: 3701427 - RNA, 16 nt, Salmonella enterica enterica serovar Typhi Ty2
cccggacaaggcgcgc

SEQ ID NO: 3701428 - RNA, 20 nt, Salmonella enterica enterica serovar Typhi Ty2
cccggacguaccgcuuuauc

SEQ ID NO: 3701429 - RNA, 21 nt, Salmonella enterica enterica serovar Typhi Ty2
cccggagagaaacaacaccgu

SEQ ID NO: 3701430 - RNA, 19 nt, Salmonella enterica enterica serovar Typhi Ty2
cccggagcggugaaacugu

SEQ ID NO: 3701431 - RNA, 19 nt, Salmonella enterica enterica serovar Typhi Ty2
cccggaucggucuggcgca

SEQ ID NO: 3701432 - RNA, 15 nt, Salmonella enterica enterica serovar Typhi Ty2
cccggcaacugcgcc

SEQ ID NO: 3701433 - RNA, 21 nt, Salmonella enterica enterica serovar Typhi Ty2
cccggcaauuaccgccagcgg

SEQ ID NO: 3701434 - RNA, 19 nt, Salmonella enterica enterica serovar Typhi Ty2
cccugcgaacagcgcucca

SEQ ID NO: 3701435 - RNA, 22 nt, Salmonella enterica enterica serovar Typhi Ty2
cccugcgaacagcgcuccacgc

SEQ ID NO: 3701436 - RNA, 23 nt, Salmonella enterica enterica serovar Typhi Ty2
cccugcgaacagcgcuccacgcg

SEQ ID NO: 3701437 - RNA, 16 nt, Salmonella enterica enterica serovar Typhi Ty2
cccugcgccagacgcg

SEQ ID NO: 3701438 - RNA, 20 nt, Salmonella enterica enterica serovar Typhi Ty2
cccugcgcggccugcgccag

SEQ ID NO: 3701439 - RNA, 21 nt, Salmonella enterica enterica serovar Typhi Ty2
cccugcgcuucuauccacugg

SEQ ID NO: 3701440 - RNA, 18 nt, Salmonella enterica enterica serovar Typhi Ty2
cccugcgcuuucaaccac

SEQ ID NO: 3701441 - RNA, 19 nt, Salmonella enterica enterica serovar Typhi Ty2
cccugcggaaccgcccauc

SEQ ID NO: 3701442 - RNA, 13 nt, Salmonella enterica enterica serovar Typhi Ty2
cccugcggcugau

SEQ ID NO: 3701443 - RNA, 20 nt, Salmonella enterica enterica serovar Typhi Ty2
cccugcggguaauccgacgc

SEQ ID NO: 3701444 - RNA, 18 nt, Salmonella enterica enterica serovar Typhi Ty2
cccugcgguagcgccgau

SEQ ID NO: 3701445 - RNA, 13 nt, Salmonella enterica enterica serovar Typhi Ty2
cccugcuccugcc

SEQ ID NO: 3701446 - RNA, 14 nt, Salmonella enterica enterica serovar Typhi Ty2
cccugcuccugcca

SEQ ID NO: 3701447 - RNA, 17 nt, Salmonella enterica enterica serovar Typhi Ty2
cccugcugauacacaac

SEQ ID NO: 3701448 - RNA, 21 nt, Salmonella enterica enterica serovar Typhi Ty2
cccugcuggcgaaccaccagc

SEQ ID NO: 3701449 - RNA, 16 nt, Salmonella enterica enterica serovar Typhi Ty2
cccugcuguuccagug

SEQ ID NO: 3701450 - RNA, 19 nt, Salmonella enterica enterica serovar Typhi Ty2
cccuggcgcaguggcgggu

SEQ ID NO: 3701451 - RNA, 14 nt, Salmonella enterica enterica serovar Typhi Ty2
cccuggcgcgccag

SEQ ID NO: 3701452 - RNA, 19 nt, Salmonella enterica enterica serovar Typhi Ty2
cccuggcucaauccaggug

SEQ ID NO: 3701453 - RNA, 23 nt, Salmonella enterica enterica serovar Typhi Ty2
cccuguaacagaauuaacgcaga

SEQ ID NO: 3701454 - RNA, 15 nt, Salmonella enterica enterica serovar Typhi Ty2
cccuguaggccugau

SEQ ID NO: 3701455 - RNA, 20 nt, Salmonella enterica enterica serovar Typhi Ty2
cccuguggaaacuccagcgg

SEQ ID NO: 3701456 - RNA, 14 nt, Salmonella enterica enterica serovar Typhi Ty2
cccuguucaaaagc

SEQ ID NO: 3701457 - RNA, 18 nt, Salmonella enterica enterica serovar Typhi Ty2
cccuguuuuuucgccgcg

SEQ ID NO: 3701458 - RNA, 20 nt, Salmonella enterica enterica serovar Typhi Ty2
cccuuacgcuuuauucuguc

SEQ ID NO: 3701459 - RNA, 11 nt, Salmonella enterica enterica serovar Typhi Ty2
cccuuaucugg

SEQ ID NO: 3701460 - RNA, 19 nt, Salmonella enterica enterica serovar Typhi Ty2
cccuuaucuggaugaggac

SEQ ID NO: 3701461 - RNA, 16 nt, Salmonella enterica enterica serovar Typhi Ty2
cccuucaccgcuuuuc

SEQ ID NO: 3701462 - RNA, 19 nt, Salmonella enterica enterica serovar Typhi Ty2
cccuucaugcagcccgcac

SEQ ID NO: 3701463 - RNA, 21 nt, Salmonella enterica enterica serovar Typhi Ty2
cccuuccagcagccagccguu

SEQ ID NO: 3701464 - RNA, 12 nt, Salmonella enterica enterica serovar Typhi Ty2
cccuuccagcga

SEQ ID NO: 3701465 - RNA, 23 nt, Salmonella enterica enterica serovar Typhi Ty2
cccuucccccagaaugccgccca

SEQ ID NO: 3701466 - RNA, 17 nt, Salmonella enterica enterica serovar Typhi Ty2
cccuuccccggcagccu

SEQ ID NO: 3701467 - RNA, 18 nt, Salmonella enterica enterica serovar Typhi Ty2
cccuuccgccacggcuuu

SEQ ID NO: 3701468 - RNA, 16 nt, Salmonella enterica enterica serovar Typhi Ty2
cccuucgaccgucagc

SEQ ID NO: 3701469 - RNA, 14 nt, Salmonella enterica enterica serovar Typhi Ty2
cccuucgcccggcg

SEQ ID NO: 3701470 - RNA, 12 nt, Salmonella enterica enterica serovar Typhi Ty2
cccuucgcccuc

SEQ ID NO: 3701471 - RNA, 23 nt, Salmonella enterica enterica serovar Typhi Ty2
cccuucuccgguaaucaccagau

SEQ ID NO: 3701472 - RNA, 15 nt, Salmonella enterica enterica serovar Typhi Ty2
cccuucuuuuacugc

SEQ ID NO: 3701473 - RNA, 18 nt, Salmonella enterica enterica serovar Typhi Ty2
cccuuguuauccuaaauc

SEQ ID NO: 3701474 - RNA, 19 nt, Salmonella enterica enterica serovar Typhi Ty2
cccuuucaaaaaagagaag

SEQ ID NO: 3701475 - RNA, 15 nt, Salmonella enterica enterica serovar Typhi Ty2
cccuuuccuuauuaa

SEQ ID NO: 3701476 - RNA, 16 nt, Salmonella enterica enterica serovar Typhi Ty2
cccuuuuucaauaagc

SEQ ID NO: 3701477 - RNA, 20 nt, Salmonella enterica enterica serovar Typhi Ty2
cccuuuuuuggucagaaagc

SEQ ID NO: 3701478 - RNA, 17 nt, Salmonella enterica enterica serovar Typhi Ty2
ccgaaagcgaccuucuc

SEQ ID NO: 3701479 - RNA, 16 nt, Salmonella enterica enterica serovar Typhi Ty2
ccgaaaggaagcgggc

SEQ ID NO: 3701480 - RNA, 16 nt, Salmonella enterica enterica serovar Typhi Ty2
ccgaaauccaccagcg

SEQ ID NO: 3701481 - RNA, 21 nt, Salmonella enterica enterica serovar Typhi Ty2
ccgaaaugaccaccgcaucgg

SEQ ID NO: 3701482 - RNA, 15 nt, Salmonella enterica enterica serovar Typhi Ty2
ccgaacaacacggcg

SEQ ID NO: 3701483 - RNA, 16 nt, Salmonella enterica enterica serovar Typhi Ty2
ccgaacgcguccauga

SEQ ID NO: 3701484 - RNA, 13 nt, Salmonella enterica enterica serovar Typhi Ty2
ccgaagcaggcgg

SEQ ID NO: 3701485 - RNA, 15 nt, Salmonella enterica enterica serovar Typhi Ty2
ccgaauaacgccagg

SEQ ID NO: 3701486 - RNA, 20 nt, Salmonella enterica enterica serovar Typhi Ty2
ccgaauagcgacaaaugaag

SEQ ID NO: 3701487 - RNA, 13 nt, Salmonella enterica enterica serovar Typhi Ty2
ccgaaucgccgcu

SEQ ID NO: 3701488 - RNA, 12 nt, Salmonella enterica enterica serovar Typhi Ty2
ccgaaucuugca

SEQ ID NO: 3701489 - RNA, 18 nt, Salmonella enterica enterica serovar Typhi Ty2
ccgaaugcguuuuuucac

SEQ ID NO: 3701490 - RNA, 20 nt, Salmonella enterica enterica serovar Typhi Ty2
ccgacaagguauaucaaccc

SEQ ID NO: 3701491 - RNA, 19 nt, Salmonella enterica enterica serovar Typhi Ty2
ccgacaauauucgccgcga

SEQ ID NO: 3701492 - RNA, 23 nt, Salmonella enterica enterica serovar Typhi Ty2
ccgacaauggcgacgaucagcgc

SEQ ID NO: 3701493 - RNA, 22 nt, Salmonella enterica enterica serovar Typhi Ty2
ccgacaauuuugauaagagaaa

SEQ ID NO: 3701494 - RNA, 16 nt, Salmonella enterica enterica serovar Typhi Ty2
ccgacacggcucgccu

SEQ ID NO: 3701495 - RNA, 13 nt, Salmonella enterica enterica serovar Typhi Ty2
ccgacagcggaaa

SEQ ID NO: 3701496 - RNA, 22 nt, Salmonella enterica enterica serovar Typhi Ty2
ccgacagggcgugaaccagcau

SEQ ID NO: 3701497 - RNA, 17 nt, Salmonella enterica enterica serovar Typhi Ty2
ccgacauagcugaacaa

SEQ ID NO: 3701498 - RNA, 18 nt, Salmonella enterica enterica serovar Typhi Ty2
ccgacaucgccaccgcau

SEQ ID NO: 3701499 - RNA, 14 nt, Salmonella enterica enterica serovar Typhi Ty2
ccgacauucccagu

SEQ ID NO: 3701500 - RNA, 20 nt, Salmonella enterica enterica serovar Typhi Ty2
ccgacauucccugcgcauac

SEQ ID NO: 3701501 - RNA, 21 nt, Salmonella enterica enterica serovar Typhi Ty2
ccgacauuguucuaaacguuc

SEQ ID NO: 3701502 - RNA, 18 nt, Salmonella enterica enterica serovar Typhi Ty2
ccgaccaauugcaggcag

SEQ ID NO: 3701503 - RNA, 21 nt, Salmonella enterica enterica serovar Typhi Ty2
ccgaccaguuuuugcgccagc

SEQ ID NO: 3701504 - RNA, 19 nt, Salmonella enterica enterica serovar Typhi Ty2
ccgaccaucgcgccgcugg

SEQ ID NO: 3701505 - RNA, 22 nt, Salmonella enterica enterica serovar Typhi Ty2
ccgacccauacucuuucccggc

SEQ ID NO: 3701506 - RNA, 22 nt, Salmonella enterica enterica serovar Typhi Ty2
ccgaccccgccgucagacaggc

SEQ ID NO: 3701507 - RNA, 15 nt, Salmonella enterica enterica serovar Typhi Ty2
ccgaccgccagcaga

SEQ ID NO: 3701508 - RNA, 15 nt, Salmonella enterica enterica serovar Typhi Ty2
ccgaccgucagcucc

SEQ ID NO: 3701509 - RNA, 14 nt, Salmonella enterica enterica serovar Typhi Ty2
ccgaccgucggcgc

SEQ ID NO: 3701510 - RNA, 15 nt, Salmonella enterica enterica serovar Typhi Ty2
ccgaccgucggcgca

SEQ ID NO: 3701511 - RNA, 22 nt, Salmonella enterica enterica serovar Typhi Ty2
ccgaccuggcggucggcuuugu

SEQ ID NO: 3701512 - RNA, 17 nt, Salmonella enterica enterica serovar Typhi Ty2
ccgaccuguaccgcgac

SEQ ID NO: 3701513 - RNA, 17 nt, Salmonella enterica enterica serovar Typhi Ty2
ccgacgaaaaagccaaa

SEQ ID NO: 3701514 - RNA, 14 nt, Salmonella enterica enterica serovar Typhi Ty2
ccgacgcacgugua

SEQ ID NO: 3701515 - RNA, 19 nt, Salmonella enterica enterica serovar Typhi Ty2
ccgacgcauuucuccugau

SEQ ID NO: 3701516 - RNA, 15 nt, Salmonella enterica enterica serovar Typhi Ty2
ccgcacagacgucgg

SEQ ID NO: 3701517 - RNA, 23 nt, Salmonella enterica enterica serovar Typhi Ty2
ccgcacagacgucggcaccgaau

SEQ ID NO: 3701518 - RNA, 13 nt, Salmonella enterica enterica serovar Typhi Ty2
ccgcacagcacau

SEQ ID NO: 3701519 - RNA, 19 nt, Salmonella enterica enterica serovar Typhi Ty2
ccgcacagcagacaaccga

SEQ ID NO: 3701520 - RNA, 17 nt, Salmonella enterica enterica serovar Typhi Ty2
ccgcaccuggguauucc

SEQ ID NO: 3701521 - RNA, 22 nt, Salmonella enterica enterica serovar Typhi Ty2
ccgcaccuggguauuccacugg

SEQ ID NO: 3701522 - RNA, 18 nt, Salmonella enterica enterica serovar Typhi Ty2
ccgcacgcgacgcgccag

SEQ ID NO: 3701523 - RNA, 23 nt, Salmonella enterica enterica serovar Typhi Ty2
ccgcacgcgacgcgccagccagc

SEQ ID NO: 3701524 - RNA, 12 nt, Salmonella enterica enterica serovar Typhi Ty2
ccgcacgcgcgc

SEQ ID NO: 3701525 - RNA, 14 nt, Salmonella enterica enterica serovar Typhi Ty2
ccgcagaaaaagcc

SEQ ID NO: 3701526 - RNA, 19 nt, Salmonella enterica enterica serovar Typhi Ty2
ccgcagauccagcacggcc

SEQ ID NO: 3701527 - RNA, 23 nt, Salmonella enterica enterica serovar Typhi Ty2
ccgcagcaaucagguauuuccug

SEQ ID NO: 3701528 - RNA, 23 nt, Salmonella enterica enterica serovar Typhi Ty2
ccgcagcacccgcucgcugcauu

SEQ ID NO: 3701529 - RNA, 12 nt, Salmonella enterica enterica serovar Typhi Ty2
ccgcagccagaa

SEQ ID NO: 3701530 - RNA, 15 nt, Salmonella enterica enterica serovar Typhi Ty2
ccgcagccagaauca

SEQ ID NO: 3701531 - RNA, 12 nt, Salmonella enterica enterica serovar Typhi Ty2
ccgcagcccgcc

SEQ ID NO: 3701532 - RNA, 14 nt, Salmonella enterica enterica serovar Typhi Ty2
ccgcagccgacgca

SEQ ID NO: 3701533 - RNA, 10 nt, Salmonella enterica enterica serovar Typhi Ty2
ccgcagccgg

SEQ ID NO: 3701534 - RNA, 13 nt, Salmonella enterica enterica serovar Typhi Ty2
ccgcagcgccaua

SEQ ID NO: 3701535 - RNA, 23 nt, Salmonella enterica enterica serovar Typhi Ty2
ccgcagcgccugcgccgcaggaa

SEQ ID NO: 3701536 - RNA, 15 nt, Salmonella enterica enterica serovar Typhi Ty2
ccgcagcgcggaagc

SEQ ID NO: 3701537 - RNA, 16 nt, Salmonella enterica enterica serovar Typhi Ty2
ccgcagcgcggccugc

SEQ ID NO: 3701538 - RNA, 14 nt, Salmonella enterica enterica serovar Typhi Ty2
ccgcagcuuauucc

SEQ ID NO: 3701539 - RNA, 11 nt, Salmonella enterica enterica serovar Typhi Ty2
ccgcaggacag

SEQ ID NO: 3701540 - RNA, 22 nt, Salmonella enterica enterica serovar Typhi Ty2
ccgcaggacagcgacauccucu

SEQ ID NO: 3701541 - RNA, 16 nt, Salmonella enterica enterica serovar Typhi Ty2
ccgcaggagagccaga

SEQ ID NO: 3701542 - RNA, 18 nt, Salmonella enterica enterica serovar Typhi Ty2
ccgcaggagagccagaag

SEQ ID NO: 3701543 - RNA, 14 nt, Salmonella enterica enterica serovar Typhi Ty2
ccgcaggcuuccag

SEQ ID NO: 3701544 - RNA, 18 nt, Salmonella enterica enterica serovar Typhi Ty2
ccgcauauauugcgcuuc

SEQ ID NO: 3701545 - RNA, 14 nt, Salmonella enterica enterica serovar Typhi Ty2
ccgcaucaaugccc

SEQ ID NO: 3701546 - RNA, 15 nt, Salmonella enterica enterica serovar Typhi Ty2
ccgcaucacggcagc

SEQ ID NO: 3701547 - RNA, 15 nt, Salmonella enterica enterica serovar Typhi Ty2
ccgcaucgauacccu

SEQ ID NO: 3701548 - RNA, 15 nt, Salmonella enterica enterica serovar Typhi Ty2
ccgcaucguuaucau

SEQ ID NO: 3701549 - RNA, 17 nt, Salmonella enterica enterica serovar Typhi Ty2
ccgcaucuucgcccggc

SEQ ID NO: 3701550 - RNA, 19 nt, Salmonella enterica enterica serovar Typhi Ty2
ccgcauggccgcuauccuc

SEQ ID NO: 3701551 - RNA, 17 nt, Salmonella enterica enterica serovar Typhi Ty2
ccgcauugagcaacccu

SEQ ID NO: 3701552 - RNA, 18 nt, Salmonella enterica enterica serovar Typhi Ty2
ccgcauugguuucgccua

SEQ ID NO: 3701553 - RNA, 19 nt, Salmonella enterica enterica serovar Typhi Ty2
ccgcauuuaacaggacgcu

SEQ ID NO: 3701554 - RNA, 23 nt, Salmonella enterica enterica serovar Typhi Ty2
ccgcauuuaacaggacgcuccau

SEQ ID NO: 3701555 - RNA, 22 nt, Salmonella enterica enterica serovar Typhi Ty2
ccgcauuucgcccucgccacgg

SEQ ID NO: 3701556 - RNA, 13 nt, Salmonella enterica enterica serovar Typhi Ty2
ccgcauuuucagc

SEQ ID NO: 3701557 - RNA, 16 nt, Salmonella enterica enterica serovar Typhi Ty2
ccgcauuuuuucuuca

SEQ ID NO: 3701558 - RNA, 23 nt, Salmonella enterica enterica serovar Typhi Ty2
ccgcauuuuuucuucaguucagc

SEQ ID NO: 3701559 - RNA, 14 nt, Salmonella enterica enterica serovar Typhi Ty2
ccgccaaacgcggu

SEQ ID NO: 3701560 - RNA, 24 nt, Salmonella enterica enterica serovar Typhi Ty2
ccgccaaacugcgcgccgcccugc

SEQ ID NO: 3701561 - RNA, 18 nt, Salmonella enterica enterica serovar Typhi Ty2
ccgccaacaccgcaucgc

SEQ ID NO: 3701562 - RNA, 13 nt, Salmonella enterica enterica serovar Typhi Ty2
ccgccaacgccaa

SEQ ID NO: 3701563 - RNA, 18 nt, Salmonella enterica enterica serovar Typhi Ty2
ccgccaacgccagcagcg

SEQ ID NO: 3701564 - RNA, 21 nt, Salmonella enterica enterica serovar Typhi Ty2
ccgccaacgguaaguugaaag

SEQ ID NO: 3701565 - RNA, 16 nt, Salmonella enterica enterica serovar Typhi Ty2
ccgccaauaaccaccu

SEQ ID NO: 3701566 - RNA, 23 nt, Salmonella enterica enterica serovar Typhi Ty2
ccgccaauauccggcacgccagc

SEQ ID NO: 3701567 - RNA, 14 nt, Salmonella enterica enterica serovar Typhi Ty2
ccgccaaugaccau

SEQ ID NO: 3701568 - RNA, 15 nt, Salmonella enterica enterica serovar Typhi Ty2
ccgccaccaccgauc

SEQ ID NO: 3701569 - RNA, 11 nt, Salmonella enterica enterica serovar Typhi Ty2
ccgccaccacg

SEQ ID NO: 3701570 - RNA, 12 nt, Salmonella enterica enterica serovar Typhi Ty2
ccgccaccacgc

SEQ ID NO: 3701571 - RNA, 15 nt, Salmonella enterica enterica serovar Typhi Ty2
ccgccaccaucgcau

SEQ ID NO: 3701572 - RNA, 19 nt, Salmonella enterica enterica serovar Typhi Ty2
ccgccagaaaagaaccgac

SEQ ID NO: 3701573 - RNA, 13 nt, Salmonella enterica enterica serovar Typhi Ty2
ccgccagacucag

SEQ ID NO: 3701574 - RNA, 16 nt, Salmonella enterica enterica serovar Typhi Ty2
ccgccagacucagcca

SEQ ID NO: 3701575 - RNA, 14 nt, Salmonella enterica enterica serovar Typhi Ty2
ccgccagagcacga

SEQ ID NO: 3701576 - RNA, 15 nt, Salmonella enterica enterica serovar Typhi Ty2
ccgccagauaaagcg

SEQ ID NO: 3701577 - RNA, 18 nt, Salmonella enterica enterica serovar Typhi Ty2
ccgccagcaccaggcucg

SEQ ID NO: 3701578 - RNA, 13 nt, Salmonella enterica enterica serovar Typhi Ty2
ccgccagcagagc

SEQ ID NO: 3701579 - RNA, 11 nt, Salmonella enterica enterica serovar Typhi Ty2
ccgccagcagu

SEQ ID NO: 3701580 - RNA, 18 nt, Salmonella enterica enterica serovar Typhi Ty2
ccgccagcgacauggcgg

SEQ ID NO: 3701581 - RNA, 20 nt, Salmonella enterica enterica serovar Typhi Ty2
ccgccagcgacauggcgguc

SEQ ID NO: 3701582 - RNA, 12 nt, Salmonella enterica enterica serovar Typhi Ty2
ccgccagcgcaa

SEQ ID NO: 3701583 - RNA, 13 nt, Salmonella enterica enterica serovar Typhi Ty2
ccgccagcggcgc

SEQ ID NO: 3701584 - RNA, 15 nt, Salmonella enterica enterica serovar Typhi Ty2
ccgccagcggcgcca

SEQ ID NO: 3701585 - RNA, 23 nt, Salmonella enterica enterica serovar Typhi Ty2
ccgccagcgucuguuucaacgca

SEQ ID NO: 3701586 - RNA, 18 nt, Salmonella enterica enterica serovar Typhi Ty2
ccgccagcuccugcgggc

SEQ ID NO: 3701587 - RNA, 19 nt, Salmonella enterica enterica serovar Typhi Ty2
ccgccaggcauguuaugaa

SEQ ID NO: 3701588 - RNA, 22 nt, Salmonella enterica enterica serovar Typhi Ty2
ccgccaggcgagcacaccauau

SEQ ID NO: 3701589 - RNA, 23 nt, Salmonella enterica enterica serovar Typhi Ty2
ccgccaguaauuuuucucccagc

SEQ ID NO: 3701590 - RNA, 17 nt, Salmonella enterica enterica serovar Typhi Ty2
ccgccagucacccugcc

SEQ ID NO: 3701591 - RNA, 22 nt, Salmonella enterica enterica serovar Typhi Ty2
ccgccaguuguucaacauagua

SEQ ID NO: 3701592 - RNA, 14 nt, Salmonella enterica enterica serovar Typhi Ty2
ccgccaguuuuuau

SEQ ID NO: 3701593 - RNA, 20 nt, Salmonella enterica enterica serovar Typhi Ty2
ccgccauagaaauagccccg

SEQ ID NO: 3701594 - RNA, 17 nt, Salmonella enterica enterica serovar Typhi Ty2
ccgccaucaacgaccau

SEQ ID NO: 3701595 - RNA, 15 nt, Salmonella enterica enterica serovar Typhi Ty2
ccgccaucacaccaa

SEQ ID NO: 3701596 - RNA, 17 nt, Salmonella enterica enterica serovar Typhi Ty2
ccgccauccgacacagc

SEQ ID NO: 3701597 - RNA, 12 nt, Salmonella enterica enterica serovar Typhi Ty2
ccgccauccggc

SEQ ID NO: 3701598 - RNA, 18 nt, Salmonella enterica enterica serovar Typhi Ty2
ccgcgaggaucugcuuau

SEQ ID NO: 3701599 - RNA, 23 nt, Salmonella enterica enterica serovar Typhi Ty2
ccgcgauaaagaauagccugggc

SEQ ID NO: 3701600 - RNA, 16 nt, Salmonella enterica enterica serovar Typhi Ty2
ccgcgauacggauagc

SEQ ID NO: 3701601 - RNA, 16 nt, Salmonella enterica enterica serovar Typhi Ty2
ccgcgaucgcggcaac

SEQ ID NO: 3701602 - RNA, 22 nt, Salmonella enterica enterica serovar Typhi Ty2
ccgcgaugaucgucgcgaucgc

SEQ ID NO: 3701603 - RNA, 16 nt, Salmonella enterica enterica serovar Typhi Ty2
ccgcgcaaagcaauac

SEQ ID NO: 3701604 - RNA, 22 nt, Salmonella enterica enterica serovar Typhi Ty2
ccgcgcaaagcaauaccacgcc

SEQ ID NO: 3701605 - RNA, 22 nt, Salmonella enterica enterica serovar Typhi Ty2
ccgcgcaaggcguucacaccgc

SEQ ID NO: 3701606 - RNA, 18 nt, Salmonella enterica enterica serovar Typhi Ty2
ccgcgcaauaugcggcgc

SEQ ID NO: 3701607 - RNA, 16 nt, Salmonella enterica enterica serovar Typhi Ty2
ccgcgcagaaucacuu

SEQ ID NO: 3701608 - RNA, 12 nt, Salmonella enterica enterica serovar Typhi Ty2
ccgcgcagcgcc

SEQ ID NO: 3701609 - RNA, 15 nt, Salmonella enterica enterica serovar Typhi Ty2
ccgcgcagugcagcg

SEQ ID NO: 3701610 - RNA, 22 nt, Salmonella enterica enterica serovar Typhi Ty2
ccgcgccaaacguggcggcaga

SEQ ID NO: 3701611 - RNA, 13 nt, Salmonella enterica enterica serovar Typhi Ty2
ccgcgccacccca

SEQ ID NO: 3701612 - RNA, 14 nt, Salmonella enterica enterica serovar Typhi Ty2
ccgcgcccugcgga

SEQ ID NO: 3701613 - RNA, 12 nt, Salmonella enterica enterica serovar Typhi Ty2
ccgcgccgucgg

SEQ ID NO: 3701614 - RNA, 17 nt, Salmonella enterica enterica serovar Typhi Ty2
ccgcgccuaccagcgcu

SEQ ID NO: 3701615 - RNA, 21 nt, Salmonella enterica enterica serovar Typhi Ty2
ccgcgccuucgcggugauccc

SEQ ID NO: 3701616 - RNA, 13 nt, Salmonella enterica enterica serovar Typhi Ty2
ccgcgcgccgccu

SEQ ID NO: 3701617 - RNA, 16 nt, Salmonella enterica enterica serovar Typhi Ty2
ccgcgcgcgcggcauc

SEQ ID NO: 3701618 - RNA, 16 nt, Salmonella enterica enterica serovar Typhi Ty2
ccgcgcggcguucugc

SEQ ID NO: 3701619 - RNA, 15 nt, Salmonella enterica enterica serovar Typhi Ty2
ccgcgcgucagcgug

SEQ ID NO: 3701620 - RNA, 14 nt, Salmonella enterica enterica serovar Typhi Ty2
ccgcgcucaacaca

SEQ ID NO: 3701621 - RNA, 20 nt, Salmonella enterica enterica serovar Typhi Ty2
ccgcgcucauacgaucgcgc

SEQ ID NO: 3701622 - RNA, 15 nt, Salmonella enterica enterica serovar Typhi Ty2
ccgcgcuccaucaua

SEQ ID NO: 3701623 - RNA, 16 nt, Salmonella enterica enterica serovar Typhi Ty2
ccgcgcucgccagcau

SEQ ID NO: 3701624 - RNA, 14 nt, Salmonella enterica enterica serovar Typhi Ty2
ccgcgcucuccggc

SEQ ID NO: 3701625 - RNA, 19 nt, Salmonella enterica enterica serovar Typhi Ty2
ccgcgcuuucuggcgcaga

SEQ ID NO: 3701626 - RNA, 18 nt, Salmonella enterica enterica serovar Typhi Ty2
ccgcggagaucgcucccg

SEQ ID NO: 3701627 - RNA, 20 nt, Salmonella enterica enterica serovar Typhi Ty2
ccgcggcggacagcggcagc

SEQ ID NO: 3701628 - RNA, 23 nt, Salmonella enterica enterica serovar Typhi Ty2
ccgcggggaucgguuuauccccg

SEQ ID NO: 3701629 - RNA, 13 nt, Salmonella enterica enterica serovar Typhi Ty2
ccgcguaaaaagu

SEQ ID NO: 3701630 - RNA, 22 nt, Salmonella enterica enterica serovar Typhi Ty2
ccgcguaaucuucgcggcugcc

SEQ ID NO: 3701631 - RNA, 20 nt, Salmonella enterica enterica serovar Typhi Ty2
ccgcguaccugugcagguac

SEQ ID NO: 3701632 - RNA, 19 nt, Salmonella enterica enterica serovar Typhi Ty2
ccgcguagcccagcgccgc

SEQ ID NO: 3701633 - RNA, 19 nt, Salmonella enterica enterica serovar Typhi Ty2
ccgcguaucauugcgcucu

SEQ ID NO: 3701634 - RNA, 12 nt, Salmonella enterica enterica serovar Typhi Ty2
ccgcgucagcac

SEQ ID NO: 3701635 - RNA, 14 nt, Salmonella enterica enterica serovar Typhi Ty2
ccgcgucagcacau

SEQ ID NO: 3701636 - RNA, 13 nt, Salmonella enterica enterica serovar Typhi Ty2
ccgcgucccgacc

SEQ ID NO: 3701637 - RNA, 20 nt, Salmonella enterica enterica serovar Typhi Ty2
ccgcguccuaccgccgcgau

SEQ ID NO: 3701638 - RNA, 19 nt, Salmonella enterica enterica serovar Typhi Ty2
ccgcgucguuacgcucguc

SEQ ID NO: 3701639 - RNA, 20 nt, Salmonella enterica enterica serovar Typhi Ty2
ccgcgucguuacgcucguca

SEQ ID NO: 3701640 - RNA, 20 nt, Salmonella enterica enterica serovar Typhi Ty2
ccgcgugaacaccacugaaa

SEQ ID NO: 3701641 - RNA, 14 nt, Salmonella enterica enterica serovar Typhi Ty2
ccgcguuggcggcu

SEQ ID NO: 3701642 - RNA, 19 nt, Salmonella enterica enterica serovar Typhi Ty2
ccgcguugguuaaggcggc

SEQ ID NO: 3701643 - RNA, 16 nt, Salmonella enterica enterica serovar Typhi Ty2
ccgcguuguccccuca

SEQ ID NO: 3701644 - RNA, 13 nt, Salmonella enterica enterica serovar Typhi Ty2
ccgcguuuuagca

SEQ ID NO: 3701645 - RNA, 18 nt, Salmonella enterica enterica serovar Typhi Ty2
ccgcguuuugcugaugaa

SEQ ID NO: 3701646 - RNA, 16 nt, Salmonella enterica enterica serovar Typhi Ty2
ccgcuaaaaaacaggc

SEQ ID NO: 3701647 - RNA, 14 nt, Salmonella enterica enterica serovar Typhi Ty2
ccgcuacaauccag

SEQ ID NO: 3701648 - RNA, 18 nt, Salmonella enterica enterica serovar Typhi Ty2
ccgcuacaauccaggacg

SEQ ID NO: 3701649 - RNA, 19 nt, Salmonella enterica enterica serovar Typhi Ty2
ccgcuacaauccaggacgu

SEQ ID NO: 3701650 - RNA, 21 nt, Salmonella enterica enterica serovar Typhi Ty2
ccgcuacccggcacaaugccc

SEQ ID NO: 3701651 - RNA, 19 nt, Salmonella enterica enterica serovar Typhi Ty2
ccgcuacguaauucaugca

SEQ ID NO: 3701652 - RNA, 14 nt, Salmonella enterica enterica serovar Typhi Ty2
ccgcuacuccgccc

SEQ ID NO: 3701653 - RNA, 15 nt, Salmonella enterica enterica serovar Typhi Ty2
ccgcuaucgaccagc

SEQ ID NO: 3701654 - RNA, 21 nt, Salmonella enterica enterica serovar Typhi Ty2
ccgcuaucgaccagcaccugc

SEQ ID NO: 3701655 - RNA, 20 nt, Salmonella enterica enterica serovar Typhi Ty2
ccgcuaucugcuccgccagc

SEQ ID NO: 3701656 - RNA, 13 nt, Salmonella enterica enterica serovar Typhi Ty2
ccgcuauuaccag

SEQ ID NO: 3701657 - RNA, 19 nt, Salmonella enterica enterica serovar Typhi Ty2
ccgcuauucaccagcguca

SEQ ID NO: 3701658 - RNA, 22 nt, Salmonella enterica enterica serovar Typhi Ty2
ccgcucacgguuucaacuucca

SEQ ID NO: 3701659 - RNA, 20 nt, Salmonella enterica enterica serovar Typhi Ty2
ccgcucaggguaaucaccau

SEQ ID NO: 3701660 - RNA, 22 nt, Salmonella enterica enterica serovar Typhi Ty2
ccgcucauuagggugcagugaa

SEQ ID NO: 3701661 - RNA, 13 nt, Salmonella enterica enterica serovar Typhi Ty2
ccgcuccagaagc

SEQ ID NO: 3701662 - RNA, 18 nt, Salmonella enterica enterica serovar Typhi Ty2
ccgcucccgcauggacaa

SEQ ID NO: 3701663 - RNA, 14 nt, Salmonella enterica enterica serovar Typhi Ty2
ccgcuccgcgcauc

SEQ ID NO: 3701664 - RNA, 15 nt, Salmonella enterica enterica serovar Typhi Ty2
ccgcucgaaaccauc

SEQ ID NO: 3701665 - RNA, 17 nt, Salmonella enterica enterica serovar Typhi Ty2
ccgcucgccgccucccc

SEQ ID NO: 3701666 - RNA, 19 nt, Salmonella enterica enterica serovar Typhi Ty2
ccgcucgcuuacgcggcgc

SEQ ID NO: 3701667 - RNA, 22 nt, Salmonella enterica enterica serovar Typhi Ty2
ccgcucggcauacaccgccagc

SEQ ID NO: 3701668 - RNA, 13 nt, Salmonella enterica enterica serovar Typhi Ty2
ccgcucugcuguu

SEQ ID NO: 3701669 - RNA, 16 nt, Salmonella enterica enterica serovar Typhi Ty2
ccgcucuucagcgucc

SEQ ID NO: 3701670 - RNA, 19 nt, Salmonella enterica enterica serovar Typhi Ty2
ccgcugaaauagccccguc

SEQ ID NO: 3701671 - RNA, 23 nt, Salmonella enterica enterica serovar Typhi Ty2
ccgcugaaccugauuauucagua

SEQ ID NO: 3701672 - RNA, 24 nt, Salmonella enterica enterica serovar Typhi Ty2
ccgcugacgcugcccgccggacag

SEQ ID NO: 3701673 - RNA, 18 nt, Salmonella enterica enterica serovar Typhi Ty2
ccgcugauauucaccugu

SEQ ID NO: 3701674 - RNA, 16 nt, Salmonella enterica enterica serovar Typhi Ty2
ccgcugcaacucccgc

SEQ ID NO: 3701675 - RNA, 20 nt, Salmonella enterica enterica serovar Typhi Ty2
ccgcugcgcucacgcggcgc

SEQ ID NO: 3701676 - RNA, 23 nt, Salmonella enterica enterica serovar Typhi Ty2
ccgcugcggaacaccagcgccgc

SEQ ID NO: 3701677 - RNA, 19 nt, Salmonella enterica enterica serovar Typhi Ty2
ccgcugcugccuuccaguu

SEQ ID NO: 3701678 - RNA, 13 nt, Salmonella enterica enterica serovar Typhi Ty2
ccgcuggccgguu

SEQ ID NO: 3701679 - RNA, 19 nt, Salmonella enterica enterica serovar Typhi Ty2
ccgcuggcgaccagccugc

SEQ ID NO: 3701680 - RNA, 15 nt, Salmonella enterica enterica serovar Typhi Ty2
ccggaugcgccucau

SEQ ID NO: 3701681 - RNA, 13 nt, Salmonella enterica enterica serovar Typhi Ty2
ccggaugcggcua

SEQ ID NO: 3701682 - RNA, 22 nt, Salmonella enterica enterica serovar Typhi Ty2
ccggaugcguguucagguuggc

SEQ ID NO: 3701683 - RNA, 14 nt, Salmonella enterica enterica serovar Typhi Ty2
ccggauggcacugc

SEQ ID NO: 3701684 - RNA, 22 nt, Salmonella enterica enterica serovar Typhi Ty2
ccggauggcgacguugcgccuu

SEQ ID NO: 3701685 - RNA, 18 nt, Salmonella enterica enterica serovar Typhi Ty2
ccggauggcgcugcgcuu

SEQ ID NO: 3701686 - RNA, 16 nt, Salmonella enterica enterica serovar Typhi Ty2
ccggauggcggcguaa

SEQ ID NO: 3701687 - RNA, 21 nt, Salmonella enterica enterica serovar Typhi Ty2
ccggauggcggcgucgccugu

SEQ ID NO: 3701688 - RNA, 23 nt, Salmonella enterica enterica serovar Typhi Ty2
ccggauggcggcgugaacgccuu

SEQ ID NO: 3701689 - RNA, 20 nt, Salmonella enterica enterica serovar Typhi Ty2
ccggauggcggcuacgccuu

SEQ ID NO: 3701690 - RNA, 21 nt, Salmonella enterica enterica serovar Typhi Ty2
ccggauggcggcuuugaacag

SEQ ID NO: 3701691 - RNA, 23 nt, Salmonella enterica enterica serovar Typhi Ty2
ccggauggggcauuagccgccau

SEQ ID NO: 3701692 - RNA, 13 nt, Salmonella enterica enterica serovar Typhi Ty2
ccggauuuaccag

SEQ ID NO: 3701693 - RNA, 13 nt, Salmonella enterica enterica serovar Typhi Ty2
ccggauuuuaaau

SEQ ID NO: 3701694 - RNA, 15 nt, Salmonella enterica enterica serovar Typhi Ty2
ccggcaaaaaucagc

SEQ ID NO: 3701695 - RNA, 17 nt, Salmonella enterica enterica serovar Typhi Ty2
ccggcaaaccuaccggc

SEQ ID NO: 3701696 - RNA, 18 nt, Salmonella enterica enterica serovar Typhi Ty2
ccggcaaacguaaaacgc

SEQ ID NO: 3701697 - RNA, 17 nt, Salmonella enterica enterica serovar Typhi Ty2
ccggcaaacucagcggc

SEQ ID NO: 3701698 - RNA, 18 nt, Salmonella enterica enterica serovar Typhi Ty2
ccggcaaagaagcuuaca

SEQ ID NO: 3701699 - RNA, 14 nt, Salmonella enterica enterica serovar Typhi Ty2
ccggcaaaggaauu

SEQ ID NO: 3701700 - RNA, 18 nt, Salmonella enterica enterica serovar Typhi Ty2
ccggcaaccugagcgcga

SEQ ID NO: 3701701 - RNA, 12 nt, Salmonella enterica enterica serovar Typhi Ty2
ccggcaacugcc

SEQ ID NO: 3701702 - RNA, 22 nt, Salmonella enterica enterica serovar Typhi Ty2
ccggcaauauuacggaaacggu

SEQ ID NO: 3701703 - RNA, 19 nt, Salmonella enterica enterica serovar Typhi Ty2
ccggcaauuaaccgauaac

SEQ ID NO: 3701704 - RNA, 21 nt, Salmonella enterica enterica serovar Typhi Ty2
ccggcaauuaccgccagcggc

SEQ ID NO: 3701705 - RNA, 19 nt, Salmonella enterica enterica serovar Typhi Ty2
ccggcacaaugcccggcau

SEQ ID NO: 3701706 - RNA, 14 nt, Salmonella enterica enterica serovar Typhi Ty2
ccggcacacagaau

SEQ ID NO: 3701707 - RNA, 20 nt, Salmonella enterica enterica serovar Typhi Ty2
ccggcacaccggccauugcc

SEQ ID NO: 3701708 - RNA, 23 nt, Salmonella enterica enterica serovar Typhi Ty2
ccggcacauauuccggcgcuggc

SEQ ID NO: 3701709 - RNA, 13 nt, Salmonella enterica enterica serovar Typhi Ty2
ccggcacauccag

SEQ ID NO: 3701710 - RNA, 16 nt, Salmonella enterica enterica serovar Typhi Ty2
ccggcacauccagcug

SEQ ID NO: 3701711 - RNA, 17 nt, Salmonella enterica enterica serovar Typhi Ty2
ccggcaccucguccaga

SEQ ID NO: 3701712 - RNA, 18 nt, Salmonella enterica enterica serovar Typhi Ty2
ccggcacggucaaucauc

SEQ ID NO: 3701713 - RNA, 18 nt, Salmonella enterica enterica serovar Typhi Ty2
ccggcacuguucggggau

SEQ ID NO: 3701714 - RNA, 23 nt, Salmonella enterica enterica serovar Typhi Ty2
ccggcagaaaugaccacguacug

SEQ ID NO: 3701715 - RNA, 20 nt, Salmonella enterica enterica serovar Typhi Ty2
ccggcagcguaacgauaugc

SEQ ID NO: 3701716 - RNA, 18 nt, Salmonella enterica enterica serovar Typhi Ty2
ccggcaggagcggagaga

SEQ ID NO: 3701717 - RNA, 15 nt, Salmonella enterica enterica serovar Typhi Ty2
ccggcaggcagcgcc

SEQ ID NO: 3701718 - RNA, 12 nt, Salmonella enterica enterica serovar Typhi Ty2
ccggcaguccau

SEQ ID NO: 3701719 - RNA, 22 nt, Salmonella enterica enterica serovar Typhi Ty2
ccggcaguuauuuuacgggcgu

SEQ ID NO: 3701720 - RNA, 23 nt, Salmonella enterica enterica serovar Typhi Ty2
ccggcauaauaugcaacacgccg

SEQ ID NO: 3701721 - RNA, 19 nt, Salmonella enterica enterica serovar Typhi Ty2
ccggcaucacaaaccagac

SEQ ID NO: 3701722 - RNA, 15 nt, Salmonella enterica enterica serovar Typhi Ty2
ccggcaucacgccgg

SEQ ID NO: 3701723 - RNA, 21 nt, Salmonella enterica enterica serovar Typhi Ty2
ccggcaucauucugcaggcgg

SEQ ID NO: 3701724 - RNA, 14 nt, Salmonella enterica enterica serovar Typhi Ty2
ccggcaucggcagc

SEQ ID NO: 3701725 - RNA, 21 nt, Salmonella enterica enterica serovar Typhi Ty2
ccggcaugccauaaucgauau

SEQ ID NO: 3701726 - RNA, 21 nt, Salmonella enterica enterica serovar Typhi Ty2
ccggcauuaugcaggcgucgg

SEQ ID NO: 3701727 - RNA, 16 nt, Salmonella enterica enterica serovar Typhi Ty2
ccggccacagcgccag

SEQ ID NO: 3701728 - RNA, 14 nt, Salmonella enterica enterica serovar Typhi Ty2
ccggccagcgccag

SEQ ID NO: 3701729 - RNA, 22 nt, Salmonella enterica enterica serovar Typhi Ty2
ccggccauagcgugaggucauu

SEQ ID NO: 3701730 - RNA, 18 nt, Salmonella enterica enterica serovar Typhi Ty2
ccggccauugccgcgccg

SEQ ID NO: 3701731 - RNA, 15 nt, Salmonella enterica enterica serovar Typhi Ty2
ccggcccccggccau

SEQ ID NO: 3701732 - RNA, 13 nt, Salmonella enterica enterica serovar Typhi Ty2
ccggccuacagac

SEQ ID NO: 3701733 - RNA, 15 nt, Salmonella enterica enterica serovar Typhi Ty2
ccggccuccaaauga

SEQ ID NO: 3701734 - RNA, 15 nt, Salmonella enterica enterica serovar Typhi Ty2
ccggccugacgcagc

SEQ ID NO: 3701735 - RNA, 13 nt, Salmonella enterica enterica serovar Typhi Ty2
ccggccugcaaac

SEQ ID NO: 3701736 - RNA, 22 nt, Salmonella enterica enterica serovar Typhi Ty2
ccggccugcagggaauaagcgc

SEQ ID NO: 3701737 - RNA, 13 nt, Salmonella enterica enterica serovar Typhi Ty2
ccggccuggcgca

SEQ ID NO: 3701738 - RNA, 22 nt, Salmonella enterica enterica serovar Typhi Ty2
ccggcgaaaaccgagcauccgc

SEQ ID NO: 3701739 - RNA, 19 nt, Salmonella enterica enterica serovar Typhi Ty2
ccggcgaaaccgauuuccu

SEQ ID NO: 3701740 - RNA, 17 nt, Salmonella enterica enterica serovar Typhi Ty2
ccggcgaaagcggacac

SEQ ID NO: 3701741 - RNA, 20 nt, Salmonella enterica enterica serovar Typhi Ty2
ccggcgaaaucgugcgcccc

SEQ ID NO: 3701742 - RNA, 19 nt, Salmonella enterica enterica serovar Typhi Ty2
ccggcgaacguuggcuggg

SEQ ID NO: 3701743 - RNA, 17 nt, Salmonella enterica enterica serovar Typhi Ty2
ccggcgaauagcgccag

SEQ ID NO: 3701744 - RNA, 18 nt, Salmonella enterica enterica serovar Typhi Ty2
ccggcgacagcgaccacg

SEQ ID NO: 3701745 - RNA, 17 nt, Salmonella enterica enterica serovar Typhi Ty2
ccggcgagcgcgauaac

SEQ ID NO: 3701746 - RNA, 18 nt, Salmonella enterica enterica serovar Typhi Ty2
ccggcgagugccugcugg

SEQ ID NO: 3701747 - RNA, 23 nt, Salmonella enterica enterica serovar Typhi Ty2
ccggcgauaacccgcgcauggcc

SEQ ID NO: 3701748 - RNA, 16 nt, Salmonella enterica enterica serovar Typhi Ty2
ccggcgauagcggccu

SEQ ID NO: 3701749 - RNA, 17 nt, Salmonella enterica enterica serovar Typhi Ty2
ccggcgauagcggccug

SEQ ID NO: 3701750 - RNA, 18 nt, Salmonella enterica enterica serovar Typhi Ty2
ccggcgauggugcggcgc

SEQ ID NO: 3701751 - RNA, 16 nt, Salmonella enterica enterica serovar Typhi Ty2
ccggcgcaaacaguac

SEQ ID NO: 3701752 - RNA, 22 nt, Salmonella enterica enterica serovar Typhi Ty2
ccggcgcaaacaguacgcccgc

SEQ ID NO: 3701753 - RNA, 18 nt, Salmonella enterica enterica serovar Typhi Ty2
ccggcgcagcaucugcgg

SEQ ID NO: 3701754 - RNA, 21 nt, Salmonella enterica enterica serovar Typhi Ty2
ccggcgccaaucaccgccagc

SEQ ID NO: 3701755 - RNA, 14 nt, Salmonella enterica enterica serovar Typhi Ty2
ccggcgccagaagc

SEQ ID NO: 3701756 - RNA, 19 nt, Salmonella enterica enterica serovar Typhi Ty2
ccggcgccagcucaacgcc

SEQ ID NO: 3701757 - RNA, 21 nt, Salmonella enterica enterica serovar Typhi Ty2
ccggcgccuguuaauaccgug

SEQ ID NO: 3701758 - RNA, 11 nt, Salmonella enterica enterica serovar Typhi Ty2
ccggcgcgccu

SEQ ID NO: 3701759 - RNA, 17 nt, Salmonella enterica enterica serovar Typhi Ty2
ccggcgcgccuuccagc

SEQ ID NO: 3701760 - RNA, 13 nt, Salmonella enterica enterica serovar Typhi Ty2
ccggcgcggcauc

SEQ ID NO: 3701761 - RNA, 14 nt, Salmonella enterica enterica serovar Typhi Ty2
ccggcgcgggugau

SEQ ID NO: 3701762 - RNA, 20 nt, Salmonella enterica enterica serovar Typhi Ty2
ccgggugcaaauccaucuca

SEQ ID NO: 3701763 - RNA, 15 nt, Salmonella enterica enterica serovar Typhi Ty2
ccggguggcgcugug

SEQ ID NO: 3701764 - RNA, 20 nt, Salmonella enterica enterica serovar Typhi Ty2
ccggguucagcgacaggcug

SEQ ID NO: 3701765 - RNA, 18 nt, Salmonella enterica enterica serovar Typhi Ty2
ccgguaaagcagugcagu

SEQ ID NO: 3701766 - RNA, 20 nt, Salmonella enterica enterica serovar Typhi Ty2
ccgguaaauccacaaccggc

SEQ ID NO: 3701767 - RNA, 22 nt, Salmonella enterica enterica serovar Typhi Ty2
ccgguaacgauaaaaugcaaau

SEQ ID NO: 3701768 - RNA, 15 nt, Salmonella enterica enterica serovar Typhi Ty2
ccgguaacguaaaua

SEQ ID NO: 3701769 - RNA, 19 nt, Salmonella enterica enterica serovar Typhi Ty2
ccgguaagcgcagcgccac

SEQ ID NO: 3701770 - RNA, 22 nt, Salmonella enterica enterica serovar Typhi Ty2
ccgguaauaauuagcauccagc

SEQ ID NO: 3701771 - RNA, 17 nt, Salmonella enterica enterica serovar Typhi Ty2
ccgguagcauccgcgau

SEQ ID NO: 3701772 - RNA, 17 nt, Salmonella enterica enterica serovar Typhi Ty2
ccgguagccaggcgcga

SEQ ID NO: 3701773 - RNA, 17 nt, Salmonella enterica enterica serovar Typhi Ty2
ccgguagcgagaagccg

SEQ ID NO: 3701774 - RNA, 13 nt, Salmonella enterica enterica serovar Typhi Ty2
ccgguagcguggu

SEQ ID NO: 3701775 - RNA, 13 nt, Salmonella enterica enterica serovar Typhi Ty2
ccgguauccagcg

SEQ ID NO: 3701776 - RNA, 17 nt, Salmonella enterica enterica serovar Typhi Ty2
ccgguauuaaagcgcgg

SEQ ID NO: 3701777 - RNA, 18 nt, Salmonella enterica enterica serovar Typhi Ty2
ccgguauuuuucaccuca

SEQ ID NO: 3701778 - RNA, 15 nt, Salmonella enterica enterica serovar Typhi Ty2
ccggucagucccagc

SEQ ID NO: 3701779 - RNA, 17 nt, Salmonella enterica enterica serovar Typhi Ty2
ccggucauacugaacaa

SEQ ID NO: 3701780 - RNA, 18 nt, Salmonella enterica enterica serovar Typhi Ty2
ccggucaucgcggaaagc

SEQ ID NO: 3701781 - RNA, 22 nt, Salmonella enterica enterica serovar Typhi Ty2
ccggucaucgcggaaagcaaug

SEQ ID NO: 3701782 - RNA, 14 nt, Salmonella enterica enterica serovar Typhi Ty2
ccggucgcgccagc

SEQ ID NO: 3701783 - RNA, 21 nt, Salmonella enterica enterica serovar Typhi Ty2
ccggucgcgccagcgaccacc

SEQ ID NO: 3701784 - RNA, 20 nt, Salmonella enterica enterica serovar Typhi Ty2
ccggucuacaagugauacgg

SEQ ID NO: 3701785 - RNA, 15 nt, Salmonella enterica enterica serovar Typhi Ty2
ccggucugcgcgccg

SEQ ID NO: 3701786 - RNA, 20 nt, Salmonella enterica enterica serovar Typhi Ty2
ccggugauggugcagccccg

SEQ ID NO: 3701787 - RNA, 19 nt, Salmonella enterica enterica serovar Typhi Ty2
ccggugccauuccagccgg

SEQ ID NO: 3701788 - RNA, 13 nt, Salmonella enterica enterica serovar Typhi Ty2
ccggugcgcccca

SEQ ID NO: 3701789 - RNA, 14 nt, Salmonella enterica enterica serovar Typhi Ty2
ccggugcgccccag

SEQ ID NO: 3701790 - RNA, 15 nt, Salmonella enterica enterica serovar Typhi Ty2
ccggugcgccccagc

SEQ ID NO: 3701791 - RNA, 16 nt, Salmonella enterica enterica serovar Typhi Ty2
ccgguggcgccacgcc

SEQ ID NO: 3701792 - RNA, 17 nt, Salmonella enterica enterica serovar Typhi Ty2
ccgguggcgcugcgcuu

SEQ ID NO: 3701793 - RNA, 23 nt, Salmonella enterica enterica serovar Typhi Ty2
ccgguggucuguucgagggcgau

SEQ ID NO: 3701794 - RNA, 22 nt, Salmonella enterica enterica serovar Typhi Ty2
ccgguuagcucaacgcaucgcu

SEQ ID NO: 3701795 - RNA, 13 nt, Salmonella enterica enterica serovar Typhi Ty2
ccgguucacccac

SEQ ID NO: 3701796 - RNA, 21 nt, Salmonella enterica enterica serovar Typhi Ty2
ccgguuccagcggccgcuccg

SEQ ID NO: 3701797 - RNA, 22 nt, Salmonella enterica enterica serovar Typhi Ty2
ccgguucggacgguaccugaag

SEQ ID NO: 3701798 - RNA, 17 nt, Salmonella enterica enterica serovar Typhi Ty2
ccgguucggcaucgccc

SEQ ID NO: 3701799 - RNA, 18 nt, Salmonella enterica enterica serovar Typhi Ty2
ccgguugaccggcccgcu

SEQ ID NO: 3701800 - RNA, 12 nt, Salmonella enterica enterica serovar Typhi Ty2
ccgguugcgcug

SEQ ID NO: 3701801 - RNA, 12 nt, Salmonella enterica enterica serovar Typhi Ty2
ccgguugcugau

SEQ ID NO: 3701802 - RNA, 12 nt, Salmonella enterica enterica serovar Typhi Ty2
ccgguuuauccc

SEQ ID NO: 3701803 - RNA, 14 nt, Salmonella enterica enterica serovar Typhi Ty2
ccgguuuauccccg

SEQ ID NO: 3701804 - RNA, 13 nt, Salmonella enterica enterica serovar Typhi Ty2
ccgguuugucgcu

SEQ ID NO: 3701805 - RNA, 16 nt, Salmonella enterica enterica serovar Typhi Ty2
ccgguuuuugcgcgcu

SEQ ID NO: 3701806 - RNA, 13 nt, Salmonella enterica enterica serovar Typhi Ty2
ccgguuuuuuaau

SEQ ID NO: 3701807 - RNA, 14 nt, Salmonella enterica enterica serovar Typhi Ty2
ccguaaaaugcugg

SEQ ID NO: 3701808 - RNA, 19 nt, Salmonella enterica enterica serovar Typhi Ty2
ccguaaacgggcugcccgg

SEQ ID NO: 3701809 - RNA, 13 nt, Salmonella enterica enterica serovar Typhi Ty2
ccguaaaguuccc

SEQ ID NO: 3701810 - RNA, 14 nt, Salmonella enterica enterica serovar Typhi Ty2
ccguaaauuccuug

SEQ ID NO: 3701811 - RNA, 20 nt, Salmonella enterica enterica serovar Typhi Ty2
ccguaaggcgauucaacagg

SEQ ID NO: 3701812 - RNA, 12 nt, Salmonella enterica enterica serovar Typhi Ty2
ccguaaggcgcc

SEQ ID NO: 3701813 - RNA, 15 nt, Salmonella enterica enterica serovar Typhi Ty2
ccguaauaaguauca

SEQ ID NO: 3701814 - RNA, 23 nt, Salmonella enterica enterica serovar Typhi Ty2
ccguacagccuaaaaaaccggcc

SEQ ID NO: 3701815 - RNA, 21 nt, Salmonella enterica enterica serovar Typhi Ty2
ccguaccagccguagcugcug

SEQ ID NO: 3701816 - RNA, 15 nt, Salmonella enterica enterica serovar Typhi Ty2
ccguaccuccagcga

SEQ ID NO: 3701817 - RNA, 18 nt, Salmonella enterica enterica serovar Typhi Ty2
ccguacguauuaucccgc

SEQ ID NO: 3701818 - RNA, 14 nt, Salmonella enterica enterica serovar Typhi Ty2
ccguacucagaucg

SEQ ID NO: 3701819 - RNA, 19 nt, Salmonella enterica enterica serovar Typhi Ty2
ccguagcguacuuucaaau

SEQ ID NO: 3701820 - RNA, 16 nt, Salmonella enterica enterica serovar Typhi Ty2
ccguagcuccagaccu

SEQ ID NO: 3701821 - RNA, 19 nt, Salmonella enterica enterica serovar Typhi Ty2
ccguaggccggauaagacg

SEQ ID NO: 3701822 - RNA, 19 nt, Salmonella enterica enterica serovar Typhi Ty2
ccguaggccugauaagacg

SEQ ID NO: 3701823 - RNA, 16 nt, Salmonella enterica enterica serovar Typhi Ty2
ccguaguagguaucca

SEQ ID NO: 3701824 - RNA, 22 nt, Salmonella enterica enterica serovar Typhi Ty2
ccguagucugauugccggauga

SEQ ID NO: 3701825 - RNA, 14 nt, Salmonella enterica enterica serovar Typhi Ty2
ccguauccagaccc

SEQ ID NO: 3701826 - RNA, 19 nt, Salmonella enterica enterica serovar Typhi Ty2
ccguauccgccaccaugau

SEQ ID NO: 3701827 - RNA, 24 nt, Salmonella enterica enterica serovar Typhi Ty2
ccguaugaccgccgcgcgucagca

SEQ ID NO: 3701828 - RNA, 19 nt, Salmonella enterica enterica serovar Typhi Ty2
ccguaugacguggccagca

SEQ ID NO: 3701829 - RNA, 14 nt, Salmonella enterica enterica serovar Typhi Ty2
ccguauugccagau

SEQ ID NO: 3701830 - RNA, 18 nt, Salmonella enterica enterica serovar Typhi Ty2
ccguauuuuauuuuucaa

SEQ ID NO: 3701831 - RNA, 19 nt, Salmonella enterica enterica serovar Typhi Ty2
ccgucaaaacgcgcauccu

SEQ ID NO: 3701832 - RNA, 19 nt, Salmonella enterica enterica serovar Typhi Ty2
ccgucaaacaagccgccaa

SEQ ID NO: 3701833 - RNA, 17 nt, Salmonella enterica enterica serovar Typhi Ty2
ccgucaaacaucgcgcu

SEQ ID NO: 3701834 - RNA, 18 nt, Salmonella enterica enterica serovar Typhi Ty2
ccgucaaagaaaacuuuc

SEQ ID NO: 3701835 - RNA, 21 nt, Salmonella enterica enterica serovar Typhi Ty2
ccgucaaaguugguucccagc

SEQ ID NO: 3701836 - RNA, 13 nt, Salmonella enterica enterica serovar Typhi Ty2
ccgucaauaauau

SEQ ID NO: 3701837 - RNA, 18 nt, Salmonella enterica enterica serovar Typhi Ty2
ccgucacaggcggccagg

SEQ ID NO: 3701838 - RNA, 14 nt, Salmonella enterica enterica serovar Typhi Ty2
ccgucaccacgcgc

SEQ ID NO: 3701839 - RNA, 16 nt, Salmonella enterica enterica serovar Typhi Ty2
ccgucacccgcguauc

SEQ ID NO: 3701840 - RNA, 19 nt, Salmonella enterica enterica serovar Typhi Ty2
ccgucacgccgacgaccgg

SEQ ID NO: 3701841 - RNA, 18 nt, Salmonella enterica enterica serovar Typhi Ty2
ccgucagaauggcgcguu

SEQ ID NO: 3701842 - RNA, 23 nt, Salmonella enterica enterica serovar Typhi Ty2
ccgucagcgguuguucagugcca

SEQ ID NO: 3701843 - RNA, 18 nt, Salmonella enterica enterica serovar Typhi Ty2
ccgucagggcgaggccca

SEQ ID NO: 3701844 - RNA, 14 nt, Salmonella enterica enterica serovar Typhi Ty2
ccguugcgucacga

SEQ ID NO: 3701845 - RNA, 20 nt, Salmonella enterica enterica serovar Typhi Ty2
ccguugucacaggcuuggca

SEQ ID NO: 3701846 - RNA, 16 nt, Salmonella enterica enterica serovar Typhi Ty2
ccguuguugcaccacc

SEQ ID NO: 3701847 - RNA, 16 nt, Salmonella enterica enterica serovar Typhi Ty2
ccguuguuuggcagga

SEQ ID NO: 3701848 - RNA, 17 nt, Salmonella enterica enterica serovar Typhi Ty2
ccguuuaccccgccagc

SEQ ID NO: 3701849 - RNA, 20 nt, Salmonella enterica enterica serovar Typhi Ty2
ccguuuaucguuaccggcuc

SEQ ID NO: 3701850 - RNA, 20 nt, Salmonella enterica enterica serovar Typhi Ty2
ccguuuccgcaauaagugca

SEQ ID NO: 3701851 - RNA, 15 nt, Salmonella enterica enterica serovar Typhi Ty2
ccguuugcagccaga

SEQ ID NO: 3701852 - RNA, 17 nt, Salmonella enterica enterica serovar Typhi Ty2
ccguuugcagccagaua

SEQ ID NO: 3701853 - RNA, 21 nt, Salmonella enterica enterica serovar Typhi Ty2
ccguuugcaguccguccagac

SEQ ID NO: 3701854 - RNA, 20 nt, Salmonella enterica enterica serovar Typhi Ty2
ccguuugcgccagcccggcg

SEQ ID NO: 3701855 - RNA, 19 nt, Salmonella enterica enterica serovar Typhi Ty2
ccguuuguaacauauuuuu

SEQ ID NO: 3701856 - RNA, 13 nt, Salmonella enterica enterica serovar Typhi Ty2
ccguuuguuuauu

SEQ ID NO: 3701857 - RNA, 17 nt, Salmonella enterica enterica serovar Typhi Ty2
ccguuuuagguucuuca

SEQ ID NO: 3701858 - RNA, 20 nt, Salmonella enterica enterica serovar Typhi Ty2
ccguuuuccggucgcgcaau

SEQ ID NO: 3701859 - RNA, 17 nt, Salmonella enterica enterica serovar Typhi Ty2
ccguuuucgucaacaua

SEQ ID NO: 3701860 - RNA, 19 nt, Salmonella enterica enterica serovar Typhi Ty2
ccguuuucuccuucaucca

SEQ ID NO: 3701861 - RNA, 23 nt, Salmonella enterica enterica serovar Typhi Ty2
ccguuuuuaucuccccaauugcu

SEQ ID NO: 3701862 - RNA, 23 nt, Salmonella enterica enterica serovar Typhi Ty2
ccuaaaccaaacaccagaucauu

SEQ ID NO: 3701863 - RNA, 13 nt, Salmonella enterica enterica serovar Typhi Ty2
ccuaaagaaaaac

SEQ ID NO: 3701864 - RNA, 21 nt, Salmonella enterica enterica serovar Typhi Ty2
ccuaaauccguuaagcccuga

SEQ ID NO: 3701865 - RNA, 21 nt, Salmonella enterica enterica serovar Typhi Ty2
ccuaacacaugcaagucgaac

SEQ ID NO: 3701866 - RNA, 16 nt, Salmonella enterica enterica serovar Typhi Ty2
ccuaacaggcgcauac

SEQ ID NO: 3701867 - RNA, 15 nt, Salmonella enterica enterica serovar Typhi Ty2
ccuaacuggaaaaag

SEQ ID NO: 3701868 - RNA, 22 nt, Salmonella enterica enterica serovar Typhi Ty2
ccuaacuggaaaaagaccaaua

SEQ ID NO: 3701869 - RNA, 18 nt, Salmonella enterica enterica serovar Typhi Ty2
ccuaagagaaaaccccgu

SEQ ID NO: 3701870 - RNA, 23 nt, Salmonella enterica enterica serovar Typhi Ty2
ccuaagccggcaggcagcgccag

SEQ ID NO: 3701871 - RNA, 13 nt, Salmonella enterica enterica serovar Typhi Ty2
ccuaauaaaauaa

SEQ ID NO: 3701872 - RNA, 15 nt, Salmonella enterica enterica serovar Typhi Ty2
ccuaauaaaauaacu

SEQ ID NO: 3701873 - RNA, 17 nt, Salmonella enterica enterica serovar Typhi Ty2
ccuaauagccagcccca

SEQ ID NO: 3701874 - RNA, 20 nt, Salmonella enterica enterica serovar Typhi Ty2
ccuaaugaagcgcguucguc

SEQ ID NO: 3701875 - RNA, 15 nt, Salmonella enterica enterica serovar Typhi Ty2
ccuaaugagccagau

SEQ ID NO: 3701876 - RNA, 17 nt, Salmonella enterica enterica serovar Typhi Ty2
ccuaaugagccagaugg

SEQ ID NO: 3701877 - RNA, 23 nt, Salmonella enterica enterica serovar Typhi Ty2
ccuacaaggaaagaaaaugccag

SEQ ID NO: 3701878 - RNA, 19 nt, Salmonella enterica enterica serovar Typhi Ty2
ccuacaauggaaaaaucug

SEQ ID NO: 3701879 - RNA, 18 nt, Salmonella enterica enterica serovar Typhi Ty2
ccuacacauugagcgaga

SEQ ID NO: 3701880 - RNA, 18 nt, Salmonella enterica enterica serovar Typhi Ty2
ccuacagguugucgcaac

SEQ ID NO: 3701881 - RNA, 14 nt, Salmonella enterica enterica serovar Typhi Ty2
ccuaccaucgcgcg

SEQ ID NO: 3701882 - RNA, 16 nt, Salmonella enterica enterica serovar Typhi Ty2
ccuaccgaggcagggg

SEQ ID NO: 3701883 - RNA, 11 nt, Salmonella enterica enterica serovar Typhi Ty2
ccuaccgccau

SEQ ID NO: 3701884 - RNA, 19 nt, Salmonella enterica enterica serovar Typhi Ty2
ccuacgauuucgcucgcuu

SEQ ID NO: 3701885 - RNA, 20 nt, Salmonella enterica enterica serovar Typhi Ty2
ccuacgcaggcuaacgcgcc

SEQ ID NO: 3701886 - RNA, 13 nt, Salmonella enterica enterica serovar Typhi Ty2
ccuacgcgcaugu

SEQ ID NO: 3701887 - RNA, 21 nt, Salmonella enterica enterica serovar Typhi Ty2
ccuacggaaagcuguuguugc

SEQ ID NO: 3701888 - RNA, 18 nt, Salmonella enterica enterica serovar Typhi Ty2
ccuacucucgcaugggga

SEQ ID NO: 3701889 - RNA, 23 nt, Salmonella enterica enterica serovar Typhi Ty2
ccuacugcuuagcucaucagccu

SEQ ID NO: 3701890 - RNA, 16 nt, Salmonella enterica enterica serovar Typhi Ty2
ccuagcgucccggcaa

SEQ ID NO: 3701891 - RNA, 15 nt, Salmonella enterica enterica serovar Typhi Ty2
ccuauaacagcgcug

SEQ ID NO: 3701892 - RNA, 18 nt, Salmonella enterica enterica serovar Typhi Ty2
ccuauagacaccuuauau

SEQ ID NO: 3701893 - RNA, 23 nt, Salmonella enterica enterica serovar Typhi Ty2
ccuaucaggaucaaaaucgcgcc

SEQ ID NO: 3701894 - RNA, 22 nt, Salmonella enterica enterica serovar Typhi Ty2
ccuaucaggcguugaccgcuuc

SEQ ID NO: 3701895 - RNA, 15 nt, Salmonella enterica enterica serovar Typhi Ty2
ccuaucccaauucgu

SEQ ID NO: 3701896 - RNA, 12 nt, Salmonella enterica enterica serovar Typhi Ty2
ccuauccggccg

SEQ ID NO: 3701897 - RNA, 13 nt, Salmonella enterica enterica serovar Typhi Ty2
ccuaucgccauau

SEQ ID NO: 3701898 - RNA, 14 nt, Salmonella enterica enterica serovar Typhi Ty2
ccuauuaggcacua

SEQ ID NO: 3701899 - RNA, 21 nt, Salmonella enterica enterica serovar Typhi Ty2
ccuauuugcuugugacggcaa

SEQ ID NO: 3701900 - RNA, 18 nt, Salmonella enterica enterica serovar Typhi Ty2
ccuauuuuaaauucccag

SEQ ID NO: 3701901 - RNA, 22 nt, Salmonella enterica enterica serovar Typhi Ty2
ccuauuuugcaaaacugaguug

SEQ ID NO: 3701902 - RNA, 16 nt, Salmonella enterica enterica serovar Typhi Ty2
ccucaaaaccgggcag

SEQ ID NO: 3701903 - RNA, 19 nt, Salmonella enterica enterica serovar Typhi Ty2
ccucaaaauggaaaauaau

SEQ ID NO: 3701904 - RNA, 14 nt, Salmonella enterica enterica serovar Typhi Ty2
ccucaaacaggcug

SEQ ID NO: 3701905 - RNA, 16 nt, Salmonella enterica enterica serovar Typhi Ty2
ccucaaacaggcuguc

SEQ ID NO: 3701906 - RNA, 22 nt, Salmonella enterica enterica serovar Typhi Ty2
ccucaacaaguccuucuucccc

SEQ ID NO: 3701907 - RNA, 16 nt, Salmonella enterica enterica serovar Typhi Ty2
ccucaacgcccugcuc

SEQ ID NO: 3701908 - RNA, 23 nt, Salmonella enterica enterica serovar Typhi Ty2
ccucaacgcccugcucccacagc

SEQ ID NO: 3701909 - RNA, 17 nt, Salmonella enterica enterica serovar Typhi Ty2
ccucaagaauaucuuua

SEQ ID NO: 3701910 - RNA, 18 nt, Salmonella enterica enterica serovar Typhi Ty2
ccucaaguaaaaugcccu

SEQ ID NO: 3701911 - RNA, 19 nt, Salmonella enterica enterica serovar Typhi Ty2
ccucaaucggcgauaaacc

SEQ ID NO: 3701912 - RNA, 20 nt, Salmonella enterica enterica serovar Typhi Ty2
ccucaaugguuucacgcucu

SEQ ID NO: 3701913 - RNA, 16 nt, Salmonella enterica enterica serovar Typhi Ty2
ccucaauugccgccag

SEQ ID NO: 3701914 - RNA, 20 nt, Salmonella enterica enterica serovar Typhi Ty2
ccucacacugauggcagacc

SEQ ID NO: 3701915 - RNA, 16 nt, Salmonella enterica enterica serovar Typhi Ty2
ccucaccguagcucca

SEQ ID NO: 3701916 - RNA, 16 nt, Salmonella enterica enterica serovar Typhi Ty2
ccucaccguccgccag

SEQ ID NO: 3701917 - RNA, 17 nt, Salmonella enterica enterica serovar Typhi Ty2
ccucaccucccccgccc

SEQ ID NO: 3701918 - RNA, 15 nt, Salmonella enterica enterica serovar Typhi Ty2
ccucacguacuacgu

SEQ ID NO: 3701919 - RNA, 17 nt, Salmonella enterica enterica serovar Typhi Ty2
ccucagcaaaaucacgc

SEQ ID NO: 3701920 - RNA, 16 nt, Salmonella enterica enterica serovar Typhi Ty2
ccucagcaggcgggcu

SEQ ID NO: 3701921 - RNA, 12 nt, Salmonella enterica enterica serovar Typhi Ty2
ccucagccaccc

SEQ ID NO: 3701922 - RNA, 14 nt, Salmonella enterica enterica serovar Typhi Ty2
ccucauauuuguau

SEQ ID NO: 3701923 - RNA, 12 nt, Salmonella enterica enterica serovar Typhi Ty2
ccucaucaugaa

SEQ ID NO: 3701924 - RNA, 18 nt, Salmonella enterica enterica serovar Typhi Ty2
ccucauccagauguuaua

SEQ ID NO: 3701925 - RNA, 22 nt, Salmonella enterica enterica serovar Typhi Ty2
ccucauccccagcaucaugucc

SEQ ID NO: 3701926 - RNA, 14 nt, Salmonella enterica enterica serovar Typhi Ty2
ccugaaacgugcau

SEQ ID NO: 3701927 - RNA, 14 nt, Salmonella enterica enterica serovar Typhi Ty2
ccugaaccagcggc

SEQ ID NO: 3701928 - RNA, 17 nt, Salmonella enterica enterica serovar Typhi Ty2
ccugaacgccuaccgcu

SEQ ID NO: 3701929 - RNA, 14 nt, Salmonella enterica enterica serovar Typhi Ty2
ccugaagacaugcu

SEQ ID NO: 3701930 - RNA, 12 nt, Salmonella enterica enterica serovar Typhi Ty2
ccugaagauagu

SEQ ID NO: 3701931 - RNA, 15 nt, Salmonella enterica enterica serovar Typhi Ty2
ccugaagccauccuc

SEQ ID NO: 3701932 - RNA, 13 nt, Salmonella enterica enterica serovar Typhi Ty2
ccugaagcgcagu

SEQ ID NO: 3701933 - RNA, 15 nt, Salmonella enterica enterica serovar Typhi Ty2
ccugaaggacaagcu

SEQ ID NO: 3701934 - RNA, 19 nt, Salmonella enterica enterica serovar Typhi Ty2
ccugaauaacccgcagccc

SEQ ID NO: 3701935 - RNA, 23 nt, Salmonella enterica enterica serovar Typhi Ty2
ccugaauaacccgcagcccugcg

SEQ ID NO: 3701936 - RNA, 15 nt, Salmonella enterica enterica serovar Typhi Ty2
ccugaauauggccag

SEQ ID NO: 3701937 - RNA, 18 nt, Salmonella enterica enterica serovar Typhi Ty2
ccugaauauuagaguggc

SEQ ID NO: 3701938 - RNA, 19 nt, Salmonella enterica enterica serovar Typhi Ty2
ccugaaucgccgcacguaa

SEQ ID NO: 3701939 - RNA, 17 nt, Salmonella enterica enterica serovar Typhi Ty2
ccugaaugcucucauau

SEQ ID NO: 3701940 - RNA, 19 nt, Salmonella enterica enterica serovar Typhi Ty2
ccugaaugcucucauauuc

SEQ ID NO: 3701941 - RNA, 17 nt, Salmonella enterica enterica serovar Typhi Ty2
ccugaauugcaaggcga

SEQ ID NO: 3701942 - RNA, 21 nt, Salmonella enterica enterica serovar Typhi Ty2
ccugaauuucaauaaucccuu

SEQ ID NO: 3701943 - RNA, 14 nt, Salmonella enterica enterica serovar Typhi Ty2
ccugacaauacugc

SEQ ID NO: 3701944 - RNA, 22 nt, Salmonella enterica enterica serovar Typhi Ty2
ccugacagagcucgucaaaaau

SEQ ID NO: 3701945 - RNA, 23 nt, Salmonella enterica enterica serovar Typhi Ty2
ccugacauuacccggccaggcgu

SEQ ID NO: 3701946 - RNA, 16 nt, Salmonella enterica enterica serovar Typhi Ty2
ccugacauuuauauua

SEQ ID NO: 3701947 - RNA, 13 nt, Salmonella enterica enterica serovar Typhi Ty2
ccugaccagcgac

SEQ ID NO: 3701948 - RNA, 24 nt, Salmonella enterica enterica serovar Typhi Ty2
ccugaccaguuguuccgcgcugau

SEQ ID NO: 3701949 - RNA, 19 nt, Salmonella enterica enterica serovar Typhi Ty2
ccugaccauggaguuucag

SEQ ID NO: 3701950 - RNA, 23 nt, Salmonella enterica enterica serovar Typhi Ty2
ccugaccauugauuuccgcgcaa

SEQ ID NO: 3701951 - RNA, 19 nt, Salmonella enterica enterica serovar Typhi Ty2
ccugaccgauauagccacu

SEQ ID NO: 3701952 - RNA, 20 nt, Salmonella enterica enterica serovar Typhi Ty2
ccugaccgauauagccacuc

SEQ ID NO: 3701953 - RNA, 17 nt, Salmonella enterica enterica serovar Typhi Ty2
ccugaccgggcucacgc

SEQ ID NO: 3701954 - RNA, 20 nt, Salmonella enterica enterica serovar Typhi Ty2
ccugaccgguaaauuucacu

SEQ ID NO: 3701955 - RNA, 18 nt, Salmonella enterica enterica serovar Typhi Ty2
ccugacgauaucgucacc

SEQ ID NO: 3701956 - RNA, 17 nt, Salmonella enterica enterica serovar Typhi Ty2
ccugacgcacaggcgcg

SEQ ID NO: 3701957 - RNA, 20 nt, Salmonella enterica enterica serovar Typhi Ty2
ccugacgcugagagaacugc

SEQ ID NO: 3701958 - RNA, 19 nt, Salmonella enterica enterica serovar Typhi Ty2
ccugacgcugcgccuggau

SEQ ID NO: 3701959 - RNA, 13 nt, Salmonella enterica enterica serovar Typhi Ty2
ccugacggcagcc

SEQ ID NO: 3701960 - RNA, 15 nt, Salmonella enterica enterica serovar Typhi Ty2
ccugacggcgcuguc

SEQ ID NO: 3701961 - RNA, 17 nt, Salmonella enterica enterica serovar Typhi Ty2
ccugacggcgcugucac

SEQ ID NO: 3701962 - RNA, 21 nt, Salmonella enterica enterica serovar Typhi Ty2
ccugacugcgcgccugcgcug

SEQ ID NO: 3701963 - RNA, 19 nt, Salmonella enterica enterica serovar Typhi Ty2
ccugacuggcugagcucac

SEQ ID NO: 3701964 - RNA, 17 nt, Salmonella enterica enterica serovar Typhi Ty2
ccugacuuuuccauacu

SEQ ID NO: 3701965 - RNA, 21 nt, Salmonella enterica enterica serovar Typhi Ty2
ccugagcagacauauuuucuc

SEQ ID NO: 3701966 - RNA, 14 nt, Salmonella enterica enterica serovar Typhi Ty2
ccugagcccacagc

SEQ ID NO: 3701967 - RNA, 15 nt, Salmonella enterica enterica serovar Typhi Ty2
ccugagcccacagcg

SEQ ID NO: 3701968 - RNA, 16 nt, Salmonella enterica enterica serovar Typhi Ty2
ccugagccgaaccccu

SEQ ID NO: 3701969 - RNA, 15 nt, Salmonella enterica enterica serovar Typhi Ty2
ccugagcgccgccaa

SEQ ID NO: 3701970 - RNA, 18 nt, Salmonella enterica enterica serovar Typhi Ty2
ccugagcgcgaacuacac

SEQ ID NO: 3701971 - RNA, 18 nt, Salmonella enterica enterica serovar Typhi Ty2
ccugaggaaaaagcgcac

SEQ ID NO: 3701972 - RNA, 19 nt, Salmonella enterica enterica serovar Typhi Ty2
ccugagucuugccuguccg

SEQ ID NO: 3701973 - RNA, 22 nt, Salmonella enterica enterica serovar Typhi Ty2
ccugauaaaaaaacgccgccuu

SEQ ID NO: 3701974 - RNA, 20 nt, Salmonella enterica enterica serovar Typhi Ty2
ccugauaagcauagcgccau

SEQ ID NO: 3701975 - RNA, 19 nt, Salmonella enterica enterica serovar Typhi Ty2
ccugauaagcgcagcgcau

SEQ ID NO: 3701976 - RNA, 18 nt, Salmonella enterica enterica serovar Typhi Ty2
ccugauaagcgcagcgcc

SEQ ID NO: 3701977 - RNA, 20 nt, Salmonella enterica enterica serovar Typhi Ty2
ccugauaagcgcagcgccau

SEQ ID NO: 3701978 - RNA, 20 nt, Salmonella enterica enterica serovar Typhi Ty2
ccugauaagcguagcgccau

SEQ ID NO: 3701979 - RNA, 16 nt, Salmonella enterica enterica serovar Typhi Ty2
ccugauagcaaucauc

SEQ ID NO: 3701980 - RNA, 19 nt, Salmonella enterica enterica serovar Typhi Ty2
ccugauagcacagcgcuau

SEQ ID NO: 3701981 - RNA, 15 nt, Salmonella enterica enterica serovar Typhi Ty2
ccugauagcgcugug

SEQ ID NO: 3701982 - RNA, 14 nt, Salmonella enterica enterica serovar Typhi Ty2
ccugauauccacgc

SEQ ID NO: 3701983 - RNA, 13 nt, Salmonella enterica enterica serovar Typhi Ty2
ccugaucaaucaa

SEQ ID NO: 3701984 - RNA, 21 nt, Salmonella enterica enterica serovar Typhi Ty2
ccugaucaucggcgcgucgcu

SEQ ID NO: 3701985 - RNA, 16 nt, Salmonella enterica enterica serovar Typhi Ty2
ccugauccagcucuuc

SEQ ID NO: 3701986 - RNA, 22 nt, Salmonella enterica enterica serovar Typhi Ty2
ccugauccggaauagagauaga

SEQ ID NO: 3701987 - RNA, 19 nt, Salmonella enterica enterica serovar Typhi Ty2
ccugauccugcaacagcac

SEQ ID NO: 3701988 - RNA, 21 nt, Salmonella enterica enterica serovar Typhi Ty2
ccugaucgcgcagacaguggc

SEQ ID NO: 3701989 - RNA, 21 nt, Salmonella enterica enterica serovar Typhi Ty2
ccugaucgugccaugaccauu

SEQ ID NO: 3701990 - RNA, 17 nt, Salmonella enterica enterica serovar Typhi Ty2
ccugaugacgcugcgcu

SEQ ID NO: 3701991 - RNA, 20 nt, Salmonella enterica enterica serovar Typhi Ty2
ccugaugacggcugguaagg

SEQ ID NO: 3701992 - RNA, 19 nt, Salmonella enterica enterica serovar Typhi Ty2
ccugaugagcgcagcgacu

SEQ ID NO: 3701993 - RNA, 17 nt, Salmonella enterica enterica serovar Typhi Ty2
ccugaugauagcgccau

SEQ ID NO: 3701994 - RNA, 23 nt, Salmonella enterica enterica serovar Typhi Ty2
ccugaugauagcgccauauaaau

SEQ ID NO: 3701995 - RNA, 12 nt, Salmonella enterica enterica serovar Typhi Ty2
ccugauggcgcg

SEQ ID NO: 3701996 - RNA, 22 nt, Salmonella enterica enterica serovar Typhi Ty2
ccugauggcgcuacguuuaucu

SEQ ID NO: 3701997 - RNA, 21 nt, Salmonella enterica enterica serovar Typhi Ty2
ccugauggucgcucuggucga

SEQ ID NO: 3701998 - RNA, 21 nt, Salmonella enterica enterica serovar Typhi Ty2
ccugauuaaguuuuuuuaaaa

SEQ ID NO: 3701999 - RNA, 14 nt, Salmonella enterica enterica serovar Typhi Ty2
ccugauucugcagc

SEQ ID NO: 3702000 - RNA, 18 nt, Salmonella enterica enterica serovar Typhi Ty2
ccugauucugcagcgagc

SEQ ID NO: 3702001 - RNA, 21 nt, Salmonella enterica enterica serovar Typhi Ty2
ccugcaaaauaccgcccaucg

SEQ ID NO: 3702002 - RNA, 14 nt, Salmonella enterica enterica serovar Typhi Ty2
ccugcaaaccucuc

SEQ ID NO: 3702003 - RNA, 20 nt, Salmonella enterica enterica serovar Typhi Ty2
ccugcaaaccucucccccgc

SEQ ID NO: 3702004 - RNA, 20 nt, Salmonella enterica enterica serovar Typhi Ty2
ccugcaaagcaaaaaucacc

SEQ ID NO: 3702005 - RNA, 17 nt, Salmonella enterica enterica serovar Typhi Ty2
ccugcaacagcaccagc

SEQ ID NO: 3702006 - RNA, 23 nt, Salmonella enterica enterica serovar Typhi Ty2
ccugcaacgcuuuagugccgcca

SEQ ID NO: 3702007 - RNA, 11 nt, Salmonella enterica enterica serovar Typhi Ty2
ccugcuucaga

SEQ ID NO: 3702008 - RNA, 16 nt, Salmonella enterica enterica serovar Typhi Ty2
ccugcuugucgaucau

SEQ ID NO: 3702009 - RNA, 18 nt, Salmonella enterica enterica serovar Typhi Ty2
ccugcuugucgaucauca

SEQ ID NO: 3702010 - RNA, 20 nt, Salmonella enterica enterica serovar Typhi Ty2
ccugcuugucgaucaucaga

SEQ ID NO: 3702011 - RNA, 17 nt, Salmonella enterica enterica serovar Typhi Ty2
ccuggaaaaaagcgccc

SEQ ID NO: 3702012 - RNA, 23 nt, Salmonella enterica enterica serovar Typhi Ty2
ccuggaaaaaagcgcccagcgcc

SEQ ID NO: 3702013 - RNA, 15 nt, Salmonella enterica enterica serovar Typhi Ty2
ccuggaaccaggcgc

SEQ ID NO: 3702014 - RNA, 18 nt, Salmonella enterica enterica serovar Typhi Ty2
ccuggagagcagcgccag

SEQ ID NO: 3702015 - RNA, 17 nt, Salmonella enterica enterica serovar Typhi Ty2
ccuggagcguaagcgcg

SEQ ID NO: 3702016 - RNA, 15 nt, Salmonella enterica enterica serovar Typhi Ty2
ccuggaggaacagcg

SEQ ID NO: 3702017 - RNA, 14 nt, Salmonella enterica enterica serovar Typhi Ty2
ccuggauuuuaccu

SEQ ID NO: 3702018 - RNA, 13 nt, Salmonella enterica enterica serovar Typhi Ty2
ccuggcagaaagg

SEQ ID NO: 3702019 - RNA, 17 nt, Salmonella enterica enterica serovar Typhi Ty2
ccuggcagaaaggugaa

SEQ ID NO: 3702020 - RNA, 21 nt, Salmonella enterica enterica serovar Typhi Ty2
ccuggcagguauuaauccugc

SEQ ID NO: 3702021 - RNA, 13 nt, Salmonella enterica enterica serovar Typhi Ty2
ccuggcauggcuc

SEQ ID NO: 3702022 - RNA, 22 nt, Salmonella enterica enterica serovar Typhi Ty2
ccuggcauggugcagccgccau

SEQ ID NO: 3702023 - RNA, 14 nt, Salmonella enterica enterica serovar Typhi Ty2
ccuggccaggcuuc

SEQ ID NO: 3702024 - RNA, 24 nt, Salmonella enterica enterica serovar Typhi Ty2
ccuggcccggcaguugcuggcgcu

SEQ ID NO: 3702025 - RNA, 18 nt, Salmonella enterica enterica serovar Typhi Ty2
ccuggccgauaugaauaa

SEQ ID NO: 3702026 - RNA, 13 nt, Salmonella enterica enterica serovar Typhi Ty2
ccuggccuccggc

SEQ ID NO: 3702027 - RNA, 19 nt, Salmonella enterica enterica serovar Typhi Ty2
ccuggccugcucaucaggu

SEQ ID NO: 3702028 - RNA, 24 nt, Salmonella enterica enterica serovar Typhi Ty2
ccuggcgaaagcgaccggcacuca

SEQ ID NO: 3702029 - RNA, 22 nt, Salmonella enterica enterica serovar Typhi Ty2
ccuggcgaauaaaauucagcgc

SEQ ID NO: 3702030 - RNA, 16 nt, Salmonella enterica enterica serovar Typhi Ty2
ccuggcgagaauagaa

SEQ ID NO: 3702031 - RNA, 14 nt, Salmonella enterica enterica serovar Typhi Ty2
ccuggcgcagcgcg

SEQ ID NO: 3702032 - RNA, 18 nt, Salmonella enterica enterica serovar Typhi Ty2
ccuggcgcuuuaaaccga

SEQ ID NO: 3702033 - RNA, 17 nt, Salmonella enterica enterica serovar Typhi Ty2
ccuggcggagcugcgcu

SEQ ID NO: 3702034 - RNA, 19 nt, Salmonella enterica enterica serovar Typhi Ty2
ccuggcgggaaacagguac

SEQ ID NO: 3702035 - RNA, 22 nt, Salmonella enterica enterica serovar Typhi Ty2
ccuggcgggcagccuucaaguu

SEQ ID NO: 3702036 - RNA, 21 nt, Salmonella enterica enterica serovar Typhi Ty2
ccuggcguaguacgcgcgccg

SEQ ID NO: 3702037 - RNA, 16 nt, Salmonella enterica enterica serovar Typhi Ty2
ccuggcguaugcuuuc

SEQ ID NO: 3702038 - RNA, 20 nt, Salmonella enterica enterica serovar Typhi Ty2
ccuggcguaugcuuucagca

SEQ ID NO: 3702039 - RNA, 15 nt, Salmonella enterica enterica serovar Typhi Ty2
ccuggcucaauccag

SEQ ID NO: 3702040 - RNA, 20 nt, Salmonella enterica enterica serovar Typhi Ty2
ccuggcucaauccaggugga

SEQ ID NO: 3702041 - RNA, 14 nt, Salmonella enterica enterica serovar Typhi Ty2
ccuggcuuaccugc

SEQ ID NO: 3702042 - RNA, 19 nt, Salmonella enterica enterica serovar Typhi Ty2
ccuggcuuaccugcucugg

SEQ ID NO: 3702043 - RNA, 14 nt, Salmonella enterica enterica serovar Typhi Ty2
ccuggcuucaaccu

SEQ ID NO: 3702044 - RNA, 19 nt, Salmonella enterica enterica serovar Typhi Ty2
ccuggcuucaaccuccugc

SEQ ID NO: 3702045 - RNA, 20 nt, Salmonella enterica enterica serovar Typhi Ty2
ccuggcuucaaccuccugca

SEQ ID NO: 3702046 - RNA, 16 nt, Salmonella enterica enterica serovar Typhi Ty2
ccuggcuugccagaua

SEQ ID NO: 3702047 - RNA, 16 nt, Salmonella enterica enterica serovar Typhi Ty2
ccuggcuugccggcac

SEQ ID NO: 3702048 - RNA, 20 nt, Salmonella enterica enterica serovar Typhi Ty2
ccugggauagugcugcgcaa

SEQ ID NO: 3702049 - RNA, 22 nt, Salmonella enterica enterica serovar Typhi Ty2
ccugggucguugacgugagaga

SEQ ID NO: 3702050 - RNA, 16 nt, Salmonella enterica enterica serovar Typhi Ty2
ccuggguuccaggcgg

SEQ ID NO: 3702051 - RNA, 17 nt, Salmonella enterica enterica serovar Typhi Ty2
ccuggucgauagccuua

SEQ ID NO: 3702052 - RNA, 13 nt, Salmonella enterica enterica serovar Typhi Ty2
ccuggucugccag

SEQ ID NO: 3702053 - RNA, 12 nt, Salmonella enterica enterica serovar Typhi Ty2
ccugguuaccgc

SEQ ID NO: 3702054 - RNA, 13 nt, Salmonella enterica enterica serovar Typhi Ty2
ccuguaaaaaauc

SEQ ID NO: 3702055 - RNA, 19 nt, Salmonella enterica enterica serovar Typhi Ty2
ccuguaaaaaauccagcgu

SEQ ID NO: 3702056 - RNA, 17 nt, Salmonella enterica enterica serovar Typhi Ty2
ccuguaaaccgccucca

SEQ ID NO: 3702057 - RNA, 18 nt, Salmonella enterica enterica serovar Typhi Ty2
ccuguaaacguuccugcc

SEQ ID NO: 3702058 - RNA, 16 nt, Salmonella enterica enterica serovar Typhi Ty2
ccuguaacaacuguuu

SEQ ID NO: 3702059 - RNA, 18 nt, Salmonella enterica enterica serovar Typhi Ty2
ccuguaaccuuaaaaggc

SEQ ID NO: 3702060 - RNA, 20 nt, Salmonella enterica enterica serovar Typhi Ty2
ccuguaacgcauaagcgcga

SEQ ID NO: 3702061 - RNA, 14 nt, Salmonella enterica enterica serovar Typhi Ty2
ccuguaccaccacg

SEQ ID NO: 3702062 - RNA, 16 nt, Salmonella enterica enterica serovar Typhi Ty2
ccuguacuugcgccgc

SEQ ID NO: 3702063 - RNA, 14 nt, Salmonella enterica enterica serovar Typhi Ty2
ccuguagcagcgcc

SEQ ID NO: 3702064 - RNA, 16 nt, Salmonella enterica enterica serovar Typhi Ty2
ccuguagcagcgccag

SEQ ID NO: 3702065 - RNA, 20 nt, Salmonella enterica enterica serovar Typhi Ty2
ccuguagcagcgccagcgug

SEQ ID NO: 3702066 - RNA, 19 nt, Salmonella enterica enterica serovar Typhi Ty2
ccuguauacaggcauggcc

SEQ ID NO: 3702067 - RNA, 15 nt, Salmonella enterica enterica serovar Typhi Ty2
ccuguaucaaaccaa

SEQ ID NO: 3702068 - RNA, 15 nt, Salmonella enterica enterica serovar Typhi Ty2
ccuguaucugcugac

SEQ ID NO: 3702069 - RNA, 14 nt, Salmonella enterica enterica serovar Typhi Ty2
ccuguauuaccuga

SEQ ID NO: 3702070 - RNA, 21 nt, Salmonella enterica enterica serovar Typhi Ty2
ccuguauuuucguuugcauuc

SEQ ID NO: 3702071 - RNA, 15 nt, Salmonella enterica enterica serovar Typhi Ty2
ccugucaggcgagcg

SEQ ID NO: 3702072 - RNA, 18 nt, Salmonella enterica enterica serovar Typhi Ty2
ccugucccuucgcccggc

SEQ ID NO: 3702073 - RNA, 16 nt, Salmonella enterica enterica serovar Typhi Ty2
ccugucgaucauccac

SEQ ID NO: 3702074 - RNA, 23 nt, Salmonella enterica enterica serovar Typhi Ty2
ccugucgcgccauguugcguaaa

SEQ ID NO: 3702075 - RNA, 16 nt, Salmonella enterica enterica serovar Typhi Ty2
ccugucguccucaggc

SEQ ID NO: 3702076 - RNA, 21 nt, Salmonella enterica enterica serovar Typhi Ty2
ccugucguccucaggccggau

SEQ ID NO: 3702077 - RNA, 14 nt, Salmonella enterica enterica serovar Typhi Ty2
ccugucuccagcgc

SEQ ID NO: 3702078 - RNA, 14 nt, Salmonella enterica enterica serovar Typhi Ty2
ccugucuccucagc

SEQ ID NO: 3702079 - RNA, 18 nt, Salmonella enterica enterica serovar Typhi Ty2
ccugucuccucagcaggc

SEQ ID NO: 3702080 - RNA, 17 nt, Salmonella enterica enterica serovar Typhi Ty2
ccugucugcgcaacgcu

SEQ ID NO: 3702081 - RNA, 17 nt, Salmonella enterica enterica serovar Typhi Ty2
ccugucugucaaaaccc

SEQ ID NO: 3702082 - RNA, 22 nt, Salmonella enterica enterica serovar Typhi Ty2
ccugucugucaaaacccagccc

SEQ ID NO: 3702083 - RNA, 23 nt, Salmonella enterica enterica serovar Typhi Ty2
ccugucugucaaaacccagccca

SEQ ID NO: 3702084 - RNA, 19 nt, Salmonella enterica enterica serovar Typhi Ty2
ccugucugucgcgggcgaa

SEQ ID NO: 3702085 - RNA, 16 nt, Salmonella enterica enterica serovar Typhi Ty2
ccugugaaguaaaaaa

SEQ ID NO: 3702086 - RNA, 13 nt, Salmonella enterica enterica serovar Typhi Ty2
ccugugccauacu

SEQ ID NO: 3702087 - RNA, 20 nt, Salmonella enterica enterica serovar Typhi Ty2
ccugugccauacuguuuauc

SEQ ID NO: 3702088 - RNA, 11 nt, Salmonella enterica enterica serovar Typhi Ty2
ccugugcuuug

SEQ ID NO: 3702089 - RNA, 20 nt, Salmonella enterica enterica serovar Typhi Ty2
ccuucuucccauauuuuuuc

SEQ ID NO: 3702090 - RNA, 14 nt, Salmonella enterica enterica serovar Typhi Ty2
ccuucuucccccug

SEQ ID NO: 3702091 - RNA, 17 nt, Salmonella enterica enterica serovar Typhi Ty2
ccuucuucgccgucaua

SEQ ID NO: 3702092 - RNA, 15 nt, Salmonella enterica enterica serovar Typhi Ty2
ccuucuuuaugcgcc

SEQ ID NO: 3702093 - RNA, 16 nt, Salmonella enterica enterica serovar Typhi Ty2
ccuucuuuggcuuaau

SEQ ID NO: 3702094 - RNA, 21 nt, Salmonella enterica enterica serovar Typhi Ty2
ccuucuuuggugcgacgccag

SEQ ID NO: 3702095 - RNA, 19 nt, Salmonella enterica enterica serovar Typhi Ty2
ccuugaaguuauccagcgc

SEQ ID NO: 3702096 - RNA, 20 nt, Salmonella enterica enterica serovar Typhi Ty2
ccuugaaguuauccagcgcc

SEQ ID NO: 3702097 - RNA, 22 nt, Salmonella enterica enterica serovar Typhi Ty2
ccuugaucaggaaaucuuccag

SEQ ID NO: 3702098 - RNA, 18 nt, Salmonella enterica enterica serovar Typhi Ty2
ccuugccagugaaaaaaa

SEQ ID NO: 3702099 - RNA, 15 nt, Salmonella enterica enterica serovar Typhi Ty2
ccuugcccgcgccag

SEQ ID NO: 3702100 - RNA, 20 nt, Salmonella enterica enterica serovar Typhi Ty2
ccuugcccguauugaagcga

SEQ ID NO: 3702101 - RNA, 19 nt, Salmonella enterica enterica serovar Typhi Ty2
ccuugcccuggaauuuuuc

SEQ ID NO: 3702102 - RNA, 21 nt, Salmonella enterica enterica serovar Typhi Ty2
ccuugcgggcaugggaaauaa

SEQ ID NO: 3702103 - RNA, 16 nt, Salmonella enterica enterica serovar Typhi Ty2
ccuugcggugagaaac

SEQ ID NO: 3702104 - RNA, 18 nt, Salmonella enterica enterica serovar Typhi Ty2
ccuugcggugcagcagac

SEQ ID NO: 3702105 - RNA, 16 nt, Salmonella enterica enterica serovar Typhi Ty2
ccuugcugaaucagau

SEQ ID NO: 3702106 - RNA, 14 nt, Salmonella enterica enterica serovar Typhi Ty2
ccuuguaagggagg

SEQ ID NO: 3702107 - RNA, 14 nt, Salmonella enterica enterica serovar Typhi Ty2
ccuuguaggccuga

SEQ ID NO: 3702108 - RNA, 22 nt, Salmonella enterica enterica serovar Typhi Ty2
ccuuguccauguaaacuccauu

SEQ ID NO: 3702109 - RNA, 13 nt, Salmonella enterica enterica serovar Typhi Ty2
ccuugucguaaua

SEQ ID NO: 3702110 - RNA, 20 nt, Salmonella enterica enterica serovar Typhi Ty2
ccuuguuauccuaaaucugc

SEQ ID NO: 3702111 - RNA, 22 nt, Salmonella enterica enterica serovar Typhi Ty2
ccuuguucaauagagcgcagca

SEQ ID NO: 3702112 - RNA, 22 nt, Salmonella enterica enterica serovar Typhi Ty2
ccuuguugauaaaacgaauacu

SEQ ID NO: 3702113 - RNA, 18 nt, Salmonella enterica enterica serovar Typhi Ty2
ccuuuaaccucuuuuuca

SEQ ID NO: 3702114 - RNA, 19 nt, Salmonella enterica enterica serovar Typhi Ty2
ccuuuaaccucuuuuucau

SEQ ID NO: 3702115 - RNA, 22 nt, Salmonella enterica enterica serovar Typhi Ty2
ccuuuaacgccuucauauuaaa

SEQ ID NO: 3702116 - RNA, 15 nt, Salmonella enterica enterica serovar Typhi Ty2
ccuuuacugcgccag

SEQ ID NO: 3702117 - RNA, 22 nt, Salmonella enterica enterica serovar Typhi Ty2
ccuuuauauuuuucccuggccg

SEQ ID NO: 3702118 - RNA, 13 nt, Salmonella enterica enterica serovar Typhi Ty2
ccuuuaucgcgca

SEQ ID NO: 3702119 - RNA, 14 nt, Salmonella enterica enterica serovar Typhi Ty2
ccuuuaucugcccu

SEQ ID NO: 3702120 - RNA, 18 nt, Salmonella enterica enterica serovar Typhi Ty2
ccuuucaaaaaagagaag

SEQ ID NO: 3702121 - RNA, 23 nt, Salmonella enterica enterica serovar Typhi Ty2
ccuuucagagcgucuuuuauccc

SEQ ID NO: 3702122 - RNA, 22 nt, Salmonella enterica enterica serovar Typhi Ty2
ccuuucauucgucaaauucacc

SEQ ID NO: 3702123 - RNA, 14 nt, Salmonella enterica enterica serovar Typhi Ty2
ccuuuccugugcuc

SEQ ID NO: 3702124 - RNA, 23 nt, Salmonella enterica enterica serovar Typhi Ty2
ccuuuccuuauuaaagccccuuc

SEQ ID NO: 3702125 - RNA, 15 nt, Salmonella enterica enterica serovar Typhi Ty2
ccuuucggacuuccu

SEQ ID NO: 3702126 - RNA, 21 nt, Salmonella enterica enterica serovar Typhi Ty2
ccuuucucugguuucccugcc

SEQ ID NO: 3702127 - RNA, 14 nt, Salmonella enterica enterica serovar Typhi Ty2
ccuuucugcgccag

SEQ ID NO: 3702128 - RNA, 15 nt, Salmonella enterica enterica serovar Typhi Ty2
ccuuugccuucgccg

SEQ ID NO: 3702129 - RNA, 12 nt, Salmonella enterica enterica serovar Typhi Ty2
ccuuugccuuuc

SEQ ID NO: 3702130 - RNA, 24 nt, Salmonella enterica enterica serovar Typhi Ty2
ccuuugcgcgcgauauccaccuga

SEQ ID NO: 3702131 - RNA, 14 nt, Salmonella enterica enterica serovar Typhi Ty2
ccuuuggccaccag

SEQ ID NO: 3702132 - RNA, 22 nt, Salmonella enterica enterica serovar Typhi Ty2
ccuuuggccuggagaucagcau

SEQ ID NO: 3702133 - RNA, 21 nt, Salmonella enterica enterica serovar Typhi Ty2
ccuuugucacccgcuuuuccu

SEQ ID NO: 3702134 - RNA, 22 nt, Salmonella enterica enterica serovar Typhi Ty2
ccuuugucgaaauugccgcccg

SEQ ID NO: 3702135 - RNA, 11 nt, Salmonella enterica enterica serovar Typhi Ty2
ccuuugugauc

SEQ ID NO: 3702136 - RNA, 18 nt, Salmonella enterica enterica serovar Typhi Ty2
ccuuugugaucugguuug

SEQ ID NO: 3702137 - RNA, 16 nt, Salmonella enterica enterica serovar Typhi Ty2
ccuuuucguacauguc

SEQ ID NO: 3702138 - RNA, 14 nt, Salmonella enterica enterica serovar Typhi Ty2
ccuuuugacgcuuc

SEQ ID NO: 3702139 - RNA, 20 nt, Salmonella enterica enterica serovar Typhi Ty2
ccuuuuuauggcccgccagc

SEQ ID NO: 3702140 - RNA, 13 nt, Salmonella enterica enterica serovar Typhi Ty2
ccuuuuucaauuu

SEQ ID NO: 3702141 - RNA, 19 nt, Salmonella enterica enterica serovar Typhi Ty2
ccuuuuucaugcaauaauc

SEQ ID NO: 3702142 - RNA, 20 nt, Salmonella enterica enterica serovar Typhi Ty2
ccuuuuuuauacuccagcag

SEQ ID NO: 3702143 - RNA, 17 nt, Salmonella enterica enterica serovar Typhi Ty2
ccuuuuuuauugccuga

SEQ ID NO: 3702144 - RNA, 13 nt, Salmonella enterica enterica serovar Typhi Ty2
ccuuuuuuguauu

SEQ ID NO: 3702145 - RNA, 16 nt, Salmonella enterica enterica serovar Typhi Ty2
cgaaaaacccgcuuca

SEQ ID NO: 3702146 - RNA, 22 nt, Salmonella enterica enterica serovar Typhi Ty2
cgaaaacguugacuuaaaaagc

SEQ ID NO: 3702147 - RNA, 16 nt, Salmonella enterica enterica serovar Typhi Ty2
cgaaaaggccuggcug

SEQ ID NO: 3702148 - RNA, 21 nt, Salmonella enterica enterica serovar Typhi Ty2
cgaaaaguguguaccagcagc

SEQ ID NO: 3702149 - RNA, 19 nt, Salmonella enterica enterica serovar Typhi Ty2
cgaaaauaaacgcuugacu

SEQ ID NO: 3702150 - RNA, 15 nt, Salmonella enterica enterica serovar Typhi Ty2
cgaaaauaucggccu

SEQ ID NO: 3702151 - RNA, 12 nt, Salmonella enterica enterica serovar Typhi Ty2
cgaaaaucaucc

SEQ ID NO: 3702152 - RNA, 13 nt, Salmonella enterica enterica serovar Typhi Ty2
cgaaaaucgguaa

SEQ ID NO: 3702153 - RNA, 18 nt, Salmonella enterica enterica serovar Typhi Ty2
cgaaacaaucaccugaug

SEQ ID NO: 3702154 - RNA, 19 nt, Salmonella enterica enterica serovar Typhi Ty2
cgaaacaggucggcaugca

SEQ ID NO: 3702155 - RNA, 13 nt, Salmonella enterica enterica serovar Typhi Ty2
cgaaaccagcaua

SEQ ID NO: 3702156 - RNA, 20 nt, Salmonella enterica enterica serovar Typhi Ty2
cgaaaccggcggcgacuggc

SEQ ID NO: 3702157 - RNA, 13 nt, Salmonella enterica enterica serovar Typhi Ty2
cgaaacggcagcg

SEQ ID NO: 3702158 - RNA, 19 nt, Salmonella enterica enterica serovar Typhi Ty2
cgaaacguccccugcgguu

SEQ ID NO: 3702159 - RNA, 11 nt, Salmonella enterica enterica serovar Typhi Ty2
cgaaacucagc

SEQ ID NO: 3702160 - RNA, 17 nt, Salmonella enterica enterica serovar Typhi Ty2
cgaaagaaacgccgacc

SEQ ID NO: 3702161 - RNA, 14 nt, Salmonella enterica enterica serovar Typhi Ty2
cgaaagcgaucaca

SEQ ID NO: 3702162 - RNA, 13 nt, Salmonella enterica enterica serovar Typhi Ty2
cgaaagcugccuu

SEQ ID NO: 3702163 - RNA, 16 nt, Salmonella enterica enterica serovar Typhi Ty2
cgaaagucaucugcca

SEQ ID NO: 3702164 - RNA, 13 nt, Salmonella enterica enterica serovar Typhi Ty2
cgaaauaaucagg

SEQ ID NO: 3702165 - RNA, 20 nt, Salmonella enterica enterica serovar Typhi Ty2
cgaaaucaaagaccuccgcc

SEQ ID NO: 3702166 - RNA, 23 nt, Salmonella enterica enterica serovar Typhi Ty2
cgaaaucaaagaccuccgcccgg

SEQ ID NO: 3702167 - RNA, 23 nt, Salmonella enterica enterica serovar Typhi Ty2
cgaaauccgcgccgccgccgaag

SEQ ID NO: 3702168 - RNA, 15 nt, Salmonella enterica enterica serovar Typhi Ty2
cgaaaugaccaccgc

SEQ ID NO: 3702169 - RNA, 22 nt, Salmonella enterica enterica serovar Typhi Ty2
cgaaaugaccaccgcaucggca

SEQ ID NO: 3702170 - RNA, 17 nt, Salmonella enterica enterica serovar Typhi Ty2
cgaaauguccauccauu

SEQ ID NO: 3702171 - RNA, 22 nt, Salmonella enterica enterica serovar Typhi Ty2
cgacaaagcguggggaaaaccc

SEQ ID NO: 3702172 - RNA, 18 nt, Salmonella enterica enterica serovar Typhi Ty2
cgacaaaugacgucagca

SEQ ID NO: 3702173 - RNA, 15 nt, Salmonella enterica enterica serovar Typhi Ty2
cgacaacaaguccaa

SEQ ID NO: 3702174 - RNA, 16 nt, Salmonella enterica enterica serovar Typhi Ty2
cgacaaccagcgaaau

SEQ ID NO: 3702175 - RNA, 18 nt, Salmonella enterica enterica serovar Typhi Ty2
cgacaacgcguuuauuau

SEQ ID NO: 3702176 - RNA, 17 nt, Salmonella enterica enterica serovar Typhi Ty2
cgacaacgcuuccggcg

SEQ ID NO: 3702177 - RNA, 16 nt, Salmonella enterica enterica serovar Typhi Ty2
cgacaacguuuucagc

SEQ ID NO: 3702178 - RNA, 23 nt, Salmonella enterica enterica serovar Typhi Ty2
cgacaagaagauuucuuaauucc

SEQ ID NO: 3702179 - RNA, 19 nt, Salmonella enterica enterica serovar Typhi Ty2
cgacaagcuaauccccagc

SEQ ID NO: 3702180 - RNA, 22 nt, Salmonella enterica enterica serovar Typhi Ty2
cgacaagcuaauccccagcgcu

SEQ ID NO: 3702181 - RNA, 15 nt, Salmonella enterica enterica serovar Typhi Ty2
cgacaaugaucagac

SEQ ID NO: 3702182 - RNA, 17 nt, Salmonella enterica enterica serovar Typhi Ty2
cgacaauguccgccaga

SEQ ID NO: 3702183 - RNA, 17 nt, Salmonella enterica enterica serovar Typhi Ty2
cgacaauuucaccuuug

SEQ ID NO: 3702184 - RNA, 15 nt, Salmonella enterica enterica serovar Typhi Ty2
cgacacaacggcaca

SEQ ID NO: 3702185 - RNA, 13 nt, Salmonella enterica enterica serovar Typhi Ty2
cgacacaucaucg

SEQ ID NO: 3702186 - RNA, 21 nt, Salmonella enterica enterica serovar Typhi Ty2
cgacacauucaggcuuuccac

SEQ ID NO: 3702187 - RNA, 14 nt, Salmonella enterica enterica serovar Typhi Ty2
cgacaccagcgucg

SEQ ID NO: 3702188 - RNA, 18 nt, Salmonella enterica enterica serovar Typhi Ty2
cgacacccgauacacgcc

SEQ ID NO: 3702189 - RNA, 16 nt, Salmonella enterica enterica serovar Typhi Ty2
cgacaccgcaaaccgu

SEQ ID NO: 3702190 - RNA, 22 nt, Salmonella enterica enterica serovar Typhi Ty2
cgacacgcgcgcugcgccugga

SEQ ID NO: 3702191 - RNA, 22 nt, Salmonella enterica enterica serovar Typhi Ty2
cgacacgcugcauauaacuuuc

SEQ ID NO: 3702192 - RNA, 18 nt, Salmonella enterica enterica serovar Typhi Ty2
cgacacggcgcagauauu

SEQ ID NO: 3702193 - RNA, 15 nt, Salmonella enterica enterica serovar Typhi Ty2
cgacacuccgcgcau

SEQ ID NO: 3702194 - RNA, 21 nt, Salmonella enterica enterica serovar Typhi Ty2
cgacacugaaacuccgcagcc

SEQ ID NO: 3702195 - RNA, 13 nt, Salmonella enterica enterica serovar Typhi Ty2
cgacagcccccau

SEQ ID NO: 3702196 - RNA, 21 nt, Salmonella enterica enterica serovar Typhi Ty2
cgacagccgcguuuugccgcu

SEQ ID NO: 3702197 - RNA, 12 nt, Salmonella enterica enterica serovar Typhi Ty2
cgacagcgcgcc

SEQ ID NO: 3702198 - RNA, 16 nt, Salmonella enterica enterica serovar Typhi Ty2
cgacaggcugccgaca

SEQ ID NO: 3702199 - RNA, 17 nt, Salmonella enterica enterica serovar Typhi Ty2
cgacagggcgugaacca

SEQ ID NO: 3702200 - RNA, 22 nt, Salmonella enterica enterica serovar Typhi Ty2
cgacagggcgugaaccagcauc

SEQ ID NO: 3702201 - RNA, 19 nt, Salmonella enterica enterica serovar Typhi Ty2
cgacaggguuugccagcac

SEQ ID NO: 3702202 - RNA, 21 nt, Salmonella enterica enterica serovar Typhi Ty2
cgacaggguuugccagcacca

SEQ ID NO: 3702203 - RNA, 13 nt, Salmonella enterica enterica serovar Typhi Ty2
cgacaguaacugc

SEQ ID NO: 3702204 - RNA, 14 nt, Salmonella enterica enterica serovar Typhi Ty2
cgacaguaacugca

SEQ ID NO: 3702205 - RNA, 16 nt, Salmonella enterica enterica serovar Typhi Ty2
cgacaguaacugcaaa

SEQ ID NO: 3702206 - RNA, 18 nt, Salmonella enterica enterica serovar Typhi Ty2
cgacaguacgguaauucc

SEQ ID NO: 3702207 - RNA, 20 nt, Salmonella enterica enterica serovar Typhi Ty2
cgacaguaguaucauccaua

SEQ ID NO: 3702208 - RNA, 17 nt, Salmonella enterica enterica serovar Typhi Ty2
cgacaguucccggcaac

SEQ ID NO: 3702209 - RNA, 15 nt, Salmonella enterica enterica serovar Typhi Ty2
cgacauaaccggcaa

SEQ ID NO: 3702210 - RNA, 16 nt, Salmonella enterica enterica serovar Typhi Ty2
cgacauaaccggcaac

SEQ ID NO: 3702211 - RNA, 21 nt, Salmonella enterica enterica serovar Typhi Ty2
cgacauaagcugcgacaacaa

SEQ ID NO: 3702212 - RNA, 15 nt, Salmonella enterica enterica serovar Typhi Ty2
cgacauacauaacgc

SEQ ID NO: 3702213 - RNA, 12 nt, Salmonella enterica enterica serovar Typhi Ty2
cgacauacgcgc

SEQ ID NO: 3702214 - RNA, 15 nt, Salmonella enterica enterica serovar Typhi Ty2
cgacauagccuuugu

SEQ ID NO: 3702215 - RNA, 23 nt, Salmonella enterica enterica serovar Typhi Ty2
cgacauauuugcgugucaucaaa

SEQ ID NO: 3702216 - RNA, 12 nt, Salmonella enterica enterica serovar Typhi Ty2
cgacaucagaug

SEQ ID NO: 3702217 - RNA, 17 nt, Salmonella enterica enterica serovar Typhi Ty2
cgacaucagccagccgc

SEQ ID NO: 3702218 - RNA, 12 nt, Salmonella enterica enterica serovar Typhi Ty2
cgacaucgccaa

SEQ ID NO: 3702219 - RNA, 15 nt, Salmonella enterica enterica serovar Typhi Ty2
cgacaucgccaccgc

SEQ ID NO: 3702220 - RNA, 15 nt, Salmonella enterica enterica serovar Typhi Ty2
cgacaucgccugcuu

SEQ ID NO: 3702221 - RNA, 18 nt, Salmonella enterica enterica serovar Typhi Ty2
cgacaucuuuuccugaag

SEQ ID NO: 3702222 - RNA, 14 nt, Salmonella enterica enterica serovar Typhi Ty2
cgacaugcgcaugu

SEQ ID NO: 3702223 - RNA, 16 nt, Salmonella enterica enterica serovar Typhi Ty2
cgacauggcugagaau

SEQ ID NO: 3702224 - RNA, 21 nt, Salmonella enterica enterica serovar Typhi Ty2
cgacaugguuaaccaccagcg

SEQ ID NO: 3702225 - RNA, 17 nt, Salmonella enterica enterica serovar Typhi Ty2
cgacauucgauguuacu

SEQ ID NO: 3702226 - RNA, 19 nt, Salmonella enterica enterica serovar Typhi Ty2
cgaccaaacaagaucgcag

SEQ ID NO: 3702227 - RNA, 13 nt, Salmonella enterica enterica serovar Typhi Ty2
cgaccaauauccg

SEQ ID NO: 3702228 - RNA, 15 nt, Salmonella enterica enterica serovar Typhi Ty2
cgaccaccauccggc

SEQ ID NO: 3702229 - RNA, 15 nt, Salmonella enterica enterica serovar Typhi Ty2
cgaccacccgcgacc

SEQ ID NO: 3702230 - RNA, 20 nt, Salmonella enterica enterica serovar Typhi Ty2
cgaccacccgcgaccagguc

SEQ ID NO: 3702231 - RNA, 13 nt, Salmonella enterica enterica serovar Typhi Ty2
cgaccacgccacc

SEQ ID NO: 3702232 - RNA, 17 nt, Salmonella enterica enterica serovar Typhi Ty2
cgaccacgccaccgccg

SEQ ID NO: 3702233 - RNA, 13 nt, Salmonella enterica enterica serovar Typhi Ty2
cgaccacggccac

SEQ ID NO: 3702234 - RNA, 21 nt, Salmonella enterica enterica serovar Typhi Ty2
cgaccacuucaacgccgcgcu

SEQ ID NO: 3702235 - RNA, 15 nt, Salmonella enterica enterica serovar Typhi Ty2
cgaccagacacggug

SEQ ID NO: 3702236 - RNA, 15 nt, Salmonella enterica enterica serovar Typhi Ty2
cgaccagaugcagca

SEQ ID NO: 3702237 - RNA, 17 nt, Salmonella enterica enterica serovar Typhi Ty2
cgaccagcagcgggcug

SEQ ID NO: 3702238 - RNA, 13 nt, Salmonella enterica enterica serovar Typhi Ty2
cgaccagccugcc

SEQ ID NO: 3702239 - RNA, 12 nt, Salmonella enterica enterica serovar Typhi Ty2
cgaccaggaauu

SEQ ID NO: 3702240 - RNA, 15 nt, Salmonella enterica enterica serovar Typhi Ty2
cgaccaggaucagac

SEQ ID NO: 3702241 - RNA, 16 nt, Salmonella enterica enterica serovar Typhi Ty2
cgaccaggaucagacc

SEQ ID NO: 3702242 - RNA, 14 nt, Salmonella enterica enterica serovar Typhi Ty2
cgaccagugaacgu

SEQ ID NO: 3702243 - RNA, 19 nt, Salmonella enterica enterica serovar Typhi Ty2
cgaccaguuuagcuaaauc

SEQ ID NO: 3702244 - RNA, 21 nt, Salmonella enterica enterica serovar Typhi Ty2
cgaccauaaauagccgaccgc

SEQ ID NO: 3702245 - RNA, 22 nt, Salmonella enterica enterica serovar Typhi Ty2
cgaccauaaauagccgaccgcc

SEQ ID NO: 3702246 - RNA, 12 nt, Salmonella enterica enterica serovar Typhi Ty2
cgaccaucgccg

SEQ ID NO: 3702247 - RNA, 16 nt, Salmonella enterica enterica serovar Typhi Ty2
cgaccaucgccgcgaa

SEQ ID NO: 3702248 - RNA, 21 nt, Salmonella enterica enterica serovar Typhi Ty2
cgacccgcaaugugcagcagg

SEQ ID NO: 3702249 - RNA, 16 nt, Salmonella enterica enterica serovar Typhi Ty2
cgacccgcaucgccgc

SEQ ID NO: 3702250 - RNA, 20 nt, Salmonella enterica enterica serovar Typhi Ty2
cgacccgcugcgugaaaagg

SEQ ID NO: 3702251 - RNA, 14 nt, Salmonella enterica enterica serovar Typhi Ty2
cgaccgacgcguuu

SEQ ID NO: 3702252 - RNA, 15 nt, Salmonella enterica enterica serovar Typhi Ty2
cgaccgccagcagag

SEQ ID NO: 3702253 - RNA, 16 nt, Salmonella enterica enterica serovar Typhi Ty2
cgacuuaucuuccacg

SEQ ID NO: 3702254 - RNA, 16 nt, Salmonella enterica enterica serovar Typhi Ty2
cgacuucauucaggca

SEQ ID NO: 3702255 - RNA, 15 nt, Salmonella enterica enterica serovar Typhi Ty2
cgacuucgcuuccug

SEQ ID NO: 3702256 - RNA, 24 nt, Salmonella enterica enterica serovar Typhi Ty2
cgacuuuccgccaccagauaguca

SEQ ID NO: 3702257 - RNA, 18 nt, Salmonella enterica enterica serovar Typhi Ty2
cgacuuucuucggauuau

SEQ ID NO: 3702258 - RNA, 21 nt, Salmonella enterica enterica serovar Typhi Ty2
cgagaaaaucagugaacaccc

SEQ ID NO: 3702259 - RNA, 14 nt, Salmonella enterica enterica serovar Typhi Ty2
cgagaaacaccaga

SEQ ID NO: 3702260 - RNA, 15 nt, Salmonella enterica enterica serovar Typhi Ty2
cgagaaacaccagaa

SEQ ID NO: 3702261 - RNA, 18 nt, Salmonella enterica enterica serovar Typhi Ty2
cgagaagaagaauuauua

SEQ ID NO: 3702262 - RNA, 18 nt, Salmonella enterica enterica serovar Typhi Ty2
cgagaauacugaagucga

SEQ ID NO: 3702263 - RNA, 14 nt, Salmonella enterica enterica serovar Typhi Ty2
cgagaaugucgcca

SEQ ID NO: 3702264 - RNA, 13 nt, Salmonella enterica enterica serovar Typhi Ty2
cgagaauuuuaug

SEQ ID NO: 3702265 - RNA, 13 nt, Salmonella enterica enterica serovar Typhi Ty2
cgagacgguguuu

SEQ ID NO: 3702266 - RNA, 13 nt, Salmonella enterica enterica serovar Typhi Ty2
cgagagaaaaaaa

SEQ ID NO: 3702267 - RNA, 14 nt, Salmonella enterica enterica serovar Typhi Ty2
cgagagaaaaaaau

SEQ ID NO: 3702268 - RNA, 22 nt, Salmonella enterica enterica serovar Typhi Ty2
cgagagaauuaacagcgcgacc

SEQ ID NO: 3702269 - RNA, 14 nt, Salmonella enterica enterica serovar Typhi Ty2
cgagagucaaggca

SEQ ID NO: 3702270 - RNA, 15 nt, Salmonella enterica enterica serovar Typhi Ty2
cgagaucgccaccgc

SEQ ID NO: 3702271 - RNA, 13 nt, Salmonella enterica enterica serovar Typhi Ty2
cgagaugaaaagu

SEQ ID NO: 3702272 - RNA, 14 nt, Salmonella enterica enterica serovar Typhi Ty2
cgagauucaauaau

SEQ ID NO: 3702273 - RNA, 23 nt, Salmonella enterica enterica serovar Typhi Ty2
cgagauuuuucugcgccaccagc

SEQ ID NO: 3702274 - RNA, 21 nt, Salmonella enterica enterica serovar Typhi Ty2
cgagcaaaacccggugcggca

SEQ ID NO: 3702275 - RNA, 13 nt, Salmonella enterica enterica serovar Typhi Ty2
cgagcaauaguga

SEQ ID NO: 3702276 - RNA, 14 nt, Salmonella enterica enterica serovar Typhi Ty2
cgagcacuuuuucc

SEQ ID NO: 3702277 - RNA, 11 nt, Salmonella enterica enterica serovar Typhi Ty2
cgagcagccaa

SEQ ID NO: 3702278 - RNA, 16 nt, Salmonella enterica enterica serovar Typhi Ty2
cgagcaggaauagcuc

SEQ ID NO: 3702279 - RNA, 14 nt, Salmonella enterica enterica serovar Typhi Ty2
cgagcaggacgcgc

SEQ ID NO: 3702280 - RNA, 14 nt, Salmonella enterica enterica serovar Typhi Ty2
cgagcaguacgccu

SEQ ID NO: 3702281 - RNA, 17 nt, Salmonella enterica enterica serovar Typhi Ty2
cgagcaguucagcagca

SEQ ID NO: 3702282 - RNA, 15 nt, Salmonella enterica enterica serovar Typhi Ty2
cgagcauccgcgcaa

SEQ ID NO: 3702283 - RNA, 17 nt, Salmonella enterica enterica serovar Typhi Ty2
cgagcaucuccagcgca

SEQ ID NO: 3702284 - RNA, 19 nt, Salmonella enterica enterica serovar Typhi Ty2
cgagccaacguauaaaaug

SEQ ID NO: 3702285 - RNA, 17 nt, Salmonella enterica enterica serovar Typhi Ty2
cgagccacgcggcauca

SEQ ID NO: 3702286 - RNA, 20 nt, Salmonella enterica enterica serovar Typhi Ty2
cgagcgaaggggcgggcagc

SEQ ID NO: 3702287 - RNA, 21 nt, Salmonella enterica enterica serovar Typhi Ty2
cgagcgaaggggcgggcagca

SEQ ID NO: 3702288 - RNA, 22 nt, Salmonella enterica enterica serovar Typhi Ty2
cgagcgaaggggcgggcagcag

SEQ ID NO: 3702289 - RNA, 20 nt, Salmonella enterica enterica serovar Typhi Ty2
cgagcgacgcccugcccaug

SEQ ID NO: 3702290 - RNA, 13 nt, Salmonella enterica enterica serovar Typhi Ty2
cgagcgauagaga

SEQ ID NO: 3702291 - RNA, 23 nt, Salmonella enterica enterica serovar Typhi Ty2
cgagcgauagagaguuccuccug

SEQ ID NO: 3702292 - RNA, 20 nt, Salmonella enterica enterica serovar Typhi Ty2
cgagcgaucauaagggagcu

SEQ ID NO: 3702293 - RNA, 15 nt, Salmonella enterica enterica serovar Typhi Ty2
cgagcgccguuaaac

SEQ ID NO: 3702294 - RNA, 18 nt, Salmonella enterica enterica serovar Typhi Ty2
cgagcggccaaagggagc

SEQ ID NO: 3702295 - RNA, 21 nt, Salmonella enterica enterica serovar Typhi Ty2
cgagcgguuucucgacggugc

SEQ ID NO: 3702296 - RNA, 20 nt, Salmonella enterica enterica serovar Typhi Ty2
cgagcguucugcacgccggu

SEQ ID NO: 3702297 - RNA, 18 nt, Salmonella enterica enterica serovar Typhi Ty2
cgagcuauguuuaagcca

SEQ ID NO: 3702298 - RNA, 15 nt, Salmonella enterica enterica serovar Typhi Ty2
cgagcugguuucaau

SEQ ID NO: 3702299 - RNA, 14 nt, Salmonella enterica enterica serovar Typhi Ty2
cgagcuguaccguc

SEQ ID NO: 3702300 - RNA, 18 nt, Salmonella enterica enterica serovar Typhi Ty2
cgagcuguaccgucccua

SEQ ID NO: 3702301 - RNA, 19 nt, Salmonella enterica enterica serovar Typhi Ty2
cgagcuuccaguucgcuga

SEQ ID NO: 3702302 - RNA, 16 nt, Salmonella enterica enterica serovar Typhi Ty2
cgaggaaaaaugagac

SEQ ID NO: 3702303 - RNA, 16 nt, Salmonella enterica enterica serovar Typhi Ty2
cgaggaacaucagcca

SEQ ID NO: 3702304 - RNA, 18 nt, Salmonella enterica enterica serovar Typhi Ty2
cgaggaacaucagccagc

SEQ ID NO: 3702305 - RNA, 19 nt, Salmonella enterica enterica serovar Typhi Ty2
cgaggaacgcgcagaccgu

SEQ ID NO: 3702306 - RNA, 18 nt, Salmonella enterica enterica serovar Typhi Ty2
cgaggaagcugcgcagca

SEQ ID NO: 3702307 - RNA, 18 nt, Salmonella enterica enterica serovar Typhi Ty2
cgaggauaaaaucgccaa

SEQ ID NO: 3702308 - RNA, 20 nt, Salmonella enterica enterica serovar Typhi Ty2
cgaggcauaccgcccagaac

SEQ ID NO: 3702309 - RNA, 18 nt, Salmonella enterica enterica serovar Typhi Ty2
cgaggcgaaacggcggaa

SEQ ID NO: 3702310 - RNA, 22 nt, Salmonella enterica enterica serovar Typhi Ty2
cgaggcuuuguccuuugcuaca

SEQ ID NO: 3702311 - RNA, 14 nt, Salmonella enterica enterica serovar Typhi Ty2
cgaggggcaggaag

SEQ ID NO: 3702312 - RNA, 14 nt, Salmonella enterica enterica serovar Typhi Ty2
cgaggggccaaaac

SEQ ID NO: 3702313 - RNA, 14 nt, Salmonella enterica enterica serovar Typhi Ty2
cgagggugggcgca

SEQ ID NO: 3702314 - RNA, 22 nt, Salmonella enterica enterica serovar Typhi Ty2
cgaggucaucuuucagaugcag

SEQ ID NO: 3702315 - RNA, 19 nt, Salmonella enterica enterica serovar Typhi Ty2
cgaggugauaaucagcgcu

SEQ ID NO: 3702316 - RNA, 23 nt, Salmonella enterica enterica serovar Typhi Ty2
cgaguaacaccgcggcgcucgcc

SEQ ID NO: 3702317 - RNA, 20 nt, Salmonella enterica enterica serovar Typhi Ty2
cgaguaauccauagccaaca

SEQ ID NO: 3702318 - RNA, 18 nt, Salmonella enterica enterica serovar Typhi Ty2
cgaguccgaggcgaaacg

SEQ ID NO: 3702319 - RNA, 13 nt, Salmonella enterica enterica serovar Typhi Ty2
cgagucgccgcuu

SEQ ID NO: 3702320 - RNA, 16 nt, Salmonella enterica enterica serovar Typhi Ty2
cgagucuuaccagguc

SEQ ID NO: 3702321 - RNA, 22 nt, Salmonella enterica enterica serovar Typhi Ty2
cgagugaggaccguacucagau

SEQ ID NO: 3702322 - RNA, 15 nt, Salmonella enterica enterica serovar Typhi Ty2
cgaguggaaucagcc

SEQ ID NO: 3702323 - RNA, 14 nt, Salmonella enterica enterica serovar Typhi Ty2
cgaguuaauagaau

SEQ ID NO: 3702324 - RNA, 13 nt, Salmonella enterica enterica serovar Typhi Ty2
cgaguuacguugc

SEQ ID NO: 3702325 - RNA, 20 nt, Salmonella enterica enterica serovar Typhi Ty2
cgauaaaaaacgcccagauc

SEQ ID NO: 3702326 - RNA, 23 nt, Salmonella enterica enterica serovar Typhi Ty2
cgauaaaaacccaccagcgccag

SEQ ID NO: 3702327 - RNA, 14 nt, Salmonella enterica enterica serovar Typhi Ty2
cgauaaacagauau

SEQ ID NO: 3702328 - RNA, 17 nt, Salmonella enterica enterica serovar Typhi Ty2
cgauaaaccuucguaau

SEQ ID NO: 3702329 - RNA, 12 nt, Salmonella enterica enterica serovar Typhi Ty2
cgauaaacgauc

SEQ ID NO: 3702330 - RNA, 17 nt, Salmonella enterica enterica serovar Typhi Ty2
cgauaaacucaaucagg

SEQ ID NO: 3702331 - RNA, 16 nt, Salmonella enterica enterica serovar Typhi Ty2
cgauaaagaacgcgcc

SEQ ID NO: 3702332 - RNA, 13 nt, Salmonella enterica enterica serovar Typhi Ty2
cgauaaagacagg

SEQ ID NO: 3702333 - RNA, 19 nt, Salmonella enterica enterica serovar Typhi Ty2
cgauaaagcgguuaucggc

SEQ ID NO: 3702334 - RNA, 17 nt, Salmonella enterica enterica serovar Typhi Ty2
cgauaaaguggcauccg

SEQ ID NO: 3702335 - RNA, 13 nt, Salmonella enterica enterica serovar Typhi Ty2
cgauccaggucuu

SEQ ID NO: 3702336 - RNA, 17 nt, Salmonella enterica enterica serovar Typhi Ty2
cgauccauauaaucaaa

SEQ ID NO: 3702337 - RNA, 18 nt, Salmonella enterica enterica serovar Typhi Ty2
cgaucccaguugaucggc

SEQ ID NO: 3702338 - RNA, 16 nt, Salmonella enterica enterica serovar Typhi Ty2
cgaucccgccgcaucc

SEQ ID NO: 3702339 - RNA, 22 nt, Salmonella enterica enterica serovar Typhi Ty2
cgaucccggcaaaaaucagccc

SEQ ID NO: 3702340 - RNA, 18 nt, Salmonella enterica enterica serovar Typhi Ty2
cgaucccgggcgauaaac

SEQ ID NO: 3702341 - RNA, 12 nt, Salmonella enterica enterica serovar Typhi Ty2
cgaucgauaaag

SEQ ID NO: 3702342 - RNA, 10 nt, Salmonella enterica enterica serovar Typhi Ty2
cgaucgccac

SEQ ID NO: 3702343 - RNA, 20 nt, Salmonella enterica enterica serovar Typhi Ty2
cgaucgccagcuacgacaag

SEQ ID NO: 3702344 - RNA, 15 nt, Salmonella enterica enterica serovar Typhi Ty2
cgaucgcuaaucagg

SEQ ID NO: 3702345 - RNA, 17 nt, Salmonella enterica enterica serovar Typhi Ty2
cgaucgcuaaucaggac

SEQ ID NO: 3702346 - RNA, 18 nt, Salmonella enterica enterica serovar Typhi Ty2
cgaucgcucaacuccugc

SEQ ID NO: 3702347 - RNA, 23 nt, Salmonella enterica enterica serovar Typhi Ty2
cgaucgcuggacgucgucaccac

SEQ ID NO: 3702348 - RNA, 20 nt, Salmonella enterica enterica serovar Typhi Ty2
cgaucggcuuguuaugcgga

SEQ ID NO: 3702349 - RNA, 18 nt, Salmonella enterica enterica serovar Typhi Ty2
cgaucguagcaucucuuc

SEQ ID NO: 3702350 - RNA, 15 nt, Salmonella enterica enterica serovar Typhi Ty2
cgaucguccgccucc

SEQ ID NO: 3702351 - RNA, 12 nt, Salmonella enterica enterica serovar Typhi Ty2
cgaucuauuuca

SEQ ID NO: 3702352 - RNA, 18 nt, Salmonella enterica enterica serovar Typhi Ty2
cgaucuauuucauaauaa

SEQ ID NO: 3702353 - RNA, 16 nt, Salmonella enterica enterica serovar Typhi Ty2
cgaucuccaucuccag

SEQ ID NO: 3702354 - RNA, 14 nt, Salmonella enterica enterica serovar Typhi Ty2
cgaucucccagccg

SEQ ID NO: 3702355 - RNA, 16 nt, Salmonella enterica enterica serovar Typhi Ty2
cgaucuccgccgucgu

SEQ ID NO: 3702356 - RNA, 12 nt, Salmonella enterica enterica serovar Typhi Ty2
cgaucugaaugc

SEQ ID NO: 3702357 - RNA, 12 nt, Salmonella enterica enterica serovar Typhi Ty2
cgaucugugucg

SEQ ID NO: 3702358 - RNA, 19 nt, Salmonella enterica enterica serovar Typhi Ty2
cgaucugugucguccaggc

SEQ ID NO: 3702359 - RNA, 13 nt, Salmonella enterica enterica serovar Typhi Ty2
cgaucuucaucgu

SEQ ID NO: 3702360 - RNA, 13 nt, Salmonella enterica enterica serovar Typhi Ty2
cgaugacagcagg

SEQ ID NO: 3702361 - RNA, 13 nt, Salmonella enterica enterica serovar Typhi Ty2
cgaugaccaucaa

SEQ ID NO: 3702362 - RNA, 14 nt, Salmonella enterica enterica serovar Typhi Ty2
cgaugacgacuuuu

SEQ ID NO: 3702363 - RNA, 15 nt, Salmonella enterica enterica serovar Typhi Ty2
cgaugacgacuuuuu

SEQ ID NO: 3702364 - RNA, 17 nt, Salmonella enterica enterica serovar Typhi Ty2
cgaugacgacuuuuugc

SEQ ID NO: 3702365 - RNA, 17 nt, Salmonella enterica enterica serovar Typhi Ty2
cgaugacgccugccaga

SEQ ID NO: 3702366 - RNA, 20 nt, Salmonella enterica enterica serovar Typhi Ty2
cgaugacucguauuuaaacc

SEQ ID NO: 3702367 - RNA, 19 nt, Salmonella enterica enterica serovar Typhi Ty2
cgaugagcgccagcaacag

SEQ ID NO: 3702368 - RNA, 16 nt, Salmonella enterica enterica serovar Typhi Ty2
cgaugaguucaguaug

SEQ ID NO: 3702369 - RNA, 19 nt, Salmonella enterica enterica serovar Typhi Ty2
cgaugauaacgcgccgcgc

SEQ ID NO: 3702370 - RNA, 14 nt, Salmonella enterica enterica serovar Typhi Ty2
cgaugcaaccccug

SEQ ID NO: 3702371 - RNA, 23 nt, Salmonella enterica enterica serovar Typhi Ty2
cgaugcaaccccugacgggcgau

SEQ ID NO: 3702372 - RNA, 23 nt, Salmonella enterica enterica serovar Typhi Ty2
cgaugcacaacacgcuuuucagc

SEQ ID NO: 3702373 - RNA, 16 nt, Salmonella enterica enterica serovar Typhi Ty2
cgaugccgccgcaacg

SEQ ID NO: 3702374 - RNA, 19 nt, Salmonella enterica enterica serovar Typhi Ty2
cgaugccguuuuaacguca

SEQ ID NO: 3702375 - RNA, 14 nt, Salmonella enterica enterica serovar Typhi Ty2
cgaugccucacccc

SEQ ID NO: 3702376 - RNA, 19 nt, Salmonella enterica enterica serovar Typhi Ty2
cgaugcgcgagccguaaac

SEQ ID NO: 3702377 - RNA, 19 nt, Salmonella enterica enterica serovar Typhi Ty2
cgaugcgcguuuuccacca

SEQ ID NO: 3702378 - RNA, 14 nt, Salmonella enterica enterica serovar Typhi Ty2
cgaugcgcuuuucc

SEQ ID NO: 3702379 - RNA, 15 nt, Salmonella enterica enterica serovar Typhi Ty2
cgaugcgcuuuucca

SEQ ID NO: 3702380 - RNA, 21 nt, Salmonella enterica enterica serovar Typhi Ty2
cgaugcggagauagcggugcc

SEQ ID NO: 3702381 - RNA, 17 nt, Salmonella enterica enterica serovar Typhi Ty2
cgaugcgguucaacgcg

SEQ ID NO: 3702382 - RNA, 19 nt, Salmonella enterica enterica serovar Typhi Ty2
cgaugcguucaaaaagcug

SEQ ID NO: 3702383 - RNA, 17 nt, Salmonella enterica enterica serovar Typhi Ty2
cgaugcugcuccaucuc

SEQ ID NO: 3702384 - RNA, 22 nt, Salmonella enterica enterica serovar Typhi Ty2
cgaugcuggugaagacgcugca

SEQ ID NO: 3702385 - RNA, 18 nt, Salmonella enterica enterica serovar Typhi Ty2
cgaugcuguuucaguaaa

SEQ ID NO: 3702386 - RNA, 23 nt, Salmonella enterica enterica serovar Typhi Ty2
cgauggaaccacauagagugauc

SEQ ID NO: 3702387 - RNA, 14 nt, Salmonella enterica enterica serovar Typhi Ty2
cgauggcaaauaau

SEQ ID NO: 3702388 - RNA, 16 nt, Salmonella enterica enterica serovar Typhi Ty2
cgauggcaaauaauac

SEQ ID NO: 3702389 - RNA, 22 nt, Salmonella enterica enterica serovar Typhi Ty2
cgauggcaaauaauaccacgau

SEQ ID NO: 3702390 - RNA, 16 nt, Salmonella enterica enterica serovar Typhi Ty2
cgauggcagugaugga

SEQ ID NO: 3702391 - RNA, 16 nt, Salmonella enterica enterica serovar Typhi Ty2
cgauggcgauauugug

SEQ ID NO: 3702392 - RNA, 13 nt, Salmonella enterica enterica serovar Typhi Ty2
cgauggcgcuacg

SEQ ID NO: 3702393 - RNA, 15 nt, Salmonella enterica enterica serovar Typhi Ty2
cgauggcgcuccuga

SEQ ID NO: 3702394 - RNA, 22 nt, Salmonella enterica enterica serovar Typhi Ty2
cgauggggcaagcucagcggca

SEQ ID NO: 3702395 - RNA, 15 nt, Salmonella enterica enterica serovar Typhi Ty2
cgauggucgccuccg

SEQ ID NO: 3702396 - RNA, 18 nt, Salmonella enterica enterica serovar Typhi Ty2
cgauggucucaaucgcaa

SEQ ID NO: 3702397 - RNA, 13 nt, Salmonella enterica enterica serovar Typhi Ty2
cgauggugccgac

SEQ ID NO: 3702398 - RNA, 14 nt, Salmonella enterica enterica serovar Typhi Ty2
cgauggugcggcgc

SEQ ID NO: 3702399 - RNA, 17 nt, Salmonella enterica enterica serovar Typhi Ty2
cgauguaguugccgccc

SEQ ID NO: 3702400 - RNA, 11 nt, Salmonella enterica enterica serovar Typhi Ty2
cgaugucgcca

SEQ ID NO: 3702401 - RNA, 20 nt, Salmonella enterica enterica serovar Typhi Ty2
cgaugugcguauugagcgca

SEQ ID NO: 3702402 - RNA, 21 nt, Salmonella enterica enterica serovar Typhi Ty2
cgauguuacgacccagcggca

SEQ ID NO: 3702403 - RNA, 14 nt, Salmonella enterica enterica serovar Typhi Ty2
cgauguucgauaau

SEQ ID NO: 3702404 - RNA, 21 nt, Salmonella enterica enterica serovar Typhi Ty2
cgauguucgucccugcaacgc

SEQ ID NO: 3702405 - RNA, 15 nt, Salmonella enterica enterica serovar Typhi Ty2
cgauguuugccacgc

SEQ ID NO: 3702406 - RNA, 22 nt, Salmonella enterica enterica serovar Typhi Ty2
cgauuaaugcuccaauaaauau

SEQ ID NO: 3702407 - RNA, 22 nt, Salmonella enterica enterica serovar Typhi Ty2
cgauuagcuggcugcgcgggag

SEQ ID NO: 3702408 - RNA, 13 nt, Salmonella enterica enterica serovar Typhi Ty2
cgauuccccacca

SEQ ID NO: 3702409 - RNA, 16 nt, Salmonella enterica enterica serovar Typhi Ty2
cgauucccgaucuuca

SEQ ID NO: 3702410 - RNA, 17 nt, Salmonella enterica enterica serovar Typhi Ty2
cgauuccgugucugaau

SEQ ID NO: 3702411 - RNA, 19 nt, Salmonella enterica enterica serovar Typhi Ty2
cgauucgagcgcagcgaga

SEQ ID NO: 3702412 - RNA, 20 nt, Salmonella enterica enterica serovar Typhi Ty2
cgauucucugaggguguuca

SEQ ID NO: 3702413 - RNA, 12 nt, Salmonella enterica enterica serovar Typhi Ty2
cgauugaucgga

SEQ ID NO: 3702414 - RNA, 21 nt, Salmonella enterica enterica serovar Typhi Ty2
cgauuggccgucucuuucaug

SEQ ID NO: 3702415 - RNA, 18 nt, Salmonella enterica enterica serovar Typhi Ty2
cgauuguguguuaauggc

SEQ ID NO: 3702416 - RNA, 21 nt, Salmonella enterica enterica serovar Typhi Ty2
cgauuuauucuuugucugucg

SEQ ID NO: 3702417 - RNA, 14 nt, Salmonella enterica enterica serovar Typhi Ty2
cgcagaaaaagccc

SEQ ID NO: 3702418 - RNA, 16 nt, Salmonella enterica enterica serovar Typhi Ty2
cgcagaagcagaccga

SEQ ID NO: 3702419 - RNA, 13 nt, Salmonella enterica enterica serovar Typhi Ty2
cgcagaaucagcg

SEQ ID NO: 3702420 - RNA, 15 nt, Salmonella enterica enterica serovar Typhi Ty2
cgcagaaucagcgug

SEQ ID NO: 3702421 - RNA, 19 nt, Salmonella enterica enterica serovar Typhi Ty2
cgcagacaauuuucuucau

SEQ ID NO: 3702422 - RNA, 14 nt, Salmonella enterica enterica serovar Typhi Ty2
cgcagacaguggcc

SEQ ID NO: 3702423 - RNA, 15 nt, Salmonella enterica enterica serovar Typhi Ty2
cgcagaccaaaguca

SEQ ID NO: 3702424 - RNA, 12 nt, Salmonella enterica enterica serovar Typhi Ty2
cgcagacccuuu

SEQ ID NO: 3702425 - RNA, 16 nt, Salmonella enterica enterica serovar Typhi Ty2
cgcagaccgcgcucca

SEQ ID NO: 3702426 - RNA, 16 nt, Salmonella enterica enterica serovar Typhi Ty2
cgcagacgccgcgguu

SEQ ID NO: 3702427 - RNA, 17 nt, Salmonella enterica enterica serovar Typhi Ty2
cgcagacugcgccacgu

SEQ ID NO: 3702428 - RNA, 18 nt, Salmonella enterica enterica serovar Typhi Ty2
cgcagagauagccagcga

SEQ ID NO: 3702429 - RNA, 21 nt, Salmonella enterica enterica serovar Typhi Ty2
cgcagaguaaaaaaaccggcg

SEQ ID NO: 3702430 - RNA, 15 nt, Salmonella enterica enterica serovar Typhi Ty2
cgcagaguaucguug

SEQ ID NO: 3702431 - RNA, 17 nt, Salmonella enterica enterica serovar Typhi Ty2
cgcagagugagcaggcu

SEQ ID NO: 3702432 - RNA, 14 nt, Salmonella enterica enterica serovar Typhi Ty2
cgcagaucgccugg

SEQ ID NO: 3702433 - RNA, 15 nt, Salmonella enterica enterica serovar Typhi Ty2
cgcagcaaacgccau

SEQ ID NO: 3702434 - RNA, 18 nt, Salmonella enterica enterica serovar Typhi Ty2
cgcagcaaacgccauagc

SEQ ID NO: 3702435 - RNA, 16 nt, Salmonella enterica enterica serovar Typhi Ty2
cgcagcaacaguugcu

SEQ ID NO: 3702436 - RNA, 14 nt, Salmonella enterica enterica serovar Typhi Ty2
cgcagcaacgguuu

SEQ ID NO: 3702437 - RNA, 15 nt, Salmonella enterica enterica serovar Typhi Ty2
cgcagcaagaacaga

SEQ ID NO: 3702438 - RNA, 12 nt, Salmonella enterica enterica serovar Typhi Ty2
cgcagcaccgcc

SEQ ID NO: 3702439 - RNA, 13 nt, Salmonella enterica enterica serovar Typhi Ty2
cgcagcauaucgc

SEQ ID NO: 3702440 - RNA, 17 nt, Salmonella enterica enterica serovar Typhi Ty2
cgcagcauaucgccguu

SEQ ID NO: 3702441 - RNA, 14 nt, Salmonella enterica enterica serovar Typhi Ty2
cgcagccaacaaca

SEQ ID NO: 3702442 - RNA, 20 nt, Salmonella enterica enterica serovar Typhi Ty2
cgcagccaacaacaggccgc

SEQ ID NO: 3702443 - RNA, 11 nt, Salmonella enterica enterica serovar Typhi Ty2
cgcagccagaa

SEQ ID NO: 3702444 - RNA, 12 nt, Salmonella enterica enterica serovar Typhi Ty2
cgcagccccagc

SEQ ID NO: 3702445 - RNA, 15 nt, Salmonella enterica enterica serovar Typhi Ty2
cgcagccccagcgcc

SEQ ID NO: 3702446 - RNA, 22 nt, Salmonella enterica enterica serovar Typhi Ty2
cgcagccccagcgccagccgcg

SEQ ID NO: 3702447 - RNA, 16 nt, Salmonella enterica enterica serovar Typhi Ty2
cgcagcccugcgucgc

SEQ ID NO: 3702448 - RNA, 22 nt, Salmonella enterica enterica serovar Typhi Ty2
cgcagcgaaaauccaguaauuu

SEQ ID NO: 3702449 - RNA, 19 nt, Salmonella enterica enterica serovar Typhi Ty2
cgcagcgccauccggcaaa

SEQ ID NO: 3702450 - RNA, 17 nt, Salmonella enterica enterica serovar Typhi Ty2
cgcagcgcccagcagcu

SEQ ID NO: 3702451 - RNA, 16 nt, Salmonella enterica enterica serovar Typhi Ty2
cgcagcuccagcucag

SEQ ID NO: 3702452 - RNA, 19 nt, Salmonella enterica enterica serovar Typhi Ty2
cgcagcugccacaccacau

SEQ ID NO: 3702453 - RNA, 15 nt, Salmonella enterica enterica serovar Typhi Ty2
cgcagcugggccugc

SEQ ID NO: 3702454 - RNA, 14 nt, Salmonella enterica enterica serovar Typhi Ty2
cgcagcugguugau

SEQ ID NO: 3702455 - RNA, 15 nt, Salmonella enterica enterica serovar Typhi Ty2
cgcagcuucgccgcg

SEQ ID NO: 3702456 - RNA, 19 nt, Salmonella enterica enterica serovar Typhi Ty2
cgcaggacuuucgcuucac

SEQ ID NO: 3702457 - RNA, 13 nt, Salmonella enterica enterica serovar Typhi Ty2
cgcaggagagcca

SEQ ID NO: 3702458 - RNA, 13 nt, Salmonella enterica enterica serovar Typhi Ty2
cgcaggagggagg

SEQ ID NO: 3702459 - RNA, 21 nt, Salmonella enterica enterica serovar Typhi Ty2
cgcaggauaaagaccggcaca

SEQ ID NO: 3702460 - RNA, 22 nt, Salmonella enterica enterica serovar Typhi Ty2
cgcaggcauuaaaaaaacguag

SEQ ID NO: 3702461 - RNA, 12 nt, Salmonella enterica enterica serovar Typhi Ty2
cgcaggccaaac

SEQ ID NO: 3702462 - RNA, 14 nt, Salmonella enterica enterica serovar Typhi Ty2
cgcaggccaucaua

SEQ ID NO: 3702463 - RNA, 13 nt, Salmonella enterica enterica serovar Typhi Ty2
cgcaggcgauagc

SEQ ID NO: 3702464 - RNA, 16 nt, Salmonella enterica enterica serovar Typhi Ty2
cgcaggcuaacgcgcc

SEQ ID NO: 3702465 - RNA, 15 nt, Salmonella enterica enterica serovar Typhi Ty2
cgcaggcuugcccau

SEQ ID NO: 3702466 - RNA, 12 nt, Salmonella enterica enterica serovar Typhi Ty2
cgcagggcugcu

SEQ ID NO: 3702467 - RNA, 15 nt, Salmonella enterica enterica serovar Typhi Ty2
cgcagguaaaaucca

SEQ ID NO: 3702468 - RNA, 17 nt, Salmonella enterica enterica serovar Typhi Ty2
cgcagguuaaagccucu

SEQ ID NO: 3702469 - RNA, 16 nt, Salmonella enterica enterica serovar Typhi Ty2
cgcaguaaacuccucu

SEQ ID NO: 3702470 - RNA, 21 nt, Salmonella enterica enterica serovar Typhi Ty2
cgcaguaauacgccgccgcag

SEQ ID NO: 3702471 - RNA, 15 nt, Salmonella enterica enterica serovar Typhi Ty2
cgcaguaaucaccgu

SEQ ID NO: 3702472 - RNA, 14 nt, Salmonella enterica enterica serovar Typhi Ty2
cgcaguacggcgca

SEQ ID NO: 3702473 - RNA, 16 nt, Salmonella enterica enterica serovar Typhi Ty2
cgcagucguuccagac

SEQ ID NO: 3702474 - RNA, 17 nt, Salmonella enterica enterica serovar Typhi Ty2
cgcagugaccagcauca

SEQ ID NO: 3702475 - RNA, 15 nt, Salmonella enterica enterica serovar Typhi Ty2
cgcaguuaugcgcau

SEQ ID NO: 3702476 - RNA, 14 nt, Salmonella enterica enterica serovar Typhi Ty2
cgcaguucaauauu

SEQ ID NO: 3702477 - RNA, 16 nt, Salmonella enterica enterica serovar Typhi Ty2
cgcaguucaauauuca

SEQ ID NO: 3702478 - RNA, 14 nt, Salmonella enterica enterica serovar Typhi Ty2
cgcaguuuacgcag

SEQ ID NO: 3702479 - RNA, 16 nt, Salmonella enterica enterica serovar Typhi Ty2
cgcaguuuacgcagcg

SEQ ID NO: 3702480 - RNA, 22 nt, Salmonella enterica enterica serovar Typhi Ty2
cgcaguuugucuucgaugcgcu

SEQ ID NO: 3702481 - RNA, 17 nt, Salmonella enterica enterica serovar Typhi Ty2
cgcaguuuguggcgugu

SEQ ID NO: 3702482 - RNA, 16 nt, Salmonella enterica enterica serovar Typhi Ty2
cgcauaauccagcagg

SEQ ID NO: 3702483 - RNA, 18 nt, Salmonella enterica enterica serovar Typhi Ty2
cgcauaaugagcgcuuga

SEQ ID NO: 3702484 - RNA, 13 nt, Salmonella enterica enterica serovar Typhi Ty2
cgcauaccagcca

SEQ ID NO: 3702485 - RNA, 14 nt, Salmonella enterica enterica serovar Typhi Ty2
cgcauaccagccau

SEQ ID NO: 3702486 - RNA, 15 nt, Salmonella enterica enterica serovar Typhi Ty2
cgcauaccagccaua

SEQ ID NO: 3702487 - RNA, 18 nt, Salmonella enterica enterica serovar Typhi Ty2
cgcauaccgaacagaaaa

SEQ ID NO: 3702488 - RNA, 20 nt, Salmonella enterica enterica serovar Typhi Ty2
cgcauagcggccagauggca

SEQ ID NO: 3702489 - RNA, 21 nt, Salmonella enterica enterica serovar Typhi Ty2
cgcauaggcuuugcugagcgc

SEQ ID NO: 3702490 - RNA, 21 nt, Salmonella enterica enterica serovar Typhi Ty2
cgcauagguugauauaaaacg

SEQ ID NO: 3702491 - RNA, 13 nt, Salmonella enterica enterica serovar Typhi Ty2
cgcauauccagca

SEQ ID NO: 3702492 - RNA, 14 nt, Salmonella enterica enterica serovar Typhi Ty2
cgcauaucccacug

SEQ ID NO: 3702493 - RNA, 19 nt, Salmonella enterica enterica serovar Typhi Ty2
cgcauaucccacugcacgc

SEQ ID NO: 3702494 - RNA, 13 nt, Salmonella enterica enterica serovar Typhi Ty2
cgcauauuuuuua

SEQ ID NO: 3702495 - RNA, 22 nt, Salmonella enterica enterica serovar Typhi Ty2
cgcaucaaacuugcccagcgcc

SEQ ID NO: 3702496 - RNA, 17 nt, Salmonella enterica enterica serovar Typhi Ty2
cgcaucaauaugcguca

SEQ ID NO: 3702497 - RNA, 14 nt, Salmonella enterica enterica serovar Typhi Ty2
cgcaucaaugccca

SEQ ID NO: 3702498 - RNA, 16 nt, Salmonella enterica enterica serovar Typhi Ty2
cgcaucacggcagcac

SEQ ID NO: 3702499 - RNA, 22 nt, Salmonella enterica enterica serovar Typhi Ty2
cgcaucaggaucuucaucccau

SEQ ID NO: 3702500 - RNA, 18 nt, Salmonella enterica enterica serovar Typhi Ty2
cgccaccgccagccaugg

SEQ ID NO: 3702501 - RNA, 15 nt, Salmonella enterica enterica serovar Typhi Ty2
cgccaccgccgccac

SEQ ID NO: 3702502 - RNA, 14 nt, Salmonella enterica enterica serovar Typhi Ty2
cgccaccgcgcgca

SEQ ID NO: 3702503 - RNA, 14 nt, Salmonella enterica enterica serovar Typhi Ty2
cgccaccgcgcgcu

SEQ ID NO: 3702504 - RNA, 15 nt, Salmonella enterica enterica serovar Typhi Ty2
cgccaccgcgcgcuu

SEQ ID NO: 3702505 - RNA, 19 nt, Salmonella enterica enterica serovar Typhi Ty2
cgccaccgggcaacacacg

SEQ ID NO: 3702506 - RNA, 22 nt, Salmonella enterica enterica serovar Typhi Ty2
cgccaccgggcaacacacgcuu

SEQ ID NO: 3702507 - RNA, 22 nt, Salmonella enterica enterica serovar Typhi Ty2
cgccaccgggccgucagggucu

SEQ ID NO: 3702508 - RNA, 20 nt, Salmonella enterica enterica serovar Typhi Ty2
cgccaccggguuaaagcccu

SEQ ID NO: 3702509 - RNA, 19 nt, Salmonella enterica enterica serovar Typhi Ty2
cgccaccucgcgacgguga

SEQ ID NO: 3702510 - RNA, 22 nt, Salmonella enterica enterica serovar Typhi Ty2
cgccaccugaauaacccgcagc

SEQ ID NO: 3702511 - RNA, 22 nt, Salmonella enterica enterica serovar Typhi Ty2
cgccaccuguuucgccaggccg

SEQ ID NO: 3702512 - RNA, 18 nt, Salmonella enterica enterica serovar Typhi Ty2
cgccaccuuaaucgacuu

SEQ ID NO: 3702513 - RNA, 15 nt, Salmonella enterica enterica serovar Typhi Ty2
cgccacgacgcuggu

SEQ ID NO: 3702514 - RNA, 21 nt, Salmonella enterica enterica serovar Typhi Ty2
cgccacgacgcugguuccccg

SEQ ID NO: 3702515 - RNA, 15 nt, Salmonella enterica enterica serovar Typhi Ty2
cgccacgaucggcaa

SEQ ID NO: 3702516 - RNA, 23 nt, Salmonella enterica enterica serovar Typhi Ty2
cgccacgccauugcugucgacaa

SEQ ID NO: 3702517 - RNA, 19 nt, Salmonella enterica enterica serovar Typhi Ty2
cgccacgcccaacauaaac

SEQ ID NO: 3702518 - RNA, 15 nt, Salmonella enterica enterica serovar Typhi Ty2
cgccacgccgcccgc

SEQ ID NO: 3702519 - RNA, 19 nt, Salmonella enterica enterica serovar Typhi Ty2
cgccacgccgcuccacagc

SEQ ID NO: 3702520 - RNA, 21 nt, Salmonella enterica enterica serovar Typhi Ty2
cgccacgcuccuucuucgccg

SEQ ID NO: 3702521 - RNA, 18 nt, Salmonella enterica enterica serovar Typhi Ty2
cgccacggccagcagcca

SEQ ID NO: 3702522 - RNA, 17 nt, Salmonella enterica enterica serovar Typhi Ty2
cgccacucuggcgacgc

SEQ ID NO: 3702523 - RNA, 20 nt, Salmonella enterica enterica serovar Typhi Ty2
cgccacugccauaaugaucc

SEQ ID NO: 3702524 - RNA, 19 nt, Salmonella enterica enterica serovar Typhi Ty2
cgccacuucacuggcggca

SEQ ID NO: 3702525 - RNA, 20 nt, Salmonella enterica enterica serovar Typhi Ty2
cgccacuucacuggcggcaa

SEQ ID NO: 3702526 - RNA, 13 nt, Salmonella enterica enterica serovar Typhi Ty2
cgccacuuccagc

SEQ ID NO: 3702527 - RNA, 14 nt, Salmonella enterica enterica serovar Typhi Ty2
cgccacuuccagcg

SEQ ID NO: 3702528 - RNA, 15 nt, Salmonella enterica enterica serovar Typhi Ty2
cgccacuuccagcgc

SEQ ID NO: 3702529 - RNA, 19 nt, Salmonella enterica enterica serovar Typhi Ty2
cgccacuuccagcgcgccg

SEQ ID NO: 3702530 - RNA, 20 nt, Salmonella enterica enterica serovar Typhi Ty2
cgccacuuccagcgcgccgu

SEQ ID NO: 3702531 - RNA, 20 nt, Salmonella enterica enterica serovar Typhi Ty2
cgccacuucuuugaccagcg

SEQ ID NO: 3702532 - RNA, 16 nt, Salmonella enterica enterica serovar Typhi Ty2
cgccacuuuuccggca

SEQ ID NO: 3702533 - RNA, 17 nt, Salmonella enterica enterica serovar Typhi Ty2
cgccagaagccgucgau

SEQ ID NO: 3702534 - RNA, 23 nt, Salmonella enterica enterica serovar Typhi Ty2
cgccagacacuggaaacagccaa

SEQ ID NO: 3702535 - RNA, 15 nt, Salmonella enterica enterica serovar Typhi Ty2
cgccagacccagcgc

SEQ ID NO: 3702536 - RNA, 16 nt, Salmonella enterica enterica serovar Typhi Ty2
cgccagacccagcgcu

SEQ ID NO: 3702537 - RNA, 18 nt, Salmonella enterica enterica serovar Typhi Ty2
cgccagaccgacgccaac

SEQ ID NO: 3702538 - RNA, 16 nt, Salmonella enterica enterica serovar Typhi Ty2
cgccagacucagccag

SEQ ID NO: 3702539 - RNA, 21 nt, Salmonella enterica enterica serovar Typhi Ty2
cgccagacucagccaggucug

SEQ ID NO: 3702540 - RNA, 21 nt, Salmonella enterica enterica serovar Typhi Ty2
cgccagagcacgaaaagugug

SEQ ID NO: 3702541 - RNA, 14 nt, Salmonella enterica enterica serovar Typhi Ty2
cgccagaggcgugc

SEQ ID NO: 3702542 - RNA, 15 nt, Salmonella enterica enterica serovar Typhi Ty2
cgccagaggcgugca

SEQ ID NO: 3702543 - RNA, 21 nt, Salmonella enterica enterica serovar Typhi Ty2
cgccagaggcgugcaugggca

SEQ ID NO: 3702544 - RNA, 22 nt, Salmonella enterica enterica serovar Typhi Ty2
cgccagaggcgugcaugggcag

SEQ ID NO: 3702545 - RNA, 20 nt, Salmonella enterica enterica serovar Typhi Ty2
cgccagauaaagcgaauaac

SEQ ID NO: 3702546 - RNA, 16 nt, Salmonella enterica enterica serovar Typhi Ty2
cgccagauaaaucagc

SEQ ID NO: 3702547 - RNA, 19 nt, Salmonella enterica enterica serovar Typhi Ty2
cgccagauaaucgccgcca

SEQ ID NO: 3702548 - RNA, 20 nt, Salmonella enterica enterica serovar Typhi Ty2
cgccagauaaucgccgccag

SEQ ID NO: 3702549 - RNA, 23 nt, Salmonella enterica enterica serovar Typhi Ty2
cgccagaucaggcgucagcaugg

SEQ ID NO: 3702550 - RNA, 22 nt, Salmonella enterica enterica serovar Typhi Ty2
cgccagauccggcagcgggcaa

SEQ ID NO: 3702551 - RNA, 20 nt, Salmonella enterica enterica serovar Typhi Ty2
cgccagaucgaacagcggca

SEQ ID NO: 3702552 - RNA, 22 nt, Salmonella enterica enterica serovar Typhi Ty2
cgccagaucgaacagcggcagg

SEQ ID NO: 3702553 - RNA, 23 nt, Salmonella enterica enterica serovar Typhi Ty2
cgccagaucgaacagcggcaggc

SEQ ID NO: 3702554 - RNA, 11 nt, Salmonella enterica enterica serovar Typhi Ty2
cgccagaugca

SEQ ID NO: 3702555 - RNA, 14 nt, Salmonella enterica enterica serovar Typhi Ty2
cgccagaugcaccg

SEQ ID NO: 3702556 - RNA, 16 nt, Salmonella enterica enterica serovar Typhi Ty2
cgccagaugucggcgg

SEQ ID NO: 3702557 - RNA, 14 nt, Salmonella enterica enterica serovar Typhi Ty2
cgccagauuaucca

SEQ ID NO: 3702558 - RNA, 18 nt, Salmonella enterica enterica serovar Typhi Ty2
cgccagauuaucggccag

SEQ ID NO: 3702559 - RNA, 23 nt, Salmonella enterica enterica serovar Typhi Ty2
cgccagauuaucggccagcgcca

SEQ ID NO: 3702560 - RNA, 17 nt, Salmonella enterica enterica serovar Typhi Ty2
cgccagauucaugauuu

SEQ ID NO: 3702561 - RNA, 21 nt, Salmonella enterica enterica serovar Typhi Ty2
cgccagcaaaauuuugcgcag

SEQ ID NO: 3702562 - RNA, 19 nt, Salmonella enterica enterica serovar Typhi Ty2
cgccagcaacagguacccc

SEQ ID NO: 3702563 - RNA, 23 nt, Salmonella enterica enterica serovar Typhi Ty2
cgccagcacauuaagcauggcgu

SEQ ID NO: 3702564 - RNA, 21 nt, Salmonella enterica enterica serovar Typhi Ty2
cgccagcaccacuacuacacc

SEQ ID NO: 3702565 - RNA, 14 nt, Salmonella enterica enterica serovar Typhi Ty2
cgccagcaccagca

SEQ ID NO: 3702566 - RNA, 15 nt, Salmonella enterica enterica serovar Typhi Ty2
cgccagcaccagcag

SEQ ID NO: 3702567 - RNA, 14 nt, Salmonella enterica enterica serovar Typhi Ty2
cgccagcaccaggc

SEQ ID NO: 3702568 - RNA, 16 nt, Salmonella enterica enterica serovar Typhi Ty2
cgccagcaccaggcuc

SEQ ID NO: 3702569 - RNA, 14 nt, Salmonella enterica enterica serovar Typhi Ty2
cgccagcagcagcg

SEQ ID NO: 3702570 - RNA, 17 nt, Salmonella enterica enterica serovar Typhi Ty2
cgccagcagcagcgcaa

SEQ ID NO: 3702571 - RNA, 15 nt, Salmonella enterica enterica serovar Typhi Ty2
cgccagcagcucgcc

SEQ ID NO: 3702572 - RNA, 23 nt, Salmonella enterica enterica serovar Typhi Ty2
cgccagcaggucgcacuccucug

SEQ ID NO: 3702573 - RNA, 16 nt, Salmonella enterica enterica serovar Typhi Ty2
cgccagcaguugcagc

SEQ ID NO: 3702574 - RNA, 17 nt, Salmonella enterica enterica serovar Typhi Ty2
cgccagcauaccgccca

SEQ ID NO: 3702575 - RNA, 21 nt, Salmonella enterica enterica serovar Typhi Ty2
cgccagccacaagagcagcaa

SEQ ID NO: 3702576 - RNA, 15 nt, Salmonella enterica enterica serovar Typhi Ty2
cgccagccagcgcca

SEQ ID NO: 3702577 - RNA, 21 nt, Salmonella enterica enterica serovar Typhi Ty2
cgccagccagcgccaccaaag

SEQ ID NO: 3702578 - RNA, 17 nt, Salmonella enterica enterica serovar Typhi Ty2
cgccagccagucgccag

SEQ ID NO: 3702579 - RNA, 14 nt, Salmonella enterica enterica serovar Typhi Ty2
cgccagccgccauu

SEQ ID NO: 3702580 - RNA, 23 nt, Salmonella enterica enterica serovar Typhi Ty2
cgccagccgcgccaucuccuccu

SEQ ID NO: 3702581 - RNA, 17 nt, Salmonella enterica enterica serovar Typhi Ty2
cgccauccggcauuuuu

SEQ ID NO: 3702582 - RNA, 14 nt, Salmonella enterica enterica serovar Typhi Ty2
cgccauccggccug

SEQ ID NO: 3702583 - RNA, 23 nt, Salmonella enterica enterica serovar Typhi Ty2
cgccauccggccuguaaggucuc

SEQ ID NO: 3702584 - RNA, 14 nt, Salmonella enterica enterica serovar Typhi Ty2
cgccauccggcgag

SEQ ID NO: 3702585 - RNA, 23 nt, Salmonella enterica enterica serovar Typhi Ty2
cgccauccggcggugcagguugc

SEQ ID NO: 3702586 - RNA, 15 nt, Salmonella enterica enterica serovar Typhi Ty2
cgccauccugcaccg

SEQ ID NO: 3702587 - RNA, 13 nt, Salmonella enterica enterica serovar Typhi Ty2
cgccauccugccg

SEQ ID NO: 3702588 - RNA, 23 nt, Salmonella enterica enterica serovar Typhi Ty2
cgccauccuuaauugccgcacgc

SEQ ID NO: 3702589 - RNA, 18 nt, Salmonella enterica enterica serovar Typhi Ty2
cgccaucgacagcgccau

SEQ ID NO: 3702590 - RNA, 22 nt, Salmonella enterica enterica serovar Typhi Ty2
cgccaucgcccggccuccggug

SEQ ID NO: 3702591 - RNA, 14 nt, Salmonella enterica enterica serovar Typhi Ty2
cgccaucgccgccu

SEQ ID NO: 3702592 - RNA, 17 nt, Salmonella enterica enterica serovar Typhi Ty2
cgccaucggcgagcggc

SEQ ID NO: 3702593 - RNA, 20 nt, Salmonella enterica enterica serovar Typhi Ty2
cgccaucggcgcguaaguuu

SEQ ID NO: 3702594 - RNA, 17 nt, Salmonella enterica enterica serovar Typhi Ty2
cgccaucguccagccau

SEQ ID NO: 3702595 - RNA, 17 nt, Salmonella enterica enterica serovar Typhi Ty2
cgccaucucacgcaugg

SEQ ID NO: 3702596 - RNA, 18 nt, Salmonella enterica enterica serovar Typhi Ty2
cgccaucucauucgccag

SEQ ID NO: 3702597 - RNA, 23 nt, Salmonella enterica enterica serovar Typhi Ty2
cgccaucucauucgccagcggau

SEQ ID NO: 3702598 - RNA, 16 nt, Salmonella enterica enterica serovar Typhi Ty2
cgccaucuccggcagc

SEQ ID NO: 3702599 - RNA, 17 nt, Salmonella enterica enterica serovar Typhi Ty2
cgccaucuccuccucau

SEQ ID NO: 3702600 - RNA, 14 nt, Salmonella enterica enterica serovar Typhi Ty2
cgccaucugugcca

SEQ ID NO: 3702601 - RNA, 16 nt, Salmonella enterica enterica serovar Typhi Ty2
cgccaucuucacgcag

SEQ ID NO: 3702602 - RNA, 18 nt, Salmonella enterica enterica serovar Typhi Ty2
cgccaucuuccgggucag

SEQ ID NO: 3702603 - RNA, 16 nt, Salmonella enterica enterica serovar Typhi Ty2
cgccaucuuucaccca

SEQ ID NO: 3702604 - RNA, 13 nt, Salmonella enterica enterica serovar Typhi Ty2
cgccaucuuucuu

SEQ ID NO: 3702605 - RNA, 22 nt, Salmonella enterica enterica serovar Typhi Ty2
cgccaugccaucggccagcagg

SEQ ID NO: 3702606 - RNA, 19 nt, Salmonella enterica enterica serovar Typhi Ty2
cgccaugcggaaucacgca

SEQ ID NO: 3702607 - RNA, 13 nt, Salmonella enterica enterica serovar Typhi Ty2
cgccaugcggcgc

SEQ ID NO: 3702608 - RNA, 15 nt, Salmonella enterica enterica serovar Typhi Ty2
cgccauggccgcagc

SEQ ID NO: 3702609 - RNA, 15 nt, Salmonella enterica enterica serovar Typhi Ty2
cgccauuccgcagaa

SEQ ID NO: 3702610 - RNA, 18 nt, Salmonella enterica enterica serovar Typhi Ty2
cgccauuccugccgccgc

SEQ ID NO: 3702611 - RNA, 22 nt, Salmonella enterica enterica serovar Typhi Ty2
cgccauucgcuuccgccgggaa

SEQ ID NO: 3702612 - RNA, 18 nt, Salmonella enterica enterica serovar Typhi Ty2
cgccauucucuucuacca

SEQ ID NO: 3702613 - RNA, 21 nt, Salmonella enterica enterica serovar Typhi Ty2
cgccauugaucauuggggaac

SEQ ID NO: 3702614 - RNA, 23 nt, Salmonella enterica enterica serovar Typhi Ty2
cgccauuggcucggcgucauccc

SEQ ID NO: 3702615 - RNA, 16 nt, Salmonella enterica enterica serovar Typhi Ty2
cgccauuuagcgccga

SEQ ID NO: 3702616 - RNA, 13 nt, Salmonella enterica enterica serovar Typhi Ty2
cgccauuuccagc

SEQ ID NO: 3702617 - RNA, 16 nt, Salmonella enterica enterica serovar Typhi Ty2
cgccauuuccagcccc

SEQ ID NO: 3702618 - RNA, 16 nt, Salmonella enterica enterica serovar Typhi Ty2
cgccauuugccagaua

SEQ ID NO: 3702619 - RNA, 14 nt, Salmonella enterica enterica serovar Typhi Ty2
cgcccaaccagccc

SEQ ID NO: 3702620 - RNA, 13 nt, Salmonella enterica enterica serovar Typhi Ty2
cgcccaacgacca

SEQ ID NO: 3702621 - RNA, 18 nt, Salmonella enterica enterica serovar Typhi Ty2
cgcccaacggaugcgcca

SEQ ID NO: 3702622 - RNA, 17 nt, Salmonella enterica enterica serovar Typhi Ty2
cgcccacaaugacagaa

SEQ ID NO: 3702623 - RNA, 15 nt, Salmonella enterica enterica serovar Typhi Ty2
cgcccacaucuguuu

SEQ ID NO: 3702624 - RNA, 21 nt, Salmonella enterica enterica serovar Typhi Ty2
cgcccaccgccaaccgcccgu

SEQ ID NO: 3702625 - RNA, 14 nt, Salmonella enterica enterica serovar Typhi Ty2
cgcccacgccgcgc

SEQ ID NO: 3702626 - RNA, 19 nt, Salmonella enterica enterica serovar Typhi Ty2
cgcccacgcggcgugcgcu

SEQ ID NO: 3702627 - RNA, 14 nt, Salmonella enterica enterica serovar Typhi Ty2
cgcccagaacggca

SEQ ID NO: 3702628 - RNA, 17 nt, Salmonella enterica enterica serovar Typhi Ty2
cgcccagauauccgcgc

SEQ ID NO: 3702629 - RNA, 16 nt, Salmonella enterica enterica serovar Typhi Ty2
cgcccagaucaggccc

SEQ ID NO: 3702630 - RNA, 16 nt, Salmonella enterica enterica serovar Typhi Ty2
cgcccagaucgaccuc

SEQ ID NO: 3702631 - RNA, 17 nt, Salmonella enterica enterica serovar Typhi Ty2
cgcccagcacuaacagc

SEQ ID NO: 3702632 - RNA, 11 nt, Salmonella enterica enterica serovar Typhi Ty2
cgcccagcagc

SEQ ID NO: 3702633 - RNA, 15 nt, Salmonella enterica enterica serovar Typhi Ty2
cgcccagcaugggca

SEQ ID NO: 3702634 - RNA, 13 nt, Salmonella enterica enterica serovar Typhi Ty2
cgcccagccaaag

SEQ ID NO: 3702635 - RNA, 14 nt, Salmonella enterica enterica serovar Typhi Ty2
cgcccagccaaagc

SEQ ID NO: 3702636 - RNA, 12 nt, Salmonella enterica enterica serovar Typhi Ty2
cgcccagcgccg

SEQ ID NO: 3702637 - RNA, 14 nt, Salmonella enterica enterica serovar Typhi Ty2
cgcccaggcgggua

SEQ ID NO: 3702638 - RNA, 15 nt, Salmonella enterica enterica serovar Typhi Ty2
cgcccaguaccagca

SEQ ID NO: 3702639 - RNA, 12 nt, Salmonella enterica enterica serovar Typhi Ty2
cgcccagucacg

SEQ ID NO: 3702640 - RNA, 15 nt, Salmonella enterica enterica serovar Typhi Ty2
cgcccauaaucacca

SEQ ID NO: 3702641 - RNA, 12 nt, Salmonella enterica enterica serovar Typhi Ty2
cgcccaucgcca

SEQ ID NO: 3702642 - RNA, 16 nt, Salmonella enterica enterica serovar Typhi Ty2
cgcccaucgccacagc

SEQ ID NO: 3702643 - RNA, 21 nt, Salmonella enterica enterica serovar Typhi Ty2
cgcccauuaauaucagcccca

SEQ ID NO: 3702644 - RNA, 21 nt, Salmonella enterica enterica serovar Typhi Ty2
cgcccauuagcauuccgcccg

SEQ ID NO: 3702645 - RNA, 16 nt, Salmonella enterica enterica serovar Typhi Ty2
cgcccauuaugccgca

SEQ ID NO: 3702646 - RNA, 14 nt, Salmonella enterica enterica serovar Typhi Ty2
cgcccauuccgccu

SEQ ID NO: 3702647 - RNA, 17 nt, Salmonella enterica enterica serovar Typhi Ty2
cgcccauuccgccugcc

SEQ ID NO: 3702648 - RNA, 15 nt, Salmonella enterica enterica serovar Typhi Ty2
cgccccaaagcgcau

SEQ ID NO: 3702649 - RNA, 14 nt, Salmonella enterica enterica serovar Typhi Ty2
cgccccaaucgcca

SEQ ID NO: 3702650 - RNA, 15 nt, Salmonella enterica enterica serovar Typhi Ty2
cgccccaaucgccag

SEQ ID NO: 3702651 - RNA, 21 nt, Salmonella enterica enterica serovar Typhi Ty2
cgccccacuuucaccuccgcu

SEQ ID NO: 3702652 - RNA, 22 nt, Salmonella enterica enterica serovar Typhi Ty2
cgccccagaagagcgagucuuu

SEQ ID NO: 3702653 - RNA, 21 nt, Salmonella enterica enterica serovar Typhi Ty2
cgccccagcaugagccagccc

SEQ ID NO: 3702654 - RNA, 22 nt, Salmonella enterica enterica serovar Typhi Ty2
cgcccccaugccgccugccgcg

SEQ ID NO: 3702655 - RNA, 14 nt, Salmonella enterica enterica serovar Typhi Ty2
cgcccccugccagc

SEQ ID NO: 3702656 - RNA, 18 nt, Salmonella enterica enterica serovar Typhi Ty2
cgccccgccgcgcggccc

SEQ ID NO: 3702657 - RNA, 14 nt, Salmonella enterica enterica serovar Typhi Ty2
cgccccgcuucccg

SEQ ID NO: 3702658 - RNA, 15 nt, Salmonella enterica enterica serovar Typhi Ty2
cgcccgaccacgccc

SEQ ID NO: 3702659 - RNA, 19 nt, Salmonella enterica enterica serovar Typhi Ty2
cgcccgauaauaucacucc

SEQ ID NO: 3702660 - RNA, 22 nt, Salmonella enterica enterica serovar Typhi Ty2
cgcccgauaauaucacucccgc

SEQ ID NO: 3702661 - RNA, 14 nt, Salmonella enterica enterica serovar Typhi Ty2
cgcccgcauucgcg

SEQ ID NO: 3702662 - RNA, 14 nt, Salmonella enterica enterica serovar Typhi Ty2
cgcccgccaccagc

SEQ ID NO: 3702663 - RNA, 11 nt, Salmonella enterica enterica serovar Typhi Ty2
cgcccgccaga

SEQ ID NO: 3702664 - RNA, 21 nt, Salmonella enterica enterica serovar Typhi Ty2
cgccgccaccauguugcgcag

SEQ ID NO: 3702665 - RNA, 22 nt, Salmonella enterica enterica serovar Typhi Ty2
cgccgccaccauguugcgcagc

SEQ ID NO: 3702666 - RNA, 18 nt, Salmonella enterica enterica serovar Typhi Ty2
cgccgccagauuauccag

SEQ ID NO: 3702667 - RNA, 12 nt, Salmonella enterica enterica serovar Typhi Ty2
cgccgccagcac

SEQ ID NO: 3702668 - RNA, 13 nt, Salmonella enterica enterica serovar Typhi Ty2
cgccgccagccga

SEQ ID NO: 3702669 - RNA, 13 nt, Salmonella enterica enterica serovar Typhi Ty2
cgccgccagcuca

SEQ ID NO: 3702670 - RNA, 13 nt, Salmonella enterica enterica serovar Typhi Ty2
cgccgccaggucu

SEQ ID NO: 3702671 - RNA, 14 nt, Salmonella enterica enterica serovar Typhi Ty2
cgccgccaggucuu

SEQ ID NO: 3702672 - RNA, 18 nt, Salmonella enterica enterica serovar Typhi Ty2
cgccgccauccgacaacc

SEQ ID NO: 3702673 - RNA, 17 nt, Salmonella enterica enterica serovar Typhi Ty2
cgccgccauccggcaca

SEQ ID NO: 3702674 - RNA, 18 nt, Salmonella enterica enterica serovar Typhi Ty2
cgccgccauccggcauca

SEQ ID NO: 3702675 - RNA, 22 nt, Salmonella enterica enterica serovar Typhi Ty2
cgccgccauuuuauccaggcca

SEQ ID NO: 3702676 - RNA, 20 nt, Salmonella enterica enterica serovar Typhi Ty2
cgccgcccaacgcggcuuua

SEQ ID NO: 3702677 - RNA, 23 nt, Salmonella enterica enterica serovar Typhi Ty2
cgccgcccaucgggccgcucagc

SEQ ID NO: 3702678 - RNA, 14 nt, Salmonella enterica enterica serovar Typhi Ty2
cgccgcccgcaugg

SEQ ID NO: 3702679 - RNA, 15 nt, Salmonella enterica enterica serovar Typhi Ty2
cgccgccgaacagac

SEQ ID NO: 3702680 - RNA, 14 nt, Salmonella enterica enterica serovar Typhi Ty2
cgccgccgcccaga

SEQ ID NO: 3702681 - RNA, 16 nt, Salmonella enterica enterica serovar Typhi Ty2
cgccgccgcgaccgcu

SEQ ID NO: 3702682 - RNA, 13 nt, Salmonella enterica enterica serovar Typhi Ty2
cgccgccgggccg

SEQ ID NO: 3702683 - RNA, 16 nt, Salmonella enterica enterica serovar Typhi Ty2
cgccgccuaucgccag

SEQ ID NO: 3702684 - RNA, 15 nt, Salmonella enterica enterica serovar Typhi Ty2
cgccgccucccccuc

SEQ ID NO: 3702685 - RNA, 21 nt, Salmonella enterica enterica serovar Typhi Ty2
cgccgccucgcgauccgccag

SEQ ID NO: 3702686 - RNA, 20 nt, Salmonella enterica enterica serovar Typhi Ty2
cgccgccucuucaaacggca

SEQ ID NO: 3702687 - RNA, 17 nt, Salmonella enterica enterica serovar Typhi Ty2
cgccgccugcgccaacg

SEQ ID NO: 3702688 - RNA, 20 nt, Salmonella enterica enterica serovar Typhi Ty2
cgccgcgaagcguuccgcca

SEQ ID NO: 3702689 - RNA, 17 nt, Salmonella enterica enterica serovar Typhi Ty2
cgccgcgaugcaucuug

SEQ ID NO: 3702690 - RNA, 20 nt, Salmonella enterica enterica serovar Typhi Ty2
cgccgcgauguuugcucgcc

SEQ ID NO: 3702691 - RNA, 13 nt, Salmonella enterica enterica serovar Typhi Ty2
cgccgcgccgaua

SEQ ID NO: 3702692 - RNA, 22 nt, Salmonella enterica enterica serovar Typhi Ty2
cgccgcggcgguuauccuccgg

SEQ ID NO: 3702693 - RNA, 22 nt, Salmonella enterica enterica serovar Typhi Ty2
cgccgcguaaauccacauucca

SEQ ID NO: 3702694 - RNA, 21 nt, Salmonella enterica enterica serovar Typhi Ty2
cgccgcguaaucuucgcggcu

SEQ ID NO: 3702695 - RNA, 16 nt, Salmonella enterica enterica serovar Typhi Ty2
cgccgcguucgcacca

SEQ ID NO: 3702696 - RNA, 17 nt, Salmonella enterica enterica serovar Typhi Ty2
cgccgcguuucucgccg

SEQ ID NO: 3702697 - RNA, 17 nt, Salmonella enterica enterica serovar Typhi Ty2
cgccgcuacugccgcca

SEQ ID NO: 3702698 - RNA, 15 nt, Salmonella enterica enterica serovar Typhi Ty2
cgccgcuaucgacca

SEQ ID NO: 3702699 - RNA, 19 nt, Salmonella enterica enterica serovar Typhi Ty2
cgccgcuaucgaccagcac

SEQ ID NO: 3702700 - RNA, 14 nt, Salmonella enterica enterica serovar Typhi Ty2
cgccgcuccacagc

SEQ ID NO: 3702701 - RNA, 23 nt, Salmonella enterica enterica serovar Typhi Ty2
cgccgcuggcgcuuugccguucu

SEQ ID NO: 3702702 - RNA, 14 nt, Salmonella enterica enterica serovar Typhi Ty2
cgccgcuggcggaa

SEQ ID NO: 3702703 - RNA, 13 nt, Salmonella enterica enterica serovar Typhi Ty2
cgccgcuggcggg

SEQ ID NO: 3702704 - RNA, 22 nt, Salmonella enterica enterica serovar Typhi Ty2
cgccgcuggcuggccagggcau

SEQ ID NO: 3702705 - RNA, 21 nt, Salmonella enterica enterica serovar Typhi Ty2
cgccgcuggucaacacgcggu

SEQ ID NO: 3702706 - RNA, 19 nt, Salmonella enterica enterica serovar Typhi Ty2
cgccgcuguuuucacucuu

SEQ ID NO: 3702707 - RNA, 13 nt, Salmonella enterica enterica serovar Typhi Ty2
cgccgcuuccccc

SEQ ID NO: 3702708 - RNA, 14 nt, Salmonella enterica enterica serovar Typhi Ty2
cgccgcuuccggca

SEQ ID NO: 3702709 - RNA, 20 nt, Salmonella enterica enterica serovar Typhi Ty2
cgccgcuuuaaucaccaugg

SEQ ID NO: 3702710 - RNA, 17 nt, Salmonella enterica enterica serovar Typhi Ty2
cgccgcuuuucaggggu

SEQ ID NO: 3702711 - RNA, 19 nt, Salmonella enterica enterica serovar Typhi Ty2
cgccgcuuuucaggggucc

SEQ ID NO: 3702712 - RNA, 20 nt, Salmonella enterica enterica serovar Typhi Ty2
cgccgcuuuuuucagcggca

SEQ ID NO: 3702713 - RNA, 22 nt, Salmonella enterica enterica serovar Typhi Ty2
cgccgcuuuuuucagcggcagc

SEQ ID NO: 3702714 - RNA, 19 nt, Salmonella enterica enterica serovar Typhi Ty2
cgccggaaaaaaugggcug

SEQ ID NO: 3702715 - RNA, 22 nt, Salmonella enterica enterica serovar Typhi Ty2
cgccggaaagaaacgccgcgca

SEQ ID NO: 3702716 - RNA, 22 nt, Salmonella enterica enterica serovar Typhi Ty2
cgccggaaagaauaaucgccgc

SEQ ID NO: 3702717 - RNA, 18 nt, Salmonella enterica enterica serovar Typhi Ty2
cgccggaaagcuggucga

SEQ ID NO: 3702718 - RNA, 15 nt, Salmonella enterica enterica serovar Typhi Ty2
cgccggaaauuugca

SEQ ID NO: 3702719 - RNA, 19 nt, Salmonella enterica enterica serovar Typhi Ty2
cgccggaaggcgaaaacau

SEQ ID NO: 3702720 - RNA, 20 nt, Salmonella enterica enterica serovar Typhi Ty2
cgccggaugaggacauaaac

SEQ ID NO: 3702721 - RNA, 18 nt, Salmonella enterica enterica serovar Typhi Ty2
cgccggauuuaccagcgc

SEQ ID NO: 3702722 - RNA, 20 nt, Salmonella enterica enterica serovar Typhi Ty2
cgccggcaaagguugccgca

SEQ ID NO: 3702723 - RNA, 17 nt, Salmonella enterica enterica serovar Typhi Ty2
cgccggcaacacccgcc

SEQ ID NO: 3702724 - RNA, 16 nt, Salmonella enterica enterica serovar Typhi Ty2
cgccggccccgcuucc

SEQ ID NO: 3702725 - RNA, 18 nt, Salmonella enterica enterica serovar Typhi Ty2
cgccggccugacgaccgu

SEQ ID NO: 3702726 - RNA, 18 nt, Salmonella enterica enterica serovar Typhi Ty2
cgccggcugcgcugccag

SEQ ID NO: 3702727 - RNA, 17 nt, Salmonella enterica enterica serovar Typhi Ty2
cgccgggauauuuccgc

SEQ ID NO: 3702728 - RNA, 17 nt, Salmonella enterica enterica serovar Typhi Ty2
cgccgggaugcuuuccg

SEQ ID NO: 3702729 - RNA, 23 nt, Salmonella enterica enterica serovar Typhi Ty2
cgccgggcgucacccgccggcag

SEQ ID NO: 3702730 - RNA, 15 nt, Salmonella enterica enterica serovar Typhi Ty2
cgccgguacgcagca

SEQ ID NO: 3702731 - RNA, 17 nt, Salmonella enterica enterica serovar Typhi Ty2
cgccgguagccagccaa

SEQ ID NO: 3702732 - RNA, 16 nt, Salmonella enterica enterica serovar Typhi Ty2
cgccgguauagcgccu

SEQ ID NO: 3702733 - RNA, 15 nt, Salmonella enterica enterica serovar Typhi Ty2
cgccggucgccagca

SEQ ID NO: 3702734 - RNA, 17 nt, Salmonella enterica enterica serovar Typhi Ty2
cgccggugacggcggaa

SEQ ID NO: 3702735 - RNA, 17 nt, Salmonella enterica enterica serovar Typhi Ty2
cgccggugaucccacca

SEQ ID NO: 3702736 - RNA, 19 nt, Salmonella enterica enterica serovar Typhi Ty2
cgccggugccugccgccuc

SEQ ID NO: 3702737 - RNA, 22 nt, Salmonella enterica enterica serovar Typhi Ty2
cgccgguguuuccgucacuucc

SEQ ID NO: 3702738 - RNA, 13 nt, Salmonella enterica enterica serovar Typhi Ty2
cgccgguuuaucc

SEQ ID NO: 3702739 - RNA, 20 nt, Salmonella enterica enterica serovar Typhi Ty2
cgccgguuucuccagccucg

SEQ ID NO: 3702740 - RNA, 22 nt, Salmonella enterica enterica serovar Typhi Ty2
cgccguaaaacaacagcggcgu

SEQ ID NO: 3702741 - RNA, 15 nt, Salmonella enterica enterica serovar Typhi Ty2
cgccguaacgaacgc

SEQ ID NO: 3702742 - RNA, 21 nt, Salmonella enterica enterica serovar Typhi Ty2
cgccguacuugacacaggcgu

SEQ ID NO: 3702743 - RNA, 16 nt, Salmonella enterica enterica serovar Typhi Ty2
cgccguagcugcgcgc

SEQ ID NO: 3702744 - RNA, 20 nt, Salmonella enterica enterica serovar Typhi Ty2
cgccgucacaaagcccaccg

SEQ ID NO: 3702745 - RNA, 13 nt, Salmonella enterica enterica serovar Typhi Ty2
cgccgucaggcua

SEQ ID NO: 3702746 - RNA, 15 nt, Salmonella enterica enterica serovar Typhi Ty2
cgccuucuucaccca

SEQ ID NO: 3702747 - RNA, 14 nt, Salmonella enterica enterica serovar Typhi Ty2
cgccuucuucaucu

SEQ ID NO: 3702748 - RNA, 16 nt, Salmonella enterica enterica serovar Typhi Ty2
cgccuucuucaucuuc

SEQ ID NO: 3702749 - RNA, 15 nt, Salmonella enterica enterica serovar Typhi Ty2
cgccuugcggcggcg

SEQ ID NO: 3702750 - RNA, 18 nt, Salmonella enterica enterica serovar Typhi Ty2
cgccuugcggcggcguuu

SEQ ID NO: 3702751 - RNA, 22 nt, Salmonella enterica enterica serovar Typhi Ty2
cgccuuuaauuccgccgggcaa

SEQ ID NO: 3702752 - RNA, 14 nt, Salmonella enterica enterica serovar Typhi Ty2
cgccuuuaucgaca

SEQ ID NO: 3702753 - RNA, 15 nt, Salmonella enterica enterica serovar Typhi Ty2
cgccuuucagauggu

SEQ ID NO: 3702754 - RNA, 17 nt, Salmonella enterica enterica serovar Typhi Ty2
cgccuuucuccaugguc

SEQ ID NO: 3702755 - RNA, 23 nt, Salmonella enterica enterica serovar Typhi Ty2
cgccuuugcgaauggccuccagc

SEQ ID NO: 3702756 - RNA, 13 nt, Salmonella enterica enterica serovar Typhi Ty2
cgcgaaaaaagau

SEQ ID NO: 3702757 - RNA, 23 nt, Salmonella enterica enterica serovar Typhi Ty2
cgcgaaaauaccccagcgcgccg

SEQ ID NO: 3702758 - RNA, 15 nt, Salmonella enterica enterica serovar Typhi Ty2
cgcgaaacaggucgg

SEQ ID NO: 3702759 - RNA, 18 nt, Salmonella enterica enterica serovar Typhi Ty2
cgcgaaacugcugccgca

SEQ ID NO: 3702760 - RNA, 22 nt, Salmonella enterica enterica serovar Typhi Ty2
cgcgaaaucaaagaccuccgcc

SEQ ID NO: 3702761 - RNA, 19 nt, Salmonella enterica enterica serovar Typhi Ty2
cgcgaacauuacauccuca

SEQ ID NO: 3702762 - RNA, 14 nt, Salmonella enterica enterica serovar Typhi Ty2
cgcgaagcggcgcu

SEQ ID NO: 3702763 - RNA, 16 nt, Salmonella enterica enterica serovar Typhi Ty2
cgcgaagugccagguu

SEQ ID NO: 3702764 - RNA, 16 nt, Salmonella enterica enterica serovar Typhi Ty2
cgcgaauaaucuguuu

SEQ ID NO: 3702765 - RNA, 15 nt, Salmonella enterica enterica serovar Typhi Ty2
cgcgaauaauuauuu

SEQ ID NO: 3702766 - RNA, 15 nt, Salmonella enterica enterica serovar Typhi Ty2
cgcgaauagccagac

SEQ ID NO: 3702767 - RNA, 20 nt, Salmonella enterica enterica serovar Typhi Ty2
cgcgaauagccagacagccc

SEQ ID NO: 3702768 - RNA, 18 nt, Salmonella enterica enterica serovar Typhi Ty2
cgcgaauaguggcgcgcc

SEQ ID NO: 3702769 - RNA, 19 nt, Salmonella enterica enterica serovar Typhi Ty2
cgcgaauaguggcgcgcca

SEQ ID NO: 3702770 - RNA, 21 nt, Salmonella enterica enterica serovar Typhi Ty2
cgcgaaucgacaauccgccac

SEQ ID NO: 3702771 - RNA, 18 nt, Salmonella enterica enterica serovar Typhi Ty2
cgcgaaucgcuucacggc

SEQ ID NO: 3702772 - RNA, 18 nt, Salmonella enterica enterica serovar Typhi Ty2
cgcgaauuucaaucgcca

SEQ ID NO: 3702773 - RNA, 18 nt, Salmonella enterica enterica serovar Typhi Ty2
cgcgaauuucacgcagca

SEQ ID NO: 3702774 - RNA, 17 nt, Salmonella enterica enterica serovar Typhi Ty2
cgcgacaaaaagcgcgc

SEQ ID NO: 3702775 - RNA, 14 nt, Salmonella enterica enterica serovar Typhi Ty2
cgcgacaacgccgg

SEQ ID NO: 3702776 - RNA, 21 nt, Salmonella enterica enterica serovar Typhi Ty2
cgcgacaacgccggaccagac

SEQ ID NO: 3702777 - RNA, 16 nt, Salmonella enterica enterica serovar Typhi Ty2
cgcgacaaggccgaua

SEQ ID NO: 3702778 - RNA, 22 nt, Salmonella enterica enterica serovar Typhi Ty2
cgcgacaucguuuccagcgaau

SEQ ID NO: 3702779 - RNA, 12 nt, Salmonella enterica enterica serovar Typhi Ty2
cgcgaccagcag

SEQ ID NO: 3702780 - RNA, 16 nt, Salmonella enterica enterica serovar Typhi Ty2
cgcgaccagcgcgcca

SEQ ID NO: 3702781 - RNA, 18 nt, Salmonella enterica enterica serovar Typhi Ty2
cgcgaccagcgcgccaaa

SEQ ID NO: 3702782 - RNA, 15 nt, Salmonella enterica enterica serovar Typhi Ty2
cgcgacccagcgcau

SEQ ID NO: 3702783 - RNA, 16 nt, Salmonella enterica enterica serovar Typhi Ty2
cgcgacgaugcgcauu

SEQ ID NO: 3702784 - RNA, 19 nt, Salmonella enterica enterica serovar Typhi Ty2
cgcgacgcgccagccagcg

SEQ ID NO: 3702785 - RNA, 20 nt, Salmonella enterica enterica serovar Typhi Ty2
cgcgacgcuuaucagcccua

SEQ ID NO: 3702786 - RNA, 13 nt, Salmonella enterica enterica serovar Typhi Ty2
cgcgacggcagcc

SEQ ID NO: 3702787 - RNA, 18 nt, Salmonella enterica enterica serovar Typhi Ty2
cgcgacgggaaggaaauu

SEQ ID NO: 3702788 - RNA, 21 nt, Salmonella enterica enterica serovar Typhi Ty2
cgcgacgggaaggaaauucag

SEQ ID NO: 3702789 - RNA, 21 nt, Salmonella enterica enterica serovar Typhi Ty2
cgcgacgggcggcgacagaga

SEQ ID NO: 3702790 - RNA, 14 nt, Salmonella enterica enterica serovar Typhi Ty2
cgcgacguccgcca

SEQ ID NO: 3702791 - RNA, 19 nt, Salmonella enterica enterica serovar Typhi Ty2
cgcgacucccaggcgcgca

SEQ ID NO: 3702792 - RNA, 19 nt, Salmonella enterica enterica serovar Typhi Ty2
cgcgacuuuggcuuuaucc

SEQ ID NO: 3702793 - RNA, 18 nt, Salmonella enterica enterica serovar Typhi Ty2
cgcgacuuuuuucaccca

SEQ ID NO: 3702794 - RNA, 14 nt, Salmonella enterica enterica serovar Typhi Ty2
cgcgagaacugcug

SEQ ID NO: 3702795 - RNA, 16 nt, Salmonella enterica enterica serovar Typhi Ty2
cgcgagaacugcugca

SEQ ID NO: 3702796 - RNA, 20 nt, Salmonella enterica enterica serovar Typhi Ty2
cgcgagaagaagaauuauua

SEQ ID NO: 3702797 - RNA, 21 nt, Salmonella enterica enterica serovar Typhi Ty2
cgcgagccuuuuaucaaugca

SEQ ID NO: 3702798 - RNA, 17 nt, Salmonella enterica enterica serovar Typhi Ty2
cgcgagcgugaucucau

SEQ ID NO: 3702799 - RNA, 17 nt, Salmonella enterica enterica serovar Typhi Ty2
cgcgaguauucgcgccc

SEQ ID NO: 3702800 - RNA, 22 nt, Salmonella enterica enterica serovar Typhi Ty2
cgcgaguguaaagauuaauaau

SEQ ID NO: 3702801 - RNA, 18 nt, Salmonella enterica enterica serovar Typhi Ty2
cgcgagugucauccugcg

SEQ ID NO: 3702802 - RNA, 18 nt, Salmonella enterica enterica serovar Typhi Ty2
cgcgauaaauucaaugag

SEQ ID NO: 3702803 - RNA, 19 nt, Salmonella enterica enterica serovar Typhi Ty2
cgcgauaacguuaccgcag

SEQ ID NO: 3702804 - RNA, 23 nt, Salmonella enterica enterica serovar Typhi Ty2
cgcgauaauaauuaccacgcagc

SEQ ID NO: 3702805 - RNA, 20 nt, Salmonella enterica enterica serovar Typhi Ty2
cgcgauacacuccggcgcgc

SEQ ID NO: 3702806 - RNA, 17 nt, Salmonella enterica enterica serovar Typhi Ty2
cgcgauacccgcgauca

SEQ ID NO: 3702807 - RNA, 21 nt, Salmonella enterica enterica serovar Typhi Ty2
cgcgauacccgcgaucacuac

SEQ ID NO: 3702808 - RNA, 21 nt, Salmonella enterica enterica serovar Typhi Ty2
cgcgauaccgccguagaaaau

SEQ ID NO: 3702809 - RNA, 15 nt, Salmonella enterica enterica serovar Typhi Ty2
cgcgauacgcagcac

SEQ ID NO: 3702810 - RNA, 23 nt, Salmonella enterica enterica serovar Typhi Ty2
cgcgauacgcagcaccgccgcga

SEQ ID NO: 3702811 - RNA, 15 nt, Salmonella enterica enterica serovar Typhi Ty2
cgcgauauccaccac

SEQ ID NO: 3702812 - RNA, 18 nt, Salmonella enterica enterica serovar Typhi Ty2
cgcgauaugucucuccag

SEQ ID NO: 3702813 - RNA, 17 nt, Salmonella enterica enterica serovar Typhi Ty2
cgcgaucaaucacgccg

SEQ ID NO: 3702814 - RNA, 21 nt, Salmonella enterica enterica serovar Typhi Ty2
cgcgaucaaucacgccgauaa

SEQ ID NO: 3702815 - RNA, 19 nt, Salmonella enterica enterica serovar Typhi Ty2
cgcgaucacagacagaugc

SEQ ID NO: 3702816 - RNA, 21 nt, Salmonella enterica enterica serovar Typhi Ty2
cgcgauccagccccagcgcca

SEQ ID NO: 3702817 - RNA, 12 nt, Salmonella enterica enterica serovar Typhi Ty2
cgcgauccgcca

SEQ ID NO: 3702818 - RNA, 19 nt, Salmonella enterica enterica serovar Typhi Ty2
cgcgaucgaugugauaaau

SEQ ID NO: 3702819 - RNA, 17 nt, Salmonella enterica enterica serovar Typhi Ty2
cgcgaucgccccgacca

SEQ ID NO: 3702820 - RNA, 13 nt, Salmonella enterica enterica serovar Typhi Ty2
cgcgaucgcgcca

SEQ ID NO: 3702821 - RNA, 17 nt, Salmonella enterica enterica serovar Typhi Ty2
cgcgaucgcgccagccu

SEQ ID NO: 3702822 - RNA, 16 nt, Salmonella enterica enterica serovar Typhi Ty2
cgcgaugccuggcgau

SEQ ID NO: 3702823 - RNA, 11 nt, Salmonella enterica enterica serovar Typhi Ty2
cgcgaugcugc

SEQ ID NO: 3702824 - RNA, 14 nt, Salmonella enterica enterica serovar Typhi Ty2
cgcgauggcgucac

SEQ ID NO: 3702825 - RNA, 23 nt, Salmonella enterica enterica serovar Typhi Ty2
cgcgauuuuuuuccgcccgccuu

SEQ ID NO: 3702826 - RNA, 20 nt, Salmonella enterica enterica serovar Typhi Ty2
cgcgcaaaacucucaccgac

SEQ ID NO: 3702827 - RNA, 18 nt, Salmonella enterica enterica serovar Typhi Ty2
cgcgcaaagccuuuccgc

SEQ ID NO: 3702828 - RNA, 19 nt, Salmonella enterica enterica serovar Typhi Ty2
cgcgcuaauuuucagggug

SEQ ID NO: 3702829 - RNA, 21 nt, Salmonella enterica enterica serovar Typhi Ty2
cgcgcuagugccgccaggcaa

SEQ ID NO: 3702830 - RNA, 23 nt, Salmonella enterica enterica serovar Typhi Ty2
cgcgcuagugccgccaggcaaau

SEQ ID NO: 3702831 - RNA, 16 nt, Salmonella enterica enterica serovar Typhi Ty2
cgcgcuauuccaguuu

SEQ ID NO: 3702832 - RNA, 19 nt, Salmonella enterica enterica serovar Typhi Ty2
cgcgcucaaauggucccug

SEQ ID NO: 3702833 - RNA, 11 nt, Salmonella enterica enterica serovar Typhi Ty2
cgcgcucgcca

SEQ ID NO: 3702834 - RNA, 13 nt, Salmonella enterica enterica serovar Typhi Ty2
cgcgcucgccagc

SEQ ID NO: 3702835 - RNA, 16 nt, Salmonella enterica enterica serovar Typhi Ty2
cgcgcucgccagcgcu

SEQ ID NO: 3702836 - RNA, 16 nt, Salmonella enterica enterica serovar Typhi Ty2
cgcgcucuuccgccag

SEQ ID NO: 3702837 - RNA, 21 nt, Salmonella enterica enterica serovar Typhi Ty2
cgcgcucuuccgccagcgcca

SEQ ID NO: 3702838 - RNA, 14 nt, Salmonella enterica enterica serovar Typhi Ty2
cgcgcugaucgcca

SEQ ID NO: 3702839 - RNA, 14 nt, Salmonella enterica enterica serovar Typhi Ty2
cgcgcugaugguuu

SEQ ID NO: 3702840 - RNA, 15 nt, Salmonella enterica enterica serovar Typhi Ty2
cgcgcugccgcccuu

SEQ ID NO: 3702841 - RNA, 23 nt, Salmonella enterica enterica serovar Typhi Ty2
cgcgcugcggcggcggaaaauag

SEQ ID NO: 3702842 - RNA, 20 nt, Salmonella enterica enterica serovar Typhi Ty2
cgcgcugcggcgucugccuu

SEQ ID NO: 3702843 - RNA, 17 nt, Salmonella enterica enterica serovar Typhi Ty2
cgcgcugcugcggcguu

SEQ ID NO: 3702844 - RNA, 15 nt, Salmonella enterica enterica serovar Typhi Ty2
cgcgcuggaucagau

SEQ ID NO: 3702845 - RNA, 12 nt, Salmonella enterica enterica serovar Typhi Ty2
cgcgcuggcaag

SEQ ID NO: 3702846 - RNA, 19 nt, Salmonella enterica enterica serovar Typhi Ty2
cgcgcuggcaagcgccagc

SEQ ID NO: 3702847 - RNA, 12 nt, Salmonella enterica enterica serovar Typhi Ty2
cgcgcuggcaau

SEQ ID NO: 3702848 - RNA, 12 nt, Salmonella enterica enterica serovar Typhi Ty2
cgcgcuggcuga

SEQ ID NO: 3702849 - RNA, 20 nt, Salmonella enterica enterica serovar Typhi Ty2
cgcgcuggugggacuguuca

SEQ ID NO: 3702850 - RNA, 17 nt, Salmonella enterica enterica serovar Typhi Ty2
cgcgcuguauaaucccg

SEQ ID NO: 3702851 - RNA, 16 nt, Salmonella enterica enterica serovar Typhi Ty2
cgcgcuguaucacuuu

SEQ ID NO: 3702852 - RNA, 16 nt, Salmonella enterica enterica serovar Typhi Ty2
cgcgcugucugccggc

SEQ ID NO: 3702853 - RNA, 22 nt, Salmonella enterica enterica serovar Typhi Ty2
cgcgcuguuuauccacaggcga

SEQ ID NO: 3702854 - RNA, 15 nt, Salmonella enterica enterica serovar Typhi Ty2
cgcgcuuccugccag

SEQ ID NO: 3702855 - RNA, 24 nt, Salmonella enterica enterica serovar Typhi Ty2
cgcgcuuuagggcuuccucgccac

SEQ ID NO: 3702856 - RNA, 17 nt, Salmonella enterica enterica serovar Typhi Ty2
cgcgcuuucuggcgcag

SEQ ID NO: 3702857 - RNA, 19 nt, Salmonella enterica enterica serovar Typhi Ty2
cgcgcuuuucgccagcgca

SEQ ID NO: 3702858 - RNA, 19 nt, Salmonella enterica enterica serovar Typhi Ty2
cgcggaagaaauagaacag

SEQ ID NO: 3702859 - RNA, 14 nt, Salmonella enterica enterica serovar Typhi Ty2
cgcggaagccacgu

SEQ ID NO: 3702860 - RNA, 18 nt, Salmonella enterica enterica serovar Typhi Ty2
cgcggaagcgaccggcgu

SEQ ID NO: 3702861 - RNA, 20 nt, Salmonella enterica enterica serovar Typhi Ty2
cgcggaagcgaccggcguca

SEQ ID NO: 3702862 - RNA, 13 nt, Salmonella enterica enterica serovar Typhi Ty2
cgcggaaucguca

SEQ ID NO: 3702863 - RNA, 23 nt, Salmonella enterica enterica serovar Typhi Ty2
cgcggaaucgucacagaccccgc

SEQ ID NO: 3702864 - RNA, 16 nt, Salmonella enterica enterica serovar Typhi Ty2
cgcggaauuucaggaa

SEQ ID NO: 3702865 - RNA, 23 nt, Salmonella enterica enterica serovar Typhi Ty2
cgcggaccguguucaugcagcca

SEQ ID NO: 3702866 - RNA, 14 nt, Salmonella enterica enterica serovar Typhi Ty2
cgcggacgccacca

SEQ ID NO: 3702867 - RNA, 22 nt, Salmonella enterica enterica serovar Typhi Ty2
cgcggagagaucgacagcgcgc

SEQ ID NO: 3702868 - RNA, 16 nt, Salmonella enterica enterica serovar Typhi Ty2
cgcggauaagcccggc

SEQ ID NO: 3702869 - RNA, 19 nt, Salmonella enterica enterica serovar Typhi Ty2
cgcggauauggcggcggcu

SEQ ID NO: 3702870 - RNA, 20 nt, Salmonella enterica enterica serovar Typhi Ty2
cgcggaucagacggcugacc

SEQ ID NO: 3702871 - RNA, 18 nt, Salmonella enterica enterica serovar Typhi Ty2
cgcggaucggcacacagc

SEQ ID NO: 3702872 - RNA, 15 nt, Salmonella enterica enterica serovar Typhi Ty2
cgcggauugccgccc

SEQ ID NO: 3702873 - RNA, 15 nt, Salmonella enterica enterica serovar Typhi Ty2
cgcggcaaccagccc

SEQ ID NO: 3702874 - RNA, 22 nt, Salmonella enterica enterica serovar Typhi Ty2
cgcggcaaccguauccagaccc

SEQ ID NO: 3702875 - RNA, 22 nt, Salmonella enterica enterica serovar Typhi Ty2
cgcggcaaugagcggccagcgg

SEQ ID NO: 3702876 - RNA, 22 nt, Salmonella enterica enterica serovar Typhi Ty2
cgcggcacacuuucaucagccg

SEQ ID NO: 3702877 - RNA, 14 nt, Salmonella enterica enterica serovar Typhi Ty2
cgcggcagcgcgca

SEQ ID NO: 3702878 - RNA, 13 nt, Salmonella enterica enterica serovar Typhi Ty2
cgcggcaggaaug

SEQ ID NO: 3702879 - RNA, 20 nt, Salmonella enterica enterica serovar Typhi Ty2
cgcggcaucguagucaggca

SEQ ID NO: 3702880 - RNA, 13 nt, Salmonella enterica enterica serovar Typhi Ty2
cgcggccaaaacc

SEQ ID NO: 3702881 - RNA, 20 nt, Salmonella enterica enterica serovar Typhi Ty2
cgcggccaaaacccaccagc

SEQ ID NO: 3702882 - RNA, 19 nt, Salmonella enterica enterica serovar Typhi Ty2
cgcggccagaaugcccagc

SEQ ID NO: 3702883 - RNA, 21 nt, Salmonella enterica enterica serovar Typhi Ty2
cgcggccagcaucguaccgug

SEQ ID NO: 3702884 - RNA, 22 nt, Salmonella enterica enterica serovar Typhi Ty2
cgcggcccauucaacgggcgau

SEQ ID NO: 3702885 - RNA, 19 nt, Salmonella enterica enterica serovar Typhi Ty2
cgcggccccaucagcacau

SEQ ID NO: 3702886 - RNA, 19 nt, Salmonella enterica enterica serovar Typhi Ty2
cgcggcgaaaaagccggcg

SEQ ID NO: 3702887 - RNA, 21 nt, Salmonella enterica enterica serovar Typhi Ty2
cgcggcgacggacucgcgcag

SEQ ID NO: 3702888 - RNA, 22 nt, Salmonella enterica enterica serovar Typhi Ty2
cgcggcgcugaguuucucccgc

SEQ ID NO: 3702889 - RNA, 15 nt, Salmonella enterica enterica serovar Typhi Ty2
cgcggcgguucaucc

SEQ ID NO: 3702890 - RNA, 18 nt, Salmonella enterica enterica serovar Typhi Ty2
cgcggcguaccgcgcgcc

SEQ ID NO: 3702891 - RNA, 19 nt, Salmonella enterica enterica serovar Typhi Ty2
cgcggcguaccgcgcgccc

SEQ ID NO: 3702892 - RNA, 21 nt, Salmonella enterica enterica serovar Typhi Ty2
cgcggcgugaugccagccaua

SEQ ID NO: 3702893 - RNA, 13 nt, Salmonella enterica enterica serovar Typhi Ty2
cgcggcgugcgcu

SEQ ID NO: 3702894 - RNA, 14 nt, Salmonella enterica enterica serovar Typhi Ty2
cgcggcuacagaca

SEQ ID NO: 3702895 - RNA, 15 nt, Salmonella enterica enterica serovar Typhi Ty2
cgcggcuaccggacu

SEQ ID NO: 3702896 - RNA, 20 nt, Salmonella enterica enterica serovar Typhi Ty2
cgcggcuacugccagcgucg

SEQ ID NO: 3702897 - RNA, 23 nt, Salmonella enterica enterica serovar Typhi Ty2
cgcggcucaccagcugacgcagc

SEQ ID NO: 3702898 - RNA, 16 nt, Salmonella enterica enterica serovar Typhi Ty2
cgcggcugccgucgau

SEQ ID NO: 3702899 - RNA, 19 nt, Salmonella enterica enterica serovar Typhi Ty2
cgcggcuucaucaccaucg

SEQ ID NO: 3702900 - RNA, 16 nt, Salmonella enterica enterica serovar Typhi Ty2
cgcgggauaucgcugg

SEQ ID NO: 3702901 - RNA, 18 nt, Salmonella enterica enterica serovar Typhi Ty2
cgcgggccauacacucaa

SEQ ID NO: 3702902 - RNA, 14 nt, Salmonella enterica enterica serovar Typhi Ty2
cgcgggccugccug

SEQ ID NO: 3702903 - RNA, 21 nt, Salmonella enterica enterica serovar Typhi Ty2
cgcgggcgauuaucucgauau

SEQ ID NO: 3702904 - RNA, 14 nt, Salmonella enterica enterica serovar Typhi Ty2
cgcgggcggcguuu

SEQ ID NO: 3702905 - RNA, 13 nt, Salmonella enterica enterica serovar Typhi Ty2
cgcgggcgguauu

SEQ ID NO: 3702906 - RNA, 16 nt, Salmonella enterica enterica serovar Typhi Ty2
cgcggguggccugcag

SEQ ID NO: 3702907 - RNA, 16 nt, Salmonella enterica enterica serovar Typhi Ty2
cgcggguucuuuccac

SEQ ID NO: 3702908 - RNA, 17 nt, Salmonella enterica enterica serovar Typhi Ty2
cgcgguaaauuccgcag

SEQ ID NO: 3702909 - RNA, 18 nt, Salmonella enterica enterica serovar Typhi Ty2
cgcgguauucauaccuuu

SEQ ID NO: 3702910 - RNA, 16 nt, Salmonella enterica enterica serovar Typhi Ty2
cgcuauccggcgcgcu

SEQ ID NO: 3702911 - RNA, 22 nt, Salmonella enterica enterica serovar Typhi Ty2
cgcuaucgcuuuaacgcugcaa

SEQ ID NO: 3702912 - RNA, 16 nt, Salmonella enterica enterica serovar Typhi Ty2
cgcuaucugacagcca

SEQ ID NO: 3702913 - RNA, 17 nt, Salmonella enterica enterica serovar Typhi Ty2
cgcuaucugcuccgcca

SEQ ID NO: 3702914 - RNA, 19 nt, Salmonella enterica enterica serovar Typhi Ty2
cgcuaucugcuccgccagc

SEQ ID NO: 3702915 - RNA, 20 nt, Salmonella enterica enterica serovar Typhi Ty2
cgcuaucuguugcgccaggg

SEQ ID NO: 3702916 - RNA, 19 nt, Salmonella enterica enterica serovar Typhi Ty2
cgcuaucuuugagcagaua

SEQ ID NO: 3702917 - RNA, 22 nt, Salmonella enterica enterica serovar Typhi Ty2
cgcuauguaagguucccugcgc

SEQ ID NO: 3702918 - RNA, 12 nt, Salmonella enterica enterica serovar Typhi Ty2
cgcuauuaccag

SEQ ID NO: 3702919 - RNA, 15 nt, Salmonella enterica enterica serovar Typhi Ty2
cgcuauuaccaguaa

SEQ ID NO: 3702920 - RNA, 21 nt, Salmonella enterica enterica serovar Typhi Ty2
cgcuauuaccccgcggcaugg

SEQ ID NO: 3702921 - RNA, 15 nt, Salmonella enterica enterica serovar Typhi Ty2
cgcucaaauaaugca

SEQ ID NO: 3702922 - RNA, 20 nt, Salmonella enterica enterica serovar Typhi Ty2
cgcucaaauacgcgauaaaa

SEQ ID NO: 3702923 - RNA, 14 nt, Salmonella enterica enterica serovar Typhi Ty2
cgcucaacuccugc

SEQ ID NO: 3702924 - RNA, 16 nt, Salmonella enterica enterica serovar Typhi Ty2
cgcucaagaugauagc

SEQ ID NO: 3702925 - RNA, 16 nt, Salmonella enterica enterica serovar Typhi Ty2
cgcucaauagccagaa

SEQ ID NO: 3702926 - RNA, 12 nt, Salmonella enterica enterica serovar Typhi Ty2
cgcucaaucaga

SEQ ID NO: 3702927 - RNA, 22 nt, Salmonella enterica enterica serovar Typhi Ty2
cgcucaauuauuaaucuuuaca

SEQ ID NO: 3702928 - RNA, 23 nt, Salmonella enterica enterica serovar Typhi Ty2
cgcucacauucauugccgccagu

SEQ ID NO: 3702929 - RNA, 16 nt, Salmonella enterica enterica serovar Typhi Ty2
cgcucaccuccgccac

SEQ ID NO: 3702930 - RNA, 16 nt, Salmonella enterica enterica serovar Typhi Ty2
cgcucacgauaacgca

SEQ ID NO: 3702931 - RNA, 11 nt, Salmonella enterica enterica serovar Typhi Ty2
cgcucacgcca

SEQ ID NO: 3702932 - RNA, 16 nt, Salmonella enterica enterica serovar Typhi Ty2
cgcucagccagaaacg

SEQ ID NO: 3702933 - RNA, 13 nt, Salmonella enterica enterica serovar Typhi Ty2
cgcucagcgccgu

SEQ ID NO: 3702934 - RNA, 19 nt, Salmonella enterica enterica serovar Typhi Ty2
cgcucagcgccguagcggc

SEQ ID NO: 3702935 - RNA, 21 nt, Salmonella enterica enterica serovar Typhi Ty2
cgcucagcgccguagcggcag

SEQ ID NO: 3702936 - RNA, 18 nt, Salmonella enterica enterica serovar Typhi Ty2
cgcucaggagcgccugac

SEQ ID NO: 3702937 - RNA, 14 nt, Salmonella enterica enterica serovar Typhi Ty2
cgcucaucggcggc

SEQ ID NO: 3702938 - RNA, 22 nt, Salmonella enterica enterica serovar Typhi Ty2
cgcucaugauucuugcggauua

SEQ ID NO: 3702939 - RNA, 14 nt, Salmonella enterica enterica serovar Typhi Ty2
cgcucaugccacgc

SEQ ID NO: 3702940 - RNA, 21 nt, Salmonella enterica enterica serovar Typhi Ty2
cgcucaugcgccuggcgguaa

SEQ ID NO: 3702941 - RNA, 15 nt, Salmonella enterica enterica serovar Typhi Ty2
cgcucaugcgcgucc

SEQ ID NO: 3702942 - RNA, 17 nt, Salmonella enterica enterica serovar Typhi Ty2
cgcuccagaccaccagc

SEQ ID NO: 3702943 - RNA, 15 nt, Salmonella enterica enterica serovar Typhi Ty2
cgcuccagcuggcug

SEQ ID NO: 3702944 - RNA, 22 nt, Salmonella enterica enterica serovar Typhi Ty2
cgcuccagggauugauggccag

SEQ ID NO: 3702945 - RNA, 12 nt, Salmonella enterica enterica serovar Typhi Ty2
cgcuccagggcu

SEQ ID NO: 3702946 - RNA, 13 nt, Salmonella enterica enterica serovar Typhi Ty2
cgcuccaucacgg

SEQ ID NO: 3702947 - RNA, 19 nt, Salmonella enterica enterica serovar Typhi Ty2
cgcuccaucauaucgcgca

SEQ ID NO: 3702948 - RNA, 21 nt, Salmonella enterica enterica serovar Typhi Ty2
cgcuccaucauaucgcgcagc

SEQ ID NO: 3702949 - RNA, 19 nt, Salmonella enterica enterica serovar Typhi Ty2
cgcuccccguuccaccgcc

SEQ ID NO: 3702950 - RNA, 20 nt, Salmonella enterica enterica serovar Typhi Ty2
cgcucccuucccccagaaug

SEQ ID NO: 3702951 - RNA, 15 nt, Salmonella enterica enterica serovar Typhi Ty2
cgcuccgacaaacuu

SEQ ID NO: 3702952 - RNA, 17 nt, Salmonella enterica enterica serovar Typhi Ty2
cgcuccgcgcauccggc

SEQ ID NO: 3702953 - RNA, 15 nt, Salmonella enterica enterica serovar Typhi Ty2
cgcuccggcgcuggc

SEQ ID NO: 3702954 - RNA, 14 nt, Salmonella enterica enterica serovar Typhi Ty2
cgcuccugcuccca

SEQ ID NO: 3702955 - RNA, 16 nt, Salmonella enterica enterica serovar Typhi Ty2
cgcuccugcucccaga

SEQ ID NO: 3702956 - RNA, 19 nt, Salmonella enterica enterica serovar Typhi Ty2
cgcuccuugagcgccugga

SEQ ID NO: 3702957 - RNA, 22 nt, Salmonella enterica enterica serovar Typhi Ty2
cgcucgauuugcccuuccagca

SEQ ID NO: 3702958 - RNA, 14 nt, Salmonella enterica enterica serovar Typhi Ty2
cgcucgccagcccg

SEQ ID NO: 3702959 - RNA, 13 nt, Salmonella enterica enterica serovar Typhi Ty2
cgcucgccgccuc

SEQ ID NO: 3702960 - RNA, 19 nt, Salmonella enterica enterica serovar Typhi Ty2
cgcucgcugauggcgagaa

SEQ ID NO: 3702961 - RNA, 14 nt, Salmonella enterica enterica serovar Typhi Ty2
cgcucgcuggugcc

SEQ ID NO: 3702962 - RNA, 23 nt, Salmonella enterica enterica serovar Typhi Ty2
cgcucgcuggugccaaucuccag

SEQ ID NO: 3702963 - RNA, 20 nt, Salmonella enterica enterica serovar Typhi Ty2
cgcucgcuuacgcggcgcgc

SEQ ID NO: 3702964 - RNA, 21 nt, Salmonella enterica enterica serovar Typhi Ty2
cgcucggcauacaccgccagc

SEQ ID NO: 3702965 - RNA, 21 nt, Salmonella enterica enterica serovar Typhi Ty2
cgcucgucgcgacguccgcca

SEQ ID NO: 3702966 - RNA, 17 nt, Salmonella enterica enterica serovar Typhi Ty2
cgcucuauauccugccc

SEQ ID NO: 3702967 - RNA, 16 nt, Salmonella enterica enterica serovar Typhi Ty2
cgcucuaucgccgccc

SEQ ID NO: 3702968 - RNA, 18 nt, Salmonella enterica enterica serovar Typhi Ty2
cgcucuaucgccgcccgc

SEQ ID NO: 3702969 - RNA, 19 nt, Salmonella enterica enterica serovar Typhi Ty2
cgcucuaucgccuggagcu

SEQ ID NO: 3702970 - RNA, 12 nt, Salmonella enterica enterica serovar Typhi Ty2
cgcucuauucca

SEQ ID NO: 3702971 - RNA, 14 nt, Salmonella enterica enterica serovar Typhi Ty2
cgcucucagcgucg

SEQ ID NO: 3702972 - RNA, 15 nt, Salmonella enterica enterica serovar Typhi Ty2
cgcucucagcgucgg

SEQ ID NO: 3702973 - RNA, 15 nt, Salmonella enterica enterica serovar Typhi Ty2
cgcucucgccgcgcu

SEQ ID NO: 3702974 - RNA, 16 nt, Salmonella enterica enterica serovar Typhi Ty2
cgcucucgccgcgcuc

SEQ ID NO: 3702975 - RNA, 22 nt, Salmonella enterica enterica serovar Typhi Ty2
cgcucucuucgugacccgccag

SEQ ID NO: 3702976 - RNA, 12 nt, Salmonella enterica enterica serovar Typhi Ty2
cgcucuuauugc

SEQ ID NO: 3702977 - RNA, 13 nt, Salmonella enterica enterica serovar Typhi Ty2
cgcucuuccgcca

SEQ ID NO: 3702978 - RNA, 15 nt, Salmonella enterica enterica serovar Typhi Ty2
cgcucuuccgccagc

SEQ ID NO: 3702979 - RNA, 21 nt, Salmonella enterica enterica serovar Typhi Ty2
cgcucuucgccaaucgccgcc

SEQ ID NO: 3702980 - RNA, 22 nt, Salmonella enterica enterica serovar Typhi Ty2
cgcucuuuaaugauguccagaa

SEQ ID NO: 3702981 - RNA, 21 nt, Salmonella enterica enterica serovar Typhi Ty2
cgcugaaaacggcaucaagcc

SEQ ID NO: 3702982 - RNA, 22 nt, Salmonella enterica enterica serovar Typhi Ty2
cgcugaagccugcuucaccgcg

SEQ ID NO: 3702983 - RNA, 15 nt, Salmonella enterica enterica serovar Typhi Ty2
cgcugaccacgccgc

SEQ ID NO: 3702984 - RNA, 12 nt, Salmonella enterica enterica serovar Typhi Ty2
cgcugaccucaa

SEQ ID NO: 3702985 - RNA, 21 nt, Salmonella enterica enterica serovar Typhi Ty2
cgcugaccuuuuucauccuca

SEQ ID NO: 3702986 - RNA, 20 nt, Salmonella enterica enterica serovar Typhi Ty2
cgcugacgaucaugccgccc

SEQ ID NO: 3702987 - RNA, 13 nt, Salmonella enterica enterica serovar Typhi Ty2
cgcugacgccagg

SEQ ID NO: 3702988 - RNA, 24 nt, Salmonella enterica enterica serovar Typhi Ty2
cgcugacgccaggccaucgacgaa

SEQ ID NO: 3702989 - RNA, 12 nt, Salmonella enterica enterica serovar Typhi Ty2
cgcugacgccga

SEQ ID NO: 3702990 - RNA, 14 nt, Salmonella enterica enterica serovar Typhi Ty2
cgcugacggcggca

SEQ ID NO: 3702991 - RNA, 22 nt, Salmonella enterica enterica serovar Typhi Ty2
cgcugacguucgacccgcaaug

SEQ ID NO: 3702992 - RNA, 21 nt, Salmonella enterica enterica serovar Typhi Ty2
cgcugagcggcucauccagca

SEQ ID NO: 3702993 - RNA, 19 nt, Salmonella enterica enterica serovar Typhi Ty2
cgcugaguuucucccgcca

SEQ ID NO: 3702994 - RNA, 22 nt, Salmonella enterica enterica serovar Typhi Ty2
cgcugaguuucucccgccagau

SEQ ID NO: 3702995 - RNA, 17 nt, Salmonella enterica enterica serovar Typhi Ty2
cgcugauaaucguauca

SEQ ID NO: 3702996 - RNA, 20 nt, Salmonella enterica enterica serovar Typhi Ty2
cgcugauacgcuggcacagg

SEQ ID NO: 3702997 - RNA, 21 nt, Salmonella enterica enterica serovar Typhi Ty2
cgcugauacguaacaugaccu

SEQ ID NO: 3702998 - RNA, 16 nt, Salmonella enterica enterica serovar Typhi Ty2
cgcugaugaaaaccca

SEQ ID NO: 3702999 - RNA, 17 nt, Salmonella enterica enterica serovar Typhi Ty2
cgcugaugaaaacccag

SEQ ID NO: 3703000 - RNA, 17 nt, Salmonella enterica enterica serovar Typhi Ty2
cgcugaugcagcuugca

SEQ ID NO: 3703001 - RNA, 11 nt, Salmonella enterica enterica serovar Typhi Ty2
cgcugauggcg

SEQ ID NO: 3703002 - RNA, 19 nt, Salmonella enterica enterica serovar Typhi Ty2
cgcugauguuuugcgccgc

SEQ ID NO: 3703003 - RNA, 20 nt, Salmonella enterica enterica serovar Typhi Ty2
cgcugauguuuugcgccgcg

SEQ ID NO: 3703004 - RNA, 14 nt, Salmonella enterica enterica serovar Typhi Ty2
cgcugauucguuuu

SEQ ID NO: 3703005 - RNA, 15 nt, Salmonella enterica enterica serovar Typhi Ty2
cgcugauugccgcca

SEQ ID NO: 3703006 - RNA, 15 nt, Salmonella enterica enterica serovar Typhi Ty2
cgcugauuugccaaa

SEQ ID NO: 3703007 - RNA, 16 nt, Salmonella enterica enterica serovar Typhi Ty2
cgcugauuuguuaucu

SEQ ID NO: 3703008 - RNA, 18 nt, Salmonella enterica enterica serovar Typhi Ty2
cgcugauuuucuccagca

SEQ ID NO: 3703009 - RNA, 18 nt, Salmonella enterica enterica serovar Typhi Ty2
cgcugcacaaucgccagc

SEQ ID NO: 3703010 - RNA, 14 nt, Salmonella enterica enterica serovar Typhi Ty2
cgcugcauccugua

SEQ ID NO: 3703011 - RNA, 19 nt, Salmonella enterica enterica serovar Typhi Ty2
cgcugcauccuguaccacc

SEQ ID NO: 3703012 - RNA, 23 nt, Salmonella enterica enterica serovar Typhi Ty2
cgcugcauccuguaccaccacgc

SEQ ID NO: 3703013 - RNA, 15 nt, Salmonella enterica enterica serovar Typhi Ty2
cgcugccacaauggc

SEQ ID NO: 3703014 - RNA, 14 nt, Salmonella enterica enterica serovar Typhi Ty2
cgcugccagcugcg

SEQ ID NO: 3703015 - RNA, 22 nt, Salmonella enterica enterica serovar Typhi Ty2
cgcugccagcugcgucagcgcu

SEQ ID NO: 3703016 - RNA, 14 nt, Salmonella enterica enterica serovar Typhi Ty2
cgcugccgcccuuu

SEQ ID NO: 3703017 - RNA, 16 nt, Salmonella enterica enterica serovar Typhi Ty2
cgcugccgcccuuucc

SEQ ID NO: 3703018 - RNA, 17 nt, Salmonella enterica enterica serovar Typhi Ty2
cgcugccgcuuauccgg

SEQ ID NO: 3703019 - RNA, 15 nt, Salmonella enterica enterica serovar Typhi Ty2
cgcugcgcaccugca

SEQ ID NO: 3703020 - RNA, 13 nt, Salmonella enterica enterica serovar Typhi Ty2
cgcugcgccagau

SEQ ID NO: 3703021 - RNA, 18 nt, Salmonella enterica enterica serovar Typhi Ty2
cgcugcgccugcugccag

SEQ ID NO: 3703022 - RNA, 14 nt, Salmonella enterica enterica serovar Typhi Ty2
cgcugcgcucacgc

SEQ ID NO: 3703023 - RNA, 18 nt, Salmonella enterica enterica serovar Typhi Ty2
cgcugcgcuuaccgggcc

SEQ ID NO: 3703024 - RNA, 19 nt, Salmonella enterica enterica serovar Typhi Ty2
cgcugcgcuuaccgggccu

SEQ ID NO: 3703025 - RNA, 20 nt, Salmonella enterica enterica serovar Typhi Ty2
cgcugcgcuuaucaggccua

SEQ ID NO: 3703026 - RNA, 16 nt, Salmonella enterica enterica serovar Typhi Ty2
cgcugcgcuuauccgc

SEQ ID NO: 3703027 - RNA, 19 nt, Salmonella enterica enterica serovar Typhi Ty2
cgcugcgcuuauccggccu

SEQ ID NO: 3703028 - RNA, 19 nt, Salmonella enterica enterica serovar Typhi Ty2
cgcugcggaacaccagcgc

SEQ ID NO: 3703029 - RNA, 22 nt, Salmonella enterica enterica serovar Typhi Ty2
cgcugcggcguggagcauucca

SEQ ID NO: 3703030 - RNA, 17 nt, Salmonella enterica enterica serovar Typhi Ty2
cgcugcgucaggcgaua

SEQ ID NO: 3703031 - RNA, 20 nt, Salmonella enterica enterica serovar Typhi Ty2
cgcugcguuuaucaggccua

SEQ ID NO: 3703032 - RNA, 23 nt, Salmonella enterica enterica serovar Typhi Ty2
cgcugcucauuuaugcgcugggc

SEQ ID NO: 3703033 - RNA, 14 nt, Salmonella enterica enterica serovar Typhi Ty2
cgcugcuccggcuu

SEQ ID NO: 3703034 - RNA, 22 nt, Salmonella enterica enterica serovar Typhi Ty2
cgcugcuguaacagacgcaggc

SEQ ID NO: 3703035 - RNA, 23 nt, Salmonella enterica enterica serovar Typhi Ty2
cgcugcuuagcaguagugagcca

SEQ ID NO: 3703036 - RNA, 14 nt, Salmonella enterica enterica serovar Typhi Ty2
cgcugcuucacgga

SEQ ID NO: 3703037 - RNA, 21 nt, Salmonella enterica enterica serovar Typhi Ty2
cgcuggaacugaucgugccca

SEQ ID NO: 3703038 - RNA, 20 nt, Salmonella enterica enterica serovar Typhi Ty2
cgcuggaaucauccaccaga

SEQ ID NO: 3703039 - RNA, 13 nt, Salmonella enterica enterica serovar Typhi Ty2
cgcuggacauuaa

SEQ ID NO: 3703040 - RNA, 23 nt, Salmonella enterica enterica serovar Typhi Ty2
cgcuggacgucgucaccacggug

SEQ ID NO: 3703041 - RNA, 16 nt, Salmonella enterica enterica serovar Typhi Ty2
cgcuggcaauaaagca

SEQ ID NO: 3703042 - RNA, 22 nt, Salmonella enterica enterica serovar Typhi Ty2
cgcuggcaauaaagcagggcgg

SEQ ID NO: 3703043 - RNA, 15 nt, Salmonella enterica enterica serovar Typhi Ty2
cgcuggcacuggcag

SEQ ID NO: 3703044 - RNA, 20 nt, Salmonella enterica enterica serovar Typhi Ty2
cgcuggcgcaaagaaggcau

SEQ ID NO: 3703045 - RNA, 12 nt, Salmonella enterica enterica serovar Typhi Ty2
cgcuggcgcgcu

SEQ ID NO: 3703046 - RNA, 20 nt, Salmonella enterica enterica serovar Typhi Ty2
cgcuggcgcggggaacaccc

SEQ ID NO: 3703047 - RNA, 13 nt, Salmonella enterica enterica serovar Typhi Ty2
cgcuggcgcuguc

SEQ ID NO: 3703048 - RNA, 19 nt, Salmonella enterica enterica serovar Typhi Ty2
cgcuggcggcccgcauuga

SEQ ID NO: 3703049 - RNA, 20 nt, Salmonella enterica enterica serovar Typhi Ty2
cgcuggcguauucgcccggc

SEQ ID NO: 3703050 - RNA, 17 nt, Salmonella enterica enterica serovar Typhi Ty2
cgcuggcguccagcccg

SEQ ID NO: 3703051 - RNA, 21 nt, Salmonella enterica enterica serovar Typhi Ty2
cgcuggcgucuguccggcgcu

SEQ ID NO: 3703052 - RNA, 12 nt, Salmonella enterica enterica serovar Typhi Ty2
cgcugggaugac

SEQ ID NO: 3703053 - RNA, 14 nt, Salmonella enterica enterica serovar Typhi Ty2
cgcugggcacgcua

SEQ ID NO: 3703054 - RNA, 22 nt, Salmonella enterica enterica serovar Typhi Ty2
cgcuggguaauagaugcgucgc

SEQ ID NO: 3703055 - RNA, 16 nt, Salmonella enterica enterica serovar Typhi Ty2
cgcuggguuuuuccgc

SEQ ID NO: 3703056 - RNA, 15 nt, Salmonella enterica enterica serovar Typhi Ty2
cgcuggucaacacgc

SEQ ID NO: 3703057 - RNA, 17 nt, Salmonella enterica enterica serovar Typhi Ty2
cgcuggucagcgcgcca

SEQ ID NO: 3703058 - RNA, 13 nt, Salmonella enterica enterica serovar Typhi Ty2
cgcuggugcagcc

SEQ ID NO: 3703059 - RNA, 16 nt, Salmonella enterica enterica serovar Typhi Ty2
cgcuggugccaaucuc

SEQ ID NO: 3703060 - RNA, 16 nt, Salmonella enterica enterica serovar Typhi Ty2
cgcuggugugcagcca

SEQ ID NO: 3703061 - RNA, 17 nt, Salmonella enterica enterica serovar Typhi Ty2
cgcugguucaugcuucc

SEQ ID NO: 3703062 - RNA, 16 nt, Salmonella enterica enterica serovar Typhi Ty2
cgcuguaaaccggccc

SEQ ID NO: 3703063 - RNA, 14 nt, Salmonella enterica enterica serovar Typhi Ty2
cgcuguaacccgcc

SEQ ID NO: 3703064 - RNA, 15 nt, Salmonella enterica enterica serovar Typhi Ty2
cgcuguaacccgccg

SEQ ID NO: 3703065 - RNA, 18 nt, Salmonella enterica enterica serovar Typhi Ty2
cgcuguaacccgccgcca

SEQ ID NO: 3703066 - RNA, 19 nt, Salmonella enterica enterica serovar Typhi Ty2
cgcuguaacccgccgccau

SEQ ID NO: 3703067 - RNA, 13 nt, Salmonella enterica enterica serovar Typhi Ty2
cgcuguagcgcca

SEQ ID NO: 3703068 - RNA, 17 nt, Salmonella enterica enterica serovar Typhi Ty2
cgcugucaccagcagca

SEQ ID NO: 3703069 - RNA, 22 nt, Salmonella enterica enterica serovar Typhi Ty2
cgcugucaccagcagcauuuca

SEQ ID NO: 3703070 - RNA, 13 nt, Salmonella enterica enterica serovar Typhi Ty2
cgcugucagugaa

SEQ ID NO: 3703071 - RNA, 18 nt, Salmonella enterica enterica serovar Typhi Ty2
cgcuguccagauagggcc

SEQ ID NO: 3703072 - RNA, 23 nt, Salmonella enterica enterica serovar Typhi Ty2
cgcuguccagauagggccaggcg

SEQ ID NO: 3703073 - RNA, 15 nt, Salmonella enterica enterica serovar Typhi Ty2
cgcugucggcgccca

SEQ ID NO: 3703074 - RNA, 20 nt, Salmonella enterica enterica serovar Typhi Ty2
cgcuuuuuuaaacgccugau

SEQ ID NO: 3703075 - RNA, 21 nt, Salmonella enterica enterica serovar Typhi Ty2
cgcuuuuuuaacgauuucccc

SEQ ID NO: 3703076 - RNA, 19 nt, Salmonella enterica enterica serovar Typhi Ty2
cgcuuuuuuauuguuucua

SEQ ID NO: 3703077 - RNA, 14 nt, Salmonella enterica enterica serovar Typhi Ty2
cgcuuuuuucucug

SEQ ID NO: 3703078 - RNA, 14 nt, Salmonella enterica enterica serovar Typhi Ty2
cggaaaccaguuca

SEQ ID NO: 3703079 - RNA, 18 nt, Salmonella enterica enterica serovar Typhi Ty2
cggaaaccaguucacgcg

SEQ ID NO: 3703080 - RNA, 20 nt, Salmonella enterica enterica serovar Typhi Ty2
cggaaacgucauuuuuucaa

SEQ ID NO: 3703081 - RNA, 20 nt, Salmonella enterica enterica serovar Typhi Ty2
cggaaagaaacgccgcgcaa

SEQ ID NO: 3703082 - RNA, 23 nt, Salmonella enterica enterica serovar Typhi Ty2
cggaaagaagcaggguauugacg

SEQ ID NO: 3703083 - RNA, 20 nt, Salmonella enterica enterica serovar Typhi Ty2
cggaaagacggcagcgccau

SEQ ID NO: 3703084 - RNA, 16 nt, Salmonella enterica enterica serovar Typhi Ty2
cggaaagcuguuguug

SEQ ID NO: 3703085 - RNA, 18 nt, Salmonella enterica enterica serovar Typhi Ty2
cggaaagggugcccgccu

SEQ ID NO: 3703086 - RNA, 20 nt, Salmonella enterica enterica serovar Typhi Ty2
cggaaaucaaaccaucccag

SEQ ID NO: 3703087 - RNA, 15 nt, Salmonella enterica enterica serovar Typhi Ty2
cggaaaucgcggcga

SEQ ID NO: 3703088 - RNA, 23 nt, Salmonella enterica enterica serovar Typhi Ty2
cggaaaugcgcggugucauugac

SEQ ID NO: 3703089 - RNA, 19 nt, Salmonella enterica enterica serovar Typhi Ty2
cggaaauuagcccgcuuca

SEQ ID NO: 3703090 - RNA, 21 nt, Salmonella enterica enterica serovar Typhi Ty2
cggaaauucacuuccgucaug

SEQ ID NO: 3703091 - RNA, 12 nt, Salmonella enterica enterica serovar Typhi Ty2
cggaacaccagc

SEQ ID NO: 3703092 - RNA, 13 nt, Salmonella enterica enterica serovar Typhi Ty2
cggaacaccagcg

SEQ ID NO: 3703093 - RNA, 14 nt, Salmonella enterica enterica serovar Typhi Ty2
cggaacaccagcgc

SEQ ID NO: 3703094 - RNA, 16 nt, Salmonella enterica enterica serovar Typhi Ty2
cggaacagggccgcau

SEQ ID NO: 3703095 - RNA, 19 nt, Salmonella enterica enterica serovar Typhi Ty2
cggaaccaaaauagauaau

SEQ ID NO: 3703096 - RNA, 14 nt, Salmonella enterica enterica serovar Typhi Ty2
cggaacccagcaaa

SEQ ID NO: 3703097 - RNA, 16 nt, Salmonella enterica enterica serovar Typhi Ty2
cggaacccagcaaauc

SEQ ID NO: 3703098 - RNA, 22 nt, Salmonella enterica enterica serovar Typhi Ty2
cggaaccgcccaucaacaccag

SEQ ID NO: 3703099 - RNA, 18 nt, Salmonella enterica enterica serovar Typhi Ty2
cggaacuaacccgcagcc

SEQ ID NO: 3703100 - RNA, 16 nt, Salmonella enterica enterica serovar Typhi Ty2
cggaacuggugaaaca

SEQ ID NO: 3703101 - RNA, 19 nt, Salmonella enterica enterica serovar Typhi Ty2
cggaacuuuaucaccagcg

SEQ ID NO: 3703102 - RNA, 21 nt, Salmonella enterica enterica serovar Typhi Ty2
cggaacuuuaucaccagcgau

SEQ ID NO: 3703103 - RNA, 19 nt, Salmonella enterica enterica serovar Typhi Ty2
cggaagacuggcgcagcaa

SEQ ID NO: 3703104 - RNA, 21 nt, Salmonella enterica enterica serovar Typhi Ty2
cggaagacuggcgcagcaaac

SEQ ID NO: 3703105 - RNA, 16 nt, Salmonella enterica enterica serovar Typhi Ty2
cggaagagaaacucuu

SEQ ID NO: 3703106 - RNA, 16 nt, Salmonella enterica enterica serovar Typhi Ty2
cggaagagcucgacca

SEQ ID NO: 3703107 - RNA, 21 nt, Salmonella enterica enterica serovar Typhi Ty2
cggaaggugccguauggcguc

SEQ ID NO: 3703108 - RNA, 18 nt, Salmonella enterica enterica serovar Typhi Ty2
cggaaguagccuccggcg

SEQ ID NO: 3703109 - RNA, 16 nt, Salmonella enterica enterica serovar Typhi Ty2
cggaagugcucuccac

SEQ ID NO: 3703110 - RNA, 23 nt, Salmonella enterica enterica serovar Typhi Ty2
cggaauaacuccagugcagaaag

SEQ ID NO: 3703111 - RNA, 16 nt, Salmonella enterica enterica serovar Typhi Ty2
cggaauaauguaaaaa

SEQ ID NO: 3703112 - RNA, 20 nt, Salmonella enterica enterica serovar Typhi Ty2
cggaauaauguaaaaaaaua

SEQ ID NO: 3703113 - RNA, 19 nt, Salmonella enterica enterica serovar Typhi Ty2
cggaauaugcgcuuuuuuc

SEQ ID NO: 3703114 - RNA, 22 nt, Salmonella enterica enterica serovar Typhi Ty2
cggaauccaucccccugccguu

SEQ ID NO: 3703115 - RNA, 23 nt, Salmonella enterica enterica serovar Typhi Ty2
cggaaucgccugcgucgccccaa

SEQ ID NO: 3703116 - RNA, 18 nt, Salmonella enterica enterica serovar Typhi Ty2
cggaaucggacacuugca

SEQ ID NO: 3703117 - RNA, 23 nt, Salmonella enterica enterica serovar Typhi Ty2
cggaaugacaaacgccaccgcca

SEQ ID NO: 3703118 - RNA, 15 nt, Salmonella enterica enterica serovar Typhi Ty2
cggaaugagagaagg

SEQ ID NO: 3703119 - RNA, 17 nt, Salmonella enterica enterica serovar Typhi Ty2
cggaaugaugugcuauu

SEQ ID NO: 3703120 - RNA, 23 nt, Salmonella enterica enterica serovar Typhi Ty2
cggaaugcugguuaacgccgcca

SEQ ID NO: 3703121 - RNA, 23 nt, Salmonella enterica enterica serovar Typhi Ty2
cggaauggauaacgaaaaggguc

SEQ ID NO: 3703122 - RNA, 21 nt, Salmonella enterica enterica serovar Typhi Ty2
cggaauggcacagcgcagcaa

SEQ ID NO: 3703123 - RNA, 20 nt, Salmonella enterica enterica serovar Typhi Ty2
cggaaugugaaauacagcca

SEQ ID NO: 3703124 - RNA, 17 nt, Salmonella enterica enterica serovar Typhi Ty2
cggacaacgcuccagca

SEQ ID NO: 3703125 - RNA, 16 nt, Salmonella enterica enterica serovar Typhi Ty2
cggacacaugaccuga

SEQ ID NO: 3703126 - RNA, 14 nt, Salmonella enterica enterica serovar Typhi Ty2
cggacacccgcagc

SEQ ID NO: 3703127 - RNA, 12 nt, Salmonella enterica enterica serovar Typhi Ty2
cggacacuaauu

SEQ ID NO: 3703128 - RNA, 15 nt, Salmonella enterica enterica serovar Typhi Ty2
cggacagcagaauau

SEQ ID NO: 3703129 - RNA, 14 nt, Salmonella enterica enterica serovar Typhi Ty2
cggacagcgcgcaa

SEQ ID NO: 3703130 - RNA, 15 nt, Salmonella enterica enterica serovar Typhi Ty2
cggacagcggcagcg

SEQ ID NO: 3703131 - RNA, 21 nt, Salmonella enterica enterica serovar Typhi Ty2
cggacauuuauuucacuggcc

SEQ ID NO: 3703132 - RNA, 14 nt, Salmonella enterica enterica serovar Typhi Ty2
cggaccccucuucu

SEQ ID NO: 3703133 - RNA, 15 nt, Salmonella enterica enterica serovar Typhi Ty2
cggaccccucuucuu

SEQ ID NO: 3703134 - RNA, 17 nt, Salmonella enterica enterica serovar Typhi Ty2
cggaccccucuucuuuu

SEQ ID NO: 3703135 - RNA, 12 nt, Salmonella enterica enterica serovar Typhi Ty2
cggaccggcgac

SEQ ID NO: 3703136 - RNA, 20 nt, Salmonella enterica enterica serovar Typhi Ty2
cggaccuaauagccagcccc

SEQ ID NO: 3703137 - RNA, 18 nt, Salmonella enterica enterica serovar Typhi Ty2
cggaccuccgcguaccuc

SEQ ID NO: 3703138 - RNA, 19 nt, Salmonella enterica enterica serovar Typhi Ty2
cggacgaacaacaucagac

SEQ ID NO: 3703139 - RNA, 20 nt, Salmonella enterica enterica serovar Typhi Ty2
cggacgaaccuggcgguaaa

SEQ ID NO: 3703140 - RNA, 12 nt, Salmonella enterica enterica serovar Typhi Ty2
cggacgaacgcu

SEQ ID NO: 3703141 - RNA, 18 nt, Salmonella enterica enterica serovar Typhi Ty2
cggacgauaaccaugcuc

SEQ ID NO: 3703142 - RNA, 21 nt, Salmonella enterica enterica serovar Typhi Ty2
cggacgauaaccaugcucagc

SEQ ID NO: 3703143 - RNA, 14 nt, Salmonella enterica enterica serovar Typhi Ty2
cggacgcaccagcc

SEQ ID NO: 3703144 - RNA, 19 nt, Salmonella enterica enterica serovar Typhi Ty2
cggacgcagaccaaaguca

SEQ ID NO: 3703145 - RNA, 15 nt, Salmonella enterica enterica serovar Typhi Ty2
cggacgccgggugau

SEQ ID NO: 3703146 - RNA, 23 nt, Salmonella enterica enterica serovar Typhi Ty2
cggacggucggcguaauguugcu

SEQ ID NO: 3703147 - RNA, 14 nt, Salmonella enterica enterica serovar Typhi Ty2
cggacguugcuccg

SEQ ID NO: 3703148 - RNA, 12 nt, Salmonella enterica enterica serovar Typhi Ty2
cggacucagggu

SEQ ID NO: 3703149 - RNA, 13 nt, Salmonella enterica enterica serovar Typhi Ty2
cggacucagggug

SEQ ID NO: 3703150 - RNA, 12 nt, Salmonella enterica enterica serovar Typhi Ty2
cggacuccagca

SEQ ID NO: 3703151 - RNA, 13 nt, Salmonella enterica enterica serovar Typhi Ty2
cggacucggcuga

SEQ ID NO: 3703152 - RNA, 21 nt, Salmonella enterica enterica serovar Typhi Ty2
cggacugauagcgaggcagca

SEQ ID NO: 3703153 - RNA, 11 nt, Salmonella enterica enterica serovar Typhi Ty2
cggacugcugg

SEQ ID NO: 3703154 - RNA, 16 nt, Salmonella enterica enterica serovar Typhi Ty2
cggagaaaaagcgaua

SEQ ID NO: 3703155 - RNA, 21 nt, Salmonella enterica enterica serovar Typhi Ty2
cggagaacgguucauccagca

SEQ ID NO: 3703156 - RNA, 14 nt, Salmonella enterica enterica serovar Typhi Ty2
cggcaaaaacguug

SEQ ID NO: 3703157 - RNA, 18 nt, Salmonella enterica enterica serovar Typhi Ty2
cggcaaaaagaaucgcca

SEQ ID NO: 3703158 - RNA, 23 nt, Salmonella enterica enterica serovar Typhi Ty2
cggcaaaauuaccaggcgguaug

SEQ ID NO: 3703159 - RNA, 15 nt, Salmonella enterica enterica serovar Typhi Ty2
cggcaaacagcuuca

SEQ ID NO: 3703160 - RNA, 16 nt, Salmonella enterica enterica serovar Typhi Ty2
cggcaaaccaaacggc

SEQ ID NO: 3703161 - RNA, 19 nt, Salmonella enterica enterica serovar Typhi Ty2
cggcaaaccuaccggcaua

SEQ ID NO: 3703162 - RNA, 13 nt, Salmonella enterica enterica serovar Typhi Ty2
cggcaaacucagc

SEQ ID NO: 3703163 - RNA, 13 nt, Salmonella enterica enterica serovar Typhi Ty2
cggcaaagaaaaa

SEQ ID NO: 3703164 - RNA, 21 nt, Salmonella enterica enterica serovar Typhi Ty2
cggcaaagaaaaagaguugca

SEQ ID NO: 3703165 - RNA, 17 nt, Salmonella enterica enterica serovar Typhi Ty2
cggcaaagaccaauaaa

SEQ ID NO: 3703166 - RNA, 17 nt, Salmonella enterica enterica serovar Typhi Ty2
cggcaaagguugccgca

SEQ ID NO: 3703167 - RNA, 16 nt, Salmonella enterica enterica serovar Typhi Ty2
cggcaaaguuccaggu

SEQ ID NO: 3703168 - RNA, 17 nt, Salmonella enterica enterica serovar Typhi Ty2
cggcaaauaccgucaua

SEQ ID NO: 3703169 - RNA, 15 nt, Salmonella enterica enterica serovar Typhi Ty2
cggcaaauccuccau

SEQ ID NO: 3703170 - RNA, 16 nt, Salmonella enterica enterica serovar Typhi Ty2
cggcaaauccuccaua

SEQ ID NO: 3703171 - RNA, 14 nt, Salmonella enterica enterica serovar Typhi Ty2
cggcaaauucuuuu

SEQ ID NO: 3703172 - RNA, 14 nt, Salmonella enterica enterica serovar Typhi Ty2
cggcaacaguaccu

SEQ ID NO: 3703173 - RNA, 16 nt, Salmonella enterica enterica serovar Typhi Ty2
cggcaacugcgccaaa

SEQ ID NO: 3703174 - RNA, 22 nt, Salmonella enterica enterica serovar Typhi Ty2
cggcaagagauucaggccgcca

SEQ ID NO: 3703175 - RNA, 17 nt, Salmonella enterica enterica serovar Typhi Ty2
cggcaagcaucugauau

SEQ ID NO: 3703176 - RNA, 17 nt, Salmonella enterica enterica serovar Typhi Ty2
cggcaagccgaucagcg

SEQ ID NO: 3703177 - RNA, 17 nt, Salmonella enterica enterica serovar Typhi Ty2
cggcaagucagaccagu

SEQ ID NO: 3703178 - RNA, 15 nt, Salmonella enterica enterica serovar Typhi Ty2
cggcaauaaacuccc

SEQ ID NO: 3703179 - RNA, 22 nt, Salmonella enterica enterica serovar Typhi Ty2
cggcaauagaacgucgcgcgcu

SEQ ID NO: 3703180 - RNA, 19 nt, Salmonella enterica enterica serovar Typhi Ty2
cggcaauaugcuguuuaug

SEQ ID NO: 3703181 - RNA, 16 nt, Salmonella enterica enterica serovar Typhi Ty2
cggcaauauugccgca

SEQ ID NO: 3703182 - RNA, 23 nt, Salmonella enterica enterica serovar Typhi Ty2
cggcaauauugccgcacgguacu

SEQ ID NO: 3703183 - RNA, 18 nt, Salmonella enterica enterica serovar Typhi Ty2
cggcaaugagcggccagc

SEQ ID NO: 3703184 - RNA, 16 nt, Salmonella enterica enterica serovar Typhi Ty2
cggcaaugauaucggc

SEQ ID NO: 3703185 - RNA, 18 nt, Salmonella enterica enterica serovar Typhi Ty2
cggcaaugcggguuucgu

SEQ ID NO: 3703186 - RNA, 12 nt, Salmonella enterica enterica serovar Typhi Ty2
cggcaauggcca

SEQ ID NO: 3703187 - RNA, 21 nt, Salmonella enterica enterica serovar Typhi Ty2
cggcaauggccgcagcgccau

SEQ ID NO: 3703188 - RNA, 24 nt, Salmonella enterica enterica serovar Typhi Ty2
cggcaaugggguuuguccugcagc

SEQ ID NO: 3703189 - RNA, 20 nt, Salmonella enterica enterica serovar Typhi Ty2
cggcaauuaaccgauaacgc

SEQ ID NO: 3703190 - RNA, 17 nt, Salmonella enterica enterica serovar Typhi Ty2
cggcaauuuccggcgac

SEQ ID NO: 3703191 - RNA, 18 nt, Salmonella enterica enterica serovar Typhi Ty2
cggcacaaugcccggcau

SEQ ID NO: 3703192 - RNA, 13 nt, Salmonella enterica enterica serovar Typhi Ty2
cggcacacagcac

SEQ ID NO: 3703193 - RNA, 23 nt, Salmonella enterica enterica serovar Typhi Ty2
cggcacauaggcaaacaccucag

SEQ ID NO: 3703194 - RNA, 19 nt, Salmonella enterica enterica serovar Typhi Ty2
cggcacauauuccggcgcu

SEQ ID NO: 3703195 - RNA, 21 nt, Salmonella enterica enterica serovar Typhi Ty2
cggcacauauuccggcgcugg

SEQ ID NO: 3703196 - RNA, 22 nt, Salmonella enterica enterica serovar Typhi Ty2
cggcacauauuccggcgcuggc

SEQ ID NO: 3703197 - RNA, 17 nt, Salmonella enterica enterica serovar Typhi Ty2
cggcacauccagcgccu

SEQ ID NO: 3703198 - RNA, 20 nt, Salmonella enterica enterica serovar Typhi Ty2
cggcacauucaccacgcagc

SEQ ID NO: 3703199 - RNA, 14 nt, Salmonella enterica enterica serovar Typhi Ty2
cggcaccagcaaug

SEQ ID NO: 3703200 - RNA, 13 nt, Salmonella enterica enterica serovar Typhi Ty2
cggcaccagccag

SEQ ID NO: 3703201 - RNA, 18 nt, Salmonella enterica enterica serovar Typhi Ty2
cggcaccggaaccggcau

SEQ ID NO: 3703202 - RNA, 17 nt, Salmonella enterica enterica serovar Typhi Ty2
cggcacgaaaaauaaaa

SEQ ID NO: 3703203 - RNA, 18 nt, Salmonella enterica enterica serovar Typhi Ty2
cggcacgguuaaugaaau

SEQ ID NO: 3703204 - RNA, 17 nt, Salmonella enterica enterica serovar Typhi Ty2
cggcacguuuuccaggu

SEQ ID NO: 3703205 - RNA, 16 nt, Salmonella enterica enterica serovar Typhi Ty2
cggcacucaccucuuc

SEQ ID NO: 3703206 - RNA, 21 nt, Salmonella enterica enterica serovar Typhi Ty2
cggcacugacucuuccgggcg

SEQ ID NO: 3703207 - RNA, 16 nt, Salmonella enterica enterica serovar Typhi Ty2
cggcacuucgauaaac

SEQ ID NO: 3703208 - RNA, 12 nt, Salmonella enterica enterica serovar Typhi Ty2
cggcagaccgga

SEQ ID NO: 3703209 - RNA, 15 nt, Salmonella enterica enterica serovar Typhi Ty2
cggcagaccggcagc

SEQ ID NO: 3703210 - RNA, 17 nt, Salmonella enterica enterica serovar Typhi Ty2
cggcagaccggcagccu

SEQ ID NO: 3703211 - RNA, 19 nt, Salmonella enterica enterica serovar Typhi Ty2
cggcagacgauagcgggug

SEQ ID NO: 3703212 - RNA, 14 nt, Salmonella enterica enterica serovar Typhi Ty2
cggcagcacccggc

SEQ ID NO: 3703213 - RNA, 14 nt, Salmonella enterica enterica serovar Typhi Ty2
cggcagcagcuuca

SEQ ID NO: 3703214 - RNA, 20 nt, Salmonella enterica enterica serovar Typhi Ty2
cggcagcagcuucagcauca

SEQ ID NO: 3703215 - RNA, 13 nt, Salmonella enterica enterica serovar Typhi Ty2
cggcagcagugag

SEQ ID NO: 3703216 - RNA, 20 nt, Salmonella enterica enterica serovar Typhi Ty2
cggcagcagugagcuuugca

SEQ ID NO: 3703217 - RNA, 16 nt, Salmonella enterica enterica serovar Typhi Ty2
cggcagccaauuuagg

SEQ ID NO: 3703218 - RNA, 17 nt, Salmonella enterica enterica serovar Typhi Ty2
cggcagccgacagcgua

SEQ ID NO: 3703219 - RNA, 18 nt, Salmonella enterica enterica serovar Typhi Ty2
cggcagccgacagcguaa

SEQ ID NO: 3703220 - RNA, 13 nt, Salmonella enterica enterica serovar Typhi Ty2
cggcagccgccac

SEQ ID NO: 3703221 - RNA, 17 nt, Salmonella enterica enterica serovar Typhi Ty2
cggcagccgccaccaca

SEQ ID NO: 3703222 - RNA, 20 nt, Salmonella enterica enterica serovar Typhi Ty2
cggcagccgccaccacaaag

SEQ ID NO: 3703223 - RNA, 23 nt, Salmonella enterica enterica serovar Typhi Ty2
cggcagcgcauaagccacuucaa

SEQ ID NO: 3703224 - RNA, 19 nt, Salmonella enterica enterica serovar Typhi Ty2
cggcagcgcgacauagagc

SEQ ID NO: 3703225 - RNA, 21 nt, Salmonella enterica enterica serovar Typhi Ty2
cggcagcgcgcacguucaggu

SEQ ID NO: 3703226 - RNA, 13 nt, Salmonella enterica enterica serovar Typhi Ty2
cggcagcgcgccg

SEQ ID NO: 3703227 - RNA, 16 nt, Salmonella enterica enterica serovar Typhi Ty2
cggcagcguccgccau

SEQ ID NO: 3703228 - RNA, 11 nt, Salmonella enterica enterica serovar Typhi Ty2
cggcagcucug

SEQ ID NO: 3703229 - RNA, 16 nt, Salmonella enterica enterica serovar Typhi Ty2
cggcagcucuuccaga

SEQ ID NO: 3703230 - RNA, 18 nt, Salmonella enterica enterica serovar Typhi Ty2
cggcagcuuccagcaaac

SEQ ID NO: 3703231 - RNA, 21 nt, Salmonella enterica enterica serovar Typhi Ty2
cggcaggaucgggaucagcgc

SEQ ID NO: 3703232 - RNA, 19 nt, Salmonella enterica enterica serovar Typhi Ty2
cggcaggccuuucggcagc

SEQ ID NO: 3703233 - RNA, 23 nt, Salmonella enterica enterica serovar Typhi Ty2
cggcaggugauggcggcuuggcu

SEQ ID NO: 3703234 - RNA, 15 nt, Salmonella enterica enterica serovar Typhi Ty2
cggcaguacacgcau

SEQ ID NO: 3703235 - RNA, 20 nt, Salmonella enterica enterica serovar Typhi Ty2
cggcagucacuuucagauuu

SEQ ID NO: 3703236 - RNA, 20 nt, Salmonella enterica enterica serovar Typhi Ty2
cggcaguccuugcagccaga

SEQ ID NO: 3703237 - RNA, 16 nt, Salmonella enterica enterica serovar Typhi Ty2
cggcagucgcuacaac

SEQ ID NO: 3703238 - RNA, 15 nt, Salmonella enterica enterica serovar Typhi Ty2
cggccuccgcuuccu

SEQ ID NO: 3703239 - RNA, 18 nt, Salmonella enterica enterica serovar Typhi Ty2
cggccuccgcuuccugcg

SEQ ID NO: 3703240 - RNA, 13 nt, Salmonella enterica enterica serovar Typhi Ty2
cggccuccgguga

SEQ ID NO: 3703241 - RNA, 23 nt, Salmonella enterica enterica serovar Typhi Ty2
cggccucuucacgcagcgccuua

SEQ ID NO: 3703242 - RNA, 22 nt, Salmonella enterica enterica serovar Typhi Ty2
cggccugacgaccguugccgau

SEQ ID NO: 3703243 - RNA, 23 nt, Salmonella enterica enterica serovar Typhi Ty2
cggccugauaagcauagcgccau

SEQ ID NO: 3703244 - RNA, 18 nt, Salmonella enterica enterica serovar Typhi Ty2
cggccugcaaaccgccuc

SEQ ID NO: 3703245 - RNA, 20 nt, Salmonella enterica enterica serovar Typhi Ty2
cggccugcaaaccgccucgc

SEQ ID NO: 3703246 - RNA, 20 nt, Salmonella enterica enterica serovar Typhi Ty2
cggccugcacaagaaacaug

SEQ ID NO: 3703247 - RNA, 22 nt, Salmonella enterica enterica serovar Typhi Ty2
cggccugcggugguggggccua

SEQ ID NO: 3703248 - RNA, 16 nt, Salmonella enterica enterica serovar Typhi Ty2
cggccugcucaaggca

SEQ ID NO: 3703249 - RNA, 12 nt, Salmonella enterica enterica serovar Typhi Ty2
cggccuggcccg

SEQ ID NO: 3703250 - RNA, 15 nt, Salmonella enterica enterica serovar Typhi Ty2
cggccuggcucuucc

SEQ ID NO: 3703251 - RNA, 16 nt, Salmonella enterica enterica serovar Typhi Ty2
cggccuggcucuuccg

SEQ ID NO: 3703252 - RNA, 15 nt, Salmonella enterica enterica serovar Typhi Ty2
cggccuguuuuucug

SEQ ID NO: 3703253 - RNA, 16 nt, Salmonella enterica enterica serovar Typhi Ty2
cggccuuauuuuucag

SEQ ID NO: 3703254 - RNA, 19 nt, Salmonella enterica enterica serovar Typhi Ty2
cggccuucgcagaucgccu

SEQ ID NO: 3703255 - RNA, 22 nt, Salmonella enterica enterica serovar Typhi Ty2
cggccuugaaguuauccagcgc

SEQ ID NO: 3703256 - RNA, 23 nt, Salmonella enterica enterica serovar Typhi Ty2
cggccuugaaguuauccagcgcc

SEQ ID NO: 3703257 - RNA, 14 nt, Salmonella enterica enterica serovar Typhi Ty2
cggccuugccgcca

SEQ ID NO: 3703258 - RNA, 18 nt, Salmonella enterica enterica serovar Typhi Ty2
cggcgaaaaccgagcauc

SEQ ID NO: 3703259 - RNA, 15 nt, Salmonella enterica enterica serovar Typhi Ty2
cggcgaaagaagcgc

SEQ ID NO: 3703260 - RNA, 17 nt, Salmonella enterica enterica serovar Typhi Ty2
cggcgaaagaagcgcug

SEQ ID NO: 3703261 - RNA, 18 nt, Salmonella enterica enterica serovar Typhi Ty2
cggcgaaagaagcgcugg

SEQ ID NO: 3703262 - RNA, 21 nt, Salmonella enterica enterica serovar Typhi Ty2
cggcgaaagaagcgcuggaga

SEQ ID NO: 3703263 - RNA, 15 nt, Salmonella enterica enterica serovar Typhi Ty2
cggcgaaccggcauc

SEQ ID NO: 3703264 - RNA, 19 nt, Salmonella enterica enterica serovar Typhi Ty2
cggcgaaccggcaucggca

SEQ ID NO: 3703265 - RNA, 21 nt, Salmonella enterica enterica serovar Typhi Ty2
cggcgaaccggcaucggcagc

SEQ ID NO: 3703266 - RNA, 18 nt, Salmonella enterica enterica serovar Typhi Ty2
cggcgaacucggucaggg

SEQ ID NO: 3703267 - RNA, 18 nt, Salmonella enterica enterica serovar Typhi Ty2
cggcgaagauccgcucac

SEQ ID NO: 3703268 - RNA, 17 nt, Salmonella enterica enterica serovar Typhi Ty2
cggcgaagggggccggg

SEQ ID NO: 3703269 - RNA, 15 nt, Salmonella enterica enterica serovar Typhi Ty2
cggcgaaggucgcgc

SEQ ID NO: 3703270 - RNA, 18 nt, Salmonella enterica enterica serovar Typhi Ty2
cggcgaaggucgcgccgc

SEQ ID NO: 3703271 - RNA, 18 nt, Salmonella enterica enterica serovar Typhi Ty2
cggcgaaucgcagagcgu

SEQ ID NO: 3703272 - RNA, 18 nt, Salmonella enterica enterica serovar Typhi Ty2
cggcgaauuaaucgucga

SEQ ID NO: 3703273 - RNA, 14 nt, Salmonella enterica enterica serovar Typhi Ty2
cggcgacagcgacc

SEQ ID NO: 3703274 - RNA, 13 nt, Salmonella enterica enterica serovar Typhi Ty2
cggcgaccagcag

SEQ ID NO: 3703275 - RNA, 14 nt, Salmonella enterica enterica serovar Typhi Ty2
cggcgaccggcaaa

SEQ ID NO: 3703276 - RNA, 20 nt, Salmonella enterica enterica serovar Typhi Ty2
cggcgacggacucgcgcaga

SEQ ID NO: 3703277 - RNA, 21 nt, Salmonella enterica enterica serovar Typhi Ty2
cggcgacggacucgcgcagaa

SEQ ID NO: 3703278 - RNA, 16 nt, Salmonella enterica enterica serovar Typhi Ty2
cggcgacgugacgcgc

SEQ ID NO: 3703279 - RNA, 20 nt, Salmonella enterica enterica serovar Typhi Ty2
cggcgacgugacgcgccagc

SEQ ID NO: 3703280 - RNA, 22 nt, Salmonella enterica enterica serovar Typhi Ty2
cggcgauaaaugucaggaucag

SEQ ID NO: 3703281 - RNA, 16 nt, Salmonella enterica enterica serovar Typhi Ty2
cggcgauagcgcccca

SEQ ID NO: 3703282 - RNA, 13 nt, Salmonella enterica enterica serovar Typhi Ty2
cggcgaucaccac

SEQ ID NO: 3703283 - RNA, 15 nt, Salmonella enterica enterica serovar Typhi Ty2
cggcgcaaacaguac

SEQ ID NO: 3703284 - RNA, 17 nt, Salmonella enterica enterica serovar Typhi Ty2
cggcgcaaacaguacgc

SEQ ID NO: 3703285 - RNA, 23 nt, Salmonella enterica enterica serovar Typhi Ty2
cggcgcaaaggccuuauccggcc

SEQ ID NO: 3703286 - RNA, 15 nt, Salmonella enterica enterica serovar Typhi Ty2
cggcgcaaaucgcca

SEQ ID NO: 3703287 - RNA, 13 nt, Salmonella enterica enterica serovar Typhi Ty2
cggcgcacugccu

SEQ ID NO: 3703288 - RNA, 15 nt, Salmonella enterica enterica serovar Typhi Ty2
cggcgcacugccuga

SEQ ID NO: 3703289 - RNA, 18 nt, Salmonella enterica enterica serovar Typhi Ty2
cggcgcacuuccucuccc

SEQ ID NO: 3703290 - RNA, 14 nt, Salmonella enterica enterica serovar Typhi Ty2
cggcgcagacacug

SEQ ID NO: 3703291 - RNA, 19 nt, Salmonella enterica enterica serovar Typhi Ty2
cggcgcagacacugccacc

SEQ ID NO: 3703292 - RNA, 22 nt, Salmonella enterica enterica serovar Typhi Ty2
cggcgcaggggcauuuuccggc

SEQ ID NO: 3703293 - RNA, 22 nt, Salmonella enterica enterica serovar Typhi Ty2
cggcgcagguccauuuuuuauc

SEQ ID NO: 3703294 - RNA, 21 nt, Salmonella enterica enterica serovar Typhi Ty2
cggcgcaguucgccgccagga

SEQ ID NO: 3703295 - RNA, 12 nt, Salmonella enterica enterica serovar Typhi Ty2
cggcgccaacgc

SEQ ID NO: 3703296 - RNA, 21 nt, Salmonella enterica enterica serovar Typhi Ty2
cggcgccaaucaccgccagca

SEQ ID NO: 3703297 - RNA, 16 nt, Salmonella enterica enterica serovar Typhi Ty2
cggcgccaggacaacg

SEQ ID NO: 3703298 - RNA, 21 nt, Salmonella enterica enterica serovar Typhi Ty2
cggcgcccagcuuacgcgcag

SEQ ID NO: 3703299 - RNA, 15 nt, Salmonella enterica enterica serovar Typhi Ty2
cggcgccgaagcagg

SEQ ID NO: 3703300 - RNA, 14 nt, Salmonella enterica enterica serovar Typhi Ty2
cggcgccuuccggc

SEQ ID NO: 3703301 - RNA, 21 nt, Salmonella enterica enterica serovar Typhi Ty2
cggcgccuuuaauuccgccgg

SEQ ID NO: 3703302 - RNA, 24 nt, Salmonella enterica enterica serovar Typhi Ty2
cggcgcgaaacaggucggcaugca

SEQ ID NO: 3703303 - RNA, 14 nt, Salmonella enterica enterica serovar Typhi Ty2
cggcgcgaaucccg

SEQ ID NO: 3703304 - RNA, 14 nt, Salmonella enterica enterica serovar Typhi Ty2
cggcgcgacgccgc

SEQ ID NO: 3703305 - RNA, 23 nt, Salmonella enterica enterica serovar Typhi Ty2
cggcgcgaguguagucccgccgg

SEQ ID NO: 3703306 - RNA, 10 nt, Salmonella enterica enterica serovar Typhi Ty2
cggcgcgcca

SEQ ID NO: 3703307 - RNA, 15 nt, Salmonella enterica enterica serovar Typhi Ty2
cggcgcgccagcgca

SEQ ID NO: 3703308 - RNA, 13 nt, Salmonella enterica enterica serovar Typhi Ty2
cggcgcgccgcug

SEQ ID NO: 3703309 - RNA, 17 nt, Salmonella enterica enterica serovar Typhi Ty2
cggcgcgccgcuggcga

SEQ ID NO: 3703310 - RNA, 24 nt, Salmonella enterica enterica serovar Typhi Ty2
cggcgcgccgcuggcgaccagccu

SEQ ID NO: 3703311 - RNA, 14 nt, Salmonella enterica enterica serovar Typhi Ty2
cggcgcgccggcaa

SEQ ID NO: 3703312 - RNA, 14 nt, Salmonella enterica enterica serovar Typhi Ty2
cggcgcgccuucca

SEQ ID NO: 3703313 - RNA, 20 nt, Salmonella enterica enterica serovar Typhi Ty2
cggcgcgccuuccagcaauu

SEQ ID NO: 3703314 - RNA, 13 nt, Salmonella enterica enterica serovar Typhi Ty2
cggcgcgcguggc

SEQ ID NO: 3703315 - RNA, 17 nt, Salmonella enterica enterica serovar Typhi Ty2
cggcgcgcucuacguug

SEQ ID NO: 3703316 - RNA, 16 nt, Salmonella enterica enterica serovar Typhi Ty2
cggcgcgcugccgccc

SEQ ID NO: 3703317 - RNA, 13 nt, Salmonella enterica enterica serovar Typhi Ty2
cggcgcggaaggg

SEQ ID NO: 3703318 - RNA, 13 nt, Salmonella enterica enterica serovar Typhi Ty2
cggcgcggcauca

SEQ ID NO: 3703319 - RNA, 17 nt, Salmonella enterica enterica serovar Typhi Ty2
cggcgcgggcaacggca

SEQ ID NO: 3703320 - RNA, 16 nt, Salmonella enterica enterica serovar Typhi Ty2
cggcuccagcgccagc

SEQ ID NO: 3703321 - RNA, 17 nt, Salmonella enterica enterica serovar Typhi Ty2
cggcuccagguugcuca

SEQ ID NO: 3703322 - RNA, 22 nt, Salmonella enterica enterica serovar Typhi Ty2
cggcuccagguugcucagguua

SEQ ID NO: 3703323 - RNA, 12 nt, Salmonella enterica enterica serovar Typhi Ty2
cggcucccauuu

SEQ ID NO: 3703324 - RNA, 22 nt, Salmonella enterica enterica serovar Typhi Ty2
cggcuccggcaaauucuuccgc

SEQ ID NO: 3703325 - RNA, 17 nt, Salmonella enterica enterica serovar Typhi Ty2
cggcucgaacuguucug

SEQ ID NO: 3703326 - RNA, 23 nt, Salmonella enterica enterica serovar Typhi Ty2
cggcucgccuugcgguugcagca

SEQ ID NO: 3703327 - RNA, 22 nt, Salmonella enterica enterica serovar Typhi Ty2
cggcucgccuuugcgcccguac

SEQ ID NO: 3703328 - RNA, 14 nt, Salmonella enterica enterica serovar Typhi Ty2
cggcugaaccaccc

SEQ ID NO: 3703329 - RNA, 12 nt, Salmonella enterica enterica serovar Typhi Ty2
cggcugaagcug

SEQ ID NO: 3703330 - RNA, 19 nt, Salmonella enterica enterica serovar Typhi Ty2
cggcugacacucauccaga

SEQ ID NO: 3703331 - RNA, 22 nt, Salmonella enterica enterica serovar Typhi Ty2
cggcugacgauacucagcccca

SEQ ID NO: 3703332 - RNA, 18 nt, Salmonella enterica enterica serovar Typhi Ty2
cggcugaguucaggcacg

SEQ ID NO: 3703333 - RNA, 22 nt, Salmonella enterica enterica serovar Typhi Ty2
cggcugauggcguuccacccag

SEQ ID NO: 3703334 - RNA, 16 nt, Salmonella enterica enterica serovar Typhi Ty2
cggcugcacaaaauac

SEQ ID NO: 3703335 - RNA, 23 nt, Salmonella enterica enterica serovar Typhi Ty2
cggcugccuuuuuuaauggcgcu

SEQ ID NO: 3703336 - RNA, 16 nt, Salmonella enterica enterica serovar Typhi Ty2
cggcugcgccugcggg

SEQ ID NO: 3703337 - RNA, 19 nt, Salmonella enterica enterica serovar Typhi Ty2
cggcugcgccuuauccggc

SEQ ID NO: 3703338 - RNA, 16 nt, Salmonella enterica enterica serovar Typhi Ty2
cggcugcgcugccagc

SEQ ID NO: 3703339 - RNA, 23 nt, Salmonella enterica enterica serovar Typhi Ty2
cggcugcgcugccagcugcguca

SEQ ID NO: 3703340 - RNA, 23 nt, Salmonella enterica enterica serovar Typhi Ty2
cggcuggguuuccggaucgccga

SEQ ID NO: 3703341 - RNA, 19 nt, Salmonella enterica enterica serovar Typhi Ty2
cggcuguagccagccugaa

SEQ ID NO: 3703342 - RNA, 12 nt, Salmonella enterica enterica serovar Typhi Ty2
cggcuguauaca

SEQ ID NO: 3703343 - RNA, 21 nt, Salmonella enterica enterica serovar Typhi Ty2
cggcuguauguaggguacagc

SEQ ID NO: 3703344 - RNA, 15 nt, Salmonella enterica enterica serovar Typhi Ty2
cggcuguguccgcca

SEQ ID NO: 3703345 - RNA, 22 nt, Salmonella enterica enterica serovar Typhi Ty2
cggcuguguccgccaugugcug

SEQ ID NO: 3703346 - RNA, 16 nt, Salmonella enterica enterica serovar Typhi Ty2
cggcuuaaauggcgcu

SEQ ID NO: 3703347 - RNA, 18 nt, Salmonella enterica enterica serovar Typhi Ty2
cggcuuaaugcccggccc

SEQ ID NO: 3703348 - RNA, 16 nt, Salmonella enterica enterica serovar Typhi Ty2
cggcuucagcggcgca

SEQ ID NO: 3703349 - RNA, 14 nt, Salmonella enterica enterica serovar Typhi Ty2
cggcuuccggcagc

SEQ ID NO: 3703350 - RNA, 23 nt, Salmonella enterica enterica serovar Typhi Ty2
cggcuuccguuuuguugccgccc

SEQ ID NO: 3703351 - RNA, 19 nt, Salmonella enterica enterica serovar Typhi Ty2
cggcuugaguuuuccgcca

SEQ ID NO: 3703352 - RNA, 17 nt, Salmonella enterica enterica serovar Typhi Ty2
cggcuugucauccugcu

SEQ ID NO: 3703353 - RNA, 15 nt, Salmonella enterica enterica serovar Typhi Ty2
cggcuuuauuacuuc

SEQ ID NO: 3703354 - RNA, 22 nt, Salmonella enterica enterica serovar Typhi Ty2
cggcuuucacaccguuauccgg

SEQ ID NO: 3703355 - RNA, 22 nt, Salmonella enterica enterica serovar Typhi Ty2
cggcuuugaacagcgucaucca

SEQ ID NO: 3703356 - RNA, 17 nt, Salmonella enterica enterica serovar Typhi Ty2
cggcuuugcgccggcag

SEQ ID NO: 3703357 - RNA, 15 nt, Salmonella enterica enterica serovar Typhi Ty2
cggcuuuuaucgaca

SEQ ID NO: 3703358 - RNA, 20 nt, Salmonella enterica enterica serovar Typhi Ty2
cgggaaaagguuucggcgau

SEQ ID NO: 3703359 - RNA, 22 nt, Salmonella enterica enterica serovar Typhi Ty2
cgggaaagauaauaccucaaau

SEQ ID NO: 3703360 - RNA, 17 nt, Salmonella enterica enterica serovar Typhi Ty2
cgggaaagggcggcagc

SEQ ID NO: 3703361 - RNA, 16 nt, Salmonella enterica enterica serovar Typhi Ty2
cgggaacaugcauauu

SEQ ID NO: 3703362 - RNA, 22 nt, Salmonella enterica enterica serovar Typhi Ty2
cgggaagagagaaaaucggcgg

SEQ ID NO: 3703363 - RNA, 22 nt, Salmonella enterica enterica serovar Typhi Ty2
cgggaagaugugccacuccgcc

SEQ ID NO: 3703364 - RNA, 15 nt, Salmonella enterica enterica serovar Typhi Ty2
cgggaaguccuucuc

SEQ ID NO: 3703365 - RNA, 23 nt, Salmonella enterica enterica serovar Typhi Ty2
cgggaauaacgcgagaagaagaa

SEQ ID NO: 3703366 - RNA, 21 nt, Salmonella enterica enterica serovar Typhi Ty2
cgggacauguucagcgcagaa

SEQ ID NO: 3703367 - RNA, 17 nt, Salmonella enterica enterica serovar Typhi Ty2
cgggacggcggccagca

SEQ ID NO: 3703368 - RNA, 19 nt, Salmonella enterica enterica serovar Typhi Ty2
cgggacggcggccagcauu

SEQ ID NO: 3703369 - RNA, 23 nt, Salmonella enterica enterica serovar Typhi Ty2
cgggacugguggcgagauaagcc

SEQ ID NO: 3703370 - RNA, 22 nt, Salmonella enterica enterica serovar Typhi Ty2
cgggagagcguauccagcaccu

SEQ ID NO: 3703371 - RNA, 12 nt, Salmonella enterica enterica serovar Typhi Ty2
cgggagcaaaau

SEQ ID NO: 3703372 - RNA, 12 nt, Salmonella enterica enterica serovar Typhi Ty2
cgggagcuugcc

SEQ ID NO: 3703373 - RNA, 15 nt, Salmonella enterica enterica serovar Typhi Ty2
cgggaggggcuuucc

SEQ ID NO: 3703374 - RNA, 18 nt, Salmonella enterica enterica serovar Typhi Ty2
cgggagguucaccaccac

SEQ ID NO: 3703375 - RNA, 19 nt, Salmonella enterica enterica serovar Typhi Ty2
cgggauacggcgagaccau

SEQ ID NO: 3703376 - RNA, 15 nt, Salmonella enterica enterica serovar Typhi Ty2
cgggauagcacuacc

SEQ ID NO: 3703377 - RNA, 16 nt, Salmonella enterica enterica serovar Typhi Ty2
cgggaucagcgcgcuc

SEQ ID NO: 3703378 - RNA, 17 nt, Salmonella enterica enterica serovar Typhi Ty2
cgggauccccugcuccu

SEQ ID NO: 3703379 - RNA, 15 nt, Salmonella enterica enterica serovar Typhi Ty2
cgggaucgagcgcgg

SEQ ID NO: 3703380 - RNA, 21 nt, Salmonella enterica enterica serovar Typhi Ty2
cgggaucgauauaucgcguca

SEQ ID NO: 3703381 - RNA, 16 nt, Salmonella enterica enterica serovar Typhi Ty2
cgggaugcauaaaaaa

SEQ ID NO: 3703382 - RNA, 17 nt, Salmonella enterica enterica serovar Typhi Ty2
cgggaugcauaaaaaaa

SEQ ID NO: 3703383 - RNA, 22 nt, Salmonella enterica enterica serovar Typhi Ty2
cgggauggccgccgagcuguga

SEQ ID NO: 3703384 - RNA, 18 nt, Salmonella enterica enterica serovar Typhi Ty2
cgggaugggaacacagca

SEQ ID NO: 3703385 - RNA, 20 nt, Salmonella enterica enterica serovar Typhi Ty2
cgggaugguuaaauucauau

SEQ ID NO: 3703386 - RNA, 19 nt, Salmonella enterica enterica serovar Typhi Ty2
cgggauuguauaccgcuuu

SEQ ID NO: 3703387 - RNA, 16 nt, Salmonella enterica enterica serovar Typhi Ty2
cgggcaaaaugcgucg

SEQ ID NO: 3703388 - RNA, 14 nt, Salmonella enterica enterica serovar Typhi Ty2
cgggcaauacgcug

SEQ ID NO: 3703389 - RNA, 15 nt, Salmonella enterica enterica serovar Typhi Ty2
cgggcaaugccacca

SEQ ID NO: 3703390 - RNA, 17 nt, Salmonella enterica enterica serovar Typhi Ty2
cgggcaaugccaccagc

SEQ ID NO: 3703391 - RNA, 21 nt, Salmonella enterica enterica serovar Typhi Ty2
cgggcaaugccaccagcgcca

SEQ ID NO: 3703392 - RNA, 22 nt, Salmonella enterica enterica serovar Typhi Ty2
cgggcaaugccaccagcgccau

SEQ ID NO: 3703393 - RNA, 20 nt, Salmonella enterica enterica serovar Typhi Ty2
cgggcaaugccacugcccuc

SEQ ID NO: 3703394 - RNA, 15 nt, Salmonella enterica enterica serovar Typhi Ty2
cgggcacgcugacca

SEQ ID NO: 3703395 - RNA, 23 nt, Salmonella enterica enterica serovar Typhi Ty2
cgggcacuccggcucgcacauau

SEQ ID NO: 3703396 - RNA, 22 nt, Salmonella enterica enterica serovar Typhi Ty2
cgggcagacaugaccgcacagc

SEQ ID NO: 3703397 - RNA, 23 nt, Salmonella enterica enterica serovar Typhi Ty2
cgggcagcaucucgauuacagcg

SEQ ID NO: 3703398 - RNA, 18 nt, Salmonella enterica enterica serovar Typhi Ty2
cgggcagcggcaagacag

SEQ ID NO: 3703399 - RNA, 19 nt, Salmonella enterica enterica serovar Typhi Ty2
cgggcagcggcaagacaga

SEQ ID NO: 3703400 - RNA, 14 nt, Salmonella enterica enterica serovar Typhi Ty2
cgggcaggauacgg

SEQ ID NO: 3703401 - RNA, 15 nt, Salmonella enterica enterica serovar Typhi Ty2
cgguaaaggcgaccg

SEQ ID NO: 3703402 - RNA, 19 nt, Salmonella enterica enterica serovar Typhi Ty2
cgguaaaggucgccgcauc

SEQ ID NO: 3703403 - RNA, 22 nt, Salmonella enterica enterica serovar Typhi Ty2
cgguaaaugcuuaucugaugaa

SEQ ID NO: 3703404 - RNA, 16 nt, Salmonella enterica enterica serovar Typhi Ty2
cgguaaauuucaaccc

SEQ ID NO: 3703405 - RNA, 21 nt, Salmonella enterica enterica serovar Typhi Ty2
cgguaaauuucuugaucaauc

SEQ ID NO: 3703406 - RNA, 20 nt, Salmonella enterica enterica serovar Typhi Ty2
cgguaacagcuugaucauca

SEQ ID NO: 3703407 - RNA, 23 nt, Salmonella enterica enterica serovar Typhi Ty2
cgguaacgacuuauuugcucagu

SEQ ID NO: 3703408 - RNA, 16 nt, Salmonella enterica enterica serovar Typhi Ty2
cgguaagagcguuacc

SEQ ID NO: 3703409 - RNA, 13 nt, Salmonella enterica enterica serovar Typhi Ty2
cgguaagccgaaa

SEQ ID NO: 3703410 - RNA, 22 nt, Salmonella enterica enterica serovar Typhi Ty2
cgguaauaauuagcauccagca

SEQ ID NO: 3703411 - RNA, 19 nt, Salmonella enterica enterica serovar Typhi Ty2
cgguaaucaccagaucggc

SEQ ID NO: 3703412 - RNA, 16 nt, Salmonella enterica enterica serovar Typhi Ty2
cgguaaucagacuggc

SEQ ID NO: 3703413 - RNA, 22 nt, Salmonella enterica enterica serovar Typhi Ty2
cgguaaucgaucccgccgcauc

SEQ ID NO: 3703414 - RNA, 15 nt, Salmonella enterica enterica serovar Typhi Ty2
cgguaaucgccgcga

SEQ ID NO: 3703415 - RNA, 18 nt, Salmonella enterica enterica serovar Typhi Ty2
cgguaaucgccugccagc

SEQ ID NO: 3703416 - RNA, 21 nt, Salmonella enterica enterica serovar Typhi Ty2
cgguaaucgccugccagcgcu

SEQ ID NO: 3703417 - RNA, 18 nt, Salmonella enterica enterica serovar Typhi Ty2
cgguaaucugccagcuua

SEQ ID NO: 3703418 - RNA, 15 nt, Salmonella enterica enterica serovar Typhi Ty2
cgguaccauaccugc

SEQ ID NO: 3703419 - RNA, 18 nt, Salmonella enterica enterica serovar Typhi Ty2
cgguacccgcugcuucac

SEQ ID NO: 3703420 - RNA, 16 nt, Salmonella enterica enterica serovar Typhi Ty2
cgguacgcaucaccag

SEQ ID NO: 3703421 - RNA, 12 nt, Salmonella enterica enterica serovar Typhi Ty2
cgguacgcccga

SEQ ID NO: 3703422 - RNA, 14 nt, Salmonella enterica enterica serovar Typhi Ty2
cgguacgccgccau

SEQ ID NO: 3703423 - RNA, 16 nt, Salmonella enterica enterica serovar Typhi Ty2
cgguacggaacgucca

SEQ ID NO: 3703424 - RNA, 14 nt, Salmonella enterica enterica serovar Typhi Ty2
cgguacuccccuuu

SEQ ID NO: 3703425 - RNA, 15 nt, Salmonella enterica enterica serovar Typhi Ty2
cgguacuccccuuuu

SEQ ID NO: 3703426 - RNA, 14 nt, Salmonella enterica enterica serovar Typhi Ty2
cgguacucuuuuuc

SEQ ID NO: 3703427 - RNA, 17 nt, Salmonella enterica enterica serovar Typhi Ty2
cgguagagcgcggucag

SEQ ID NO: 3703428 - RNA, 18 nt, Salmonella enterica enterica serovar Typhi Ty2
cgguagagcgcggucagg

SEQ ID NO: 3703429 - RNA, 19 nt, Salmonella enterica enterica serovar Typhi Ty2
cgguagagcgcggucaggu

SEQ ID NO: 3703430 - RNA, 22 nt, Salmonella enterica enterica serovar Typhi Ty2
cgguagcaaaggcuaccgggca

SEQ ID NO: 3703431 - RNA, 17 nt, Salmonella enterica enterica serovar Typhi Ty2
cgguagcacuuuaaaca

SEQ ID NO: 3703432 - RNA, 16 nt, Salmonella enterica enterica serovar Typhi Ty2
cgguagcuuuuuaaau

SEQ ID NO: 3703433 - RNA, 13 nt, Salmonella enterica enterica serovar Typhi Ty2
cgguagguuuaaa

SEQ ID NO: 3703434 - RNA, 20 nt, Salmonella enterica enterica serovar Typhi Ty2
cgguauaaauuuccgcagcc

SEQ ID NO: 3703435 - RNA, 21 nt, Salmonella enterica enterica serovar Typhi Ty2
cgguauaaauuuccgcagcca

SEQ ID NO: 3703436 - RNA, 16 nt, Salmonella enterica enterica serovar Typhi Ty2
cgguauccgcauucua

SEQ ID NO: 3703437 - RNA, 22 nt, Salmonella enterica enterica serovar Typhi Ty2
cgguaucgacaaccgccugcgu

SEQ ID NO: 3703438 - RNA, 20 nt, Salmonella enterica enterica serovar Typhi Ty2
cgguaucgaucacgcgcagg

SEQ ID NO: 3703439 - RNA, 16 nt, Salmonella enterica enterica serovar Typhi Ty2
cgguaugcaccucuuu

SEQ ID NO: 3703440 - RNA, 23 nt, Salmonella enterica enterica serovar Typhi Ty2
cgguauuaucaauaguuaauuaa

SEQ ID NO: 3703441 - RNA, 22 nt, Salmonella enterica enterica serovar Typhi Ty2
cgguauugugccgcgccugcca

SEQ ID NO: 3703442 - RNA, 18 nt, Salmonella enterica enterica serovar Typhi Ty2
cgguauuuauccagcagg

SEQ ID NO: 3703443 - RNA, 17 nt, Salmonella enterica enterica serovar Typhi Ty2
cgguauuucgcaacgcc

SEQ ID NO: 3703444 - RNA, 16 nt, Salmonella enterica enterica serovar Typhi Ty2
cggucaacgcgccgcc

SEQ ID NO: 3703445 - RNA, 18 nt, Salmonella enterica enterica serovar Typhi Ty2
cggucaacgcgccgccaa

SEQ ID NO: 3703446 - RNA, 14 nt, Salmonella enterica enterica serovar Typhi Ty2
cggucaacgcggcu

SEQ ID NO: 3703447 - RNA, 16 nt, Salmonella enterica enterica serovar Typhi Ty2
cggucaacguuucccc

SEQ ID NO: 3703448 - RNA, 15 nt, Salmonella enterica enterica serovar Typhi Ty2
cggucaauacaucac

SEQ ID NO: 3703449 - RNA, 15 nt, Salmonella enterica enterica serovar Typhi Ty2
cggucaaucaucaga

SEQ ID NO: 3703450 - RNA, 12 nt, Salmonella enterica enterica serovar Typhi Ty2
cggucagccaca

SEQ ID NO: 3703451 - RNA, 12 nt, Salmonella enterica enterica serovar Typhi Ty2
cggucagccagc

SEQ ID NO: 3703452 - RNA, 15 nt, Salmonella enterica enterica serovar Typhi Ty2
cggucagcggcgcgc

SEQ ID NO: 3703453 - RNA, 22 nt, Salmonella enterica enterica serovar Typhi Ty2
cggucagcggcgcgccgcucga

SEQ ID NO: 3703454 - RNA, 16 nt, Salmonella enterica enterica serovar Typhi Ty2
cggucagcggcggaaa

SEQ ID NO: 3703455 - RNA, 22 nt, Salmonella enterica enterica serovar Typhi Ty2
cggucagcuuuucagcccaggc

SEQ ID NO: 3703456 - RNA, 22 nt, Salmonella enterica enterica serovar Typhi Ty2
cggucaggaagcggacuaccug

SEQ ID NO: 3703457 - RNA, 19 nt, Salmonella enterica enterica serovar Typhi Ty2
cggucaggggucagcguau

SEQ ID NO: 3703458 - RNA, 18 nt, Salmonella enterica enterica serovar Typhi Ty2
cggucagggugaauacca

SEQ ID NO: 3703459 - RNA, 14 nt, Salmonella enterica enterica serovar Typhi Ty2
cggucagguagcag

SEQ ID NO: 3703460 - RNA, 14 nt, Salmonella enterica enterica serovar Typhi Ty2
cggucaguuugccc

SEQ ID NO: 3703461 - RNA, 15 nt, Salmonella enterica enterica serovar Typhi Ty2
cggucauccagcggu

SEQ ID NO: 3703462 - RNA, 17 nt, Salmonella enterica enterica serovar Typhi Ty2
cggucauguuccaacaa

SEQ ID NO: 3703463 - RNA, 15 nt, Salmonella enterica enterica serovar Typhi Ty2
cggucccuggcuggu

SEQ ID NO: 3703464 - RNA, 18 nt, Salmonella enterica enterica serovar Typhi Ty2
cggucgaaaugccuuacc

SEQ ID NO: 3703465 - RNA, 23 nt, Salmonella enterica enterica serovar Typhi Ty2
cggucgacagccacacgccacaa

SEQ ID NO: 3703466 - RNA, 21 nt, Salmonella enterica enterica serovar Typhi Ty2
cggucgccguuaacuggcgca

SEQ ID NO: 3703467 - RNA, 13 nt, Salmonella enterica enterica serovar Typhi Ty2
cggucgcgcgcag

SEQ ID NO: 3703468 - RNA, 20 nt, Salmonella enterica enterica serovar Typhi Ty2
cggucgcuuuuugcgccagc

SEQ ID NO: 3703469 - RNA, 15 nt, Salmonella enterica enterica serovar Typhi Ty2
cggucggccuuaacg

SEQ ID NO: 3703470 - RNA, 23 nt, Salmonella enterica enterica serovar Typhi Ty2
cggucguaaacacgacgccgccg

SEQ ID NO: 3703471 - RNA, 23 nt, Salmonella enterica enterica serovar Typhi Ty2
cggucugauaagcgcagcgccau

SEQ ID NO: 3703472 - RNA, 15 nt, Salmonella enterica enterica serovar Typhi Ty2
cggucugucgguaaa

SEQ ID NO: 3703473 - RNA, 15 nt, Salmonella enterica enterica serovar Typhi Ty2
cggucuucacucacc

SEQ ID NO: 3703474 - RNA, 15 nt, Salmonella enterica enterica serovar Typhi Ty2
cggucuuucaacaua

SEQ ID NO: 3703475 - RNA, 15 nt, Salmonella enterica enterica serovar Typhi Ty2
cggucuuuuucgcag

SEQ ID NO: 3703476 - RNA, 17 nt, Salmonella enterica enterica serovar Typhi Ty2
cggugaagaaaaucccg

SEQ ID NO: 3703477 - RNA, 13 nt, Salmonella enterica enterica serovar Typhi Ty2
cggugaagacgac

SEQ ID NO: 3703478 - RNA, 18 nt, Salmonella enterica enterica serovar Typhi Ty2
cggugaauauuugcgcua

SEQ ID NO: 3703479 - RNA, 21 nt, Salmonella enterica enterica serovar Typhi Ty2
cggugaccugccuuucccauc

SEQ ID NO: 3703480 - RNA, 22 nt, Salmonella enterica enterica serovar Typhi Ty2
cggugacgcgaucgucgguaau

SEQ ID NO: 3703481 - RNA, 17 nt, Salmonella enterica enterica serovar Typhi Ty2
cggugacggaaaccagc

SEQ ID NO: 3703482 - RNA, 19 nt, Salmonella enterica enterica serovar Typhi Ty2
cggugacggaaaccagcau

SEQ ID NO: 3703483 - RNA, 18 nt, Salmonella enterica enterica serovar Typhi Ty2
cguaaauucccuccagau

SEQ ID NO: 3703484 - RNA, 20 nt, Salmonella enterica enterica serovar Typhi Ty2
cguaaauuccuuguuuuaac

SEQ ID NO: 3703485 - RNA, 23 nt, Salmonella enterica enterica serovar Typhi Ty2
cguaaauucucuauacugcugac

SEQ ID NO: 3703486 - RNA, 18 nt, Salmonella enterica enterica serovar Typhi Ty2
cguaacagacgcaucuuu

SEQ ID NO: 3703487 - RNA, 23 nt, Salmonella enterica enterica serovar Typhi Ty2
cguaacagacgcaucuuuuuccc

SEQ ID NO: 3703488 - RNA, 13 nt, Salmonella enterica enterica serovar Typhi Ty2
cguaacaggucac

SEQ ID NO: 3703489 - RNA, 12 nt, Salmonella enterica enterica serovar Typhi Ty2
cguaacccagug

SEQ ID NO: 3703490 - RNA, 17 nt, Salmonella enterica enterica serovar Typhi Ty2
cguaaccgcaaaugcca

SEQ ID NO: 3703491 - RNA, 13 nt, Salmonella enterica enterica serovar Typhi Ty2
cguaaccgcagcg

SEQ ID NO: 3703492 - RNA, 12 nt, Salmonella enterica enterica serovar Typhi Ty2
cguaacgccaca

SEQ ID NO: 3703493 - RNA, 15 nt, Salmonella enterica enterica serovar Typhi Ty2
cguaacguagcaauc

SEQ ID NO: 3703494 - RNA, 21 nt, Salmonella enterica enterica serovar Typhi Ty2
cguaacugcgguaaauaaugc

SEQ ID NO: 3703495 - RNA, 18 nt, Salmonella enterica enterica serovar Typhi Ty2
cguaacuugauuccuggc

SEQ ID NO: 3703496 - RNA, 11 nt, Salmonella enterica enterica serovar Typhi Ty2
cguaagaaaag

SEQ ID NO: 3703497 - RNA, 19 nt, Salmonella enterica enterica serovar Typhi Ty2
cguaagaauuauuaccaau

SEQ ID NO: 3703498 - RNA, 14 nt, Salmonella enterica enterica serovar Typhi Ty2
cguaagaccagauu

SEQ ID NO: 3703499 - RNA, 22 nt, Salmonella enterica enterica serovar Typhi Ty2
cguaagccaccgcccagagaau

SEQ ID NO: 3703500 - RNA, 20 nt, Salmonella enterica enterica serovar Typhi Ty2
cguaagccaguucucuucuu

SEQ ID NO: 3703501 - RNA, 12 nt, Salmonella enterica enterica serovar Typhi Ty2
cguaagcgcguu

SEQ ID NO: 3703502 - RNA, 21 nt, Salmonella enterica enterica serovar Typhi Ty2
cguaagcgcuaugcccaccgc

SEQ ID NO: 3703503 - RNA, 16 nt, Salmonella enterica enterica serovar Typhi Ty2
cguaagcgggaugggu

SEQ ID NO: 3703504 - RNA, 23 nt, Salmonella enterica enterica serovar Typhi Ty2
cguaagcuuucugaauuucacgc

SEQ ID NO: 3703505 - RNA, 18 nt, Salmonella enterica enterica serovar Typhi Ty2
cguaaggauacucagcga

SEQ ID NO: 3703506 - RNA, 19 nt, Salmonella enterica enterica serovar Typhi Ty2
cguaaggauacucagcgac

SEQ ID NO: 3703507 - RNA, 16 nt, Salmonella enterica enterica serovar Typhi Ty2
cguaagucguaccggc

SEQ ID NO: 3703508 - RNA, 18 nt, Salmonella enterica enterica serovar Typhi Ty2
cguaaguuaaaacgccau

SEQ ID NO: 3703509 - RNA, 16 nt, Salmonella enterica enterica serovar Typhi Ty2
cguaauaaggcggaua

SEQ ID NO: 3703510 - RNA, 15 nt, Salmonella enterica enterica serovar Typhi Ty2
cguaauacgaucuuc

SEQ ID NO: 3703511 - RNA, 19 nt, Salmonella enterica enterica serovar Typhi Ty2
cguaauacguaaaccgcuc

SEQ ID NO: 3703512 - RNA, 17 nt, Salmonella enterica enterica serovar Typhi Ty2
cguaauauacgccaccu

SEQ ID NO: 3703513 - RNA, 15 nt, Salmonella enterica enterica serovar Typhi Ty2
cguaauccggccugg

SEQ ID NO: 3703514 - RNA, 14 nt, Salmonella enterica enterica serovar Typhi Ty2
cguaaucggccugu

SEQ ID NO: 3703515 - RNA, 21 nt, Salmonella enterica enterica serovar Typhi Ty2
cguaaucuuuucauauuauuu

SEQ ID NO: 3703516 - RNA, 22 nt, Salmonella enterica enterica serovar Typhi Ty2
cguaaucuuuucauauuauuug

SEQ ID NO: 3703517 - RNA, 12 nt, Salmonella enterica enterica serovar Typhi Ty2
cguaaugagcac

SEQ ID NO: 3703518 - RNA, 20 nt, Salmonella enterica enterica serovar Typhi Ty2
cguaaugagcgucgccagac

SEQ ID NO: 3703519 - RNA, 20 nt, Salmonella enterica enterica serovar Typhi Ty2
cguaaugcgccccggcggcg

SEQ ID NO: 3703520 - RNA, 22 nt, Salmonella enterica enterica serovar Typhi Ty2
cguaaugugaaaaacgggagau

SEQ ID NO: 3703521 - RNA, 19 nt, Salmonella enterica enterica serovar Typhi Ty2
cguaauuaaccgcgccgcu

SEQ ID NO: 3703522 - RNA, 17 nt, Salmonella enterica enterica serovar Typhi Ty2
cguaauuguugccccgc

SEQ ID NO: 3703523 - RNA, 19 nt, Salmonella enterica enterica serovar Typhi Ty2
cguaauuugcgacauggcg

SEQ ID NO: 3703524 - RNA, 21 nt, Salmonella enterica enterica serovar Typhi Ty2
cguacaggcggaaaucaacaa

SEQ ID NO: 3703525 - RNA, 17 nt, Salmonella enterica enterica serovar Typhi Ty2
cguacauaacagcagca

SEQ ID NO: 3703526 - RNA, 18 nt, Salmonella enterica enterica serovar Typhi Ty2
cguacauaacagcagcag

SEQ ID NO: 3703527 - RNA, 15 nt, Salmonella enterica enterica serovar Typhi Ty2
cguacaugaauaaua

SEQ ID NO: 3703528 - RNA, 20 nt, Salmonella enterica enterica serovar Typhi Ty2
cguacauguccagaucuuca

SEQ ID NO: 3703529 - RNA, 16 nt, Salmonella enterica enterica serovar Typhi Ty2
cguacauugccggaug

SEQ ID NO: 3703530 - RNA, 14 nt, Salmonella enterica enterica serovar Typhi Ty2
cguaccaggcagcg

SEQ ID NO: 3703531 - RNA, 16 nt, Salmonella enterica enterica serovar Typhi Ty2
cguaccaucagcguca

SEQ ID NO: 3703532 - RNA, 13 nt, Salmonella enterica enterica serovar Typhi Ty2
cguaccccaaucu

SEQ ID NO: 3703533 - RNA, 20 nt, Salmonella enterica enterica serovar Typhi Ty2
cguacccggcuuacaacauu

SEQ ID NO: 3703534 - RNA, 21 nt, Salmonella enterica enterica serovar Typhi Ty2
cguacccggcuuacaacauug

SEQ ID NO: 3703535 - RNA, 16 nt, Salmonella enterica enterica serovar Typhi Ty2
cguaccgaagaacaua

SEQ ID NO: 3703536 - RNA, 20 nt, Salmonella enterica enterica serovar Typhi Ty2
cguaccgaagaacauaaaca

SEQ ID NO: 3703537 - RNA, 20 nt, Salmonella enterica enterica serovar Typhi Ty2
cguaccgccuuguccggccu

SEQ ID NO: 3703538 - RNA, 14 nt, Salmonella enterica enterica serovar Typhi Ty2
cguaccgcgcgccc

SEQ ID NO: 3703539 - RNA, 18 nt, Salmonella enterica enterica serovar Typhi Ty2
cguaccgcguuuaacgca

SEQ ID NO: 3703540 - RNA, 20 nt, Salmonella enterica enterica serovar Typhi Ty2
cguaccggcgcucagccaga

SEQ ID NO: 3703541 - RNA, 20 nt, Salmonella enterica enterica serovar Typhi Ty2
cguaccgucuggcgaggcgc

SEQ ID NO: 3703542 - RNA, 20 nt, Salmonella enterica enterica serovar Typhi Ty2
cguacgccuaaaugaacuua

SEQ ID NO: 3703543 - RNA, 13 nt, Salmonella enterica enterica serovar Typhi Ty2
cguacggaaggua

SEQ ID NO: 3703544 - RNA, 14 nt, Salmonella enterica enterica serovar Typhi Ty2
cguacggcuucaau

SEQ ID NO: 3703545 - RNA, 20 nt, Salmonella enterica enterica serovar Typhi Ty2
cguacguuuuuccauucaca

SEQ ID NO: 3703546 - RNA, 19 nt, Salmonella enterica enterica serovar Typhi Ty2
cguacuaaagagcgccuga

SEQ ID NO: 3703547 - RNA, 22 nt, Salmonella enterica enterica serovar Typhi Ty2
cguacucagaucggcagacagu

SEQ ID NO: 3703548 - RNA, 19 nt, Salmonella enterica enterica serovar Typhi Ty2
cguacucggauagcuacga

SEQ ID NO: 3703549 - RNA, 22 nt, Salmonella enterica enterica serovar Typhi Ty2
cguacucuaggcgcugcuggca

SEQ ID NO: 3703550 - RNA, 17 nt, Salmonella enterica enterica serovar Typhi Ty2
cguagaacagcaugaau

SEQ ID NO: 3703551 - RNA, 14 nt, Salmonella enterica enterica serovar Typhi Ty2
cguagaagcuuacc

SEQ ID NO: 3703552 - RNA, 16 nt, Salmonella enterica enterica serovar Typhi Ty2
cguagaccgcccagga

SEQ ID NO: 3703553 - RNA, 15 nt, Salmonella enterica enterica serovar Typhi Ty2
cguagaucuuuugcg

SEQ ID NO: 3703554 - RNA, 12 nt, Salmonella enterica enterica serovar Typhi Ty2
cguagcaaauag

SEQ ID NO: 3703555 - RNA, 13 nt, Salmonella enterica enterica serovar Typhi Ty2
cguagccagagcg

SEQ ID NO: 3703556 - RNA, 21 nt, Salmonella enterica enterica serovar Typhi Ty2
cguagcccagcgccgcaucgc

SEQ ID NO: 3703557 - RNA, 20 nt, Salmonella enterica enterica serovar Typhi Ty2
cguagccccuaucuggugcu

SEQ ID NO: 3703558 - RNA, 17 nt, Salmonella enterica enterica serovar Typhi Ty2
cguagccgaacaguuuc

SEQ ID NO: 3703559 - RNA, 16 nt, Salmonella enterica enterica serovar Typhi Ty2
cguagccgcagaacca

SEQ ID NO: 3703560 - RNA, 18 nt, Salmonella enterica enterica serovar Typhi Ty2
cguagccgcagaaccauu

SEQ ID NO: 3703561 - RNA, 17 nt, Salmonella enterica enterica serovar Typhi Ty2
cguagccgccgagcgcc

SEQ ID NO: 3703562 - RNA, 12 nt, Salmonella enterica enterica serovar Typhi Ty2
cguagccgcgcg

SEQ ID NO: 3703563 - RNA, 14 nt, Salmonella enterica enterica serovar Typhi Ty2
cguagccgcgcgcc

SEQ ID NO: 3703564 - RNA, 22 nt, Salmonella enterica enterica serovar Typhi Ty2
cguagccgcuuacucagccaga

SEQ ID NO: 3703565 - RNA, 12 nt, Salmonella enterica enterica serovar Typhi Ty2
cgucacgaccgg

SEQ ID NO: 3703566 - RNA, 14 nt, Salmonella enterica enterica serovar Typhi Ty2
cgucacgaccggcg

SEQ ID NO: 3703567 - RNA, 17 nt, Salmonella enterica enterica serovar Typhi Ty2
cgucacgcaacaggccg

SEQ ID NO: 3703568 - RNA, 15 nt, Salmonella enterica enterica serovar Typhi Ty2
cgucacgccaucagg

SEQ ID NO: 3703569 - RNA, 21 nt, Salmonella enterica enterica serovar Typhi Ty2
cgucacgccgacgaccggcag

SEQ ID NO: 3703570 - RNA, 18 nt, Salmonella enterica enterica serovar Typhi Ty2
cgucacgcguucgaccgu

SEQ ID NO: 3703571 - RNA, 19 nt, Salmonella enterica enterica serovar Typhi Ty2
cgucagacaggccugguua

SEQ ID NO: 3703572 - RNA, 18 nt, Salmonella enterica enterica serovar Typhi Ty2
cgucagaccggcaaucaa

SEQ ID NO: 3703573 - RNA, 19 nt, Salmonella enterica enterica serovar Typhi Ty2
cgucagacggcuccagcgc

SEQ ID NO: 3703574 - RNA, 17 nt, Salmonella enterica enterica serovar Typhi Ty2
cgucagauaaagcuucu

SEQ ID NO: 3703575 - RNA, 17 nt, Salmonella enterica enterica serovar Typhi Ty2
cgucagcacgccgcccg

SEQ ID NO: 3703576 - RNA, 13 nt, Salmonella enterica enterica serovar Typhi Ty2
cgucagcauggua

SEQ ID NO: 3703577 - RNA, 23 nt, Salmonella enterica enterica serovar Typhi Ty2
cgucagccacuucuuccagcggc

SEQ ID NO: 3703578 - RNA, 11 nt, Salmonella enterica enterica serovar Typhi Ty2
cgucagccaga

SEQ ID NO: 3703579 - RNA, 15 nt, Salmonella enterica enterica serovar Typhi Ty2
cgucagccagaacga

SEQ ID NO: 3703580 - RNA, 21 nt, Salmonella enterica enterica serovar Typhi Ty2
cgucagccccguacaaggucg

SEQ ID NO: 3703581 - RNA, 14 nt, Salmonella enterica enterica serovar Typhi Ty2
cgucagcgcauacc

SEQ ID NO: 3703582 - RNA, 18 nt, Salmonella enterica enterica serovar Typhi Ty2
cgucagcgcccgauaaau

SEQ ID NO: 3703583 - RNA, 15 nt, Salmonella enterica enterica serovar Typhi Ty2
cgucagcgccuccgc

SEQ ID NO: 3703584 - RNA, 18 nt, Salmonella enterica enterica serovar Typhi Ty2
cgucaggaucguaacagg

SEQ ID NO: 3703585 - RNA, 23 nt, Salmonella enterica enterica serovar Typhi Ty2
cgucaggcccauuuucggcauca

SEQ ID NO: 3703586 - RNA, 21 nt, Salmonella enterica enterica serovar Typhi Ty2
cgucaggccgccgcaaaagcc

SEQ ID NO: 3703587 - RNA, 18 nt, Salmonella enterica enterica serovar Typhi Ty2
cgucagguuuaaucggcg

SEQ ID NO: 3703588 - RNA, 16 nt, Salmonella enterica enterica serovar Typhi Ty2
cgucaguaccagcgag

SEQ ID NO: 3703589 - RNA, 13 nt, Salmonella enterica enterica serovar Typhi Ty2
cgucauaaucgcg

SEQ ID NO: 3703590 - RNA, 16 nt, Salmonella enterica enterica serovar Typhi Ty2
cgucauagccgcgcgu

SEQ ID NO: 3703591 - RNA, 18 nt, Salmonella enterica enterica serovar Typhi Ty2
cgucauauagccgcgcag

SEQ ID NO: 3703592 - RNA, 21 nt, Salmonella enterica enterica serovar Typhi Ty2
cgucaucaggcguuguaauaa

SEQ ID NO: 3703593 - RNA, 23 nt, Salmonella enterica enterica serovar Typhi Ty2
cgucaucauuaccuuuuccggcg

SEQ ID NO: 3703594 - RNA, 19 nt, Salmonella enterica enterica serovar Typhi Ty2
cgucauccgcguaaucgcg

SEQ ID NO: 3703595 - RNA, 19 nt, Salmonella enterica enterica serovar Typhi Ty2
cgucauccggcaagcgcug

SEQ ID NO: 3703596 - RNA, 18 nt, Salmonella enterica enterica serovar Typhi Ty2
cgucauccggcaaucaga

SEQ ID NO: 3703597 - RNA, 13 nt, Salmonella enterica enterica serovar Typhi Ty2
cgucauccuccug

SEQ ID NO: 3703598 - RNA, 18 nt, Salmonella enterica enterica serovar Typhi Ty2
cgucaucgcgcgcaggcc

SEQ ID NO: 3703599 - RNA, 21 nt, Salmonella enterica enterica serovar Typhi Ty2
cgucaucgcucaucucaagcc

SEQ ID NO: 3703600 - RNA, 20 nt, Salmonella enterica enterica serovar Typhi Ty2
cgucaucgcuccagacggcg

SEQ ID NO: 3703601 - RNA, 17 nt, Salmonella enterica enterica serovar Typhi Ty2
cgucaucggcgcgcugg

SEQ ID NO: 3703602 - RNA, 16 nt, Salmonella enterica enterica serovar Typhi Ty2
cgucaucgggcuguua

SEQ ID NO: 3703603 - RNA, 23 nt, Salmonella enterica enterica serovar Typhi Ty2
cgucaugauguuugucuuuucca

SEQ ID NO: 3703604 - RNA, 22 nt, Salmonella enterica enterica serovar Typhi Ty2
cgucaugcuucaccucagcaaa

SEQ ID NO: 3703605 - RNA, 24 nt, Salmonella enterica enterica serovar Typhi Ty2
cgucauuaugcauugccaugcgac

SEQ ID NO: 3703606 - RNA, 13 nt, Salmonella enterica enterica serovar Typhi Ty2
cgucauuuaccag

SEQ ID NO: 3703607 - RNA, 13 nt, Salmonella enterica enterica serovar Typhi Ty2
cgucauuuacugc

SEQ ID NO: 3703608 - RNA, 14 nt, Salmonella enterica enterica serovar Typhi Ty2
cgucauuuccggcg

SEQ ID NO: 3703609 - RNA, 19 nt, Salmonella enterica enterica serovar Typhi Ty2
cgucauuuucuuucaucaa

SEQ ID NO: 3703610 - RNA, 21 nt, Salmonella enterica enterica serovar Typhi Ty2
cguccacacgccuggccaggc

SEQ ID NO: 3703611 - RNA, 13 nt, Salmonella enterica enterica serovar Typhi Ty2
cguccacauccag

SEQ ID NO: 3703612 - RNA, 18 nt, Salmonella enterica enterica serovar Typhi Ty2
cguccacauccagcgcca

SEQ ID NO: 3703613 - RNA, 12 nt, Salmonella enterica enterica serovar Typhi Ty2
cguccacucuuc

SEQ ID NO: 3703614 - RNA, 13 nt, Salmonella enterica enterica serovar Typhi Ty2
cguccagauaaug

SEQ ID NO: 3703615 - RNA, 11 nt, Salmonella enterica enterica serovar Typhi Ty2
cguccagaugc

SEQ ID NO: 3703616 - RNA, 18 nt, Salmonella enterica enterica serovar Typhi Ty2
cguccagccgcucuguau

SEQ ID NO: 3703617 - RNA, 19 nt, Salmonella enterica enterica serovar Typhi Ty2
cguccagcgcgugaaccgu

SEQ ID NO: 3703618 - RNA, 11 nt, Salmonella enterica enterica serovar Typhi Ty2
cguccagcggc

SEQ ID NO: 3703619 - RNA, 19 nt, Salmonella enterica enterica serovar Typhi Ty2
cguccaggccugauaagca

SEQ ID NO: 3703620 - RNA, 16 nt, Salmonella enterica enterica serovar Typhi Ty2
cguccauaagcgcggc

SEQ ID NO: 3703621 - RNA, 14 nt, Salmonella enterica enterica serovar Typhi Ty2
cguccauccgggua

SEQ ID NO: 3703622 - RNA, 21 nt, Salmonella enterica enterica serovar Typhi Ty2
cguccauuucaaugcauacug

SEQ ID NO: 3703623 - RNA, 16 nt, Salmonella enterica enterica serovar Typhi Ty2
cgucccagcggauguc

SEQ ID NO: 3703624 - RNA, 13 nt, Salmonella enterica enterica serovar Typhi Ty2
cguccccagccag

SEQ ID NO: 3703625 - RNA, 18 nt, Salmonella enterica enterica serovar Typhi Ty2
cguccccagccagagauc

SEQ ID NO: 3703626 - RNA, 17 nt, Salmonella enterica enterica serovar Typhi Ty2
cguccccuauacgccau

SEQ ID NO: 3703627 - RNA, 18 nt, Salmonella enterica enterica serovar Typhi Ty2
cguccccuggacgcgagc

SEQ ID NO: 3703628 - RNA, 19 nt, Salmonella enterica enterica serovar Typhi Ty2
cgucccguuuuucccgcug

SEQ ID NO: 3703629 - RNA, 15 nt, Salmonella enterica enterica serovar Typhi Ty2
cgucccugccacagu

SEQ ID NO: 3703630 - RNA, 14 nt, Salmonella enterica enterica serovar Typhi Ty2
cgucccuuucccuu

SEQ ID NO: 3703631 - RNA, 21 nt, Salmonella enterica enterica serovar Typhi Ty2
cgucccuuucccuuccagcga

SEQ ID NO: 3703632 - RNA, 18 nt, Salmonella enterica enterica serovar Typhi Ty2
cguccgcagccgacgcau

SEQ ID NO: 3703633 - RNA, 14 nt, Salmonella enterica enterica serovar Typhi Ty2
cguccgccaacagc

SEQ ID NO: 3703634 - RNA, 12 nt, Salmonella enterica enterica serovar Typhi Ty2
cguccgccaggc

SEQ ID NO: 3703635 - RNA, 16 nt, Salmonella enterica enterica serovar Typhi Ty2
cguccggaaaauccuc

SEQ ID NO: 3703636 - RNA, 19 nt, Salmonella enterica enterica serovar Typhi Ty2
cguccggcaucgugauaaa

SEQ ID NO: 3703637 - RNA, 21 nt, Salmonella enterica enterica serovar Typhi Ty2
cguccguucacuaacgcggca

SEQ ID NO: 3703638 - RNA, 16 nt, Salmonella enterica enterica serovar Typhi Ty2
cguccuccaacgugca

SEQ ID NO: 3703639 - RNA, 21 nt, Salmonella enterica enterica serovar Typhi Ty2
cguccugacggugcgcgacgc

SEQ ID NO: 3703640 - RNA, 22 nt, Salmonella enterica enterica serovar Typhi Ty2
cguccugacggugcgcgacgcc

SEQ ID NO: 3703641 - RNA, 12 nt, Salmonella enterica enterica serovar Typhi Ty2
cguccugcggcu

SEQ ID NO: 3703642 - RNA, 19 nt, Salmonella enterica enterica serovar Typhi Ty2
cguccuguagccgugccug

SEQ ID NO: 3703643 - RNA, 20 nt, Salmonella enterica enterica serovar Typhi Ty2
cguccuucacguuauucgga

SEQ ID NO: 3703644 - RNA, 15 nt, Salmonella enterica enterica serovar Typhi Ty2
cgucgaaugacgcgc

SEQ ID NO: 3703645 - RNA, 13 nt, Salmonella enterica enterica serovar Typhi Ty2
cgucgacagcgcc

SEQ ID NO: 3703646 - RNA, 18 nt, Salmonella enterica enterica serovar Typhi Ty2
cgucgaccauacgcagca

SEQ ID NO: 3703647 - RNA, 17 nt, Salmonella enterica enterica serovar Typhi Ty2
cgugugcggaugcgcca

SEQ ID NO: 3703648 - RNA, 22 nt, Salmonella enterica enterica serovar Typhi Ty2
cgugugcgguauagaucagacg

SEQ ID NO: 3703649 - RNA, 20 nt, Salmonella enterica enterica serovar Typhi Ty2
cguguggcggaaugaccuga

SEQ ID NO: 3703650 - RNA, 11 nt, Salmonella enterica enterica serovar Typhi Ty2
cguguggcugu

SEQ ID NO: 3703651 - RNA, 20 nt, Salmonella enterica enterica serovar Typhi Ty2
cgugugucccggacaaugua

SEQ ID NO: 3703652 - RNA, 20 nt, Salmonella enterica enterica serovar Typhi Ty2
cguguuacugacgaccggca

SEQ ID NO: 3703653 - RNA, 13 nt, Salmonella enterica enterica serovar Typhi Ty2
cguguuauuuuca

SEQ ID NO: 3703654 - RNA, 15 nt, Salmonella enterica enterica serovar Typhi Ty2
cguguucaugcgcgg

SEQ ID NO: 3703655 - RNA, 18 nt, Salmonella enterica enterica serovar Typhi Ty2
cguuaaacaccucaccgg

SEQ ID NO: 3703656 - RNA, 15 nt, Salmonella enterica enterica serovar Typhi Ty2
cguuaaauaccagca

SEQ ID NO: 3703657 - RNA, 18 nt, Salmonella enterica enterica serovar Typhi Ty2
cguuaaauaccagcaccu

SEQ ID NO: 3703658 - RNA, 20 nt, Salmonella enterica enterica serovar Typhi Ty2
cguuaaauccucccaucgag

SEQ ID NO: 3703659 - RNA, 15 nt, Salmonella enterica enterica serovar Typhi Ty2
cguuaaccagcggcg

SEQ ID NO: 3703660 - RNA, 14 nt, Salmonella enterica enterica serovar Typhi Ty2
cguuaacccggcau

SEQ ID NO: 3703661 - RNA, 15 nt, Salmonella enterica enterica serovar Typhi Ty2
cguuaacccggcauu

SEQ ID NO: 3703662 - RNA, 20 nt, Salmonella enterica enterica serovar Typhi Ty2
cguuaacguaaagccaucca

SEQ ID NO: 3703663 - RNA, 16 nt, Salmonella enterica enterica serovar Typhi Ty2
cguuaaggccugcgcg

SEQ ID NO: 3703664 - RNA, 22 nt, Salmonella enterica enterica serovar Typhi Ty2
cguuaaggugcauuccgcgcaa

SEQ ID NO: 3703665 - RNA, 13 nt, Salmonella enterica enterica serovar Typhi Ty2
cguuaaucggcac

SEQ ID NO: 3703666 - RNA, 17 nt, Salmonella enterica enterica serovar Typhi Ty2
cguuaauucauggccau

SEQ ID NO: 3703667 - RNA, 23 nt, Salmonella enterica enterica serovar Typhi Ty2
cguuaauugauggcaccaccugg

SEQ ID NO: 3703668 - RNA, 16 nt, Salmonella enterica enterica serovar Typhi Ty2
cguuacccaugagcga

SEQ ID NO: 3703669 - RNA, 17 nt, Salmonella enterica enterica serovar Typhi Ty2
cguuaccccuuuuucaa

SEQ ID NO: 3703670 - RNA, 12 nt, Salmonella enterica enterica serovar Typhi Ty2
cguuacccuccu

SEQ ID NO: 3703671 - RNA, 16 nt, Salmonella enterica enterica serovar Typhi Ty2
cguuaccgccgagcau

SEQ ID NO: 3703672 - RNA, 15 nt, Salmonella enterica enterica serovar Typhi Ty2
cguuaccggcaggcu

SEQ ID NO: 3703673 - RNA, 16 nt, Salmonella enterica enterica serovar Typhi Ty2
cguuaccgggcaaacg

SEQ ID NO: 3703674 - RNA, 13 nt, Salmonella enterica enterica serovar Typhi Ty2
cguuacgcauuuc

SEQ ID NO: 3703675 - RNA, 15 nt, Salmonella enterica enterica serovar Typhi Ty2
cguuacgcgcugcaa

SEQ ID NO: 3703676 - RNA, 20 nt, Salmonella enterica enterica serovar Typhi Ty2
cguuacggcugaagcugccg

SEQ ID NO: 3703677 - RNA, 18 nt, Salmonella enterica enterica serovar Typhi Ty2
cguuacuggcgaccggca

SEQ ID NO: 3703678 - RNA, 15 nt, Salmonella enterica enterica serovar Typhi Ty2
cguuacuucccccau

SEQ ID NO: 3703679 - RNA, 19 nt, Salmonella enterica enterica serovar Typhi Ty2
cguuacuuucauaauguuc

SEQ ID NO: 3703680 - RNA, 19 nt, Salmonella enterica enterica serovar Typhi Ty2
cguuagaaccaaucgagaa

SEQ ID NO: 3703681 - RNA, 20 nt, Salmonella enterica enterica serovar Typhi Ty2
cguuagauauagcuuuucaa

SEQ ID NO: 3703682 - RNA, 13 nt, Salmonella enterica enterica serovar Typhi Ty2
cguuagccgccau

SEQ ID NO: 3703683 - RNA, 19 nt, Salmonella enterica enterica serovar Typhi Ty2
cguuagccgccauccggca

SEQ ID NO: 3703684 - RNA, 21 nt, Salmonella enterica enterica serovar Typhi Ty2
cguuagcgagguucccgccgc

SEQ ID NO: 3703685 - RNA, 22 nt, Salmonella enterica enterica serovar Typhi Ty2
cguuagcgccauccggcauuuc

SEQ ID NO: 3703686 - RNA, 18 nt, Salmonella enterica enterica serovar Typhi Ty2
cguuagcgucauccggca

SEQ ID NO: 3703687 - RNA, 15 nt, Salmonella enterica enterica serovar Typhi Ty2
cguuauaauccugau

SEQ ID NO: 3703688 - RNA, 18 nt, Salmonella enterica enterica serovar Typhi Ty2
cguuaucauuaucgccaa

SEQ ID NO: 3703689 - RNA, 12 nt, Salmonella enterica enterica serovar Typhi Ty2
cguuauccagca

SEQ ID NO: 3703690 - RNA, 15 nt, Salmonella enterica enterica serovar Typhi Ty2
cguuauccagcagcc

SEQ ID NO: 3703691 - RNA, 14 nt, Salmonella enterica enterica serovar Typhi Ty2
cguuaucggccugc

SEQ ID NO: 3703692 - RNA, 18 nt, Salmonella enterica enterica serovar Typhi Ty2
cguuaucguagugccaca

SEQ ID NO: 3703693 - RNA, 18 nt, Salmonella enterica enterica serovar Typhi Ty2
cguuaucugaccuacagg

SEQ ID NO: 3703694 - RNA, 16 nt, Salmonella enterica enterica serovar Typhi Ty2
cguuaucuguaauuga

SEQ ID NO: 3703695 - RNA, 17 nt, Salmonella enterica enterica serovar Typhi Ty2
cguuaugaauggcggag

SEQ ID NO: 3703696 - RNA, 20 nt, Salmonella enterica enterica serovar Typhi Ty2
cguuauugaccaucgccagc

SEQ ID NO: 3703697 - RNA, 15 nt, Salmonella enterica enterica serovar Typhi Ty2
cguuauuuuccugaa

SEQ ID NO: 3703698 - RNA, 16 nt, Salmonella enterica enterica serovar Typhi Ty2
cguuauuuuccugaaa

SEQ ID NO: 3703699 - RNA, 21 nt, Salmonella enterica enterica serovar Typhi Ty2
cguuauuuuccugaaaaaauu

SEQ ID NO: 3703700 - RNA, 18 nt, Salmonella enterica enterica serovar Typhi Ty2
cguucaaaaucaaacaga

SEQ ID NO: 3703701 - RNA, 19 nt, Salmonella enterica enterica serovar Typhi Ty2
cguucaacggcaaaucgcg

SEQ ID NO: 3703702 - RNA, 19 nt, Salmonella enterica enterica serovar Typhi Ty2
cguucacaccgccgccagc

SEQ ID NO: 3703703 - RNA, 21 nt, Salmonella enterica enterica serovar Typhi Ty2
cguucacaccgccgccagcca

SEQ ID NO: 3703704 - RNA, 17 nt, Salmonella enterica enterica serovar Typhi Ty2
cguucaccacaacccac

SEQ ID NO: 3703705 - RNA, 21 nt, Salmonella enterica enterica serovar Typhi Ty2
cguucaccagccacugcgcca

SEQ ID NO: 3703706 - RNA, 15 nt, Salmonella enterica enterica serovar Typhi Ty2
cguucacgccgccau

SEQ ID NO: 3703707 - RNA, 15 nt, Salmonella enterica enterica serovar Typhi Ty2
cguucacgucgcgaa

SEQ ID NO: 3703708 - RNA, 23 nt, Salmonella enterica enterica serovar Typhi Ty2
cguucacuaacgcggcaucaagc

SEQ ID NO: 3703709 - RNA, 21 nt, Salmonella enterica enterica serovar Typhi Ty2
cguucagauaggcgcgaaaug

SEQ ID NO: 3703710 - RNA, 17 nt, Salmonella enterica enterica serovar Typhi Ty2
cguucagcauauccagc

SEQ ID NO: 3703711 - RNA, 15 nt, Salmonella enterica enterica serovar Typhi Ty2
cguucagcaucggga

SEQ ID NO: 3703712 - RNA, 13 nt, Salmonella enterica enterica serovar Typhi Ty2
cguucaggcggca

SEQ ID NO: 3703713 - RNA, 13 nt, Salmonella enterica enterica serovar Typhi Ty2
cguucaucaggca

SEQ ID NO: 3703714 - RNA, 14 nt, Salmonella enterica enterica serovar Typhi Ty2
cguucaucaggcaa

SEQ ID NO: 3703715 - RNA, 17 nt, Salmonella enterica enterica serovar Typhi Ty2
cguucauccaugauggc

SEQ ID NO: 3703716 - RNA, 12 nt, Salmonella enterica enterica serovar Typhi Ty2
cguucauccucc

SEQ ID NO: 3703717 - RNA, 15 nt, Salmonella enterica enterica serovar Typhi Ty2
cguucaucggcauac

SEQ ID NO: 3703718 - RNA, 14 nt, Salmonella enterica enterica serovar Typhi Ty2
cguucauucgcccc

SEQ ID NO: 3703719 - RNA, 19 nt, Salmonella enterica enterica serovar Typhi Ty2
cguucauucgccccagcau

SEQ ID NO: 3703720 - RNA, 16 nt, Salmonella enterica enterica serovar Typhi Ty2
cguucauugcuuucuu

SEQ ID NO: 3703721 - RNA, 21 nt, Salmonella enterica enterica serovar Typhi Ty2
cguuccacacguccauccggg

SEQ ID NO: 3703722 - RNA, 13 nt, Salmonella enterica enterica serovar Typhi Ty2
cguuccagcagcg

SEQ ID NO: 3703723 - RNA, 18 nt, Salmonella enterica enterica serovar Typhi Ty2
cguuccaucacuuccugu

SEQ ID NO: 3703724 - RNA, 18 nt, Salmonella enterica enterica serovar Typhi Ty2
cguucccgaaaauccgga

SEQ ID NO: 3703725 - RNA, 20 nt, Salmonella enterica enterica serovar Typhi Ty2
cguuccguucgcgucacaau

SEQ ID NO: 3703726 - RNA, 14 nt, Salmonella enterica enterica serovar Typhi Ty2
cguuccugccguca

SEQ ID NO: 3703727 - RNA, 14 nt, Salmonella enterica enterica serovar Typhi Ty2
cguuccuuaucagc

SEQ ID NO: 3703728 - RNA, 18 nt, Salmonella enterica enterica serovar Typhi Ty2
cguucgacaacggaucgc

SEQ ID NO: 3703729 - RNA, 14 nt, Salmonella enterica enterica serovar Typhi Ty2
cguuuuccagcauc

SEQ ID NO: 3703730 - RNA, 13 nt, Salmonella enterica enterica serovar Typhi Ty2
cguuuugcagcgc

SEQ ID NO: 3703731 - RNA, 16 nt, Salmonella enterica enterica serovar Typhi Ty2
cguuuugcagcgccau

SEQ ID NO: 3703732 - RNA, 17 nt, Salmonella enterica enterica serovar Typhi Ty2
cguuuugcgacuucaga

SEQ ID NO: 3703733 - RNA, 14 nt, Salmonella enterica enterica serovar Typhi Ty2
cguuuugcgcguaa

SEQ ID NO: 3703734 - RNA, 13 nt, Salmonella enterica enterica serovar Typhi Ty2
cguuuugcucuuc

SEQ ID NO: 3703735 - RNA, 17 nt, Salmonella enterica enterica serovar Typhi Ty2
cguuuugcugccacguc

SEQ ID NO: 3703736 - RNA, 12 nt, Salmonella enterica enterica serovar Typhi Ty2
cguuuugcuguc

SEQ ID NO: 3703737 - RNA, 19 nt, Salmonella enterica enterica serovar Typhi Ty2
cguuuuggguaaauaccag

SEQ ID NO: 3703738 - RNA, 20 nt, Salmonella enterica enterica serovar Typhi Ty2
cguuuuguaggccggauaag

SEQ ID NO: 3703739 - RNA, 13 nt, Salmonella enterica enterica serovar Typhi Ty2
cguuuuuagcucg

SEQ ID NO: 3703740 - RNA, 18 nt, Salmonella enterica enterica serovar Typhi Ty2
cguuuuuaucgcucgucg

SEQ ID NO: 3703741 - RNA, 16 nt, Salmonella enterica enterica serovar Typhi Ty2
cguuuuucucaucaag

SEQ ID NO: 3703742 - RNA, 15 nt, Salmonella enterica enterica serovar Typhi Ty2
cguuuuuuccagcgc

SEQ ID NO: 3703743 - RNA, 19 nt, Salmonella enterica enterica serovar Typhi Ty2
cguuuuuuccugcugguag

SEQ ID NO: 3703744 - RNA, 19 nt, Salmonella enterica enterica serovar Typhi Ty2
cguuuuuucgcacgccucu

SEQ ID NO: 3703745 - RNA, 19 nt, Salmonella enterica enterica serovar Typhi Ty2
cguuuuuuuguuuuaccug

SEQ ID NO: 3703746 - RNA, 14 nt, Salmonella enterica enterica serovar Typhi Ty2
cuaaaaaccagaau

SEQ ID NO: 3703747 - RNA, 16 nt, Salmonella enterica enterica serovar Typhi Ty2
cuaaaaaccugguccg

SEQ ID NO: 3703748 - RNA, 22 nt, Salmonella enterica enterica serovar Typhi Ty2
cuaaaaaucaaucuacuguuau

SEQ ID NO: 3703749 - RNA, 16 nt, Salmonella enterica enterica serovar Typhi Ty2
cuaaaauacccgaccc

SEQ ID NO: 3703750 - RNA, 19 nt, Salmonella enterica enterica serovar Typhi Ty2
cuaaaauuauuuuuacuua

SEQ ID NO: 3703751 - RNA, 23 nt, Salmonella enterica enterica serovar Typhi Ty2
cuaaacaauuugcccagcgcugg

SEQ ID NO: 3703752 - RNA, 14 nt, Salmonella enterica enterica serovar Typhi Ty2
cuaaaccacggaau

SEQ ID NO: 3703753 - RNA, 17 nt, Salmonella enterica enterica serovar Typhi Ty2
cuaaacccaccauaggc

SEQ ID NO: 3703754 - RNA, 11 nt, Salmonella enterica enterica serovar Typhi Ty2
cuaaaccggcg

SEQ ID NO: 3703755 - RNA, 18 nt, Salmonella enterica enterica serovar Typhi Ty2
cuaaaccggcggaauagc

SEQ ID NO: 3703756 - RNA, 23 nt, Salmonella enterica enterica serovar Typhi Ty2
cuaaaccgucauuuaccagugcu

SEQ ID NO: 3703757 - RNA, 16 nt, Salmonella enterica enterica serovar Typhi Ty2
cuaaaccuucgcuuuu

SEQ ID NO: 3703758 - RNA, 18 nt, Salmonella enterica enterica serovar Typhi Ty2
cuaaacucaacugggcga

SEQ ID NO: 3703759 - RNA, 13 nt, Salmonella enterica enterica serovar Typhi Ty2
cuaaacucaucuu

SEQ ID NO: 3703760 - RNA, 18 nt, Salmonella enterica enterica serovar Typhi Ty2
cuaaacucaucuuuauuc

SEQ ID NO: 3703761 - RNA, 11 nt, Salmonella enterica enterica serovar Typhi Ty2
cuaaagaaaaa

SEQ ID NO: 3703762 - RNA, 16 nt, Salmonella enterica enterica serovar Typhi Ty2
cuaaagagcgccugac

SEQ ID NO: 3703763 - RNA, 15 nt, Salmonella enterica enterica serovar Typhi Ty2
cuaaagcgcuggcgg

SEQ ID NO: 3703764 - RNA, 17 nt, Salmonella enterica enterica serovar Typhi Ty2
cuaaagggaucuuccug

SEQ ID NO: 3703765 - RNA, 20 nt, Salmonella enterica enterica serovar Typhi Ty2
cuaaaguuuauuuaggauuu

SEQ ID NO: 3703766 - RNA, 13 nt, Salmonella enterica enterica serovar Typhi Ty2
cuaaauaaaaaua

SEQ ID NO: 3703767 - RNA, 20 nt, Salmonella enterica enterica serovar Typhi Ty2
cuaaauccguuaagcccuga

SEQ ID NO: 3703768 - RNA, 19 nt, Salmonella enterica enterica serovar Typhi Ty2
cuaaaucuuuuugugcaau

SEQ ID NO: 3703769 - RNA, 16 nt, Salmonella enterica enterica serovar Typhi Ty2
cuaaaugaacuuacac

SEQ ID NO: 3703770 - RNA, 23 nt, Salmonella enterica enterica serovar Typhi Ty2
cuaaaugacgcgcgagaacugcu

SEQ ID NO: 3703771 - RNA, 17 nt, Salmonella enterica enterica serovar Typhi Ty2
cuaaaugcauagcccca

SEQ ID NO: 3703772 - RNA, 18 nt, Salmonella enterica enterica serovar Typhi Ty2
cuaaaugcauagccccag

SEQ ID NO: 3703773 - RNA, 18 nt, Salmonella enterica enterica serovar Typhi Ty2
cuaaauugggauguugcc

SEQ ID NO: 3703774 - RNA, 19 nt, Salmonella enterica enterica serovar Typhi Ty2
cuaacacaugcaagucgaa

SEQ ID NO: 3703775 - RNA, 12 nt, Salmonella enterica enterica serovar Typhi Ty2
cuaacagcagca

SEQ ID NO: 3703776 - RNA, 11 nt, Salmonella enterica enterica serovar Typhi Ty2
cuaacaggaag

SEQ ID NO: 3703777 - RNA, 13 nt, Salmonella enterica enterica serovar Typhi Ty2
cuaacagugaaau

SEQ ID NO: 3703778 - RNA, 14 nt, Salmonella enterica enterica serovar Typhi Ty2
cuaaccaaacagac

SEQ ID NO: 3703779 - RNA, 13 nt, Salmonella enterica enterica serovar Typhi Ty2
cuaaccagcgcaa

SEQ ID NO: 3703780 - RNA, 19 nt, Salmonella enterica enterica serovar Typhi Ty2
cuaacccggcaaacguaaa

SEQ ID NO: 3703781 - RNA, 17 nt, Salmonella enterica enterica serovar Typhi Ty2
cuaaccuguaucugcug

SEQ ID NO: 3703782 - RNA, 17 nt, Salmonella enterica enterica serovar Typhi Ty2
cuaacgaaaccggcggc

SEQ ID NO: 3703783 - RNA, 15 nt, Salmonella enterica enterica serovar Typhi Ty2
cuaacgaggccacca

SEQ ID NO: 3703784 - RNA, 17 nt, Salmonella enterica enterica serovar Typhi Ty2
cuaacgccgugucgacc

SEQ ID NO: 3703785 - RNA, 20 nt, Salmonella enterica enterica serovar Typhi Ty2
cuaacgccugauccggccua

SEQ ID NO: 3703786 - RNA, 18 nt, Salmonella enterica enterica serovar Typhi Ty2
cuaacgcggcaucaagca

SEQ ID NO: 3703787 - RNA, 14 nt, Salmonella enterica enterica serovar Typhi Ty2
cuaacgcucuucuc

SEQ ID NO: 3703788 - RNA, 16 nt, Salmonella enterica enterica serovar Typhi Ty2
cuaacgucagcgccac

SEQ ID NO: 3703789 - RNA, 20 nt, Salmonella enterica enterica serovar Typhi Ty2
cuaacgucuuauccggccua

SEQ ID NO: 3703790 - RNA, 14 nt, Salmonella enterica enterica serovar Typhi Ty2
cuaacuggaaaaag

SEQ ID NO: 3703791 - RNA, 17 nt, Salmonella enterica enterica serovar Typhi Ty2
cuaacugguacguccau

SEQ ID NO: 3703792 - RNA, 20 nt, Salmonella enterica enterica serovar Typhi Ty2
cuaacugguacguccauccg

SEQ ID NO: 3703793 - RNA, 21 nt, Salmonella enterica enterica serovar Typhi Ty2
cuaagagccugucccaccagg

SEQ ID NO: 3703794 - RNA, 21 nt, Salmonella enterica enterica serovar Typhi Ty2
cuaagagugacgguuuucacu

SEQ ID NO: 3703795 - RNA, 23 nt, Salmonella enterica enterica serovar Typhi Ty2
cuaagcacgggcuugaauaacau

SEQ ID NO: 3703796 - RNA, 12 nt, Salmonella enterica enterica serovar Typhi Ty2
cuaagccagaag

SEQ ID NO: 3703797 - RNA, 17 nt, Salmonella enterica enterica serovar Typhi Ty2
cuaagccaguucucaau

SEQ ID NO: 3703798 - RNA, 20 nt, Salmonella enterica enterica serovar Typhi Ty2
cuaagggguugaugccgacc

SEQ ID NO: 3703799 - RNA, 19 nt, Salmonella enterica enterica serovar Typhi Ty2
cuaaggucacuacgcggcu

SEQ ID NO: 3703800 - RNA, 14 nt, Salmonella enterica enterica serovar Typhi Ty2
cuaaguaaggagga

SEQ ID NO: 3703801 - RNA, 15 nt, Salmonella enterica enterica serovar Typhi Ty2
cuaagugagcauuac

SEQ ID NO: 3703802 - RNA, 18 nt, Salmonella enterica enterica serovar Typhi Ty2
cuaauaaaauaacuauaa

SEQ ID NO: 3703803 - RNA, 16 nt, Salmonella enterica enterica serovar Typhi Ty2
cuaauaaaauucacuu

SEQ ID NO: 3703804 - RNA, 16 nt, Salmonella enterica enterica serovar Typhi Ty2
cuaauaccgagaaugc

SEQ ID NO: 3703805 - RNA, 19 nt, Salmonella enterica enterica serovar Typhi Ty2
cuaauauccaccagcccau

SEQ ID NO: 3703806 - RNA, 21 nt, Salmonella enterica enterica serovar Typhi Ty2
cuaaucaauaaguuuuuucuu

SEQ ID NO: 3703807 - RNA, 15 nt, Salmonella enterica enterica serovar Typhi Ty2
cuaauccccagcgcu

SEQ ID NO: 3703808 - RNA, 22 nt, Salmonella enterica enterica serovar Typhi Ty2
cuaauccccauuuuuuucagcc

SEQ ID NO: 3703809 - RNA, 15 nt, Salmonella enterica enterica serovar Typhi Ty2
cuaaugaagcgcguu

SEQ ID NO: 3703810 - RNA, 17 nt, Salmonella enterica enterica serovar Typhi Ty2
cuaaugagccagaugga

SEQ ID NO: 3703811 - RNA, 15 nt, Salmonella enterica enterica serovar Typhi Ty2
cuagucaauaaagac

SEQ ID NO: 3703812 - RNA, 11 nt, Salmonella enterica enterica serovar Typhi Ty2
cuauaaaaauc

SEQ ID NO: 3703813 - RNA, 16 nt, Salmonella enterica enterica serovar Typhi Ty2
cuauaaaaaugaggua

SEQ ID NO: 3703814 - RNA, 15 nt, Salmonella enterica enterica serovar Typhi Ty2
cuauaacagcgcugg

SEQ ID NO: 3703815 - RNA, 22 nt, Salmonella enterica enterica serovar Typhi Ty2
cuauaaguacgcggucgccugc

SEQ ID NO: 3703816 - RNA, 18 nt, Salmonella enterica enterica serovar Typhi Ty2
cuauacgguaaaucauuu

SEQ ID NO: 3703817 - RNA, 23 nt, Salmonella enterica enterica serovar Typhi Ty2
cuauagagagauggaacaucuuu

SEQ ID NO: 3703818 - RNA, 23 nt, Salmonella enterica enterica serovar Typhi Ty2
cuauagcccacgcauaaugagcg

SEQ ID NO: 3703819 - RNA, 16 nt, Salmonella enterica enterica serovar Typhi Ty2
cuauagcuuuucauau

SEQ ID NO: 3703820 - RNA, 17 nt, Salmonella enterica enterica serovar Typhi Ty2
cuauaguggcauuuacc

SEQ ID NO: 3703821 - RNA, 18 nt, Salmonella enterica enterica serovar Typhi Ty2
cuauaguggcauuuaccu

SEQ ID NO: 3703822 - RNA, 20 nt, Salmonella enterica enterica serovar Typhi Ty2
cuauaugcaggcauaaaaaa

SEQ ID NO: 3703823 - RNA, 17 nt, Salmonella enterica enterica serovar Typhi Ty2
cuauauggcgcaagugu

SEQ ID NO: 3703824 - RNA, 16 nt, Salmonella enterica enterica serovar Typhi Ty2
cuaucaagauaaaaag

SEQ ID NO: 3703825 - RNA, 22 nt, Salmonella enterica enterica serovar Typhi Ty2
cuaucaccgcgaugaccaucaa

SEQ ID NO: 3703826 - RNA, 16 nt, Salmonella enterica enterica serovar Typhi Ty2
cuaucagaaaaaauua

SEQ ID NO: 3703827 - RNA, 14 nt, Salmonella enterica enterica serovar Typhi Ty2
cuaucagccgcgac

SEQ ID NO: 3703828 - RNA, 23 nt, Salmonella enterica enterica serovar Typhi Ty2
cuaucagguaacauaucgacaua

SEQ ID NO: 3703829 - RNA, 16 nt, Salmonella enterica enterica serovar Typhi Ty2
cuaucaugcugcgguu

SEQ ID NO: 3703830 - RNA, 15 nt, Salmonella enterica enterica serovar Typhi Ty2
cuauccacagcgaau

SEQ ID NO: 3703831 - RNA, 19 nt, Salmonella enterica enterica serovar Typhi Ty2
cuauccaccccuugcgcgu

SEQ ID NO: 3703832 - RNA, 11 nt, Salmonella enterica enterica serovar Typhi Ty2
cuauccacgca

SEQ ID NO: 3703833 - RNA, 18 nt, Salmonella enterica enterica serovar Typhi Ty2
cuauccacgcagacgccg

SEQ ID NO: 3703834 - RNA, 12 nt, Salmonella enterica enterica serovar Typhi Ty2
cuauccagcagu

SEQ ID NO: 3703835 - RNA, 17 nt, Salmonella enterica enterica serovar Typhi Ty2
cuauccagcaguaaaua

SEQ ID NO: 3703836 - RNA, 14 nt, Salmonella enterica enterica serovar Typhi Ty2
cuauccagucagcg

SEQ ID NO: 3703837 - RNA, 16 nt, Salmonella enterica enterica serovar Typhi Ty2
cuauccagucagcguu

SEQ ID NO: 3703838 - RNA, 23 nt, Salmonella enterica enterica serovar Typhi Ty2
cuauccauaccggacuccaggca

SEQ ID NO: 3703839 - RNA, 22 nt, Salmonella enterica enterica serovar Typhi Ty2
cuaucccaggcggagaaaugcg

SEQ ID NO: 3703840 - RNA, 18 nt, Salmonella enterica enterica serovar Typhi Ty2
cuauccgaugaagccugg

SEQ ID NO: 3703841 - RNA, 20 nt, Salmonella enterica enterica serovar Typhi Ty2
cuauccgccagguauucuaa

SEQ ID NO: 3703842 - RNA, 15 nt, Salmonella enterica enterica serovar Typhi Ty2
cuauccgccgccagc

SEQ ID NO: 3703843 - RNA, 21 nt, Salmonella enterica enterica serovar Typhi Ty2
cuauccgccgccagccauaaa

SEQ ID NO: 3703844 - RNA, 23 nt, Salmonella enterica enterica serovar Typhi Ty2
cuauccucuuuuaucacccggau

SEQ ID NO: 3703845 - RNA, 17 nt, Salmonella enterica enterica serovar Typhi Ty2
cuaucgaccagcaccug

SEQ ID NO: 3703846 - RNA, 16 nt, Salmonella enterica enterica serovar Typhi Ty2
cuaucgccagcgcguu

SEQ ID NO: 3703847 - RNA, 12 nt, Salmonella enterica enterica serovar Typhi Ty2
cuaucgccauau

SEQ ID NO: 3703848 - RNA, 22 nt, Salmonella enterica enterica serovar Typhi Ty2
cuaucgcccaaauaguccagca

SEQ ID NO: 3703849 - RNA, 15 nt, Salmonella enterica enterica serovar Typhi Ty2
cuaucgccuggagcu

SEQ ID NO: 3703850 - RNA, 21 nt, Salmonella enterica enterica serovar Typhi Ty2
cuaucgcguaucccuaagcgu

SEQ ID NO: 3703851 - RNA, 20 nt, Salmonella enterica enterica serovar Typhi Ty2
cuaucgcuccucccugacug

SEQ ID NO: 3703852 - RNA, 20 nt, Salmonella enterica enterica serovar Typhi Ty2
cuaucgcugcugauuggcga

SEQ ID NO: 3703853 - RNA, 20 nt, Salmonella enterica enterica serovar Typhi Ty2
cuaucggcaaaccaugaucg

SEQ ID NO: 3703854 - RNA, 23 nt, Salmonella enterica enterica serovar Typhi Ty2
cuaucugcuucuggcuugcgcua

SEQ ID NO: 3703855 - RNA, 19 nt, Salmonella enterica enterica serovar Typhi Ty2
cuaucuucaauacgaaaac

SEQ ID NO: 3703856 - RNA, 14 nt, Salmonella enterica enterica serovar Typhi Ty2
cuaucuucgauaaa

SEQ ID NO: 3703857 - RNA, 17 nt, Salmonella enterica enterica serovar Typhi Ty2
cuaucuuuucaaucagg

SEQ ID NO: 3703858 - RNA, 13 nt, Salmonella enterica enterica serovar Typhi Ty2
cuaugcaaaacgu

SEQ ID NO: 3703859 - RNA, 14 nt, Salmonella enterica enterica serovar Typhi Ty2
cuaugcaaaagaaa

SEQ ID NO: 3703860 - RNA, 16 nt, Salmonella enterica enterica serovar Typhi Ty2
cuaugccaggcgcaac

SEQ ID NO: 3703861 - RNA, 19 nt, Salmonella enterica enterica serovar Typhi Ty2
cuaugcgccaguuguccgc

SEQ ID NO: 3703862 - RNA, 16 nt, Salmonella enterica enterica serovar Typhi Ty2
cuaugcuuauccggcc

SEQ ID NO: 3703863 - RNA, 16 nt, Salmonella enterica enterica serovar Typhi Ty2
cuauguuugcugagaa

SEQ ID NO: 3703864 - RNA, 18 nt, Salmonella enterica enterica serovar Typhi Ty2
cuauuaaucugugagcac

SEQ ID NO: 3703865 - RNA, 13 nt, Salmonella enterica enterica serovar Typhi Ty2
cuauuacaaaaau

SEQ ID NO: 3703866 - RNA, 20 nt, Salmonella enterica enterica serovar Typhi Ty2
cuauuaguucugaggcuauu

SEQ ID NO: 3703867 - RNA, 21 nt, Salmonella enterica enterica serovar Typhi Ty2
cuauucaccagacuaaaacgu

SEQ ID NO: 3703868 - RNA, 12 nt, Salmonella enterica enterica serovar Typhi Ty2
cuauucagcagu

SEQ ID NO: 3703869 - RNA, 18 nt, Salmonella enterica enterica serovar Typhi Ty2
cuauuccaaaauaauaaa

SEQ ID NO: 3703870 - RNA, 16 nt, Salmonella enterica enterica serovar Typhi Ty2
cuauuccaacuaugug

SEQ ID NO: 3703871 - RNA, 20 nt, Salmonella enterica enterica serovar Typhi Ty2
cuauuccaacuaugugggcg

SEQ ID NO: 3703872 - RNA, 16 nt, Salmonella enterica enterica serovar Typhi Ty2
cuauuccaguuuuuau

SEQ ID NO: 3703873 - RNA, 14 nt, Salmonella enterica enterica serovar Typhi Ty2
cuauucccaggcaa

SEQ ID NO: 3703874 - RNA, 20 nt, Salmonella enterica enterica serovar Typhi Ty2
cuauucccaggcaaaugauu

SEQ ID NO: 3703875 - RNA, 21 nt, Salmonella enterica enterica serovar Typhi Ty2
cuauuccuguauaauuauuug

SEQ ID NO: 3703876 - RNA, 15 nt, Salmonella enterica enterica serovar Typhi Ty2
cuauucguucucuga

SEQ ID NO: 3703877 - RNA, 19 nt, Salmonella enterica enterica serovar Typhi Ty2
cuauugaaaaagccgcgcc

SEQ ID NO: 3703878 - RNA, 20 nt, Salmonella enterica enterica serovar Typhi Ty2
cuauugagguaguccugcuc

SEQ ID NO: 3703879 - RNA, 17 nt, Salmonella enterica enterica serovar Typhi Ty2
cuauuuaacccugguuu

SEQ ID NO: 3703880 - RNA, 15 nt, Salmonella enterica enterica serovar Typhi Ty2
cuauuuauugaagau

SEQ ID NO: 3703881 - RNA, 17 nt, Salmonella enterica enterica serovar Typhi Ty2
cuauuuauugaagaugu

SEQ ID NO: 3703882 - RNA, 17 nt, Salmonella enterica enterica serovar Typhi Ty2
cuauuucuuagcgccag

SEQ ID NO: 3703883 - RNA, 13 nt, Salmonella enterica enterica serovar Typhi Ty2
cuauuugcagauu

SEQ ID NO: 3703884 - RNA, 17 nt, Salmonella enterica enterica serovar Typhi Ty2
cuauuuucgccgacccc

SEQ ID NO: 3703885 - RNA, 16 nt, Salmonella enterica enterica serovar Typhi Ty2
cuauuuuuugcuggcg

SEQ ID NO: 3703886 - RNA, 18 nt, Salmonella enterica enterica serovar Typhi Ty2
cucaaagcguuauuugca

SEQ ID NO: 3703887 - RNA, 19 nt, Salmonella enterica enterica serovar Typhi Ty2
cucaaaguuaccggcauua

SEQ ID NO: 3703888 - RNA, 18 nt, Salmonella enterica enterica serovar Typhi Ty2
cucaacacauaacgcccg

SEQ ID NO: 3703889 - RNA, 21 nt, Salmonella enterica enterica serovar Typhi Ty2
cucaacacauaacgcccgaca

SEQ ID NO: 3703890 - RNA, 17 nt, Salmonella enterica enterica serovar Typhi Ty2
cucaacauacgccgcca

SEQ ID NO: 3703891 - RNA, 23 nt, Salmonella enterica enterica serovar Typhi Ty2
cucaacauacgccgccagccacu

SEQ ID NO: 3703892 - RNA, 14 nt, Salmonella enterica enterica serovar Typhi Ty2
cucaacaucauuaa

SEQ ID NO: 3703893 - RNA, 13 nt, Salmonella enterica enterica serovar Typhi Ty2
cucauacccuucc

SEQ ID NO: 3703894 - RNA, 14 nt, Salmonella enterica enterica serovar Typhi Ty2
cucauagccgcuuu

SEQ ID NO: 3703895 - RNA, 14 nt, Salmonella enterica enterica serovar Typhi Ty2
cucauauacccugc

SEQ ID NO: 3703896 - RNA, 16 nt, Salmonella enterica enterica serovar Typhi Ty2
cucauauuccagccac

SEQ ID NO: 3703897 - RNA, 14 nt, Salmonella enterica enterica serovar Typhi Ty2
cucaucaaacaggg

SEQ ID NO: 3703898 - RNA, 17 nt, Salmonella enterica enterica serovar Typhi Ty2
cucaucaaacagggcgu

SEQ ID NO: 3703899 - RNA, 17 nt, Salmonella enterica enterica serovar Typhi Ty2
cucaucacagccacacu

SEQ ID NO: 3703900 - RNA, 22 nt, Salmonella enterica enterica serovar Typhi Ty2
cucaucagccugaaagauuauu

SEQ ID NO: 3703901 - RNA, 21 nt, Salmonella enterica enterica serovar Typhi Ty2
cucaucaguuugcgauaagcg

SEQ ID NO: 3703902 - RNA, 20 nt, Salmonella enterica enterica serovar Typhi Ty2
cucauccaacugcgccugaa

SEQ ID NO: 3703903 - RNA, 24 nt, Salmonella enterica enterica serovar Typhi Ty2
cucauccaacugcgccugaagaua

SEQ ID NO: 3703904 - RNA, 14 nt, Salmonella enterica enterica serovar Typhi Ty2
cucauccaccuuau

SEQ ID NO: 3703905 - RNA, 21 nt, Salmonella enterica enterica serovar Typhi Ty2
cucauccagauguuauaaacu

SEQ ID NO: 3703906 - RNA, 11 nt, Salmonella enterica enterica serovar Typhi Ty2
cucauccagcg

SEQ ID NO: 3703907 - RNA, 18 nt, Salmonella enterica enterica serovar Typhi Ty2
cucauccccagcaucaug

SEQ ID NO: 3703908 - RNA, 13 nt, Salmonella enterica enterica serovar Typhi Ty2
cucaucgccgcaa

SEQ ID NO: 3703909 - RNA, 16 nt, Salmonella enterica enterica serovar Typhi Ty2
cucaucgccgcaauga

SEQ ID NO: 3703910 - RNA, 20 nt, Salmonella enterica enterica serovar Typhi Ty2
cucaucggcaaacauagccu

SEQ ID NO: 3703911 - RNA, 18 nt, Salmonella enterica enterica serovar Typhi Ty2
cucaucugaugauuaauu

SEQ ID NO: 3703912 - RNA, 14 nt, Salmonella enterica enterica serovar Typhi Ty2
cucaucuugcagga

SEQ ID NO: 3703913 - RNA, 13 nt, Salmonella enterica enterica serovar Typhi Ty2
cucaucuuuuaca

SEQ ID NO: 3703914 - RNA, 19 nt, Salmonella enterica enterica serovar Typhi Ty2
cucaugauagggcagcagu

SEQ ID NO: 3703915 - RNA, 14 nt, Salmonella enterica enterica serovar Typhi Ty2
cucaugcguaaauc

SEQ ID NO: 3703916 - RNA, 21 nt, Salmonella enterica enterica serovar Typhi Ty2
cucaugugcagcauccagcuc

SEQ ID NO: 3703917 - RNA, 23 nt, Salmonella enterica enterica serovar Typhi Ty2
cucauguuauaagcgcgcaggua

SEQ ID NO: 3703918 - RNA, 17 nt, Salmonella enterica enterica serovar Typhi Ty2
cucauguucaagcuggu

SEQ ID NO: 3703919 - RNA, 15 nt, Salmonella enterica enterica serovar Typhi Ty2
cucauguucgcuucu

SEQ ID NO: 3703920 - RNA, 14 nt, Salmonella enterica enterica serovar Typhi Ty2
cucauuaaaaaaac

SEQ ID NO: 3703921 - RNA, 23 nt, Salmonella enterica enterica serovar Typhi Ty2
cucauuaccggcugccgauagca

SEQ ID NO: 3703922 - RNA, 22 nt, Salmonella enterica enterica serovar Typhi Ty2
cucauuauggacgggauacggc

SEQ ID NO: 3703923 - RNA, 15 nt, Salmonella enterica enterica serovar Typhi Ty2
cucauucagcggcug

SEQ ID NO: 3703924 - RNA, 19 nt, Salmonella enterica enterica serovar Typhi Ty2
cucauucugauuuuacuaa

SEQ ID NO: 3703925 - RNA, 16 nt, Salmonella enterica enterica serovar Typhi Ty2
cucauuucacuauaaa

SEQ ID NO: 3703926 - RNA, 18 nt, Salmonella enterica enterica serovar Typhi Ty2
cucauuugcggcgucgcc

SEQ ID NO: 3703927 - RNA, 22 nt, Salmonella enterica enterica serovar Typhi Ty2
cucauuuugccguugcuguucc

SEQ ID NO: 3703928 - RNA, 20 nt, Salmonella enterica enterica serovar Typhi Ty2
cucauuuuguugcuccagca

SEQ ID NO: 3703929 - RNA, 16 nt, Salmonella enterica enterica serovar Typhi Ty2
cucauuuuugcccagc

SEQ ID NO: 3703930 - RNA, 14 nt, Salmonella enterica enterica serovar Typhi Ty2
cuccacaguucaau

SEQ ID NO: 3703931 - RNA, 13 nt, Salmonella enterica enterica serovar Typhi Ty2
cuccacauccugu

SEQ ID NO: 3703932 - RNA, 19 nt, Salmonella enterica enterica serovar Typhi Ty2
cuccaccaaaucccccaac

SEQ ID NO: 3703933 - RNA, 17 nt, Salmonella enterica enterica serovar Typhi Ty2
cuccacugucaaaaaua

SEQ ID NO: 3703934 - RNA, 22 nt, Salmonella enterica enterica serovar Typhi Ty2
cuccagaagaucuaaagccagu

SEQ ID NO: 3703935 - RNA, 19 nt, Salmonella enterica enterica serovar Typhi Ty2
cuccagaagcacuucucca

SEQ ID NO: 3703936 - RNA, 12 nt, Salmonella enterica enterica serovar Typhi Ty2
cuccagaagcau

SEQ ID NO: 3703937 - RNA, 15 nt, Salmonella enterica enterica serovar Typhi Ty2
cuccagaccaccagc

SEQ ID NO: 3703938 - RNA, 17 nt, Salmonella enterica enterica serovar Typhi Ty2
cuccagaccgcugcgga

SEQ ID NO: 3703939 - RNA, 18 nt, Salmonella enterica enterica serovar Typhi Ty2
cuccagaccucguucggc

SEQ ID NO: 3703940 - RNA, 17 nt, Salmonella enterica enterica serovar Typhi Ty2
cuccagacgaugauaau

SEQ ID NO: 3703941 - RNA, 16 nt, Salmonella enterica enterica serovar Typhi Ty2
cuccagcacauccuca

SEQ ID NO: 3703942 - RNA, 17 nt, Salmonella enterica enterica serovar Typhi Ty2
cuccagcccaucagucc

SEQ ID NO: 3703943 - RNA, 16 nt, Salmonella enterica enterica serovar Typhi Ty2
cuccagccucgcgcau

SEQ ID NO: 3703944 - RNA, 23 nt, Salmonella enterica enterica serovar Typhi Ty2
cuccagcgauagucguugcgccg

SEQ ID NO: 3703945 - RNA, 17 nt, Salmonella enterica enterica serovar Typhi Ty2
cuccagcgcauugccuu

SEQ ID NO: 3703946 - RNA, 18 nt, Salmonella enterica enterica serovar Typhi Ty2
cuccagcgccagcuccau

SEQ ID NO: 3703947 - RNA, 16 nt, Salmonella enterica enterica serovar Typhi Ty2
cuccagcgccuguuga

SEQ ID NO: 3703948 - RNA, 22 nt, Salmonella enterica enterica serovar Typhi Ty2
cuccagcgggcuggcauucauu

SEQ ID NO: 3703949 - RNA, 14 nt, Salmonella enterica enterica serovar Typhi Ty2
cuccagcguggcag

SEQ ID NO: 3703950 - RNA, 16 nt, Salmonella enterica enterica serovar Typhi Ty2
cuccaggccaagcgcc

SEQ ID NO: 3703951 - RNA, 16 nt, Salmonella enterica enterica serovar Typhi Ty2
cuccaggcgaaucccc

SEQ ID NO: 3703952 - RNA, 17 nt, Salmonella enterica enterica serovar Typhi Ty2
cuccaguaauucccggc

SEQ ID NO: 3703953 - RNA, 12 nt, Salmonella enterica enterica serovar Typhi Ty2
cuccaguugaua

SEQ ID NO: 3703954 - RNA, 22 nt, Salmonella enterica enterica serovar Typhi Ty2
cuccaguuguuccagcagcuca

SEQ ID NO: 3703955 - RNA, 13 nt, Salmonella enterica enterica serovar Typhi Ty2
cuccauaauuuga

SEQ ID NO: 3703956 - RNA, 20 nt, Salmonella enterica enterica serovar Typhi Ty2
cuccauacccuauuuacaga

SEQ ID NO: 3703957 - RNA, 19 nt, Salmonella enterica enterica serovar Typhi Ty2
cuccauagaaaucagcagg

SEQ ID NO: 3703958 - RNA, 18 nt, Salmonella enterica enterica serovar Typhi Ty2
cuccaucacgguaaaccu

SEQ ID NO: 3703959 - RNA, 16 nt, Salmonella enterica enterica serovar Typhi Ty2
cuccaucauuuccggc

SEQ ID NO: 3703960 - RNA, 17 nt, Salmonella enterica enterica serovar Typhi Ty2
cuccauggucagacgcu

SEQ ID NO: 3703961 - RNA, 19 nt, Salmonella enterica enterica serovar Typhi Ty2
cuccauuuuggggaaaaua

SEQ ID NO: 3703962 - RNA, 23 nt, Salmonella enterica enterica serovar Typhi Ty2
cucccaacagacgaucuacggua

SEQ ID NO: 3703963 - RNA, 16 nt, Salmonella enterica enterica serovar Typhi Ty2
cucccaggcgcgcagc

SEQ ID NO: 3703964 - RNA, 21 nt, Salmonella enterica enterica serovar Typhi Ty2
cucccaggcgcgcagcugcca

SEQ ID NO: 3703965 - RNA, 22 nt, Salmonella enterica enterica serovar Typhi Ty2
cuccccaggcgcuauucccagg

SEQ ID NO: 3703966 - RNA, 22 nt, Salmonella enterica enterica serovar Typhi Ty2
cuccccgccccagcagcagccg

SEQ ID NO: 3703967 - RNA, 18 nt, Salmonella enterica enterica serovar Typhi Ty2
cuccccguuccaccgcca

SEQ ID NO: 3703968 - RNA, 19 nt, Salmonella enterica enterica serovar Typhi Ty2
cuccccguuccaccgccaa

SEQ ID NO: 3703969 - RNA, 19 nt, Salmonella enterica enterica serovar Typhi Ty2
cuccccugccggcggcaga

SEQ ID NO: 3703970 - RNA, 15 nt, Salmonella enterica enterica serovar Typhi Ty2
cuccccuuuuuucug

SEQ ID NO: 3703971 - RNA, 22 nt, Salmonella enterica enterica serovar Typhi Ty2
cucccgccagaugcagcggcag

SEQ ID NO: 3703972 - RNA, 21 nt, Salmonella enterica enterica serovar Typhi Ty2
cucccgcgucacgaccggcga

SEQ ID NO: 3703973 - RNA, 21 nt, Salmonella enterica enterica serovar Typhi Ty2
cucccgcugcggcguggagca

SEQ ID NO: 3703974 - RNA, 21 nt, Salmonella enterica enterica serovar Typhi Ty2
cucccggaugcaccaucucuu

SEQ ID NO: 3703975 - RNA, 19 nt, Salmonella enterica enterica serovar Typhi Ty2
cucgccgacaugcuccugc

SEQ ID NO: 3703976 - RNA, 17 nt, Salmonella enterica enterica serovar Typhi Ty2
cucgccgaccggcgcgc

SEQ ID NO: 3703977 - RNA, 20 nt, Salmonella enterica enterica serovar Typhi Ty2
cucgccgacggucaaacuga

SEQ ID NO: 3703978 - RNA, 18 nt, Salmonella enterica enterica serovar Typhi Ty2
cucgccgauuggcaaaau

SEQ ID NO: 3703979 - RNA, 11 nt, Salmonella enterica enterica serovar Typhi Ty2
cucgccgccgg

SEQ ID NO: 3703980 - RNA, 13 nt, Salmonella enterica enterica serovar Typhi Ty2
cucgccgccuccc

SEQ ID NO: 3703981 - RNA, 15 nt, Salmonella enterica enterica serovar Typhi Ty2
cucgccgccuccccc

SEQ ID NO: 3703982 - RNA, 17 nt, Salmonella enterica enterica serovar Typhi Ty2
cucgccgccucccccuc

SEQ ID NO: 3703983 - RNA, 18 nt, Salmonella enterica enterica serovar Typhi Ty2
cucgccgccucccccuca

SEQ ID NO: 3703984 - RNA, 23 nt, Salmonella enterica enterica serovar Typhi Ty2
cucgccggauggcgacgcguagc

SEQ ID NO: 3703985 - RNA, 18 nt, Salmonella enterica enterica serovar Typhi Ty2
cucgccgguagccagcca

SEQ ID NO: 3703986 - RNA, 20 nt, Salmonella enterica enterica serovar Typhi Ty2
cucgcgacauggcgguaauc

SEQ ID NO: 3703987 - RNA, 16 nt, Salmonella enterica enterica serovar Typhi Ty2
cucgcgauaggccucg

SEQ ID NO: 3703988 - RNA, 16 nt, Salmonella enterica enterica serovar Typhi Ty2
cucgcgcagauagagc

SEQ ID NO: 3703989 - RNA, 20 nt, Salmonella enterica enterica serovar Typhi Ty2
cucgcggcagauaucgcuga

SEQ ID NO: 3703990 - RNA, 18 nt, Salmonella enterica enterica serovar Typhi Ty2
cucgcgggcauacucucc

SEQ ID NO: 3703991 - RNA, 18 nt, Salmonella enterica enterica serovar Typhi Ty2
cucgcguaccagaaacag

SEQ ID NO: 3703992 - RNA, 23 nt, Salmonella enterica enterica serovar Typhi Ty2
cucgcguccccagccgaugaccc

SEQ ID NO: 3703993 - RNA, 20 nt, Salmonella enterica enterica serovar Typhi Ty2
cucgcuaauuggcuuaccuu

SEQ ID NO: 3703994 - RNA, 14 nt, Salmonella enterica enterica serovar Typhi Ty2
cucgcuacuggcaa

SEQ ID NO: 3703995 - RNA, 23 nt, Salmonella enterica enterica serovar Typhi Ty2
cucgcucaucacaucgcgcagca

SEQ ID NO: 3703996 - RNA, 22 nt, Salmonella enterica enterica serovar Typhi Ty2
cucgcucauuugcgagaaaaag

SEQ ID NO: 3703997 - RNA, 14 nt, Salmonella enterica enterica serovar Typhi Ty2
cucgcucccuuccc

SEQ ID NO: 3703998 - RNA, 17 nt, Salmonella enterica enterica serovar Typhi Ty2
cucgcucgcccaucacu

SEQ ID NO: 3703999 - RNA, 20 nt, Salmonella enterica enterica serovar Typhi Ty2
cucgcugauacgcaccagcu

SEQ ID NO: 3704000 - RNA, 23 nt, Salmonella enterica enterica serovar Typhi Ty2
cucgcugauacgcuggcacagga

SEQ ID NO: 3704001 - RNA, 15 nt, Salmonella enterica enterica serovar Typhi Ty2
cucgcugauggcgag

SEQ ID NO: 3704002 - RNA, 18 nt, Salmonella enterica enterica serovar Typhi Ty2
cucgcugccgaccuggcu

SEQ ID NO: 3704003 - RNA, 21 nt, Salmonella enterica enterica serovar Typhi Ty2
cucgcuggugccaaucuccag

SEQ ID NO: 3704004 - RNA, 19 nt, Salmonella enterica enterica serovar Typhi Ty2
cucgcuguauuucccucuc

SEQ ID NO: 3704005 - RNA, 19 nt, Salmonella enterica enterica serovar Typhi Ty2
cucgcuguggccaggcacg

SEQ ID NO: 3704006 - RNA, 16 nt, Salmonella enterica enterica serovar Typhi Ty2
cucgcuguucgccaga

SEQ ID NO: 3704007 - RNA, 23 nt, Salmonella enterica enterica serovar Typhi Ty2
cucgcuuaaaccaccauacccag

SEQ ID NO: 3704008 - RNA, 11 nt, Salmonella enterica enterica serovar Typhi Ty2
cucgcuuguug

SEQ ID NO: 3704009 - RNA, 16 nt, Salmonella enterica enterica serovar Typhi Ty2
cucggauagcuacgau

SEQ ID NO: 3704010 - RNA, 20 nt, Salmonella enterica enterica serovar Typhi Ty2
cucggcgagcaguacgccug

SEQ ID NO: 3704011 - RNA, 18 nt, Salmonella enterica enterica serovar Typhi Ty2
cucggcggucagccacau

SEQ ID NO: 3704012 - RNA, 13 nt, Salmonella enterica enterica serovar Typhi Ty2
cucgggcgucgcg

SEQ ID NO: 3704013 - RNA, 15 nt, Salmonella enterica enterica serovar Typhi Ty2
cucggucaacauucc

SEQ ID NO: 3704014 - RNA, 13 nt, Salmonella enterica enterica serovar Typhi Ty2
cucgguccacacc

SEQ ID NO: 3704015 - RNA, 15 nt, Salmonella enterica enterica serovar Typhi Ty2
cucggugccgcugcu

SEQ ID NO: 3704016 - RNA, 19 nt, Salmonella enterica enterica serovar Typhi Ty2
cucgguggauaaauuuguc

SEQ ID NO: 3704017 - RNA, 18 nt, Salmonella enterica enterica serovar Typhi Ty2
cucguacacgcgcccgcc

SEQ ID NO: 3704018 - RNA, 20 nt, Salmonella enterica enterica serovar Typhi Ty2
cucguaggccggauaagacg

SEQ ID NO: 3704019 - RNA, 20 nt, Salmonella enterica enterica serovar Typhi Ty2
cucguauaucgcgauaaacu

SEQ ID NO: 3704020 - RNA, 12 nt, Salmonella enterica enterica serovar Typhi Ty2
cucguauuauug

SEQ ID NO: 3704021 - RNA, 15 nt, Salmonella enterica enterica serovar Typhi Ty2
cucguccugcaauuu

SEQ ID NO: 3704022 - RNA, 15 nt, Salmonella enterica enterica serovar Typhi Ty2
cucgucgccagggcg

SEQ ID NO: 3704023 - RNA, 21 nt, Salmonella enterica enterica serovar Typhi Ty2
cucgucggcaagaauuucaau

SEQ ID NO: 3704024 - RNA, 21 nt, Salmonella enterica enterica serovar Typhi Ty2
cucgugcaggccggauaagcc

SEQ ID NO: 3704025 - RNA, 15 nt, Salmonella enterica enterica serovar Typhi Ty2
cucguguaaggcuuc

SEQ ID NO: 3704026 - RNA, 21 nt, Salmonella enterica enterica serovar Typhi Ty2
cucguguaaggcuuccggcag

SEQ ID NO: 3704027 - RNA, 19 nt, Salmonella enterica enterica serovar Typhi Ty2
cucguucgauagcguuuuc

SEQ ID NO: 3704028 - RNA, 23 nt, Salmonella enterica enterica serovar Typhi Ty2
cucguugauguuuuuaaaagaag

SEQ ID NO: 3704029 - RNA, 14 nt, Salmonella enterica enterica serovar Typhi Ty2
cucguugcgucgug

SEQ ID NO: 3704030 - RNA, 22 nt, Salmonella enterica enterica serovar Typhi Ty2
cucuaaaucuuuuugugcaauc

SEQ ID NO: 3704031 - RNA, 19 nt, Salmonella enterica enterica serovar Typhi Ty2
cucuaauucccaguaaccu

SEQ ID NO: 3704032 - RNA, 12 nt, Salmonella enterica enterica serovar Typhi Ty2
cucuacauuucg

SEQ ID NO: 3704033 - RNA, 14 nt, Salmonella enterica enterica serovar Typhi Ty2
cucuacucgcggac

SEQ ID NO: 3704034 - RNA, 15 nt, Salmonella enterica enterica serovar Typhi Ty2
cucuacuuuccugaa

SEQ ID NO: 3704035 - RNA, 18 nt, Salmonella enterica enterica serovar Typhi Ty2
cucuauaccauaaaugaa

SEQ ID NO: 3704036 - RNA, 16 nt, Salmonella enterica enterica serovar Typhi Ty2
cucuauacggcgcgca

SEQ ID NO: 3704037 - RNA, 13 nt, Salmonella enterica enterica serovar Typhi Ty2
cucuaucagcgcc

SEQ ID NO: 3704038 - RNA, 17 nt, Salmonella enterica enterica serovar Typhi Ty2
cucuaucagcgccuccg

SEQ ID NO: 3704039 - RNA, 12 nt, Salmonella enterica enterica serovar Typhi Ty2
cucuauuuuuua

SEQ ID NO: 3704040 - RNA, 17 nt, Salmonella enterica enterica serovar Typhi Ty2
cucucaccaguagcgcg

SEQ ID NO: 3704041 - RNA, 22 nt, Salmonella enterica enterica serovar Typhi Ty2
cucucagcgucggugaagaaaa

SEQ ID NO: 3704042 - RNA, 23 nt, Salmonella enterica enterica serovar Typhi Ty2
cucucaggcaguaacucaauauc

SEQ ID NO: 3704043 - RNA, 18 nt, Salmonella enterica enterica serovar Typhi Ty2
cucucauagccgacccgc

SEQ ID NO: 3704044 - RNA, 23 nt, Salmonella enterica enterica serovar Typhi Ty2
cucuccaguuugcguucacagca

SEQ ID NO: 3704045 - RNA, 14 nt, Salmonella enterica enterica serovar Typhi Ty2
cucucccagcugag

SEQ ID NO: 3704046 - RNA, 16 nt, Salmonella enterica enterica serovar Typhi Ty2
cucucccaggcauccu

SEQ ID NO: 3704047 - RNA, 14 nt, Salmonella enterica enterica serovar Typhi Ty2
cucucccuggcagg

SEQ ID NO: 3704048 - RNA, 16 nt, Salmonella enterica enterica serovar Typhi Ty2
cucucccuggcaggua

SEQ ID NO: 3704049 - RNA, 18 nt, Salmonella enterica enterica serovar Typhi Ty2
cucuccgcaauuaauuua

SEQ ID NO: 3704050 - RNA, 19 nt, Salmonella enterica enterica serovar Typhi Ty2
cucuccgguugcugauaac

SEQ ID NO: 3704051 - RNA, 14 nt, Salmonella enterica enterica serovar Typhi Ty2
cucuccugaagcca

SEQ ID NO: 3704052 - RNA, 22 nt, Salmonella enterica enterica serovar Typhi Ty2
cucuccugaauugcaaggcgac

SEQ ID NO: 3704053 - RNA, 20 nt, Salmonella enterica enterica serovar Typhi Ty2
cucucgauaucggcaauauu

SEQ ID NO: 3704054 - RNA, 21 nt, Salmonella enterica enterica serovar Typhi Ty2
cucucuuucgguagccacaga

SEQ ID NO: 3704055 - RNA, 14 nt, Salmonella enterica enterica serovar Typhi Ty2
cucugaaacgcuuc

SEQ ID NO: 3704056 - RNA, 19 nt, Salmonella enterica enterica serovar Typhi Ty2
cucugauuucgacgauaaa

SEQ ID NO: 3704057 - RNA, 17 nt, Salmonella enterica enterica serovar Typhi Ty2
cugaaggacaagcugcg

SEQ ID NO: 3704058 - RNA, 21 nt, Salmonella enterica enterica serovar Typhi Ty2
cugaauaaauaguauaacgau

SEQ ID NO: 3704059 - RNA, 17 nt, Salmonella enterica enterica serovar Typhi Ty2
cugaauaacagcaccau

SEQ ID NO: 3704060 - RNA, 11 nt, Salmonella enterica enterica serovar Typhi Ty2
cugaauaaucg

SEQ ID NO: 3704061 - RNA, 21 nt, Salmonella enterica enterica serovar Typhi Ty2
cugaauaaugguaaauuuauc

SEQ ID NO: 3704062 - RNA, 20 nt, Salmonella enterica enterica serovar Typhi Ty2
cugaauaugcgucagauguu

SEQ ID NO: 3704063 - RNA, 18 nt, Salmonella enterica enterica serovar Typhi Ty2
cugaauauggccaguccc

SEQ ID NO: 3704064 - RNA, 16 nt, Salmonella enterica enterica serovar Typhi Ty2
cugaaucagcaucuua

SEQ ID NO: 3704065 - RNA, 16 nt, Salmonella enterica enterica serovar Typhi Ty2
cugaaucucuucccag

SEQ ID NO: 3704066 - RNA, 14 nt, Salmonella enterica enterica serovar Typhi Ty2
cugaaucugcuccg

SEQ ID NO: 3704067 - RNA, 19 nt, Salmonella enterica enterica serovar Typhi Ty2
cugaaugcccuuuuccaga

SEQ ID NO: 3704068 - RNA, 17 nt, Salmonella enterica enterica serovar Typhi Ty2
cugaauguauauaacgc

SEQ ID NO: 3704069 - RNA, 16 nt, Salmonella enterica enterica serovar Typhi Ty2
cugaauuaucaggguu

SEQ ID NO: 3704070 - RNA, 23 nt, Salmonella enterica enterica serovar Typhi Ty2
cugaauuuacgccguccggcgaa

SEQ ID NO: 3704071 - RNA, 18 nt, Salmonella enterica enterica serovar Typhi Ty2
cugacaaaaacggcuuua

SEQ ID NO: 3704072 - RNA, 16 nt, Salmonella enterica enterica serovar Typhi Ty2
cugacaaacccuguau

SEQ ID NO: 3704073 - RNA, 18 nt, Salmonella enterica enterica serovar Typhi Ty2
cugacaaagguugcgcca

SEQ ID NO: 3704074 - RNA, 14 nt, Salmonella enterica enterica serovar Typhi Ty2
cugacaaucagcac

SEQ ID NO: 3704075 - RNA, 12 nt, Salmonella enterica enterica serovar Typhi Ty2
cugacacccucu

SEQ ID NO: 3704076 - RNA, 15 nt, Salmonella enterica enterica serovar Typhi Ty2
cugacacccucugcg

SEQ ID NO: 3704077 - RNA, 20 nt, Salmonella enterica enterica serovar Typhi Ty2
cugacagaaauagccgguaa

SEQ ID NO: 3704078 - RNA, 13 nt, Salmonella enterica enterica serovar Typhi Ty2
cugacagauaucu

SEQ ID NO: 3704079 - RNA, 16 nt, Salmonella enterica enterica serovar Typhi Ty2
cugacagcgcgcgaau

SEQ ID NO: 3704080 - RNA, 23 nt, Salmonella enterica enterica serovar Typhi Ty2
cugacaggccggauuagcgacag

SEQ ID NO: 3704081 - RNA, 13 nt, Salmonella enterica enterica serovar Typhi Ty2
cugacauaaucau

SEQ ID NO: 3704082 - RNA, 15 nt, Salmonella enterica enterica serovar Typhi Ty2
cugacauuuauauua

SEQ ID NO: 3704083 - RNA, 17 nt, Salmonella enterica enterica serovar Typhi Ty2
cugaccaacaacagaua

SEQ ID NO: 3704084 - RNA, 19 nt, Salmonella enterica enterica serovar Typhi Ty2
cugaccaacgucagcaucu

SEQ ID NO: 3704085 - RNA, 20 nt, Salmonella enterica enterica serovar Typhi Ty2
cugaccaacgucagcaucuc

SEQ ID NO: 3704086 - RNA, 19 nt, Salmonella enterica enterica serovar Typhi Ty2
cugaccaagcgucagcaug

SEQ ID NO: 3704087 - RNA, 15 nt, Salmonella enterica enterica serovar Typhi Ty2
cugaccacauuuucu

SEQ ID NO: 3704088 - RNA, 16 nt, Salmonella enterica enterica serovar Typhi Ty2
cugaccacauuuucuc

SEQ ID NO: 3704089 - RNA, 14 nt, Salmonella enterica enterica serovar Typhi Ty2
cugaccagacagau

SEQ ID NO: 3704090 - RNA, 13 nt, Salmonella enterica enterica serovar Typhi Ty2
cugaccagcgacg

SEQ ID NO: 3704091 - RNA, 14 nt, Salmonella enterica enterica serovar Typhi Ty2
cugaccagggcaaa

SEQ ID NO: 3704092 - RNA, 22 nt, Salmonella enterica enterica serovar Typhi Ty2
cugaccaugcauauaagagacg

SEQ ID NO: 3704093 - RNA, 14 nt, Salmonella enterica enterica serovar Typhi Ty2
cugaccaugccaca

SEQ ID NO: 3704094 - RNA, 19 nt, Salmonella enterica enterica serovar Typhi Ty2
cugaccgguaaauuucacu

SEQ ID NO: 3704095 - RNA, 13 nt, Salmonella enterica enterica serovar Typhi Ty2
cugaccuacaggc

SEQ ID NO: 3704096 - RNA, 13 nt, Salmonella enterica enterica serovar Typhi Ty2
cugaccuuaaucc

SEQ ID NO: 3704097 - RNA, 21 nt, Salmonella enterica enterica serovar Typhi Ty2
cugacgaaagucauccaguac

SEQ ID NO: 3704098 - RNA, 19 nt, Salmonella enterica enterica serovar Typhi Ty2
cugacgaagaacuuaggau

SEQ ID NO: 3704099 - RNA, 16 nt, Salmonella enterica enterica serovar Typhi Ty2
cugacgagguuaucag

SEQ ID NO: 3704100 - RNA, 16 nt, Salmonella enterica enterica serovar Typhi Ty2
cugacgaguggcggac

SEQ ID NO: 3704101 - RNA, 15 nt, Salmonella enterica enterica serovar Typhi Ty2
cugacgcaaucuguu

SEQ ID NO: 3704102 - RNA, 20 nt, Salmonella enterica enterica serovar Typhi Ty2
cugacgcaauuguugcgcca

SEQ ID NO: 3704103 - RNA, 22 nt, Salmonella enterica enterica serovar Typhi Ty2
cugacgcaauuguugcgccaug

SEQ ID NO: 3704104 - RNA, 12 nt, Salmonella enterica enterica serovar Typhi Ty2
cugacgcagcag

SEQ ID NO: 3704105 - RNA, 17 nt, Salmonella enterica enterica serovar Typhi Ty2
cugacgcagcuucugau

SEQ ID NO: 3704106 - RNA, 17 nt, Salmonella enterica enterica serovar Typhi Ty2
cugacgccauucauucc

SEQ ID NO: 3704107 - RNA, 17 nt, Salmonella enterica enterica serovar Typhi Ty2
cugacgcccaucagcau

SEQ ID NO: 3704108 - RNA, 18 nt, Salmonella enterica enterica serovar Typhi Ty2
cugacgcccaucagcauc

SEQ ID NO: 3704109 - RNA, 23 nt, Salmonella enterica enterica serovar Typhi Ty2
cugacgccgguauucauaugcuc

SEQ ID NO: 3704110 - RNA, 13 nt, Salmonella enterica enterica serovar Typhi Ty2
cugacgcgcagcg

SEQ ID NO: 3704111 - RNA, 17 nt, Salmonella enterica enterica serovar Typhi Ty2
cugacgcggacgccacc

SEQ ID NO: 3704112 - RNA, 16 nt, Salmonella enterica enterica serovar Typhi Ty2
cugacgcugcgccugg

SEQ ID NO: 3704113 - RNA, 23 nt, Salmonella enterica enterica serovar Typhi Ty2
cugacggccugucuccucagcag

SEQ ID NO: 3704114 - RNA, 16 nt, Salmonella enterica enterica serovar Typhi Ty2
cugacggcgcugucac

SEQ ID NO: 3704115 - RNA, 19 nt, Salmonella enterica enterica serovar Typhi Ty2
cugacgguagcgucaggua

SEQ ID NO: 3704116 - RNA, 22 nt, Salmonella enterica enterica serovar Typhi Ty2
cugacggugauguuggcccgga

SEQ ID NO: 3704117 - RNA, 16 nt, Salmonella enterica enterica serovar Typhi Ty2
cugacggugguaaauc

SEQ ID NO: 3704118 - RNA, 16 nt, Salmonella enterica enterica serovar Typhi Ty2
cugacguugcgggccu

SEQ ID NO: 3704119 - RNA, 16 nt, Salmonella enterica enterica serovar Typhi Ty2
cugacuauacccaaaa

SEQ ID NO: 3704120 - RNA, 18 nt, Salmonella enterica enterica serovar Typhi Ty2
cugacuauccacagcgaa

SEQ ID NO: 3704121 - RNA, 15 nt, Salmonella enterica enterica serovar Typhi Ty2
cugacuauugcugag

SEQ ID NO: 3704122 - RNA, 15 nt, Salmonella enterica enterica serovar Typhi Ty2
cugacucaucacauc

SEQ ID NO: 3704123 - RNA, 14 nt, Salmonella enterica enterica serovar Typhi Ty2
cugacuccagcugg

SEQ ID NO: 3704124 - RNA, 21 nt, Salmonella enterica enterica serovar Typhi Ty2
cugacugaucgauccacuucc

SEQ ID NO: 3704125 - RNA, 13 nt, Salmonella enterica enterica serovar Typhi Ty2
cugacugcauaau

SEQ ID NO: 3704126 - RNA, 19 nt, Salmonella enterica enterica serovar Typhi Ty2
cugacugcauaauggugga

SEQ ID NO: 3704127 - RNA, 19 nt, Salmonella enterica enterica serovar Typhi Ty2
cugacugcgugagugugga

SEQ ID NO: 3704128 - RNA, 14 nt, Salmonella enterica enterica serovar Typhi Ty2
cugacugcugucau

SEQ ID NO: 3704129 - RNA, 13 nt, Salmonella enterica enterica serovar Typhi Ty2
cugacuguaauuu

SEQ ID NO: 3704130 - RNA, 12 nt, Salmonella enterica enterica serovar Typhi Ty2
cugacuuuccug

SEQ ID NO: 3704131 - RNA, 12 nt, Salmonella enterica enterica serovar Typhi Ty2
cugacuuuucca

SEQ ID NO: 3704132 - RNA, 19 nt, Salmonella enterica enterica serovar Typhi Ty2
cugagaaaaauacgccaga

SEQ ID NO: 3704133 - RNA, 16 nt, Salmonella enterica enterica serovar Typhi Ty2
cugagaauuuccaguu

SEQ ID NO: 3704134 - RNA, 20 nt, Salmonella enterica enterica serovar Typhi Ty2
cugagacaggccagaauuca

SEQ ID NO: 3704135 - RNA, 17 nt, Salmonella enterica enterica serovar Typhi Ty2
cugagacgugugauugu

SEQ ID NO: 3704136 - RNA, 19 nt, Salmonella enterica enterica serovar Typhi Ty2
cugagauaauacauaucau

SEQ ID NO: 3704137 - RNA, 13 nt, Salmonella enterica enterica serovar Typhi Ty2
cugagaucaaaca

SEQ ID NO: 3704138 - RNA, 22 nt, Salmonella enterica enterica serovar Typhi Ty2
cugagaugaaaucuacaggucg

SEQ ID NO: 3704139 - RNA, 17 nt, Salmonella enterica enterica serovar Typhi Ty2
cugauuucgccccacug

SEQ ID NO: 3704140 - RNA, 13 nt, Salmonella enterica enterica serovar Typhi Ty2
cugauuuuacuga

SEQ ID NO: 3704141 - RNA, 15 nt, Salmonella enterica enterica serovar Typhi Ty2
cugauuuuuuugcug

SEQ ID NO: 3704142 - RNA, 20 nt, Salmonella enterica enterica serovar Typhi Ty2
cugcaaaaagccuugcugaa

SEQ ID NO: 3704143 - RNA, 13 nt, Salmonella enterica enterica serovar Typhi Ty2
cugcaaaauuugu

SEQ ID NO: 3704144 - RNA, 16 nt, Salmonella enterica enterica serovar Typhi Ty2
cugcaaauacugcuuu

SEQ ID NO: 3704145 - RNA, 23 nt, Salmonella enterica enterica serovar Typhi Ty2
cugcaaauacugcuuuuccggca

SEQ ID NO: 3704146 - RNA, 14 nt, Salmonella enterica enterica serovar Typhi Ty2
cugcaaaucugccg

SEQ ID NO: 3704147 - RNA, 21 nt, Salmonella enterica enterica serovar Typhi Ty2
cugcaaaucugccgucaucga

SEQ ID NO: 3704148 - RNA, 16 nt, Salmonella enterica enterica serovar Typhi Ty2
cugcaaaucuucggca

SEQ ID NO: 3704149 - RNA, 16 nt, Salmonella enterica enterica serovar Typhi Ty2
cugcaacagcaccagc

SEQ ID NO: 3704150 - RNA, 19 nt, Salmonella enterica enterica serovar Typhi Ty2
cugcaacauuacugaccga

SEQ ID NO: 3704151 - RNA, 20 nt, Salmonella enterica enterica serovar Typhi Ty2
cugcaagagaaauaacaccu

SEQ ID NO: 3704152 - RNA, 18 nt, Salmonella enterica enterica serovar Typhi Ty2
cugcaaucguucuugcac

SEQ ID NO: 3704153 - RNA, 20 nt, Salmonella enterica enterica serovar Typhi Ty2
cugcaaugguaaaacgcugg

SEQ ID NO: 3704154 - RNA, 13 nt, Salmonella enterica enterica serovar Typhi Ty2
cugcaauucauag

SEQ ID NO: 3704155 - RNA, 21 nt, Salmonella enterica enterica serovar Typhi Ty2
cugcacaacauuccgcuucca

SEQ ID NO: 3704156 - RNA, 15 nt, Salmonella enterica enterica serovar Typhi Ty2
cugcacaagaaacau

SEQ ID NO: 3704157 - RNA, 19 nt, Salmonella enterica enterica serovar Typhi Ty2
cugcacaaucgccagcccc

SEQ ID NO: 3704158 - RNA, 20 nt, Salmonella enterica enterica serovar Typhi Ty2
cugcacauucagguggcuga

SEQ ID NO: 3704159 - RNA, 23 nt, Salmonella enterica enterica serovar Typhi Ty2
cugcacauugcaggcuuuuucau

SEQ ID NO: 3704160 - RNA, 15 nt, Salmonella enterica enterica serovar Typhi Ty2
cugcacccaucuuua

SEQ ID NO: 3704161 - RNA, 12 nt, Salmonella enterica enterica serovar Typhi Ty2
cugcaccgccug

SEQ ID NO: 3704162 - RNA, 18 nt, Salmonella enterica enterica serovar Typhi Ty2
cugcaccuuuuuuuccag

SEQ ID NO: 3704163 - RNA, 19 nt, Salmonella enterica enterica serovar Typhi Ty2
cugcacgagagaccaugcu

SEQ ID NO: 3704164 - RNA, 20 nt, Salmonella enterica enterica serovar Typhi Ty2
cugcacgagagaccaugcuc

SEQ ID NO: 3704165 - RNA, 16 nt, Salmonella enterica enterica serovar Typhi Ty2
cugcacguaccugcuc

SEQ ID NO: 3704166 - RNA, 15 nt, Salmonella enterica enterica serovar Typhi Ty2
cugcacuaaaccaga

SEQ ID NO: 3704167 - RNA, 17 nt, Salmonella enterica enterica serovar Typhi Ty2
cugcacuuccagccacg

SEQ ID NO: 3704168 - RNA, 19 nt, Salmonella enterica enterica serovar Typhi Ty2
cugcacuuuaagcggcagc

SEQ ID NO: 3704169 - RNA, 21 nt, Salmonella enterica enterica serovar Typhi Ty2
cugcagaaucccgauaaucaa

SEQ ID NO: 3704170 - RNA, 23 nt, Salmonella enterica enterica serovar Typhi Ty2
cugcagacccacuuucagcuccg

SEQ ID NO: 3704171 - RNA, 20 nt, Salmonella enterica enterica serovar Typhi Ty2
cugcagaccuauauggcgca

SEQ ID NO: 3704172 - RNA, 22 nt, Salmonella enterica enterica serovar Typhi Ty2
cugcagagcggcaaauucagcg

SEQ ID NO: 3704173 - RNA, 22 nt, Salmonella enterica enterica serovar Typhi Ty2
cugcagauuuugcucccuggug

SEQ ID NO: 3704174 - RNA, 11 nt, Salmonella enterica enterica serovar Typhi Ty2
cugcaggccaa

SEQ ID NO: 3704175 - RNA, 17 nt, Salmonella enterica enterica serovar Typhi Ty2
cugcagggaauaagcgc

SEQ ID NO: 3704176 - RNA, 18 nt, Salmonella enterica enterica serovar Typhi Ty2
cugcagggaauaagcgcc

SEQ ID NO: 3704177 - RNA, 18 nt, Salmonella enterica enterica serovar Typhi Ty2
cugcagggauaugcugau

SEQ ID NO: 3704178 - RNA, 13 nt, Salmonella enterica enterica serovar Typhi Ty2
cugcagggccgcg

SEQ ID NO: 3704179 - RNA, 19 nt, Salmonella enterica enterica serovar Typhi Ty2
cugcauaaaggaguaacag

SEQ ID NO: 3704180 - RNA, 21 nt, Salmonella enterica enterica serovar Typhi Ty2
cugcauaauggcgacggccac

SEQ ID NO: 3704181 - RNA, 12 nt, Salmonella enterica enterica serovar Typhi Ty2
cugcauauuuuu

SEQ ID NO: 3704182 - RNA, 13 nt, Salmonella enterica enterica serovar Typhi Ty2
cugcaucaacagg

SEQ ID NO: 3704183 - RNA, 15 nt, Salmonella enterica enterica serovar Typhi Ty2
cugcaucaccucaga

SEQ ID NO: 3704184 - RNA, 16 nt, Salmonella enterica enterica serovar Typhi Ty2
cugcaucaccucagaa

SEQ ID NO: 3704185 - RNA, 13 nt, Salmonella enterica enterica serovar Typhi Ty2
cugcaucagcucg

SEQ ID NO: 3704186 - RNA, 13 nt, Salmonella enterica enterica serovar Typhi Ty2
cugcaucaugcgc

SEQ ID NO: 3704187 - RNA, 15 nt, Salmonella enterica enterica serovar Typhi Ty2
cugcauccuguacca

SEQ ID NO: 3704188 - RNA, 19 nt, Salmonella enterica enterica serovar Typhi Ty2
cugcauccuguaccaccac

SEQ ID NO: 3704189 - RNA, 19 nt, Salmonella enterica enterica serovar Typhi Ty2
cugcaucgugagcgcguca

SEQ ID NO: 3704190 - RNA, 20 nt, Salmonella enterica enterica serovar Typhi Ty2
cugcaucguuugcaguuccg

SEQ ID NO: 3704191 - RNA, 21 nt, Salmonella enterica enterica serovar Typhi Ty2
cugcaucugcggucuccugaa

SEQ ID NO: 3704192 - RNA, 16 nt, Salmonella enterica enterica serovar Typhi Ty2
cugcaucuuacugacc

SEQ ID NO: 3704193 - RNA, 17 nt, Salmonella enterica enterica serovar Typhi Ty2
cugcauuacauucauaa

SEQ ID NO: 3704194 - RNA, 11 nt, Salmonella enterica enterica serovar Typhi Ty2
cugcauucagg

SEQ ID NO: 3704195 - RNA, 20 nt, Salmonella enterica enterica serovar Typhi Ty2
cugcauucaggccucugcuu

SEQ ID NO: 3704196 - RNA, 22 nt, Salmonella enterica enterica serovar Typhi Ty2
cugcauuguuccugcuggcaaa

SEQ ID NO: 3704197 - RNA, 15 nt, Salmonella enterica enterica serovar Typhi Ty2
cugcauuugcugccg

SEQ ID NO: 3704198 - RNA, 18 nt, Salmonella enterica enterica serovar Typhi Ty2
cugcauuugcugccgugg

SEQ ID NO: 3704199 - RNA, 16 nt, Salmonella enterica enterica serovar Typhi Ty2
cugccaacauggggag

SEQ ID NO: 3704200 - RNA, 22 nt, Salmonella enterica enterica serovar Typhi Ty2
cugccaaccggccccaucgccg

SEQ ID NO: 3704201 - RNA, 20 nt, Salmonella enterica enterica serovar Typhi Ty2
cugccaaugaaauaauugug

SEQ ID NO: 3704202 - RNA, 13 nt, Salmonella enterica enterica serovar Typhi Ty2
cugccacaacggc

SEQ ID NO: 3704203 - RNA, 23 nt, Salmonella enterica enterica serovar Typhi Ty2
cugccacaacggcaauuuuuaca

SEQ ID NO: 3704204 - RNA, 16 nt, Salmonella enterica enterica serovar Typhi Ty2
cugccaccagcguacc

SEQ ID NO: 3704205 - RNA, 16 nt, Salmonella enterica enterica serovar Typhi Ty2
cugccaccgucgcggc

SEQ ID NO: 3704206 - RNA, 17 nt, Salmonella enterica enterica serovar Typhi Ty2
cugccaccgucgcggca

SEQ ID NO: 3704207 - RNA, 22 nt, Salmonella enterica enterica serovar Typhi Ty2
cugccagcagaagacggaaacc

SEQ ID NO: 3704208 - RNA, 18 nt, Salmonella enterica enterica serovar Typhi Ty2
cugccaggcguguggcca

SEQ ID NO: 3704209 - RNA, 23 nt, Salmonella enterica enterica serovar Typhi Ty2
cugccaggcguguggccagggca

SEQ ID NO: 3704210 - RNA, 19 nt, Salmonella enterica enterica serovar Typhi Ty2
cugccagggugcaaagaaa

SEQ ID NO: 3704211 - RNA, 22 nt, Salmonella enterica enterica serovar Typhi Ty2
cugccagguuauuucgcgcagu

SEQ ID NO: 3704212 - RNA, 18 nt, Salmonella enterica enterica serovar Typhi Ty2
cugccaguagauggcgcu

SEQ ID NO: 3704213 - RNA, 19 nt, Salmonella enterica enterica serovar Typhi Ty2
cugccaguaguugaauaac

SEQ ID NO: 3704214 - RNA, 13 nt, Salmonella enterica enterica serovar Typhi Ty2
cugccaucaggca

SEQ ID NO: 3704215 - RNA, 13 nt, Salmonella enterica enterica serovar Typhi Ty2
cugccaucaucca

SEQ ID NO: 3704216 - RNA, 15 nt, Salmonella enterica enterica serovar Typhi Ty2
cugccaucauccagu

SEQ ID NO: 3704217 - RNA, 20 nt, Salmonella enterica enterica serovar Typhi Ty2
cugccaucgcuucuacagcc

SEQ ID NO: 3704218 - RNA, 13 nt, Salmonella enterica enterica serovar Typhi Ty2
cugccauucccag

SEQ ID NO: 3704219 - RNA, 22 nt, Salmonella enterica enterica serovar Typhi Ty2
cugccauuucugcucacgguuu

SEQ ID NO: 3704220 - RNA, 13 nt, Salmonella enterica enterica serovar Typhi Ty2
cugcccacccggg

SEQ ID NO: 3704221 - RNA, 23 nt, Salmonella enterica enterica serovar Typhi Ty2
cugcgcgccaaaccguucacgcu

SEQ ID NO: 3704222 - RNA, 20 nt, Salmonella enterica enterica serovar Typhi Ty2
cugcgcgccgcccugcauca

SEQ ID NO: 3704223 - RNA, 22 nt, Salmonella enterica enterica serovar Typhi Ty2
cugcgcgccgcccugcaucaug

SEQ ID NO: 3704224 - RNA, 12 nt, Salmonella enterica enterica serovar Typhi Ty2
cugcgcgccgga

SEQ ID NO: 3704225 - RNA, 15 nt, Salmonella enterica enterica serovar Typhi Ty2
cugcgcgccugcgcu

SEQ ID NO: 3704226 - RNA, 16 nt, Salmonella enterica enterica serovar Typhi Ty2
cugcgcgccuugcgca

SEQ ID NO: 3704227 - RNA, 20 nt, Salmonella enterica enterica serovar Typhi Ty2
cugcgcggcaaugagcggcc

SEQ ID NO: 3704228 - RNA, 15 nt, Salmonella enterica enterica serovar Typhi Ty2
cugcgcggccugcgc

SEQ ID NO: 3704229 - RNA, 22 nt, Salmonella enterica enterica serovar Typhi Ty2
cugcgcgucccucuccagggca

SEQ ID NO: 3704230 - RNA, 14 nt, Salmonella enterica enterica serovar Typhi Ty2
cugcgcgucggcau

SEQ ID NO: 3704231 - RNA, 14 nt, Salmonella enterica enterica serovar Typhi Ty2
cugcgcguucugcu

SEQ ID NO: 3704232 - RNA, 19 nt, Salmonella enterica enterica serovar Typhi Ty2
cugcgcguucugcuccaga

SEQ ID NO: 3704233 - RNA, 23 nt, Salmonella enterica enterica serovar Typhi Ty2
cugcgcucaucaggccugggcga

SEQ ID NO: 3704234 - RNA, 14 nt, Salmonella enterica enterica serovar Typhi Ty2
cugcgcugacggcg

SEQ ID NO: 3704235 - RNA, 17 nt, Salmonella enterica enterica serovar Typhi Ty2
cugcgcugcggucaggg

SEQ ID NO: 3704236 - RNA, 13 nt, Salmonella enterica enterica serovar Typhi Ty2
cugcgcugggccg

SEQ ID NO: 3704237 - RNA, 18 nt, Salmonella enterica enterica serovar Typhi Ty2
cugcgcuuaucaggccua

SEQ ID NO: 3704238 - RNA, 21 nt, Salmonella enterica enterica serovar Typhi Ty2
cugcgcuucgaugcguucaaa

SEQ ID NO: 3704239 - RNA, 17 nt, Salmonella enterica enterica serovar Typhi Ty2
cugcgcuucuauccacu

SEQ ID NO: 3704240 - RNA, 13 nt, Salmonella enterica enterica serovar Typhi Ty2
cugcgcuucugau

SEQ ID NO: 3704241 - RNA, 15 nt, Salmonella enterica enterica serovar Typhi Ty2
cugcggaacaccagc

SEQ ID NO: 3704242 - RNA, 19 nt, Salmonella enterica enterica serovar Typhi Ty2
cugcggaacuaacccgcag

SEQ ID NO: 3704243 - RNA, 13 nt, Salmonella enterica enterica serovar Typhi Ty2
cugcggaauuuua

SEQ ID NO: 3704244 - RNA, 20 nt, Salmonella enterica enterica serovar Typhi Ty2
cugcggcacgucauuacggu

SEQ ID NO: 3704245 - RNA, 17 nt, Salmonella enterica enterica serovar Typhi Ty2
cugcggcaguucuaaca

SEQ ID NO: 3704246 - RNA, 21 nt, Salmonella enterica enterica serovar Typhi Ty2
cugcggcauuacgcgccucuu

SEQ ID NO: 3704247 - RNA, 21 nt, Salmonella enterica enterica serovar Typhi Ty2
cugcggccaugaucgccgcca

SEQ ID NO: 3704248 - RNA, 16 nt, Salmonella enterica enterica serovar Typhi Ty2
cugcggccucgccucu

SEQ ID NO: 3704249 - RNA, 14 nt, Salmonella enterica enterica serovar Typhi Ty2
cugcggccugccca

SEQ ID NO: 3704250 - RNA, 23 nt, Salmonella enterica enterica serovar Typhi Ty2
cugcggcggcggaaaauagccag

SEQ ID NO: 3704251 - RNA, 15 nt, Salmonella enterica enterica serovar Typhi Ty2
cugcggcgucugccu

SEQ ID NO: 3704252 - RNA, 18 nt, Salmonella enterica enterica serovar Typhi Ty2
cugcggcuauauaaaauc

SEQ ID NO: 3704253 - RNA, 20 nt, Salmonella enterica enterica serovar Typhi Ty2
cugcggcuauauaaaaucgg

SEQ ID NO: 3704254 - RNA, 18 nt, Salmonella enterica enterica serovar Typhi Ty2
cugcggcugacgcgauga

SEQ ID NO: 3704255 - RNA, 19 nt, Salmonella enterica enterica serovar Typhi Ty2
cugcggcugacgcgaugac

SEQ ID NO: 3704256 - RNA, 18 nt, Salmonella enterica enterica serovar Typhi Ty2
cugcgguacugcuggccu

SEQ ID NO: 3704257 - RNA, 15 nt, Salmonella enterica enterica serovar Typhi Ty2
cugcgguaucggaga

SEQ ID NO: 3704258 - RNA, 16 nt, Salmonella enterica enterica serovar Typhi Ty2
cugcggucaggaauga

SEQ ID NO: 3704259 - RNA, 16 nt, Salmonella enterica enterica serovar Typhi Ty2
cugcggucuccugaac

SEQ ID NO: 3704260 - RNA, 17 nt, Salmonella enterica enterica serovar Typhi Ty2
cugcguaaaaucagcau

SEQ ID NO: 3704261 - RNA, 21 nt, Salmonella enterica enterica serovar Typhi Ty2
cugcguaaaccauuucuccug

SEQ ID NO: 3704262 - RNA, 22 nt, Salmonella enterica enterica serovar Typhi Ty2
cugcgucaugucguuagaacca

SEQ ID NO: 3704263 - RNA, 15 nt, Salmonella enterica enterica serovar Typhi Ty2
cugcgugaagacaca

SEQ ID NO: 3704264 - RNA, 16 nt, Salmonella enterica enterica serovar Typhi Ty2
cugcgugaagacacaa

SEQ ID NO: 3704265 - RNA, 18 nt, Salmonella enterica enterica serovar Typhi Ty2
cugcgugaugcaucagaa

SEQ ID NO: 3704266 - RNA, 23 nt, Salmonella enterica enterica serovar Typhi Ty2
cugcgugccguugaccagcugac

SEQ ID NO: 3704267 - RNA, 20 nt, Salmonella enterica enterica serovar Typhi Ty2
cugcguugcucgccagccug

SEQ ID NO: 3704268 - RNA, 20 nt, Salmonella enterica enterica serovar Typhi Ty2
cugcuaaacgagccgucauc

SEQ ID NO: 3704269 - RNA, 20 nt, Salmonella enterica enterica serovar Typhi Ty2
cugcuagaacauuucccgaa

SEQ ID NO: 3704270 - RNA, 21 nt, Salmonella enterica enterica serovar Typhi Ty2
cugcuaucaggauucgacggc

SEQ ID NO: 3704271 - RNA, 14 nt, Salmonella enterica enterica serovar Typhi Ty2
cugcuauccccauu

SEQ ID NO: 3704272 - RNA, 22 nt, Salmonella enterica enterica serovar Typhi Ty2
cugcucaagaauacccuuuaca

SEQ ID NO: 3704273 - RNA, 23 nt, Salmonella enterica enterica serovar Typhi Ty2
cugcucaauacuuuccgggccgg

SEQ ID NO: 3704274 - RNA, 22 nt, Salmonella enterica enterica serovar Typhi Ty2
cugcucauuuaugcgcugggca

SEQ ID NO: 3704275 - RNA, 12 nt, Salmonella enterica enterica serovar Typhi Ty2
cugcuccaugac

SEQ ID NO: 3704276 - RNA, 17 nt, Salmonella enterica enterica serovar Typhi Ty2
cugcucccccaguugcu

SEQ ID NO: 3704277 - RNA, 16 nt, Salmonella enterica enterica serovar Typhi Ty2
cugcucccucacgcgu

SEQ ID NO: 3704278 - RNA, 15 nt, Salmonella enterica enterica serovar Typhi Ty2
cugcuccgccagcaa

SEQ ID NO: 3704279 - RNA, 18 nt, Salmonella enterica enterica serovar Typhi Ty2
cugcuccggcuuaaugcc

SEQ ID NO: 3704280 - RNA, 22 nt, Salmonella enterica enterica serovar Typhi Ty2
cugcuccggcuuaaugcccggc

SEQ ID NO: 3704281 - RNA, 19 nt, Salmonella enterica enterica serovar Typhi Ty2
cugcuccguccacgcgagc

SEQ ID NO: 3704282 - RNA, 23 nt, Salmonella enterica enterica serovar Typhi Ty2
cugcuccugccagauuuucuuua

SEQ ID NO: 3704283 - RNA, 22 nt, Salmonella enterica enterica serovar Typhi Ty2
cugcucggguaaggcaucguug

SEQ ID NO: 3704284 - RNA, 17 nt, Salmonella enterica enterica serovar Typhi Ty2
cugcucgguaaaaaguu

SEQ ID NO: 3704285 - RNA, 14 nt, Salmonella enterica enterica serovar Typhi Ty2
cugcucgguaucgu

SEQ ID NO: 3704286 - RNA, 14 nt, Salmonella enterica enterica serovar Typhi Ty2
cugcucguaaagca

SEQ ID NO: 3704287 - RNA, 20 nt, Salmonella enterica enterica serovar Typhi Ty2
cugcucguuaaauccuccca

SEQ ID NO: 3704288 - RNA, 20 nt, Salmonella enterica enterica serovar Typhi Ty2
cugcucuccuugcggugaga

SEQ ID NO: 3704289 - RNA, 20 nt, Salmonella enterica enterica serovar Typhi Ty2
cugcugaaaaagaacaauaa

SEQ ID NO: 3704290 - RNA, 17 nt, Salmonella enterica enterica serovar Typhi Ty2
cugcugaaaugccuggu

SEQ ID NO: 3704291 - RNA, 15 nt, Salmonella enterica enterica serovar Typhi Ty2
cugcugaacacaaug

SEQ ID NO: 3704292 - RNA, 23 nt, Salmonella enterica enterica serovar Typhi Ty2
cugcugacaaaaacggcuuuaau

SEQ ID NO: 3704293 - RNA, 18 nt, Salmonella enterica enterica serovar Typhi Ty2
cugcugaccuuaauccag

SEQ ID NO: 3704294 - RNA, 16 nt, Salmonella enterica enterica serovar Typhi Ty2
cugcugagugacgggc

SEQ ID NO: 3704295 - RNA, 11 nt, Salmonella enterica enterica serovar Typhi Ty2
cugcugauaau

SEQ ID NO: 3704296 - RNA, 22 nt, Salmonella enterica enterica serovar Typhi Ty2
cugcugauaguccaguacccgc

SEQ ID NO: 3704297 - RNA, 13 nt, Salmonella enterica enterica serovar Typhi Ty2
cugcugaugccag

SEQ ID NO: 3704298 - RNA, 14 nt, Salmonella enterica enterica serovar Typhi Ty2
cugcugauuggcga

SEQ ID NO: 3704299 - RNA, 16 nt, Salmonella enterica enterica serovar Typhi Ty2
cugcugcauccgcgcu

SEQ ID NO: 3704300 - RNA, 18 nt, Salmonella enterica enterica serovar Typhi Ty2
cugcugccagccgccgcc

SEQ ID NO: 3704301 - RNA, 18 nt, Salmonella enterica enterica serovar Typhi Ty2
cugcugccagcgccgccg

SEQ ID NO: 3704302 - RNA, 15 nt, Salmonella enterica enterica serovar Typhi Ty2
cugcugccgcagcac

SEQ ID NO: 3704303 - RNA, 16 nt, Salmonella enterica enterica serovar Typhi Ty2
cuggcauggugcagcc

SEQ ID NO: 3704304 - RNA, 16 nt, Salmonella enterica enterica serovar Typhi Ty2
cuggcauuacgcuggc

SEQ ID NO: 3704305 - RNA, 19 nt, Salmonella enterica enterica serovar Typhi Ty2
cuggcauuacgcuggcccc

SEQ ID NO: 3704306 - RNA, 17 nt, Salmonella enterica enterica serovar Typhi Ty2
cuggcauuuuacuucug

SEQ ID NO: 3704307 - RNA, 14 nt, Salmonella enterica enterica serovar Typhi Ty2
cuggccacagcaaa

SEQ ID NO: 3704308 - RNA, 23 nt, Salmonella enterica enterica serovar Typhi Ty2
cuggccacgccgaggcauucagc

SEQ ID NO: 3704309 - RNA, 14 nt, Salmonella enterica enterica serovar Typhi Ty2
cuggccagggcauc

SEQ ID NO: 3704310 - RNA, 17 nt, Salmonella enterica enterica serovar Typhi Ty2
cuggccaguucgucuuc

SEQ ID NO: 3704311 - RNA, 23 nt, Salmonella enterica enterica serovar Typhi Ty2
cuggccaguucgucuuccggaua

SEQ ID NO: 3704312 - RNA, 21 nt, Salmonella enterica enterica serovar Typhi Ty2
cuggccaguuucaaugcccag

SEQ ID NO: 3704313 - RNA, 15 nt, Salmonella enterica enterica serovar Typhi Ty2
cuggccgaauagcug

SEQ ID NO: 3704314 - RNA, 18 nt, Salmonella enterica enterica serovar Typhi Ty2
cuggccgcgcuuuuuuaa

SEQ ID NO: 3704315 - RNA, 15 nt, Salmonella enterica enterica serovar Typhi Ty2
cuggccuucuuucuc

SEQ ID NO: 3704316 - RNA, 21 nt, Salmonella enterica enterica serovar Typhi Ty2
cuggcgaaagcgaccggcacu

SEQ ID NO: 3704317 - RNA, 22 nt, Salmonella enterica enterica serovar Typhi Ty2
cuggcgaauaaaauucagcgca

SEQ ID NO: 3704318 - RNA, 18 nt, Salmonella enterica enterica serovar Typhi Ty2
cuggcgacauuaaaggac

SEQ ID NO: 3704319 - RNA, 22 nt, Salmonella enterica enterica serovar Typhi Ty2
cuggcgaccgccaccauccggc

SEQ ID NO: 3704320 - RNA, 14 nt, Salmonella enterica enterica serovar Typhi Ty2
cuggcgcaaccggc

SEQ ID NO: 3704321 - RNA, 13 nt, Salmonella enterica enterica serovar Typhi Ty2
cuggcgcagcgcu

SEQ ID NO: 3704322 - RNA, 18 nt, Salmonella enterica enterica serovar Typhi Ty2
cuggcgcauuuuaaugau

SEQ ID NO: 3704323 - RNA, 14 nt, Salmonella enterica enterica serovar Typhi Ty2
cuggcgcccgguuc

SEQ ID NO: 3704324 - RNA, 13 nt, Salmonella enterica enterica serovar Typhi Ty2
cuggcgccgcaag

SEQ ID NO: 3704325 - RNA, 12 nt, Salmonella enterica enterica serovar Typhi Ty2
cuggcgccggag

SEQ ID NO: 3704326 - RNA, 23 nt, Salmonella enterica enterica serovar Typhi Ty2
cuggcgcgcgcgccuaccgccau

SEQ ID NO: 3704327 - RNA, 19 nt, Salmonella enterica enterica serovar Typhi Ty2
cuggcgcggggaacacacg

SEQ ID NO: 3704328 - RNA, 18 nt, Salmonella enterica enterica serovar Typhi Ty2
cuggcgcggggaacacag

SEQ ID NO: 3704329 - RNA, 19 nt, Salmonella enterica enterica serovar Typhi Ty2
cuggcgcggggaacacaga

SEQ ID NO: 3704330 - RNA, 19 nt, Salmonella enterica enterica serovar Typhi Ty2
cuggcgcggggaacaccca

SEQ ID NO: 3704331 - RNA, 17 nt, Salmonella enterica enterica serovar Typhi Ty2
cuggcgcggggaacacg

SEQ ID NO: 3704332 - RNA, 16 nt, Salmonella enterica enterica serovar Typhi Ty2
cuggcgcgugcccagu

SEQ ID NO: 3704333 - RNA, 18 nt, Salmonella enterica enterica serovar Typhi Ty2
cuggcgcucaaucagaau

SEQ ID NO: 3704334 - RNA, 15 nt, Salmonella enterica enterica serovar Typhi Ty2
cuggcgcuggguaac

SEQ ID NO: 3704335 - RNA, 23 nt, Salmonella enterica enterica serovar Typhi Ty2
cuggcgcuguaauagauaugaaa

SEQ ID NO: 3704336 - RNA, 20 nt, Salmonella enterica enterica serovar Typhi Ty2
cuggcgcuguuuuuacgcca

SEQ ID NO: 3704337 - RNA, 19 nt, Salmonella enterica enterica serovar Typhi Ty2
cuggcggaauggcgggcgc

SEQ ID NO: 3704338 - RNA, 20 nt, Salmonella enterica enterica serovar Typhi Ty2
cuggcggaauggcgggcgca

SEQ ID NO: 3704339 - RNA, 17 nt, Salmonella enterica enterica serovar Typhi Ty2
cuggcggagcugcgcuu

SEQ ID NO: 3704340 - RNA, 13 nt, Salmonella enterica enterica serovar Typhi Ty2
cuggcggccccuc

SEQ ID NO: 3704341 - RNA, 18 nt, Salmonella enterica enterica serovar Typhi Ty2
cuggcggccccucuucca

SEQ ID NO: 3704342 - RNA, 22 nt, Salmonella enterica enterica serovar Typhi Ty2
cuggcggcgaaagagaaagcgc

SEQ ID NO: 3704343 - RNA, 23 nt, Salmonella enterica enterica serovar Typhi Ty2
cuggcggugcggucacaggcaua

SEQ ID NO: 3704344 - RNA, 23 nt, Salmonella enterica enterica serovar Typhi Ty2
cuggcguagucucccuccugcuc

SEQ ID NO: 3704345 - RNA, 19 nt, Salmonella enterica enterica serovar Typhi Ty2
cuggcguccagcccgucca

SEQ ID NO: 3704346 - RNA, 14 nt, Salmonella enterica enterica serovar Typhi Ty2
cuggcgucgccaaa

SEQ ID NO: 3704347 - RNA, 19 nt, Salmonella enterica enterica serovar Typhi Ty2
cuggcgucuguccggcgcu

SEQ ID NO: 3704348 - RNA, 13 nt, Salmonella enterica enterica serovar Typhi Ty2
cuggcguuaaaua

SEQ ID NO: 3704349 - RNA, 13 nt, Salmonella enterica enterica serovar Typhi Ty2
cuggcguuaucau

SEQ ID NO: 3704350 - RNA, 16 nt, Salmonella enterica enterica serovar Typhi Ty2
cuggcuaccacauucu

SEQ ID NO: 3704351 - RNA, 15 nt, Salmonella enterica enterica serovar Typhi Ty2
cuggcuacguacaca

SEQ ID NO: 3704352 - RNA, 15 nt, Salmonella enterica enterica serovar Typhi Ty2
cuggcuaucccgaug

SEQ ID NO: 3704353 - RNA, 15 nt, Salmonella enterica enterica serovar Typhi Ty2
cuggcucaauccagg

SEQ ID NO: 3704354 - RNA, 11 nt, Salmonella enterica enterica serovar Typhi Ty2
cuggcucagac

SEQ ID NO: 3704355 - RNA, 13 nt, Salmonella enterica enterica serovar Typhi Ty2
cuggcucagacca

SEQ ID NO: 3704356 - RNA, 14 nt, Salmonella enterica enterica serovar Typhi Ty2
cuggcucggccugu

SEQ ID NO: 3704357 - RNA, 15 nt, Salmonella enterica enterica serovar Typhi Ty2
cuggcucggccuguc

SEQ ID NO: 3704358 - RNA, 17 nt, Salmonella enterica enterica serovar Typhi Ty2
cuggcugcugauggucu

SEQ ID NO: 3704359 - RNA, 17 nt, Salmonella enterica enterica serovar Typhi Ty2
cuggcuggcgcugacga

SEQ ID NO: 3704360 - RNA, 15 nt, Salmonella enterica enterica serovar Typhi Ty2
cuggcugucgauaac

SEQ ID NO: 3704361 - RNA, 20 nt, Salmonella enterica enterica serovar Typhi Ty2
cuggcugucgauaacagcau

SEQ ID NO: 3704362 - RNA, 16 nt, Salmonella enterica enterica serovar Typhi Ty2
cuggcugugccaauaa

SEQ ID NO: 3704363 - RNA, 18 nt, Salmonella enterica enterica serovar Typhi Ty2
cuggcuuacaggcacgcc

SEQ ID NO: 3704364 - RNA, 15 nt, Salmonella enterica enterica serovar Typhi Ty2
cuggcuuaccugcuc

SEQ ID NO: 3704365 - RNA, 13 nt, Salmonella enterica enterica serovar Typhi Ty2
cuggcuucagccu

SEQ ID NO: 3704366 - RNA, 14 nt, Salmonella enterica enterica serovar Typhi Ty2
cuggcuucagccug

SEQ ID NO: 3704367 - RNA, 16 nt, Salmonella enterica enterica serovar Typhi Ty2
cuggcuucagccugug

SEQ ID NO: 3704368 - RNA, 18 nt, Salmonella enterica enterica serovar Typhi Ty2
cuggcuucagccugugca

SEQ ID NO: 3704369 - RNA, 14 nt, Salmonella enterica enterica serovar Typhi Ty2
cuggcuugccggca

SEQ ID NO: 3704370 - RNA, 14 nt, Salmonella enterica enterica serovar Typhi Ty2
cuggcuugccgggc

SEQ ID NO: 3704371 - RNA, 14 nt, Salmonella enterica enterica serovar Typhi Ty2
cuggcuuuauauaa

SEQ ID NO: 3704372 - RNA, 16 nt, Salmonella enterica enterica serovar Typhi Ty2
cuggcuuugcgccggc

SEQ ID NO: 3704373 - RNA, 17 nt, Salmonella enterica enterica serovar Typhi Ty2
cugggaaguugcccuua

SEQ ID NO: 3704374 - RNA, 17 nt, Salmonella enterica enterica serovar Typhi Ty2
cugggaauaggccgcca

SEQ ID NO: 3704375 - RNA, 19 nt, Salmonella enterica enterica serovar Typhi Ty2
cugggagccgcugcucauu

SEQ ID NO: 3704376 - RNA, 21 nt, Salmonella enterica enterica serovar Typhi Ty2
cugggauucggcaacacccac

SEQ ID NO: 3704377 - RNA, 12 nt, Salmonella enterica enterica serovar Typhi Ty2
cugggccugcuc

SEQ ID NO: 3704378 - RNA, 17 nt, Salmonella enterica enterica serovar Typhi Ty2
cugggcgacuucauuca

SEQ ID NO: 3704379 - RNA, 13 nt, Salmonella enterica enterica serovar Typhi Ty2
cugggcgcaugag

SEQ ID NO: 3704380 - RNA, 14 nt, Salmonella enterica enterica serovar Typhi Ty2
cugggcugagaaaa

SEQ ID NO: 3704381 - RNA, 17 nt, Salmonella enterica enterica serovar Typhi Ty2
cugggcugagaaaaauu

SEQ ID NO: 3704382 - RNA, 21 nt, Salmonella enterica enterica serovar Typhi Ty2
cugggcuuuauccugaccgcu

SEQ ID NO: 3704383 - RNA, 17 nt, Salmonella enterica enterica serovar Typhi Ty2
cuggggucgucagcgga

SEQ ID NO: 3704384 - RNA, 18 nt, Salmonella enterica enterica serovar Typhi Ty2
cuggguaagcgcagcgcc

SEQ ID NO: 3704385 - RNA, 20 nt, Salmonella enterica enterica serovar Typhi Ty2
cuguacggagcuaauaugaa

SEQ ID NO: 3704386 - RNA, 23 nt, Salmonella enterica enterica serovar Typhi Ty2
cuguagauagcuauccacgcaga

SEQ ID NO: 3704387 - RNA, 14 nt, Salmonella enterica enterica serovar Typhi Ty2
cuguagauugcgcg

SEQ ID NO: 3704388 - RNA, 15 nt, Salmonella enterica enterica serovar Typhi Ty2
cuguagauugcgcgc

SEQ ID NO: 3704389 - RNA, 20 nt, Salmonella enterica enterica serovar Typhi Ty2
cuguagcaguggagaggcca

SEQ ID NO: 3704390 - RNA, 13 nt, Salmonella enterica enterica serovar Typhi Ty2
cuguagccagccu

SEQ ID NO: 3704391 - RNA, 22 nt, Salmonella enterica enterica serovar Typhi Ty2
cuguagccagccugaacgggug

SEQ ID NO: 3704392 - RNA, 20 nt, Salmonella enterica enterica serovar Typhi Ty2
cuguagcgcuuuggagguca

SEQ ID NO: 3704393 - RNA, 18 nt, Salmonella enterica enterica serovar Typhi Ty2
cuguaggaucaaccaccu

SEQ ID NO: 3704394 - RNA, 22 nt, Salmonella enterica enterica serovar Typhi Ty2
cuguagggcacugggcgauacc

SEQ ID NO: 3704395 - RNA, 20 nt, Salmonella enterica enterica serovar Typhi Ty2
cuguagguucgguaugccuu

SEQ ID NO: 3704396 - RNA, 17 nt, Salmonella enterica enterica serovar Typhi Ty2
cuguaguaaucauacgc

SEQ ID NO: 3704397 - RNA, 15 nt, Salmonella enterica enterica serovar Typhi Ty2
cuguauaaaauauuu

SEQ ID NO: 3704398 - RNA, 15 nt, Salmonella enterica enterica serovar Typhi Ty2
cuguaucaaaccaac

SEQ ID NO: 3704399 - RNA, 15 nt, Salmonella enterica enterica serovar Typhi Ty2
cuguaucacuuuuua

SEQ ID NO: 3704400 - RNA, 17 nt, Salmonella enterica enterica serovar Typhi Ty2
cuguaucgacauaguac

SEQ ID NO: 3704401 - RNA, 17 nt, Salmonella enterica enterica serovar Typhi Ty2
cuguaucugcugacacc

SEQ ID NO: 3704402 - RNA, 17 nt, Salmonella enterica enterica serovar Typhi Ty2
cuguauucgguggaaac

SEQ ID NO: 3704403 - RNA, 20 nt, Salmonella enterica enterica serovar Typhi Ty2
cuguauucguccauaagcgc

SEQ ID NO: 3704404 - RNA, 17 nt, Salmonella enterica enterica serovar Typhi Ty2
cuguauuuucguuugca

SEQ ID NO: 3704405 - RNA, 14 nt, Salmonella enterica enterica serovar Typhi Ty2
cugucaaaaauaac

SEQ ID NO: 3704406 - RNA, 14 nt, Salmonella enterica enterica serovar Typhi Ty2
cugucaccagcagc

SEQ ID NO: 3704407 - RNA, 17 nt, Salmonella enterica enterica serovar Typhi Ty2
cugucaccgacacgcau

SEQ ID NO: 3704408 - RNA, 17 nt, Salmonella enterica enterica serovar Typhi Ty2
cugucagaaaucugaau

SEQ ID NO: 3704409 - RNA, 18 nt, Salmonella enterica enterica serovar Typhi Ty2
cugucagaaaucugaaug

SEQ ID NO: 3704410 - RNA, 16 nt, Salmonella enterica enterica serovar Typhi Ty2
cugucaucaaugagcg

SEQ ID NO: 3704411 - RNA, 23 nt, Salmonella enterica enterica serovar Typhi Ty2
cuguccagccgcccuucuccggu

SEQ ID NO: 3704412 - RNA, 17 nt, Salmonella enterica enterica serovar Typhi Ty2
cugucccagccuuccug

SEQ ID NO: 3704413 - RNA, 21 nt, Salmonella enterica enterica serovar Typhi Ty2
cugucccuucgcccggcgcgc

SEQ ID NO: 3704414 - RNA, 18 nt, Salmonella enterica enterica serovar Typhi Ty2
cuguccgcccaguaccag

SEQ ID NO: 3704415 - RNA, 19 nt, Salmonella enterica enterica serovar Typhi Ty2
cuguccggaauaacuccag

SEQ ID NO: 3704416 - RNA, 19 nt, Salmonella enterica enterica serovar Typhi Ty2
cuguccggguaucugggcg

SEQ ID NO: 3704417 - RNA, 18 nt, Salmonella enterica enterica serovar Typhi Ty2
cugucgaaaccagcauaa

SEQ ID NO: 3704418 - RNA, 22 nt, Salmonella enterica enterica serovar Typhi Ty2
cugucgaaaccagcauaaugag

SEQ ID NO: 3704419 - RNA, 19 nt, Salmonella enterica enterica serovar Typhi Ty2
cugucgaacaugcggauau

SEQ ID NO: 3704420 - RNA, 12 nt, Salmonella enterica enterica serovar Typhi Ty2
cugucgaccauc

SEQ ID NO: 3704421 - RNA, 14 nt, Salmonella enterica enterica serovar Typhi Ty2
cugucgaugauauc

SEQ ID NO: 3704422 - RNA, 21 nt, Salmonella enterica enterica serovar Typhi Ty2
cugucgcaauuuaccuauuuc

SEQ ID NO: 3704423 - RNA, 17 nt, Salmonella enterica enterica serovar Typhi Ty2
cugucgcccgcaaccac

SEQ ID NO: 3704424 - RNA, 17 nt, Salmonella enterica enterica serovar Typhi Ty2
cugucgccgcguaaauc

SEQ ID NO: 3704425 - RNA, 20 nt, Salmonella enterica enterica serovar Typhi Ty2
cugucgccgcguaaauccac

SEQ ID NO: 3704426 - RNA, 18 nt, Salmonella enterica enterica serovar Typhi Ty2
cugucgccgucugcaaaa

SEQ ID NO: 3704427 - RNA, 23 nt, Salmonella enterica enterica serovar Typhi Ty2
cugucgcuaaagcacuccccggc

SEQ ID NO: 3704428 - RNA, 15 nt, Salmonella enterica enterica serovar Typhi Ty2
cugucgcucgcggca

SEQ ID NO: 3704429 - RNA, 16 nt, Salmonella enterica enterica serovar Typhi Ty2
cugucgcucgcggcag

SEQ ID NO: 3704430 - RNA, 15 nt, Salmonella enterica enterica serovar Typhi Ty2
cugucggcagaaccu

SEQ ID NO: 3704431 - RNA, 14 nt, Salmonella enterica enterica serovar Typhi Ty2
cugucggcgaggua

SEQ ID NO: 3704432 - RNA, 22 nt, Salmonella enterica enterica serovar Typhi Ty2
cugucggcgagguacugcauaa

SEQ ID NO: 3704433 - RNA, 17 nt, Salmonella enterica enterica serovar Typhi Ty2
cugucggucagauucag

SEQ ID NO: 3704434 - RNA, 15 nt, Salmonella enterica enterica serovar Typhi Ty2
cugucgucaccugua

SEQ ID NO: 3704435 - RNA, 17 nt, Salmonella enterica enterica serovar Typhi Ty2
cugucguccucaggccg

SEQ ID NO: 3704436 - RNA, 14 nt, Salmonella enterica enterica serovar Typhi Ty2
cugucugaaucagu

SEQ ID NO: 3704437 - RNA, 20 nt, Salmonella enterica enterica serovar Typhi Ty2
cugucugcaagagaaauaac

SEQ ID NO: 3704438 - RNA, 18 nt, Salmonella enterica enterica serovar Typhi Ty2
cugucugucgcgggcgaa

SEQ ID NO: 3704439 - RNA, 22 nt, Salmonella enterica enterica serovar Typhi Ty2
cugucuuacacugauaccccag

SEQ ID NO: 3704440 - RNA, 14 nt, Salmonella enterica enterica serovar Typhi Ty2
cugucuuguggaac

SEQ ID NO: 3704441 - RNA, 15 nt, Salmonella enterica enterica serovar Typhi Ty2
cugucuuguuuuucu

SEQ ID NO: 3704442 - RNA, 20 nt, Salmonella enterica enterica serovar Typhi Ty2
cugugacaucgccccggccu

SEQ ID NO: 3704443 - RNA, 23 nt, Salmonella enterica enterica serovar Typhi Ty2
cugugacaucgccccggccuuau

SEQ ID NO: 3704444 - RNA, 22 nt, Salmonella enterica enterica serovar Typhi Ty2
cugugacggcaacugaaaacag

SEQ ID NO: 3704445 - RNA, 22 nt, Salmonella enterica enterica serovar Typhi Ty2
cugugauaaaaacgccuugccc

SEQ ID NO: 3704446 - RNA, 16 nt, Salmonella enterica enterica serovar Typhi Ty2
cugugauugaauucac

SEQ ID NO: 3704447 - RNA, 17 nt, Salmonella enterica enterica serovar Typhi Ty2
cugugcaaaauuacuuc

SEQ ID NO: 3704448 - RNA, 13 nt, Salmonella enterica enterica serovar Typhi Ty2
cugugccagccca

SEQ ID NO: 3704449 - RNA, 23 nt, Salmonella enterica enterica serovar Typhi Ty2
cugugccgccgguguuuccguca

SEQ ID NO: 3704450 - RNA, 14 nt, Salmonella enterica enterica serovar Typhi Ty2
cugugcgacaaccu

SEQ ID NO: 3704451 - RNA, 13 nt, Salmonella enterica enterica serovar Typhi Ty2
cugugcgccugcu

SEQ ID NO: 3704452 - RNA, 15 nt, Salmonella enterica enterica serovar Typhi Ty2
cugugcggaauagcc

SEQ ID NO: 3704453 - RNA, 14 nt, Salmonella enterica enterica serovar Typhi Ty2
cugugcgugaccca

SEQ ID NO: 3704454 - RNA, 17 nt, Salmonella enterica enterica serovar Typhi Ty2
cugugcuaucaggccua

SEQ ID NO: 3704455 - RNA, 19 nt, Salmonella enterica enterica serovar Typhi Ty2
cuguggaaacuccagcggc

SEQ ID NO: 3704456 - RNA, 17 nt, Salmonella enterica enterica serovar Typhi Ty2
cuguggaggguaagaaa

SEQ ID NO: 3704457 - RNA, 18 nt, Salmonella enterica enterica serovar Typhi Ty2
cuguggcaauuuucaguu

SEQ ID NO: 3704458 - RNA, 19 nt, Salmonella enterica enterica serovar Typhi Ty2
cugugggcgugucgccggg

SEQ ID NO: 3704459 - RNA, 13 nt, Salmonella enterica enterica serovar Typhi Ty2
cuguggugugccu

SEQ ID NO: 3704460 - RNA, 18 nt, Salmonella enterica enterica serovar Typhi Ty2
cuguggugugccugcguu

SEQ ID NO: 3704461 - RNA, 14 nt, Salmonella enterica enterica serovar Typhi Ty2
cugugguucugcca

SEQ ID NO: 3704462 - RNA, 17 nt, Salmonella enterica enterica serovar Typhi Ty2
cugugguugcccgcagg

SEQ ID NO: 3704463 - RNA, 20 nt, Salmonella enterica enterica serovar Typhi Ty2
cuguguacgcguucugaaua

SEQ ID NO: 3704464 - RNA, 18 nt, Salmonella enterica enterica serovar Typhi Ty2
cugugucguccaggccug

SEQ ID NO: 3704465 - RNA, 19 nt, Salmonella enterica enterica serovar Typhi Ty2
cugugugagcgcccgccgc

SEQ ID NO: 3704466 - RNA, 16 nt, Salmonella enterica enterica serovar Typhi Ty2
cugugugggcacucga

SEQ ID NO: 3704467 - RNA, 23 nt, Salmonella enterica enterica serovar Typhi Ty2
cuuacagggcgaugccucacccc

SEQ ID NO: 3704468 - RNA, 19 nt, Salmonella enterica enterica serovar Typhi Ty2
cuuaccagguauuaaauac

SEQ ID NO: 3704469 - RNA, 18 nt, Salmonella enterica enterica serovar Typhi Ty2
cuuaccaggucuuaccua

SEQ ID NO: 3704470 - RNA, 14 nt, Salmonella enterica enterica serovar Typhi Ty2
cuuaccaucuggcc

SEQ ID NO: 3704471 - RNA, 16 nt, Salmonella enterica enterica serovar Typhi Ty2
cuuacccggcguauug

SEQ ID NO: 3704472 - RNA, 13 nt, Salmonella enterica enterica serovar Typhi Ty2
cuuaccgcaucgc

SEQ ID NO: 3704473 - RNA, 15 nt, Salmonella enterica enterica serovar Typhi Ty2
cuuaccgcggucacc

SEQ ID NO: 3704474 - RNA, 16 nt, Salmonella enterica enterica serovar Typhi Ty2
cuuaccgcuaaaauac

SEQ ID NO: 3704475 - RNA, 23 nt, Salmonella enterica enterica serovar Typhi Ty2
cuuaccggugcgauucagcgcag

SEQ ID NO: 3704476 - RNA, 23 nt, Salmonella enterica enterica serovar Typhi Ty2
cuuaccuauuuuaaauucccagc

SEQ ID NO: 3704477 - RNA, 17 nt, Salmonella enterica enterica serovar Typhi Ty2
cuuaccuugaguaacug

SEQ ID NO: 3704478 - RNA, 19 nt, Salmonella enterica enterica serovar Typhi Ty2
cuuaccuuguucuuccauu

SEQ ID NO: 3704479 - RNA, 20 nt, Salmonella enterica enterica serovar Typhi Ty2
cuuacgaagaucgucgauca

SEQ ID NO: 3704480 - RNA, 23 nt, Salmonella enterica enterica serovar Typhi Ty2
cuuacgaauuuuaucuuccggca

SEQ ID NO: 3704481 - RNA, 16 nt, Salmonella enterica enterica serovar Typhi Ty2
cuuacgagaggcuuua

SEQ ID NO: 3704482 - RNA, 23 nt, Salmonella enterica enterica serovar Typhi Ty2
cuuacgcaguugggcgcgcgacu

SEQ ID NO: 3704483 - RNA, 22 nt, Salmonella enterica enterica serovar Typhi Ty2
cuuacgcggcgcgcucuuuuuc

SEQ ID NO: 3704484 - RNA, 19 nt, Salmonella enterica enterica serovar Typhi Ty2
cuuacgcuuacccggccua

SEQ ID NO: 3704485 - RNA, 16 nt, Salmonella enterica enterica serovar Typhi Ty2
cuuacgcuugggcuga

SEQ ID NO: 3704486 - RNA, 21 nt, Salmonella enterica enterica serovar Typhi Ty2
cuuacggacugcggccugcaa

SEQ ID NO: 3704487 - RNA, 22 nt, Salmonella enterica enterica serovar Typhi Ty2
cuuacggacugcggccugcaaa

SEQ ID NO: 3704488 - RNA, 24 nt, Salmonella enterica enterica serovar Typhi Ty2
cuuacgguaaagcguaucgcccag

SEQ ID NO: 3704489 - RNA, 21 nt, Salmonella enterica enterica serovar Typhi Ty2
cuuacguucgaugacuuguuc

SEQ ID NO: 3704490 - RNA, 18 nt, Salmonella enterica enterica serovar Typhi Ty2
cuuacguugcauuuauca

SEQ ID NO: 3704491 - RNA, 13 nt, Salmonella enterica enterica serovar Typhi Ty2
cuuacugcugucc

SEQ ID NO: 3704492 - RNA, 14 nt, Salmonella enterica enterica serovar Typhi Ty2
cuuacuuguaggcc

SEQ ID NO: 3704493 - RNA, 20 nt, Salmonella enterica enterica serovar Typhi Ty2
cuuacuuucuugccacuggc

SEQ ID NO: 3704494 - RNA, 14 nt, Salmonella enterica enterica serovar Typhi Ty2
cuuacuuugcgccc

SEQ ID NO: 3704495 - RNA, 17 nt, Salmonella enterica enterica serovar Typhi Ty2
cuuagcaacugccggcu

SEQ ID NO: 3704496 - RNA, 23 nt, Salmonella enterica enterica serovar Typhi Ty2
cuuagcacccaccaucacuucca

SEQ ID NO: 3704497 - RNA, 19 nt, Salmonella enterica enterica serovar Typhi Ty2
cuuagcgcccgguuuuuuu

SEQ ID NO: 3704498 - RNA, 19 nt, Salmonella enterica enterica serovar Typhi Ty2
cuuagcuggccaaucagcg

SEQ ID NO: 3704499 - RNA, 14 nt, Salmonella enterica enterica serovar Typhi Ty2
cuuaggcagccagg

SEQ ID NO: 3704500 - RNA, 20 nt, Salmonella enterica enterica serovar Typhi Ty2
cuuaggcaggggauuagacu

SEQ ID NO: 3704501 - RNA, 17 nt, Salmonella enterica enterica serovar Typhi Ty2
cuuaguuuucguagggc

SEQ ID NO: 3704502 - RNA, 16 nt, Salmonella enterica enterica serovar Typhi Ty2
cuuauacaggcgcagg

SEQ ID NO: 3704503 - RNA, 18 nt, Salmonella enterica enterica serovar Typhi Ty2
cuuauacccuuguaaauu

SEQ ID NO: 3704504 - RNA, 17 nt, Salmonella enterica enterica serovar Typhi Ty2
cuuauacugauaaacua

SEQ ID NO: 3704505 - RNA, 14 nt, Salmonella enterica enterica serovar Typhi Ty2
cuuauaucauggga

SEQ ID NO: 3704506 - RNA, 20 nt, Salmonella enterica enterica serovar Typhi Ty2
cuuauauuuauuuauugucu

SEQ ID NO: 3704507 - RNA, 20 nt, Salmonella enterica enterica serovar Typhi Ty2
cuuaucaaaccagcuuuuca

SEQ ID NO: 3704508 - RNA, 11 nt, Salmonella enterica enterica serovar Typhi Ty2
cuuaucagaac

SEQ ID NO: 3704509 - RNA, 13 nt, Salmonella enterica enterica serovar Typhi Ty2
cuuaucaggccua

SEQ ID NO: 3704510 - RNA, 23 nt, Salmonella enterica enterica serovar Typhi Ty2
cuuaucaggccuguaaaccgccu

SEQ ID NO: 3704511 - RNA, 20 nt, Salmonella enterica enterica serovar Typhi Ty2
cuuauccaaauccuuaauca

SEQ ID NO: 3704512 - RNA, 19 nt, Salmonella enterica enterica serovar Typhi Ty2
cuuaucccacaacuguucu

SEQ ID NO: 3704513 - RNA, 13 nt, Salmonella enterica enterica serovar Typhi Ty2
cuuaucccagccg

SEQ ID NO: 3704514 - RNA, 20 nt, Salmonella enterica enterica serovar Typhi Ty2
cuuauccccauucugcugau

SEQ ID NO: 3704515 - RNA, 20 nt, Salmonella enterica enterica serovar Typhi Ty2
cuuauccggccuaccgucuc

SEQ ID NO: 3704516 - RNA, 17 nt, Salmonella enterica enterica serovar Typhi Ty2
cuuauccggccuccaaa

SEQ ID NO: 3704517 - RNA, 20 nt, Salmonella enterica enterica serovar Typhi Ty2
cuuauccggccugcaggcaa

SEQ ID NO: 3704518 - RNA, 20 nt, Salmonella enterica enterica serovar Typhi Ty2
cuuauccggcuuacggcuau

SEQ ID NO: 3704519 - RNA, 17 nt, Salmonella enterica enterica serovar Typhi Ty2
cuuaucgccaaagauau

SEQ ID NO: 3704520 - RNA, 15 nt, Salmonella enterica enterica serovar Typhi Ty2
cuuaucgccccagcc

SEQ ID NO: 3704521 - RNA, 22 nt, Salmonella enterica enterica serovar Typhi Ty2
cuuaucggcguguuucaucuca

SEQ ID NO: 3704522 - RNA, 22 nt, Salmonella enterica enterica serovar Typhi Ty2
cuuaucguuaaggccugcgcga

SEQ ID NO: 3704523 - RNA, 15 nt, Salmonella enterica enterica serovar Typhi Ty2
cuuaucugcaauaaa

SEQ ID NO: 3704524 - RNA, 13 nt, Salmonella enterica enterica serovar Typhi Ty2
cuuaucuggauga

SEQ ID NO: 3704525 - RNA, 13 nt, Salmonella enterica enterica serovar Typhi Ty2
cuuaucuugcgca

SEQ ID NO: 3704526 - RNA, 22 nt, Salmonella enterica enterica serovar Typhi Ty2
cuuaugaaaccccaaaucagca

SEQ ID NO: 3704527 - RNA, 15 nt, Salmonella enterica enterica serovar Typhi Ty2
cuuaugaucgcccag

SEQ ID NO: 3704528 - RNA, 21 nt, Salmonella enterica enterica serovar Typhi Ty2
cuuaugaucgcccagccacuc

SEQ ID NO: 3704529 - RNA, 16 nt, Salmonella enterica enterica serovar Typhi Ty2
cuuaugcaagauugcg

SEQ ID NO: 3704530 - RNA, 12 nt, Salmonella enterica enterica serovar Typhi Ty2
cuuaugcccggc

SEQ ID NO: 3704531 - RNA, 12 nt, Salmonella enterica enterica serovar Typhi Ty2
cuuauuacgcaa

SEQ ID NO: 3704532 - RNA, 13 nt, Salmonella enterica enterica serovar Typhi Ty2
cuuauuacgcuuc

SEQ ID NO: 3704533 - RNA, 13 nt, Salmonella enterica enterica serovar Typhi Ty2
cuuauucaaucaa

SEQ ID NO: 3704534 - RNA, 15 nt, Salmonella enterica enterica serovar Typhi Ty2
cuuauugaguuaccg

SEQ ID NO: 3704535 - RNA, 16 nt, Salmonella enterica enterica serovar Typhi Ty2
cuuauugucgccgccg

SEQ ID NO: 3704536 - RNA, 20 nt, Salmonella enterica enterica serovar Typhi Ty2
cuuauuuuauuuuuauauuc

SEQ ID NO: 3704537 - RNA, 19 nt, Salmonella enterica enterica serovar Typhi Ty2
cuuauuuuccguuagccaa

SEQ ID NO: 3704538 - RNA, 21 nt, Salmonella enterica enterica serovar Typhi Ty2
cuuauuuuucagcgccaguga

SEQ ID NO: 3704539 - RNA, 23 nt, Salmonella enterica enterica serovar Typhi Ty2
cuucaaauauauugaaaagggac

SEQ ID NO: 3704540 - RNA, 14 nt, Salmonella enterica enterica serovar Typhi Ty2
cuucaacagcggcg

SEQ ID NO: 3704541 - RNA, 19 nt, Salmonella enterica enterica serovar Typhi Ty2
cuucaacagcggcggcagu

SEQ ID NO: 3704542 - RNA, 18 nt, Salmonella enterica enterica serovar Typhi Ty2
cuucaacagcucgccaug

SEQ ID NO: 3704543 - RNA, 18 nt, Salmonella enterica enterica serovar Typhi Ty2
cuucaacccagcagcaga

SEQ ID NO: 3704544 - RNA, 19 nt, Salmonella enterica enterica serovar Typhi Ty2
cuucaaccguuucuuuuuc

SEQ ID NO: 3704545 - RNA, 21 nt, Salmonella enterica enterica serovar Typhi Ty2
cuucaaccguuucuuuuucga

SEQ ID NO: 3704546 - RNA, 19 nt, Salmonella enterica enterica serovar Typhi Ty2
cuucaaccuuuaucuguug

SEQ ID NO: 3704547 - RNA, 18 nt, Salmonella enterica enterica serovar Typhi Ty2
cuucaaccuuugggcaga

SEQ ID NO: 3704548 - RNA, 19 nt, Salmonella enterica enterica serovar Typhi Ty2
cuucaacgcaggcgaaauc

SEQ ID NO: 3704549 - RNA, 21 nt, Salmonella enterica enterica serovar Typhi Ty2
cuuccaguaguaaaccgguug

SEQ ID NO: 3704550 - RNA, 16 nt, Salmonella enterica enterica serovar Typhi Ty2
cuuccaguugaaaacc

SEQ ID NO: 3704551 - RNA, 14 nt, Salmonella enterica enterica serovar Typhi Ty2
cuuccaguugcguc

SEQ ID NO: 3704552 - RNA, 15 nt, Salmonella enterica enterica serovar Typhi Ty2
cuuccaguugcguca

SEQ ID NO: 3704553 - RNA, 13 nt, Salmonella enterica enterica serovar Typhi Ty2
cuuccaguugcuu

SEQ ID NO: 3704554 - RNA, 16 nt, Salmonella enterica enterica serovar Typhi Ty2
cuuccaguuuugccag

SEQ ID NO: 3704555 - RNA, 13 nt, Salmonella enterica enterica serovar Typhi Ty2
cuuccaucgcauc

SEQ ID NO: 3704556 - RNA, 17 nt, Salmonella enterica enterica serovar Typhi Ty2
cuuccaugccuucauaa

SEQ ID NO: 3704557 - RNA, 16 nt, Salmonella enterica enterica serovar Typhi Ty2
cuucccacagucggcg

SEQ ID NO: 3704558 - RNA, 22 nt, Salmonella enterica enterica serovar Typhi Ty2
cuucccauauuuuuucugccag

SEQ ID NO: 3704559 - RNA, 23 nt, Salmonella enterica enterica serovar Typhi Ty2
cuucccauauuuuuucugccagu

SEQ ID NO: 3704560 - RNA, 23 nt, Salmonella enterica enterica serovar Typhi Ty2
cuucccccagaaugccgcccauc

SEQ ID NO: 3704561 - RNA, 23 nt, Salmonella enterica enterica serovar Typhi Ty2
cuucccccuggcuaucaauguuu

SEQ ID NO: 3704562 - RNA, 16 nt, Salmonella enterica enterica serovar Typhi Ty2
cuuccccgaucagaaa

SEQ ID NO: 3704563 - RNA, 23 nt, Salmonella enterica enterica serovar Typhi Ty2
cuuccccggcagccucaggccug

SEQ ID NO: 3704564 - RNA, 22 nt, Salmonella enterica enterica serovar Typhi Ty2
cuuccccggucagucccagcgu

SEQ ID NO: 3704565 - RNA, 23 nt, Salmonella enterica enterica serovar Typhi Ty2
cuucccgcaaacuggccacagca

SEQ ID NO: 3704566 - RNA, 23 nt, Salmonella enterica enterica serovar Typhi Ty2
cuucccgcaccgcgaugcugcuc

SEQ ID NO: 3704567 - RNA, 16 nt, Salmonella enterica enterica serovar Typhi Ty2
cuucccgcgcagugca

SEQ ID NO: 3704568 - RNA, 14 nt, Salmonella enterica enterica serovar Typhi Ty2
cuucccgcucauua

SEQ ID NO: 3704569 - RNA, 17 nt, Salmonella enterica enterica serovar Typhi Ty2
cuucccggggaacagaa

SEQ ID NO: 3704570 - RNA, 19 nt, Salmonella enterica enterica serovar Typhi Ty2
cuuccgacacugaaacucc

SEQ ID NO: 3704571 - RNA, 22 nt, Salmonella enterica enterica serovar Typhi Ty2
cuuccgcaauacagcccgccag

SEQ ID NO: 3704572 - RNA, 20 nt, Salmonella enterica enterica serovar Typhi Ty2
cuuccgcacgcgcgcccugc

SEQ ID NO: 3704573 - RNA, 22 nt, Salmonella enterica enterica serovar Typhi Ty2
cuuccgcaucgacguucagcau

SEQ ID NO: 3704574 - RNA, 17 nt, Salmonella enterica enterica serovar Typhi Ty2
cuuccgccaccacgccc

SEQ ID NO: 3704575 - RNA, 18 nt, Salmonella enterica enterica serovar Typhi Ty2
cuuccgccacggcuuuca

SEQ ID NO: 3704576 - RNA, 21 nt, Salmonella enterica enterica serovar Typhi Ty2
cuuccgccaggcgggugguga

SEQ ID NO: 3704577 - RNA, 16 nt, Salmonella enterica enterica serovar Typhi Ty2
cuuccgccauacccgg

SEQ ID NO: 3704578 - RNA, 19 nt, Salmonella enterica enterica serovar Typhi Ty2
cuuccgccauacccggcuc

SEQ ID NO: 3704579 - RNA, 22 nt, Salmonella enterica enterica serovar Typhi Ty2
cuuccgccauacccggcuccca

SEQ ID NO: 3704580 - RNA, 14 nt, Salmonella enterica enterica serovar Typhi Ty2
cuuccgccugauaa

SEQ ID NO: 3704581 - RNA, 19 nt, Salmonella enterica enterica serovar Typhi Ty2
cuuccgcuuuaagcgcugc

SEQ ID NO: 3704582 - RNA, 20 nt, Salmonella enterica enterica serovar Typhi Ty2
cuuccggauaacgcgcuggc

SEQ ID NO: 3704583 - RNA, 16 nt, Salmonella enterica enterica serovar Typhi Ty2
cuuccggcgagagaau

SEQ ID NO: 3704584 - RNA, 15 nt, Salmonella enterica enterica serovar Typhi Ty2
cuuccgggcgggcgc

SEQ ID NO: 3704585 - RNA, 20 nt, Salmonella enterica enterica serovar Typhi Ty2
cuuccgguugaccgcauaau

SEQ ID NO: 3704586 - RNA, 16 nt, Salmonella enterica enterica serovar Typhi Ty2
cuuccguaaaaagaac

SEQ ID NO: 3704587 - RNA, 12 nt, Salmonella enterica enterica serovar Typhi Ty2
cuuccgucagcg

SEQ ID NO: 3704588 - RNA, 14 nt, Salmonella enterica enterica serovar Typhi Ty2
cuuccgucagcgaa

SEQ ID NO: 3704589 - RNA, 14 nt, Salmonella enterica enterica serovar Typhi Ty2
cuuccucacagccu

SEQ ID NO: 3704590 - RNA, 18 nt, Salmonella enterica enterica serovar Typhi Ty2
cuuccucauuuuugccca

SEQ ID NO: 3704591 - RNA, 22 nt, Salmonella enterica enterica serovar Typhi Ty2
cuuccuccagcaucagguggaa

SEQ ID NO: 3704592 - RNA, 14 nt, Salmonella enterica enterica serovar Typhi Ty2
cuuccugcacgccu

SEQ ID NO: 3704593 - RNA, 17 nt, Salmonella enterica enterica serovar Typhi Ty2
cuuccugcauuaccggg

SEQ ID NO: 3704594 - RNA, 15 nt, Salmonella enterica enterica serovar Typhi Ty2
cuuccugccaggccg

SEQ ID NO: 3704595 - RNA, 23 nt, Salmonella enterica enterica serovar Typhi Ty2
cuuccugccgcgaucgcggcaac

SEQ ID NO: 3704596 - RNA, 12 nt, Salmonella enterica enterica serovar Typhi Ty2
cuuccugcugcg

SEQ ID NO: 3704597 - RNA, 21 nt, Salmonella enterica enterica serovar Typhi Ty2
cuuccugcugcgccagcgcau

SEQ ID NO: 3704598 - RNA, 17 nt, Salmonella enterica enterica serovar Typhi Ty2
cuuccuuugccuuucuu

SEQ ID NO: 3704599 - RNA, 15 nt, Salmonella enterica enterica serovar Typhi Ty2
cuucgaacagcucau

SEQ ID NO: 3704600 - RNA, 18 nt, Salmonella enterica enterica serovar Typhi Ty2
cuucgaaugucucaauau

SEQ ID NO: 3704601 - RNA, 18 nt, Salmonella enterica enterica serovar Typhi Ty2
cuucgaccgucagcagca

SEQ ID NO: 3704602 - RNA, 12 nt, Salmonella enterica enterica serovar Typhi Ty2
cuucgauaaacg

SEQ ID NO: 3704603 - RNA, 13 nt, Salmonella enterica enterica serovar Typhi Ty2
cuucgcaaccggu

SEQ ID NO: 3704604 - RNA, 13 nt, Salmonella enterica enterica serovar Typhi Ty2
cuucgcaaucucc

SEQ ID NO: 3704605 - RNA, 13 nt, Salmonella enterica enterica serovar Typhi Ty2
cuucgcacugccc

SEQ ID NO: 3704606 - RNA, 18 nt, Salmonella enterica enterica serovar Typhi Ty2
cuucgccaaaauggcgaa

SEQ ID NO: 3704607 - RNA, 21 nt, Salmonella enterica enterica serovar Typhi Ty2
cuucgccaacuuuuugcgcaa

SEQ ID NO: 3704608 - RNA, 17 nt, Salmonella enterica enterica serovar Typhi Ty2
cuucgccaaucgccgcc

SEQ ID NO: 3704609 - RNA, 18 nt, Salmonella enterica enterica serovar Typhi Ty2
cuucgccaucuccaucau

SEQ ID NO: 3704610 - RNA, 20 nt, Salmonella enterica enterica serovar Typhi Ty2
cuucgccaucuccaucauuu

SEQ ID NO: 3704611 - RNA, 19 nt, Salmonella enterica enterica serovar Typhi Ty2
cuucgccauuacaggacag

SEQ ID NO: 3704612 - RNA, 19 nt, Salmonella enterica enterica serovar Typhi Ty2
cuucgccguuaucggccug

SEQ ID NO: 3704613 - RNA, 21 nt, Salmonella enterica enterica serovar Typhi Ty2
cuucgccuaaaucaagcagug

SEQ ID NO: 3704614 - RNA, 16 nt, Salmonella enterica enterica serovar Typhi Ty2
cuucgccuucacgcau

SEQ ID NO: 3704615 - RNA, 21 nt, Salmonella enterica enterica serovar Typhi Ty2
cuucgccuucgcccauaucca

SEQ ID NO: 3704616 - RNA, 19 nt, Salmonella enterica enterica serovar Typhi Ty2
cuucgcgcagccagcgccc

SEQ ID NO: 3704617 - RNA, 16 nt, Salmonella enterica enterica serovar Typhi Ty2
cuucgcggaauuucag

SEQ ID NO: 3704618 - RNA, 13 nt, Salmonella enterica enterica serovar Typhi Ty2
cuucgcggccgcu

SEQ ID NO: 3704619 - RNA, 15 nt, Salmonella enterica enterica serovar Typhi Ty2
cuucgcgggaccaaa

SEQ ID NO: 3704620 - RNA, 18 nt, Salmonella enterica enterica serovar Typhi Ty2
cuucgcguuuaucaccaa

SEQ ID NO: 3704621 - RNA, 19 nt, Salmonella enterica enterica serovar Typhi Ty2
cuucgcuuaucaggccuac

SEQ ID NO: 3704622 - RNA, 14 nt, Salmonella enterica enterica serovar Typhi Ty2
cuucgcuuaucugg

SEQ ID NO: 3704623 - RNA, 18 nt, Salmonella enterica enterica serovar Typhi Ty2
cuucggacuccugacgcu

SEQ ID NO: 3704624 - RNA, 14 nt, Salmonella enterica enterica serovar Typhi Ty2
cuucggccuccgcu

SEQ ID NO: 3704625 - RNA, 18 nt, Salmonella enterica enterica serovar Typhi Ty2
cuucggccugaaucagca

SEQ ID NO: 3704626 - RNA, 19 nt, Salmonella enterica enterica serovar Typhi Ty2
cuucggcgucgugcugggc

SEQ ID NO: 3704627 - RNA, 16 nt, Salmonella enterica enterica serovar Typhi Ty2
cuucguaccaaacgaa

SEQ ID NO: 3704628 - RNA, 14 nt, Salmonella enterica enterica serovar Typhi Ty2
cuucguauuucuuc

SEQ ID NO: 3704629 - RNA, 14 nt, Salmonella enterica enterica serovar Typhi Ty2
cuucgucaaaaugg

SEQ ID NO: 3704630 - RNA, 17 nt, Salmonella enterica enterica serovar Typhi Ty2
cuucgucaaugcugcuu

SEQ ID NO: 3704631 - RNA, 14 nt, Salmonella enterica enterica serovar Typhi Ty2
cuugcccagcauau

SEQ ID NO: 3704632 - RNA, 21 nt, Salmonella enterica enterica serovar Typhi Ty2
cuugcccuguuucgcaggccg

SEQ ID NO: 3704633 - RNA, 13 nt, Salmonella enterica enterica serovar Typhi Ty2
cuugccgcgccag

SEQ ID NO: 3704634 - RNA, 15 nt, Salmonella enterica enterica serovar Typhi Ty2
cuugccggcgcagcg

SEQ ID NO: 3704635 - RNA, 15 nt, Salmonella enterica enterica serovar Typhi Ty2
cuugccgggggcgcu

SEQ ID NO: 3704636 - RNA, 18 nt, Salmonella enterica enterica serovar Typhi Ty2
cuugccguuuuucucauc

SEQ ID NO: 3704637 - RNA, 20 nt, Salmonella enterica enterica serovar Typhi Ty2
cuugccucacccugaaaucc

SEQ ID NO: 3704638 - RNA, 19 nt, Salmonella enterica enterica serovar Typhi Ty2
cuugccugcuuuuucauca

SEQ ID NO: 3704639 - RNA, 20 nt, Salmonella enterica enterica serovar Typhi Ty2
cuugcgaccacuccggcaua

SEQ ID NO: 3704640 - RNA, 17 nt, Salmonella enterica enterica serovar Typhi Ty2
cuugcgcaucgcaucag

SEQ ID NO: 3704641 - RNA, 15 nt, Salmonella enterica enterica serovar Typhi Ty2
cuugcgccaucaucc

SEQ ID NO: 3704642 - RNA, 21 nt, Salmonella enterica enterica serovar Typhi Ty2
cuugcgccaucauccggcaac

SEQ ID NO: 3704643 - RNA, 13 nt, Salmonella enterica enterica serovar Typhi Ty2
cuugcgccauucu

SEQ ID NO: 3704644 - RNA, 13 nt, Salmonella enterica enterica serovar Typhi Ty2
cuugcgccgccau

SEQ ID NO: 3704645 - RNA, 21 nt, Salmonella enterica enterica serovar Typhi Ty2
cuugcgccgccauccggccug

SEQ ID NO: 3704646 - RNA, 22 nt, Salmonella enterica enterica serovar Typhi Ty2
cuugcgccgccauccggccugu

SEQ ID NO: 3704647 - RNA, 17 nt, Salmonella enterica enterica serovar Typhi Ty2
cuugcggggagaaugcg

SEQ ID NO: 3704648 - RNA, 16 nt, Salmonella enterica enterica serovar Typhi Ty2
cuugcggugagaaacg

SEQ ID NO: 3704649 - RNA, 22 nt, Salmonella enterica enterica serovar Typhi Ty2
cuugcucaaaaagcucaagcgc

SEQ ID NO: 3704650 - RNA, 14 nt, Salmonella enterica enterica serovar Typhi Ty2
cuugcucucaggca

SEQ ID NO: 3704651 - RNA, 20 nt, Salmonella enterica enterica serovar Typhi Ty2
cuugcuggccuguucaagug

SEQ ID NO: 3704652 - RNA, 23 nt, Salmonella enterica enterica serovar Typhi Ty2
cuugcuuaacagaauugcgccac

SEQ ID NO: 3704653 - RNA, 18 nt, Salmonella enterica enterica serovar Typhi Ty2
cuugcuuuagcuugugau

SEQ ID NO: 3704654 - RNA, 19 nt, Salmonella enterica enterica serovar Typhi Ty2
cuuggaaaguugcgccgug

SEQ ID NO: 3704655 - RNA, 17 nt, Salmonella enterica enterica serovar Typhi Ty2
cuuggcguauagccgcc

SEQ ID NO: 3704656 - RNA, 17 nt, Salmonella enterica enterica serovar Typhi Ty2
cuuggcguuaaagacgc

SEQ ID NO: 3704657 - RNA, 22 nt, Salmonella enterica enterica serovar Typhi Ty2
cuuguaaaaaugccugugccag

SEQ ID NO: 3704658 - RNA, 14 nt, Salmonella enterica enterica serovar Typhi Ty2
cuuguaagggaggu

SEQ ID NO: 3704659 - RNA, 17 nt, Salmonella enterica enterica serovar Typhi Ty2
cuuguagaaaagaaggg

SEQ ID NO: 3704660 - RNA, 15 nt, Salmonella enterica enterica serovar Typhi Ty2
cuuguaggccuggua

SEQ ID NO: 3704661 - RNA, 15 nt, Salmonella enterica enterica serovar Typhi Ty2
cuugucauccugcuc

SEQ ID NO: 3704662 - RNA, 16 nt, Salmonella enterica enterica serovar Typhi Ty2
cuuguccgaugcagac

SEQ ID NO: 3704663 - RNA, 23 nt, Salmonella enterica enterica serovar Typhi Ty2
cuuguccggcguuuuagcgccau

SEQ ID NO: 3704664 - RNA, 18 nt, Salmonella enterica enterica serovar Typhi Ty2
cuugucgccaaccuccca

SEQ ID NO: 3704665 - RNA, 15 nt, Salmonella enterica enterica serovar Typhi Ty2
cuugugagcgucgcg

SEQ ID NO: 3704666 - RNA, 22 nt, Salmonella enterica enterica serovar Typhi Ty2
cuugugauaucugacuuauucg

SEQ ID NO: 3704667 - RNA, 24 nt, Salmonella enterica enterica serovar Typhi Ty2
cuugugcuuccagcuccauccacc

SEQ ID NO: 3704668 - RNA, 22 nt, Salmonella enterica enterica serovar Typhi Ty2
cuuguguggagguuucuucauc

SEQ ID NO: 3704669 - RNA, 16 nt, Salmonella enterica enterica serovar Typhi Ty2
cuuguuacucaauaaa

SEQ ID NO: 3704670 - RNA, 16 nt, Salmonella enterica enterica serovar Typhi Ty2
cuuguucgcaggucaa

SEQ ID NO: 3704671 - RNA, 14 nt, Salmonella enterica enterica serovar Typhi Ty2
cuuguugcggauga

SEQ ID NO: 3704672 - RNA, 15 nt, Salmonella enterica enterica serovar Typhi Ty2
cuuguuguaaagaaa

SEQ ID NO: 3704673 - RNA, 22 nt, Salmonella enterica enterica serovar Typhi Ty2
cuuuaaacgccagccugugauc

SEQ ID NO: 3704674 - RNA, 21 nt, Salmonella enterica enterica serovar Typhi Ty2
cuuuaaagcgcugcguggcgg

SEQ ID NO: 3704675 - RNA, 16 nt, Salmonella enterica enterica serovar Typhi Ty2
cuuuaaaugccuguuu

SEQ ID NO: 3704676 - RNA, 19 nt, Salmonella enterica enterica serovar Typhi Ty2
cuuuaaaugccuguuuaua

SEQ ID NO: 3704677 - RNA, 16 nt, Salmonella enterica enterica serovar Typhi Ty2
cuuuaaccacagccuu

SEQ ID NO: 3704678 - RNA, 14 nt, Salmonella enterica enterica serovar Typhi Ty2
cuuuaaccgccugc

SEQ ID NO: 3704679 - RNA, 15 nt, Salmonella enterica enterica serovar Typhi Ty2
cuuuaaccgccugcu

SEQ ID NO: 3704680 - RNA, 16 nt, Salmonella enterica enterica serovar Typhi Ty2
cuuuaaccucuuuuuc

SEQ ID NO: 3704681 - RNA, 23 nt, Salmonella enterica enterica serovar Typhi Ty2
cuuuaacgccuucauauuaaauu

SEQ ID NO: 3704682 - RNA, 17 nt, Salmonella enterica enterica serovar Typhi Ty2
cuuuaacgcugcaaagu

SEQ ID NO: 3704683 - RNA, 13 nt, Salmonella enterica enterica serovar Typhi Ty2
cuuuaacgcuggc

SEQ ID NO: 3704684 - RNA, 16 nt, Salmonella enterica enterica serovar Typhi Ty2
cuuuaagcaccgcuuu

SEQ ID NO: 3704685 - RNA, 13 nt, Salmonella enterica enterica serovar Typhi Ty2
cuuuaauauucau

SEQ ID NO: 3704686 - RNA, 14 nt, Salmonella enterica enterica serovar Typhi Ty2
cuuuaaucaccaug

SEQ ID NO: 3704687 - RNA, 20 nt, Salmonella enterica enterica serovar Typhi Ty2
cuuuaaucacccgcgccagc

SEQ ID NO: 3704688 - RNA, 18 nt, Salmonella enterica enterica serovar Typhi Ty2
cuuuaaugauguccagaa

SEQ ID NO: 3704689 - RNA, 20 nt, Salmonella enterica enterica serovar Typhi Ty2
cuuuaaugcccgguauuuuu

SEQ ID NO: 3704690 - RNA, 14 nt, Salmonella enterica enterica serovar Typhi Ty2
cuuuacaccccacu

SEQ ID NO: 3704691 - RNA, 16 nt, Salmonella enterica enterica serovar Typhi Ty2
cuuuaccaaugugcaa

SEQ ID NO: 3704692 - RNA, 14 nt, Salmonella enterica enterica serovar Typhi Ty2
cuuuacccagcggg

SEQ ID NO: 3704693 - RNA, 17 nt, Salmonella enterica enterica serovar Typhi Ty2
cuuuacccuuacggcca

SEQ ID NO: 3704694 - RNA, 19 nt, Salmonella enterica enterica serovar Typhi Ty2
cuuuacccuuacggccacu

SEQ ID NO: 3704695 - RNA, 18 nt, Salmonella enterica enterica serovar Typhi Ty2
cuuuacgcuuguuguaaa

SEQ ID NO: 3704696 - RNA, 16 nt, Salmonella enterica enterica serovar Typhi Ty2
cuuuacugaaucucag

SEQ ID NO: 3704697 - RNA, 19 nt, Salmonella enterica enterica serovar Typhi Ty2
cuuuacugcgccagccugc

SEQ ID NO: 3704698 - RNA, 20 nt, Salmonella enterica enterica serovar Typhi Ty2
cuuuacugcgccagccugcu

SEQ ID NO: 3704699 - RNA, 22 nt, Salmonella enterica enterica serovar Typhi Ty2
cuuuacuguugccuuugcgcgc

SEQ ID NO: 3704700 - RNA, 21 nt, Salmonella enterica enterica serovar Typhi Ty2
cuuuagauaauuucgcauaau

SEQ ID NO: 3704701 - RNA, 14 nt, Salmonella enterica enterica serovar Typhi Ty2
cuuuaggcaggaaa

SEQ ID NO: 3704702 - RNA, 18 nt, Salmonella enterica enterica serovar Typhi Ty2
cuuuaggguaucauuucc

SEQ ID NO: 3704703 - RNA, 21 nt, Salmonella enterica enterica serovar Typhi Ty2
cuuuaggguaucauuuccaca

SEQ ID NO: 3704704 - RNA, 23 nt, Salmonella enterica enterica serovar Typhi Ty2
cuuuauaaaaagcacaucagcaa

SEQ ID NO: 3704705 - RNA, 13 nt, Salmonella enterica enterica serovar Typhi Ty2
cuuuauauaaaaa

SEQ ID NO: 3704706 - RNA, 16 nt, Salmonella enterica enterica serovar Typhi Ty2
cuuuauauaaaaaaug

SEQ ID NO: 3704707 - RNA, 17 nt, Salmonella enterica enterica serovar Typhi Ty2
cuuuauauaaaaaaugg

SEQ ID NO: 3704708 - RNA, 20 nt, Salmonella enterica enterica serovar Typhi Ty2
cuuuaucaaacaaaccaaac

SEQ ID NO: 3704709 - RNA, 21 nt, Salmonella enterica enterica serovar Typhi Ty2
cuuuauccagcggcgcgcggu

SEQ ID NO: 3704710 - RNA, 18 nt, Salmonella enterica enterica serovar Typhi Ty2
cuuuauccggucugcgcg

SEQ ID NO: 3704711 - RNA, 23 nt, Salmonella enterica enterica serovar Typhi Ty2
cuuuaucgcgcagcagauuaaca

SEQ ID NO: 3704712 - RNA, 20 nt, Salmonella enterica enterica serovar Typhi Ty2
cuuuaucuucugcugcuccc

SEQ ID NO: 3704713 - RNA, 17 nt, Salmonella enterica enterica serovar Typhi Ty2
cuuuguugaucucauug

SEQ ID NO: 3704714 - RNA, 23 nt, Salmonella enterica enterica serovar Typhi Ty2
cuuuuaaacgugcggcggccucu

SEQ ID NO: 3704715 - RNA, 18 nt, Salmonella enterica enterica serovar Typhi Ty2
cuuuuaauuuuuauguca

SEQ ID NO: 3704716 - RNA, 22 nt, Salmonella enterica enterica serovar Typhi Ty2
cuuuuaauuuuuaugucauuua

SEQ ID NO: 3704717 - RNA, 22 nt, Salmonella enterica enterica serovar Typhi Ty2
cuuuuacaagaauaugcagugc

SEQ ID NO: 3704718 - RNA, 23 nt, Salmonella enterica enterica serovar Typhi Ty2
cuuuuacaggccggacaggcgac

SEQ ID NO: 3704719 - RNA, 16 nt, Salmonella enterica enterica serovar Typhi Ty2
cuuuuaccgcgucgcu

SEQ ID NO: 3704720 - RNA, 19 nt, Salmonella enterica enterica serovar Typhi Ty2
cuuuuaccuuacggacugc

SEQ ID NO: 3704721 - RNA, 14 nt, Salmonella enterica enterica serovar Typhi Ty2
cuuuuagcaccaga

SEQ ID NO: 3704722 - RNA, 14 nt, Salmonella enterica enterica serovar Typhi Ty2
cuuuuagcgcgccg

SEQ ID NO: 3704723 - RNA, 14 nt, Salmonella enterica enterica serovar Typhi Ty2
cuuuuaguauuuac

SEQ ID NO: 3704724 - RNA, 16 nt, Salmonella enterica enterica serovar Typhi Ty2
cuuuuaguauuuacaa

SEQ ID NO: 3704725 - RNA, 16 nt, Salmonella enterica enterica serovar Typhi Ty2
cuuuuaguuacgcacg

SEQ ID NO: 3704726 - RNA, 19 nt, Salmonella enterica enterica serovar Typhi Ty2
cuuuuaguuacgcacgcca

SEQ ID NO: 3704727 - RNA, 19 nt, Salmonella enterica enterica serovar Typhi Ty2
cuuuuaguucaaccugcgc

SEQ ID NO: 3704728 - RNA, 16 nt, Salmonella enterica enterica serovar Typhi Ty2
cuuuuauccccaccac

SEQ ID NO: 3704729 - RNA, 22 nt, Salmonella enterica enterica serovar Typhi Ty2
cuuuuauuauuuugauacucau

SEQ ID NO: 3704730 - RNA, 17 nt, Salmonella enterica enterica serovar Typhi Ty2
cuuuucaggucuggauu

SEQ ID NO: 3704731 - RNA, 19 nt, Salmonella enterica enterica serovar Typhi Ty2
cuuuucauccacagcgcca

SEQ ID NO: 3704732 - RNA, 22 nt, Salmonella enterica enterica serovar Typhi Ty2
cuuuucauccacagcgccagaa

SEQ ID NO: 3704733 - RNA, 18 nt, Salmonella enterica enterica serovar Typhi Ty2
cuuuucccgccagcugcg

SEQ ID NO: 3704734 - RNA, 22 nt, Salmonella enterica enterica serovar Typhi Ty2
cuuuucccguaaugcccaggcg

SEQ ID NO: 3704735 - RNA, 17 nt, Salmonella enterica enterica serovar Typhi Ty2
cuuuuccggcagcgcau

SEQ ID NO: 3704736 - RNA, 12 nt, Salmonella enterica enterica serovar Typhi Ty2
cuuuuccuucca

SEQ ID NO: 3704737 - RNA, 18 nt, Salmonella enterica enterica serovar Typhi Ty2
cuuuucggcgcuuaucca

SEQ ID NO: 3704738 - RNA, 16 nt, Salmonella enterica enterica serovar Typhi Ty2
cuuuucgggcacuggc

SEQ ID NO: 3704739 - RNA, 16 nt, Salmonella enterica enterica serovar Typhi Ty2
cuuuucggguaaauca

SEQ ID NO: 3704740 - RNA, 15 nt, Salmonella enterica enterica serovar Typhi Ty2
cuuuucuggcuucag

SEQ ID NO: 3704741 - RNA, 22 nt, Salmonella enterica enterica serovar Typhi Ty2
cuuuucugucguguccuugcca

SEQ ID NO: 3704742 - RNA, 14 nt, Salmonella enterica enterica serovar Typhi Ty2
cuuuucuuucagcu

SEQ ID NO: 3704743 - RNA, 18 nt, Salmonella enterica enterica serovar Typhi Ty2
cuuuugauacucugcuuu

SEQ ID NO: 3704744 - RNA, 21 nt, Salmonella enterica enterica serovar Typhi Ty2
cuuuugauacucugcuuuuuc

SEQ ID NO: 3704745 - RNA, 11 nt, Salmonella enterica enterica serovar Typhi Ty2
cuuuugcagcg

SEQ ID NO: 3704746 - RNA, 18 nt, Salmonella enterica enterica serovar Typhi Ty2
cuuuugccgucaggucau

SEQ ID NO: 3704747 - RNA, 19 nt, Salmonella enterica enterica serovar Typhi Ty2
cuuuugcgccuuccaguuc

SEQ ID NO: 3704748 - RNA, 19 nt, Salmonella enterica enterica serovar Typhi Ty2
cuuuugcgcguuccccaac

SEQ ID NO: 3704749 - RNA, 19 nt, Salmonella enterica enterica serovar Typhi Ty2
cuuuugcuaacagugaaau

SEQ ID NO: 3704750 - RNA, 18 nt, Salmonella enterica enterica serovar Typhi Ty2
cuuuugcuuucuggauga

SEQ ID NO: 3704751 - RNA, 20 nt, Salmonella enterica enterica serovar Typhi Ty2
cuuuuggcguaauggcggga

SEQ ID NO: 3704752 - RNA, 15 nt, Salmonella enterica enterica serovar Typhi Ty2
cuuuugguuuuucaa

SEQ ID NO: 3704753 - RNA, 19 nt, Salmonella enterica enterica serovar Typhi Ty2
cuuuugguuuuucaaccac

SEQ ID NO: 3704754 - RNA, 15 nt, Salmonella enterica enterica serovar Typhi Ty2
cuuuugucggccugu

SEQ ID NO: 3704755 - RNA, 19 nt, Salmonella enterica enterica serovar Typhi Ty2
cuuuugucggccuguucuu

SEQ ID NO: 3704756 - RNA, 19 nt, Salmonella enterica enterica serovar Typhi Ty2
cuuuugucguccccuggac

SEQ ID NO: 3704757 - RNA, 13 nt, Salmonella enterica enterica serovar Typhi Ty2
cuuuuuaaaauga

SEQ ID NO: 3704758 - RNA, 15 nt, Salmonella enterica enterica serovar Typhi Ty2
cuuuuuaaaaugacc

SEQ ID NO: 3704759 - RNA, 22 nt, Salmonella enterica enterica serovar Typhi Ty2
cuuuuuaaccauaaugucuucc

SEQ ID NO: 3704760 - RNA, 22 nt, Salmonella enterica enterica serovar Typhi Ty2
cuuuuuagcacagcucuaauug

SEQ ID NO: 3704761 - RNA, 16 nt, Salmonella enterica enterica serovar Typhi Ty2
cuuuuuauuacuuucu

SEQ ID NO: 3704762 - RNA, 22 nt, Salmonella enterica enterica serovar Typhi Ty2
cuuuuucaacagcacccaggca

SEQ ID NO: 3704763 - RNA, 13 nt, Salmonella enterica enterica serovar Typhi Ty2
cuuuuucagaucu

SEQ ID NO: 3704764 - RNA, 12 nt, Salmonella enterica enterica serovar Typhi Ty2
cuuuuucaggca

SEQ ID NO: 3704765 - RNA, 17 nt, Salmonella enterica enterica serovar Typhi Ty2
cuuuuucauauuuuccu

SEQ ID NO: 3704766 - RNA, 21 nt, Salmonella enterica enterica serovar Typhi Ty2
cuuuuuccgccugaucuuucu

SEQ ID NO: 3704767 - RNA, 17 nt, Salmonella enterica enterica serovar Typhi Ty2
cuuuuuccuccugcgga

SEQ ID NO: 3704768 - RNA, 16 nt, Salmonella enterica enterica serovar Typhi Ty2
cuuuuuccugccauug

SEQ ID NO: 3704769 - RNA, 15 nt, Salmonella enterica enterica serovar Typhi Ty2
cuuuuucggcuggca

SEQ ID NO: 3704770 - RNA, 17 nt, Salmonella enterica enterica serovar Typhi Ty2
cuuuuucggcuggcagc

SEQ ID NO: 3704771 - RNA, 13 nt, Salmonella enterica enterica serovar Typhi Ty2
cuuuuugagcggc

SEQ ID NO: 3704772 - RNA, 20 nt, Salmonella enterica enterica serovar Typhi Ty2
cuuuuugcauucgcuccuca

SEQ ID NO: 3704773 - RNA, 17 nt, Salmonella enterica enterica serovar Typhi Ty2
cuuuuugcgacacgcug

SEQ ID NO: 3704774 - RNA, 17 nt, Salmonella enterica enterica serovar Typhi Ty2
cuuuuugugcaaucaca

SEQ ID NO: 3704775 - RNA, 19 nt, Salmonella enterica enterica serovar Typhi Ty2
cuuuuuuagucuccugcca

SEQ ID NO: 3704776 - RNA, 14 nt, Salmonella enterica enterica serovar Typhi Ty2
cuuuuuuaugcugu

SEQ ID NO: 3704777 - RNA, 15 nt, Salmonella enterica enterica serovar Typhi Ty2
cuuuuuuauugccug

SEQ ID NO: 3704778 - RNA, 14 nt, Salmonella enterica enterica serovar Typhi Ty2
cuuuuuuauuguuu

SEQ ID NO: 3704779 - RNA, 11 nt, Salmonella enterica enterica serovar Typhi Ty2
cuuuuuuucaa

SEQ ID NO: 3704780 - RNA, 18 nt, Salmonella enterica enterica serovar Typhi Ty2
cuuuuuuuuaugccucuu

SEQ ID NO: 3704781 - RNA, 18 nt, Salmonella enterica enterica serovar Typhi Ty2
gaaaaaaaagcgccgcag

SEQ ID NO: 3704782 - RNA, 15 nt, Salmonella enterica enterica serovar Typhi Ty2
gaaaaaagcagcauc

SEQ ID NO: 3704783 - RNA, 23 nt, Salmonella enterica enterica serovar Typhi Ty2
gaaaaaauacugauaaaaaacag

SEQ ID NO: 3704784 - RNA, 14 nt, Salmonella enterica enterica serovar Typhi Ty2
gaaaaaauuaaaaa

SEQ ID NO: 3704785 - RNA, 13 nt, Salmonella enterica enterica serovar Typhi Ty2
gaaaaaauuacag

SEQ ID NO: 3704786 - RNA, 15 nt, Salmonella enterica enterica serovar Typhi Ty2
gaaaaacaucauggc

SEQ ID NO: 3704787 - RNA, 20 nt, Salmonella enterica enterica serovar Typhi Ty2
gaaaaacucaccgcuaugaa

SEQ ID NO: 3704788 - RNA, 20 nt, Salmonella enterica enterica serovar Typhi Ty2
gaaaaagaaguuagauauua

SEQ ID NO: 3704789 - RNA, 21 nt, Salmonella enterica enterica serovar Typhi Ty2
gaaaaagaccgacaucgccag

SEQ ID NO: 3704790 - RNA, 14 nt, Salmonella enterica enterica serovar Typhi Ty2
gaaaaagcaauaau

SEQ ID NO: 3704791 - RNA, 22 nt, Salmonella enterica enterica serovar Typhi Ty2
gaaaaauaagagggcgccaugc

SEQ ID NO: 3704792 - RNA, 19 nt, Salmonella enterica enterica serovar Typhi Ty2
gaaaaaucagucauuugca

SEQ ID NO: 3704793 - RNA, 16 nt, Salmonella enterica enterica serovar Typhi Ty2
gaaaaaucuguaggcc

SEQ ID NO: 3704794 - RNA, 13 nt, Salmonella enterica enterica serovar Typhi Ty2
gaaaaauguguug

SEQ ID NO: 3704795 - RNA, 15 nt, Salmonella enterica enterica serovar Typhi Ty2
gaaacugcugccgca

SEQ ID NO: 3704796 - RNA, 18 nt, Salmonella enterica enterica serovar Typhi Ty2
gaaacugcugccgcagca

SEQ ID NO: 3704797 - RNA, 18 nt, Salmonella enterica enterica serovar Typhi Ty2
gaaagaaaacuuuccaac

SEQ ID NO: 3704798 - RNA, 12 nt, Salmonella enterica enterica serovar Typhi Ty2
gaaagaagaggc

SEQ ID NO: 3704799 - RNA, 17 nt, Salmonella enterica enterica serovar Typhi Ty2
gaaagaccugccgaccu

SEQ ID NO: 3704800 - RNA, 13 nt, Salmonella enterica enterica serovar Typhi Ty2
gaaagagcaaaua

SEQ ID NO: 3704801 - RNA, 17 nt, Salmonella enterica enterica serovar Typhi Ty2
gaaagauaaaaauagca

SEQ ID NO: 3704802 - RNA, 13 nt, Salmonella enterica enterica serovar Typhi Ty2
gaaagauaaaaua

SEQ ID NO: 3704803 - RNA, 16 nt, Salmonella enterica enterica serovar Typhi Ty2
gaaagauagcaggccc

SEQ ID NO: 3704804 - RNA, 20 nt, Salmonella enterica enterica serovar Typhi Ty2
gaaagauuucaucaggcuga

SEQ ID NO: 3704805 - RNA, 13 nt, Salmonella enterica enterica serovar Typhi Ty2
gaaagcacuucuc

SEQ ID NO: 3704806 - RNA, 17 nt, Salmonella enterica enterica serovar Typhi Ty2
gaaagccauaaaacugg

SEQ ID NO: 3704807 - RNA, 21 nt, Salmonella enterica enterica serovar Typhi Ty2
gaaagccauaaaacuggcgcu

SEQ ID NO: 3704808 - RNA, 18 nt, Salmonella enterica enterica serovar Typhi Ty2
gaaagccucuuccgccug

SEQ ID NO: 3704809 - RNA, 20 nt, Salmonella enterica enterica serovar Typhi Ty2
gaaagcgaccuucuccccgu

SEQ ID NO: 3704810 - RNA, 22 nt, Salmonella enterica enterica serovar Typhi Ty2
gaaagcgacucauccacauacu

SEQ ID NO: 3704811 - RNA, 13 nt, Salmonella enterica enterica serovar Typhi Ty2
gaaagcugccuuu

SEQ ID NO: 3704812 - RNA, 19 nt, Salmonella enterica enterica serovar Typhi Ty2
gaaaggcgcaacgucgcca

SEQ ID NO: 3704813 - RNA, 15 nt, Salmonella enterica enterica serovar Typhi Ty2
gaaaggcuugcagga

SEQ ID NO: 3704814 - RNA, 15 nt, Salmonella enterica enterica serovar Typhi Ty2
gaaagggacgaugau

SEQ ID NO: 3704815 - RNA, 16 nt, Salmonella enterica enterica serovar Typhi Ty2
gaaagggaucaaugua

SEQ ID NO: 3704816 - RNA, 15 nt, Salmonella enterica enterica serovar Typhi Ty2
gaaagguauguacug

SEQ ID NO: 3704817 - RNA, 18 nt, Salmonella enterica enterica serovar Typhi Ty2
gaaagguccggcccgcua

SEQ ID NO: 3704818 - RNA, 20 nt, Salmonella enterica enterica serovar Typhi Ty2
gaaagucaaaauaaaauuau

SEQ ID NO: 3704819 - RNA, 14 nt, Salmonella enterica enterica serovar Typhi Ty2
gaaagucuguucgu

SEQ ID NO: 3704820 - RNA, 20 nt, Salmonella enterica enterica serovar Typhi Ty2
gaaagucuuuuguuuuucuc

SEQ ID NO: 3704821 - RNA, 22 nt, Salmonella enterica enterica serovar Typhi Ty2
gaaagugaauccccaggagcau

SEQ ID NO: 3704822 - RNA, 18 nt, Salmonella enterica enterica serovar Typhi Ty2
gaaagugcugaaauuucc

SEQ ID NO: 3704823 - RNA, 21 nt, Salmonella enterica enterica serovar Typhi Ty2
gaaagugggcgcuuuguuacu

SEQ ID NO: 3704824 - RNA, 16 nt, Salmonella enterica enterica serovar Typhi Ty2
gaaaguggugggugau

SEQ ID NO: 3704825 - RNA, 19 nt, Salmonella enterica enterica serovar Typhi Ty2
gaaaguuacuuuccauaua

SEQ ID NO: 3704826 - RNA, 19 nt, Salmonella enterica enterica serovar Typhi Ty2
gaaaguugcgccgugccug

SEQ ID NO: 3704827 - RNA, 13 nt, Salmonella enterica enterica serovar Typhi Ty2
gaaauaacagacu

SEQ ID NO: 3704828 - RNA, 18 nt, Salmonella enterica enterica serovar Typhi Ty2
gaaauaacgcacuaccag

SEQ ID NO: 3704829 - RNA, 23 nt, Salmonella enterica enterica serovar Typhi Ty2
gaaauaacguuacauuuuccaug

SEQ ID NO: 3704830 - RNA, 22 nt, Salmonella enterica enterica serovar Typhi Ty2
gaaauaaucaggugaauaccaa

SEQ ID NO: 3704831 - RNA, 14 nt, Salmonella enterica enterica serovar Typhi Ty2
gaaauaaucuguag

SEQ ID NO: 3704832 - RNA, 23 nt, Salmonella enterica enterica serovar Typhi Ty2
gaaauaccaggcggcuuuuucau

SEQ ID NO: 3704833 - RNA, 21 nt, Salmonella enterica enterica serovar Typhi Ty2
gaaauaccgguaaucaagccu

SEQ ID NO: 3704834 - RNA, 21 nt, Salmonella enterica enterica serovar Typhi Ty2
gaaauaccuaacucuuccgca

SEQ ID NO: 3704835 - RNA, 23 nt, Salmonella enterica enterica serovar Typhi Ty2
gaaauagacgagcgaaaaacugu

SEQ ID NO: 3704836 - RNA, 17 nt, Salmonella enterica enterica serovar Typhi Ty2
gaaauagccccgucaug

SEQ ID NO: 3704837 - RNA, 20 nt, Salmonella enterica enterica serovar Typhi Ty2
gaaauagcggaacugcguuu

SEQ ID NO: 3704838 - RNA, 20 nt, Salmonella enterica enterica serovar Typhi Ty2
gaaauaucgcgcggcaugga

SEQ ID NO: 3704839 - RNA, 15 nt, Salmonella enterica enterica serovar Typhi Ty2
gaaauauucucagcc

SEQ ID NO: 3704840 - RNA, 19 nt, Salmonella enterica enterica serovar Typhi Ty2
gaaaucagagacaaauaca

SEQ ID NO: 3704841 - RNA, 15 nt, Salmonella enterica enterica serovar Typhi Ty2
gaaaucaucaaucgc

SEQ ID NO: 3704842 - RNA, 16 nt, Salmonella enterica enterica serovar Typhi Ty2
gaaaucaucaaucgcu

SEQ ID NO: 3704843 - RNA, 23 nt, Salmonella enterica enterica serovar Typhi Ty2
gaaauccaccagcggacggcuaa

SEQ ID NO: 3704844 - RNA, 17 nt, Salmonella enterica enterica serovar Typhi Ty2
gaaauccgcgucccagc

SEQ ID NO: 3704845 - RNA, 17 nt, Salmonella enterica enterica serovar Typhi Ty2
gaaauccucuauuuuuu

SEQ ID NO: 3704846 - RNA, 21 nt, Salmonella enterica enterica serovar Typhi Ty2
gaaaucgccgggcuauccggc

SEQ ID NO: 3704847 - RNA, 16 nt, Salmonella enterica enterica serovar Typhi Ty2
gaaaucggcagcaccc

SEQ ID NO: 3704848 - RNA, 18 nt, Salmonella enterica enterica serovar Typhi Ty2
gaaaucgguacgcgucug

SEQ ID NO: 3704849 - RNA, 18 nt, Salmonella enterica enterica serovar Typhi Ty2
gaaaucgugcgccccagg

SEQ ID NO: 3704850 - RNA, 17 nt, Salmonella enterica enterica serovar Typhi Ty2
gaaaucugaaugguucc

SEQ ID NO: 3704851 - RNA, 15 nt, Salmonella enterica enterica serovar Typhi Ty2
gaaaucuguuccagc

SEQ ID NO: 3704852 - RNA, 20 nt, Salmonella enterica enterica serovar Typhi Ty2
gaaaucuguuccagcgagca

SEQ ID NO: 3704853 - RNA, 22 nt, Salmonella enterica enterica serovar Typhi Ty2
gaaaucuguuccagcgagcagg

SEQ ID NO: 3704854 - RNA, 23 nt, Salmonella enterica enterica serovar Typhi Ty2
gaaaucuucgccuaaaucaagca

SEQ ID NO: 3704855 - RNA, 19 nt, Salmonella enterica enterica serovar Typhi Ty2
gaaaucuuucuccugguuu

SEQ ID NO: 3704856 - RNA, 17 nt, Salmonella enterica enterica serovar Typhi Ty2
gaaaugcccauaaagaa

SEQ ID NO: 3704857 - RNA, 21 nt, Salmonella enterica enterica serovar Typhi Ty2
gaaaugcccauaaagaaauau

SEQ ID NO: 3704858 - RNA, 24 nt, Salmonella enterica enterica serovar Typhi Ty2
gaaaugcccgauagugcaagcuca

SEQ ID NO: 3704859 - RNA, 18 nt, Salmonella enterica enterica serovar Typhi Ty2
gaaaugccgggcaaaaaa

SEQ ID NO: 3704860 - RNA, 17 nt, Salmonella enterica enterica serovar Typhi Ty2
gaaaugccuuauccggc

SEQ ID NO: 3704861 - RNA, 17 nt, Salmonella enterica enterica serovar Typhi Ty2
gaaaugcgaauccggcg

SEQ ID NO: 3704862 - RNA, 22 nt, Salmonella enterica enterica serovar Typhi Ty2
gaaaugcgacaucucaggcaag

SEQ ID NO: 3704863 - RNA, 19 nt, Salmonella enterica enterica serovar Typhi Ty2
gaaaugcguggcauuaaca

SEQ ID NO: 3704864 - RNA, 20 nt, Salmonella enterica enterica serovar Typhi Ty2
gaaauggccccaaaucagac

SEQ ID NO: 3704865 - RNA, 18 nt, Salmonella enterica enterica serovar Typhi Ty2
gaaauggguaucuucauc

SEQ ID NO: 3704866 - RNA, 15 nt, Salmonella enterica enterica serovar Typhi Ty2
gaaauguauucuccc

SEQ ID NO: 3704867 - RNA, 15 nt, Salmonella enterica enterica serovar Typhi Ty2
gaaaugucuggcgcu

SEQ ID NO: 3704868 - RNA, 17 nt, Salmonella enterica enterica serovar Typhi Ty2
gaaaugucuggcgcuaa

SEQ ID NO: 3704869 - RNA, 18 nt, Salmonella enterica enterica serovar Typhi Ty2
gaaauuaaacugccuucg

SEQ ID NO: 3704870 - RNA, 13 nt, Salmonella enterica enterica serovar Typhi Ty2
gaaauuaaucagg

SEQ ID NO: 3704871 - RNA, 12 nt, Salmonella enterica enterica serovar Typhi Ty2
gaaauuauccac

SEQ ID NO: 3704872 - RNA, 17 nt, Salmonella enterica enterica serovar Typhi Ty2
gaaauuauccacaaacu

SEQ ID NO: 3704873 - RNA, 20 nt, Salmonella enterica enterica serovar Typhi Ty2
gaaauuauuccuuaucacau

SEQ ID NO: 3704874 - RNA, 16 nt, Salmonella enterica enterica serovar Typhi Ty2
gaaauuccuuccggcg

SEQ ID NO: 3704875 - RNA, 15 nt, Salmonella enterica enterica serovar Typhi Ty2
gaaauucgcagcgca

SEQ ID NO: 3704876 - RNA, 14 nt, Salmonella enterica enterica serovar Typhi Ty2
gaaauucucagaaa

SEQ ID NO: 3704877 - RNA, 17 nt, Salmonella enterica enterica serovar Typhi Ty2
gaaauucucagaaacaa

SEQ ID NO: 3704878 - RNA, 13 nt, Salmonella enterica enterica serovar Typhi Ty2
gaaauugcagggu

SEQ ID NO: 3704879 - RNA, 18 nt, Salmonella enterica enterica serovar Typhi Ty2
gaaauugcagggugcagc

SEQ ID NO: 3704880 - RNA, 22 nt, Salmonella enterica enterica serovar Typhi Ty2
gaaauugcagggugcagcaaau

SEQ ID NO: 3704881 - RNA, 14 nt, Salmonella enterica enterica serovar Typhi Ty2
gaaauuuaaagaua

SEQ ID NO: 3704882 - RNA, 21 nt, Salmonella enterica enterica serovar Typhi Ty2
gaaauuuaaagauagcugcuu

SEQ ID NO: 3704883 - RNA, 22 nt, Salmonella enterica enterica serovar Typhi Ty2
gaaauuuaggucaaaaaagcga

SEQ ID NO: 3704884 - RNA, 16 nt, Salmonella enterica enterica serovar Typhi Ty2
gaaauuucuuuuccag

SEQ ID NO: 3704885 - RNA, 19 nt, Salmonella enterica enterica serovar Typhi Ty2
gaacaaacagaccgccaug

SEQ ID NO: 3704886 - RNA, 23 nt, Salmonella enterica enterica serovar Typhi Ty2
gaacaaaucgaaccggggcgcgc

SEQ ID NO: 3704887 - RNA, 20 nt, Salmonella enterica enterica serovar Typhi Ty2
gaacaaguucuucgaagcac

SEQ ID NO: 3704888 - RNA, 19 nt, Salmonella enterica enterica serovar Typhi Ty2
gaacaauagacgcuacugu

SEQ ID NO: 3704889 - RNA, 13 nt, Salmonella enterica enterica serovar Typhi Ty2
gaacaaucaguau

SEQ ID NO: 3704890 - RNA, 16 nt, Salmonella enterica enterica serovar Typhi Ty2
gaacaccucauauuug

SEQ ID NO: 3704891 - RNA, 23 nt, Salmonella enterica enterica serovar Typhi Ty2
gaacacggacucgccuuucucca

SEQ ID NO: 3704892 - RNA, 21 nt, Salmonella enterica enterica serovar Typhi Ty2
gaacagaacagugaguuaaga

SEQ ID NO: 3704893 - RNA, 15 nt, Salmonella enterica enterica serovar Typhi Ty2
gaacagauaaauguc

SEQ ID NO: 3704894 - RNA, 12 nt, Salmonella enterica enterica serovar Typhi Ty2
gaacagcaucac

SEQ ID NO: 3704895 - RNA, 13 nt, Salmonella enterica enterica serovar Typhi Ty2
gaacagccaggcu

SEQ ID NO: 3704896 - RNA, 18 nt, Salmonella enterica enterica serovar Typhi Ty2
gaacagccccaccgccag

SEQ ID NO: 3704897 - RNA, 16 nt, Salmonella enterica enterica serovar Typhi Ty2
gaacagcggcaggcgg

SEQ ID NO: 3704898 - RNA, 17 nt, Salmonella enterica enterica serovar Typhi Ty2
gaacagcgucauccagu

SEQ ID NO: 3704899 - RNA, 21 nt, Salmonella enterica enterica serovar Typhi Ty2
gaacagcgucauccaguguua

SEQ ID NO: 3704900 - RNA, 20 nt, Salmonella enterica enterica serovar Typhi Ty2
gaacagcuggugcggcauau

SEQ ID NO: 3704901 - RNA, 18 nt, Salmonella enterica enterica serovar Typhi Ty2
gaacaggccaaacccugc

SEQ ID NO: 3704902 - RNA, 18 nt, Salmonella enterica enterica serovar Typhi Ty2
gaacaggcuucccaauac

SEQ ID NO: 3704903 - RNA, 15 nt, Salmonella enterica enterica serovar Typhi Ty2
gaacagggcgggcga

SEQ ID NO: 3704904 - RNA, 22 nt, Salmonella enterica enterica serovar Typhi Ty2
gaacagucccaccagcgcggca

SEQ ID NO: 3704905 - RNA, 15 nt, Salmonella enterica enterica serovar Typhi Ty2
gaacaguuucgccag

SEQ ID NO: 3704906 - RNA, 16 nt, Salmonella enterica enterica serovar Typhi Ty2
gaacaguuucgccagc

SEQ ID NO: 3704907 - RNA, 13 nt, Salmonella enterica enterica serovar Typhi Ty2
gaacaguuucucg

SEQ ID NO: 3704908 - RNA, 14 nt, Salmonella enterica enterica serovar Typhi Ty2
gaacaguuucucgc

SEQ ID NO: 3704909 - RNA, 17 nt, Salmonella enterica enterica serovar Typhi Ty2
gaacauaaaaacgcgcu

SEQ ID NO: 3704910 - RNA, 17 nt, Salmonella enterica enterica serovar Typhi Ty2
gaacauaacgggaauaa

SEQ ID NO: 3704911 - RNA, 22 nt, Salmonella enterica enterica serovar Typhi Ty2
gaacauaccggagccugggauu

SEQ ID NO: 3704912 - RNA, 23 nt, Salmonella enterica enterica serovar Typhi Ty2
gaacauacuuucucuccuucacg

SEQ ID NO: 3704913 - RNA, 13 nt, Salmonella enterica enterica serovar Typhi Ty2
gaacauaugaagg

SEQ ID NO: 3704914 - RNA, 15 nt, Salmonella enterica enterica serovar Typhi Ty2
gaacaucaagcggua

SEQ ID NO: 3704915 - RNA, 17 nt, Salmonella enterica enterica serovar Typhi Ty2
gaacaucacgaugaaag

SEQ ID NO: 3704916 - RNA, 15 nt, Salmonella enterica enterica serovar Typhi Ty2
gaacaucagccagca

SEQ ID NO: 3704917 - RNA, 20 nt, Salmonella enterica enterica serovar Typhi Ty2
gaacaucagccagcagcuca

SEQ ID NO: 3704918 - RNA, 18 nt, Salmonella enterica enterica serovar Typhi Ty2
gaacaucgcgacggaggc

SEQ ID NO: 3704919 - RNA, 15 nt, Salmonella enterica enterica serovar Typhi Ty2
gaacaucuuccaggu

SEQ ID NO: 3704920 - RNA, 17 nt, Salmonella enterica enterica serovar Typhi Ty2
gaacaugccgacggaga

SEQ ID NO: 3704921 - RNA, 19 nt, Salmonella enterica enterica serovar Typhi Ty2
gaacauugccccucccuga

SEQ ID NO: 3704922 - RNA, 22 nt, Salmonella enterica enterica serovar Typhi Ty2
gaacauugccccucccugaauc

SEQ ID NO: 3704923 - RNA, 16 nt, Salmonella enterica enterica serovar Typhi Ty2
gaacauuuaagauuua

SEQ ID NO: 3704924 - RNA, 16 nt, Salmonella enterica enterica serovar Typhi Ty2
gaacauuucaucuauc

SEQ ID NO: 3704925 - RNA, 15 nt, Salmonella enterica enterica serovar Typhi Ty2
gaaccaacgucauca

SEQ ID NO: 3704926 - RNA, 21 nt, Salmonella enterica enterica serovar Typhi Ty2
gaaccaauaguauggagcagg

SEQ ID NO: 3704927 - RNA, 21 nt, Salmonella enterica enterica serovar Typhi Ty2
gaaccaaucgagaagccauca

SEQ ID NO: 3704928 - RNA, 14 nt, Salmonella enterica enterica serovar Typhi Ty2
gaaccacgcaaagg

SEQ ID NO: 3704929 - RNA, 15 nt, Salmonella enterica enterica serovar Typhi Ty2
gaaccagcggcacca

SEQ ID NO: 3704930 - RNA, 16 nt, Salmonella enterica enterica serovar Typhi Ty2
gaaccaucauuaauau

SEQ ID NO: 3704931 - RNA, 21 nt, Salmonella enterica enterica serovar Typhi Ty2
gaaccauuuccucugcggacg

SEQ ID NO: 3704932 - RNA, 16 nt, Salmonella enterica enterica serovar Typhi Ty2
gaaccauuuuccccag

SEQ ID NO: 3704933 - RNA, 20 nt, Salmonella enterica enterica serovar Typhi Ty2
gaacccaucagggaaaaaug

SEQ ID NO: 3704934 - RNA, 16 nt, Salmonella enterica enterica serovar Typhi Ty2
gaacccgaccgucuuu

SEQ ID NO: 3704935 - RNA, 17 nt, Salmonella enterica enterica serovar Typhi Ty2
gaacccucgaaugugaa

SEQ ID NO: 3704936 - RNA, 14 nt, Salmonella enterica enterica serovar Typhi Ty2
gaacccugccugcc

SEQ ID NO: 3704937 - RNA, 17 nt, Salmonella enterica enterica serovar Typhi Ty2
gaaccgaauaacgccag

SEQ ID NO: 3704938 - RNA, 19 nt, Salmonella enterica enterica serovar Typhi Ty2
gaaccgaauaacgccaggu

SEQ ID NO: 3704939 - RNA, 23 nt, Salmonella enterica enterica serovar Typhi Ty2
gaaccgacggugcucaugacauc

SEQ ID NO: 3704940 - RNA, 20 nt, Salmonella enterica enterica serovar Typhi Ty2
gaaccgcccaucaacaccag

SEQ ID NO: 3704941 - RNA, 17 nt, Salmonella enterica enterica serovar Typhi Ty2
gaaccgcuuuuccugcu

SEQ ID NO: 3704942 - RNA, 14 nt, Salmonella enterica enterica serovar Typhi Ty2
gaaccggggcgcgc

SEQ ID NO: 3704943 - RNA, 20 nt, Salmonella enterica enterica serovar Typhi Ty2
gaaccguaaacgccugcacc

SEQ ID NO: 3704944 - RNA, 15 nt, Salmonella enterica enterica serovar Typhi Ty2
gaaccguggccuccg

SEQ ID NO: 3704945 - RNA, 18 nt, Salmonella enterica enterica serovar Typhi Ty2
gaaccguggccuccggca

SEQ ID NO: 3704946 - RNA, 14 nt, Salmonella enterica enterica serovar Typhi Ty2
gaaccuggcgguaa

SEQ ID NO: 3704947 - RNA, 19 nt, Salmonella enterica enterica serovar Typhi Ty2
gaaccuggcgguaaauacg

SEQ ID NO: 3704948 - RNA, 15 nt, Salmonella enterica enterica serovar Typhi Ty2
gaaccuuacggcuca

SEQ ID NO: 3704949 - RNA, 13 nt, Salmonella enterica enterica serovar Typhi Ty2
gaacgacgcugau

SEQ ID NO: 3704950 - RNA, 15 nt, Salmonella enterica enterica serovar Typhi Ty2
gaacgagaggaggag

SEQ ID NO: 3704951 - RNA, 20 nt, Salmonella enterica enterica serovar Typhi Ty2
gaacgccgcuagcggcggcc

SEQ ID NO: 3704952 - RNA, 17 nt, Salmonella enterica enterica serovar Typhi Ty2
gaacgccuuauccggcc

SEQ ID NO: 3704953 - RNA, 20 nt, Salmonella enterica enterica serovar Typhi Ty2
gaacgcggcgccgaagcagg

SEQ ID NO: 3704954 - RNA, 23 nt, Salmonella enterica enterica serovar Typhi Ty2
gaacgcguccaugaccaccagcg

SEQ ID NO: 3704955 - RNA, 18 nt, Salmonella enterica enterica serovar Typhi Ty2
gaacgcuggcacuuuccg

SEQ ID NO: 3704956 - RNA, 15 nt, Salmonella enterica enterica serovar Typhi Ty2
gaacgcuuccgggcu

SEQ ID NO: 3704957 - RNA, 15 nt, Salmonella enterica enterica serovar Typhi Ty2
gaacggcauaaucug

SEQ ID NO: 3704958 - RNA, 19 nt, Salmonella enterica enterica serovar Typhi Ty2
gaacggcuuuccagcagcc

SEQ ID NO: 3704959 - RNA, 13 nt, Salmonella enterica enterica serovar Typhi Ty2
gaauauuuugcug

SEQ ID NO: 3704960 - RNA, 15 nt, Salmonella enterica enterica serovar Typhi Ty2
gaaucacauccgcca

SEQ ID NO: 3704961 - RNA, 20 nt, Salmonella enterica enterica serovar Typhi Ty2
gaaucacauccgccagcgcc

SEQ ID NO: 3704962 - RNA, 15 nt, Salmonella enterica enterica serovar Typhi Ty2
gaaucaccgacagca

SEQ ID NO: 3704963 - RNA, 14 nt, Salmonella enterica enterica serovar Typhi Ty2
gaaucacguaaucg

SEQ ID NO: 3704964 - RNA, 17 nt, Salmonella enterica enterica serovar Typhi Ty2
gaaucacuuacuaaggu

SEQ ID NO: 3704965 - RNA, 14 nt, Salmonella enterica enterica serovar Typhi Ty2
gaaucagaugcuca

SEQ ID NO: 3704966 - RNA, 21 nt, Salmonella enterica enterica serovar Typhi Ty2
gaaucagaugcucaucaacga

SEQ ID NO: 3704967 - RNA, 22 nt, Salmonella enterica enterica serovar Typhi Ty2
gaaucagaugcucaucaacgau

SEQ ID NO: 3704968 - RNA, 16 nt, Salmonella enterica enterica serovar Typhi Ty2
gaaucagauuacccuc

SEQ ID NO: 3704969 - RNA, 16 nt, Salmonella enterica enterica serovar Typhi Ty2
gaaucagugcaucuuc

SEQ ID NO: 3704970 - RNA, 12 nt, Salmonella enterica enterica serovar Typhi Ty2
gaaucaucagaa

SEQ ID NO: 3704971 - RNA, 22 nt, Salmonella enterica enterica serovar Typhi Ty2
gaauccacuccguguugcugcc

SEQ ID NO: 3704972 - RNA, 13 nt, Salmonella enterica enterica serovar Typhi Ty2
gaauccacuuuug

SEQ ID NO: 3704973 - RNA, 11 nt, Salmonella enterica enterica serovar Typhi Ty2
gaauccaggua

SEQ ID NO: 3704974 - RNA, 16 nt, Salmonella enterica enterica serovar Typhi Ty2
gaauccagguacccca

SEQ ID NO: 3704975 - RNA, 20 nt, Salmonella enterica enterica serovar Typhi Ty2
gaaucccacggagaaaagcg

SEQ ID NO: 3704976 - RNA, 19 nt, Salmonella enterica enterica serovar Typhi Ty2
gaaucccauuagccacccc

SEQ ID NO: 3704977 - RNA, 21 nt, Salmonella enterica enterica serovar Typhi Ty2
gaaucccccugccacaaccgc

SEQ ID NO: 3704978 - RNA, 18 nt, Salmonella enterica enterica serovar Typhi Ty2
gaauccccggcuuccagc

SEQ ID NO: 3704979 - RNA, 13 nt, Salmonella enterica enterica serovar Typhi Ty2
gaaucccgucgua

SEQ ID NO: 3704980 - RNA, 20 nt, Salmonella enterica enterica serovar Typhi Ty2
gaaucccgucguagccacca

SEQ ID NO: 3704981 - RNA, 20 nt, Salmonella enterica enterica serovar Typhi Ty2
gaauccggcgcucaucagac

SEQ ID NO: 3704982 - RNA, 19 nt, Salmonella enterica enterica serovar Typhi Ty2
gaauccguugaucguccau

SEQ ID NO: 3704983 - RNA, 12 nt, Salmonella enterica enterica serovar Typhi Ty2
gaaucgccagca

SEQ ID NO: 3704984 - RNA, 13 nt, Salmonella enterica enterica serovar Typhi Ty2
gaaucgccagcau

SEQ ID NO: 3704985 - RNA, 16 nt, Salmonella enterica enterica serovar Typhi Ty2
gaaucgccagcaucgg

SEQ ID NO: 3704986 - RNA, 23 nt, Salmonella enterica enterica serovar Typhi Ty2
gaaucgccagcaucggcagcgcc

SEQ ID NO: 3704987 - RNA, 19 nt, Salmonella enterica enterica serovar Typhi Ty2
gaaucgccagucgcagcaa

SEQ ID NO: 3704988 - RNA, 15 nt, Salmonella enterica enterica serovar Typhi Ty2
gaaucgccgucagug

SEQ ID NO: 3704989 - RNA, 14 nt, Salmonella enterica enterica serovar Typhi Ty2
gaaucgccucuucg

SEQ ID NO: 3704990 - RNA, 14 nt, Salmonella enterica enterica serovar Typhi Ty2
gaaucgccugcguc

SEQ ID NO: 3704991 - RNA, 18 nt, Salmonella enterica enterica serovar Typhi Ty2
gaaucgcuuccuggguua

SEQ ID NO: 3704992 - RNA, 24 nt, Salmonella enterica enterica serovar Typhi Ty2
gaaucguccagauugagacaaaua

SEQ ID NO: 3704993 - RNA, 22 nt, Salmonella enterica enterica serovar Typhi Ty2
gaaucgugcaagcccaacuauu

SEQ ID NO: 3704994 - RNA, 15 nt, Salmonella enterica enterica serovar Typhi Ty2
gaaucguucgccagu

SEQ ID NO: 3704995 - RNA, 22 nt, Salmonella enterica enterica serovar Typhi Ty2
gaaucucgaaacaauagcugug

SEQ ID NO: 3704996 - RNA, 21 nt, Salmonella enterica enterica serovar Typhi Ty2
gaaucuggauagucaggcgau

SEQ ID NO: 3704997 - RNA, 23 nt, Salmonella enterica enterica serovar Typhi Ty2
gaaucuggucggugauauauuca

SEQ ID NO: 3704998 - RNA, 16 nt, Salmonella enterica enterica serovar Typhi Ty2
gaaucugguuguuucg

SEQ ID NO: 3704999 - RNA, 12 nt, Salmonella enterica enterica serovar Typhi Ty2
gaaugaaacagu

SEQ ID NO: 3705000 - RNA, 18 nt, Salmonella enterica enterica serovar Typhi Ty2
gaaugaccgaggaaauca

SEQ ID NO: 3705001 - RNA, 14 nt, Salmonella enterica enterica serovar Typhi Ty2
gaaugagcaucuac

SEQ ID NO: 3705002 - RNA, 15 nt, Salmonella enterica enterica serovar Typhi Ty2
gaaugaugugcuauu

SEQ ID NO: 3705003 - RNA, 23 nt, Salmonella enterica enterica serovar Typhi Ty2
gaaugauugccggauggcggcgu

SEQ ID NO: 3705004 - RNA, 13 nt, Salmonella enterica enterica serovar Typhi Ty2
gaaugcaagcagc

SEQ ID NO: 3705005 - RNA, 17 nt, Salmonella enterica enterica serovar Typhi Ty2
gaaugcagaccucugcu

SEQ ID NO: 3705006 - RNA, 23 nt, Salmonella enterica enterica serovar Typhi Ty2
gaaugccauauuuuuccagcgcc

SEQ ID NO: 3705007 - RNA, 18 nt, Salmonella enterica enterica serovar Typhi Ty2
gaaugcccacuccggcgu

SEQ ID NO: 3705008 - RNA, 22 nt, Salmonella enterica enterica serovar Typhi Ty2
gaaugccgcccauccagagcag

SEQ ID NO: 3705009 - RNA, 23 nt, Salmonella enterica enterica serovar Typhi Ty2
gaaugccgcccauccagagcagu

SEQ ID NO: 3705010 - RNA, 17 nt, Salmonella enterica enterica serovar Typhi Ty2
gaaugccuuuuacaaua

SEQ ID NO: 3705011 - RNA, 11 nt, Salmonella enterica enterica serovar Typhi Ty2
gaaugcgaaua

SEQ ID NO: 3705012 - RNA, 15 nt, Salmonella enterica enterica serovar Typhi Ty2
gaaugcgccgucagg

SEQ ID NO: 3705013 - RNA, 17 nt, Salmonella enterica enterica serovar Typhi Ty2
gaaugcguuuuuucacc

SEQ ID NO: 3705014 - RNA, 21 nt, Salmonella enterica enterica serovar Typhi Ty2
gaaugcuauaugcaggcauaa

SEQ ID NO: 3705015 - RNA, 20 nt, Salmonella enterica enterica serovar Typhi Ty2
gaaugcugacgcguuuuuuc

SEQ ID NO: 3705016 - RNA, 23 nt, Salmonella enterica enterica serovar Typhi Ty2
gaaugcugacggauucuuccucu

SEQ ID NO: 3705017 - RNA, 23 nt, Salmonella enterica enterica serovar Typhi Ty2
gaaugcuucgccacgaccuacac

SEQ ID NO: 3705018 - RNA, 21 nt, Salmonella enterica enterica serovar Typhi Ty2
gaaugcuucuucgccagcuuc

SEQ ID NO: 3705019 - RNA, 19 nt, Salmonella enterica enterica serovar Typhi Ty2
gaauggauaacgaaaaggg

SEQ ID NO: 3705020 - RNA, 18 nt, Salmonella enterica enterica serovar Typhi Ty2
gaauggcgauuaacgcau

SEQ ID NO: 3705021 - RNA, 18 nt, Salmonella enterica enterica serovar Typhi Ty2
gaaugguauuaccucgcg

SEQ ID NO: 3705022 - RNA, 14 nt, Salmonella enterica enterica serovar Typhi Ty2
gaaugguucccuga

SEQ ID NO: 3705023 - RNA, 15 nt, Salmonella enterica enterica serovar Typhi Ty2
gaauguagcgcccuu

SEQ ID NO: 3705024 - RNA, 20 nt, Salmonella enterica enterica serovar Typhi Ty2
gaauguaggccggguaagcg

SEQ ID NO: 3705025 - RNA, 13 nt, Salmonella enterica enterica serovar Typhi Ty2
gaauguguucuuu

SEQ ID NO: 3705026 - RNA, 20 nt, Salmonella enterica enterica serovar Typhi Ty2
gaauguuccccguugagaau

SEQ ID NO: 3705027 - RNA, 23 nt, Salmonella enterica enterica serovar Typhi Ty2
gaauuacgggcgauacaccuuca

SEQ ID NO: 3705028 - RNA, 18 nt, Salmonella enterica enterica serovar Typhi Ty2
gaauuaugcagacgcucg

SEQ ID NO: 3705029 - RNA, 13 nt, Salmonella enterica enterica serovar Typhi Ty2
gaauuauuaccaa

SEQ ID NO: 3705030 - RNA, 20 nt, Salmonella enterica enterica serovar Typhi Ty2
gaauuauuaccaaugagcug

SEQ ID NO: 3705031 - RNA, 14 nt, Salmonella enterica enterica serovar Typhi Ty2
gaauuauuucagga

SEQ ID NO: 3705032 - RNA, 22 nt, Salmonella enterica enterica serovar Typhi Ty2
gaauucaaagaacagggggcgc

SEQ ID NO: 3705033 - RNA, 18 nt, Salmonella enterica enterica serovar Typhi Ty2
gaauucaccgcaugacaa

SEQ ID NO: 3705034 - RNA, 15 nt, Salmonella enterica enterica serovar Typhi Ty2
gaauuccaguccuuu

SEQ ID NO: 3705035 - RNA, 12 nt, Salmonella enterica enterica serovar Typhi Ty2
gaauucuucugu

SEQ ID NO: 3705036 - RNA, 13 nt, Salmonella enterica enterica serovar Typhi Ty2
gaauugauaaaga

SEQ ID NO: 3705037 - RNA, 16 nt, Salmonella enterica enterica serovar Typhi Ty2
gaauugauaaagaucu

SEQ ID NO: 3705038 - RNA, 13 nt, Salmonella enterica enterica serovar Typhi Ty2
gaauugcaaggcg

SEQ ID NO: 3705039 - RNA, 13 nt, Salmonella enterica enterica serovar Typhi Ty2
gaauugguagacg

SEQ ID NO: 3705040 - RNA, 13 nt, Salmonella enterica enterica serovar Typhi Ty2
gaauuuacgggcg

SEQ ID NO: 3705041 - RNA, 22 nt, Salmonella enterica enterica serovar Typhi Ty2
gacagcgcgcaaaaaccggagc

SEQ ID NO: 3705042 - RNA, 22 nt, Salmonella enterica enterica serovar Typhi Ty2
gacagcggauuacgcgccugcc

SEQ ID NO: 3705043 - RNA, 16 nt, Salmonella enterica enterica serovar Typhi Ty2
gacagcguaaugcgcc

SEQ ID NO: 3705044 - RNA, 17 nt, Salmonella enterica enterica serovar Typhi Ty2
gacagcguaaugcgcca

SEQ ID NO: 3705045 - RNA, 14 nt, Salmonella enterica enterica serovar Typhi Ty2
gacaggaguauagc

SEQ ID NO: 3705046 - RNA, 20 nt, Salmonella enterica enterica serovar Typhi Ty2
gacagggcgugaaccagcau

SEQ ID NO: 3705047 - RNA, 22 nt, Salmonella enterica enterica serovar Typhi Ty2
gacagggcgugaaccagcaucc

SEQ ID NO: 3705048 - RNA, 14 nt, Salmonella enterica enterica serovar Typhi Ty2
gacaggugaccagg

SEQ ID NO: 3705049 - RNA, 20 nt, Salmonella enterica enterica serovar Typhi Ty2
gacaggugcgcuguggucgu

SEQ ID NO: 3705050 - RNA, 18 nt, Salmonella enterica enterica serovar Typhi Ty2
gacaguauagaaauagcc

SEQ ID NO: 3705051 - RNA, 22 nt, Salmonella enterica enterica serovar Typhi Ty2
gacagugacggcaauagaacgu

SEQ ID NO: 3705052 - RNA, 13 nt, Salmonella enterica enterica serovar Typhi Ty2
gacagugaugaau

SEQ ID NO: 3705053 - RNA, 11 nt, Salmonella enterica enterica serovar Typhi Ty2
gacagugcuau

SEQ ID NO: 3705054 - RNA, 18 nt, Salmonella enterica enterica serovar Typhi Ty2
gacaguguucccugcgcu

SEQ ID NO: 3705055 - RNA, 15 nt, Salmonella enterica enterica serovar Typhi Ty2
gacauaagaguccau

SEQ ID NO: 3705056 - RNA, 16 nt, Salmonella enterica enterica serovar Typhi Ty2
gacauaagugcaggcu

SEQ ID NO: 3705057 - RNA, 15 nt, Salmonella enterica enterica serovar Typhi Ty2
gacauaaucaugaac

SEQ ID NO: 3705058 - RNA, 17 nt, Salmonella enterica enterica serovar Typhi Ty2
gacauagcauaauaaug

SEQ ID NO: 3705059 - RNA, 21 nt, Salmonella enterica enterica serovar Typhi Ty2
gacauaguacccucugcacca

SEQ ID NO: 3705060 - RNA, 16 nt, Salmonella enterica enterica serovar Typhi Ty2
gacauauucaugguuc

SEQ ID NO: 3705061 - RNA, 17 nt, Salmonella enterica enterica serovar Typhi Ty2
gacaucacguucgcgca

SEQ ID NO: 3705062 - RNA, 17 nt, Salmonella enterica enterica serovar Typhi Ty2
gacaucagccagccgcc

SEQ ID NO: 3705063 - RNA, 18 nt, Salmonella enterica enterica serovar Typhi Ty2
gacauccagcauuucgac

SEQ ID NO: 3705064 - RNA, 16 nt, Salmonella enterica enterica serovar Typhi Ty2
gacaucccagacaaaa

SEQ ID NO: 3705065 - RNA, 13 nt, Salmonella enterica enterica serovar Typhi Ty2
gacauccccgccg

SEQ ID NO: 3705066 - RNA, 21 nt, Salmonella enterica enterica serovar Typhi Ty2
gacaucgccggagccgccugg

SEQ ID NO: 3705067 - RNA, 23 nt, Salmonella enterica enterica serovar Typhi Ty2
gacaucgccugguaaggcaaaua

SEQ ID NO: 3705068 - RNA, 21 nt, Salmonella enterica enterica serovar Typhi Ty2
gacaucgcucccggcaccagg

SEQ ID NO: 3705069 - RNA, 14 nt, Salmonella enterica enterica serovar Typhi Ty2
gacaucgcuuccgu

SEQ ID NO: 3705070 - RNA, 23 nt, Salmonella enterica enterica serovar Typhi Ty2
gacaucgucacaauaugguuauc

SEQ ID NO: 3705071 - RNA, 16 nt, Salmonella enterica enterica serovar Typhi Ty2
gacaucguguauacca

SEQ ID NO: 3705072 - RNA, 15 nt, Salmonella enterica enterica serovar Typhi Ty2
gacaucucaggcaag

SEQ ID NO: 3705073 - RNA, 12 nt, Salmonella enterica enterica serovar Typhi Ty2
gacaucuucauc

SEQ ID NO: 3705074 - RNA, 14 nt, Salmonella enterica enterica serovar Typhi Ty2
gacaugaccgcaca

SEQ ID NO: 3705075 - RNA, 12 nt, Salmonella enterica enterica serovar Typhi Ty2
gacaugcagauc

SEQ ID NO: 3705076 - RNA, 14 nt, Salmonella enterica enterica serovar Typhi Ty2
gacaugcucaugaa

SEQ ID NO: 3705077 - RNA, 15 nt, Salmonella enterica enterica serovar Typhi Ty2
gacauggcgaccggg

SEQ ID NO: 3705078 - RNA, 21 nt, Salmonella enterica enterica serovar Typhi Ty2
gacauguuccgccccgccuuc

SEQ ID NO: 3705079 - RNA, 23 nt, Salmonella enterica enterica serovar Typhi Ty2
gacauguuuauguagccagccau

SEQ ID NO: 3705080 - RNA, 15 nt, Salmonella enterica enterica serovar Typhi Ty2
gacauuaaagucgcg

SEQ ID NO: 3705081 - RNA, 17 nt, Salmonella enterica enterica serovar Typhi Ty2
gacauuauucaccugga

SEQ ID NO: 3705082 - RNA, 17 nt, Salmonella enterica enterica serovar Typhi Ty2
gacauugguuucaugca

SEQ ID NO: 3705083 - RNA, 18 nt, Salmonella enterica enterica serovar Typhi Ty2
gacauugucggcgcuauc

SEQ ID NO: 3705084 - RNA, 14 nt, Salmonella enterica enterica serovar Typhi Ty2
gacauuguucuaaa

SEQ ID NO: 3705085 - RNA, 17 nt, Salmonella enterica enterica serovar Typhi Ty2
gacauuugcaucaaacu

SEQ ID NO: 3705086 - RNA, 23 nt, Salmonella enterica enterica serovar Typhi Ty2
gaccaaaauggcaaguaaaauag

SEQ ID NO: 3705087 - RNA, 20 nt, Salmonella enterica enterica serovar Typhi Ty2
gaccaaaugguugguauugc

SEQ ID NO: 3705088 - RNA, 14 nt, Salmonella enterica enterica serovar Typhi Ty2
gaccaacgucagca

SEQ ID NO: 3705089 - RNA, 15 nt, Salmonella enterica enterica serovar Typhi Ty2
gaccaacguuuuucc

SEQ ID NO: 3705090 - RNA, 17 nt, Salmonella enterica enterica serovar Typhi Ty2
gaccaacguuuuuccuu

SEQ ID NO: 3705091 - RNA, 13 nt, Salmonella enterica enterica serovar Typhi Ty2
gaccaagcgucag

SEQ ID NO: 3705092 - RNA, 21 nt, Salmonella enterica enterica serovar Typhi Ty2
gaccaauaaaggucggcugcc

SEQ ID NO: 3705093 - RNA, 22 nt, Salmonella enterica enterica serovar Typhi Ty2
gaccaauaaaggucggcugccc

SEQ ID NO: 3705094 - RNA, 12 nt, Salmonella enterica enterica serovar Typhi Ty2
gaccaauauccg

SEQ ID NO: 3705095 - RNA, 20 nt, Salmonella enterica enterica serovar Typhi Ty2
gaccacaccgucaacaucau

SEQ ID NO: 3705096 - RNA, 16 nt, Salmonella enterica enterica serovar Typhi Ty2
gaccaccauccggcaa

SEQ ID NO: 3705097 - RNA, 14 nt, Salmonella enterica enterica serovar Typhi Ty2
gaccaccgccauau

SEQ ID NO: 3705098 - RNA, 13 nt, Salmonella enterica enterica serovar Typhi Ty2
gaccaccgcgcua

SEQ ID NO: 3705099 - RNA, 18 nt, Salmonella enterica enterica serovar Typhi Ty2
gaccacgacgccggagac

SEQ ID NO: 3705100 - RNA, 17 nt, Salmonella enterica enterica serovar Typhi Ty2
gaccacggccacagcca

SEQ ID NO: 3705101 - RNA, 22 nt, Salmonella enterica enterica serovar Typhi Ty2
gaccacggccacagccauccga

SEQ ID NO: 3705102 - RNA, 14 nt, Salmonella enterica enterica serovar Typhi Ty2
gaccagauacuuca

SEQ ID NO: 3705103 - RNA, 17 nt, Salmonella enterica enterica serovar Typhi Ty2
gaccagaugcagcaacg

SEQ ID NO: 3705104 - RNA, 23 nt, Salmonella enterica enterica serovar Typhi Ty2
gaccagcaccaucuuuuccggca

SEQ ID NO: 3705105 - RNA, 11 nt, Salmonella enterica enterica serovar Typhi Ty2
gaccagcaccu

SEQ ID NO: 3705106 - RNA, 13 nt, Salmonella enterica enterica serovar Typhi Ty2
gaccagcaccugc

SEQ ID NO: 3705107 - RNA, 15 nt, Salmonella enterica enterica serovar Typhi Ty2
gaccagcagcaucac

SEQ ID NO: 3705108 - RNA, 13 nt, Salmonella enterica enterica serovar Typhi Ty2
gaccagcaucagc

SEQ ID NO: 3705109 - RNA, 16 nt, Salmonella enterica enterica serovar Typhi Ty2
gaccagcaugugccgg

SEQ ID NO: 3705110 - RNA, 18 nt, Salmonella enterica enterica serovar Typhi Ty2
gaccagcgacgaugaaau

SEQ ID NO: 3705111 - RNA, 21 nt, Salmonella enterica enterica serovar Typhi Ty2
gaccagcgcaaacaacccggc

SEQ ID NO: 3705112 - RNA, 11 nt, Salmonella enterica enterica serovar Typhi Ty2
gaccagcgccc

SEQ ID NO: 3705113 - RNA, 20 nt, Salmonella enterica enterica serovar Typhi Ty2
gaccagcugacgacgccagc

SEQ ID NO: 3705114 - RNA, 13 nt, Salmonella enterica enterica serovar Typhi Ty2
gaccaggaucaga

SEQ ID NO: 3705115 - RNA, 15 nt, Salmonella enterica enterica serovar Typhi Ty2
gaccaggaucagacc

SEQ ID NO: 3705116 - RNA, 14 nt, Salmonella enterica enterica serovar Typhi Ty2
gaccaggauggcca

SEQ ID NO: 3705117 - RNA, 15 nt, Salmonella enterica enterica serovar Typhi Ty2
gaccaggauggccag

SEQ ID NO: 3705118 - RNA, 21 nt, Salmonella enterica enterica serovar Typhi Ty2
gaccaggauggccagcaccag

SEQ ID NO: 3705119 - RNA, 20 nt, Salmonella enterica enterica serovar Typhi Ty2
gaccaggauuuaauggucuc

SEQ ID NO: 3705120 - RNA, 18 nt, Salmonella enterica enterica serovar Typhi Ty2
gaccaggcgacuauccac

SEQ ID NO: 3705121 - RNA, 15 nt, Salmonella enterica enterica serovar Typhi Ty2
gaccagguacagcuu

SEQ ID NO: 3705122 - RNA, 16 nt, Salmonella enterica enterica serovar Typhi Ty2
gaccaguuauucggca

SEQ ID NO: 3705123 - RNA, 16 nt, Salmonella enterica enterica serovar Typhi Ty2
gaccugaaaucagccu

SEQ ID NO: 3705124 - RNA, 13 nt, Salmonella enterica enterica serovar Typhi Ty2
gaccugaucggcc

SEQ ID NO: 3705125 - RNA, 16 nt, Salmonella enterica enterica serovar Typhi Ty2
gaccugcaacuccaca

SEQ ID NO: 3705126 - RNA, 23 nt, Salmonella enterica enterica serovar Typhi Ty2
gaccugcaacuccacaaauagca

SEQ ID NO: 3705127 - RNA, 22 nt, Salmonella enterica enterica serovar Typhi Ty2
gaccugccuuucccauccgccg

SEQ ID NO: 3705128 - RNA, 17 nt, Salmonella enterica enterica serovar Typhi Ty2
gaccugcuccaugacgu

SEQ ID NO: 3705129 - RNA, 11 nt, Salmonella enterica enterica serovar Typhi Ty2
gaccuggcgcu

SEQ ID NO: 3705130 - RNA, 17 nt, Salmonella enterica enterica serovar Typhi Ty2
gaccuuaucccgcugac

SEQ ID NO: 3705131 - RNA, 18 nt, Salmonella enterica enterica serovar Typhi Ty2
gaccuucaacccagcagc

SEQ ID NO: 3705132 - RNA, 22 nt, Salmonella enterica enterica serovar Typhi Ty2
gaccuucaacccagcagcagau

SEQ ID NO: 3705133 - RNA, 15 nt, Salmonella enterica enterica serovar Typhi Ty2
gacgaacggccugau

SEQ ID NO: 3705134 - RNA, 19 nt, Salmonella enterica enterica serovar Typhi Ty2
gacgaaucagcgauugcgc

SEQ ID NO: 3705135 - RNA, 18 nt, Salmonella enterica enterica serovar Typhi Ty2
gacgaauccuauacccaa

SEQ ID NO: 3705136 - RNA, 16 nt, Salmonella enterica enterica serovar Typhi Ty2
gacgaaucuggauagu

SEQ ID NO: 3705137 - RNA, 19 nt, Salmonella enterica enterica serovar Typhi Ty2
gacgacaacgcccacauca

SEQ ID NO: 3705138 - RNA, 17 nt, Salmonella enterica enterica serovar Typhi Ty2
gacgacaucuuuuccug

SEQ ID NO: 3705139 - RNA, 17 nt, Salmonella enterica enterica serovar Typhi Ty2
gacgacgccagccagcc

SEQ ID NO: 3705140 - RNA, 17 nt, Salmonella enterica enterica serovar Typhi Ty2
gacgacgccaggcgguc

SEQ ID NO: 3705141 - RNA, 23 nt, Salmonella enterica enterica serovar Typhi Ty2
gacgacuucacccgcgggcggcg

SEQ ID NO: 3705142 - RNA, 19 nt, Salmonella enterica enterica serovar Typhi Ty2
gacgagcagguuacucuuc

SEQ ID NO: 3705143 - RNA, 21 nt, Salmonella enterica enterica serovar Typhi Ty2
gacgagcgcgucagcgccucc

SEQ ID NO: 3705144 - RNA, 22 nt, Salmonella enterica enterica serovar Typhi Ty2
gacgaggauuagacuucuucca

SEQ ID NO: 3705145 - RNA, 13 nt, Salmonella enterica enterica serovar Typhi Ty2
gacgauaaaaaaa

SEQ ID NO: 3705146 - RNA, 16 nt, Salmonella enterica enterica serovar Typhi Ty2
gacgauaaccaugcuc

SEQ ID NO: 3705147 - RNA, 15 nt, Salmonella enterica enterica serovar Typhi Ty2
gacgauaaccggacg

SEQ ID NO: 3705148 - RNA, 18 nt, Salmonella enterica enterica serovar Typhi Ty2
gacgauacgucauaucau

SEQ ID NO: 3705149 - RNA, 15 nt, Salmonella enterica enterica serovar Typhi Ty2
gacgaucagcgccac

SEQ ID NO: 3705150 - RNA, 16 nt, Salmonella enterica enterica serovar Typhi Ty2
gacgaugauaauacau

SEQ ID NO: 3705151 - RNA, 20 nt, Salmonella enterica enterica serovar Typhi Ty2
gacgcaauagaguaaugaca

SEQ ID NO: 3705152 - RNA, 14 nt, Salmonella enterica enterica serovar Typhi Ty2
gacgcacaggcgcg

SEQ ID NO: 3705153 - RNA, 13 nt, Salmonella enterica enterica serovar Typhi Ty2
gacgcaccagcca

SEQ ID NO: 3705154 - RNA, 19 nt, Salmonella enterica enterica serovar Typhi Ty2
gacgcaccagccaggcgau

SEQ ID NO: 3705155 - RNA, 15 nt, Salmonella enterica enterica serovar Typhi Ty2
gacgcagacaauaaa

SEQ ID NO: 3705156 - RNA, 21 nt, Salmonella enterica enterica serovar Typhi Ty2
gacgcagcaguuccccgccgc

SEQ ID NO: 3705157 - RNA, 16 nt, Salmonella enterica enterica serovar Typhi Ty2
gacgcagcuucgccgc

SEQ ID NO: 3705158 - RNA, 17 nt, Salmonella enterica enterica serovar Typhi Ty2
gacgcaucuuuuucccg

SEQ ID NO: 3705159 - RNA, 21 nt, Salmonella enterica enterica serovar Typhi Ty2
gacgccaauuccuaucaguac

SEQ ID NO: 3705160 - RNA, 13 nt, Salmonella enterica enterica serovar Typhi Ty2
gacgccagccgga

SEQ ID NO: 3705161 - RNA, 12 nt, Salmonella enterica enterica serovar Typhi Ty2
gacgccaggcag

SEQ ID NO: 3705162 - RNA, 12 nt, Salmonella enterica enterica serovar Typhi Ty2
gacgccaggcgc

SEQ ID NO: 3705163 - RNA, 22 nt, Salmonella enterica enterica serovar Typhi Ty2
gacgccgaaccuggcgggcagc

SEQ ID NO: 3705164 - RNA, 17 nt, Salmonella enterica enterica serovar Typhi Ty2
gacgccgacauaagcug

SEQ ID NO: 3705165 - RNA, 17 nt, Salmonella enterica enterica serovar Typhi Ty2
gacgccggucaugccau

SEQ ID NO: 3705166 - RNA, 17 nt, Salmonella enterica enterica serovar Typhi Ty2
gacgccguccaggcucg

SEQ ID NO: 3705167 - RNA, 23 nt, Salmonella enterica enterica serovar Typhi Ty2
gacgccgucugguacggccacca

SEQ ID NO: 3705168 - RNA, 12 nt, Salmonella enterica enterica serovar Typhi Ty2
gacgccugcaua

SEQ ID NO: 3705169 - RNA, 14 nt, Salmonella enterica enterica serovar Typhi Ty2
gacgcgaagcggcg

SEQ ID NO: 3705170 - RNA, 19 nt, Salmonella enterica enterica serovar Typhi Ty2
gacgcgaaugucauccgga

SEQ ID NO: 3705171 - RNA, 21 nt, Salmonella enterica enterica serovar Typhi Ty2
gacgcgacuuuuuucacccag

SEQ ID NO: 3705172 - RNA, 13 nt, Salmonella enterica enterica serovar Typhi Ty2
gacgcgcagcacc

SEQ ID NO: 3705173 - RNA, 18 nt, Salmonella enterica enterica serovar Typhi Ty2
gacgcgccaccaucgucg

SEQ ID NO: 3705174 - RNA, 15 nt, Salmonella enterica enterica serovar Typhi Ty2
gacgcgccagcggau

SEQ ID NO: 3705175 - RNA, 21 nt, Salmonella enterica enterica serovar Typhi Ty2
gacgcgcgagaacugcugcau

SEQ ID NO: 3705176 - RNA, 21 nt, Salmonella enterica enterica serovar Typhi Ty2
gacgcgcgcgaaaagaaacug

SEQ ID NO: 3705177 - RNA, 19 nt, Salmonella enterica enterica serovar Typhi Ty2
gacgcgcucaccuccgcca

SEQ ID NO: 3705178 - RNA, 22 nt, Salmonella enterica enterica serovar Typhi Ty2
gacgcggaacuggugaaacagg

SEQ ID NO: 3705179 - RNA, 15 nt, Salmonella enterica enterica serovar Typhi Ty2
gacgcggcuuauccg

SEQ ID NO: 3705180 - RNA, 17 nt, Salmonella enterica enterica serovar Typhi Ty2
gacgcgggccgcauugc

SEQ ID NO: 3705181 - RNA, 22 nt, Salmonella enterica enterica serovar Typhi Ty2
gacgcggugaaaggcuugcagg

SEQ ID NO: 3705182 - RNA, 16 nt, Salmonella enterica enterica serovar Typhi Ty2
gacgcgucagcugaga

SEQ ID NO: 3705183 - RNA, 23 nt, Salmonella enterica enterica serovar Typhi Ty2
gacgcgucauaaugcccagcgcc

SEQ ID NO: 3705184 - RNA, 17 nt, Salmonella enterica enterica serovar Typhi Ty2
gacgcguuuuccagcac

SEQ ID NO: 3705185 - RNA, 18 nt, Salmonella enterica enterica serovar Typhi Ty2
gacgcuaacgcuuauccg

SEQ ID NO: 3705186 - RNA, 15 nt, Salmonella enterica enterica serovar Typhi Ty2
gacgcuacgcgucgc

SEQ ID NO: 3705187 - RNA, 24 nt, Salmonella enterica enterica serovar Typhi Ty2
gacgcuacgcgucgccauccggcg

SEQ ID NO: 3705188 - RNA, 14 nt, Salmonella enterica enterica serovar Typhi Ty2
gacgcuauuuuuca

SEQ ID NO: 3705189 - RNA, 15 nt, Salmonella enterica enterica serovar Typhi Ty2
gacgcuccaucacgg

SEQ ID NO: 3705190 - RNA, 20 nt, Salmonella enterica enterica serovar Typhi Ty2
gacgcucgacguccagcgcg

SEQ ID NO: 3705191 - RNA, 18 nt, Salmonella enterica enterica serovar Typhi Ty2
gacgcugaaccuuccauu

SEQ ID NO: 3705192 - RNA, 15 nt, Salmonella enterica enterica serovar Typhi Ty2
gacgcugagagaacu

SEQ ID NO: 3705193 - RNA, 16 nt, Salmonella enterica enterica serovar Typhi Ty2
gacgcugcgccuggau

SEQ ID NO: 3705194 - RNA, 15 nt, Salmonella enterica enterica serovar Typhi Ty2
gacgcugcgcggcga

SEQ ID NO: 3705195 - RNA, 19 nt, Salmonella enterica enterica serovar Typhi Ty2
gacgcugcgcuuauccggc

SEQ ID NO: 3705196 - RNA, 20 nt, Salmonella enterica enterica serovar Typhi Ty2
gacgcugcgcuuauccggcc

SEQ ID NO: 3705197 - RNA, 16 nt, Salmonella enterica enterica serovar Typhi Ty2
gacgcuggcacuggca

SEQ ID NO: 3705198 - RNA, 12 nt, Salmonella enterica enterica serovar Typhi Ty2
gacgcugguugu

SEQ ID NO: 3705199 - RNA, 17 nt, Salmonella enterica enterica serovar Typhi Ty2
gacgcuuacaucgccau

SEQ ID NO: 3705200 - RNA, 15 nt, Salmonella enterica enterica serovar Typhi Ty2
gacgcuuacgaagau

SEQ ID NO: 3705201 - RNA, 20 nt, Salmonella enterica enterica serovar Typhi Ty2
gacgcuucaaagccgguacg

SEQ ID NO: 3705202 - RNA, 21 nt, Salmonella enterica enterica serovar Typhi Ty2
gacgcuuugcauuaucgaugc

SEQ ID NO: 3705203 - RNA, 14 nt, Salmonella enterica enterica serovar Typhi Ty2
gacggaaaccagau

SEQ ID NO: 3705204 - RNA, 22 nt, Salmonella enterica enterica serovar Typhi Ty2
gacggacucgcgcagaaucagc

SEQ ID NO: 3705205 - RNA, 17 nt, Salmonella enterica enterica serovar Typhi Ty2
gacugaccagacagauu

SEQ ID NO: 3705206 - RNA, 20 nt, Salmonella enterica enterica serovar Typhi Ty2
gacugaguauuggcaagaau

SEQ ID NO: 3705207 - RNA, 20 nt, Salmonella enterica enterica serovar Typhi Ty2
gacugauaaaagcccuuauc

SEQ ID NO: 3705208 - RNA, 14 nt, Salmonella enterica enterica serovar Typhi Ty2
gacugauacccagc

SEQ ID NO: 3705209 - RNA, 14 nt, Salmonella enterica enterica serovar Typhi Ty2
gacugauaccgcgu

SEQ ID NO: 3705210 - RNA, 13 nt, Salmonella enterica enterica serovar Typhi Ty2
gacugaucccacu

SEQ ID NO: 3705211 - RNA, 16 nt, Salmonella enterica enterica serovar Typhi Ty2
gacugcaaaucugccg

SEQ ID NO: 3705212 - RNA, 14 nt, Salmonella enterica enterica serovar Typhi Ty2
gacugcacuuccug

SEQ ID NO: 3705213 - RNA, 15 nt, Salmonella enterica enterica serovar Typhi Ty2
gacugcacuuccugc

SEQ ID NO: 3705214 - RNA, 16 nt, Salmonella enterica enterica serovar Typhi Ty2
gacugcacuuccugcg

SEQ ID NO: 3705215 - RNA, 12 nt, Salmonella enterica enterica serovar Typhi Ty2
gacugccgcaga

SEQ ID NO: 3705216 - RNA, 19 nt, Salmonella enterica enterica serovar Typhi Ty2
gacugccguauaauccagc

SEQ ID NO: 3705217 - RNA, 20 nt, Salmonella enterica enterica serovar Typhi Ty2
gacugccguauaauccagcu

SEQ ID NO: 3705218 - RNA, 16 nt, Salmonella enterica enterica serovar Typhi Ty2
gacugcggggagcgaa

SEQ ID NO: 3705219 - RNA, 23 nt, Salmonella enterica enterica serovar Typhi Ty2
gacuggcaccacgaccagacugg

SEQ ID NO: 3705220 - RNA, 18 nt, Salmonella enterica enterica serovar Typhi Ty2
gacuggcgaccgccacca

SEQ ID NO: 3705221 - RNA, 21 nt, Salmonella enterica enterica serovar Typhi Ty2
gacuggcgccgucacguucgg

SEQ ID NO: 3705222 - RNA, 22 nt, Salmonella enterica enterica serovar Typhi Ty2
gacugguuuuucgccgaccauc

SEQ ID NO: 3705223 - RNA, 21 nt, Salmonella enterica enterica serovar Typhi Ty2
gacuguaaaucugccgucauc

SEQ ID NO: 3705224 - RNA, 19 nt, Salmonella enterica enterica serovar Typhi Ty2
gacugucgaaaccagcaua

SEQ ID NO: 3705225 - RNA, 18 nt, Salmonella enterica enterica serovar Typhi Ty2
gacugucuuaucaggccu

SEQ ID NO: 3705226 - RNA, 18 nt, Salmonella enterica enterica serovar Typhi Ty2
gacugucuuguuuuucug

SEQ ID NO: 3705227 - RNA, 13 nt, Salmonella enterica enterica serovar Typhi Ty2
gacugugauggcg

SEQ ID NO: 3705228 - RNA, 15 nt, Salmonella enterica enterica serovar Typhi Ty2
gacuguucacaucca

SEQ ID NO: 3705229 - RNA, 16 nt, Salmonella enterica enterica serovar Typhi Ty2
gacuguucagcugaca

SEQ ID NO: 3705230 - RNA, 12 nt, Salmonella enterica enterica serovar Typhi Ty2
gacuguugaaag

SEQ ID NO: 3705231 - RNA, 23 nt, Salmonella enterica enterica serovar Typhi Ty2
gacuguuucauuacucguccuuc

SEQ ID NO: 3705232 - RNA, 19 nt, Salmonella enterica enterica serovar Typhi Ty2
gacuuacggaaaaaugucg

SEQ ID NO: 3705233 - RNA, 18 nt, Salmonella enterica enterica serovar Typhi Ty2
gacuuaucgaccuuuucc

SEQ ID NO: 3705234 - RNA, 13 nt, Salmonella enterica enterica serovar Typhi Ty2
gacuuauuaaaaa

SEQ ID NO: 3705235 - RNA, 15 nt, Salmonella enterica enterica serovar Typhi Ty2
gacuuauuaaaaaua

SEQ ID NO: 3705236 - RNA, 19 nt, Salmonella enterica enterica serovar Typhi Ty2
gacuuauuugcucaguuca

SEQ ID NO: 3705237 - RNA, 18 nt, Salmonella enterica enterica serovar Typhi Ty2
gacuucaacgcaggcgaa

SEQ ID NO: 3705238 - RNA, 12 nt, Salmonella enterica enterica serovar Typhi Ty2
gacuucaacgcc

SEQ ID NO: 3705239 - RNA, 20 nt, Salmonella enterica enterica serovar Typhi Ty2
gacuucacacugugguuucu

SEQ ID NO: 3705240 - RNA, 11 nt, Salmonella enterica enterica serovar Typhi Ty2
gacuucaccuc

SEQ ID NO: 3705241 - RNA, 14 nt, Salmonella enterica enterica serovar Typhi Ty2
gacuucaccucagc

SEQ ID NO: 3705242 - RNA, 14 nt, Salmonella enterica enterica serovar Typhi Ty2
gacuucacuuuccc

SEQ ID NO: 3705243 - RNA, 14 nt, Salmonella enterica enterica serovar Typhi Ty2
gacuucauuuucca

SEQ ID NO: 3705244 - RNA, 17 nt, Salmonella enterica enterica serovar Typhi Ty2
gacuucgcuuccugcau

SEQ ID NO: 3705245 - RNA, 12 nt, Salmonella enterica enterica serovar Typhi Ty2
gacuucucccuc

SEQ ID NO: 3705246 - RNA, 21 nt, Salmonella enterica enterica serovar Typhi Ty2
gacuucugcucgguaaaaagu

SEQ ID NO: 3705247 - RNA, 22 nt, Salmonella enterica enterica serovar Typhi Ty2
gacuuuaaacuuauccgccauc

SEQ ID NO: 3705248 - RNA, 22 nt, Salmonella enterica enterica serovar Typhi Ty2
gacuuuaucuuuaccagggaau

SEQ ID NO: 3705249 - RNA, 19 nt, Salmonella enterica enterica serovar Typhi Ty2
gacuuuuagucgucaugau

SEQ ID NO: 3705250 - RNA, 17 nt, Salmonella enterica enterica serovar Typhi Ty2
gacuuuuugaaaucacg

SEQ ID NO: 3705251 - RNA, 18 nt, Salmonella enterica enterica serovar Typhi Ty2
gagaaaacgcggccugga

SEQ ID NO: 3705252 - RNA, 12 nt, Salmonella enterica enterica serovar Typhi Ty2
gagaaaauaccg

SEQ ID NO: 3705253 - RNA, 19 nt, Salmonella enterica enterica serovar Typhi Ty2
gagaaaauaccgcacauca

SEQ ID NO: 3705254 - RNA, 15 nt, Salmonella enterica enterica serovar Typhi Ty2
gagaaaauagaggaa

SEQ ID NO: 3705255 - RNA, 22 nt, Salmonella enterica enterica serovar Typhi Ty2
gagaaaauuacgcccaucagcc

SEQ ID NO: 3705256 - RNA, 13 nt, Salmonella enterica enterica serovar Typhi Ty2
gagaaacauacug

SEQ ID NO: 3705257 - RNA, 23 nt, Salmonella enterica enterica serovar Typhi Ty2
gagaaagcguugccguaggcaac

SEQ ID NO: 3705258 - RNA, 12 nt, Salmonella enterica enterica serovar Typhi Ty2
gagaaaguggug

SEQ ID NO: 3705259 - RNA, 11 nt, Salmonella enterica enterica serovar Typhi Ty2
gagaaaucaac

SEQ ID NO: 3705260 - RNA, 20 nt, Salmonella enterica enterica serovar Typhi Ty2
gagaaaucaacgaaaucaga

SEQ ID NO: 3705261 - RNA, 23 nt, Salmonella enterica enterica serovar Typhi Ty2
gagaaaucaacgaaaucagagac

SEQ ID NO: 3705262 - RNA, 16 nt, Salmonella enterica enterica serovar Typhi Ty2
gagaacagguaguuac

SEQ ID NO: 3705263 - RNA, 14 nt, Salmonella enterica enterica serovar Typhi Ty2
gagaaccugaacaa

SEQ ID NO: 3705264 - RNA, 20 nt, Salmonella enterica enterica serovar Typhi Ty2
gagaacgccgggccugccag

SEQ ID NO: 3705265 - RNA, 22 nt, Salmonella enterica enterica serovar Typhi Ty2
gagaacggaccggcaaucgccu

SEQ ID NO: 3705266 - RNA, 22 nt, Salmonella enterica enterica serovar Typhi Ty2
gagaacgguucauccagcagca

SEQ ID NO: 3705267 - RNA, 21 nt, Salmonella enterica enterica serovar Typhi Ty2
gagaacguugccgcaggcaac

SEQ ID NO: 3705268 - RNA, 14 nt, Salmonella enterica enterica serovar Typhi Ty2
gagaagaagaauua

SEQ ID NO: 3705269 - RNA, 17 nt, Salmonella enterica enterica serovar Typhi Ty2
gagaagaagaauuauua

SEQ ID NO: 3705270 - RNA, 21 nt, Salmonella enterica enterica serovar Typhi Ty2
gagaagccgauggaaguacug

SEQ ID NO: 3705271 - RNA, 15 nt, Salmonella enterica enterica serovar Typhi Ty2
gagaaggucagucca

SEQ ID NO: 3705272 - RNA, 18 nt, Salmonella enterica enterica serovar Typhi Ty2
gagaauaacgaugaugaa

SEQ ID NO: 3705273 - RNA, 18 nt, Salmonella enterica enterica serovar Typhi Ty2
gagaaucaccuggcagcc

SEQ ID NO: 3705274 - RNA, 17 nt, Salmonella enterica enterica serovar Typhi Ty2
gagaaugcgagcaaaac

SEQ ID NO: 3705275 - RNA, 16 nt, Salmonella enterica enterica serovar Typhi Ty2
gagaauuauucguguu

SEQ ID NO: 3705276 - RNA, 22 nt, Salmonella enterica enterica serovar Typhi Ty2
gagacaaauaacuuuccugccu

SEQ ID NO: 3705277 - RNA, 16 nt, Salmonella enterica enterica serovar Typhi Ty2
gagacagagaaccuga

SEQ ID NO: 3705278 - RNA, 21 nt, Salmonella enterica enterica serovar Typhi Ty2
gagacagagaaccugaacaau

SEQ ID NO: 3705279 - RNA, 18 nt, Salmonella enterica enterica serovar Typhi Ty2
gagacagcgggcaauggc

SEQ ID NO: 3705280 - RNA, 16 nt, Salmonella enterica enterica serovar Typhi Ty2
gagacaugccgccaga

SEQ ID NO: 3705281 - RNA, 17 nt, Salmonella enterica enterica serovar Typhi Ty2
gagacaugccgccagac

SEQ ID NO: 3705282 - RNA, 18 nt, Salmonella enterica enterica serovar Typhi Ty2
gagacauugccuuccagg

SEQ ID NO: 3705283 - RNA, 21 nt, Salmonella enterica enterica serovar Typhi Ty2
gagacauugguuucaugcauc

SEQ ID NO: 3705284 - RNA, 15 nt, Salmonella enterica enterica serovar Typhi Ty2
gagaccaucaacagc

SEQ ID NO: 3705285 - RNA, 16 nt, Salmonella enterica enterica serovar Typhi Ty2
gagacuaucgauagcg

SEQ ID NO: 3705286 - RNA, 15 nt, Salmonella enterica enterica serovar Typhi Ty2
gagacuaucuugccg

SEQ ID NO: 3705287 - RNA, 19 nt, Salmonella enterica enterica serovar Typhi Ty2
gagcgaauccccgggaaca

SEQ ID NO: 3705288 - RNA, 16 nt, Salmonella enterica enterica serovar Typhi Ty2
gagcgaauguauaauc

SEQ ID NO: 3705289 - RNA, 21 nt, Salmonella enterica enterica serovar Typhi Ty2
gagcgacgguuuuauccccuu

SEQ ID NO: 3705290 - RNA, 17 nt, Salmonella enterica enterica serovar Typhi Ty2
gagcgacgucccgucag

SEQ ID NO: 3705291 - RNA, 16 nt, Salmonella enterica enterica serovar Typhi Ty2
gagcgaucauaaggga

SEQ ID NO: 3705292 - RNA, 21 nt, Salmonella enterica enterica serovar Typhi Ty2
gagcgaucauaagggagcuga

SEQ ID NO: 3705293 - RNA, 13 nt, Salmonella enterica enterica serovar Typhi Ty2
gagcgcaggcgag

SEQ ID NO: 3705294 - RNA, 16 nt, Salmonella enterica enterica serovar Typhi Ty2
gagcgccaaaaagaaa

SEQ ID NO: 3705295 - RNA, 22 nt, Salmonella enterica enterica serovar Typhi Ty2
gagcgccgcgccuaccagcgcu

SEQ ID NO: 3705296 - RNA, 15 nt, Salmonella enterica enterica serovar Typhi Ty2
gagcgccggcaaagc

SEQ ID NO: 3705297 - RNA, 16 nt, Salmonella enterica enterica serovar Typhi Ty2
gagcgccguaccgcgu

SEQ ID NO: 3705298 - RNA, 16 nt, Salmonella enterica enterica serovar Typhi Ty2
gagcgccucugauuuu

SEQ ID NO: 3705299 - RNA, 14 nt, Salmonella enterica enterica serovar Typhi Ty2
gagcgcgccgcaca

SEQ ID NO: 3705300 - RNA, 14 nt, Salmonella enterica enterica serovar Typhi Ty2
gagcgcgcgcgccu

SEQ ID NO: 3705301 - RNA, 17 nt, Salmonella enterica enterica serovar Typhi Ty2
gagcgcgcucugccuuu

SEQ ID NO: 3705302 - RNA, 17 nt, Salmonella enterica enterica serovar Typhi Ty2
gagcgcguccagacguu

SEQ ID NO: 3705303 - RNA, 19 nt, Salmonella enterica enterica serovar Typhi Ty2
gagcggagagagcgcuucc

SEQ ID NO: 3705304 - RNA, 19 nt, Salmonella enterica enterica serovar Typhi Ty2
gagcggauaauccgccacu

SEQ ID NO: 3705305 - RNA, 15 nt, Salmonella enterica enterica serovar Typhi Ty2
gagcggccaaaggga

SEQ ID NO: 3705306 - RNA, 23 nt, Salmonella enterica enterica serovar Typhi Ty2
gagcgggucaacgccaagcgcgg

SEQ ID NO: 3705307 - RNA, 16 nt, Salmonella enterica enterica serovar Typhi Ty2
gagcgguaagagccag

SEQ ID NO: 3705308 - RNA, 21 nt, Salmonella enterica enterica serovar Typhi Ty2
gagcgguuuuuuuguggccug

SEQ ID NO: 3705309 - RNA, 13 nt, Salmonella enterica enterica serovar Typhi Ty2
gagcguauccagc

SEQ ID NO: 3705310 - RNA, 17 nt, Salmonella enterica enterica serovar Typhi Ty2
gagcguccagucgggcg

SEQ ID NO: 3705311 - RNA, 17 nt, Salmonella enterica enterica serovar Typhi Ty2
gagcgucucauccggca

SEQ ID NO: 3705312 - RNA, 18 nt, Salmonella enterica enterica serovar Typhi Ty2
gagcgucuuuuaucccca

SEQ ID NO: 3705313 - RNA, 17 nt, Salmonella enterica enterica serovar Typhi Ty2
gagcgugaucucauugg

SEQ ID NO: 3705314 - RNA, 18 nt, Salmonella enterica enterica serovar Typhi Ty2
gagcgugaucucauugga

SEQ ID NO: 3705315 - RNA, 21 nt, Salmonella enterica enterica serovar Typhi Ty2
gagcguuacccagacagcaaa

SEQ ID NO: 3705316 - RNA, 22 nt, Salmonella enterica enterica serovar Typhi Ty2
gagcuaaucaauaaguuuuuuc

SEQ ID NO: 3705317 - RNA, 17 nt, Salmonella enterica enterica serovar Typhi Ty2
gagcugcgauaauccgg

SEQ ID NO: 3705318 - RNA, 14 nt, Salmonella enterica enterica serovar Typhi Ty2
gagcugcgcuucga

SEQ ID NO: 3705319 - RNA, 13 nt, Salmonella enterica enterica serovar Typhi Ty2
gagcugcgguggu

SEQ ID NO: 3705320 - RNA, 18 nt, Salmonella enterica enterica serovar Typhi Ty2
gagcuguagcgaagggua

SEQ ID NO: 3705321 - RNA, 14 nt, Salmonella enterica enterica serovar Typhi Ty2
gagcuuuuuuuugc

SEQ ID NO: 3705322 - RNA, 18 nt, Salmonella enterica enterica serovar Typhi Ty2
gaggaaaaagccgccgug

SEQ ID NO: 3705323 - RNA, 18 nt, Salmonella enterica enterica serovar Typhi Ty2
gaggaaaccuuucuucuc

SEQ ID NO: 3705324 - RNA, 14 nt, Salmonella enterica enterica serovar Typhi Ty2
gaggaacaucagcc

SEQ ID NO: 3705325 - RNA, 15 nt, Salmonella enterica enterica serovar Typhi Ty2
gaggaacaucagcca

SEQ ID NO: 3705326 - RNA, 17 nt, Salmonella enterica enterica serovar Typhi Ty2
gaggaacuguucagcca

SEQ ID NO: 3705327 - RNA, 20 nt, Salmonella enterica enterica serovar Typhi Ty2
gaggaagcugcgcagcacuu

SEQ ID NO: 3705328 - RNA, 13 nt, Salmonella enterica enterica serovar Typhi Ty2
gaggacagugaaa

SEQ ID NO: 3705329 - RNA, 15 nt, Salmonella enterica enterica serovar Typhi Ty2
gaggacauuaaaguc

SEQ ID NO: 3705330 - RNA, 20 nt, Salmonella enterica enterica serovar Typhi Ty2
gaggaguaguuaaaaaaggu

SEQ ID NO: 3705331 - RNA, 22 nt, Salmonella enterica enterica serovar Typhi Ty2
gaggauauuuauuugcauugua

SEQ ID NO: 3705332 - RNA, 21 nt, Salmonella enterica enterica serovar Typhi Ty2
gaggaugaaaaguauggcggu

SEQ ID NO: 3705333 - RNA, 15 nt, Salmonella enterica enterica serovar Typhi Ty2
gaggaugccugcgca

SEQ ID NO: 3705334 - RNA, 12 nt, Salmonella enterica enterica serovar Typhi Ty2
gaggcagcagga

SEQ ID NO: 3705335 - RNA, 21 nt, Salmonella enterica enterica serovar Typhi Ty2
gaggcaggggcucuaaaaagg

SEQ ID NO: 3705336 - RNA, 12 nt, Salmonella enterica enterica serovar Typhi Ty2
gaggcagugaaa

SEQ ID NO: 3705337 - RNA, 23 nt, Salmonella enterica enterica serovar Typhi Ty2
gaggcagugaaauccucuaucca

SEQ ID NO: 3705338 - RNA, 23 nt, Salmonella enterica enterica serovar Typhi Ty2
gaggcaucgcccuguaagaggca

SEQ ID NO: 3705339 - RNA, 15 nt, Salmonella enterica enterica serovar Typhi Ty2
gaggccaccagcgcc

SEQ ID NO: 3705340 - RNA, 23 nt, Salmonella enterica enterica serovar Typhi Ty2
gaggccguuauugucaugcuaaa

SEQ ID NO: 3705341 - RNA, 14 nt, Salmonella enterica enterica serovar Typhi Ty2
gaggccuuuugcag

SEQ ID NO: 3705342 - RNA, 16 nt, Salmonella enterica enterica serovar Typhi Ty2
gaggcgcagccgccau

SEQ ID NO: 3705343 - RNA, 22 nt, Salmonella enterica enterica serovar Typhi Ty2
gaggcggaguuauacagugcca

SEQ ID NO: 3705344 - RNA, 20 nt, Salmonella enterica enterica serovar Typhi Ty2
gaggcguucccgaaaugggc

SEQ ID NO: 3705345 - RNA, 22 nt, Salmonella enterica enterica serovar Typhi Ty2
gaggcguugcuccagcagcgcc

SEQ ID NO: 3705346 - RNA, 15 nt, Salmonella enterica enterica serovar Typhi Ty2
gagggaaauagccua

SEQ ID NO: 3705347 - RNA, 23 nt, Salmonella enterica enterica serovar Typhi Ty2
gaggggcacgcccgcauucauaa

SEQ ID NO: 3705348 - RNA, 17 nt, Salmonella enterica enterica serovar Typhi Ty2
gagggucaacaggcuga

SEQ ID NO: 3705349 - RNA, 13 nt, Salmonella enterica enterica serovar Typhi Ty2
gaggguguucacg

SEQ ID NO: 3705350 - RNA, 22 nt, Salmonella enterica enterica serovar Typhi Ty2
gaggguuuucaauuccacaggc

SEQ ID NO: 3705351 - RNA, 17 nt, Salmonella enterica enterica serovar Typhi Ty2
gagguauaggaaaauga

SEQ ID NO: 3705352 - RNA, 16 nt, Salmonella enterica enterica serovar Typhi Ty2
gaggucauuauucagg

SEQ ID NO: 3705353 - RNA, 16 nt, Salmonella enterica enterica serovar Typhi Ty2
gaggugaauaaauccu

SEQ ID NO: 3705354 - RNA, 19 nt, Salmonella enterica enterica serovar Typhi Ty2
gagguucgccucccucacc

SEQ ID NO: 3705355 - RNA, 18 nt, Salmonella enterica enterica serovar Typhi Ty2
gagguuucagcaccucca

SEQ ID NO: 3705356 - RNA, 16 nt, Salmonella enterica enterica serovar Typhi Ty2
gagguuucuucaucaa

SEQ ID NO: 3705357 - RNA, 16 nt, Salmonella enterica enterica serovar Typhi Ty2
gagguuuucucaucca

SEQ ID NO: 3705358 - RNA, 15 nt, Salmonella enterica enterica serovar Typhi Ty2
gaguaaaaccggcac

SEQ ID NO: 3705359 - RNA, 20 nt, Salmonella enterica enterica serovar Typhi Ty2
gaguaaaaccggcacaucca

SEQ ID NO: 3705360 - RNA, 23 nt, Salmonella enterica enterica serovar Typhi Ty2
gaguaaaguuauucacguagggu

SEQ ID NO: 3705361 - RNA, 16 nt, Salmonella enterica enterica serovar Typhi Ty2
gaguaaauaaaucagc

SEQ ID NO: 3705362 - RNA, 20 nt, Salmonella enterica enterica serovar Typhi Ty2
gaguaaucacuaacugacca

SEQ ID NO: 3705363 - RNA, 20 nt, Salmonella enterica enterica serovar Typhi Ty2
gaguaauguucaguuuuucc

SEQ ID NO: 3705364 - RNA, 23 nt, Salmonella enterica enterica serovar Typhi Ty2
gaguaauguucaguuuuuccagc

SEQ ID NO: 3705365 - RNA, 22 nt, Salmonella enterica enterica serovar Typhi Ty2
gaguauaaaacucgccgcgaac

SEQ ID NO: 3705366 - RNA, 22 nt, Salmonella enterica enterica serovar Typhi Ty2
gaguauuuaccuacuguggugu

SEQ ID NO: 3705367 - RNA, 18 nt, Salmonella enterica enterica serovar Typhi Ty2
gagucaaaagauugauuu

SEQ ID NO: 3705368 - RNA, 15 nt, Salmonella enterica enterica serovar Typhi Ty2
gagucaaggcaucca

SEQ ID NO: 3705369 - RNA, 23 nt, Salmonella enterica enterica serovar Typhi Ty2
gauaagcauagcgccaucaggca

SEQ ID NO: 3705370 - RNA, 21 nt, Salmonella enterica enterica serovar Typhi Ty2
gauaagccugugcgccugcug

SEQ ID NO: 3705371 - RNA, 16 nt, Salmonella enterica enterica serovar Typhi Ty2
gauaagcgaagcgcca

SEQ ID NO: 3705372 - RNA, 23 nt, Salmonella enterica enterica serovar Typhi Ty2
gauaagcgaagcgccaucaggca

SEQ ID NO: 3705373 - RNA, 20 nt, Salmonella enterica enterica serovar Typhi Ty2
gauaagcgaagcgucauccg

SEQ ID NO: 3705374 - RNA, 16 nt, Salmonella enterica enterica serovar Typhi Ty2
gauaagcgcagcgcca

SEQ ID NO: 3705375 - RNA, 17 nt, Salmonella enterica enterica serovar Typhi Ty2
gauaagcgcagcgccau

SEQ ID NO: 3705376 - RNA, 20 nt, Salmonella enterica enterica serovar Typhi Ty2
gauaagcgcagcgccaucag

SEQ ID NO: 3705377 - RNA, 21 nt, Salmonella enterica enterica serovar Typhi Ty2
gauaagcgcagcgccaucagg

SEQ ID NO: 3705378 - RNA, 23 nt, Salmonella enterica enterica serovar Typhi Ty2
gauaagcgcagcgccaucaggcc

SEQ ID NO: 3705379 - RNA, 23 nt, Salmonella enterica enterica serovar Typhi Ty2
gauaagcgcagcgccauccggca

SEQ ID NO: 3705380 - RNA, 23 nt, Salmonella enterica enterica serovar Typhi Ty2
gauaagcgcagcgucaucaggcc

SEQ ID NO: 3705381 - RNA, 16 nt, Salmonella enterica enterica serovar Typhi Ty2
gauaagcguagcgcca

SEQ ID NO: 3705382 - RNA, 23 nt, Salmonella enterica enterica serovar Typhi Ty2
gauaagcguagcgccaucaggcu

SEQ ID NO: 3705383 - RNA, 23 nt, Salmonella enterica enterica serovar Typhi Ty2
gauaagcguagcgccauccggca

SEQ ID NO: 3705384 - RNA, 20 nt, Salmonella enterica enterica serovar Typhi Ty2
gauaagcuuucuguuaucag

SEQ ID NO: 3705385 - RNA, 23 nt, Salmonella enterica enterica serovar Typhi Ty2
gauaagcuuucuguuaucaggcg

SEQ ID NO: 3705386 - RNA, 13 nt, Salmonella enterica enterica serovar Typhi Ty2
gauaaggcagcaa

SEQ ID NO: 3705387 - RNA, 23 nt, Salmonella enterica enterica serovar Typhi Ty2
gauaaggccacgccgccauccgg

SEQ ID NO: 3705388 - RNA, 23 nt, Salmonella enterica enterica serovar Typhi Ty2
gauaaggcggagccgccauccgg

SEQ ID NO: 3705389 - RNA, 19 nt, Salmonella enterica enterica serovar Typhi Ty2
gauaagguaaagccgccau

SEQ ID NO: 3705390 - RNA, 19 nt, Salmonella enterica enterica serovar Typhi Ty2
gauaaggucgcuauccagc

SEQ ID NO: 3705391 - RNA, 22 nt, Salmonella enterica enterica serovar Typhi Ty2
gauaagguguuuacgccgccau

SEQ ID NO: 3705392 - RNA, 23 nt, Salmonella enterica enterica serovar Typhi Ty2
gauaagguguuuacgccgccauc

SEQ ID NO: 3705393 - RNA, 16 nt, Salmonella enterica enterica serovar Typhi Ty2
gauaaguccuaacacc

SEQ ID NO: 3705394 - RNA, 11 nt, Salmonella enterica enterica serovar Typhi Ty2
gauaauaauga

SEQ ID NO: 3705395 - RNA, 17 nt, Salmonella enterica enterica serovar Typhi Ty2
gauaauacauugccgca

SEQ ID NO: 3705396 - RNA, 23 nt, Salmonella enterica enterica serovar Typhi Ty2
gauaauacgcgcgauuacgcgac

SEQ ID NO: 3705397 - RNA, 16 nt, Salmonella enterica enterica serovar Typhi Ty2
gauaauagaaccgaau

SEQ ID NO: 3705398 - RNA, 17 nt, Salmonella enterica enterica serovar Typhi Ty2
gauaauaguggugcgca

SEQ ID NO: 3705399 - RNA, 22 nt, Salmonella enterica enterica serovar Typhi Ty2
gauaaucaauggccuugccagc

SEQ ID NO: 3705400 - RNA, 21 nt, Salmonella enterica enterica serovar Typhi Ty2
gauaaucacggcggaggccga

SEQ ID NO: 3705401 - RNA, 14 nt, Salmonella enterica enterica serovar Typhi Ty2
gauaaucagcagcg

SEQ ID NO: 3705402 - RNA, 18 nt, Salmonella enterica enterica serovar Typhi Ty2
gauaauguugguaaauuu

SEQ ID NO: 3705403 - RNA, 15 nt, Salmonella enterica enterica serovar Typhi Ty2
gauaauucccccagu

SEQ ID NO: 3705404 - RNA, 23 nt, Salmonella enterica enterica serovar Typhi Ty2
gauaauucccccaguaguugacc

SEQ ID NO: 3705405 - RNA, 13 nt, Salmonella enterica enterica serovar Typhi Ty2
gauaauuuaucca

SEQ ID NO: 3705406 - RNA, 19 nt, Salmonella enterica enterica serovar Typhi Ty2
gauaauuuuaccuucgcgu

SEQ ID NO: 3705407 - RNA, 22 nt, Salmonella enterica enterica serovar Typhi Ty2
gauaauuuucccaguucaucca

SEQ ID NO: 3705408 - RNA, 18 nt, Salmonella enterica enterica serovar Typhi Ty2
gauacaagguauccgcca

SEQ ID NO: 3705409 - RNA, 15 nt, Salmonella enterica enterica serovar Typhi Ty2
gauacaccuucacau

SEQ ID NO: 3705410 - RNA, 21 nt, Salmonella enterica enterica serovar Typhi Ty2
gauacagaaaaccggcaaaua

SEQ ID NO: 3705411 - RNA, 15 nt, Salmonella enterica enterica serovar Typhi Ty2
gauacagcagcaccu

SEQ ID NO: 3705412 - RNA, 20 nt, Salmonella enterica enterica serovar Typhi Ty2
gauacaggacugacugcugu

SEQ ID NO: 3705413 - RNA, 21 nt, Salmonella enterica enterica serovar Typhi Ty2
gauacaggacugacugcuguc

SEQ ID NO: 3705414 - RNA, 14 nt, Salmonella enterica enterica serovar Typhi Ty2
gauaccagauuaau

SEQ ID NO: 3705415 - RNA, 22 nt, Salmonella enterica enterica serovar Typhi Ty2
gauaccagccuucggacugcug

SEQ ID NO: 3705416 - RNA, 19 nt, Salmonella enterica enterica serovar Typhi Ty2
gauacccagcgucccggcg

SEQ ID NO: 3705417 - RNA, 20 nt, Salmonella enterica enterica serovar Typhi Ty2
gauacccagcgucccggcgu

SEQ ID NO: 3705418 - RNA, 21 nt, Salmonella enterica enterica serovar Typhi Ty2
gauaccccagcgaucccaguu

SEQ ID NO: 3705419 - RNA, 17 nt, Salmonella enterica enterica serovar Typhi Ty2
gauacccgcccagauca

SEQ ID NO: 3705420 - RNA, 14 nt, Salmonella enterica enterica serovar Typhi Ty2
gauaccgccagccc

SEQ ID NO: 3705421 - RNA, 22 nt, Salmonella enterica enterica serovar Typhi Ty2
gauaccggaggagugcgccagu

SEQ ID NO: 3705422 - RNA, 19 nt, Salmonella enterica enterica serovar Typhi Ty2
gauacgauugcgcguguua

SEQ ID NO: 3705423 - RNA, 21 nt, Salmonella enterica enterica serovar Typhi Ty2
gauacgcagcaccgccgcgau

SEQ ID NO: 3705424 - RNA, 15 nt, Salmonella enterica enterica serovar Typhi Ty2
gauacgccagcagac

SEQ ID NO: 3705425 - RNA, 14 nt, Salmonella enterica enterica serovar Typhi Ty2
gauacgccagguua

SEQ ID NO: 3705426 - RNA, 20 nt, Salmonella enterica enterica serovar Typhi Ty2
gauacgcgucaaagcacaug

SEQ ID NO: 3705427 - RNA, 20 nt, Salmonella enterica enterica serovar Typhi Ty2
gauacgcuguaguuccugua

SEQ ID NO: 3705428 - RNA, 17 nt, Salmonella enterica enterica serovar Typhi Ty2
gauacggcuccagcaca

SEQ ID NO: 3705429 - RNA, 17 nt, Salmonella enterica enterica serovar Typhi Ty2
gauacgggaucgauaau

SEQ ID NO: 3705430 - RNA, 22 nt, Salmonella enterica enterica serovar Typhi Ty2
gauacgggaucgauaauugcuc

SEQ ID NO: 3705431 - RNA, 17 nt, Salmonella enterica enterica serovar Typhi Ty2
gauacggguaaucagac

SEQ ID NO: 3705432 - RNA, 14 nt, Salmonella enterica enterica serovar Typhi Ty2
gauacguucauccu

SEQ ID NO: 3705433 - RNA, 13 nt, Salmonella enterica enterica serovar Typhi Ty2
gauacguuccagc

SEQ ID NO: 3705434 - RNA, 14 nt, Salmonella enterica enterica serovar Typhi Ty2
gauacguuccagca

SEQ ID NO: 3705435 - RNA, 12 nt, Salmonella enterica enterica serovar Typhi Ty2
gauacugcaacg

SEQ ID NO: 3705436 - RNA, 21 nt, Salmonella enterica enterica serovar Typhi Ty2
gauacugccgcccaucgccac

SEQ ID NO: 3705437 - RNA, 21 nt, Salmonella enterica enterica serovar Typhi Ty2
gauacuggaagugauccuuca

SEQ ID NO: 3705438 - RNA, 15 nt, Salmonella enterica enterica serovar Typhi Ty2
gauagacaugaccgg

SEQ ID NO: 3705439 - RNA, 19 nt, Salmonella enterica enterica serovar Typhi Ty2
gauagagaguuccuccugg

SEQ ID NO: 3705440 - RNA, 16 nt, Salmonella enterica enterica serovar Typhi Ty2
gauagagguuaccggg

SEQ ID NO: 3705441 - RNA, 22 nt, Salmonella enterica enterica serovar Typhi Ty2
gauagagguuaccgggcuaaac

SEQ ID NO: 3705442 - RNA, 22 nt, Salmonella enterica enterica serovar Typhi Ty2
gauagcacagcgcuaucaggca

SEQ ID NO: 3705443 - RNA, 14 nt, Salmonella enterica enterica serovar Typhi Ty2
gauagcacuaccca

SEQ ID NO: 3705444 - RNA, 14 nt, Salmonella enterica enterica serovar Typhi Ty2
gauagcaucuuccu

SEQ ID NO: 3705445 - RNA, 20 nt, Salmonella enterica enterica serovar Typhi Ty2
gauagccauacgauucaggu

SEQ ID NO: 3705446 - RNA, 14 nt, Salmonella enterica enterica serovar Typhi Ty2
gauagccauuauag

SEQ ID NO: 3705447 - RNA, 22 nt, Salmonella enterica enterica serovar Typhi Ty2
gauagcccggcauguccaucag

SEQ ID NO: 3705448 - RNA, 11 nt, Salmonella enterica enterica serovar Typhi Ty2
gauagccuuau

SEQ ID NO: 3705449 - RNA, 18 nt, Salmonella enterica enterica serovar Typhi Ty2
gauagcgacggcgcgcca

SEQ ID NO: 3705450 - RNA, 12 nt, Salmonella enterica enterica serovar Typhi Ty2
gaucagacgcac

SEQ ID NO: 3705451 - RNA, 19 nt, Salmonella enterica enterica serovar Typhi Ty2
gaucagacuuuggauaaag

SEQ ID NO: 3705452 - RNA, 13 nt, Salmonella enterica enterica serovar Typhi Ty2
gaucagcaaaaua

SEQ ID NO: 3705453 - RNA, 21 nt, Salmonella enterica enterica serovar Typhi Ty2
gaucagcaccacgcccggauc

SEQ ID NO: 3705454 - RNA, 15 nt, Salmonella enterica enterica serovar Typhi Ty2
gaucagcagaacaaa

SEQ ID NO: 3705455 - RNA, 15 nt, Salmonella enterica enterica serovar Typhi Ty2
gaucagcgccacgca

SEQ ID NO: 3705456 - RNA, 18 nt, Salmonella enterica enterica serovar Typhi Ty2
gaucaggaaaucuuccag

SEQ ID NO: 3705457 - RNA, 20 nt, Salmonella enterica enterica serovar Typhi Ty2
gaucaggcaaaaaucggccu

SEQ ID NO: 3705458 - RNA, 20 nt, Salmonella enterica enterica serovar Typhi Ty2
gaucaggccgcagacggaga

SEQ ID NO: 3705459 - RNA, 16 nt, Salmonella enterica enterica serovar Typhi Ty2
gaucaggcgucagcgg

SEQ ID NO: 3705460 - RNA, 13 nt, Salmonella enterica enterica serovar Typhi Ty2
gaucaggcuaaag

SEQ ID NO: 3705461 - RNA, 14 nt, Salmonella enterica enterica serovar Typhi Ty2
gaucaggucugaga

SEQ ID NO: 3705462 - RNA, 17 nt, Salmonella enterica enterica serovar Typhi Ty2
gaucaguagacgguaac

SEQ ID NO: 3705463 - RNA, 19 nt, Salmonella enterica enterica serovar Typhi Ty2
gaucauaagggagcugacu

SEQ ID NO: 3705464 - RNA, 14 nt, Salmonella enterica enterica serovar Typhi Ty2
gaucauaccggcag

SEQ ID NO: 3705465 - RNA, 19 nt, Salmonella enterica enterica serovar Typhi Ty2
gaucaucacgaaauaacgc

SEQ ID NO: 3705466 - RNA, 15 nt, Salmonella enterica enterica serovar Typhi Ty2
gaucaucauggcuga

SEQ ID NO: 3705467 - RNA, 20 nt, Salmonella enterica enterica serovar Typhi Ty2
gaucaucuucacuucacaaa

SEQ ID NO: 3705468 - RNA, 12 nt, Salmonella enterica enterica serovar Typhi Ty2
gaucaucuuuua

SEQ ID NO: 3705469 - RNA, 20 nt, Salmonella enterica enterica serovar Typhi Ty2
gaucaugaggaugagcguuu

SEQ ID NO: 3705470 - RNA, 14 nt, Salmonella enterica enterica serovar Typhi Ty2
gaucauggcucaga

SEQ ID NO: 3705471 - RNA, 19 nt, Salmonella enterica enterica serovar Typhi Ty2
gaucauuaccugucgccca

SEQ ID NO: 3705472 - RNA, 19 nt, Salmonella enterica enterica serovar Typhi Ty2
gaucauuggggaaccuggc

SEQ ID NO: 3705473 - RNA, 20 nt, Salmonella enterica enterica serovar Typhi Ty2
gauccaccaccagcaucacg

SEQ ID NO: 3705474 - RNA, 12 nt, Salmonella enterica enterica serovar Typhi Ty2
gauccagaaccg

SEQ ID NO: 3705475 - RNA, 20 nt, Salmonella enterica enterica serovar Typhi Ty2
gauccagaacugcgaaauca

SEQ ID NO: 3705476 - RNA, 21 nt, Salmonella enterica enterica serovar Typhi Ty2
gauccagccccagcgccagcu

SEQ ID NO: 3705477 - RNA, 22 nt, Salmonella enterica enterica serovar Typhi Ty2
gauccagcgauugacgguuugu

SEQ ID NO: 3705478 - RNA, 18 nt, Salmonella enterica enterica serovar Typhi Ty2
gauccaucgccugcggcg

SEQ ID NO: 3705479 - RNA, 22 nt, Salmonella enterica enterica serovar Typhi Ty2
gaucccagcgaacugauaaaag

SEQ ID NO: 3705480 - RNA, 17 nt, Salmonella enterica enterica serovar Typhi Ty2
gaucccaggccggcaua

SEQ ID NO: 3705481 - RNA, 21 nt, Salmonella enterica enterica serovar Typhi Ty2
gaucccagggcggcgucgcca

SEQ ID NO: 3705482 - RNA, 23 nt, Salmonella enterica enterica serovar Typhi Ty2
gaucccagggcggcgucgccaga

SEQ ID NO: 3705483 - RNA, 22 nt, Salmonella enterica enterica serovar Typhi Ty2
gauccccaucccaaucaggcuu

SEQ ID NO: 3705484 - RNA, 21 nt, Salmonella enterica enterica serovar Typhi Ty2
gauccccucuuccaucagcca

SEQ ID NO: 3705485 - RNA, 22 nt, Salmonella enterica enterica serovar Typhi Ty2
gauccccucuuccaucagccag

SEQ ID NO: 3705486 - RNA, 16 nt, Salmonella enterica enterica serovar Typhi Ty2
gaucccgacucugacg

SEQ ID NO: 3705487 - RNA, 15 nt, Salmonella enterica enterica serovar Typhi Ty2
gaucccgcgcgccuc

SEQ ID NO: 3705488 - RNA, 20 nt, Salmonella enterica enterica serovar Typhi Ty2
gaucccgggcgauaaaccag

SEQ ID NO: 3705489 - RNA, 14 nt, Salmonella enterica enterica serovar Typhi Ty2
gaucccuaauaaaa

SEQ ID NO: 3705490 - RNA, 21 nt, Salmonella enterica enterica serovar Typhi Ty2
gauccgacaugaugccaaaua

SEQ ID NO: 3705491 - RNA, 15 nt, Salmonella enterica enterica serovar Typhi Ty2
gauccgccuuacgca

SEQ ID NO: 3705492 - RNA, 21 nt, Salmonella enterica enterica serovar Typhi Ty2
gauccggcauccaaccgaaca

SEQ ID NO: 3705493 - RNA, 20 nt, Salmonella enterica enterica serovar Typhi Ty2
gauccguucgaucagcuggc

SEQ ID NO: 3705494 - RNA, 22 nt, Salmonella enterica enterica serovar Typhi Ty2
gauccguucgaucagcuggcuu

SEQ ID NO: 3705495 - RNA, 18 nt, Salmonella enterica enterica serovar Typhi Ty2
gauccugcggcauuagca

SEQ ID NO: 3705496 - RNA, 19 nt, Salmonella enterica enterica serovar Typhi Ty2
gauccuguucaaacaucag

SEQ ID NO: 3705497 - RNA, 20 nt, Salmonella enterica enterica serovar Typhi Ty2
gauccuguucaaacaucagc

SEQ ID NO: 3705498 - RNA, 14 nt, Salmonella enterica enterica serovar Typhi Ty2
gaucgaaucucccg

SEQ ID NO: 3705499 - RNA, 18 nt, Salmonella enterica enterica serovar Typhi Ty2
gaucgaaugaaaauguau

SEQ ID NO: 3705500 - RNA, 18 nt, Salmonella enterica enterica serovar Typhi Ty2
gaucgacaaaccacugcu

SEQ ID NO: 3705501 - RNA, 19 nt, Salmonella enterica enterica serovar Typhi Ty2
gaucgacaaaccacugcug

SEQ ID NO: 3705502 - RNA, 13 nt, Salmonella enterica enterica serovar Typhi Ty2
gaucgacaaugau

SEQ ID NO: 3705503 - RNA, 15 nt, Salmonella enterica enterica serovar Typhi Ty2
gaucgacaaugauca

SEQ ID NO: 3705504 - RNA, 17 nt, Salmonella enterica enterica serovar Typhi Ty2
gaucgacaaugaucaga

SEQ ID NO: 3705505 - RNA, 23 nt, Salmonella enterica enterica serovar Typhi Ty2
gaucgacauaagaguccauucgg

SEQ ID NO: 3705506 - RNA, 14 nt, Salmonella enterica enterica serovar Typhi Ty2
gaucgacaucuuca

SEQ ID NO: 3705507 - RNA, 20 nt, Salmonella enterica enterica serovar Typhi Ty2
gaucgagccgucgccggccu

SEQ ID NO: 3705508 - RNA, 16 nt, Salmonella enterica enterica serovar Typhi Ty2
gaucgaggucagcauu

SEQ ID NO: 3705509 - RNA, 20 nt, Salmonella enterica enterica serovar Typhi Ty2
gaucgauaauugcucaccca

SEQ ID NO: 3705510 - RNA, 18 nt, Salmonella enterica enterica serovar Typhi Ty2
gaucgauauaucgcguca

SEQ ID NO: 3705511 - RNA, 17 nt, Salmonella enterica enterica serovar Typhi Ty2
gaucgauccacuuccca

SEQ ID NO: 3705512 - RNA, 17 nt, Salmonella enterica enterica serovar Typhi Ty2
gaucgaucccggcaaaa

SEQ ID NO: 3705513 - RNA, 20 nt, Salmonella enterica enterica serovar Typhi Ty2
gaucgaucucgauauucaca

SEQ ID NO: 3705514 - RNA, 20 nt, Salmonella enterica enterica serovar Typhi Ty2
gaucgcaagauccugauauu

SEQ ID NO: 3705515 - RNA, 18 nt, Salmonella enterica enterica serovar Typhi Ty2
gaucgcauaaauauccgg

SEQ ID NO: 3705516 - RNA, 22 nt, Salmonella enterica enterica serovar Typhi Ty2
gaucgccaucgauagcagcgcu

SEQ ID NO: 3705517 - RNA, 18 nt, Salmonella enterica enterica serovar Typhi Ty2
gaucgcccagaugaaucg

SEQ ID NO: 3705518 - RNA, 14 nt, Salmonella enterica enterica serovar Typhi Ty2
gaucgccgccgaau

SEQ ID NO: 3705519 - RNA, 23 nt, Salmonella enterica enterica serovar Typhi Ty2
gaucgccgccgcgagcagcgaaa

SEQ ID NO: 3705520 - RNA, 10 nt, Salmonella enterica enterica serovar Typhi Ty2
gaucgccugg

SEQ ID NO: 3705521 - RNA, 13 nt, Salmonella enterica enterica serovar Typhi Ty2
gaucgcgcagcag

SEQ ID NO: 3705522 - RNA, 14 nt, Salmonella enterica enterica serovar Typhi Ty2
gaucgcgcagcagg

SEQ ID NO: 3705523 - RNA, 20 nt, Salmonella enterica enterica serovar Typhi Ty2
gaucgcgccggucgccagca

SEQ ID NO: 3705524 - RNA, 13 nt, Salmonella enterica enterica serovar Typhi Ty2
gaucgcgugucgg

SEQ ID NO: 3705525 - RNA, 15 nt, Salmonella enterica enterica serovar Typhi Ty2
gaucgcuaaucagga

SEQ ID NO: 3705526 - RNA, 17 nt, Salmonella enterica enterica serovar Typhi Ty2
gaucgcuaaucaggaca

SEQ ID NO: 3705527 - RNA, 18 nt, Salmonella enterica enterica serovar Typhi Ty2
gaucggaagacuggcgca

SEQ ID NO: 3705528 - RNA, 22 nt, Salmonella enterica enterica serovar Typhi Ty2
gaucggcaaaagugugauaagc

SEQ ID NO: 3705529 - RNA, 14 nt, Salmonella enterica enterica serovar Typhi Ty2
gaucggcgcaggga

SEQ ID NO: 3705530 - RNA, 20 nt, Salmonella enterica enterica serovar Typhi Ty2
gaucggcuggguuuccggau

SEQ ID NO: 3705531 - RNA, 17 nt, Salmonella enterica enterica serovar Typhi Ty2
gaucggcuuuaucuuua

SEQ ID NO: 3705532 - RNA, 22 nt, Salmonella enterica enterica serovar Typhi Ty2
gaugcgccgacugaacauagcc

SEQ ID NO: 3705533 - RNA, 18 nt, Salmonella enterica enterica serovar Typhi Ty2
gaugcgcguuuagcgcca

SEQ ID NO: 3705534 - RNA, 20 nt, Salmonella enterica enterica serovar Typhi Ty2
gaugcgcucacgcuuauccg

SEQ ID NO: 3705535 - RNA, 13 nt, Salmonella enterica enterica serovar Typhi Ty2
gaugcgcuuuacu

SEQ ID NO: 3705536 - RNA, 21 nt, Salmonella enterica enterica serovar Typhi Ty2
gaugcggcaaaaauccuucuu

SEQ ID NO: 3705537 - RNA, 19 nt, Salmonella enterica enterica serovar Typhi Ty2
gaugcgggcgaucggcugu

SEQ ID NO: 3705538 - RNA, 17 nt, Salmonella enterica enterica serovar Typhi Ty2
gaugcguauccagcgcg

SEQ ID NO: 3705539 - RNA, 22 nt, Salmonella enterica enterica serovar Typhi Ty2
gaugcguucuagcuuaucgcca

SEQ ID NO: 3705540 - RNA, 23 nt, Salmonella enterica enterica serovar Typhi Ty2
gaugcuaaccucuauaguaaauu

SEQ ID NO: 3705541 - RNA, 16 nt, Salmonella enterica enterica serovar Typhi Ty2
gaugcuauaccgcccg

SEQ ID NO: 3705542 - RNA, 14 nt, Salmonella enterica enterica serovar Typhi Ty2
gaugcucgcucauc

SEQ ID NO: 3705543 - RNA, 17 nt, Salmonella enterica enterica serovar Typhi Ty2
gaugcugaauagccagc

SEQ ID NO: 3705544 - RNA, 18 nt, Salmonella enterica enterica serovar Typhi Ty2
gaugcugauguccgcagc

SEQ ID NO: 3705545 - RNA, 18 nt, Salmonella enterica enterica serovar Typhi Ty2
gaugcugccugccugaag

SEQ ID NO: 3705546 - RNA, 17 nt, Salmonella enterica enterica serovar Typhi Ty2
gaugcugcgcauccgcg

SEQ ID NO: 3705547 - RNA, 16 nt, Salmonella enterica enterica serovar Typhi Ty2
gaugcugcguuuuuuc

SEQ ID NO: 3705548 - RNA, 19 nt, Salmonella enterica enterica serovar Typhi Ty2
gaugcugucuuagugaaag

SEQ ID NO: 3705549 - RNA, 22 nt, Salmonella enterica enterica serovar Typhi Ty2
gaugcuugccauauugccgcac

SEQ ID NO: 3705550 - RNA, 17 nt, Salmonella enterica enterica serovar Typhi Ty2
gauggaacgcauccagc

SEQ ID NO: 3705551 - RNA, 17 nt, Salmonella enterica enterica serovar Typhi Ty2
gauggacuugugcagug

SEQ ID NO: 3705552 - RNA, 13 nt, Salmonella enterica enterica serovar Typhi Ty2
gauggcaaauaau

SEQ ID NO: 3705553 - RNA, 11 nt, Salmonella enterica enterica serovar Typhi Ty2
gauggcacugc

SEQ ID NO: 3705554 - RNA, 23 nt, Salmonella enterica enterica serovar Typhi Ty2
gauggcacugcgcuuauccggcc

SEQ ID NO: 3705555 - RNA, 17 nt, Salmonella enterica enterica serovar Typhi Ty2
gauggcaguacagggcg

SEQ ID NO: 3705556 - RNA, 18 nt, Salmonella enterica enterica serovar Typhi Ty2
gauggccgccgagcugug

SEQ ID NO: 3705557 - RNA, 20 nt, Salmonella enterica enterica serovar Typhi Ty2
gauggccgguuauaccgcca

SEQ ID NO: 3705558 - RNA, 23 nt, Salmonella enterica enterica serovar Typhi Ty2
gauggcgacuaacgucuuauccg

SEQ ID NO: 3705559 - RNA, 16 nt, Salmonella enterica enterica serovar Typhi Ty2
gauggcgaucagcgcc

SEQ ID NO: 3705560 - RNA, 17 nt, Salmonella enterica enterica serovar Typhi Ty2
gauggcgaucagcgcca

SEQ ID NO: 3705561 - RNA, 21 nt, Salmonella enterica enterica serovar Typhi Ty2
gauggcgauucauaugcgcca

SEQ ID NO: 3705562 - RNA, 13 nt, Salmonella enterica enterica serovar Typhi Ty2
gauggcgccagcc

SEQ ID NO: 3705563 - RNA, 20 nt, Salmonella enterica enterica serovar Typhi Ty2
gauggcgcgacgcuuaucag

SEQ ID NO: 3705564 - RNA, 16 nt, Salmonella enterica enterica serovar Typhi Ty2
gauggcgcuaagccag

SEQ ID NO: 3705565 - RNA, 21 nt, Salmonella enterica enterica serovar Typhi Ty2
gauggcgcuaaugcuuauccg

SEQ ID NO: 3705566 - RNA, 19 nt, Salmonella enterica enterica serovar Typhi Ty2
gauggcgcuacgcuuauca

SEQ ID NO: 3705567 - RNA, 20 nt, Salmonella enterica enterica serovar Typhi Ty2
gauggcgcuacgcuuauccg

SEQ ID NO: 3705568 - RNA, 19 nt, Salmonella enterica enterica serovar Typhi Ty2
gauggcgcuacgcuuaucg

SEQ ID NO: 3705569 - RNA, 14 nt, Salmonella enterica enterica serovar Typhi Ty2
gauggcgcuccuga

SEQ ID NO: 3705570 - RNA, 21 nt, Salmonella enterica enterica serovar Typhi Ty2
gauggcgcugccgcuuauccg

SEQ ID NO: 3705571 - RNA, 23 nt, Salmonella enterica enterica serovar Typhi Ty2
gauggcgcugcgcuuaucaggcc

SEQ ID NO: 3705572 - RNA, 20 nt, Salmonella enterica enterica serovar Typhi Ty2
gauggcgcugcgcuuauccg

SEQ ID NO: 3705573 - RNA, 19 nt, Salmonella enterica enterica serovar Typhi Ty2
gauggcgcuucgcuuacca

SEQ ID NO: 3705574 - RNA, 19 nt, Salmonella enterica enterica serovar Typhi Ty2
gauggcgcuucgcuuauca

SEQ ID NO: 3705575 - RNA, 20 nt, Salmonella enterica enterica serovar Typhi Ty2
gauggcgcuuugcuuauccg

SEQ ID NO: 3705576 - RNA, 18 nt, Salmonella enterica enterica serovar Typhi Ty2
gauggcggcgucgccugu

SEQ ID NO: 3705577 - RNA, 22 nt, Salmonella enterica enterica serovar Typhi Ty2
gauggcggcuacgccuuauccg

SEQ ID NO: 3705578 - RNA, 21 nt, Salmonella enterica enterica serovar Typhi Ty2
gauggcggcugcgccuuauca

SEQ ID NO: 3705579 - RNA, 22 nt, Salmonella enterica enterica serovar Typhi Ty2
gauggcggcugcgccuuauccg

SEQ ID NO: 3705580 - RNA, 17 nt, Salmonella enterica enterica serovar Typhi Ty2
gauggcgucacauggcg

SEQ ID NO: 3705581 - RNA, 19 nt, Salmonella enterica enterica serovar Typhi Ty2
gauggcgucacauggcgaa

SEQ ID NO: 3705582 - RNA, 19 nt, Salmonella enterica enterica serovar Typhi Ty2
gauggcuaugaagcuggag

SEQ ID NO: 3705583 - RNA, 22 nt, Salmonella enterica enterica serovar Typhi Ty2
gauggcuauuaccggcuggaag

SEQ ID NO: 3705584 - RNA, 19 nt, Salmonella enterica enterica serovar Typhi Ty2
gauggcuuugcugucagaa

SEQ ID NO: 3705585 - RNA, 23 nt, Salmonella enterica enterica serovar Typhi Ty2
gaugggcagauagaaugcuucuu

SEQ ID NO: 3705586 - RNA, 19 nt, Salmonella enterica enterica serovar Typhi Ty2
gaugguauaaaucacgcug

SEQ ID NO: 3705587 - RNA, 16 nt, Salmonella enterica enterica serovar Typhi Ty2
gauggucaauaacagc

SEQ ID NO: 3705588 - RNA, 22 nt, Salmonella enterica enterica serovar Typhi Ty2
gauggugcagccccggcggcgu

SEQ ID NO: 3705589 - RNA, 20 nt, Salmonella enterica enterica serovar Typhi Ty2
gauggugcggcgcacugccu

SEQ ID NO: 3705590 - RNA, 16 nt, Salmonella enterica enterica serovar Typhi Ty2
gaugguguuaccgcca

SEQ ID NO: 3705591 - RNA, 23 nt, Salmonella enterica enterica serovar Typhi Ty2
gaugguuaaauucauauuuaaau

SEQ ID NO: 3705592 - RNA, 13 nt, Salmonella enterica enterica serovar Typhi Ty2
gaugguuaagcag

SEQ ID NO: 3705593 - RNA, 16 nt, Salmonella enterica enterica serovar Typhi Ty2
gaugguuauuuucaga

SEQ ID NO: 3705594 - RNA, 21 nt, Salmonella enterica enterica serovar Typhi Ty2
gaugguuucggcaugccacug

SEQ ID NO: 3705595 - RNA, 13 nt, Salmonella enterica enterica serovar Typhi Ty2
gaugguuucuucg

SEQ ID NO: 3705596 - RNA, 17 nt, Salmonella enterica enterica serovar Typhi Ty2
gauguaaaaccuggcac

SEQ ID NO: 3705597 - RNA, 22 nt, Salmonella enterica enterica serovar Typhi Ty2
gauguacuguauucgguggaaa

SEQ ID NO: 3705598 - RNA, 16 nt, Salmonella enterica enterica serovar Typhi Ty2
gauguaguuguucuuu

SEQ ID NO: 3705599 - RNA, 14 nt, Salmonella enterica enterica serovar Typhi Ty2
gauguauuuaucca

SEQ ID NO: 3705600 - RNA, 11 nt, Salmonella enterica enterica serovar Typhi Ty2
gaugucauccg

SEQ ID NO: 3705601 - RNA, 22 nt, Salmonella enterica enterica serovar Typhi Ty2
gaugucauugacuuaucgcgcu

SEQ ID NO: 3705602 - RNA, 16 nt, Salmonella enterica enterica serovar Typhi Ty2
gauguccgcagccgca

SEQ ID NO: 3705603 - RNA, 20 nt, Salmonella enterica enterica serovar Typhi Ty2
gauguccgccuugaggcguu

SEQ ID NO: 3705604 - RNA, 14 nt, Salmonella enterica enterica serovar Typhi Ty2
gaugucucagcgca

SEQ ID NO: 3705605 - RNA, 23 nt, Salmonella enterica enterica serovar Typhi Ty2
gaugugucuauuuauugaagaug

SEQ ID NO: 3705606 - RNA, 21 nt, Salmonella enterica enterica serovar Typhi Ty2
gauguucgcgauuuucaucaa

SEQ ID NO: 3705607 - RNA, 16 nt, Salmonella enterica enterica serovar Typhi Ty2
gauguugauacagaaa

SEQ ID NO: 3705608 - RNA, 16 nt, Salmonella enterica enterica serovar Typhi Ty2
gauuaacaagcagaua

SEQ ID NO: 3705609 - RNA, 19 nt, Salmonella enterica enterica serovar Typhi Ty2
gauuaacaagcagauaccg

SEQ ID NO: 3705610 - RNA, 21 nt, Salmonella enterica enterica serovar Typhi Ty2
gauuaacccggucauccagcg

SEQ ID NO: 3705611 - RNA, 15 nt, Salmonella enterica enterica serovar Typhi Ty2
gauuaacggcaaaaa

SEQ ID NO: 3705612 - RNA, 19 nt, Salmonella enterica enterica serovar Typhi Ty2
gauuaauaaaauuuuugcc

SEQ ID NO: 3705613 - RNA, 19 nt, Salmonella enterica enterica serovar Typhi Ty2
gcaaaaauaggcuuuugau

SEQ ID NO: 3705614 - RNA, 14 nt, Salmonella enterica enterica serovar Typhi Ty2
gcaaaaaucagccc

SEQ ID NO: 3705615 - RNA, 13 nt, Salmonella enterica enterica serovar Typhi Ty2
gcaaaaauuugcg

SEQ ID NO: 3705616 - RNA, 12 nt, Salmonella enterica enterica serovar Typhi Ty2
gcaaaacauggc

SEQ ID NO: 3705617 - RNA, 15 nt, Salmonella enterica enterica serovar Typhi Ty2
gcaaaaccagacgcc

SEQ ID NO: 3705618 - RNA, 19 nt, Salmonella enterica enterica serovar Typhi Ty2
gcaaaacgcauccagcgca

SEQ ID NO: 3705619 - RNA, 21 nt, Salmonella enterica enterica serovar Typhi Ty2
gcaaaacucucaccgaccugc

SEQ ID NO: 3705620 - RNA, 18 nt, Salmonella enterica enterica serovar Typhi Ty2
gcaaaagggccauggcug

SEQ ID NO: 3705621 - RNA, 21 nt, Salmonella enterica enterica serovar Typhi Ty2
gcaaaaucguuaaccagcggc

SEQ ID NO: 3705622 - RNA, 15 nt, Salmonella enterica enterica serovar Typhi Ty2
gcaaacaacccggcu

SEQ ID NO: 3705623 - RNA, 16 nt, Salmonella enterica enterica serovar Typhi Ty2
gcaaacaccucagcca

SEQ ID NO: 3705624 - RNA, 13 nt, Salmonella enterica enterica serovar Typhi Ty2
gcaaacagcacgc

SEQ ID NO: 3705625 - RNA, 21 nt, Salmonella enterica enterica serovar Typhi Ty2
gcaaacagcacgcccugccau

SEQ ID NO: 3705626 - RNA, 14 nt, Salmonella enterica enterica serovar Typhi Ty2
gcaaacagcuucau

SEQ ID NO: 3705627 - RNA, 16 nt, Salmonella enterica enterica serovar Typhi Ty2
gcaaacaguacgcccg

SEQ ID NO: 3705628 - RNA, 22 nt, Salmonella enterica enterica serovar Typhi Ty2
gcaaacagugggaagcacaucc

SEQ ID NO: 3705629 - RNA, 22 nt, Salmonella enterica enterica serovar Typhi Ty2
gcaaaccaucgucggacaacgu

SEQ ID NO: 3705630 - RNA, 21 nt, Salmonella enterica enterica serovar Typhi Ty2
gcaaaccaugauaauaaucau

SEQ ID NO: 3705631 - RNA, 12 nt, Salmonella enterica enterica serovar Typhi Ty2
gcaaacccucau

SEQ ID NO: 3705632 - RNA, 18 nt, Salmonella enterica enterica serovar Typhi Ty2
gcaaaccggcaugaagac

SEQ ID NO: 3705633 - RNA, 20 nt, Salmonella enterica enterica serovar Typhi Ty2
gcaaaccggguaacaacauu

SEQ ID NO: 3705634 - RNA, 15 nt, Salmonella enterica enterica serovar Typhi Ty2
gcaaaccuuccgcca

SEQ ID NO: 3705635 - RNA, 15 nt, Salmonella enterica enterica serovar Typhi Ty2
gcaaacgacgcugac

SEQ ID NO: 3705636 - RNA, 18 nt, Salmonella enterica enterica serovar Typhi Ty2
gcaaacgauaaaagcucu

SEQ ID NO: 3705637 - RNA, 14 nt, Salmonella enterica enterica serovar Typhi Ty2
gcaaacgccauagc

SEQ ID NO: 3705638 - RNA, 21 nt, Salmonella enterica enterica serovar Typhi Ty2
gcaaacgccgaagccagcgca

SEQ ID NO: 3705639 - RNA, 14 nt, Salmonella enterica enterica serovar Typhi Ty2
gcaaacgccgccug

SEQ ID NO: 3705640 - RNA, 20 nt, Salmonella enterica enterica serovar Typhi Ty2
gcaaacggcacuacagcccu

SEQ ID NO: 3705641 - RNA, 15 nt, Salmonella enterica enterica serovar Typhi Ty2
gcaaacggcuggaua

SEQ ID NO: 3705642 - RNA, 23 nt, Salmonella enterica enterica serovar Typhi Ty2
gcaaacgguaaacgugccacagu

SEQ ID NO: 3705643 - RNA, 13 nt, Salmonella enterica enterica serovar Typhi Ty2
gcaaacgguuaau

SEQ ID NO: 3705644 - RNA, 16 nt, Salmonella enterica enterica serovar Typhi Ty2
gcaaacgguuaauacu

SEQ ID NO: 3705645 - RNA, 18 nt, Salmonella enterica enterica serovar Typhi Ty2
gcaaacgguuaauacuga

SEQ ID NO: 3705646 - RNA, 16 nt, Salmonella enterica enterica serovar Typhi Ty2
gcaaacuauguacgcc

SEQ ID NO: 3705647 - RNA, 15 nt, Salmonella enterica enterica serovar Typhi Ty2
gcaaacucagcggcu

SEQ ID NO: 3705648 - RNA, 15 nt, Salmonella enterica enterica serovar Typhi Ty2
gcaaacugaucgagg

SEQ ID NO: 3705649 - RNA, 15 nt, Salmonella enterica enterica serovar Typhi Ty2
gcaaacugccaggca

SEQ ID NO: 3705650 - RNA, 21 nt, Salmonella enterica enterica serovar Typhi Ty2
gcaaacugcucauuauggacg

SEQ ID NO: 3705651 - RNA, 22 nt, Salmonella enterica enterica serovar Typhi Ty2
gcaaacuguauccguaauauga

SEQ ID NO: 3705652 - RNA, 14 nt, Salmonella enterica enterica serovar Typhi Ty2
gcaaacuuugcgcc

SEQ ID NO: 3705653 - RNA, 22 nt, Salmonella enterica enterica serovar Typhi Ty2
gcaaacuuugcgccauuucaau

SEQ ID NO: 3705654 - RNA, 16 nt, Salmonella enterica enterica serovar Typhi Ty2
gcaaagacaggugacc

SEQ ID NO: 3705655 - RNA, 22 nt, Salmonella enterica enterica serovar Typhi Ty2
gcaaagaccgcgucauuaugca

SEQ ID NO: 3705656 - RNA, 18 nt, Salmonella enterica enterica serovar Typhi Ty2
gcaaagccaucaauccau

SEQ ID NO: 3705657 - RNA, 16 nt, Salmonella enterica enterica serovar Typhi Ty2
gcaaagcccacgcccu

SEQ ID NO: 3705658 - RNA, 19 nt, Salmonella enterica enterica serovar Typhi Ty2
gcaaagcccacgcccugca

SEQ ID NO: 3705659 - RNA, 18 nt, Salmonella enterica enterica serovar Typhi Ty2
gcaaagcccaucagcgcc

SEQ ID NO: 3705660 - RNA, 20 nt, Salmonella enterica enterica serovar Typhi Ty2
gcaaagccgccguagcguuu

SEQ ID NO: 3705661 - RNA, 17 nt, Salmonella enterica enterica serovar Typhi Ty2
gcaaagcgacgcgcggu

SEQ ID NO: 3705662 - RNA, 18 nt, Salmonella enterica enterica serovar Typhi Ty2
gcaaagcucaacgcaggc

SEQ ID NO: 3705663 - RNA, 18 nt, Salmonella enterica enterica serovar Typhi Ty2
gcaaaggaaugcuuuaca

SEQ ID NO: 3705664 - RNA, 20 nt, Salmonella enterica enterica serovar Typhi Ty2
gcaaaggaccaacaccagcc

SEQ ID NO: 3705665 - RNA, 16 nt, Salmonella enterica enterica serovar Typhi Ty2
gcaaagguugccgcaa

SEQ ID NO: 3705666 - RNA, 17 nt, Salmonella enterica enterica serovar Typhi Ty2
gcaaagguugccgcaau

SEQ ID NO: 3705667 - RNA, 22 nt, Salmonella enterica enterica serovar Typhi Ty2
gcaaagucgaacgacugaguau

SEQ ID NO: 3705668 - RNA, 20 nt, Salmonella enterica enterica serovar Typhi Ty2
gcaaagucuuuuguauugcg

SEQ ID NO: 3705669 - RNA, 15 nt, Salmonella enterica enterica serovar Typhi Ty2
gcaaauaccacauca

SEQ ID NO: 3705670 - RNA, 19 nt, Salmonella enterica enterica serovar Typhi Ty2
gcaaauaccacaucagacc

SEQ ID NO: 3705671 - RNA, 19 nt, Salmonella enterica enterica serovar Typhi Ty2
gcaaauacugcuuuuccgg

SEQ ID NO: 3705672 - RNA, 17 nt, Salmonella enterica enterica serovar Typhi Ty2
gcaaauacuggaaaaaa

SEQ ID NO: 3705673 - RNA, 19 nt, Salmonella enterica enterica serovar Typhi Ty2
gcaaauagguuuuaugcau

SEQ ID NO: 3705674 - RNA, 15 nt, Salmonella enterica enterica serovar Typhi Ty2
gcaaaucaacauuau

SEQ ID NO: 3705675 - RNA, 13 nt, Salmonella enterica enterica serovar Typhi Ty2
gcaaaucaccaca

SEQ ID NO: 3705676 - RNA, 22 nt, Salmonella enterica enterica serovar Typhi Ty2
gcaaauccuccauaaauaacau

SEQ ID NO: 3705677 - RNA, 20 nt, Salmonella enterica enterica serovar Typhi Ty2
gcaaaucgcccaucacaugu

SEQ ID NO: 3705678 - RNA, 19 nt, Salmonella enterica enterica serovar Typhi Ty2
gcaaaucugccgucaucga

SEQ ID NO: 3705679 - RNA, 22 nt, Salmonella enterica enterica serovar Typhi Ty2
gcaaaucugccgucaucgacuu

SEQ ID NO: 3705680 - RNA, 17 nt, Salmonella enterica enterica serovar Typhi Ty2
gcaaaugauaauaugcu

SEQ ID NO: 3705681 - RNA, 21 nt, Salmonella enterica enterica serovar Typhi Ty2
gcaaaugauuaucuccaucuu

SEQ ID NO: 3705682 - RNA, 16 nt, Salmonella enterica enterica serovar Typhi Ty2
gcaaaugccaucccau

SEQ ID NO: 3705683 - RNA, 22 nt, Salmonella enterica enterica serovar Typhi Ty2
gcaaaugucagaucguaugcgc

SEQ ID NO: 3705684 - RNA, 19 nt, Salmonella enterica enterica serovar Typhi Ty2
gcaaauucgucgccgccaa

SEQ ID NO: 3705685 - RNA, 19 nt, Salmonella enterica enterica serovar Typhi Ty2
gcaaauugagaccauccug

SEQ ID NO: 3705686 - RNA, 15 nt, Salmonella enterica enterica serovar Typhi Ty2
gcaaauuuaagccag

SEQ ID NO: 3705687 - RNA, 22 nt, Salmonella enterica enterica serovar Typhi Ty2
gcaacaaacauaagcaaauccu

SEQ ID NO: 3705688 - RNA, 20 nt, Salmonella enterica enterica serovar Typhi Ty2
gcaacaacaaacacaaucac

SEQ ID NO: 3705689 - RNA, 11 nt, Salmonella enterica enterica serovar Typhi Ty2
gcaacaacagu

SEQ ID NO: 3705690 - RNA, 21 nt, Salmonella enterica enterica serovar Typhi Ty2
gcaacaacaguugcagcaccu

SEQ ID NO: 3705691 - RNA, 14 nt, Salmonella enterica enterica serovar Typhi Ty2
gcaacacagccagc

SEQ ID NO: 3705692 - RNA, 21 nt, Salmonella enterica enterica serovar Typhi Ty2
gcaacacgacaaaagcaucaa

SEQ ID NO: 3705693 - RNA, 21 nt, Salmonella enterica enterica serovar Typhi Ty2
gcaacacuuugcgcugcgcau

SEQ ID NO: 3705694 - RNA, 18 nt, Salmonella enterica enterica serovar Typhi Ty2
gcaacagcaagucgcggg

SEQ ID NO: 3705695 - RNA, 19 nt, Salmonella enterica enterica serovar Typhi Ty2
gcaaggaaaaccaguaacg

SEQ ID NO: 3705696 - RNA, 18 nt, Salmonella enterica enterica serovar Typhi Ty2
gcaaggaaauauuaauua

SEQ ID NO: 3705697 - RNA, 20 nt, Salmonella enterica enterica serovar Typhi Ty2
gcaaggaacaguagaggggg

SEQ ID NO: 3705698 - RNA, 14 nt, Salmonella enterica enterica serovar Typhi Ty2
gcaaggacgccagu

SEQ ID NO: 3705699 - RNA, 21 nt, Salmonella enterica enterica serovar Typhi Ty2
gcaaggagacgcccgucacca

SEQ ID NO: 3705700 - RNA, 13 nt, Salmonella enterica enterica serovar Typhi Ty2
gcaaggccgagcg

SEQ ID NO: 3705701 - RNA, 13 nt, Salmonella enterica enterica serovar Typhi Ty2
gcaaguaugaaaa

SEQ ID NO: 3705702 - RNA, 16 nt, Salmonella enterica enterica serovar Typhi Ty2
gcaaguauuggcugcc

SEQ ID NO: 3705703 - RNA, 18 nt, Salmonella enterica enterica serovar Typhi Ty2
gcaagucgcgggcgcuaa

SEQ ID NO: 3705704 - RNA, 19 nt, Salmonella enterica enterica serovar Typhi Ty2
gcaagucgcgggcgcuaaa

SEQ ID NO: 3705705 - RNA, 22 nt, Salmonella enterica enterica serovar Typhi Ty2
gcaauaacaccggcggcgccau

SEQ ID NO: 3705706 - RNA, 21 nt, Salmonella enterica enterica serovar Typhi Ty2
gcaauaaguucaaacucauua

SEQ ID NO: 3705707 - RNA, 15 nt, Salmonella enterica enterica serovar Typhi Ty2
gcaauaccacgcccg

SEQ ID NO: 3705708 - RNA, 23 nt, Salmonella enterica enterica serovar Typhi Ty2
gcaauaccacgcccgccgccagc

SEQ ID NO: 3705709 - RNA, 17 nt, Salmonella enterica enterica serovar Typhi Ty2
gcaauacuggaccccag

SEQ ID NO: 3705710 - RNA, 15 nt, Salmonella enterica enterica serovar Typhi Ty2
gcaauacuguaagcc

SEQ ID NO: 3705711 - RNA, 22 nt, Salmonella enterica enterica serovar Typhi Ty2
gcaauagaauaggaaauaauua

SEQ ID NO: 3705712 - RNA, 14 nt, Salmonella enterica enterica serovar Typhi Ty2
gcaauagaguaaug

SEQ ID NO: 3705713 - RNA, 15 nt, Salmonella enterica enterica serovar Typhi Ty2
gcaauagaguaauga

SEQ ID NO: 3705714 - RNA, 17 nt, Salmonella enterica enterica serovar Typhi Ty2
gcaauagccaauaacgu

SEQ ID NO: 3705715 - RNA, 15 nt, Salmonella enterica enterica serovar Typhi Ty2
gcaauagcgcgucgu

SEQ ID NO: 3705716 - RNA, 16 nt, Salmonella enterica enterica serovar Typhi Ty2
gcaauauaaauaucau

SEQ ID NO: 3705717 - RNA, 13 nt, Salmonella enterica enterica serovar Typhi Ty2
gcaauauccuccg

SEQ ID NO: 3705718 - RNA, 14 nt, Salmonella enterica enterica serovar Typhi Ty2
gcaauaugcggcgc

SEQ ID NO: 3705719 - RNA, 19 nt, Salmonella enterica enterica serovar Typhi Ty2
gcaauaugucuuaaacagc

SEQ ID NO: 3705720 - RNA, 19 nt, Salmonella enterica enterica serovar Typhi Ty2
gcaauauguuuaaagaaga

SEQ ID NO: 3705721 - RNA, 20 nt, Salmonella enterica enterica serovar Typhi Ty2
gcaauauuaaugucaugcgc

SEQ ID NO: 3705722 - RNA, 14 nt, Salmonella enterica enterica serovar Typhi Ty2
gcaauauugccgca

SEQ ID NO: 3705723 - RNA, 18 nt, Salmonella enterica enterica serovar Typhi Ty2
gcaauauugccgcacggu

SEQ ID NO: 3705724 - RNA, 14 nt, Salmonella enterica enterica serovar Typhi Ty2
gcaaucacacuaca

SEQ ID NO: 3705725 - RNA, 16 nt, Salmonella enterica enterica serovar Typhi Ty2
gcaaucacauacagca

SEQ ID NO: 3705726 - RNA, 22 nt, Salmonella enterica enterica serovar Typhi Ty2
gcaaucacguuuugcagcgcca

SEQ ID NO: 3705727 - RNA, 12 nt, Salmonella enterica enterica serovar Typhi Ty2
gcaaucacuuca

SEQ ID NO: 3705728 - RNA, 20 nt, Salmonella enterica enterica serovar Typhi Ty2
gcaaucaguacgcgcgcggc

SEQ ID NO: 3705729 - RNA, 18 nt, Salmonella enterica enterica serovar Typhi Ty2
gcaaucaguggcggcaaa

SEQ ID NO: 3705730 - RNA, 18 nt, Salmonella enterica enterica serovar Typhi Ty2
gcaaucauccugauuuua

SEQ ID NO: 3705731 - RNA, 22 nt, Salmonella enterica enterica serovar Typhi Ty2
gcaaucauccugauuuuacuga

SEQ ID NO: 3705732 - RNA, 11 nt, Salmonella enterica enterica serovar Typhi Ty2
gcaauccgcgc

SEQ ID NO: 3705733 - RNA, 14 nt, Salmonella enterica enterica serovar Typhi Ty2
gcaaucgagaucag

SEQ ID NO: 3705734 - RNA, 16 nt, Salmonella enterica enterica serovar Typhi Ty2
gcaaucgcgguaugcg

SEQ ID NO: 3705735 - RNA, 22 nt, Salmonella enterica enterica serovar Typhi Ty2
gcaaucgguaaaggucgccgca

SEQ ID NO: 3705736 - RNA, 18 nt, Salmonella enterica enterica serovar Typhi Ty2
gcaaucucuggccaggca

SEQ ID NO: 3705737 - RNA, 12 nt, Salmonella enterica enterica serovar Typhi Ty2
gcaaucucuuua

SEQ ID NO: 3705738 - RNA, 20 nt, Salmonella enterica enterica serovar Typhi Ty2
gcaaucucuuuauugcuggu

SEQ ID NO: 3705739 - RNA, 11 nt, Salmonella enterica enterica serovar Typhi Ty2
gcaaucuggcg

SEQ ID NO: 3705740 - RNA, 17 nt, Salmonella enterica enterica serovar Typhi Ty2
gcaaucuggcgcaaugc

SEQ ID NO: 3705741 - RNA, 20 nt, Salmonella enterica enterica serovar Typhi Ty2
gcaaucuuuacccggcgcaa

SEQ ID NO: 3705742 - RNA, 22 nt, Salmonella enterica enterica serovar Typhi Ty2
gcaaucuuuacccggcgcaaac

SEQ ID NO: 3705743 - RNA, 17 nt, Salmonella enterica enterica serovar Typhi Ty2
gcaaugauaacggcgcc

SEQ ID NO: 3705744 - RNA, 16 nt, Salmonella enterica enterica serovar Typhi Ty2
gcaaugaucagcgacg

SEQ ID NO: 3705745 - RNA, 15 nt, Salmonella enterica enterica serovar Typhi Ty2
gcaaugccaccacac

SEQ ID NO: 3705746 - RNA, 21 nt, Salmonella enterica enterica serovar Typhi Ty2
gcaaugccauauuuaccuuuu

SEQ ID NO: 3705747 - RNA, 16 nt, Salmonella enterica enterica serovar Typhi Ty2
gcaaugcccacgccgu

SEQ ID NO: 3705748 - RNA, 20 nt, Salmonella enterica enterica serovar Typhi Ty2
gcaaugcccccucggcagca

SEQ ID NO: 3705749 - RNA, 15 nt, Salmonella enterica enterica serovar Typhi Ty2
gcaaugccccgccgc

SEQ ID NO: 3705750 - RNA, 17 nt, Salmonella enterica enterica serovar Typhi Ty2
gcaaugccgccugcggu

SEQ ID NO: 3705751 - RNA, 19 nt, Salmonella enterica enterica serovar Typhi Ty2
gcaaugcgaauaacaucau

SEQ ID NO: 3705752 - RNA, 20 nt, Salmonella enterica enterica serovar Typhi Ty2
gcaaugcgcuuuuuuugccc

SEQ ID NO: 3705753 - RNA, 21 nt, Salmonella enterica enterica serovar Typhi Ty2
gcaaugcgcuuuuuuugcccu

SEQ ID NO: 3705754 - RNA, 23 nt, Salmonella enterica enterica serovar Typhi Ty2
gcaaugcugacgacauucagcac

SEQ ID NO: 3705755 - RNA, 18 nt, Salmonella enterica enterica serovar Typhi Ty2
gcaauggccgcagcgcca

SEQ ID NO: 3705756 - RNA, 17 nt, Salmonella enterica enterica serovar Typhi Ty2
gcaaugucugccucggg

SEQ ID NO: 3705757 - RNA, 16 nt, Salmonella enterica enterica serovar Typhi Ty2
gcaauguggacaauca

SEQ ID NO: 3705758 - RNA, 20 nt, Salmonella enterica enterica serovar Typhi Ty2
gcaauguggacaaucaggcu

SEQ ID NO: 3705759 - RNA, 16 nt, Salmonella enterica enterica serovar Typhi Ty2
gcaauguucaauauca

SEQ ID NO: 3705760 - RNA, 18 nt, Salmonella enterica enterica serovar Typhi Ty2
gcaauguucaauaucaaa

SEQ ID NO: 3705761 - RNA, 20 nt, Salmonella enterica enterica serovar Typhi Ty2
gcaauguucaauaucaaauu

SEQ ID NO: 3705762 - RNA, 17 nt, Salmonella enterica enterica serovar Typhi Ty2
gcaauguuccccugaug

SEQ ID NO: 3705763 - RNA, 23 nt, Salmonella enterica enterica serovar Typhi Ty2
gcaauuaauaaacaaugcaggua

SEQ ID NO: 3705764 - RNA, 15 nt, Salmonella enterica enterica serovar Typhi Ty2
gcaauuaccgccagc

SEQ ID NO: 3705765 - RNA, 21 nt, Salmonella enterica enterica serovar Typhi Ty2
gcaauuauauugcguaaaaac

SEQ ID NO: 3705766 - RNA, 22 nt, Salmonella enterica enterica serovar Typhi Ty2
gcaauucagguaauacgcgucu

SEQ ID NO: 3705767 - RNA, 23 nt, Salmonella enterica enterica serovar Typhi Ty2
gcaauuccgcuuucuucccggca

SEQ ID NO: 3705768 - RNA, 21 nt, Salmonella enterica enterica serovar Typhi Ty2
gcaauuccggcgaaaaaccga

SEQ ID NO: 3705769 - RNA, 17 nt, Salmonella enterica enterica serovar Typhi Ty2
gcaauuccggucaucgc

SEQ ID NO: 3705770 - RNA, 15 nt, Salmonella enterica enterica serovar Typhi Ty2
gcaauuccugacugc

SEQ ID NO: 3705771 - RNA, 23 nt, Salmonella enterica enterica serovar Typhi Ty2
gcaauucgagauuuuucugcgcc

SEQ ID NO: 3705772 - RNA, 17 nt, Salmonella enterica enterica serovar Typhi Ty2
gcaauugauacauuuuu

SEQ ID NO: 3705773 - RNA, 17 nt, Salmonella enterica enterica serovar Typhi Ty2
gcaauugccgauaucaa

SEQ ID NO: 3705774 - RNA, 18 nt, Salmonella enterica enterica serovar Typhi Ty2
gcaauugguaauuaaagg

SEQ ID NO: 3705775 - RNA, 17 nt, Salmonella enterica enterica serovar Typhi Ty2
gcaauuguuccugcguc

SEQ ID NO: 3705776 - RNA, 18 nt, Salmonella enterica enterica serovar Typhi Ty2
gcaauuuaccuauuucga

SEQ ID NO: 3705777 - RNA, 22 nt, Salmonella enterica enterica serovar Typhi Ty2
gcacccaccaucacuuccaucc

SEQ ID NO: 3705778 - RNA, 15 nt, Salmonella enterica enterica serovar Typhi Ty2
gcacccggagagaaa

SEQ ID NO: 3705779 - RNA, 16 nt, Salmonella enterica enterica serovar Typhi Ty2
gcacccggagagaaac

SEQ ID NO: 3705780 - RNA, 18 nt, Salmonella enterica enterica serovar Typhi Ty2
gcacccuucgcuauccau

SEQ ID NO: 3705781 - RNA, 16 nt, Salmonella enterica enterica serovar Typhi Ty2
gcaccgaaacagcacg

SEQ ID NO: 3705782 - RNA, 20 nt, Salmonella enterica enterica serovar Typhi Ty2
gcaccgccaaacgcggucag

SEQ ID NO: 3705783 - RNA, 20 nt, Salmonella enterica enterica serovar Typhi Ty2
gcaccgcgaccaguucaccg

SEQ ID NO: 3705784 - RNA, 16 nt, Salmonella enterica enterica serovar Typhi Ty2
gcaccgcuaaaaaaca

SEQ ID NO: 3705785 - RNA, 15 nt, Salmonella enterica enterica serovar Typhi Ty2
gcaccggaacagaag

SEQ ID NO: 3705786 - RNA, 21 nt, Salmonella enterica enterica serovar Typhi Ty2
gcaccggcuguucacguacca

SEQ ID NO: 3705787 - RNA, 15 nt, Salmonella enterica enterica serovar Typhi Ty2
gcaccguaaacggcu

SEQ ID NO: 3705788 - RNA, 19 nt, Salmonella enterica enterica serovar Typhi Ty2
gcaccgucgagaaaccgcu

SEQ ID NO: 3705789 - RNA, 21 nt, Salmonella enterica enterica serovar Typhi Ty2
gcaccguuucuuugcugccgu

SEQ ID NO: 3705790 - RNA, 21 nt, Salmonella enterica enterica serovar Typhi Ty2
gcaccucagaccguuagccgg

SEQ ID NO: 3705791 - RNA, 17 nt, Salmonella enterica enterica serovar Typhi Ty2
gcaccucaucgcuaccu

SEQ ID NO: 3705792 - RNA, 21 nt, Salmonella enterica enterica serovar Typhi Ty2
gcaccucgguauguccugccg

SEQ ID NO: 3705793 - RNA, 21 nt, Salmonella enterica enterica serovar Typhi Ty2
gcaccugauagugaucgccaa

SEQ ID NO: 3705794 - RNA, 18 nt, Salmonella enterica enterica serovar Typhi Ty2
gcaccuggagcgccuccc

SEQ ID NO: 3705795 - RNA, 20 nt, Salmonella enterica enterica serovar Typhi Ty2
gcaccugggaaucgugcaau

SEQ ID NO: 3705796 - RNA, 13 nt, Salmonella enterica enterica serovar Typhi Ty2
gcaccugggcaau

SEQ ID NO: 3705797 - RNA, 22 nt, Salmonella enterica enterica serovar Typhi Ty2
gcaccuucaacagcucgccaug

SEQ ID NO: 3705798 - RNA, 14 nt, Salmonella enterica enterica serovar Typhi Ty2
gcaccuucucuccu

SEQ ID NO: 3705799 - RNA, 12 nt, Salmonella enterica enterica serovar Typhi Ty2
gcacgaaaaaua

SEQ ID NO: 3705800 - RNA, 13 nt, Salmonella enterica enterica serovar Typhi Ty2
gcacgaaauguag

SEQ ID NO: 3705801 - RNA, 22 nt, Salmonella enterica enterica serovar Typhi Ty2
gcacgaacauaccggagccugg

SEQ ID NO: 3705802 - RNA, 15 nt, Salmonella enterica enterica serovar Typhi Ty2
gcacgacacaaaagc

SEQ ID NO: 3705803 - RNA, 17 nt, Salmonella enterica enterica serovar Typhi Ty2
gcacgacacaaaagcau

SEQ ID NO: 3705804 - RNA, 13 nt, Salmonella enterica enterica serovar Typhi Ty2
gcacgacagugcu

SEQ ID NO: 3705805 - RNA, 22 nt, Salmonella enterica enterica serovar Typhi Ty2
gcacgaccuuuucuucaucgau

SEQ ID NO: 3705806 - RNA, 16 nt, Salmonella enterica enterica serovar Typhi Ty2
gcacgccacauugacc

SEQ ID NO: 3705807 - RNA, 12 nt, Salmonella enterica enterica serovar Typhi Ty2
gcacgccagggu

SEQ ID NO: 3705808 - RNA, 14 nt, Salmonella enterica enterica serovar Typhi Ty2
gcacgccaggguaa

SEQ ID NO: 3705809 - RNA, 18 nt, Salmonella enterica enterica serovar Typhi Ty2
gcacgcccauauccagcu

SEQ ID NO: 3705810 - RNA, 17 nt, Salmonella enterica enterica serovar Typhi Ty2
gcacgcccgcauucaua

SEQ ID NO: 3705811 - RNA, 21 nt, Salmonella enterica enterica serovar Typhi Ty2
gcacgcccgcauucauaagca

SEQ ID NO: 3705812 - RNA, 18 nt, Salmonella enterica enterica serovar Typhi Ty2
gcacgcccuucgucagga

SEQ ID NO: 3705813 - RNA, 15 nt, Salmonella enterica enterica serovar Typhi Ty2
gcacgccgcccgccu

SEQ ID NO: 3705814 - RNA, 14 nt, Salmonella enterica enterica serovar Typhi Ty2
gcacgccgcguuuu

SEQ ID NO: 3705815 - RNA, 21 nt, Salmonella enterica enterica serovar Typhi Ty2
gcacgcgcagcaucucaucca

SEQ ID NO: 3705816 - RNA, 19 nt, Salmonella enterica enterica serovar Typhi Ty2
gcacgcgggccaauccagc

SEQ ID NO: 3705817 - RNA, 21 nt, Salmonella enterica enterica serovar Typhi Ty2
gcacgcgggccaauccagcua

SEQ ID NO: 3705818 - RNA, 18 nt, Salmonella enterica enterica serovar Typhi Ty2
gcacgcuaaagcgcuggc

SEQ ID NO: 3705819 - RNA, 21 nt, Salmonella enterica enterica serovar Typhi Ty2
gcacgcuaaagcgcuggcggc

SEQ ID NO: 3705820 - RNA, 18 nt, Salmonella enterica enterica serovar Typhi Ty2
gcacgcuggcaucaauau

SEQ ID NO: 3705821 - RNA, 17 nt, Salmonella enterica enterica serovar Typhi Ty2
gcacgcugguagccucg

SEQ ID NO: 3705822 - RNA, 13 nt, Salmonella enterica enterica serovar Typhi Ty2
gcacgcuguuucu

SEQ ID NO: 3705823 - RNA, 17 nt, Salmonella enterica enterica serovar Typhi Ty2
gcacgcuuuuuugcugg

SEQ ID NO: 3705824 - RNA, 14 nt, Salmonella enterica enterica serovar Typhi Ty2
gcacggauacugcu

SEQ ID NO: 3705825 - RNA, 16 nt, Salmonella enterica enterica serovar Typhi Ty2
gcacggaugcaucaug

SEQ ID NO: 3705826 - RNA, 23 nt, Salmonella enterica enterica serovar Typhi Ty2
gcacgguuaaugaaaucgucgcc

SEQ ID NO: 3705827 - RNA, 23 nt, Salmonella enterica enterica serovar Typhi Ty2
gcacguaguaaugcauggucgcc

SEQ ID NO: 3705828 - RNA, 16 nt, Salmonella enterica enterica serovar Typhi Ty2
gcacguccagauacgc

SEQ ID NO: 3705829 - RNA, 15 nt, Salmonella enterica enterica serovar Typhi Ty2
gcacgucgucccagg

SEQ ID NO: 3705830 - RNA, 21 nt, Salmonella enterica enterica serovar Typhi Ty2
gcacguguguugcgucaacgc

SEQ ID NO: 3705831 - RNA, 23 nt, Salmonella enterica enterica serovar Typhi Ty2
gcacguuaaagccgaccaucgcg

SEQ ID NO: 3705832 - RNA, 15 nt, Salmonella enterica enterica serovar Typhi Ty2
gcacguuuuccaggu

SEQ ID NO: 3705833 - RNA, 20 nt, Salmonella enterica enterica serovar Typhi Ty2
gcacguuuugguccaugccg

SEQ ID NO: 3705834 - RNA, 19 nt, Salmonella enterica enterica serovar Typhi Ty2
gcacuacggauggcccugc

SEQ ID NO: 3705835 - RNA, 21 nt, Salmonella enterica enterica serovar Typhi Ty2
gcacuacggcaaacgcuggug

SEQ ID NO: 3705836 - RNA, 24 nt, Salmonella enterica enterica serovar Typhi Ty2
gcacuacgguccaguugcccucuu

SEQ ID NO: 3705837 - RNA, 13 nt, Salmonella enterica enterica serovar Typhi Ty2
gcacucaccucuu

SEQ ID NO: 3705838 - RNA, 17 nt, Salmonella enterica enterica serovar Typhi Ty2
gcacucagaaaauuauu

SEQ ID NO: 3705839 - RNA, 16 nt, Salmonella enterica enterica serovar Typhi Ty2
gcacucgcgacauggc

SEQ ID NO: 3705840 - RNA, 14 nt, Salmonella enterica enterica serovar Typhi Ty2
gcacugacuuacag

SEQ ID NO: 3705841 - RNA, 17 nt, Salmonella enterica enterica serovar Typhi Ty2
gcacugauagccgccag

SEQ ID NO: 3705842 - RNA, 19 nt, Salmonella enterica enterica serovar Typhi Ty2
gcacugcaauuucugcugg

SEQ ID NO: 3705843 - RNA, 12 nt, Salmonella enterica enterica serovar Typhi Ty2
gcacugcaccug

SEQ ID NO: 3705844 - RNA, 15 nt, Salmonella enterica enterica serovar Typhi Ty2
gcacugcaccugguc

SEQ ID NO: 3705845 - RNA, 17 nt, Salmonella enterica enterica serovar Typhi Ty2
gcacugcaccuggucga

SEQ ID NO: 3705846 - RNA, 21 nt, Salmonella enterica enterica serovar Typhi Ty2
gcacugcuuccugccgcgauc

SEQ ID NO: 3705847 - RNA, 21 nt, Salmonella enterica enterica serovar Typhi Ty2
gcacuguggugugccugcgcu

SEQ ID NO: 3705848 - RNA, 21 nt, Salmonella enterica enterica serovar Typhi Ty2
gcacuuacucuacauucuguu

SEQ ID NO: 3705849 - RNA, 19 nt, Salmonella enterica enterica serovar Typhi Ty2
gcacuucacccaucgccag

SEQ ID NO: 3705850 - RNA, 15 nt, Salmonella enterica enterica serovar Typhi Ty2
gcacuuccagccacg

SEQ ID NO: 3705851 - RNA, 17 nt, Salmonella enterica enterica serovar Typhi Ty2
gcacuuccucucccacu

SEQ ID NO: 3705852 - RNA, 18 nt, Salmonella enterica enterica serovar Typhi Ty2
gcacuuuaagcggcagcu

SEQ ID NO: 3705853 - RNA, 12 nt, Salmonella enterica enterica serovar Typhi Ty2
gcacuuucauug

SEQ ID NO: 3705854 - RNA, 16 nt, Salmonella enterica enterica serovar Typhi Ty2
gcacuuucauugccgu

SEQ ID NO: 3705855 - RNA, 15 nt, Salmonella enterica enterica serovar Typhi Ty2
gcacuuuuccagcca

SEQ ID NO: 3705856 - RNA, 15 nt, Salmonella enterica enterica serovar Typhi Ty2
gcacuuuucccgcca

SEQ ID NO: 3705857 - RNA, 16 nt, Salmonella enterica enterica serovar Typhi Ty2
gcagaaaaaucagcau

SEQ ID NO: 3705858 - RNA, 12 nt, Salmonella enterica enterica serovar Typhi Ty2
gcagaaaaccgg

SEQ ID NO: 3705859 - RNA, 17 nt, Salmonella enterica enterica serovar Typhi Ty2
gcagccaugccagcgcg

SEQ ID NO: 3705860 - RNA, 14 nt, Salmonella enterica enterica serovar Typhi Ty2
gcagccccagcgcc

SEQ ID NO: 3705861 - RNA, 23 nt, Salmonella enterica enterica serovar Typhi Ty2
gcagccccaguugguuguagcac

SEQ ID NO: 3705862 - RNA, 20 nt, Salmonella enterica enterica serovar Typhi Ty2
gcagccccauuugccgugcc

SEQ ID NO: 3705863 - RNA, 18 nt, Salmonella enterica enterica serovar Typhi Ty2
gcagccccggcauccagu

SEQ ID NO: 3705864 - RNA, 18 nt, Salmonella enterica enterica serovar Typhi Ty2
gcagcccgcccacaggcu

SEQ ID NO: 3705865 - RNA, 23 nt, Salmonella enterica enterica serovar Typhi Ty2
gcagcccugcgucgcguaccagc

SEQ ID NO: 3705866 - RNA, 23 nt, Salmonella enterica enterica serovar Typhi Ty2
gcagcccuuacgcuuuauucugu

SEQ ID NO: 3705867 - RNA, 21 nt, Salmonella enterica enterica serovar Typhi Ty2
gcagcccuuugagaaaacugc

SEQ ID NO: 3705868 - RNA, 17 nt, Salmonella enterica enterica serovar Typhi Ty2
gcagccgcucaggguaa

SEQ ID NO: 3705869 - RNA, 13 nt, Salmonella enterica enterica serovar Typhi Ty2
gcagccgcugaua

SEQ ID NO: 3705870 - RNA, 16 nt, Salmonella enterica enterica serovar Typhi Ty2
gcagccgguauccagc

SEQ ID NO: 3705871 - RNA, 18 nt, Salmonella enterica enterica serovar Typhi Ty2
gcagccgguauccagcgc

SEQ ID NO: 3705872 - RNA, 19 nt, Salmonella enterica enterica serovar Typhi Ty2
gcagccgguauccagcgcg

SEQ ID NO: 3705873 - RNA, 14 nt, Salmonella enterica enterica serovar Typhi Ty2
gcagccucguccug

SEQ ID NO: 3705874 - RNA, 13 nt, Salmonella enterica enterica serovar Typhi Ty2
gcagccugccgca

SEQ ID NO: 3705875 - RNA, 18 nt, Salmonella enterica enterica serovar Typhi Ty2
gcagcgaaagcugccuuu

SEQ ID NO: 3705876 - RNA, 15 nt, Salmonella enterica enterica serovar Typhi Ty2
gcagcgauauuucuc

SEQ ID NO: 3705877 - RNA, 16 nt, Salmonella enterica enterica serovar Typhi Ty2
gcagcgaugacagcag

SEQ ID NO: 3705878 - RNA, 16 nt, Salmonella enterica enterica serovar Typhi Ty2
gcagcgcaccugcccc

SEQ ID NO: 3705879 - RNA, 14 nt, Salmonella enterica enterica serovar Typhi Ty2
gcagcgcaucaucc

SEQ ID NO: 3705880 - RNA, 15 nt, Salmonella enterica enterica serovar Typhi Ty2
gcagcgcaucauggu

SEQ ID NO: 3705881 - RNA, 14 nt, Salmonella enterica enterica serovar Typhi Ty2
gcagcgccaucagg

SEQ ID NO: 3705882 - RNA, 13 nt, Salmonella enterica enterica serovar Typhi Ty2
gcagcgccaucca

SEQ ID NO: 3705883 - RNA, 16 nt, Salmonella enterica enterica serovar Typhi Ty2
gcagcgccauccggca

SEQ ID NO: 3705884 - RNA, 21 nt, Salmonella enterica enterica serovar Typhi Ty2
gcagcgccauugagcauucua

SEQ ID NO: 3705885 - RNA, 13 nt, Salmonella enterica enterica serovar Typhi Ty2
gcagcgcccagca

SEQ ID NO: 3705886 - RNA, 15 nt, Salmonella enterica enterica serovar Typhi Ty2
gcagcgccccgccgc

SEQ ID NO: 3705887 - RNA, 17 nt, Salmonella enterica enterica serovar Typhi Ty2
gcagcgccccgccgcgc

SEQ ID NO: 3705888 - RNA, 17 nt, Salmonella enterica enterica serovar Typhi Ty2
gcagcgcgaacaggcug

SEQ ID NO: 3705889 - RNA, 20 nt, Salmonella enterica enterica serovar Typhi Ty2
gcagcgcgcgacccagcgca

SEQ ID NO: 3705890 - RNA, 13 nt, Salmonella enterica enterica serovar Typhi Ty2
gcagcgcggccug

SEQ ID NO: 3705891 - RNA, 19 nt, Salmonella enterica enterica serovar Typhi Ty2
gcagcgcgggaucgagcgc

SEQ ID NO: 3705892 - RNA, 14 nt, Salmonella enterica enterica serovar Typhi Ty2
gcagcgcugaaucg

SEQ ID NO: 3705893 - RNA, 18 nt, Salmonella enterica enterica serovar Typhi Ty2
gcagcgcugagucauccu

SEQ ID NO: 3705894 - RNA, 13 nt, Salmonella enterica enterica serovar Typhi Ty2
gcagcggcaguga

SEQ ID NO: 3705895 - RNA, 11 nt, Salmonella enterica enterica serovar Typhi Ty2
gcagcggcggu

SEQ ID NO: 3705896 - RNA, 17 nt, Salmonella enterica enterica serovar Typhi Ty2
gcagcggcgguuauccg

SEQ ID NO: 3705897 - RNA, 20 nt, Salmonella enterica enterica serovar Typhi Ty2
gcagcggcgguuauccgcca

SEQ ID NO: 3705898 - RNA, 21 nt, Salmonella enterica enterica serovar Typhi Ty2
gcagcggcguaucuuccagcg

SEQ ID NO: 3705899 - RNA, 15 nt, Salmonella enterica enterica serovar Typhi Ty2
gcagcggcugcgccu

SEQ ID NO: 3705900 - RNA, 14 nt, Salmonella enterica enterica serovar Typhi Ty2
gcagcggucaucaa

SEQ ID NO: 3705901 - RNA, 19 nt, Salmonella enterica enterica serovar Typhi Ty2
gcagcguaauacaggcgau

SEQ ID NO: 3705902 - RNA, 15 nt, Salmonella enterica enterica serovar Typhi Ty2
gcagcgucggcuuca

SEQ ID NO: 3705903 - RNA, 20 nt, Salmonella enterica enterica serovar Typhi Ty2
gcagcgugaaacgcccuucc

SEQ ID NO: 3705904 - RNA, 23 nt, Salmonella enterica enterica serovar Typhi Ty2
gcagcguuugacggauuuuuuuc

SEQ ID NO: 3705905 - RNA, 20 nt, Salmonella enterica enterica serovar Typhi Ty2
gcagcucaagcgccgcgaua

SEQ ID NO: 3705906 - RNA, 14 nt, Salmonella enterica enterica serovar Typhi Ty2
gcagcucaucaaua

SEQ ID NO: 3705907 - RNA, 23 nt, Salmonella enterica enterica serovar Typhi Ty2
gcagcuccuuuuaauaaagaaag

SEQ ID NO: 3705908 - RNA, 16 nt, Salmonella enterica enterica serovar Typhi Ty2
gcagcugccacaccac

SEQ ID NO: 3705909 - RNA, 20 nt, Salmonella enterica enterica serovar Typhi Ty2
gcagcugcuuaacuucugca

SEQ ID NO: 3705910 - RNA, 12 nt, Salmonella enterica enterica serovar Typhi Ty2
gcagcugggccu

SEQ ID NO: 3705911 - RNA, 13 nt, Salmonella enterica enterica serovar Typhi Ty2
gcagcugggccug

SEQ ID NO: 3705912 - RNA, 16 nt, Salmonella enterica enterica serovar Typhi Ty2
gcagcugggccugcuc

SEQ ID NO: 3705913 - RNA, 15 nt, Salmonella enterica enterica serovar Typhi Ty2
gcagcuucagcauca

SEQ ID NO: 3705914 - RNA, 13 nt, Salmonella enterica enterica serovar Typhi Ty2
gcagcuucagcca

SEQ ID NO: 3705915 - RNA, 16 nt, Salmonella enterica enterica serovar Typhi Ty2
gcagcuucagccaguc

SEQ ID NO: 3705916 - RNA, 22 nt, Salmonella enterica enterica serovar Typhi Ty2
gcagcuucgccgcguaaucuuc

SEQ ID NO: 3705917 - RNA, 15 nt, Salmonella enterica enterica serovar Typhi Ty2
gcagcuucugauacu

SEQ ID NO: 3705918 - RNA, 17 nt, Salmonella enterica enterica serovar Typhi Ty2
gcagcuugcaggcaaaa

SEQ ID NO: 3705919 - RNA, 15 nt, Salmonella enterica enterica serovar Typhi Ty2
gcagcuuggcggcuu

SEQ ID NO: 3705920 - RNA, 18 nt, Salmonella enterica enterica serovar Typhi Ty2
gcagcuuggcggcuuccu

SEQ ID NO: 3705921 - RNA, 17 nt, Salmonella enterica enterica serovar Typhi Ty2
gcagcuuuugccugcgu

SEQ ID NO: 3705922 - RNA, 24 nt, Salmonella enterica enterica serovar Typhi Ty2
gcaggaaggaauuaugcagacgcu

SEQ ID NO: 3705923 - RNA, 15 nt, Salmonella enterica enterica serovar Typhi Ty2
gcaggaaggcgugca

SEQ ID NO: 3705924 - RNA, 14 nt, Salmonella enterica enterica serovar Typhi Ty2
gcaggacagcgaca

SEQ ID NO: 3705925 - RNA, 12 nt, Salmonella enterica enterica serovar Typhi Ty2
gcaggacccgag

SEQ ID NO: 3705926 - RNA, 19 nt, Salmonella enterica enterica serovar Typhi Ty2
gcaggagagccagaagaau

SEQ ID NO: 3705927 - RNA, 16 nt, Salmonella enterica enterica serovar Typhi Ty2
gcaggaugcgcugcgc

SEQ ID NO: 3705928 - RNA, 23 nt, Salmonella enterica enterica serovar Typhi Ty2
gcaggaugucgauaauacagccu

SEQ ID NO: 3705929 - RNA, 19 nt, Salmonella enterica enterica serovar Typhi Ty2
gcaggcaaaacgggcggcg

SEQ ID NO: 3705930 - RNA, 21 nt, Salmonella enterica enterica serovar Typhi Ty2
gcaggcaaaacgggcggcggc

SEQ ID NO: 3705931 - RNA, 13 nt, Salmonella enterica enterica serovar Typhi Ty2
gcaggcaaaucaa

SEQ ID NO: 3705932 - RNA, 17 nt, Salmonella enterica enterica serovar Typhi Ty2
gcaggcaggucuccagc

SEQ ID NO: 3705933 - RNA, 17 nt, Salmonella enterica enterica serovar Typhi Ty2
gcaggcauuaaaaaaac

SEQ ID NO: 3705934 - RNA, 18 nt, Salmonella enterica enterica serovar Typhi Ty2
gcaggcauuaaaaaaacg

SEQ ID NO: 3705935 - RNA, 17 nt, Salmonella enterica enterica serovar Typhi Ty2
gcaggccaaacagcggc

SEQ ID NO: 3705936 - RNA, 15 nt, Salmonella enterica enterica serovar Typhi Ty2
gcaggccggagcuga

SEQ ID NO: 3705937 - RNA, 20 nt, Salmonella enterica enterica serovar Typhi Ty2
gcaggccggauaaggcauuu

SEQ ID NO: 3705938 - RNA, 18 nt, Salmonella enterica enterica serovar Typhi Ty2
gcaggccuggcuggauga

SEQ ID NO: 3705939 - RNA, 22 nt, Salmonella enterica enterica serovar Typhi Ty2
gcaggcgaaaccggccgccauc

SEQ ID NO: 3705940 - RNA, 15 nt, Salmonella enterica enterica serovar Typhi Ty2
gcaggcgacuggcgu

SEQ ID NO: 3705941 - RNA, 20 nt, Salmonella enterica enterica serovar Typhi Ty2
gcauaccgugugcagugaca

SEQ ID NO: 3705942 - RNA, 14 nt, Salmonella enterica enterica serovar Typhi Ty2
gcauacgccccggu

SEQ ID NO: 3705943 - RNA, 21 nt, Salmonella enterica enterica serovar Typhi Ty2
gcauacucauuaccggcugcc

SEQ ID NO: 3705944 - RNA, 22 nt, Salmonella enterica enterica serovar Typhi Ty2
gcauacucuccuccauaccuuu

SEQ ID NO: 3705945 - RNA, 18 nt, Salmonella enterica enterica serovar Typhi Ty2
gcauacucuuggagagca

SEQ ID NO: 3705946 - RNA, 22 nt, Salmonella enterica enterica serovar Typhi Ty2
gcauacucuuggagagcaucau

SEQ ID NO: 3705947 - RNA, 14 nt, Salmonella enterica enterica serovar Typhi Ty2
gcauagaaaaagaa

SEQ ID NO: 3705948 - RNA, 16 nt, Salmonella enterica enterica serovar Typhi Ty2
gcauagacgugcggca

SEQ ID NO: 3705949 - RNA, 21 nt, Salmonella enterica enterica serovar Typhi Ty2
gcauagauaacgaugugacug

SEQ ID NO: 3705950 - RNA, 16 nt, Salmonella enterica enterica serovar Typhi Ty2
gcauagccccagcgca

SEQ ID NO: 3705951 - RNA, 19 nt, Salmonella enterica enterica serovar Typhi Ty2
gcauagccccagcgcaaac

SEQ ID NO: 3705952 - RNA, 23 nt, Salmonella enterica enterica serovar Typhi Ty2
gcauagccggauaauuuauccag

SEQ ID NO: 3705953 - RNA, 20 nt, Salmonella enterica enterica serovar Typhi Ty2
gcauagcgcgaaugauuuua

SEQ ID NO: 3705954 - RNA, 18 nt, Salmonella enterica enterica serovar Typhi Ty2
gcauagcgggagauugaa

SEQ ID NO: 3705955 - RNA, 19 nt, Salmonella enterica enterica serovar Typhi Ty2
gcauagcgucaucaacaua

SEQ ID NO: 3705956 - RNA, 18 nt, Salmonella enterica enterica serovar Typhi Ty2
gcauagcuguuccgcaac

SEQ ID NO: 3705957 - RNA, 22 nt, Salmonella enterica enterica serovar Typhi Ty2
gcauaguccugccgacaggcag

SEQ ID NO: 3705958 - RNA, 18 nt, Salmonella enterica enterica serovar Typhi Ty2
gcauauaagagacgccaa

SEQ ID NO: 3705959 - RNA, 19 nt, Salmonella enterica enterica serovar Typhi Ty2
gcauauccagcgccugcgc

SEQ ID NO: 3705960 - RNA, 13 nt, Salmonella enterica enterica serovar Typhi Ty2
gcauaucgcccug

SEQ ID NO: 3705961 - RNA, 23 nt, Salmonella enterica enterica serovar Typhi Ty2
gcauaucuggcgaggcuuugucc

SEQ ID NO: 3705962 - RNA, 22 nt, Salmonella enterica enterica serovar Typhi Ty2
gcauauugcguaucguaagcca

SEQ ID NO: 3705963 - RNA, 14 nt, Salmonella enterica enterica serovar Typhi Ty2
gcauauuuagccca

SEQ ID NO: 3705964 - RNA, 15 nt, Salmonella enterica enterica serovar Typhi Ty2
gcauauuucuaauga

SEQ ID NO: 3705965 - RNA, 16 nt, Salmonella enterica enterica serovar Typhi Ty2
gcaucaaacuuuuaaa

SEQ ID NO: 3705966 - RNA, 21 nt, Salmonella enterica enterica serovar Typhi Ty2
gcaucaaacuuuuaaauugaa

SEQ ID NO: 3705967 - RNA, 13 nt, Salmonella enterica enterica serovar Typhi Ty2
gcaucaaagccac

SEQ ID NO: 3705968 - RNA, 16 nt, Salmonella enterica enterica serovar Typhi Ty2
gcaucaaauaccuuuu

SEQ ID NO: 3705969 - RNA, 13 nt, Salmonella enterica enterica serovar Typhi Ty2
gcaucaacgccag

SEQ ID NO: 3705970 - RNA, 15 nt, Salmonella enterica enterica serovar Typhi Ty2
gcaucaacguaaaua

SEQ ID NO: 3705971 - RNA, 18 nt, Salmonella enterica enterica serovar Typhi Ty2
gcaucaaugcccagcgca

SEQ ID NO: 3705972 - RNA, 15 nt, Salmonella enterica enterica serovar Typhi Ty2
gcaucaauggcguca

SEQ ID NO: 3705973 - RNA, 14 nt, Salmonella enterica enterica serovar Typhi Ty2
gcaucacaugcggg

SEQ ID NO: 3705974 - RNA, 15 nt, Salmonella enterica enterica serovar Typhi Ty2
gcaucacggcagcac

SEQ ID NO: 3705975 - RNA, 13 nt, Salmonella enterica enterica serovar Typhi Ty2
gcaucagaaaaac

SEQ ID NO: 3705976 - RNA, 14 nt, Salmonella enterica enterica serovar Typhi Ty2
gcaucagaaaaacc

SEQ ID NO: 3705977 - RNA, 15 nt, Salmonella enterica enterica serovar Typhi Ty2
gcaucagaaaaaccu

SEQ ID NO: 3705978 - RNA, 22 nt, Salmonella enterica enterica serovar Typhi Ty2
gcaucagaaaaaccuccggcua

SEQ ID NO: 3705979 - RNA, 15 nt, Salmonella enterica enterica serovar Typhi Ty2
gcaucagacgguggc

SEQ ID NO: 3705980 - RNA, 20 nt, Salmonella enterica enterica serovar Typhi Ty2
gcaucagcaauuucucgccc

SEQ ID NO: 3705981 - RNA, 18 nt, Salmonella enterica enterica serovar Typhi Ty2
gcaucaggaaauccugga

SEQ ID NO: 3705982 - RNA, 20 nt, Salmonella enterica enterica serovar Typhi Ty2
gcaucaggacauggucacca

SEQ ID NO: 3705983 - RNA, 17 nt, Salmonella enterica enterica serovar Typhi Ty2
gcaucaggaucuucauc

SEQ ID NO: 3705984 - RNA, 13 nt, Salmonella enterica enterica serovar Typhi Ty2
gcaucauaaaagg

SEQ ID NO: 3705985 - RNA, 23 nt, Salmonella enterica enterica serovar Typhi Ty2
gcaucauauaaccacgaaaauua

SEQ ID NO: 3705986 - RNA, 11 nt, Salmonella enterica enterica serovar Typhi Ty2
gcaucaucaaa

SEQ ID NO: 3705987 - RNA, 17 nt, Salmonella enterica enterica serovar Typhi Ty2
gcaucaucucccaggcc

SEQ ID NO: 3705988 - RNA, 21 nt, Salmonella enterica enterica serovar Typhi Ty2
gcaucaucucccaggccgcca

SEQ ID NO: 3705989 - RNA, 22 nt, Salmonella enterica enterica serovar Typhi Ty2
gcaucaucucccaggccgccac

SEQ ID NO: 3705990 - RNA, 19 nt, Salmonella enterica enterica serovar Typhi Ty2
gcaucaugcuaaaagcgac

SEQ ID NO: 3705991 - RNA, 22 nt, Salmonella enterica enterica serovar Typhi Ty2
gcaucaugggcucaucaaacag

SEQ ID NO: 3705992 - RNA, 15 nt, Salmonella enterica enterica serovar Typhi Ty2
gcaucauucaucucg

SEQ ID NO: 3705993 - RNA, 15 nt, Salmonella enterica enterica serovar Typhi Ty2
gcaucauucugcagg

SEQ ID NO: 3705994 - RNA, 15 nt, Salmonella enterica enterica serovar Typhi Ty2
gcauccagcacgagc

SEQ ID NO: 3705995 - RNA, 17 nt, Salmonella enterica enterica serovar Typhi Ty2
gcauccagcacgagcgc

SEQ ID NO: 3705996 - RNA, 15 nt, Salmonella enterica enterica serovar Typhi Ty2
gcauccaguuucuuc

SEQ ID NO: 3705997 - RNA, 21 nt, Salmonella enterica enterica serovar Typhi Ty2
gcauccauauaagcgguauuc

SEQ ID NO: 3705998 - RNA, 21 nt, Salmonella enterica enterica serovar Typhi Ty2
gcaucccgcuggcgccaccgc

SEQ ID NO: 3705999 - RNA, 11 nt, Salmonella enterica enterica serovar Typhi Ty2
gcaucccggca

SEQ ID NO: 3706000 - RNA, 20 nt, Salmonella enterica enterica serovar Typhi Ty2
gcaucccggugucaaagcgc

SEQ ID NO: 3706001 - RNA, 13 nt, Salmonella enterica enterica serovar Typhi Ty2
gcaucccguuaug

SEQ ID NO: 3706002 - RNA, 14 nt, Salmonella enterica enterica serovar Typhi Ty2
gcauccgccgccgc

SEQ ID NO: 3706003 - RNA, 23 nt, Salmonella enterica enterica serovar Typhi Ty2
gcauccgcggcgcuuugcuucuc

SEQ ID NO: 3706004 - RNA, 15 nt, Salmonella enterica enterica serovar Typhi Ty2
gcauccggacgccag

SEQ ID NO: 3706005 - RNA, 16 nt, Salmonella enterica enterica serovar Typhi Ty2
gcauccggcaauucaa

SEQ ID NO: 3706006 - RNA, 16 nt, Salmonella enterica enterica serovar Typhi Ty2
gcauccggccagcgac

SEQ ID NO: 3706007 - RNA, 17 nt, Salmonella enterica enterica serovar Typhi Ty2
gcauccggcccgugcca

SEQ ID NO: 3706008 - RNA, 18 nt, Salmonella enterica enterica serovar Typhi Ty2
gcauccguagcuucagcu

SEQ ID NO: 3706009 - RNA, 17 nt, Salmonella enterica enterica serovar Typhi Ty2
gcauccuccauccaggu

SEQ ID NO: 3706010 - RNA, 13 nt, Salmonella enterica enterica serovar Typhi Ty2
gcauccucuuucc

SEQ ID NO: 3706011 - RNA, 23 nt, Salmonella enterica enterica serovar Typhi Ty2
gcauccugcggguucaucgccac

SEQ ID NO: 3706012 - RNA, 13 nt, Salmonella enterica enterica serovar Typhi Ty2
gcaucgacgccag

SEQ ID NO: 3706013 - RNA, 16 nt, Salmonella enterica enterica serovar Typhi Ty2
gcaucgacguucagca

SEQ ID NO: 3706014 - RNA, 17 nt, Salmonella enterica enterica serovar Typhi Ty2
gcaucgacguucagcau

SEQ ID NO: 3706015 - RNA, 19 nt, Salmonella enterica enterica serovar Typhi Ty2
gcaucgacguucagcauau

SEQ ID NO: 3706016 - RNA, 21 nt, Salmonella enterica enterica serovar Typhi Ty2
gcaucgauuuuucaucuucag

SEQ ID NO: 3706017 - RNA, 12 nt, Salmonella enterica enterica serovar Typhi Ty2
gcaucgccgccc

SEQ ID NO: 3706018 - RNA, 14 nt, Salmonella enterica enterica serovar Typhi Ty2
gcaucgccgcccag

SEQ ID NO: 3706019 - RNA, 19 nt, Salmonella enterica enterica serovar Typhi Ty2
gcaucgccgcggcgcuggc

SEQ ID NO: 3706020 - RNA, 22 nt, Salmonella enterica enterica serovar Typhi Ty2
gcaucgccgguagcuucagcgg

SEQ ID NO: 3706021 - RNA, 13 nt, Salmonella enterica enterica serovar Typhi Ty2
gcaucgcggucag

SEQ ID NO: 3706022 - RNA, 19 nt, Salmonella enterica enterica serovar Typhi Ty2
gcaucgcguuauugaccau

SEQ ID NO: 3706023 - RNA, 17 nt, Salmonella enterica enterica serovar Typhi Ty2
gcauugggauggauaaa

SEQ ID NO: 3706024 - RNA, 22 nt, Salmonella enterica enterica serovar Typhi Ty2
gcauugguggggcuaagugagc

SEQ ID NO: 3706025 - RNA, 14 nt, Salmonella enterica enterica serovar Typhi Ty2
gcauuguccgcauu

SEQ ID NO: 3706026 - RNA, 18 nt, Salmonella enterica enterica serovar Typhi Ty2
gcauugugccggguagcg

SEQ ID NO: 3706027 - RNA, 19 nt, Salmonella enterica enterica serovar Typhi Ty2
gcauuguuaauccagagcg

SEQ ID NO: 3706028 - RNA, 19 nt, Salmonella enterica enterica serovar Typhi Ty2
gcauuuaacggcuuacugc

SEQ ID NO: 3706029 - RNA, 13 nt, Salmonella enterica enterica serovar Typhi Ty2
gcauuuaucaauc

SEQ ID NO: 3706030 - RNA, 17 nt, Salmonella enterica enterica serovar Typhi Ty2
gcauuuaugccgccauc

SEQ ID NO: 3706031 - RNA, 24 nt, Salmonella enterica enterica serovar Typhi Ty2
gcauuucaaagcguucugaacugu

SEQ ID NO: 3706032 - RNA, 20 nt, Salmonella enterica enterica serovar Typhi Ty2
gcauuucgccaguuccauca

SEQ ID NO: 3706033 - RNA, 14 nt, Salmonella enterica enterica serovar Typhi Ty2
gcauuucgccgcca

SEQ ID NO: 3706034 - RNA, 18 nt, Salmonella enterica enterica serovar Typhi Ty2
gcauuugcuuucaucaau

SEQ ID NO: 3706035 - RNA, 17 nt, Salmonella enterica enterica serovar Typhi Ty2
gcauuuuaucuuuuguu

SEQ ID NO: 3706036 - RNA, 16 nt, Salmonella enterica enterica serovar Typhi Ty2
gcauuuucaaugucgc

SEQ ID NO: 3706037 - RNA, 13 nt, Salmonella enterica enterica serovar Typhi Ty2
gcauuuuccggcg

SEQ ID NO: 3706038 - RNA, 16 nt, Salmonella enterica enterica serovar Typhi Ty2
gcauuuuggccgggau

SEQ ID NO: 3706039 - RNA, 22 nt, Salmonella enterica enterica serovar Typhi Ty2
gcauuuuucauggugaacaugg

SEQ ID NO: 3706040 - RNA, 14 nt, Salmonella enterica enterica serovar Typhi Ty2
gcauuuuuucuuca

SEQ ID NO: 3706041 - RNA, 15 nt, Salmonella enterica enterica serovar Typhi Ty2
gcauuuuuucuucag

SEQ ID NO: 3706042 - RNA, 15 nt, Salmonella enterica enterica serovar Typhi Ty2
gccaaaaaaucgcug

SEQ ID NO: 3706043 - RNA, 19 nt, Salmonella enterica enterica serovar Typhi Ty2
gccaaaacccaccagcagg

SEQ ID NO: 3706044 - RNA, 18 nt, Salmonella enterica enterica serovar Typhi Ty2
gccaaaacggucgguaau

SEQ ID NO: 3706045 - RNA, 17 nt, Salmonella enterica enterica serovar Typhi Ty2
gccaaaagaggcagcaa

SEQ ID NO: 3706046 - RNA, 13 nt, Salmonella enterica enterica serovar Typhi Ty2
gccaaaauaugcu

SEQ ID NO: 3706047 - RNA, 18 nt, Salmonella enterica enterica serovar Typhi Ty2
gccaaaaucgauagcggu

SEQ ID NO: 3706048 - RNA, 12 nt, Salmonella enterica enterica serovar Typhi Ty2
gccaaaauggcg

SEQ ID NO: 3706049 - RNA, 17 nt, Salmonella enterica enterica serovar Typhi Ty2
gccaaaccugccacagg

SEQ ID NO: 3706050 - RNA, 17 nt, Salmonella enterica enterica serovar Typhi Ty2
gccaaacuccaccugau

SEQ ID NO: 3706051 - RNA, 13 nt, Salmonella enterica enterica serovar Typhi Ty2
gccaaacuccuca

SEQ ID NO: 3706052 - RNA, 21 nt, Salmonella enterica enterica serovar Typhi Ty2
gccaaacucuuuuucaauaaa

SEQ ID NO: 3706053 - RNA, 14 nt, Salmonella enterica enterica serovar Typhi Ty2
gccaaacugcggaa

SEQ ID NO: 3706054 - RNA, 12 nt, Salmonella enterica enterica serovar Typhi Ty2
gccaaacugcug

SEQ ID NO: 3706055 - RNA, 13 nt, Salmonella enterica enterica serovar Typhi Ty2
gccaaacugcugg

SEQ ID NO: 3706056 - RNA, 21 nt, Salmonella enterica enterica serovar Typhi Ty2
gccaaagcgauccggcaucca

SEQ ID NO: 3706057 - RNA, 18 nt, Salmonella enterica enterica serovar Typhi Ty2
gccaaagucauugcugcc

SEQ ID NO: 3706058 - RNA, 20 nt, Salmonella enterica enterica serovar Typhi Ty2
gccaaagucauugcugccag

SEQ ID NO: 3706059 - RNA, 20 nt, Salmonella enterica enterica serovar Typhi Ty2
gccaaauacgucgcacggau

SEQ ID NO: 3706060 - RNA, 14 nt, Salmonella enterica enterica serovar Typhi Ty2
gccaaauagcgcca

SEQ ID NO: 3706061 - RNA, 17 nt, Salmonella enterica enterica serovar Typhi Ty2
gccaaauagcgccagac

SEQ ID NO: 3706062 - RNA, 22 nt, Salmonella enterica enterica serovar Typhi Ty2
gccaaauagcgccagacagaua

SEQ ID NO: 3706063 - RNA, 19 nt, Salmonella enterica enterica serovar Typhi Ty2
gccaaauuuagugcucagc

SEQ ID NO: 3706064 - RNA, 14 nt, Salmonella enterica enterica serovar Typhi Ty2
gccaacaacaggcc

SEQ ID NO: 3706065 - RNA, 20 nt, Salmonella enterica enterica serovar Typhi Ty2
gccaacaacaggccgccgag

SEQ ID NO: 3706066 - RNA, 21 nt, Salmonella enterica enterica serovar Typhi Ty2
gccaacagccgcccacaaccg

SEQ ID NO: 3706067 - RNA, 16 nt, Salmonella enterica enterica serovar Typhi Ty2
gccaacauagccacag

SEQ ID NO: 3706068 - RNA, 19 nt, Salmonella enterica enterica serovar Typhi Ty2
gccaacauagccacaggcu

SEQ ID NO: 3706069 - RNA, 22 nt, Salmonella enterica enterica serovar Typhi Ty2
gccaacauguaauuacggcaca

SEQ ID NO: 3706070 - RNA, 20 nt, Salmonella enterica enterica serovar Typhi Ty2
gccaaccaccgcggagaucg

SEQ ID NO: 3706071 - RNA, 13 nt, Salmonella enterica enterica serovar Typhi Ty2
gccaaccagaccg

SEQ ID NO: 3706072 - RNA, 21 nt, Salmonella enterica enterica serovar Typhi Ty2
gccaaccagcgcuuugcggcu

SEQ ID NO: 3706073 - RNA, 22 nt, Salmonella enterica enterica serovar Typhi Ty2
gccaacgaccggcgcagcgccc

SEQ ID NO: 3706074 - RNA, 16 nt, Salmonella enterica enterica serovar Typhi Ty2
gccaacgauacagcac

SEQ ID NO: 3706075 - RNA, 12 nt, Salmonella enterica enterica serovar Typhi Ty2
gccaacgccaac

SEQ ID NO: 3706076 - RNA, 15 nt, Salmonella enterica enterica serovar Typhi Ty2
gccaacgccagcagc

SEQ ID NO: 3706077 - RNA, 14 nt, Salmonella enterica enterica serovar Typhi Ty2
gccaacuuuuucuu

SEQ ID NO: 3706078 - RNA, 19 nt, Salmonella enterica enterica serovar Typhi Ty2
gccaagaccgccuaacagc

SEQ ID NO: 3706079 - RNA, 20 nt, Salmonella enterica enterica serovar Typhi Ty2
gccaagaccgccuaacagcg

SEQ ID NO: 3706080 - RNA, 14 nt, Salmonella enterica enterica serovar Typhi Ty2
gccaagaucgccaa

SEQ ID NO: 3706081 - RNA, 15 nt, Salmonella enterica enterica serovar Typhi Ty2
gccaagcaacacggc

SEQ ID NO: 3706082 - RNA, 17 nt, Salmonella enterica enterica serovar Typhi Ty2
gccaagcagcgccacgc

SEQ ID NO: 3706083 - RNA, 18 nt, Salmonella enterica enterica serovar Typhi Ty2
gccaagcagcgccacgcc

SEQ ID NO: 3706084 - RNA, 17 nt, Salmonella enterica enterica serovar Typhi Ty2
gccaagcgcggacagca

SEQ ID NO: 3706085 - RNA, 16 nt, Salmonella enterica enterica serovar Typhi Ty2
gccaagcgcggcagca

SEQ ID NO: 3706086 - RNA, 17 nt, Salmonella enterica enterica serovar Typhi Ty2
gccaagcgcggcagcag

SEQ ID NO: 3706087 - RNA, 19 nt, Salmonella enterica enterica serovar Typhi Ty2
gccaagcgcggcagcagcu

SEQ ID NO: 3706088 - RNA, 16 nt, Salmonella enterica enterica serovar Typhi Ty2
gccaagcggcaacucu

SEQ ID NO: 3706089 - RNA, 13 nt, Salmonella enterica enterica serovar Typhi Ty2
gccaagcggcauc

SEQ ID NO: 3706090 - RNA, 19 nt, Salmonella enterica enterica serovar Typhi Ty2
gccaagcggcaucucgcca

SEQ ID NO: 3706091 - RNA, 17 nt, Salmonella enterica enterica serovar Typhi Ty2
gccaaguaauaaagaga

SEQ ID NO: 3706092 - RNA, 18 nt, Salmonella enterica enterica serovar Typhi Ty2
gccaauaaccaccuguuc

SEQ ID NO: 3706093 - RNA, 17 nt, Salmonella enterica enterica serovar Typhi Ty2
gccaauaacgccuggug

SEQ ID NO: 3706094 - RNA, 18 nt, Salmonella enterica enterica serovar Typhi Ty2
gccaauaaucaaaugauu

SEQ ID NO: 3706095 - RNA, 17 nt, Salmonella enterica enterica serovar Typhi Ty2
gccaauaauuuuagaaa

SEQ ID NO: 3706096 - RNA, 24 nt, Salmonella enterica enterica serovar Typhi Ty2
gccaauacgggagagcguauccag

SEQ ID NO: 3706097 - RNA, 17 nt, Salmonella enterica enterica serovar Typhi Ty2
gccaaucaacgccgcca

SEQ ID NO: 3706098 - RNA, 20 nt, Salmonella enterica enterica serovar Typhi Ty2
gccaaucaccgccagcaacg

SEQ ID NO: 3706099 - RNA, 13 nt, Salmonella enterica enterica serovar Typhi Ty2
gccaaucacugcg

SEQ ID NO: 3706100 - RNA, 14 nt, Salmonella enterica enterica serovar Typhi Ty2
gccaauccugcacc

SEQ ID NO: 3706101 - RNA, 11 nt, Salmonella enterica enterica serovar Typhi Ty2
gccaaugaacu

SEQ ID NO: 3706102 - RNA, 22 nt, Salmonella enterica enterica serovar Typhi Ty2
gccaauggcucaacuccgccgg

SEQ ID NO: 3706103 - RNA, 16 nt, Salmonella enterica enterica serovar Typhi Ty2
gccaauuccgccauaa

SEQ ID NO: 3706104 - RNA, 13 nt, Salmonella enterica enterica serovar Typhi Ty2
gccacaaacugcg

SEQ ID NO: 3706105 - RNA, 22 nt, Salmonella enterica enterica serovar Typhi Ty2
gccagacagcauuuuucacagu

SEQ ID NO: 3706106 - RNA, 14 nt, Salmonella enterica enterica serovar Typhi Ty2
gccagaccaauaga

SEQ ID NO: 3706107 - RNA, 16 nt, Salmonella enterica enterica serovar Typhi Ty2
gccagaccaauagaga

SEQ ID NO: 3706108 - RNA, 22 nt, Salmonella enterica enterica serovar Typhi Ty2
gccagaccaauagagagcgaca

SEQ ID NO: 3706109 - RNA, 17 nt, Salmonella enterica enterica serovar Typhi Ty2
gccagacccaauaugcc

SEQ ID NO: 3706110 - RNA, 20 nt, Salmonella enterica enterica serovar Typhi Ty2
gccagaccccaguaauccgg

SEQ ID NO: 3706111 - RNA, 13 nt, Salmonella enterica enterica serovar Typhi Ty2
gccagacccgcgc

SEQ ID NO: 3706112 - RNA, 18 nt, Salmonella enterica enterica serovar Typhi Ty2
gccagacgaacggccuga

SEQ ID NO: 3706113 - RNA, 23 nt, Salmonella enterica enterica serovar Typhi Ty2
gccagacgaugaauuccugcggc

SEQ ID NO: 3706114 - RNA, 19 nt, Salmonella enterica enterica serovar Typhi Ty2
gccagacgcgcagcaccga

SEQ ID NO: 3706115 - RNA, 17 nt, Salmonella enterica enterica serovar Typhi Ty2
gccagacgcuuauucgc

SEQ ID NO: 3706116 - RNA, 16 nt, Salmonella enterica enterica serovar Typhi Ty2
gccagacggcgcccag

SEQ ID NO: 3706117 - RNA, 17 nt, Salmonella enterica enterica serovar Typhi Ty2
gccagacgggccaggcg

SEQ ID NO: 3706118 - RNA, 15 nt, Salmonella enterica enterica serovar Typhi Ty2
gccagacucagccag

SEQ ID NO: 3706119 - RNA, 18 nt, Salmonella enterica enterica serovar Typhi Ty2
gccagacucgcucccuuc

SEQ ID NO: 3706120 - RNA, 16 nt, Salmonella enterica enterica serovar Typhi Ty2
gccagagcgcgcuggc

SEQ ID NO: 3706121 - RNA, 19 nt, Salmonella enterica enterica serovar Typhi Ty2
gccagagcgcgcuggcaag

SEQ ID NO: 3706122 - RNA, 16 nt, Salmonella enterica enterica serovar Typhi Ty2
gccagaggcagcacau

SEQ ID NO: 3706123 - RNA, 14 nt, Salmonella enterica enterica serovar Typhi Ty2
gccagaggcgugca

SEQ ID NO: 3706124 - RNA, 19 nt, Salmonella enterica enterica serovar Typhi Ty2
gccagaggcgugcaugggc

SEQ ID NO: 3706125 - RNA, 22 nt, Salmonella enterica enterica serovar Typhi Ty2
gccagaggcgugcaugggcagc

SEQ ID NO: 3706126 - RNA, 18 nt, Salmonella enterica enterica serovar Typhi Ty2
gccagauaaagcagcgac

SEQ ID NO: 3706127 - RNA, 19 nt, Salmonella enterica enterica serovar Typhi Ty2
gccagauaaagcagcgaca

SEQ ID NO: 3706128 - RNA, 15 nt, Salmonella enterica enterica serovar Typhi Ty2
gccagauaaauagcg

SEQ ID NO: 3706129 - RNA, 19 nt, Salmonella enterica enterica serovar Typhi Ty2
gccagauaaaucagcccga

SEQ ID NO: 3706130 - RNA, 15 nt, Salmonella enterica enterica serovar Typhi Ty2
gccagauagcgucuu

SEQ ID NO: 3706131 - RNA, 20 nt, Salmonella enterica enterica serovar Typhi Ty2
gccagauauuuucggcauac

SEQ ID NO: 3706132 - RNA, 14 nt, Salmonella enterica enterica serovar Typhi Ty2
gccagaucaggcgu

SEQ ID NO: 3706133 - RNA, 14 nt, Salmonella enterica enterica serovar Typhi Ty2
gccagaugcagcgg

SEQ ID NO: 3706134 - RNA, 15 nt, Salmonella enterica enterica serovar Typhi Ty2
gccagaugcagcggc

SEQ ID NO: 3706135 - RNA, 22 nt, Salmonella enterica enterica serovar Typhi Ty2
gccagauggaaaccggcgucuu

SEQ ID NO: 3706136 - RNA, 18 nt, Salmonella enterica enterica serovar Typhi Ty2
gccagauggauaaccugc

SEQ ID NO: 3706137 - RNA, 23 nt, Salmonella enterica enterica serovar Typhi Ty2
gccagaugguaagcauagcgccu

SEQ ID NO: 3706138 - RNA, 21 nt, Salmonella enterica enterica serovar Typhi Ty2
gccagaugucgcggauaugca

SEQ ID NO: 3706139 - RNA, 22 nt, Salmonella enterica enterica serovar Typhi Ty2
gccagauuaucggccagcgcca

SEQ ID NO: 3706140 - RNA, 14 nt, Salmonella enterica enterica serovar Typhi Ty2
gccagauucaccac

SEQ ID NO: 3706141 - RNA, 14 nt, Salmonella enterica enterica serovar Typhi Ty2
gccagcaacagcgu

SEQ ID NO: 3706142 - RNA, 15 nt, Salmonella enterica enterica serovar Typhi Ty2
gccagcaacgcccag

SEQ ID NO: 3706143 - RNA, 19 nt, Salmonella enterica enterica serovar Typhi Ty2
gccagcaacguuaaggccg

SEQ ID NO: 3706144 - RNA, 17 nt, Salmonella enterica enterica serovar Typhi Ty2
gccagcaauacccagaa

SEQ ID NO: 3706145 - RNA, 14 nt, Salmonella enterica enterica serovar Typhi Ty2
gccagcaccacuac

SEQ ID NO: 3706146 - RNA, 16 nt, Salmonella enterica enterica serovar Typhi Ty2
gccagcaccaggcucg

SEQ ID NO: 3706147 - RNA, 20 nt, Salmonella enterica enterica serovar Typhi Ty2
gccagcagcauaaaaccgcc

SEQ ID NO: 3706148 - RNA, 19 nt, Salmonella enterica enterica serovar Typhi Ty2
gccagcagcgcaccugccc

SEQ ID NO: 3706149 - RNA, 15 nt, Salmonella enterica enterica serovar Typhi Ty2
gccagcagcucgccg

SEQ ID NO: 3706150 - RNA, 13 nt, Salmonella enterica enterica serovar Typhi Ty2
gccagcaggcgca

SEQ ID NO: 3706151 - RNA, 20 nt, Salmonella enterica enterica serovar Typhi Ty2
gccagcaguuuuucaaucuu

SEQ ID NO: 3706152 - RNA, 15 nt, Salmonella enterica enterica serovar Typhi Ty2
gccagcauaccgccc

SEQ ID NO: 3706153 - RNA, 13 nt, Salmonella enterica enterica serovar Typhi Ty2
gccagcauauaaa

SEQ ID NO: 3706154 - RNA, 19 nt, Salmonella enterica enterica serovar Typhi Ty2
gccagcaucggcagcgcca

SEQ ID NO: 3706155 - RNA, 19 nt, Salmonella enterica enterica serovar Typhi Ty2
gccagcauuucaaucgcgc

SEQ ID NO: 3706156 - RNA, 22 nt, Salmonella enterica enterica serovar Typhi Ty2
gccagcauuucaaucgcgcccg

SEQ ID NO: 3706157 - RNA, 17 nt, Salmonella enterica enterica serovar Typhi Ty2
gccagcauuuccagcug

SEQ ID NO: 3706158 - RNA, 16 nt, Salmonella enterica enterica serovar Typhi Ty2
gccagcauuuuuccac

SEQ ID NO: 3706159 - RNA, 14 nt, Salmonella enterica enterica serovar Typhi Ty2
gccagccaaaacgu

SEQ ID NO: 3706160 - RNA, 18 nt, Salmonella enterica enterica serovar Typhi Ty2
gccagccaaauagcgcca

SEQ ID NO: 3706161 - RNA, 17 nt, Salmonella enterica enterica serovar Typhi Ty2
gccagccagcgccacca

SEQ ID NO: 3706162 - RNA, 21 nt, Salmonella enterica enterica serovar Typhi Ty2
gccagccagucgccaggcaag

SEQ ID NO: 3706163 - RNA, 16 nt, Salmonella enterica enterica serovar Typhi Ty2
gccagccauggcccuu

SEQ ID NO: 3706164 - RNA, 13 nt, Salmonella enterica enterica serovar Typhi Ty2
gccagccauuaaa

SEQ ID NO: 3706165 - RNA, 17 nt, Salmonella enterica enterica serovar Typhi Ty2
gccagccauucaccacu

SEQ ID NO: 3706166 - RNA, 20 nt, Salmonella enterica enterica serovar Typhi Ty2
gccagccauugaugcaggcg

SEQ ID NO: 3706167 - RNA, 14 nt, Salmonella enterica enterica serovar Typhi Ty2
gccagccccagaaa

SEQ ID NO: 3706168 - RNA, 20 nt, Salmonella enterica enterica serovar Typhi Ty2
gccagccccugcggauuacg

SEQ ID NO: 3706169 - RNA, 20 nt, Salmonella enterica enterica serovar Typhi Ty2
gccagcccgaucaucuccug

SEQ ID NO: 3706170 - RNA, 22 nt, Salmonella enterica enterica serovar Typhi Ty2
gccagcccgaucaucuccugua

SEQ ID NO: 3706171 - RNA, 19 nt, Salmonella enterica enterica serovar Typhi Ty2
gccagccgauuuuucggca

SEQ ID NO: 3706172 - RNA, 21 nt, Salmonella enterica enterica serovar Typhi Ty2
gccagccgauuuuucggcacg

SEQ ID NO: 3706173 - RNA, 13 nt, Salmonella enterica enterica serovar Typhi Ty2
gccagccgccgcc

SEQ ID NO: 3706174 - RNA, 20 nt, Salmonella enterica enterica serovar Typhi Ty2
gccagccgcgccaucuccuc

SEQ ID NO: 3706175 - RNA, 16 nt, Salmonella enterica enterica serovar Typhi Ty2
gccagccguaacgagu

SEQ ID NO: 3706176 - RNA, 23 nt, Salmonella enterica enterica serovar Typhi Ty2
gccagccugugaucggagaaaua

SEQ ID NO: 3706177 - RNA, 12 nt, Salmonella enterica enterica serovar Typhi Ty2
gccagccuuccc

SEQ ID NO: 3706178 - RNA, 19 nt, Salmonella enterica enterica serovar Typhi Ty2
gccagcgacaacgcuuccg

SEQ ID NO: 3706179 - RNA, 21 nt, Salmonella enterica enterica serovar Typhi Ty2
gccagcgaccaccgucccagu

SEQ ID NO: 3706180 - RNA, 17 nt, Salmonella enterica enterica serovar Typhi Ty2
gccagcgacugguguua

SEQ ID NO: 3706181 - RNA, 14 nt, Salmonella enterica enterica serovar Typhi Ty2
gccagcgagaaguc

SEQ ID NO: 3706182 - RNA, 19 nt, Salmonella enterica enterica serovar Typhi Ty2
gccagcgauggggcaagcu

SEQ ID NO: 3706183 - RNA, 21 nt, Salmonella enterica enterica serovar Typhi Ty2
gccagcgauuccgucaggaac

SEQ ID NO: 3706184 - RNA, 15 nt, Salmonella enterica enterica serovar Typhi Ty2
gccagcgccagcguu

SEQ ID NO: 3706185 - RNA, 12 nt, Salmonella enterica enterica serovar Typhi Ty2
gccagcgccgcc

SEQ ID NO: 3706186 - RNA, 18 nt, Salmonella enterica enterica serovar Typhi Ty2
gccagcgccguuguccgu

SEQ ID NO: 3706187 - RNA, 16 nt, Salmonella enterica enterica serovar Typhi Ty2
gccaguucacgccgcc

SEQ ID NO: 3706188 - RNA, 17 nt, Salmonella enterica enterica serovar Typhi Ty2
gccaguucacgccgccg

SEQ ID NO: 3706189 - RNA, 14 nt, Salmonella enterica enterica serovar Typhi Ty2
gccaguucauuccg

SEQ ID NO: 3706190 - RNA, 19 nt, Salmonella enterica enterica serovar Typhi Ty2
gccaguucauuccgcccug

SEQ ID NO: 3706191 - RNA, 15 nt, Salmonella enterica enterica serovar Typhi Ty2
gccaguuggccggau

SEQ ID NO: 3706192 - RNA, 20 nt, Salmonella enterica enterica serovar Typhi Ty2
gccaguuguccgcuggucag

SEQ ID NO: 3706193 - RNA, 19 nt, Salmonella enterica enterica serovar Typhi Ty2
gccaguuuacgcguacucg

SEQ ID NO: 3706194 - RNA, 20 nt, Salmonella enterica enterica serovar Typhi Ty2
gccaguuuccugacccgcuc

SEQ ID NO: 3706195 - RNA, 21 nt, Salmonella enterica enterica serovar Typhi Ty2
gccaguuucucgucauaguga

SEQ ID NO: 3706196 - RNA, 18 nt, Salmonella enterica enterica serovar Typhi Ty2
gccauaacaacuauuuuu

SEQ ID NO: 3706197 - RNA, 23 nt, Salmonella enterica enterica serovar Typhi Ty2
gccauaaugcacaauacgccgag

SEQ ID NO: 3706198 - RNA, 17 nt, Salmonella enterica enterica serovar Typhi Ty2
gccauaauggauuaggu

SEQ ID NO: 3706199 - RNA, 13 nt, Salmonella enterica enterica serovar Typhi Ty2
gccauaauuguuc

SEQ ID NO: 3706200 - RNA, 14 nt, Salmonella enterica enterica serovar Typhi Ty2
gccauacacgcggc

SEQ ID NO: 3706201 - RNA, 16 nt, Salmonella enterica enterica serovar Typhi Ty2
gccauacuuacugcug

SEQ ID NO: 3706202 - RNA, 13 nt, Salmonella enterica enterica serovar Typhi Ty2
gccauagaaagau

SEQ ID NO: 3706203 - RNA, 18 nt, Salmonella enterica enterica serovar Typhi Ty2
gccauagacuuuggcgca

SEQ ID NO: 3706204 - RNA, 14 nt, Salmonella enterica enterica serovar Typhi Ty2
gccauagcgcuaug

SEQ ID NO: 3706205 - RNA, 18 nt, Salmonella enterica enterica serovar Typhi Ty2
gccauaguagaagugaag

SEQ ID NO: 3706206 - RNA, 15 nt, Salmonella enterica enterica serovar Typhi Ty2
gccauaucgccgcca

SEQ ID NO: 3706207 - RNA, 15 nt, Salmonella enterica enterica serovar Typhi Ty2
gccauauguuccacc

SEQ ID NO: 3706208 - RNA, 16 nt, Salmonella enterica enterica serovar Typhi Ty2
gccauauuaugcuggc

SEQ ID NO: 3706209 - RNA, 20 nt, Salmonella enterica enterica serovar Typhi Ty2
gccauauuaugcuggccugc

SEQ ID NO: 3706210 - RNA, 18 nt, Salmonella enterica enterica serovar Typhi Ty2
gccauauugccgcacaug

SEQ ID NO: 3706211 - RNA, 13 nt, Salmonella enterica enterica serovar Typhi Ty2
gccauauugcugu

SEQ ID NO: 3706212 - RNA, 20 nt, Salmonella enterica enterica serovar Typhi Ty2
gccauauuguucaguuucaa

SEQ ID NO: 3706213 - RNA, 20 nt, Salmonella enterica enterica serovar Typhi Ty2
gccauauuuuuccagcgccu

SEQ ID NO: 3706214 - RNA, 18 nt, Salmonella enterica enterica serovar Typhi Ty2
gccaucacaccaacgcug

SEQ ID NO: 3706215 - RNA, 23 nt, Salmonella enterica enterica serovar Typhi Ty2
gccaucagacucucaaugcccau

SEQ ID NO: 3706216 - RNA, 14 nt, Salmonella enterica enterica serovar Typhi Ty2
gccaucagcaccuu

SEQ ID NO: 3706217 - RNA, 17 nt, Salmonella enterica enterica serovar Typhi Ty2
gccaucaggcaaugucu

SEQ ID NO: 3706218 - RNA, 12 nt, Salmonella enterica enterica serovar Typhi Ty2
gccaucaggcag

SEQ ID NO: 3706219 - RNA, 23 nt, Salmonella enterica enterica serovar Typhi Ty2
gccaucaggcaguuuauccggcg

SEQ ID NO: 3706220 - RNA, 17 nt, Salmonella enterica enterica serovar Typhi Ty2
gccaucaggcaucugaa

SEQ ID NO: 3706221 - RNA, 18 nt, Salmonella enterica enterica serovar Typhi Ty2
gccaucaggcaucugaaa

SEQ ID NO: 3706222 - RNA, 15 nt, Salmonella enterica enterica serovar Typhi Ty2
gccaucaucaguaac

SEQ ID NO: 3706223 - RNA, 21 nt, Salmonella enterica enterica serovar Typhi Ty2
gccaucaugcccacaggcagg

SEQ ID NO: 3706224 - RNA, 17 nt, Salmonella enterica enterica serovar Typhi Ty2
gccauccaccaggcaug

SEQ ID NO: 3706225 - RNA, 19 nt, Salmonella enterica enterica serovar Typhi Ty2
gccaucccgcugaucgccg

SEQ ID NO: 3706226 - RNA, 22 nt, Salmonella enterica enterica serovar Typhi Ty2
gccauccggcaaacucagcggc

SEQ ID NO: 3706227 - RNA, 20 nt, Salmonella enterica enterica serovar Typhi Ty2
gccauccggcaaauccucca

SEQ ID NO: 3706228 - RNA, 14 nt, Salmonella enterica enterica serovar Typhi Ty2
gccauccggcaaca

SEQ ID NO: 3706229 - RNA, 13 nt, Salmonella enterica enterica serovar Typhi Ty2
gccauccggcaca

SEQ ID NO: 3706230 - RNA, 17 nt, Salmonella enterica enterica serovar Typhi Ty2
gccauccggcacuacag

SEQ ID NO: 3706231 - RNA, 17 nt, Salmonella enterica enterica serovar Typhi Ty2
gccauccggcaucacgu

SEQ ID NO: 3706232 - RNA, 18 nt, Salmonella enterica enterica serovar Typhi Ty2
gccauccggcaucucuuc

SEQ ID NO: 3706233 - RNA, 15 nt, Salmonella enterica enterica serovar Typhi Ty2
gccauccggcgcuga

SEQ ID NO: 3706234 - RNA, 14 nt, Salmonella enterica enterica serovar Typhi Ty2
gccauccugcaccg

SEQ ID NO: 3706235 - RNA, 23 nt, Salmonella enterica enterica serovar Typhi Ty2
gccauccugccgcaccagucggc

SEQ ID NO: 3706236 - RNA, 23 nt, Salmonella enterica enterica serovar Typhi Ty2
gccauccugcgugccguugacca

SEQ ID NO: 3706237 - RNA, 22 nt, Salmonella enterica enterica serovar Typhi Ty2
gccauccuguucaagcaauaau

SEQ ID NO: 3706238 - RNA, 15 nt, Salmonella enterica enterica serovar Typhi Ty2
gccaucgacagcgcc

SEQ ID NO: 3706239 - RNA, 16 nt, Salmonella enterica enterica serovar Typhi Ty2
gccaucgacagcgcca

SEQ ID NO: 3706240 - RNA, 22 nt, Salmonella enterica enterica serovar Typhi Ty2
gccaucgacagcgccauauaaa

SEQ ID NO: 3706241 - RNA, 14 nt, Salmonella enterica enterica serovar Typhi Ty2
gccaucgcggcgca

SEQ ID NO: 3706242 - RNA, 22 nt, Salmonella enterica enterica serovar Typhi Ty2
gccaucgcggcgcaaaucgcca

SEQ ID NO: 3706243 - RNA, 14 nt, Salmonella enterica enterica serovar Typhi Ty2
gccaucgcugacga

SEQ ID NO: 3706244 - RNA, 21 nt, Salmonella enterica enterica serovar Typhi Ty2
gccaucggcgccggggugcug

SEQ ID NO: 3706245 - RNA, 19 nt, Salmonella enterica enterica serovar Typhi Ty2
gccaucguaugcugucgcc

SEQ ID NO: 3706246 - RNA, 16 nt, Salmonella enterica enterica serovar Typhi Ty2
gccaucgucaccggau

SEQ ID NO: 3706247 - RNA, 17 nt, Salmonella enterica enterica serovar Typhi Ty2
gccaucgucaccggauc

SEQ ID NO: 3706248 - RNA, 14 nt, Salmonella enterica enterica serovar Typhi Ty2
gccaucgucacgca

SEQ ID NO: 3706249 - RNA, 15 nt, Salmonella enterica enterica serovar Typhi Ty2
gccaucguccagcca

SEQ ID NO: 3706250 - RNA, 16 nt, Salmonella enterica enterica serovar Typhi Ty2
gccaucgucgccacca

SEQ ID NO: 3706251 - RNA, 14 nt, Salmonella enterica enterica serovar Typhi Ty2
gccaucucauucgc

SEQ ID NO: 3706252 - RNA, 17 nt, Salmonella enterica enterica serovar Typhi Ty2
gccaucucauucgccag

SEQ ID NO: 3706253 - RNA, 22 nt, Salmonella enterica enterica serovar Typhi Ty2
gccaucuccaucauuuccggcg

SEQ ID NO: 3706254 - RNA, 15 nt, Salmonella enterica enterica serovar Typhi Ty2
gccaucuccggcagc

SEQ ID NO: 3706255 - RNA, 14 nt, Salmonella enterica enterica serovar Typhi Ty2
gccaucuuccagca

SEQ ID NO: 3706256 - RNA, 17 nt, Salmonella enterica enterica serovar Typhi Ty2
gccaucuuccagcauca

SEQ ID NO: 3706257 - RNA, 12 nt, Salmonella enterica enterica serovar Typhi Ty2
gccaucuuccuc

SEQ ID NO: 3706258 - RNA, 18 nt, Salmonella enterica enterica serovar Typhi Ty2
gccaucuuuacccugagc

SEQ ID NO: 3706259 - RNA, 19 nt, Salmonella enterica enterica serovar Typhi Ty2
gccaucuuuacccugagcc

SEQ ID NO: 3706260 - RNA, 18 nt, Salmonella enterica enterica serovar Typhi Ty2
gccaugaguaaugaccac

SEQ ID NO: 3706261 - RNA, 14 nt, Salmonella enterica enterica serovar Typhi Ty2
gccaugauccuggu

SEQ ID NO: 3706262 - RNA, 15 nt, Salmonella enterica enterica serovar Typhi Ty2
gccaugaucgccgcc

SEQ ID NO: 3706263 - RNA, 21 nt, Salmonella enterica enterica serovar Typhi Ty2
gccaugaucgccgccaucggc

SEQ ID NO: 3706264 - RNA, 16 nt, Salmonella enterica enterica serovar Typhi Ty2
gccaugaugagcgcca

SEQ ID NO: 3706265 - RNA, 23 nt, Salmonella enterica enterica serovar Typhi Ty2
gccaugcaccacgacggccggac

SEQ ID NO: 3706266 - RNA, 14 nt, Salmonella enterica enterica serovar Typhi Ty2
gccaugcauaugaa

SEQ ID NO: 3706267 - RNA, 16 nt, Salmonella enterica enterica serovar Typhi Ty2
gccaugcaucaauggc

SEQ ID NO: 3706268 - RNA, 15 nt, Salmonella enterica enterica serovar Typhi Ty2
gccaugccagcaguu

SEQ ID NO: 3706269 - RNA, 13 nt, Salmonella enterica enterica serovar Typhi Ty2
gcccaggccugau

SEQ ID NO: 3706270 - RNA, 18 nt, Salmonella enterica enterica serovar Typhi Ty2
gcccaggcgccgcucauc

SEQ ID NO: 3706271 - RNA, 20 nt, Salmonella enterica enterica serovar Typhi Ty2
gcccagguagaaucccacca

SEQ ID NO: 3706272 - RNA, 15 nt, Salmonella enterica enterica serovar Typhi Ty2
gcccaguaccagcac

SEQ ID NO: 3706273 - RNA, 19 nt, Salmonella enterica enterica serovar Typhi Ty2
gcccauaccacaacagaau

SEQ ID NO: 3706274 - RNA, 19 nt, Salmonella enterica enterica serovar Typhi Ty2
gcccauaccccacgccaua

SEQ ID NO: 3706275 - RNA, 20 nt, Salmonella enterica enterica serovar Typhi Ty2
gcccauaccccacgccauaa

SEQ ID NO: 3706276 - RNA, 11 nt, Salmonella enterica enterica serovar Typhi Ty2
gcccauacugg

SEQ ID NO: 3706277 - RNA, 20 nt, Salmonella enterica enterica serovar Typhi Ty2
gcccauauccaucuggcggu

SEQ ID NO: 3706278 - RNA, 17 nt, Salmonella enterica enterica serovar Typhi Ty2
gcccaucagcaucccac

SEQ ID NO: 3706279 - RNA, 20 nt, Salmonella enterica enterica serovar Typhi Ty2
gcccaucagcaucccaccgg

SEQ ID NO: 3706280 - RNA, 14 nt, Salmonella enterica enterica serovar Typhi Ty2
gcccaucagcgcca

SEQ ID NO: 3706281 - RNA, 17 nt, Salmonella enterica enterica serovar Typhi Ty2
gcccaucaucaucggca

SEQ ID NO: 3706282 - RNA, 18 nt, Salmonella enterica enterica serovar Typhi Ty2
gcccaucaucaucggcac

SEQ ID NO: 3706283 - RNA, 14 nt, Salmonella enterica enterica serovar Typhi Ty2
gcccauccagagca

SEQ ID NO: 3706284 - RNA, 16 nt, Salmonella enterica enterica serovar Typhi Ty2
gcccauccagagcagu

SEQ ID NO: 3706285 - RNA, 21 nt, Salmonella enterica enterica serovar Typhi Ty2
gcccaucgcgccaugauucau

SEQ ID NO: 3706286 - RNA, 15 nt, Salmonella enterica enterica serovar Typhi Ty2
gcccaucugacgugc

SEQ ID NO: 3706287 - RNA, 20 nt, Salmonella enterica enterica serovar Typhi Ty2
gcccaugcaaccagugcgug

SEQ ID NO: 3706288 - RNA, 15 nt, Salmonella enterica enterica serovar Typhi Ty2
gcccaugccgcccag

SEQ ID NO: 3706289 - RNA, 20 nt, Salmonella enterica enterica serovar Typhi Ty2
gcccauggcaggcagcacaa

SEQ ID NO: 3706290 - RNA, 18 nt, Salmonella enterica enterica serovar Typhi Ty2
gcccauuccgccaacggu

SEQ ID NO: 3706291 - RNA, 14 nt, Salmonella enterica enterica serovar Typhi Ty2
gcccauuccgccug

SEQ ID NO: 3706292 - RNA, 21 nt, Salmonella enterica enterica serovar Typhi Ty2
gcccauucuucgucgucauca

SEQ ID NO: 3706293 - RNA, 16 nt, Salmonella enterica enterica serovar Typhi Ty2
gcccauugccacccau

SEQ ID NO: 3706294 - RNA, 16 nt, Salmonella enterica enterica serovar Typhi Ty2
gcccauuuuccuccca

SEQ ID NO: 3706295 - RNA, 13 nt, Salmonella enterica enterica serovar Typhi Ty2
gccccaacgcgcu

SEQ ID NO: 3706296 - RNA, 13 nt, Salmonella enterica enterica serovar Typhi Ty2
gccccaauaccac

SEQ ID NO: 3706297 - RNA, 18 nt, Salmonella enterica enterica serovar Typhi Ty2
gccccacacggccaccau

SEQ ID NO: 3706298 - RNA, 15 nt, Salmonella enterica enterica serovar Typhi Ty2
gccccaccgccagaa

SEQ ID NO: 3706299 - RNA, 20 nt, Salmonella enterica enterica serovar Typhi Ty2
gccccacgauacgccccugc

SEQ ID NO: 3706300 - RNA, 13 nt, Salmonella enterica enterica serovar Typhi Ty2
gccccacuggccc

SEQ ID NO: 3706301 - RNA, 17 nt, Salmonella enterica enterica serovar Typhi Ty2
gccccacuggcccccug

SEQ ID NO: 3706302 - RNA, 19 nt, Salmonella enterica enterica serovar Typhi Ty2
gccccagcaccaacgccgc

SEQ ID NO: 3706303 - RNA, 21 nt, Salmonella enterica enterica serovar Typhi Ty2
gccccagcauauuuuccggcg

SEQ ID NO: 3706304 - RNA, 11 nt, Salmonella enterica enterica serovar Typhi Ty2
gccccagcccu

SEQ ID NO: 3706305 - RNA, 17 nt, Salmonella enterica enterica serovar Typhi Ty2
gccccagcgccagccgc

SEQ ID NO: 3706306 - RNA, 23 nt, Salmonella enterica enterica serovar Typhi Ty2
gccccaggcuauccagcucaccg

SEQ ID NO: 3706307 - RNA, 23 nt, Salmonella enterica enterica serovar Typhi Ty2
gccccagguuugaggcuugcagc

SEQ ID NO: 3706308 - RNA, 14 nt, Salmonella enterica enterica serovar Typhi Ty2
gccccaucacggga

SEQ ID NO: 3706309 - RNA, 12 nt, Salmonella enterica enterica serovar Typhi Ty2
gccccaucagca

SEQ ID NO: 3706310 - RNA, 16 nt, Salmonella enterica enterica serovar Typhi Ty2
gccccaucagcacaug

SEQ ID NO: 3706311 - RNA, 17 nt, Salmonella enterica enterica serovar Typhi Ty2
gccccauguggccagcg

SEQ ID NO: 3706312 - RNA, 17 nt, Salmonella enterica enterica serovar Typhi Ty2
gcccccauacgcgcgcc

SEQ ID NO: 3706313 - RNA, 15 nt, Salmonella enterica enterica serovar Typhi Ty2
gccccccgcacagca

SEQ ID NO: 3706314 - RNA, 22 nt, Salmonella enterica enterica serovar Typhi Ty2
gccccccgguagccacacccau

SEQ ID NO: 3706315 - RNA, 17 nt, Salmonella enterica enterica serovar Typhi Ty2
gccccccuaccggaauc

SEQ ID NO: 3706316 - RNA, 19 nt, Salmonella enterica enterica serovar Typhi Ty2
gcccccgauucaaucuggu

SEQ ID NO: 3706317 - RNA, 14 nt, Salmonella enterica enterica serovar Typhi Ty2
gcccccgcgcaggc

SEQ ID NO: 3706318 - RNA, 16 nt, Salmonella enterica enterica serovar Typhi Ty2
gcccccugccagcgcu

SEQ ID NO: 3706319 - RNA, 17 nt, Salmonella enterica enterica serovar Typhi Ty2
gccccgacaaaacgggc

SEQ ID NO: 3706320 - RNA, 15 nt, Salmonella enterica enterica serovar Typhi Ty2
gccccgacaucagau

SEQ ID NO: 3706321 - RNA, 12 nt, Salmonella enterica enterica serovar Typhi Ty2
gccccgccgcgc

SEQ ID NO: 3706322 - RNA, 20 nt, Salmonella enterica enterica serovar Typhi Ty2
gccccgccgcgcggccccau

SEQ ID NO: 3706323 - RNA, 22 nt, Salmonella enterica enterica serovar Typhi Ty2
gccccgcuucccgaaaggaagc

SEQ ID NO: 3706324 - RNA, 14 nt, Salmonella enterica enterica serovar Typhi Ty2
gccccggcgcgcgc

SEQ ID NO: 3706325 - RNA, 18 nt, Salmonella enterica enterica serovar Typhi Ty2
gccccggucaacgcgccg

SEQ ID NO: 3706326 - RNA, 20 nt, Salmonella enterica enterica serovar Typhi Ty2
gccccggucaacgcgccgcc

SEQ ID NO: 3706327 - RNA, 15 nt, Salmonella enterica enterica serovar Typhi Ty2
gccccguaucauuag

SEQ ID NO: 3706328 - RNA, 23 nt, Salmonella enterica enterica serovar Typhi Ty2
gccccgucagucgccagaaggca

SEQ ID NO: 3706329 - RNA, 23 nt, Salmonella enterica enterica serovar Typhi Ty2
gccccguggcgggaugccccacu

SEQ ID NO: 3706330 - RNA, 14 nt, Salmonella enterica enterica serovar Typhi Ty2
gccccuaaggcagc

SEQ ID NO: 3706331 - RNA, 16 nt, Salmonella enterica enterica serovar Typhi Ty2
gccccuaaggcagcaa

SEQ ID NO: 3706332 - RNA, 11 nt, Salmonella enterica enterica serovar Typhi Ty2
gccccucccug

SEQ ID NO: 3706333 - RNA, 20 nt, Salmonella enterica enterica serovar Typhi Ty2
gccccucgcuaaugcccggc

SEQ ID NO: 3706334 - RNA, 18 nt, Salmonella enterica enterica serovar Typhi Ty2
gccccucuugcagcaaga

SEQ ID NO: 3706335 - RNA, 19 nt, Salmonella enterica enterica serovar Typhi Ty2
gccccugagcaaucaguuc

SEQ ID NO: 3706336 - RNA, 21 nt, Salmonella enterica enterica serovar Typhi Ty2
gccccugagcaaucaguucuc

SEQ ID NO: 3706337 - RNA, 14 nt, Salmonella enterica enterica serovar Typhi Ty2
gccccugcgccagc

SEQ ID NO: 3706338 - RNA, 14 nt, Salmonella enterica enterica serovar Typhi Ty2
gccccugcuggcga

SEQ ID NO: 3706339 - RNA, 15 nt, Salmonella enterica enterica serovar Typhi Ty2
gccccugggcgaaaa

SEQ ID NO: 3706340 - RNA, 19 nt, Salmonella enterica enterica serovar Typhi Ty2
gccccuguggaaucagucg

SEQ ID NO: 3706341 - RNA, 18 nt, Salmonella enterica enterica serovar Typhi Ty2
gccccuguuucgcccgcu

SEQ ID NO: 3706342 - RNA, 17 nt, Salmonella enterica enterica serovar Typhi Ty2
gccccuuccgccacggc

SEQ ID NO: 3706343 - RNA, 16 nt, Salmonella enterica enterica serovar Typhi Ty2
gccccuuuacgcguga

SEQ ID NO: 3706344 - RNA, 22 nt, Salmonella enterica enterica serovar Typhi Ty2
gcccgaaagcaauacuguaagc

SEQ ID NO: 3706345 - RNA, 11 nt, Salmonella enterica enterica serovar Typhi Ty2
gcccgaaucgc

SEQ ID NO: 3706346 - RNA, 23 nt, Salmonella enterica enterica serovar Typhi Ty2
gcccgacaggguuugccagcacc

SEQ ID NO: 3706347 - RNA, 13 nt, Salmonella enterica enterica serovar Typhi Ty2
gcccgacgcgcca

SEQ ID NO: 3706348 - RNA, 21 nt, Salmonella enterica enterica serovar Typhi Ty2
gcccgacgcgccacuuccagc

SEQ ID NO: 3706349 - RNA, 18 nt, Salmonella enterica enterica serovar Typhi Ty2
gcccgagcgacgcccugc

SEQ ID NO: 3706350 - RNA, 16 nt, Salmonella enterica enterica serovar Typhi Ty2
gcccgauaaaucgcau

SEQ ID NO: 3706351 - RNA, 16 nt, Salmonella enterica enterica serovar Typhi Ty2
gcccugagcccacagc

SEQ ID NO: 3706352 - RNA, 20 nt, Salmonella enterica enterica serovar Typhi Ty2
gcccugagcccacagcggau

SEQ ID NO: 3706353 - RNA, 17 nt, Salmonella enterica enterica serovar Typhi Ty2
gcccugauggcgcgcca

SEQ ID NO: 3706354 - RNA, 21 nt, Salmonella enterica enterica serovar Typhi Ty2
gcccugcaucaugcgcagaaa

SEQ ID NO: 3706355 - RNA, 19 nt, Salmonella enterica enterica serovar Typhi Ty2
gcccugcggaaccgcccau

SEQ ID NO: 3706356 - RNA, 17 nt, Salmonella enterica enterica serovar Typhi Ty2
gcccugcggacaggcga

SEQ ID NO: 3706357 - RNA, 16 nt, Salmonella enterica enterica serovar Typhi Ty2
gcccugcucccacagc

SEQ ID NO: 3706358 - RNA, 14 nt, Salmonella enterica enterica serovar Typhi Ty2
gcccugcuggcgca

SEQ ID NO: 3706359 - RNA, 16 nt, Salmonella enterica enterica serovar Typhi Ty2
gcccugcuguuccagu

SEQ ID NO: 3706360 - RNA, 23 nt, Salmonella enterica enterica serovar Typhi Ty2
gcccuggaggaacagcgccguca

SEQ ID NO: 3706361 - RNA, 19 nt, Salmonella enterica enterica serovar Typhi Ty2
gcccuggcucaauccaggu

SEQ ID NO: 3706362 - RNA, 13 nt, Salmonella enterica enterica serovar Typhi Ty2
gcccuggguugcc

SEQ ID NO: 3706363 - RNA, 18 nt, Salmonella enterica enterica serovar Typhi Ty2
gcccuggugagcuccagc

SEQ ID NO: 3706364 - RNA, 22 nt, Salmonella enterica enterica serovar Typhi Ty2
gcccuggugagcuccagcccgc

SEQ ID NO: 3706365 - RNA, 21 nt, Salmonella enterica enterica serovar Typhi Ty2
gcccuguaaaggauugccgcc

SEQ ID NO: 3706366 - RNA, 14 nt, Salmonella enterica enterica serovar Typhi Ty2
gcccuguccuccau

SEQ ID NO: 3706367 - RNA, 18 nt, Salmonella enterica enterica serovar Typhi Ty2
gcccugugccgcuggugc

SEQ ID NO: 3706368 - RNA, 14 nt, Salmonella enterica enterica serovar Typhi Ty2
gcccuguuauucag

SEQ ID NO: 3706369 - RNA, 20 nt, Salmonella enterica enterica serovar Typhi Ty2
gcccuguuuuuucgccgcgc

SEQ ID NO: 3706370 - RNA, 19 nt, Salmonella enterica enterica serovar Typhi Ty2
gcccuuaaauccggccucc

SEQ ID NO: 3706371 - RNA, 14 nt, Salmonella enterica enterica serovar Typhi Ty2
gcccuuaucuggau

SEQ ID NO: 3706372 - RNA, 14 nt, Salmonella enterica enterica serovar Typhi Ty2
gcccuucaucuucc

SEQ ID NO: 3706373 - RNA, 15 nt, Salmonella enterica enterica serovar Typhi Ty2
gcccuucaucuucca

SEQ ID NO: 3706374 - RNA, 17 nt, Salmonella enterica enterica serovar Typhi Ty2
gcccuuccgucagcguc

SEQ ID NO: 3706375 - RNA, 22 nt, Salmonella enterica enterica serovar Typhi Ty2
gcccuucgucaggaggccugaa

SEQ ID NO: 3706376 - RNA, 18 nt, Salmonella enterica enterica serovar Typhi Ty2
gcccuugccgcuuccagu

SEQ ID NO: 3706377 - RNA, 15 nt, Salmonella enterica enterica serovar Typhi Ty2
gcccuuucagagcgu

SEQ ID NO: 3706378 - RNA, 11 nt, Salmonella enterica enterica serovar Typhi Ty2
gcccuuucuua

SEQ ID NO: 3706379 - RNA, 12 nt, Salmonella enterica enterica serovar Typhi Ty2
gcccuuugcccu

SEQ ID NO: 3706380 - RNA, 11 nt, Salmonella enterica enterica serovar Typhi Ty2
gcccuuuuguu

SEQ ID NO: 3706381 - RNA, 16 nt, Salmonella enterica enterica serovar Typhi Ty2
gcccuuuuguuuuugc

SEQ ID NO: 3706382 - RNA, 19 nt, Salmonella enterica enterica serovar Typhi Ty2
gccgaaauccaccagcgga

SEQ ID NO: 3706383 - RNA, 17 nt, Salmonella enterica enterica serovar Typhi Ty2
gccgaacaguuucucgc

SEQ ID NO: 3706384 - RNA, 15 nt, Salmonella enterica enterica serovar Typhi Ty2
gccgaaccuggcggg

SEQ ID NO: 3706385 - RNA, 16 nt, Salmonella enterica enterica serovar Typhi Ty2
gccgaacucuuccacc

SEQ ID NO: 3706386 - RNA, 14 nt, Salmonella enterica enterica serovar Typhi Ty2
gccgaagugcgcgc

SEQ ID NO: 3706387 - RNA, 20 nt, Salmonella enterica enterica serovar Typhi Ty2
gccgaagugugccagcagau

SEQ ID NO: 3706388 - RNA, 16 nt, Salmonella enterica enterica serovar Typhi Ty2
gccgaauggcgggccu

SEQ ID NO: 3706389 - RNA, 20 nt, Salmonella enterica enterica serovar Typhi Ty2
gccgaauggcgggccuacgc

SEQ ID NO: 3706390 - RNA, 23 nt, Salmonella enterica enterica serovar Typhi Ty2
gccgaauuuacugugauccacca

SEQ ID NO: 3706391 - RNA, 19 nt, Salmonella enterica enterica serovar Typhi Ty2
gccgacaccggccugccua

SEQ ID NO: 3706392 - RNA, 21 nt, Salmonella enterica enterica serovar Typhi Ty2
gccgacaggcagguugccgau

SEQ ID NO: 3706393 - RNA, 22 nt, Salmonella enterica enterica serovar Typhi Ty2
gccgacauaagugcaggcugag

SEQ ID NO: 3706394 - RNA, 13 nt, Salmonella enterica enterica serovar Typhi Ty2
gccgacaucacgc

SEQ ID NO: 3706395 - RNA, 13 nt, Salmonella enterica enterica serovar Typhi Ty2
gccgacaucgcca

SEQ ID NO: 3706396 - RNA, 18 nt, Salmonella enterica enterica serovar Typhi Ty2
gccgacaucgccaccgca

SEQ ID NO: 3706397 - RNA, 17 nt, Salmonella enterica enterica serovar Typhi Ty2
gccgacaucgcucccgg

SEQ ID NO: 3706398 - RNA, 20 nt, Salmonella enterica enterica serovar Typhi Ty2
gccgacaucgcucccggcac

SEQ ID NO: 3706399 - RNA, 19 nt, Salmonella enterica enterica serovar Typhi Ty2
gccgacaugguuaaccacc

SEQ ID NO: 3706400 - RNA, 15 nt, Salmonella enterica enterica serovar Typhi Ty2
gccgacauucccugc

SEQ ID NO: 3706401 - RNA, 19 nt, Salmonella enterica enterica serovar Typhi Ty2
gccgaccaauugcaggcag

SEQ ID NO: 3706402 - RNA, 15 nt, Salmonella enterica enterica serovar Typhi Ty2
gccgaccaccagcuu

SEQ ID NO: 3706403 - RNA, 15 nt, Salmonella enterica enterica serovar Typhi Ty2
gccgaccagcgucuu

SEQ ID NO: 3706404 - RNA, 14 nt, Salmonella enterica enterica serovar Typhi Ty2
gccgaccauccaga

SEQ ID NO: 3706405 - RNA, 14 nt, Salmonella enterica enterica serovar Typhi Ty2
gccgaccaucgcgc

SEQ ID NO: 3706406 - RNA, 22 nt, Salmonella enterica enterica serovar Typhi Ty2
gccgaccauuggcaccaccagg

SEQ ID NO: 3706407 - RNA, 23 nt, Salmonella enterica enterica serovar Typhi Ty2
gccgaccccaugacggccugcgc

SEQ ID NO: 3706408 - RNA, 20 nt, Salmonella enterica enterica serovar Typhi Ty2
gccgacccgcaucgccgcgg

SEQ ID NO: 3706409 - RNA, 21 nt, Salmonella enterica enterica serovar Typhi Ty2
gccgacccgcaucgccgcggc

SEQ ID NO: 3706410 - RNA, 22 nt, Salmonella enterica enterica serovar Typhi Ty2
gccgaccgccaggucggcuuuu

SEQ ID NO: 3706411 - RNA, 14 nt, Salmonella enterica enterica serovar Typhi Ty2
gccgaccggcgcgc

SEQ ID NO: 3706412 - RNA, 17 nt, Salmonella enterica enterica serovar Typhi Ty2
gccgaccgucggcgcaa

SEQ ID NO: 3706413 - RNA, 16 nt, Salmonella enterica enterica serovar Typhi Ty2
gccgaccgugauuuuu

SEQ ID NO: 3706414 - RNA, 16 nt, Salmonella enterica enterica serovar Typhi Ty2
gccgacgaccggcagc

SEQ ID NO: 3706415 - RNA, 14 nt, Salmonella enterica enterica serovar Typhi Ty2
gccgacgcauccgc

SEQ ID NO: 3706416 - RNA, 15 nt, Salmonella enterica enterica serovar Typhi Ty2
gccgacgcauccgcc

SEQ ID NO: 3706417 - RNA, 18 nt, Salmonella enterica enterica serovar Typhi Ty2
gccgacgcauuucuccug

SEQ ID NO: 3706418 - RNA, 15 nt, Salmonella enterica enterica serovar Typhi Ty2
gccgacgccacccag

SEQ ID NO: 3706419 - RNA, 20 nt, Salmonella enterica enterica serovar Typhi Ty2
gccgacgccacccagcgaac

SEQ ID NO: 3706420 - RNA, 16 nt, Salmonella enterica enterica serovar Typhi Ty2
gccgacgcucuuccuc

SEQ ID NO: 3706421 - RNA, 12 nt, Salmonella enterica enterica serovar Typhi Ty2
gccgacggcgcu

SEQ ID NO: 3706422 - RNA, 19 nt, Salmonella enterica enterica serovar Typhi Ty2
gccgacguuaucgccgaca

SEQ ID NO: 3706423 - RNA, 12 nt, Salmonella enterica enterica serovar Typhi Ty2
gccgacucacgc

SEQ ID NO: 3706424 - RNA, 14 nt, Salmonella enterica enterica serovar Typhi Ty2
gccgacucgcgcaa

SEQ ID NO: 3706425 - RNA, 23 nt, Salmonella enterica enterica serovar Typhi Ty2
gccgacuggcaccacgaccagac

SEQ ID NO: 3706426 - RNA, 12 nt, Salmonella enterica enterica serovar Typhi Ty2
gccgacuuuacg

SEQ ID NO: 3706427 - RNA, 19 nt, Salmonella enterica enterica serovar Typhi Ty2
gccgacuuuacggccuagc

SEQ ID NO: 3706428 - RNA, 16 nt, Salmonella enterica enterica serovar Typhi Ty2
gccgagcaacagaaac

SEQ ID NO: 3706429 - RNA, 16 nt, Salmonella enterica enterica serovar Typhi Ty2
gccgagggcauugaug

SEQ ID NO: 3706430 - RNA, 19 nt, Salmonella enterica enterica serovar Typhi Ty2
gccgagggcauugaugguu

SEQ ID NO: 3706431 - RNA, 15 nt, Salmonella enterica enterica serovar Typhi Ty2
gccgaggugguggaa

SEQ ID NO: 3706432 - RNA, 21 nt, Salmonella enterica enterica serovar Typhi Ty2
gccgauaaccagcgcgccgcc

SEQ ID NO: 3706433 - RNA, 14 nt, Salmonella enterica enterica serovar Typhi Ty2
gccgccaucggcgc

SEQ ID NO: 3706434 - RNA, 18 nt, Salmonella enterica enterica serovar Typhi Ty2
gccgccaucgucgccacc

SEQ ID NO: 3706435 - RNA, 22 nt, Salmonella enterica enterica serovar Typhi Ty2
gccgccaucuccggcagcgaau

SEQ ID NO: 3706436 - RNA, 12 nt, Salmonella enterica enterica serovar Typhi Ty2
gccgccauggcg

SEQ ID NO: 3706437 - RNA, 16 nt, Salmonella enterica enterica serovar Typhi Ty2
gccgccauuaauacca

SEQ ID NO: 3706438 - RNA, 21 nt, Salmonella enterica enterica serovar Typhi Ty2
gccgccauucgcuuccgccgg

SEQ ID NO: 3706439 - RNA, 23 nt, Salmonella enterica enterica serovar Typhi Ty2
gccgccauucgcuuccgccggga

SEQ ID NO: 3706440 - RNA, 16 nt, Salmonella enterica enterica serovar Typhi Ty2
gccgccauugccagua

SEQ ID NO: 3706441 - RNA, 16 nt, Salmonella enterica enterica serovar Typhi Ty2
gccgcccaacagggcg

SEQ ID NO: 3706442 - RNA, 18 nt, Salmonella enterica enterica serovar Typhi Ty2
gccgcccaaccagcccag

SEQ ID NO: 3706443 - RNA, 20 nt, Salmonella enterica enterica serovar Typhi Ty2
gccgcccaggccaugcgccg

SEQ ID NO: 3706444 - RNA, 22 nt, Salmonella enterica enterica serovar Typhi Ty2
gccgcccaggccugauaagcgc

SEQ ID NO: 3706445 - RNA, 16 nt, Salmonella enterica enterica serovar Typhi Ty2
gccgcccauccagagc

SEQ ID NO: 3706446 - RNA, 15 nt, Salmonella enterica enterica serovar Typhi Ty2
gccgcccaucgccac

SEQ ID NO: 3706447 - RNA, 18 nt, Salmonella enterica enterica serovar Typhi Ty2
gccgcccaucgccacagc

SEQ ID NO: 3706448 - RNA, 19 nt, Salmonella enterica enterica serovar Typhi Ty2
gccgcccaucgccacagcg

SEQ ID NO: 3706449 - RNA, 18 nt, Salmonella enterica enterica serovar Typhi Ty2
gccgcccccaugccgccu

SEQ ID NO: 3706450 - RNA, 13 nt, Salmonella enterica enterica serovar Typhi Ty2
gccgccccccguc

SEQ ID NO: 3706451 - RNA, 15 nt, Salmonella enterica enterica serovar Typhi Ty2
gccgcccgccugagc

SEQ ID NO: 3706452 - RNA, 16 nt, Salmonella enterica enterica serovar Typhi Ty2
gccgcccuccggcaca

SEQ ID NO: 3706453 - RNA, 14 nt, Salmonella enterica enterica serovar Typhi Ty2
gccgcccugcauca

SEQ ID NO: 3706454 - RNA, 16 nt, Salmonella enterica enterica serovar Typhi Ty2
gccgcccugcaucaug

SEQ ID NO: 3706455 - RNA, 16 nt, Salmonella enterica enterica serovar Typhi Ty2
gccgccgacaaccagc

SEQ ID NO: 3706456 - RNA, 14 nt, Salmonella enterica enterica serovar Typhi Ty2
gccgccgagcgccg

SEQ ID NO: 3706457 - RNA, 12 nt, Salmonella enterica enterica serovar Typhi Ty2
gccgccgcagca

SEQ ID NO: 3706458 - RNA, 15 nt, Salmonella enterica enterica serovar Typhi Ty2
gccgccgcagcagau

SEQ ID NO: 3706459 - RNA, 11 nt, Salmonella enterica enterica serovar Typhi Ty2
gccgccgcagg

SEQ ID NO: 3706460 - RNA, 16 nt, Salmonella enterica enterica serovar Typhi Ty2
gccgccgcaggacagc

SEQ ID NO: 3706461 - RNA, 16 nt, Salmonella enterica enterica serovar Typhi Ty2
gccgccgccaucgucg

SEQ ID NO: 3706462 - RNA, 14 nt, Salmonella enterica enterica serovar Typhi Ty2
gccgccgccugcca

SEQ ID NO: 3706463 - RNA, 11 nt, Salmonella enterica enterica serovar Typhi Ty2
gccgccgggca

SEQ ID NO: 3706464 - RNA, 17 nt, Salmonella enterica enterica serovar Typhi Ty2
gccgccggugacggcgg

SEQ ID NO: 3706465 - RNA, 19 nt, Salmonella enterica enterica serovar Typhi Ty2
gccgccgguguuuccguca

SEQ ID NO: 3706466 - RNA, 19 nt, Salmonella enterica enterica serovar Typhi Ty2
gccgccguagaacgggccg

SEQ ID NO: 3706467 - RNA, 20 nt, Salmonella enterica enterica serovar Typhi Ty2
gccgccgugauaaauacgcu

SEQ ID NO: 3706468 - RNA, 16 nt, Salmonella enterica enterica serovar Typhi Ty2
gccgccguuuuauuug

SEQ ID NO: 3706469 - RNA, 15 nt, Salmonella enterica enterica serovar Typhi Ty2
gccgccuaucgccag

SEQ ID NO: 3706470 - RNA, 20 nt, Salmonella enterica enterica serovar Typhi Ty2
gccgccucccccucaaucgg

SEQ ID NO: 3706471 - RNA, 14 nt, Salmonella enterica enterica serovar Typhi Ty2
gccgccugaugcug

SEQ ID NO: 3706472 - RNA, 15 nt, Salmonella enterica enterica serovar Typhi Ty2
gccgccugaugcugg

SEQ ID NO: 3706473 - RNA, 16 nt, Salmonella enterica enterica serovar Typhi Ty2
gccgccuggcgcgacu

SEQ ID NO: 3706474 - RNA, 16 nt, Salmonella enterica enterica serovar Typhi Ty2
gccgccuuggcgaccu

SEQ ID NO: 3706475 - RNA, 20 nt, Salmonella enterica enterica serovar Typhi Ty2
gccgcgaacguucaaaauca

SEQ ID NO: 3706476 - RNA, 14 nt, Salmonella enterica enterica serovar Typhi Ty2
gccgcgacgcgcga

SEQ ID NO: 3706477 - RNA, 16 nt, Salmonella enterica enterica serovar Typhi Ty2
gccgcgacgcgcgagc

SEQ ID NO: 3706478 - RNA, 19 nt, Salmonella enterica enterica serovar Typhi Ty2
gccgcgagagucgccagga

SEQ ID NO: 3706479 - RNA, 24 nt, Salmonella enterica enterica serovar Typhi Ty2
gccgcgauacauugucgcagcgcu

SEQ ID NO: 3706480 - RNA, 14 nt, Salmonella enterica enterica serovar Typhi Ty2
gccgcgaucgcggc

SEQ ID NO: 3706481 - RNA, 14 nt, Salmonella enterica enterica serovar Typhi Ty2
gccgcgcaagcgau

SEQ ID NO: 3706482 - RNA, 16 nt, Salmonella enterica enterica serovar Typhi Ty2
gccgcgccagacgcca

SEQ ID NO: 3706483 - RNA, 18 nt, Salmonella enterica enterica serovar Typhi Ty2
gccgcgcccuaacaggcg

SEQ ID NO: 3706484 - RNA, 16 nt, Salmonella enterica enterica serovar Typhi Ty2
gccgcgcccugcggaa

SEQ ID NO: 3706485 - RNA, 22 nt, Salmonella enterica enterica serovar Typhi Ty2
gccgcgccgacauagcugaaca

SEQ ID NO: 3706486 - RNA, 17 nt, Salmonella enterica enterica serovar Typhi Ty2
gccgcgccggacuccag

SEQ ID NO: 3706487 - RNA, 21 nt, Salmonella enterica enterica serovar Typhi Ty2
gccgcgccggacuccagcaac

SEQ ID NO: 3706488 - RNA, 18 nt, Salmonella enterica enterica serovar Typhi Ty2
gccgcgccuaccagcgcu

SEQ ID NO: 3706489 - RNA, 13 nt, Salmonella enterica enterica serovar Typhi Ty2
gccgcgcgccgcc

SEQ ID NO: 3706490 - RNA, 14 nt, Salmonella enterica enterica serovar Typhi Ty2
gccgcgcgccgccu

SEQ ID NO: 3706491 - RNA, 18 nt, Salmonella enterica enterica serovar Typhi Ty2
gccgcgcgccgccucuuc

SEQ ID NO: 3706492 - RNA, 20 nt, Salmonella enterica enterica serovar Typhi Ty2
gccgcgcgguauuucgcaac

SEQ ID NO: 3706493 - RNA, 22 nt, Salmonella enterica enterica serovar Typhi Ty2
gccgcgcuccaucauaucgcgc

SEQ ID NO: 3706494 - RNA, 13 nt, Salmonella enterica enterica serovar Typhi Ty2
gccgcgcuggaua

SEQ ID NO: 3706495 - RNA, 16 nt, Salmonella enterica enterica serovar Typhi Ty2
gccgcgcuuucaguaa

SEQ ID NO: 3706496 - RNA, 19 nt, Salmonella enterica enterica serovar Typhi Ty2
gccgcgcuuucaguaauaa

SEQ ID NO: 3706497 - RNA, 21 nt, Salmonella enterica enterica serovar Typhi Ty2
gccgcgggaaauaccaaauau

SEQ ID NO: 3706498 - RNA, 15 nt, Salmonella enterica enterica serovar Typhi Ty2
gccgcggucgagcau

SEQ ID NO: 3706499 - RNA, 16 nt, Salmonella enterica enterica serovar Typhi Ty2
gccgcgugcucgcggc

SEQ ID NO: 3706500 - RNA, 23 nt, Salmonella enterica enterica serovar Typhi Ty2
gccgcguuuaagucccuggcgcg

SEQ ID NO: 3706501 - RNA, 16 nt, Salmonella enterica enterica serovar Typhi Ty2
gccgcguuuugccgcu

SEQ ID NO: 3706502 - RNA, 18 nt, Salmonella enterica enterica serovar Typhi Ty2
gccgcuacugccgccauc

SEQ ID NO: 3706503 - RNA, 14 nt, Salmonella enterica enterica serovar Typhi Ty2
gccgcuauccucgc

SEQ ID NO: 3706504 - RNA, 22 nt, Salmonella enterica enterica serovar Typhi Ty2
gccgcuaucgaccagcaccugc

SEQ ID NO: 3706505 - RNA, 23 nt, Salmonella enterica enterica serovar Typhi Ty2
gccgcuaugacgaagcugaguau

SEQ ID NO: 3706506 - RNA, 19 nt, Salmonella enterica enterica serovar Typhi Ty2
gccgcuaugcaauuguucc

SEQ ID NO: 3706507 - RNA, 14 nt, Salmonella enterica enterica serovar Typhi Ty2
gccgcuccacagca

SEQ ID NO: 3706508 - RNA, 14 nt, Salmonella enterica enterica serovar Typhi Ty2
gccgcuccagggau

SEQ ID NO: 3706509 - RNA, 16 nt, Salmonella enterica enterica serovar Typhi Ty2
gccgcucccgcaugga

SEQ ID NO: 3706510 - RNA, 16 nt, Salmonella enterica enterica serovar Typhi Ty2
gccgcucgccugcgcu

SEQ ID NO: 3706511 - RNA, 16 nt, Salmonella enterica enterica serovar Typhi Ty2
gccgcugauauucacc

SEQ ID NO: 3706512 - RNA, 14 nt, Salmonella enterica enterica serovar Typhi Ty2
gccgcugauccgcc

SEQ ID NO: 3706513 - RNA, 12 nt, Salmonella enterica enterica serovar Typhi Ty2
gccgcuggcggg

SEQ ID NO: 3706514 - RNA, 13 nt, Salmonella enterica enterica serovar Typhi Ty2
gccgcuggcuggc

SEQ ID NO: 3706515 - RNA, 17 nt, Salmonella enterica enterica serovar Typhi Ty2
gccgcugucgccagaau

SEQ ID NO: 3706516 - RNA, 19 nt, Salmonella enterica enterica serovar Typhi Ty2
gccggucaugccaucccgc

SEQ ID NO: 3706517 - RNA, 13 nt, Salmonella enterica enterica serovar Typhi Ty2
gccggucgccagc

SEQ ID NO: 3706518 - RNA, 16 nt, Salmonella enterica enterica serovar Typhi Ty2
gccggucggcgcguca

SEQ ID NO: 3706519 - RNA, 19 nt, Salmonella enterica enterica serovar Typhi Ty2
gccggucguaaugagcacu

SEQ ID NO: 3706520 - RNA, 13 nt, Salmonella enterica enterica serovar Typhi Ty2
gccggugccgcaa

SEQ ID NO: 3706521 - RNA, 21 nt, Salmonella enterica enterica serovar Typhi Ty2
gccggugccgcaaucgguuuc

SEQ ID NO: 3706522 - RNA, 16 nt, Salmonella enterica enterica serovar Typhi Ty2
gccgguuauaccgcca

SEQ ID NO: 3706523 - RNA, 17 nt, Salmonella enterica enterica serovar Typhi Ty2
gccgguuauaccgccau

SEQ ID NO: 3706524 - RNA, 22 nt, Salmonella enterica enterica serovar Typhi Ty2
gccgguugccagggaaugccau

SEQ ID NO: 3706525 - RNA, 18 nt, Salmonella enterica enterica serovar Typhi Ty2
gccgguugggcgcuuaac

SEQ ID NO: 3706526 - RNA, 23 nt, Salmonella enterica enterica serovar Typhi Ty2
gccgguuuauccccgcuggcgcg

SEQ ID NO: 3706527 - RNA, 16 nt, Salmonella enterica enterica serovar Typhi Ty2
gccgguuucauaacac

SEQ ID NO: 3706528 - RNA, 22 nt, Salmonella enterica enterica serovar Typhi Ty2
gccgguuuuagcguauccggca

SEQ ID NO: 3706529 - RNA, 17 nt, Salmonella enterica enterica serovar Typhi Ty2
gccguaaacaggcaggc

SEQ ID NO: 3706530 - RNA, 22 nt, Salmonella enterica enterica serovar Typhi Ty2
gccguaaggcguaccgccgcga

SEQ ID NO: 3706531 - RNA, 16 nt, Salmonella enterica enterica serovar Typhi Ty2
gccguacuccagccca

SEQ ID NO: 3706532 - RNA, 18 nt, Salmonella enterica enterica serovar Typhi Ty2
gccguagcccgcuuuacc

SEQ ID NO: 3706533 - RNA, 12 nt, Salmonella enterica enterica serovar Typhi Ty2
gccguagcguuu

SEQ ID NO: 3706534 - RNA, 19 nt, Salmonella enterica enterica serovar Typhi Ty2
gccguaucagcaagcgcca

SEQ ID NO: 3706535 - RNA, 13 nt, Salmonella enterica enterica serovar Typhi Ty2
gccguauccaggg

SEQ ID NO: 3706536 - RNA, 18 nt, Salmonella enterica enterica serovar Typhi Ty2
gccguauucuuacccacc

SEQ ID NO: 3706537 - RNA, 20 nt, Salmonella enterica enterica serovar Typhi Ty2
gccgucaaacaagccgccaa

SEQ ID NO: 3706538 - RNA, 23 nt, Salmonella enterica enterica serovar Typhi Ty2
gccgucaaacaagccgccaacgc

SEQ ID NO: 3706539 - RNA, 17 nt, Salmonella enterica enterica serovar Typhi Ty2
gccgucaaacaucgcgc

SEQ ID NO: 3706540 - RNA, 20 nt, Salmonella enterica enterica serovar Typhi Ty2
gccgucaauuuuaagaauau

SEQ ID NO: 3706541 - RNA, 16 nt, Salmonella enterica enterica serovar Typhi Ty2
gccgucacuuuaucac

SEQ ID NO: 3706542 - RNA, 17 nt, Salmonella enterica enterica serovar Typhi Ty2
gccgucagugagcccuc

SEQ ID NO: 3706543 - RNA, 18 nt, Salmonella enterica enterica serovar Typhi Ty2
gccgucauaccgcccaug

SEQ ID NO: 3706544 - RNA, 14 nt, Salmonella enterica enterica serovar Typhi Ty2
gccguccauccggc

SEQ ID NO: 3706545 - RNA, 20 nt, Salmonella enterica enterica serovar Typhi Ty2
gccgucgacaaagccgacgc

SEQ ID NO: 3706546 - RNA, 13 nt, Salmonella enterica enterica serovar Typhi Ty2
gccgucgccacac

SEQ ID NO: 3706547 - RNA, 18 nt, Salmonella enterica enterica serovar Typhi Ty2
gccgucggcaauaaacuc

SEQ ID NO: 3706548 - RNA, 15 nt, Salmonella enterica enterica serovar Typhi Ty2
gccgucggcgccagc

SEQ ID NO: 3706549 - RNA, 17 nt, Salmonella enterica enterica serovar Typhi Ty2
gccgucgucaccgccgc

SEQ ID NO: 3706550 - RNA, 23 nt, Salmonella enterica enterica serovar Typhi Ty2
gccgucguuaacaucaucaggcc

SEQ ID NO: 3706551 - RNA, 21 nt, Salmonella enterica enterica serovar Typhi Ty2
gccgucguugcugucgcgcaa

SEQ ID NO: 3706552 - RNA, 13 nt, Salmonella enterica enterica serovar Typhi Ty2
gccgucuucuucu

SEQ ID NO: 3706553 - RNA, 15 nt, Salmonella enterica enterica serovar Typhi Ty2
gccgugaacgccaaa

SEQ ID NO: 3706554 - RNA, 19 nt, Salmonella enterica enterica serovar Typhi Ty2
gccgugaauaaaaccggca

SEQ ID NO: 3706555 - RNA, 19 nt, Salmonella enterica enterica serovar Typhi Ty2
gccgugaggcugaagcgcg

SEQ ID NO: 3706556 - RNA, 18 nt, Salmonella enterica enterica serovar Typhi Ty2
gccgugccugcuccgcca

SEQ ID NO: 3706557 - RNA, 22 nt, Salmonella enterica enterica serovar Typhi Ty2
gccgugccugggcggcaacccg

SEQ ID NO: 3706558 - RNA, 13 nt, Salmonella enterica enterica serovar Typhi Ty2
gccgugcgccgac

SEQ ID NO: 3706559 - RNA, 19 nt, Salmonella enterica enterica serovar Typhi Ty2
gccgugcgccgacaucgcc

SEQ ID NO: 3706560 - RNA, 12 nt, Salmonella enterica enterica serovar Typhi Ty2
gccguggcuggc

SEQ ID NO: 3706561 - RNA, 20 nt, Salmonella enterica enterica serovar Typhi Ty2
gccgugucgaccggcaccau

SEQ ID NO: 3706562 - RNA, 19 nt, Salmonella enterica enterica serovar Typhi Ty2
gccguguugugugccgcgc

SEQ ID NO: 3706563 - RNA, 16 nt, Salmonella enterica enterica serovar Typhi Ty2
gccguuaacuggcgca

SEQ ID NO: 3706564 - RNA, 23 nt, Salmonella enterica enterica serovar Typhi Ty2
gccguuaacuggcgcaucugguc

SEQ ID NO: 3706565 - RNA, 15 nt, Salmonella enterica enterica serovar Typhi Ty2
gccguuaauuuucac

SEQ ID NO: 3706566 - RNA, 15 nt, Salmonella enterica enterica serovar Typhi Ty2
gccguuaccgccgag

SEQ ID NO: 3706567 - RNA, 17 nt, Salmonella enterica enterica serovar Typhi Ty2
gccguuaccgccgagca

SEQ ID NO: 3706568 - RNA, 15 nt, Salmonella enterica enterica serovar Typhi Ty2
gccguuaccguggcg

SEQ ID NO: 3706569 - RNA, 13 nt, Salmonella enterica enterica serovar Typhi Ty2
gccguuagcgccu

SEQ ID NO: 3706570 - RNA, 15 nt, Salmonella enterica enterica serovar Typhi Ty2
gccguuagcgccuuu

SEQ ID NO: 3706571 - RNA, 13 nt, Salmonella enterica enterica serovar Typhi Ty2
gccguuccgcaac

SEQ ID NO: 3706572 - RNA, 22 nt, Salmonella enterica enterica serovar Typhi Ty2
gccguugcgauaauacacggua

SEQ ID NO: 3706573 - RNA, 15 nt, Salmonella enterica enterica serovar Typhi Ty2
gccguuggcgcgaau

SEQ ID NO: 3706574 - RNA, 24 nt, Salmonella enterica enterica serovar Typhi Ty2
gccguuggcuuuggcucacugcua

SEQ ID NO: 3706575 - RNA, 18 nt, Salmonella enterica enterica serovar Typhi Ty2
gccguugucauggcgcca

SEQ ID NO: 3706576 - RNA, 17 nt, Salmonella enterica enterica serovar Typhi Ty2
gccguugugcugguuga

SEQ ID NO: 3706577 - RNA, 21 nt, Salmonella enterica enterica serovar Typhi Ty2
gccguuuuaacgucauuacca

SEQ ID NO: 3706578 - RNA, 16 nt, Salmonella enterica enterica serovar Typhi Ty2
gccguuuucaugcacg

SEQ ID NO: 3706579 - RNA, 13 nt, Salmonella enterica enterica serovar Typhi Ty2
gccguuuuccggu

SEQ ID NO: 3706580 - RNA, 19 nt, Salmonella enterica enterica serovar Typhi Ty2
gccguuuuuaauuugcucc

SEQ ID NO: 3706581 - RNA, 22 nt, Salmonella enterica enterica serovar Typhi Ty2
gccguuuuuaauuugcuccaga

SEQ ID NO: 3706582 - RNA, 12 nt, Salmonella enterica enterica serovar Typhi Ty2
gccuaaagaaaa

SEQ ID NO: 3706583 - RNA, 13 nt, Salmonella enterica enterica serovar Typhi Ty2
gccuaaagaaaaa

SEQ ID NO: 3706584 - RNA, 14 nt, Salmonella enterica enterica serovar Typhi Ty2
gccuaaaucgcugc

SEQ ID NO: 3706585 - RNA, 14 nt, Salmonella enterica enterica serovar Typhi Ty2
gccuaagaccagca

SEQ ID NO: 3706586 - RNA, 24 nt, Salmonella enterica enterica serovar Typhi Ty2
gccuaagaucggguggccuaacgc

SEQ ID NO: 3706587 - RNA, 12 nt, Salmonella enterica enterica serovar Typhi Ty2
gccuaagcccac

SEQ ID NO: 3706588 - RNA, 14 nt, Salmonella enterica enterica serovar Typhi Ty2
gccuaaugagccag

SEQ ID NO: 3706589 - RNA, 15 nt, Salmonella enterica enterica serovar Typhi Ty2
gccuaaugagccaga

SEQ ID NO: 3706590 - RNA, 23 nt, Salmonella enterica enterica serovar Typhi Ty2
gccuaaugggccagauucuuagu

SEQ ID NO: 3706591 - RNA, 16 nt, Salmonella enterica enterica serovar Typhi Ty2
gccuacaaaaaccguu

SEQ ID NO: 3706592 - RNA, 21 nt, Salmonella enterica enterica serovar Typhi Ty2
gccuacaaaaucgcccaggcc

SEQ ID NO: 3706593 - RNA, 21 nt, Salmonella enterica enterica serovar Typhi Ty2
gccuacaacucagcguaauug

SEQ ID NO: 3706594 - RNA, 12 nt, Salmonella enterica enterica serovar Typhi Ty2
gccuacaagaau

SEQ ID NO: 3706595 - RNA, 15 nt, Salmonella enterica enterica serovar Typhi Ty2
gccuacauccggcuc

SEQ ID NO: 3706596 - RNA, 15 nt, Salmonella enterica enterica serovar Typhi Ty2
gccuaccagucgacu

SEQ ID NO: 3706597 - RNA, 17 nt, Salmonella enterica enterica serovar Typhi Ty2
gccuaccaguuguuguc

SEQ ID NO: 3706598 - RNA, 15 nt, Salmonella enterica enterica serovar Typhi Ty2
gccuacccgcgugcg

SEQ ID NO: 3706599 - RNA, 19 nt, Salmonella enterica enterica serovar Typhi Ty2
gccuaccggaauacacaau

SEQ ID NO: 3706600 - RNA, 17 nt, Salmonella enterica enterica serovar Typhi Ty2
gccuaccugccgccaua

SEQ ID NO: 3706601 - RNA, 18 nt, Salmonella enterica enterica serovar Typhi Ty2
gccuacgcgcucacggca

SEQ ID NO: 3706602 - RNA, 23 nt, Salmonella enterica enterica serovar Typhi Ty2
gccuacggucgguuucauaacgc

SEQ ID NO: 3706603 - RNA, 14 nt, Salmonella enterica enterica serovar Typhi Ty2
gccuagcgcgcgca

SEQ ID NO: 3706604 - RNA, 23 nt, Salmonella enterica enterica serovar Typhi Ty2
gccuauagacaccuuauauuccg

SEQ ID NO: 3706605 - RNA, 18 nt, Salmonella enterica enterica serovar Typhi Ty2
gccuauauuucugucgcc

SEQ ID NO: 3706606 - RNA, 23 nt, Salmonella enterica enterica serovar Typhi Ty2
gccuaucaccgcgaugaccauca

SEQ ID NO: 3706607 - RNA, 14 nt, Salmonella enterica enterica serovar Typhi Ty2
gccuaucaugcugc

SEQ ID NO: 3706608 - RNA, 12 nt, Salmonella enterica enterica serovar Typhi Ty2
gccuaucgccau

SEQ ID NO: 3706609 - RNA, 14 nt, Salmonella enterica enterica serovar Typhi Ty2
gccuaucgccauau

SEQ ID NO: 3706610 - RNA, 20 nt, Salmonella enterica enterica serovar Typhi Ty2
gccuaucgccauauacgcca

SEQ ID NO: 3706611 - RNA, 19 nt, Salmonella enterica enterica serovar Typhi Ty2
gccuaugcugucgcaauuu

SEQ ID NO: 3706612 - RNA, 21 nt, Salmonella enterica enterica serovar Typhi Ty2
gccucaaccaacggcgcuggc

SEQ ID NO: 3706613 - RNA, 22 nt, Salmonella enterica enterica serovar Typhi Ty2
gccucaauugccgccagcuccu

SEQ ID NO: 3706614 - RNA, 20 nt, Salmonella enterica enterica serovar Typhi Ty2
gccucaucgacagacuucac

SEQ ID NO: 3706615 - RNA, 11 nt, Salmonella enterica enterica serovar Typhi Ty2
gccucauugau

SEQ ID NO: 3706616 - RNA, 12 nt, Salmonella enterica enterica serovar Typhi Ty2
gccuccagcagc

SEQ ID NO: 3706617 - RNA, 18 nt, Salmonella enterica enterica serovar Typhi Ty2
gccucccaguucccccgg

SEQ ID NO: 3706618 - RNA, 17 nt, Salmonella enterica enterica serovar Typhi Ty2
gccucccccucaaucgg

SEQ ID NO: 3706619 - RNA, 13 nt, Salmonella enterica enterica serovar Typhi Ty2
gccuccccugccg

SEQ ID NO: 3706620 - RNA, 21 nt, Salmonella enterica enterica serovar Typhi Ty2
gccucccgaugguggcgucgg

SEQ ID NO: 3706621 - RNA, 12 nt, Salmonella enterica enterica serovar Typhi Ty2
gccucccugccu

SEQ ID NO: 3706622 - RNA, 21 nt, Salmonella enterica enterica serovar Typhi Ty2
gccuccgcguagcccagcgcc

SEQ ID NO: 3706623 - RNA, 15 nt, Salmonella enterica enterica serovar Typhi Ty2
gccuccgcuuccugc

SEQ ID NO: 3706624 - RNA, 20 nt, Salmonella enterica enterica serovar Typhi Ty2
gccuccggaugacgccgcuu

SEQ ID NO: 3706625 - RNA, 19 nt, Salmonella enterica enterica serovar Typhi Ty2
gccuccggcggugaagcag

SEQ ID NO: 3706626 - RNA, 23 nt, Salmonella enterica enterica serovar Typhi Ty2
gccuccggguuucacugcgugau

SEQ ID NO: 3706627 - RNA, 20 nt, Salmonella enterica enterica serovar Typhi Ty2
gccuccuggcuuaccugcuc

SEQ ID NO: 3706628 - RNA, 16 nt, Salmonella enterica enterica serovar Typhi Ty2
gccucgccaaagcgcu

SEQ ID NO: 3706629 - RNA, 16 nt, Salmonella enterica enterica serovar Typhi Ty2
gccucgcgauccgcca

SEQ ID NO: 3706630 - RNA, 22 nt, Salmonella enterica enterica serovar Typhi Ty2
gccucgcgcauccgggccgcua

SEQ ID NO: 3706631 - RNA, 21 nt, Salmonella enterica enterica serovar Typhi Ty2
gccucgcucucuuucaccagc

SEQ ID NO: 3706632 - RNA, 19 nt, Salmonella enterica enterica serovar Typhi Ty2
gccucgcugauacgcacca

SEQ ID NO: 3706633 - RNA, 22 nt, Salmonella enterica enterica serovar Typhi Ty2
gccucgcugauacgcaccagcu

SEQ ID NO: 3706634 - RNA, 14 nt, Salmonella enterica enterica serovar Typhi Ty2
gccucguccugcaa

SEQ ID NO: 3706635 - RNA, 17 nt, Salmonella enterica enterica serovar Typhi Ty2
gccucguccugcaauuu

SEQ ID NO: 3706636 - RNA, 22 nt, Salmonella enterica enterica serovar Typhi Ty2
gccucguguaaggcuuccggca

SEQ ID NO: 3706637 - RNA, 20 nt, Salmonella enterica enterica serovar Typhi Ty2
gccucguucccagcgggaac

SEQ ID NO: 3706638 - RNA, 14 nt, Salmonella enterica enterica serovar Typhi Ty2
gccucuaucuucuc

SEQ ID NO: 3706639 - RNA, 16 nt, Salmonella enterica enterica serovar Typhi Ty2
gccucucccagcauga

SEQ ID NO: 3706640 - RNA, 16 nt, Salmonella enterica enterica serovar Typhi Ty2
gccucugauuuuucca

SEQ ID NO: 3706641 - RNA, 19 nt, Salmonella enterica enterica serovar Typhi Ty2
gccucuucacauaauggag

SEQ ID NO: 3706642 - RNA, 22 nt, Salmonella enterica enterica serovar Typhi Ty2
gccucuuggaugauuuucuucu

SEQ ID NO: 3706643 - RNA, 13 nt, Salmonella enterica enterica serovar Typhi Ty2
gccucuuucagau

SEQ ID NO: 3706644 - RNA, 21 nt, Salmonella enterica enterica serovar Typhi Ty2
gccucuuucagaucgccgccg

SEQ ID NO: 3706645 - RNA, 16 nt, Salmonella enterica enterica serovar Typhi Ty2
gccucuuuugucgucc

SEQ ID NO: 3706646 - RNA, 21 nt, Salmonella enterica enterica serovar Typhi Ty2
gccucuuuuuucgccacgcca

SEQ ID NO: 3706647 - RNA, 14 nt, Salmonella enterica enterica serovar Typhi Ty2
gccugaaccggugg

SEQ ID NO: 3706648 - RNA, 21 nt, Salmonella enterica enterica serovar Typhi Ty2
gccugaagccagcaaucagcc

SEQ ID NO: 3706649 - RNA, 15 nt, Salmonella enterica enterica serovar Typhi Ty2
gccugaauaaugacc

SEQ ID NO: 3706650 - RNA, 16 nt, Salmonella enterica enterica serovar Typhi Ty2
gccugaauaaugaccu

SEQ ID NO: 3706651 - RNA, 22 nt, Salmonella enterica enterica serovar Typhi Ty2
gccugaaugcagaccucugcuu

SEQ ID NO: 3706652 - RNA, 12 nt, Salmonella enterica enterica serovar Typhi Ty2
gccugaaugcuc

SEQ ID NO: 3706653 - RNA, 17 nt, Salmonella enterica enterica serovar Typhi Ty2
gccugacagcaaugagc

SEQ ID NO: 3706654 - RNA, 20 nt, Salmonella enterica enterica serovar Typhi Ty2
gccugacgaaagucauccag

SEQ ID NO: 3706655 - RNA, 23 nt, Salmonella enterica enterica serovar Typhi Ty2
gccugacgaaagucauccaguac

SEQ ID NO: 3706656 - RNA, 18 nt, Salmonella enterica enterica serovar Typhi Ty2
gccugacggcgcugucac

SEQ ID NO: 3706657 - RNA, 18 nt, Salmonella enterica enterica serovar Typhi Ty2
gccugagcgcgcagcugg

SEQ ID NO: 3706658 - RNA, 20 nt, Salmonella enterica enterica serovar Typhi Ty2
gccugauaaauaugucggcc

SEQ ID NO: 3706659 - RNA, 20 nt, Salmonella enterica enterica serovar Typhi Ty2
gccugauaagcauagcgcca

SEQ ID NO: 3706660 - RNA, 22 nt, Salmonella enterica enterica serovar Typhi Ty2
gccugauaagcauagcgccauc

SEQ ID NO: 3706661 - RNA, 15 nt, Salmonella enterica enterica serovar Typhi Ty2
gccugauaagcgcag

SEQ ID NO: 3706662 - RNA, 15 nt, Salmonella enterica enterica serovar Typhi Ty2
gccugaucuuucugg

SEQ ID NO: 3706663 - RNA, 16 nt, Salmonella enterica enterica serovar Typhi Ty2
gccugaucuuucuggu

SEQ ID NO: 3706664 - RNA, 19 nt, Salmonella enterica enterica serovar Typhi Ty2
gccugaugcgccgccuugg

SEQ ID NO: 3706665 - RNA, 22 nt, Salmonella enterica enterica serovar Typhi Ty2
gccugaugcgcguuuagcgcca

SEQ ID NO: 3706666 - RNA, 20 nt, Salmonella enterica enterica serovar Typhi Ty2
gccugaugcugcgcauccgc

SEQ ID NO: 3706667 - RNA, 23 nt, Salmonella enterica enterica serovar Typhi Ty2
gccugaugcugcgcauccgcggc

SEQ ID NO: 3706668 - RNA, 13 nt, Salmonella enterica enterica serovar Typhi Ty2
gccugauggcgcu

SEQ ID NO: 3706669 - RNA, 17 nt, Salmonella enterica enterica serovar Typhi Ty2
gccugauggcgcuacgc

SEQ ID NO: 3706670 - RNA, 19 nt, Salmonella enterica enterica serovar Typhi Ty2
gccugauggcgcuacgcca

SEQ ID NO: 3706671 - RNA, 23 nt, Salmonella enterica enterica serovar Typhi Ty2
gccugauggcgcuacgcuuauca

SEQ ID NO: 3706672 - RNA, 17 nt, Salmonella enterica enterica serovar Typhi Ty2
gccugauggcgcugcgc

SEQ ID NO: 3706673 - RNA, 23 nt, Salmonella enterica enterica serovar Typhi Ty2
gccugauggcgcuucgcuuauca

SEQ ID NO: 3706674 - RNA, 19 nt, Salmonella enterica enterica serovar Typhi Ty2
gccugauggcguagcgcca

SEQ ID NO: 3706675 - RNA, 22 nt, Salmonella enterica enterica serovar Typhi Ty2
gccugauggucgcucuggucga

SEQ ID NO: 3706676 - RNA, 20 nt, Salmonella enterica enterica serovar Typhi Ty2
gccugauucaccaacugcug

SEQ ID NO: 3706677 - RNA, 16 nt, Salmonella enterica enterica serovar Typhi Ty2
gccugauucauuccca

SEQ ID NO: 3706678 - RNA, 21 nt, Salmonella enterica enterica serovar Typhi Ty2
gccugauucgugacaucaagc

SEQ ID NO: 3706679 - RNA, 15 nt, Salmonella enterica enterica serovar Typhi Ty2
gccuuacaggcgcau

SEQ ID NO: 3706680 - RNA, 18 nt, Salmonella enterica enterica serovar Typhi Ty2
gccuuacaggcgcaucag

SEQ ID NO: 3706681 - RNA, 13 nt, Salmonella enterica enterica serovar Typhi Ty2
gccuuacccgacc

SEQ ID NO: 3706682 - RNA, 14 nt, Salmonella enterica enterica serovar Typhi Ty2
gccuuacccggccu

SEQ ID NO: 3706683 - RNA, 17 nt, Salmonella enterica enterica serovar Typhi Ty2
gccuuaccgggccuacg

SEQ ID NO: 3706684 - RNA, 15 nt, Salmonella enterica enterica serovar Typhi Ty2
gccuuaucaggccug

SEQ ID NO: 3706685 - RNA, 19 nt, Salmonella enterica enterica serovar Typhi Ty2
gccuuauccgaccuacaga

SEQ ID NO: 3706686 - RNA, 22 nt, Salmonella enterica enterica serovar Typhi Ty2
gccuuauccggccuacaacuca

SEQ ID NO: 3706687 - RNA, 19 nt, Salmonella enterica enterica serovar Typhi Ty2
gccuuauccggccuacacg

SEQ ID NO: 3706688 - RNA, 18 nt, Salmonella enterica enterica serovar Typhi Ty2
gccuuauccggccuacag

SEQ ID NO: 3706689 - RNA, 18 nt, Salmonella enterica enterica serovar Typhi Ty2
gccuuauccggccuacgu

SEQ ID NO: 3706690 - RNA, 13 nt, Salmonella enterica enterica serovar Typhi Ty2
gccuuauccggcg

SEQ ID NO: 3706691 - RNA, 23 nt, Salmonella enterica enterica serovar Typhi Ty2
gccuuaucgagugucaauaagcc

SEQ ID NO: 3706692 - RNA, 16 nt, Salmonella enterica enterica serovar Typhi Ty2
gccuucaacgcucagu

SEQ ID NO: 3706693 - RNA, 14 nt, Salmonella enterica enterica serovar Typhi Ty2
gccuucaaucagca

SEQ ID NO: 3706694 - RNA, 21 nt, Salmonella enterica enterica serovar Typhi Ty2
gccuucaauuugaccugaccu

SEQ ID NO: 3706695 - RNA, 17 nt, Salmonella enterica enterica serovar Typhi Ty2
gccuucacacugcgccg

SEQ ID NO: 3706696 - RNA, 20 nt, Salmonella enterica enterica serovar Typhi Ty2
gccuucacacugcgccgcca

SEQ ID NO: 3706697 - RNA, 24 nt, Salmonella enterica enterica serovar Typhi Ty2
gccuucauaaugaauacgcuccag

SEQ ID NO: 3706698 - RNA, 14 nt, Salmonella enterica enterica serovar Typhi Ty2
gccuucauuaauuu

SEQ ID NO: 3706699 - RNA, 13 nt, Salmonella enterica enterica serovar Typhi Ty2
gccuuccagaaau

SEQ ID NO: 3706700 - RNA, 22 nt, Salmonella enterica enterica serovar Typhi Ty2
gccuucccgauaaccgcguuca

SEQ ID NO: 3706701 - RNA, 20 nt, Salmonella enterica enterica serovar Typhi Ty2
gccuuccguccacaucgcga

SEQ ID NO: 3706702 - RNA, 16 nt, Salmonella enterica enterica serovar Typhi Ty2
gccuuccuccagcauc

SEQ ID NO: 3706703 - RNA, 22 nt, Salmonella enterica enterica serovar Typhi Ty2
gccuuccuccagcaucaggugg

SEQ ID NO: 3706704 - RNA, 17 nt, Salmonella enterica enterica serovar Typhi Ty2
gccuuccuccaguaauu

SEQ ID NO: 3706705 - RNA, 22 nt, Salmonella enterica enterica serovar Typhi Ty2
gccuuccuguggaaggcauuau

SEQ ID NO: 3706706 - RNA, 17 nt, Salmonella enterica enterica serovar Typhi Ty2
gccuucgauuaacgcau

SEQ ID NO: 3706707 - RNA, 15 nt, Salmonella enterica enterica serovar Typhi Ty2
gccuucgccuucacg

SEQ ID NO: 3706708 - RNA, 24 nt, Salmonella enterica enterica serovar Typhi Ty2
gccuucggccugaaucagcaucuu

SEQ ID NO: 3706709 - RNA, 15 nt, Salmonella enterica enterica serovar Typhi Ty2
gccuucggcgcuggg

SEQ ID NO: 3706710 - RNA, 18 nt, Salmonella enterica enterica serovar Typhi Ty2
gccuucguuauaaggccu

SEQ ID NO: 3706711 - RNA, 20 nt, Salmonella enterica enterica serovar Typhi Ty2
gccuucguuauaaggccugc

SEQ ID NO: 3706712 - RNA, 14 nt, Salmonella enterica enterica serovar Typhi Ty2
gccuucuccccuuc

SEQ ID NO: 3706713 - RNA, 18 nt, Salmonella enterica enterica serovar Typhi Ty2
gccuucuucgcaaucucc

SEQ ID NO: 3706714 - RNA, 21 nt, Salmonella enterica enterica serovar Typhi Ty2
gccuugaaguuauccagcgcc

SEQ ID NO: 3706715 - RNA, 16 nt, Salmonella enterica enterica serovar Typhi Ty2
gccuugauaccgccgc

SEQ ID NO: 3706716 - RNA, 20 nt, Salmonella enterica enterica serovar Typhi Ty2
gccuugauccuguaacgcau

SEQ ID NO: 3706717 - RNA, 14 nt, Salmonella enterica enterica serovar Typhi Ty2
gccuugcaaaccgg

SEQ ID NO: 3706718 - RNA, 22 nt, Salmonella enterica enterica serovar Typhi Ty2
gccuugcccguauugaagcgau

SEQ ID NO: 3706719 - RNA, 20 nt, Salmonella enterica enterica serovar Typhi Ty2
gccuugugucacauuuucuu

SEQ ID NO: 3706720 - RNA, 21 nt, Salmonella enterica enterica serovar Typhi Ty2
gccuuuacugaaucucagaua

SEQ ID NO: 3706721 - RNA, 14 nt, Salmonella enterica enterica serovar Typhi Ty2
gccuuuauccagcg

SEQ ID NO: 3706722 - RNA, 14 nt, Salmonella enterica enterica serovar Typhi Ty2
gccuuuaugcaguu

SEQ ID NO: 3706723 - RNA, 20 nt, Salmonella enterica enterica serovar Typhi Ty2
gccuuucacgcguucaauau

SEQ ID NO: 3706724 - RNA, 15 nt, Salmonella enterica enterica serovar Typhi Ty2
gccuuucagaucggc

SEQ ID NO: 3706725 - RNA, 17 nt, Salmonella enterica enterica serovar Typhi Ty2
gccuuucagaucggcaa

SEQ ID NO: 3706726 - RNA, 17 nt, Salmonella enterica enterica serovar Typhi Ty2
gccuuucagaugguuug

SEQ ID NO: 3706727 - RNA, 22 nt, Salmonella enterica enterica serovar Typhi Ty2
gccuuucuuauuuuuuucaacg

SEQ ID NO: 3706728 - RNA, 14 nt, Salmonella enterica enterica serovar Typhi Ty2
gccuuugccuucgc

SEQ ID NO: 3706729 - RNA, 17 nt, Salmonella enterica enterica serovar Typhi Ty2
gccuuugcguaccgcaa

SEQ ID NO: 3706730 - RNA, 19 nt, Salmonella enterica enterica serovar Typhi Ty2
gccuuugcguaccgcaaug

SEQ ID NO: 3706731 - RNA, 14 nt, Salmonella enterica enterica serovar Typhi Ty2
gccuuuggcaauca

SEQ ID NO: 3706732 - RNA, 23 nt, Salmonella enterica enterica serovar Typhi Ty2
gccuuuuaucaaugcacugacuu

SEQ ID NO: 3706733 - RNA, 18 nt, Salmonella enterica enterica serovar Typhi Ty2
gccuuuucccccagcauu

SEQ ID NO: 3706734 - RNA, 20 nt, Salmonella enterica enterica serovar Typhi Ty2
gccuuuucccccagcauuuu

SEQ ID NO: 3706735 - RNA, 22 nt, Salmonella enterica enterica serovar Typhi Ty2
gccuuuuucaacagcacccagg

SEQ ID NO: 3706736 - RNA, 15 nt, Salmonella enterica enterica serovar Typhi Ty2
gccuuuuucccacug

SEQ ID NO: 3706737 - RNA, 15 nt, Salmonella enterica enterica serovar Typhi Ty2
gccuuuuuccgggau

SEQ ID NO: 3706738 - RNA, 17 nt, Salmonella enterica enterica serovar Typhi Ty2
gccuuuuuuaauccagg

SEQ ID NO: 3706739 - RNA, 20 nt, Salmonella enterica enterica serovar Typhi Ty2
gccuuuuuuaauccaggaau

SEQ ID NO: 3706740 - RNA, 22 nt, Salmonella enterica enterica serovar Typhi Ty2
gccuuuuuuauacuccagcaga

SEQ ID NO: 3706741 - RNA, 23 nt, Salmonella enterica enterica serovar Typhi Ty2
gccuuuuuuauacuccagcagac

SEQ ID NO: 3706742 - RNA, 18 nt, Salmonella enterica enterica serovar Typhi Ty2
gccuuuuuucaccugcaa

SEQ ID NO: 3706743 - RNA, 15 nt, Salmonella enterica enterica serovar Typhi Ty2
gcgaaaaaaagcccg

SEQ ID NO: 3706744 - RNA, 12 nt, Salmonella enterica enterica serovar Typhi Ty2
gcgaaaaagccg

SEQ ID NO: 3706745 - RNA, 15 nt, Salmonella enterica enterica serovar Typhi Ty2
gcgaaaacagcuggc

SEQ ID NO: 3706746 - RNA, 15 nt, Salmonella enterica enterica serovar Typhi Ty2
gcgaaaacggcguag

SEQ ID NO: 3706747 - RNA, 23 nt, Salmonella enterica enterica serovar Typhi Ty2
gcgaaaacguugacuuaaaaagc

SEQ ID NO: 3706748 - RNA, 23 nt, Salmonella enterica enterica serovar Typhi Ty2
gcgaaaaucgguaacaucaagua

SEQ ID NO: 3706749 - RNA, 23 nt, Salmonella enterica enterica serovar Typhi Ty2
gcgaaacaggucggcaugcaucu

SEQ ID NO: 3706750 - RNA, 20 nt, Salmonella enterica enterica serovar Typhi Ty2
gcgaaagaagcgcuggagaa

SEQ ID NO: 3706751 - RNA, 17 nt, Salmonella enterica enterica serovar Typhi Ty2
gcgaaagagaaagcgcu

SEQ ID NO: 3706752 - RNA, 21 nt, Salmonella enterica enterica serovar Typhi Ty2
gcgaaagcacuucucgcgcau

SEQ ID NO: 3706753 - RNA, 21 nt, Salmonella enterica enterica serovar Typhi Ty2
gcgaaaucaaagaccuccgcc

SEQ ID NO: 3706754 - RNA, 21 nt, Salmonella enterica enterica serovar Typhi Ty2
gcgaaaugcgaauccggcggc

SEQ ID NO: 3706755 - RNA, 14 nt, Salmonella enterica enterica serovar Typhi Ty2
gcgaaauugguaga

SEQ ID NO: 3706756 - RNA, 17 nt, Salmonella enterica enterica serovar Typhi Ty2
gcgaaauuuaauauaug

SEQ ID NO: 3706757 - RNA, 19 nt, Salmonella enterica enterica serovar Typhi Ty2
gcgaacaaagccccgggcg

SEQ ID NO: 3706758 - RNA, 12 nt, Salmonella enterica enterica serovar Typhi Ty2
gcgaacagcgca

SEQ ID NO: 3706759 - RNA, 13 nt, Salmonella enterica enterica serovar Typhi Ty2
gcgaacagcgcac

SEQ ID NO: 3706760 - RNA, 12 nt, Salmonella enterica enterica serovar Typhi Ty2
gcgaacagcgcu

SEQ ID NO: 3706761 - RNA, 18 nt, Salmonella enterica enterica serovar Typhi Ty2
gcgacgauaaaucgguuc

SEQ ID NO: 3706762 - RNA, 15 nt, Salmonella enterica enterica serovar Typhi Ty2
gcgacgaucagcgcc

SEQ ID NO: 3706763 - RNA, 17 nt, Salmonella enterica enterica serovar Typhi Ty2
gcgacgccaaaccugcc

SEQ ID NO: 3706764 - RNA, 22 nt, Salmonella enterica enterica serovar Typhi Ty2
gcgacgccagauuaucggccag

SEQ ID NO: 3706765 - RNA, 14 nt, Salmonella enterica enterica serovar Typhi Ty2
gcgacgccgccauc

SEQ ID NO: 3706766 - RNA, 18 nt, Salmonella enterica enterica serovar Typhi Ty2
gcgacgccgccauccggc

SEQ ID NO: 3706767 - RNA, 17 nt, Salmonella enterica enterica serovar Typhi Ty2
gcgacgcgccagccagc

SEQ ID NO: 3706768 - RNA, 16 nt, Salmonella enterica enterica serovar Typhi Ty2
gcgacgcggcgaguua

SEQ ID NO: 3706769 - RNA, 15 nt, Salmonella enterica enterica serovar Typhi Ty2
gcgacggaccggcag

SEQ ID NO: 3706770 - RNA, 16 nt, Salmonella enterica enterica serovar Typhi Ty2
gcgacggagcgugcug

SEQ ID NO: 3706771 - RNA, 15 nt, Salmonella enterica enterica serovar Typhi Ty2
gcgacggcgcuggcu

SEQ ID NO: 3706772 - RNA, 13 nt, Salmonella enterica enterica serovar Typhi Ty2
gcgacggcggcgu

SEQ ID NO: 3706773 - RNA, 20 nt, Salmonella enterica enterica serovar Typhi Ty2
gcgacggcguaagcgcuaug

SEQ ID NO: 3706774 - RNA, 18 nt, Salmonella enterica enterica serovar Typhi Ty2
gcgacggcguauucggca

SEQ ID NO: 3706775 - RNA, 15 nt, Salmonella enterica enterica serovar Typhi Ty2
gcgacggggcgcaga

SEQ ID NO: 3706776 - RNA, 18 nt, Salmonella enterica enterica serovar Typhi Ty2
gcgacgugacggugaccu

SEQ ID NO: 3706777 - RNA, 20 nt, Salmonella enterica enterica serovar Typhi Ty2
gcgacguuaucucgccagga

SEQ ID NO: 3706778 - RNA, 18 nt, Salmonella enterica enterica serovar Typhi Ty2
gcgacguugucuucaucu

SEQ ID NO: 3706779 - RNA, 20 nt, Salmonella enterica enterica serovar Typhi Ty2
gcgacuaccucuuauccggc

SEQ ID NO: 3706780 - RNA, 21 nt, Salmonella enterica enterica serovar Typhi Ty2
gcgacuaugccggcugcagca

SEQ ID NO: 3706781 - RNA, 20 nt, Salmonella enterica enterica serovar Typhi Ty2
gcgacucuguauuuaauacc

SEQ ID NO: 3706782 - RNA, 16 nt, Salmonella enterica enterica serovar Typhi Ty2
gcgacugaaaaucaaa

SEQ ID NO: 3706783 - RNA, 12 nt, Salmonella enterica enterica serovar Typhi Ty2
gcgacugccgca

SEQ ID NO: 3706784 - RNA, 14 nt, Salmonella enterica enterica serovar Typhi Ty2
gcgacugccgcaga

SEQ ID NO: 3706785 - RNA, 18 nt, Salmonella enterica enterica serovar Typhi Ty2
gcgacuggaacgucauca

SEQ ID NO: 3706786 - RNA, 16 nt, Salmonella enterica enterica serovar Typhi Ty2
gcgacuucauucaggc

SEQ ID NO: 3706787 - RNA, 17 nt, Salmonella enterica enterica serovar Typhi Ty2
gcgacuucauucaggca

SEQ ID NO: 3706788 - RNA, 16 nt, Salmonella enterica enterica serovar Typhi Ty2
gcgacuuggaaaguug

SEQ ID NO: 3706789 - RNA, 21 nt, Salmonella enterica enterica serovar Typhi Ty2
gcgacuuucacgaaaccggcg

SEQ ID NO: 3706790 - RNA, 20 nt, Salmonella enterica enterica serovar Typhi Ty2
gcgacuuuccgccaccagau

SEQ ID NO: 3706791 - RNA, 11 nt, Salmonella enterica enterica serovar Typhi Ty2
gcgagaaaaaa

SEQ ID NO: 3706792 - RNA, 22 nt, Salmonella enterica enterica serovar Typhi Ty2
gcgagaaggcuuugccauacgc

SEQ ID NO: 3706793 - RNA, 17 nt, Salmonella enterica enterica serovar Typhi Ty2
gcgagaccauauugaag

SEQ ID NO: 3706794 - RNA, 20 nt, Salmonella enterica enterica serovar Typhi Ty2
gcgagaccaucaacagcgug

SEQ ID NO: 3706795 - RNA, 14 nt, Salmonella enterica enterica serovar Typhi Ty2
gcgagacgccuggg

SEQ ID NO: 3706796 - RNA, 15 nt, Salmonella enterica enterica serovar Typhi Ty2
gcgagagaaaaaaau

SEQ ID NO: 3706797 - RNA, 16 nt, Salmonella enterica enterica serovar Typhi Ty2
gcgagaguuugugaug

SEQ ID NO: 3706798 - RNA, 22 nt, Salmonella enterica enterica serovar Typhi Ty2
gcgagcaacuuuuucugcgcgg

SEQ ID NO: 3706799 - RNA, 20 nt, Salmonella enterica enterica serovar Typhi Ty2
gcgagcacuuuuuccuccug

SEQ ID NO: 3706800 - RNA, 16 nt, Salmonella enterica enterica serovar Typhi Ty2
gcgagcaggaauagcu

SEQ ID NO: 3706801 - RNA, 18 nt, Salmonella enterica enterica serovar Typhi Ty2
gcgagcaguucagcagca

SEQ ID NO: 3706802 - RNA, 11 nt, Salmonella enterica enterica serovar Typhi Ty2
gcgagcccugu

SEQ ID NO: 3706803 - RNA, 15 nt, Salmonella enterica enterica serovar Typhi Ty2
gcgagccuucaacaa

SEQ ID NO: 3706804 - RNA, 19 nt, Salmonella enterica enterica serovar Typhi Ty2
gcgagcgcauacgcugucc

SEQ ID NO: 3706805 - RNA, 11 nt, Salmonella enterica enterica serovar Typhi Ty2
gcgagcgccgu

SEQ ID NO: 3706806 - RNA, 22 nt, Salmonella enterica enterica serovar Typhi Ty2
gcgaggaacaucagccagcagc

SEQ ID NO: 3706807 - RNA, 13 nt, Salmonella enterica enterica serovar Typhi Ty2
gcgaggcgcgcuc

SEQ ID NO: 3706808 - RNA, 20 nt, Salmonella enterica enterica serovar Typhi Ty2
gcgagggauuuccuggcagu

SEQ ID NO: 3706809 - RNA, 21 nt, Salmonella enterica enterica serovar Typhi Ty2
gcgaggugguucauaauaccu

SEQ ID NO: 3706810 - RNA, 20 nt, Salmonella enterica enterica serovar Typhi Ty2
gcgaguccgcuuuucguccc

SEQ ID NO: 3706811 - RNA, 13 nt, Salmonella enterica enterica serovar Typhi Ty2
gcgauaaaccagc

SEQ ID NO: 3706812 - RNA, 14 nt, Salmonella enterica enterica serovar Typhi Ty2
gcgauaaaccagcc

SEQ ID NO: 3706813 - RNA, 19 nt, Salmonella enterica enterica serovar Typhi Ty2
gcgauaaccgccgccgcgc

SEQ ID NO: 3706814 - RNA, 20 nt, Salmonella enterica enterica serovar Typhi Ty2
gcgauaaugaagcauaaaaa

SEQ ID NO: 3706815 - RNA, 17 nt, Salmonella enterica enterica serovar Typhi Ty2
gcgauacccccaaccgu

SEQ ID NO: 3706816 - RNA, 15 nt, Salmonella enterica enterica serovar Typhi Ty2
gcgauacgcagcacc

SEQ ID NO: 3706817 - RNA, 22 nt, Salmonella enterica enterica serovar Typhi Ty2
gcgauacgcgcguucguugaug

SEQ ID NO: 3706818 - RNA, 15 nt, Salmonella enterica enterica serovar Typhi Ty2
gcgauacguaggccu

SEQ ID NO: 3706819 - RNA, 18 nt, Salmonella enterica enterica serovar Typhi Ty2
gcgauacucugcccgccg

SEQ ID NO: 3706820 - RNA, 14 nt, Salmonella enterica enterica serovar Typhi Ty2
gcgauacugccgcc

SEQ ID NO: 3706821 - RNA, 20 nt, Salmonella enterica enterica serovar Typhi Ty2
gcgauagagaguuccuccug

SEQ ID NO: 3706822 - RNA, 22 nt, Salmonella enterica enterica serovar Typhi Ty2
gcgauaguguggucgucagccg

SEQ ID NO: 3706823 - RNA, 18 nt, Salmonella enterica enterica serovar Typhi Ty2
gcgauauagcgcugaagu

SEQ ID NO: 3706824 - RNA, 20 nt, Salmonella enterica enterica serovar Typhi Ty2
gcgauaucaacgucuugccg

SEQ ID NO: 3706825 - RNA, 24 nt, Salmonella enterica enterica serovar Typhi Ty2
gcgauauccaccgguacgcuccag

SEQ ID NO: 3706826 - RNA, 17 nt, Salmonella enterica enterica serovar Typhi Ty2
gcgauauccgugccgcc

SEQ ID NO: 3706827 - RNA, 19 nt, Salmonella enterica enterica serovar Typhi Ty2
gcgauauucaacagcccga

SEQ ID NO: 3706828 - RNA, 16 nt, Salmonella enterica enterica serovar Typhi Ty2
gcgauauucgggcgca

SEQ ID NO: 3706829 - RNA, 15 nt, Salmonella enterica enterica serovar Typhi Ty2
gcgaucacuaccgcc

SEQ ID NO: 3706830 - RNA, 18 nt, Salmonella enterica enterica serovar Typhi Ty2
gcgaucacuaccgccauc

SEQ ID NO: 3706831 - RNA, 19 nt, Salmonella enterica enterica serovar Typhi Ty2
gcgaucacuucgacaugcg

SEQ ID NO: 3706832 - RNA, 11 nt, Salmonella enterica enterica serovar Typhi Ty2
gcgaucagcgc

SEQ ID NO: 3706833 - RNA, 20 nt, Salmonella enterica enterica serovar Typhi Ty2
gcgauccagccccagcgcca

SEQ ID NO: 3706834 - RNA, 21 nt, Salmonella enterica enterica serovar Typhi Ty2
gcgauccagccccagcgccag

SEQ ID NO: 3706835 - RNA, 22 nt, Salmonella enterica enterica serovar Typhi Ty2
gcgauccagccccagcgccagc

SEQ ID NO: 3706836 - RNA, 20 nt, Salmonella enterica enterica serovar Typhi Ty2
gcgaucccaguugaucggcc

SEQ ID NO: 3706837 - RNA, 21 nt, Salmonella enterica enterica serovar Typhi Ty2
gcgauccgcgagacgccuggg

SEQ ID NO: 3706838 - RNA, 23 nt, Salmonella enterica enterica serovar Typhi Ty2
gcgaucgacuaauuuuaggaaga

SEQ ID NO: 3706839 - RNA, 17 nt, Salmonella enterica enterica serovar Typhi Ty2
gcgaucgcgauucgccc

SEQ ID NO: 3706840 - RNA, 22 nt, Salmonella enterica enterica serovar Typhi Ty2
gcgaucgcgccggucgccagca

SEQ ID NO: 3706841 - RNA, 13 nt, Salmonella enterica enterica serovar Typhi Ty2
gcgaucgcuucca

SEQ ID NO: 3706842 - RNA, 16 nt, Salmonella enterica enterica serovar Typhi Ty2
gcgaucggcuguaccu

SEQ ID NO: 3706843 - RNA, 14 nt, Salmonella enterica enterica serovar Typhi Ty2
gcgcaguggcgggu

SEQ ID NO: 3706844 - RNA, 21 nt, Salmonella enterica enterica serovar Typhi Ty2
gcgcaguugccaguacagcag

SEQ ID NO: 3706845 - RNA, 21 nt, Salmonella enterica enterica serovar Typhi Ty2
gcgcauaagccacuucaacca

SEQ ID NO: 3706846 - RNA, 17 nt, Salmonella enterica enterica serovar Typhi Ty2
gcgcauacgucaugccu

SEQ ID NO: 3706847 - RNA, 13 nt, Salmonella enterica enterica serovar Typhi Ty2
gcgcauacucuuc

SEQ ID NO: 3706848 - RNA, 18 nt, Salmonella enterica enterica serovar Typhi Ty2
gcgcauacucuuccguca

SEQ ID NO: 3706849 - RNA, 15 nt, Salmonella enterica enterica serovar Typhi Ty2
gcgcauacuuauaca

SEQ ID NO: 3706850 - RNA, 19 nt, Salmonella enterica enterica serovar Typhi Ty2
gcgcauacuuauacagcgc

SEQ ID NO: 3706851 - RNA, 19 nt, Salmonella enterica enterica serovar Typhi Ty2
gcgcauagauauaacccag

SEQ ID NO: 3706852 - RNA, 15 nt, Salmonella enterica enterica serovar Typhi Ty2
gcgcauauuccggcg

SEQ ID NO: 3706853 - RNA, 16 nt, Salmonella enterica enterica serovar Typhi Ty2
gcgcauauuccggcga

SEQ ID NO: 3706854 - RNA, 17 nt, Salmonella enterica enterica serovar Typhi Ty2
gcgcauauuccggcgac

SEQ ID NO: 3706855 - RNA, 19 nt, Salmonella enterica enterica serovar Typhi Ty2
gcgcaucaacgccaggcag

SEQ ID NO: 3706856 - RNA, 14 nt, Salmonella enterica enterica serovar Typhi Ty2
gcgcaucagaaaaa

SEQ ID NO: 3706857 - RNA, 13 nt, Salmonella enterica enterica serovar Typhi Ty2
gcgcauccggcau

SEQ ID NO: 3706858 - RNA, 14 nt, Salmonella enterica enterica serovar Typhi Ty2
gcgcauccggcauc

SEQ ID NO: 3706859 - RNA, 17 nt, Salmonella enterica enterica serovar Typhi Ty2
gcgcauccgucaggccc

SEQ ID NO: 3706860 - RNA, 18 nt, Salmonella enterica enterica serovar Typhi Ty2
gcgcaucgauauaagcgc

SEQ ID NO: 3706861 - RNA, 17 nt, Salmonella enterica enterica serovar Typhi Ty2
gcgcaucgcaucagggc

SEQ ID NO: 3706862 - RNA, 18 nt, Salmonella enterica enterica serovar Typhi Ty2
gcgcaucuggucauggcu

SEQ ID NO: 3706863 - RNA, 12 nt, Salmonella enterica enterica serovar Typhi Ty2
gcgcauggaaga

SEQ ID NO: 3706864 - RNA, 15 nt, Salmonella enterica enterica serovar Typhi Ty2
gcgcauggccauaga

SEQ ID NO: 3706865 - RNA, 15 nt, Salmonella enterica enterica serovar Typhi Ty2
gcgcauguaaccaaa

SEQ ID NO: 3706866 - RNA, 19 nt, Salmonella enterica enterica serovar Typhi Ty2
gcgcaugugagcaucggcg

SEQ ID NO: 3706867 - RNA, 21 nt, Salmonella enterica enterica serovar Typhi Ty2
gcgcaugugagcaucggcgau

SEQ ID NO: 3706868 - RNA, 17 nt, Salmonella enterica enterica serovar Typhi Ty2
gcgcauuaacgccaugc

SEQ ID NO: 3706869 - RNA, 22 nt, Salmonella enterica enterica serovar Typhi Ty2
gcgcauuaauaugcgcaaucac

SEQ ID NO: 3706870 - RNA, 19 nt, Salmonella enterica enterica serovar Typhi Ty2
gcgcauugccugaaccggu

SEQ ID NO: 3706871 - RNA, 23 nt, Salmonella enterica enterica serovar Typhi Ty2
gcgcauuucuguugcaaauauuc

SEQ ID NO: 3706872 - RNA, 16 nt, Salmonella enterica enterica serovar Typhi Ty2
gcgcauuugcggcguc

SEQ ID NO: 3706873 - RNA, 17 nt, Salmonella enterica enterica serovar Typhi Ty2
gcgcauuuuacugccgu

SEQ ID NO: 3706874 - RNA, 17 nt, Salmonella enterica enterica serovar Typhi Ty2
gcgccaaaagaggcagc

SEQ ID NO: 3706875 - RNA, 18 nt, Salmonella enterica enterica serovar Typhi Ty2
gcgccaaacgggcaagcc

SEQ ID NO: 3706876 - RNA, 20 nt, Salmonella enterica enterica serovar Typhi Ty2
gcgccaaaguuaaucagcgc

SEQ ID NO: 3706877 - RNA, 20 nt, Salmonella enterica enterica serovar Typhi Ty2
gcgccaacgccacugccaua

SEQ ID NO: 3706878 - RNA, 19 nt, Salmonella enterica enterica serovar Typhi Ty2
gcgccaauccaugccggcu

SEQ ID NO: 3706879 - RNA, 13 nt, Salmonella enterica enterica serovar Typhi Ty2
gcgccaaucgcga

SEQ ID NO: 3706880 - RNA, 17 nt, Salmonella enterica enterica serovar Typhi Ty2
gcgccaaugcgaaaaua

SEQ ID NO: 3706881 - RNA, 15 nt, Salmonella enterica enterica serovar Typhi Ty2
gcgccacgcccacgc

SEQ ID NO: 3706882 - RNA, 16 nt, Salmonella enterica enterica serovar Typhi Ty2
gcgccacuucacuggc

SEQ ID NO: 3706883 - RNA, 22 nt, Salmonella enterica enterica serovar Typhi Ty2
gcgccacuuccagcgcgccguc

SEQ ID NO: 3706884 - RNA, 22 nt, Salmonella enterica enterica serovar Typhi Ty2
gcgccagaaagguauuaaguga

SEQ ID NO: 3706885 - RNA, 21 nt, Salmonella enterica enterica serovar Typhi Ty2
gcgccagacccacuaacugcc

SEQ ID NO: 3706886 - RNA, 14 nt, Salmonella enterica enterica serovar Typhi Ty2
gcgccagacgccau

SEQ ID NO: 3706887 - RNA, 12 nt, Salmonella enterica enterica serovar Typhi Ty2
gcgccagcagca

SEQ ID NO: 3706888 - RNA, 16 nt, Salmonella enterica enterica serovar Typhi Ty2
gcgccagcagcagcgc

SEQ ID NO: 3706889 - RNA, 12 nt, Salmonella enterica enterica serovar Typhi Ty2
gcgccagcaggu

SEQ ID NO: 3706890 - RNA, 11 nt, Salmonella enterica enterica serovar Typhi Ty2
gcgccagcaug

SEQ ID NO: 3706891 - RNA, 14 nt, Salmonella enterica enterica serovar Typhi Ty2
gcgccagccagcgc

SEQ ID NO: 3706892 - RNA, 19 nt, Salmonella enterica enterica serovar Typhi Ty2
gcgccagccagcgccacca

SEQ ID NO: 3706893 - RNA, 16 nt, Salmonella enterica enterica serovar Typhi Ty2
gcgccagccagucgcc

SEQ ID NO: 3706894 - RNA, 18 nt, Salmonella enterica enterica serovar Typhi Ty2
gcgccagccagucgccag

SEQ ID NO: 3706895 - RNA, 20 nt, Salmonella enterica enterica serovar Typhi Ty2
gcgccagccagucgccaggc

SEQ ID NO: 3706896 - RNA, 22 nt, Salmonella enterica enterica serovar Typhi Ty2
gcgccagccagucgccaggcaa

SEQ ID NO: 3706897 - RNA, 22 nt, Salmonella enterica enterica serovar Typhi Ty2
gcgccagccauagcagcaaauu

SEQ ID NO: 3706898 - RNA, 17 nt, Salmonella enterica enterica serovar Typhi Ty2
gcgccagccgcgccauc

SEQ ID NO: 3706899 - RNA, 20 nt, Salmonella enterica enterica serovar Typhi Ty2
gcgccagcgaccaccguccc

SEQ ID NO: 3706900 - RNA, 12 nt, Salmonella enterica enterica serovar Typhi Ty2
gcgccagcgacg

SEQ ID NO: 3706901 - RNA, 17 nt, Salmonella enterica enterica serovar Typhi Ty2
gcgccagcgauggggca

SEQ ID NO: 3706902 - RNA, 12 nt, Salmonella enterica enterica serovar Typhi Ty2
gcgccagcgcau

SEQ ID NO: 3706903 - RNA, 15 nt, Salmonella enterica enterica serovar Typhi Ty2
gcgccagcggcggcu

SEQ ID NO: 3706904 - RNA, 14 nt, Salmonella enterica enterica serovar Typhi Ty2
gcgccagcggcugc

SEQ ID NO: 3706905 - RNA, 17 nt, Salmonella enterica enterica serovar Typhi Ty2
gcgccagcgugcuaagc

SEQ ID NO: 3706906 - RNA, 15 nt, Salmonella enterica enterica serovar Typhi Ty2
gcgccagcucaugca

SEQ ID NO: 3706907 - RNA, 19 nt, Salmonella enterica enterica serovar Typhi Ty2
gcgccagcuuucggcgagc

SEQ ID NO: 3706908 - RNA, 15 nt, Salmonella enterica enterica serovar Typhi Ty2
gcgccaggaaacucg

SEQ ID NO: 3706909 - RNA, 12 nt, Salmonella enterica enterica serovar Typhi Ty2
gcgccaggccau

SEQ ID NO: 3706910 - RNA, 16 nt, Salmonella enterica enterica serovar Typhi Ty2
gcgccaggccauugcu

SEQ ID NO: 3706911 - RNA, 17 nt, Salmonella enterica enterica serovar Typhi Ty2
gcgccaggcccagccgc

SEQ ID NO: 3706912 - RNA, 19 nt, Salmonella enterica enterica serovar Typhi Ty2
gcgccaggucucauagcgc

SEQ ID NO: 3706913 - RNA, 21 nt, Salmonella enterica enterica serovar Typhi Ty2
gcgccaguuuuuccuguuccu

SEQ ID NO: 3706914 - RNA, 19 nt, Salmonella enterica enterica serovar Typhi Ty2
gcgccauaguccauuacgc

SEQ ID NO: 3706915 - RNA, 22 nt, Salmonella enterica enterica serovar Typhi Ty2
gcgccauauccucgcugggcca

SEQ ID NO: 3706916 - RNA, 21 nt, Salmonella enterica enterica serovar Typhi Ty2
gcgccauauugcuguauuuua

SEQ ID NO: 3706917 - RNA, 13 nt, Salmonella enterica enterica serovar Typhi Ty2
gcgccaucaggca

SEQ ID NO: 3706918 - RNA, 16 nt, Salmonella enterica enterica serovar Typhi Ty2
gcgccaucaggcacaa

SEQ ID NO: 3706919 - RNA, 18 nt, Salmonella enterica enterica serovar Typhi Ty2
gcgccaucaggcaucuga

SEQ ID NO: 3706920 - RNA, 13 nt, Salmonella enterica enterica serovar Typhi Ty2
gcgccaucaggcc

SEQ ID NO: 3706921 - RNA, 20 nt, Salmonella enterica enterica serovar Typhi Ty2
gcgccaucauccggcaacua

SEQ ID NO: 3706922 - RNA, 14 nt, Salmonella enterica enterica serovar Typhi Ty2
gcgccaucaugcag

SEQ ID NO: 3706923 - RNA, 18 nt, Salmonella enterica enterica serovar Typhi Ty2
gcgccauccaccaggcau

SEQ ID NO: 3706924 - RNA, 20 nt, Salmonella enterica enterica serovar Typhi Ty2
gcgccauccaccaggcaugc

SEQ ID NO: 3706925 - RNA, 21 nt, Salmonella enterica enterica serovar Typhi Ty2
gcgccuccgcguagcccagcg

SEQ ID NO: 3706926 - RNA, 18 nt, Salmonella enterica enterica serovar Typhi Ty2
gcgccugaagauacgcca

SEQ ID NO: 3706927 - RNA, 19 nt, Salmonella enterica enterica serovar Typhi Ty2
gcgccugaagauacgccag

SEQ ID NO: 3706928 - RNA, 19 nt, Salmonella enterica enterica serovar Typhi Ty2
gcgccugaauguacgcaua

SEQ ID NO: 3706929 - RNA, 16 nt, Salmonella enterica enterica serovar Typhi Ty2
gcgccugaccgcgauc

SEQ ID NO: 3706930 - RNA, 21 nt, Salmonella enterica enterica serovar Typhi Ty2
gcgccugacgcggacgccacc

SEQ ID NO: 3706931 - RNA, 19 nt, Salmonella enterica enterica serovar Typhi Ty2
gcgccugaugcacauuguc

SEQ ID NO: 3706932 - RNA, 17 nt, Salmonella enterica enterica serovar Typhi Ty2
gcgccugcauacucaca

SEQ ID NO: 3706933 - RNA, 18 nt, Salmonella enterica enterica serovar Typhi Ty2
gcgccugcauacucacau

SEQ ID NO: 3706934 - RNA, 21 nt, Salmonella enterica enterica serovar Typhi Ty2
gcgccuggaugaagcagacau

SEQ ID NO: 3706935 - RNA, 17 nt, Salmonella enterica enterica serovar Typhi Ty2
gcgccugggauaagcag

SEQ ID NO: 3706936 - RNA, 22 nt, Salmonella enterica enterica serovar Typhi Ty2
gcgccuguaaggcucucuuacc

SEQ ID NO: 3706937 - RNA, 23 nt, Salmonella enterica enterica serovar Typhi Ty2
gcgccuguaaggcucucuuacca

SEQ ID NO: 3706938 - RNA, 20 nt, Salmonella enterica enterica serovar Typhi Ty2
gcgccugucgggccuacaga

SEQ ID NO: 3706939 - RNA, 20 nt, Salmonella enterica enterica serovar Typhi Ty2
gcgccugucuccagcgccgc

SEQ ID NO: 3706940 - RNA, 21 nt, Salmonella enterica enterica serovar Typhi Ty2
gcgccugugaaacggcggacg

SEQ ID NO: 3706941 - RNA, 17 nt, Salmonella enterica enterica serovar Typhi Ty2
gcgccuguuagggcgcg

SEQ ID NO: 3706942 - RNA, 18 nt, Salmonella enterica enterica serovar Typhi Ty2
gcgccuguuagggcgcgg

SEQ ID NO: 3706943 - RNA, 18 nt, Salmonella enterica enterica serovar Typhi Ty2
gcgccuuaucgaccaggc

SEQ ID NO: 3706944 - RNA, 13 nt, Salmonella enterica enterica serovar Typhi Ty2
gcgccuuccagca

SEQ ID NO: 3706945 - RNA, 19 nt, Salmonella enterica enterica serovar Typhi Ty2
gcgccuuuaauuccgccgg

SEQ ID NO: 3706946 - RNA, 18 nt, Salmonella enterica enterica serovar Typhi Ty2
gcgccuuuuggcagcagc

SEQ ID NO: 3706947 - RNA, 14 nt, Salmonella enterica enterica serovar Typhi Ty2
gcgcgaaaacagcu

SEQ ID NO: 3706948 - RNA, 23 nt, Salmonella enterica enterica serovar Typhi Ty2
gcgcgaaaucaaagaccuccgcc

SEQ ID NO: 3706949 - RNA, 21 nt, Salmonella enterica enterica serovar Typhi Ty2
gcgcgaagaggaugaaaagua

SEQ ID NO: 3706950 - RNA, 21 nt, Salmonella enterica enterica serovar Typhi Ty2
gcgcgaauaaugcguccgcca

SEQ ID NO: 3706951 - RNA, 22 nt, Salmonella enterica enterica serovar Typhi Ty2
gcgcgaaucgccucuucgaccg

SEQ ID NO: 3706952 - RNA, 15 nt, Salmonella enterica enterica serovar Typhi Ty2
gcgcgacaauauuca

SEQ ID NO: 3706953 - RNA, 13 nt, Salmonella enterica enterica serovar Typhi Ty2
gcgcgacauccgc

SEQ ID NO: 3706954 - RNA, 15 nt, Salmonella enterica enterica serovar Typhi Ty2
gcgcgacgacgccag

SEQ ID NO: 3706955 - RNA, 12 nt, Salmonella enterica enterica serovar Typhi Ty2
gcgcgacgccga

SEQ ID NO: 3706956 - RNA, 15 nt, Salmonella enterica enterica serovar Typhi Ty2
gcgcgacgccgcaua

SEQ ID NO: 3706957 - RNA, 18 nt, Salmonella enterica enterica serovar Typhi Ty2
gcgcgacgcgucagugaa

SEQ ID NO: 3706958 - RNA, 14 nt, Salmonella enterica enterica serovar Typhi Ty2
gcgcgacggcggcg

SEQ ID NO: 3706959 - RNA, 18 nt, Salmonella enterica enterica serovar Typhi Ty2
gcgcgacgguaaggcuau

SEQ ID NO: 3706960 - RNA, 22 nt, Salmonella enterica enterica serovar Typhi Ty2
gcgcgagaacugcugcauccgc

SEQ ID NO: 3706961 - RNA, 21 nt, Salmonella enterica enterica serovar Typhi Ty2
gcgcgagaaguucucacccau

SEQ ID NO: 3706962 - RNA, 23 nt, Salmonella enterica enterica serovar Typhi Ty2
gcgcgagccacgcggcaucaggc

SEQ ID NO: 3706963 - RNA, 15 nt, Salmonella enterica enterica serovar Typhi Ty2
gcgcgauacgcagca

SEQ ID NO: 3706964 - RNA, 18 nt, Salmonella enterica enterica serovar Typhi Ty2
gcgcgauacgcagcaccg

SEQ ID NO: 3706965 - RNA, 17 nt, Salmonella enterica enterica serovar Typhi Ty2
gcgcgauauccaccuga

SEQ ID NO: 3706966 - RNA, 16 nt, Salmonella enterica enterica serovar Typhi Ty2
gcgcgaucuguuggug

SEQ ID NO: 3706967 - RNA, 20 nt, Salmonella enterica enterica serovar Typhi Ty2
gcgcgaugccugccgggccu

SEQ ID NO: 3706968 - RNA, 17 nt, Salmonella enterica enterica serovar Typhi Ty2
gcgcgcacacaauagca

SEQ ID NO: 3706969 - RNA, 19 nt, Salmonella enterica enterica serovar Typhi Ty2
gcgcgcagaguguaggccu

SEQ ID NO: 3706970 - RNA, 12 nt, Salmonella enterica enterica serovar Typhi Ty2
gcgcgcagcgcu

SEQ ID NO: 3706971 - RNA, 19 nt, Salmonella enterica enterica serovar Typhi Ty2
gcgcgcaucgggccguccg

SEQ ID NO: 3706972 - RNA, 18 nt, Salmonella enterica enterica serovar Typhi Ty2
gcgcgccaaacggcagcu

SEQ ID NO: 3706973 - RNA, 22 nt, Salmonella enterica enterica serovar Typhi Ty2
gcgcgccagcgauuccgucagg

SEQ ID NO: 3706974 - RNA, 15 nt, Salmonella enterica enterica serovar Typhi Ty2
gcgcgccaguuuggu

SEQ ID NO: 3706975 - RNA, 18 nt, Salmonella enterica enterica serovar Typhi Ty2
gcgcgcccgccaccagca

SEQ ID NO: 3706976 - RNA, 16 nt, Salmonella enterica enterica serovar Typhi Ty2
gcgcgcccugcgggcc

SEQ ID NO: 3706977 - RNA, 23 nt, Salmonella enterica enterica serovar Typhi Ty2
gcgcgccgaaaauauacaccuga

SEQ ID NO: 3706978 - RNA, 13 nt, Salmonella enterica enterica serovar Typhi Ty2
gcgcgccgacagg

SEQ ID NO: 3706979 - RNA, 14 nt, Salmonella enterica enterica serovar Typhi Ty2
gcgcgccgcccugc

SEQ ID NO: 3706980 - RNA, 12 nt, Salmonella enterica enterica serovar Typhi Ty2
gcgcgccgccuc

SEQ ID NO: 3706981 - RNA, 11 nt, Salmonella enterica enterica serovar Typhi Ty2
gcgcgccgcgc

SEQ ID NO: 3706982 - RNA, 15 nt, Salmonella enterica enterica serovar Typhi Ty2
gcgcgccgcgcagca

SEQ ID NO: 3706983 - RNA, 14 nt, Salmonella enterica enterica serovar Typhi Ty2
gcgcgccgcuggcg

SEQ ID NO: 3706984 - RNA, 19 nt, Salmonella enterica enterica serovar Typhi Ty2
gcgcgccgggcuucauacc

SEQ ID NO: 3706985 - RNA, 13 nt, Salmonella enterica enterica serovar Typhi Ty2
gcgcgccggugau

SEQ ID NO: 3706986 - RNA, 20 nt, Salmonella enterica enterica serovar Typhi Ty2
gcgcgccggugaucccacca

SEQ ID NO: 3706987 - RNA, 16 nt, Salmonella enterica enterica serovar Typhi Ty2
gcgcgccuaccgccau

SEQ ID NO: 3706988 - RNA, 17 nt, Salmonella enterica enterica serovar Typhi Ty2
gcgcgcgaaaagaaacu

SEQ ID NO: 3706989 - RNA, 13 nt, Salmonella enterica enterica serovar Typhi Ty2
gcgcgcgcgccug

SEQ ID NO: 3706990 - RNA, 12 nt, Salmonella enterica enterica serovar Typhi Ty2
gcgcgcgcuaau

SEQ ID NO: 3706991 - RNA, 22 nt, Salmonella enterica enterica serovar Typhi Ty2
gcgcgcggaacuuuaucaccag

SEQ ID NO: 3706992 - RNA, 21 nt, Salmonella enterica enterica serovar Typhi Ty2
gcgcgcggauauggcggcggc

SEQ ID NO: 3706993 - RNA, 16 nt, Salmonella enterica enterica serovar Typhi Ty2
gcgcgcguacugcccg

SEQ ID NO: 3706994 - RNA, 12 nt, Salmonella enterica enterica serovar Typhi Ty2
gcgcgcuccaga

SEQ ID NO: 3706995 - RNA, 14 nt, Salmonella enterica enterica serovar Typhi Ty2
gcgcgcugccgccc

SEQ ID NO: 3706996 - RNA, 16 nt, Salmonella enterica enterica serovar Typhi Ty2
gcgcgcugcgccugga

SEQ ID NO: 3706997 - RNA, 12 nt, Salmonella enterica enterica serovar Typhi Ty2
gcgcgcuggagg

SEQ ID NO: 3706998 - RNA, 13 nt, Salmonella enterica enterica serovar Typhi Ty2
gcgcgcuggcaag

SEQ ID NO: 3706999 - RNA, 12 nt, Salmonella enterica enterica serovar Typhi Ty2
gcgcgcuggcgu

SEQ ID NO: 3707000 - RNA, 16 nt, Salmonella enterica enterica serovar Typhi Ty2
gcgcgcuggugucgcc

SEQ ID NO: 3707001 - RNA, 19 nt, Salmonella enterica enterica serovar Typhi Ty2
gcgcgcuucguuuuccgca

SEQ ID NO: 3707002 - RNA, 15 nt, Salmonella enterica enterica serovar Typhi Ty2
gcgcgcuucuucaug

SEQ ID NO: 3707003 - RNA, 23 nt, Salmonella enterica enterica serovar Typhi Ty2
gcgcgcuuuccacaaucccggca

SEQ ID NO: 3707004 - RNA, 22 nt, Salmonella enterica enterica serovar Typhi Ty2
gcgcggaacuuuaucaccagcg

SEQ ID NO: 3707005 - RNA, 24 nt, Salmonella enterica enterica serovar Typhi Ty2
gcgcggaaggcgccucgcgcggcg

SEQ ID NO: 3707006 - RNA, 17 nt, Salmonella enterica enterica serovar Typhi Ty2
gcgcggauauggcggcg

SEQ ID NO: 3707007 - RNA, 19 nt, Salmonella enterica enterica serovar Typhi Ty2
gcgcugauauuuuuacuga

SEQ ID NO: 3707008 - RNA, 14 nt, Salmonella enterica enterica serovar Typhi Ty2
gcgcugaucgccac

SEQ ID NO: 3707009 - RNA, 16 nt, Salmonella enterica enterica serovar Typhi Ty2
gcgcugaugugcggcc

SEQ ID NO: 3707010 - RNA, 18 nt, Salmonella enterica enterica serovar Typhi Ty2
gcgcugcacaaucgccag

SEQ ID NO: 3707011 - RNA, 18 nt, Salmonella enterica enterica serovar Typhi Ty2
gcgcugccagcugcguca

SEQ ID NO: 3707012 - RNA, 21 nt, Salmonella enterica enterica serovar Typhi Ty2
gcgcugccgcuuauccggccu

SEQ ID NO: 3707013 - RNA, 22 nt, Salmonella enterica enterica serovar Typhi Ty2
gcgcugccgucaaugccuggca

SEQ ID NO: 3707014 - RNA, 18 nt, Salmonella enterica enterica serovar Typhi Ty2
gcgcugcgcgcgaugcug

SEQ ID NO: 3707015 - RNA, 13 nt, Salmonella enterica enterica serovar Typhi Ty2
gcgcugcgcggcg

SEQ ID NO: 3707016 - RNA, 15 nt, Salmonella enterica enterica serovar Typhi Ty2
gcgcugcgcggcgug

SEQ ID NO: 3707017 - RNA, 18 nt, Salmonella enterica enterica serovar Typhi Ty2
gcgcugcgcuuacccagu

SEQ ID NO: 3707018 - RNA, 20 nt, Salmonella enterica enterica serovar Typhi Ty2
gcgcugcgcuuaucaggccu

SEQ ID NO: 3707019 - RNA, 17 nt, Salmonella enterica enterica serovar Typhi Ty2
gcgcugcggucagggcu

SEQ ID NO: 3707020 - RNA, 22 nt, Salmonella enterica enterica serovar Typhi Ty2
gcgcugcgguuuacgccaugca

SEQ ID NO: 3707021 - RNA, 19 nt, Salmonella enterica enterica serovar Typhi Ty2
gcgcuggcaagcgccagca

SEQ ID NO: 3707022 - RNA, 18 nt, Salmonella enterica enterica serovar Typhi Ty2
gcgcuggccuucauaccg

SEQ ID NO: 3707023 - RNA, 14 nt, Salmonella enterica enterica serovar Typhi Ty2
gcgcuggcgcgucu

SEQ ID NO: 3707024 - RNA, 15 nt, Salmonella enterica enterica serovar Typhi Ty2
gcgcuggcgcgucug

SEQ ID NO: 3707025 - RNA, 14 nt, Salmonella enterica enterica serovar Typhi Ty2
gcgcuggcgcuguu

SEQ ID NO: 3707026 - RNA, 13 nt, Salmonella enterica enterica serovar Typhi Ty2
gcgcuggcggcga

SEQ ID NO: 3707027 - RNA, 15 nt, Salmonella enterica enterica serovar Typhi Ty2
gcgcuggcggcgacg

SEQ ID NO: 3707028 - RNA, 14 nt, Salmonella enterica enterica serovar Typhi Ty2
gcgcuggcgugguu

SEQ ID NO: 3707029 - RNA, 12 nt, Salmonella enterica enterica serovar Typhi Ty2
gcgcuggcuggc

SEQ ID NO: 3707030 - RNA, 14 nt, Salmonella enterica enterica serovar Typhi Ty2
gcgcugggccgggc

SEQ ID NO: 3707031 - RNA, 17 nt, Salmonella enterica enterica serovar Typhi Ty2
gcgcugggccgggccug

SEQ ID NO: 3707032 - RNA, 17 nt, Salmonella enterica enterica serovar Typhi Ty2
gcgcuggguacguucgg

SEQ ID NO: 3707033 - RNA, 22 nt, Salmonella enterica enterica serovar Typhi Ty2
gcgcuggguacguucggacugg

SEQ ID NO: 3707034 - RNA, 18 nt, Salmonella enterica enterica serovar Typhi Ty2
gcgcuggugacaucgccg

SEQ ID NO: 3707035 - RNA, 15 nt, Salmonella enterica enterica serovar Typhi Ty2
gcgcugguggcgguc

SEQ ID NO: 3707036 - RNA, 17 nt, Salmonella enterica enterica serovar Typhi Ty2
gcgcuguaacuucacgc

SEQ ID NO: 3707037 - RNA, 23 nt, Salmonella enterica enterica serovar Typhi Ty2
gcgcuguacgccucuuucagccg

SEQ ID NO: 3707038 - RNA, 23 nt, Salmonella enterica enterica serovar Typhi Ty2
gcgcuguauaaucccgcggcgga

SEQ ID NO: 3707039 - RNA, 15 nt, Salmonella enterica enterica serovar Typhi Ty2
gcgcugucugccggc

SEQ ID NO: 3707040 - RNA, 14 nt, Salmonella enterica enterica serovar Typhi Ty2
gcgcugugacggca

SEQ ID NO: 3707041 - RNA, 18 nt, Salmonella enterica enterica serovar Typhi Ty2
gcgcugugcuaucaggcc

SEQ ID NO: 3707042 - RNA, 19 nt, Salmonella enterica enterica serovar Typhi Ty2
gcgcugugcuaucaggccu

SEQ ID NO: 3707043 - RNA, 17 nt, Salmonella enterica enterica serovar Typhi Ty2
gcgcuguucuugcugcu

SEQ ID NO: 3707044 - RNA, 23 nt, Salmonella enterica enterica serovar Typhi Ty2
gcgcuguucuugcugcugcugau

SEQ ID NO: 3707045 - RNA, 19 nt, Salmonella enterica enterica serovar Typhi Ty2
gcgcuguuggcauccugcg

SEQ ID NO: 3707046 - RNA, 21 nt, Salmonella enterica enterica serovar Typhi Ty2
gcgcuguuguuccagauaauc

SEQ ID NO: 3707047 - RNA, 20 nt, Salmonella enterica enterica serovar Typhi Ty2
gcgcuguuuuuacgccauaa

SEQ ID NO: 3707048 - RNA, 14 nt, Salmonella enterica enterica serovar Typhi Ty2
gcgcuuaacgcgcu

SEQ ID NO: 3707049 - RNA, 24 nt, Salmonella enterica enterica serovar Typhi Ty2
gcgcuuacacacccggccuaucaa

SEQ ID NO: 3707050 - RNA, 22 nt, Salmonella enterica enterica serovar Typhi Ty2
gcgcuuaccgggccgacaggcg

SEQ ID NO: 3707051 - RNA, 20 nt, Salmonella enterica enterica serovar Typhi Ty2
gcgcuuaccgggccuacacg

SEQ ID NO: 3707052 - RNA, 19 nt, Salmonella enterica enterica serovar Typhi Ty2
gcgcuuaccgggccuacag

SEQ ID NO: 3707053 - RNA, 22 nt, Salmonella enterica enterica serovar Typhi Ty2
gcgcuuagccugaucgaucagc

SEQ ID NO: 3707054 - RNA, 19 nt, Salmonella enterica enterica serovar Typhi Ty2
gcgcuuaucaggccuacaa

SEQ ID NO: 3707055 - RNA, 13 nt, Salmonella enterica enterica serovar Typhi Ty2
gcgcuuaucgccg

SEQ ID NO: 3707056 - RNA, 12 nt, Salmonella enterica enterica serovar Typhi Ty2
gcgcuuccugca

SEQ ID NO: 3707057 - RNA, 13 nt, Salmonella enterica enterica serovar Typhi Ty2
gcgcuuccugcag

SEQ ID NO: 3707058 - RNA, 16 nt, Salmonella enterica enterica serovar Typhi Ty2
gcgcuuccugcagugg

SEQ ID NO: 3707059 - RNA, 17 nt, Salmonella enterica enterica serovar Typhi Ty2
gcgcuuccugcagugga

SEQ ID NO: 3707060 - RNA, 13 nt, Salmonella enterica enterica serovar Typhi Ty2
gcgcuucgccugc

SEQ ID NO: 3707061 - RNA, 20 nt, Salmonella enterica enterica serovar Typhi Ty2
gcgcuucgcuuaucaggccu

SEQ ID NO: 3707062 - RNA, 15 nt, Salmonella enterica enterica serovar Typhi Ty2
gcgcuucggcgauag

SEQ ID NO: 3707063 - RNA, 21 nt, Salmonella enterica enterica serovar Typhi Ty2
gcgcuucguugagcuuaucgg

SEQ ID NO: 3707064 - RNA, 17 nt, Salmonella enterica enterica serovar Typhi Ty2
gcgcuucugauuauuga

SEQ ID NO: 3707065 - RNA, 22 nt, Salmonella enterica enterica serovar Typhi Ty2
gcgcuugcauggcagccccggc

SEQ ID NO: 3707066 - RNA, 13 nt, Salmonella enterica enterica serovar Typhi Ty2
gcgcuugcggccg

SEQ ID NO: 3707067 - RNA, 21 nt, Salmonella enterica enterica serovar Typhi Ty2
gcgcuuuacugucgcuggaua

SEQ ID NO: 3707068 - RNA, 16 nt, Salmonella enterica enterica serovar Typhi Ty2
gcgcuuuagggcuucc

SEQ ID NO: 3707069 - RNA, 15 nt, Salmonella enterica enterica serovar Typhi Ty2
gcgcuuucuucuuca

SEQ ID NO: 3707070 - RNA, 18 nt, Salmonella enterica enterica serovar Typhi Ty2
gcgcuuugccgcugcugc

SEQ ID NO: 3707071 - RNA, 20 nt, Salmonella enterica enterica serovar Typhi Ty2
gcgcuuuggguuaaugccag

SEQ ID NO: 3707072 - RNA, 12 nt, Salmonella enterica enterica serovar Typhi Ty2
gcgcuuuguuuc

SEQ ID NO: 3707073 - RNA, 20 nt, Salmonella enterica enterica serovar Typhi Ty2
gcgcuuuuagccaguuggca

SEQ ID NO: 3707074 - RNA, 16 nt, Salmonella enterica enterica serovar Typhi Ty2
gcgcuuuuccagcacg

SEQ ID NO: 3707075 - RNA, 17 nt, Salmonella enterica enterica serovar Typhi Ty2
gcgcuuuugccgcgccc

SEQ ID NO: 3707076 - RNA, 12 nt, Salmonella enterica enterica serovar Typhi Ty2
gcgcuuuuucac

SEQ ID NO: 3707077 - RNA, 14 nt, Salmonella enterica enterica serovar Typhi Ty2
gcggaaaaaagcag

SEQ ID NO: 3707078 - RNA, 15 nt, Salmonella enterica enterica serovar Typhi Ty2
gcggaaaagcgccca

SEQ ID NO: 3707079 - RNA, 19 nt, Salmonella enterica enterica serovar Typhi Ty2
gcggaaaauauucagcaca

SEQ ID NO: 3707080 - RNA, 16 nt, Salmonella enterica enterica serovar Typhi Ty2
gcggaaauguagcccc

SEQ ID NO: 3707081 - RNA, 23 nt, Salmonella enterica enterica serovar Typhi Ty2
gcggaaauuagcccgcuucacgc

SEQ ID NO: 3707082 - RNA, 17 nt, Salmonella enterica enterica serovar Typhi Ty2
gcggaacaccagcgccg

SEQ ID NO: 3707083 - RNA, 14 nt, Salmonella enterica enterica serovar Typhi Ty2
gcggaacgcguucc

SEQ ID NO: 3707084 - RNA, 18 nt, Salmonella enterica enterica serovar Typhi Ty2
gcggaacggcgagcuuua

SEQ ID NO: 3707085 - RNA, 21 nt, Salmonella enterica enterica serovar Typhi Ty2
gcggaagccacguucuuccag

SEQ ID NO: 3707086 - RNA, 22 nt, Salmonella enterica enterica serovar Typhi Ty2
gcggaaggcgccucgcgcggcg

SEQ ID NO: 3707087 - RNA, 15 nt, Salmonella enterica enterica serovar Typhi Ty2
gcggaaguagagaac

SEQ ID NO: 3707088 - RNA, 21 nt, Salmonella enterica enterica serovar Typhi Ty2
gcggaaguagccuccggcggu

SEQ ID NO: 3707089 - RNA, 18 nt, Salmonella enterica enterica serovar Typhi Ty2
gcggcccacucauccagc

SEQ ID NO: 3707090 - RNA, 20 nt, Salmonella enterica enterica serovar Typhi Ty2
gcggcccauucaacgggcga

SEQ ID NO: 3707091 - RNA, 16 nt, Salmonella enterica enterica serovar Typhi Ty2
gcggccccaucagcac

SEQ ID NO: 3707092 - RNA, 23 nt, Salmonella enterica enterica serovar Typhi Ty2
gcggcccgggagaacgccgggcc

SEQ ID NO: 3707093 - RNA, 21 nt, Salmonella enterica enterica serovar Typhi Ty2
gcggccgcuuuucggcgcuua

SEQ ID NO: 3707094 - RNA, 14 nt, Salmonella enterica enterica serovar Typhi Ty2
gcggccugcaaaga

SEQ ID NO: 3707095 - RNA, 17 nt, Salmonella enterica enterica serovar Typhi Ty2
gcggccugcgugcgccg

SEQ ID NO: 3707096 - RNA, 11 nt, Salmonella enterica enterica serovar Typhi Ty2
gcggccuugcc

SEQ ID NO: 3707097 - RNA, 16 nt, Salmonella enterica enterica serovar Typhi Ty2
gcggccuuuauccagc

SEQ ID NO: 3707098 - RNA, 21 nt, Salmonella enterica enterica serovar Typhi Ty2
gcggcgaaauaggccgcgaua

SEQ ID NO: 3707099 - RNA, 22 nt, Salmonella enterica enterica serovar Typhi Ty2
gcggcgaaaugccuuauccggc

SEQ ID NO: 3707100 - RNA, 14 nt, Salmonella enterica enterica serovar Typhi Ty2
gcggcgaaccggca

SEQ ID NO: 3707101 - RNA, 18 nt, Salmonella enterica enterica serovar Typhi Ty2
gcggcgaagcaucuuucc

SEQ ID NO: 3707102 - RNA, 19 nt, Salmonella enterica enterica serovar Typhi Ty2
gcggcgaagcaucuuuccg

SEQ ID NO: 3707103 - RNA, 20 nt, Salmonella enterica enterica serovar Typhi Ty2
gcggcgacagagaaugcgcc

SEQ ID NO: 3707104 - RNA, 21 nt, Salmonella enterica enterica serovar Typhi Ty2
gcggcgaucagacgcugguug

SEQ ID NO: 3707105 - RNA, 17 nt, Salmonella enterica enterica serovar Typhi Ty2
gcggcgcaaaucgccau

SEQ ID NO: 3707106 - RNA, 23 nt, Salmonella enterica enterica serovar Typhi Ty2
gcggcgcaaaucgccaucagcgc

SEQ ID NO: 3707107 - RNA, 17 nt, Salmonella enterica enterica serovar Typhi Ty2
gcggcgccaacgcgcua

SEQ ID NO: 3707108 - RNA, 16 nt, Salmonella enterica enterica serovar Typhi Ty2
gcggcgccaucaccau

SEQ ID NO: 3707109 - RNA, 19 nt, Salmonella enterica enterica serovar Typhi Ty2
gcggcgccuuguccggcgu

SEQ ID NO: 3707110 - RNA, 19 nt, Salmonella enterica enterica serovar Typhi Ty2
gcggcgcgauaugucucuc

SEQ ID NO: 3707111 - RNA, 14 nt, Salmonella enterica enterica serovar Typhi Ty2
gcggcgcgcccggc

SEQ ID NO: 3707112 - RNA, 14 nt, Salmonella enterica enterica serovar Typhi Ty2
gcggcgcgcuggcg

SEQ ID NO: 3707113 - RNA, 18 nt, Salmonella enterica enterica serovar Typhi Ty2
gcggcgcucgccagcccg

SEQ ID NO: 3707114 - RNA, 19 nt, Salmonella enterica enterica serovar Typhi Ty2
gcggcgcuuugcuucucgc

SEQ ID NO: 3707115 - RNA, 15 nt, Salmonella enterica enterica serovar Typhi Ty2
gcggcggacaacgcu

SEQ ID NO: 3707116 - RNA, 20 nt, Salmonella enterica enterica serovar Typhi Ty2
gcggcggacaacgcuccagc

SEQ ID NO: 3707117 - RNA, 22 nt, Salmonella enterica enterica serovar Typhi Ty2
gcggcggacaacgcuccagcag

SEQ ID NO: 3707118 - RNA, 22 nt, Salmonella enterica enterica serovar Typhi Ty2
gcggcggacaugguaauaacgc

SEQ ID NO: 3707119 - RNA, 14 nt, Salmonella enterica enterica serovar Typhi Ty2
gcggcggaccgcaa

SEQ ID NO: 3707120 - RNA, 11 nt, Salmonella enterica enterica serovar Typhi Ty2
gcggcggcaag

SEQ ID NO: 3707121 - RNA, 17 nt, Salmonella enterica enterica serovar Typhi Ty2
gcggcggcccgaagggc

SEQ ID NO: 3707122 - RNA, 21 nt, Salmonella enterica enterica serovar Typhi Ty2
gcggcggggauaaucagcagc

SEQ ID NO: 3707123 - RNA, 16 nt, Salmonella enterica enterica serovar Typhi Ty2
gcggcggguaaauaga

SEQ ID NO: 3707124 - RNA, 21 nt, Salmonella enterica enterica serovar Typhi Ty2
gcggcgguaacgccuucgcaa

SEQ ID NO: 3707125 - RNA, 17 nt, Salmonella enterica enterica serovar Typhi Ty2
gcggcggucugcgccug

SEQ ID NO: 3707126 - RNA, 14 nt, Salmonella enterica enterica serovar Typhi Ty2
gcggcgguuauccg

SEQ ID NO: 3707127 - RNA, 16 nt, Salmonella enterica enterica serovar Typhi Ty2
gcggcgguuauccgcc

SEQ ID NO: 3707128 - RNA, 22 nt, Salmonella enterica enterica serovar Typhi Ty2
gcggcgguuauccuccgggucg

SEQ ID NO: 3707129 - RNA, 16 nt, Salmonella enterica enterica serovar Typhi Ty2
gcggcgguucauccug

SEQ ID NO: 3707130 - RNA, 14 nt, Salmonella enterica enterica serovar Typhi Ty2
gcggcguaacggcu

SEQ ID NO: 3707131 - RNA, 21 nt, Salmonella enterica enterica serovar Typhi Ty2
gcggcguacacuucauccggc

SEQ ID NO: 3707132 - RNA, 14 nt, Salmonella enterica enterica serovar Typhi Ty2
gcggcguaccgcgc

SEQ ID NO: 3707133 - RNA, 17 nt, Salmonella enterica enterica serovar Typhi Ty2
gcggcguaccgcgcgcc

SEQ ID NO: 3707134 - RNA, 17 nt, Salmonella enterica enterica serovar Typhi Ty2
gcggcgucugcaccggu

SEQ ID NO: 3707135 - RNA, 18 nt, Salmonella enterica enterica serovar Typhi Ty2
gcggcgucugcaccggua

SEQ ID NO: 3707136 - RNA, 16 nt, Salmonella enterica enterica serovar Typhi Ty2
gcggcguguggcugug

SEQ ID NO: 3707137 - RNA, 16 nt, Salmonella enterica enterica serovar Typhi Ty2
gcggcuaauacgccag

SEQ ID NO: 3707138 - RNA, 19 nt, Salmonella enterica enterica serovar Typhi Ty2
gcggcuagcgccuuauccg

SEQ ID NO: 3707139 - RNA, 15 nt, Salmonella enterica enterica serovar Typhi Ty2
gcggcucaccagcug

SEQ ID NO: 3707140 - RNA, 23 nt, Salmonella enterica enterica serovar Typhi Ty2
gcggcucaccagcugacgcagca

SEQ ID NO: 3707141 - RNA, 22 nt, Salmonella enterica enterica serovar Typhi Ty2
gcggcugaaccacccugaaaag

SEQ ID NO: 3707142 - RNA, 22 nt, Salmonella enterica enterica serovar Typhi Ty2
gcggcugacgcgaugacggcgc

SEQ ID NO: 3707143 - RNA, 15 nt, Salmonella enterica enterica serovar Typhi Ty2
gcggcugguaagaga

SEQ ID NO: 3707144 - RNA, 21 nt, Salmonella enterica enterica serovar Typhi Ty2
gcggcugguaagagagccuua

SEQ ID NO: 3707145 - RNA, 21 nt, Salmonella enterica enterica serovar Typhi Ty2
gcggcugucaucaaugagcgg

SEQ ID NO: 3707146 - RNA, 15 nt, Salmonella enterica enterica serovar Typhi Ty2
gcggcuucagcgaca

SEQ ID NO: 3707147 - RNA, 17 nt, Salmonella enterica enterica serovar Typhi Ty2
gcggcuucagcgacauc

SEQ ID NO: 3707148 - RNA, 19 nt, Salmonella enterica enterica serovar Typhi Ty2
gcggcuuuaaugccgccgu

SEQ ID NO: 3707149 - RNA, 16 nt, Salmonella enterica enterica serovar Typhi Ty2
gcggcuuuacccggcg

SEQ ID NO: 3707150 - RNA, 22 nt, Salmonella enterica enterica serovar Typhi Ty2
gcggcuuugcgccggcaguccu

SEQ ID NO: 3707151 - RNA, 14 nt, Salmonella enterica enterica serovar Typhi Ty2
gcgggaaauaccaa

SEQ ID NO: 3707152 - RNA, 20 nt, Salmonella enterica enterica serovar Typhi Ty2
gcgggaaauaccauccgcgc

SEQ ID NO: 3707153 - RNA, 14 nt, Salmonella enterica enterica serovar Typhi Ty2
gcgggacugcugcu

SEQ ID NO: 3707154 - RNA, 20 nt, Salmonella enterica enterica serovar Typhi Ty2
gcgggauaacgcaacaacag

SEQ ID NO: 3707155 - RNA, 19 nt, Salmonella enterica enterica serovar Typhi Ty2
gcgggauauaacgcaacgu

SEQ ID NO: 3707156 - RNA, 22 nt, Salmonella enterica enterica serovar Typhi Ty2
gcgggauaucgcuggucggcug

SEQ ID NO: 3707157 - RNA, 19 nt, Salmonella enterica enterica serovar Typhi Ty2
gcgggaugcguaauccggc

SEQ ID NO: 3707158 - RNA, 21 nt, Salmonella enterica enterica serovar Typhi Ty2
gcgggaugcuauaccgcccgc

SEQ ID NO: 3707159 - RNA, 18 nt, Salmonella enterica enterica serovar Typhi Ty2
gcgggauggccgccgagc

SEQ ID NO: 3707160 - RNA, 17 nt, Salmonella enterica enterica serovar Typhi Ty2
gcgggcaaaagggccau

SEQ ID NO: 3707161 - RNA, 23 nt, Salmonella enterica enterica serovar Typhi Ty2
gcgggcaaaagggccauggcugg

SEQ ID NO: 3707162 - RNA, 17 nt, Salmonella enterica enterica serovar Typhi Ty2
gcgggcaauuccgguca

SEQ ID NO: 3707163 - RNA, 18 nt, Salmonella enterica enterica serovar Typhi Ty2
gcgggcagccuucaaguu

SEQ ID NO: 3707164 - RNA, 21 nt, Salmonella enterica enterica serovar Typhi Ty2
gcgggcauacucuccuccaua

SEQ ID NO: 3707165 - RNA, 21 nt, Salmonella enterica enterica serovar Typhi Ty2
gcgggcauauucuggcgacgg

SEQ ID NO: 3707166 - RNA, 15 nt, Salmonella enterica enterica serovar Typhi Ty2
gcgggccaauccagc

SEQ ID NO: 3707167 - RNA, 16 nt, Salmonella enterica enterica serovar Typhi Ty2
gcgggcgaucggcugu

SEQ ID NO: 3707168 - RNA, 19 nt, Salmonella enterica enterica serovar Typhi Ty2
gcgggcugccccagacgcc

SEQ ID NO: 3707169 - RNA, 23 nt, Salmonella enterica enterica serovar Typhi Ty2
gcgggcugccccagacgcccuuc

SEQ ID NO: 3707170 - RNA, 19 nt, Salmonella enterica enterica serovar Typhi Ty2
gcguacuaaauaggcggca

SEQ ID NO: 3707171 - RNA, 14 nt, Salmonella enterica enterica serovar Typhi Ty2
gcguagcccagcgc

SEQ ID NO: 3707172 - RNA, 16 nt, Salmonella enterica enterica serovar Typhi Ty2
gcguagcccagcgccg

SEQ ID NO: 3707173 - RNA, 20 nt, Salmonella enterica enterica serovar Typhi Ty2
gcguagccgccgagcgccgu

SEQ ID NO: 3707174 - RNA, 16 nt, Salmonella enterica enterica serovar Typhi Ty2
gcguagcgcauccggc

SEQ ID NO: 3707175 - RNA, 15 nt, Salmonella enterica enterica serovar Typhi Ty2
gcguagcgcgcggau

SEQ ID NO: 3707176 - RNA, 19 nt, Salmonella enterica enterica serovar Typhi Ty2
gcguagcguguauuccagu

SEQ ID NO: 3707177 - RNA, 17 nt, Salmonella enterica enterica serovar Typhi Ty2
gcguagcucgcccagca

SEQ ID NO: 3707178 - RNA, 24 nt, Salmonella enterica enterica serovar Typhi Ty2
gcguaggguagaucacgccagcgc

SEQ ID NO: 3707179 - RNA, 15 nt, Salmonella enterica enterica serovar Typhi Ty2
gcguagucucccucc

SEQ ID NO: 3707180 - RNA, 23 nt, Salmonella enterica enterica serovar Typhi Ty2
gcguauccauucucaucagaccg

SEQ ID NO: 3707181 - RNA, 20 nt, Salmonella enterica enterica serovar Typhi Ty2
gcguaucucauugauggucg

SEQ ID NO: 3707182 - RNA, 12 nt, Salmonella enterica enterica serovar Typhi Ty2
gcguauuucacc

SEQ ID NO: 3707183 - RNA, 22 nt, Salmonella enterica enterica serovar Typhi Ty2
gcgucaaaaauaaaaaccgccu

SEQ ID NO: 3707184 - RNA, 14 nt, Salmonella enterica enterica serovar Typhi Ty2
gcgucaaaacuuau

SEQ ID NO: 3707185 - RNA, 18 nt, Salmonella enterica enterica serovar Typhi Ty2
gcgucaaaguugcaucaa

SEQ ID NO: 3707186 - RNA, 19 nt, Salmonella enterica enterica serovar Typhi Ty2
gcgucaaauagagaaaaua

SEQ ID NO: 3707187 - RNA, 13 nt, Salmonella enterica enterica serovar Typhi Ty2
gcgucaacgccac

SEQ ID NO: 3707188 - RNA, 14 nt, Salmonella enterica enterica serovar Typhi Ty2
gcgucaacguccag

SEQ ID NO: 3707189 - RNA, 20 nt, Salmonella enterica enterica serovar Typhi Ty2
gcgucaacguuuuucagccg

SEQ ID NO: 3707190 - RNA, 17 nt, Salmonella enterica enterica serovar Typhi Ty2
gcgucaacucagcaaua

SEQ ID NO: 3707191 - RNA, 16 nt, Salmonella enterica enterica serovar Typhi Ty2
gcgucaauaaucgcgc

SEQ ID NO: 3707192 - RNA, 15 nt, Salmonella enterica enterica serovar Typhi Ty2
gcgucacaaucgcgc

SEQ ID NO: 3707193 - RNA, 15 nt, Salmonella enterica enterica serovar Typhi Ty2
gcgucacauggcgaa

SEQ ID NO: 3707194 - RNA, 14 nt, Salmonella enterica enterica serovar Typhi Ty2
gcgucacccgccgg

SEQ ID NO: 3707195 - RNA, 22 nt, Salmonella enterica enterica serovar Typhi Ty2
gcgucacccgccggcagcagcu

SEQ ID NO: 3707196 - RNA, 16 nt, Salmonella enterica enterica serovar Typhi Ty2
gcgucacgaccggcga

SEQ ID NO: 3707197 - RNA, 19 nt, Salmonella enterica enterica serovar Typhi Ty2
gcgucacgcgcaaagcugc

SEQ ID NO: 3707198 - RNA, 19 nt, Salmonella enterica enterica serovar Typhi Ty2
gcgucagaaauccgcgaau

SEQ ID NO: 3707199 - RNA, 12 nt, Salmonella enterica enterica serovar Typhi Ty2
gcgucagcagag

SEQ ID NO: 3707200 - RNA, 17 nt, Salmonella enterica enterica serovar Typhi Ty2
gcgucagccagaacgaa

SEQ ID NO: 3707201 - RNA, 22 nt, Salmonella enterica enterica serovar Typhi Ty2
gcgucagcccaagcugacggau

SEQ ID NO: 3707202 - RNA, 14 nt, Salmonella enterica enterica serovar Typhi Ty2
gcgucagcccuucu

SEQ ID NO: 3707203 - RNA, 13 nt, Salmonella enterica enterica serovar Typhi Ty2
gcgucagccggca

SEQ ID NO: 3707204 - RNA, 13 nt, Salmonella enterica enterica serovar Typhi Ty2
gcgucagcgcggc

SEQ ID NO: 3707205 - RNA, 15 nt, Salmonella enterica enterica serovar Typhi Ty2
gcgucaggacggcga

SEQ ID NO: 3707206 - RNA, 16 nt, Salmonella enterica enterica serovar Typhi Ty2
gcgucaggccaggguu

SEQ ID NO: 3707207 - RNA, 22 nt, Salmonella enterica enterica serovar Typhi Ty2
gcgucaggccaucgcuucggca

SEQ ID NO: 3707208 - RNA, 12 nt, Salmonella enterica enterica serovar Typhi Ty2
gcgucaggcgau

SEQ ID NO: 3707209 - RNA, 19 nt, Salmonella enterica enterica serovar Typhi Ty2
gcgucaggcuguuguucuu

SEQ ID NO: 3707210 - RNA, 22 nt, Salmonella enterica enterica serovar Typhi Ty2
gcgucaguaaaagcccgcccag

SEQ ID NO: 3707211 - RNA, 17 nt, Salmonella enterica enterica serovar Typhi Ty2
gcgucauaaccgcaguc

SEQ ID NO: 3707212 - RNA, 18 nt, Salmonella enterica enterica serovar Typhi Ty2
gcgucauagccgcgcguc

SEQ ID NO: 3707213 - RNA, 17 nt, Salmonella enterica enterica serovar Typhi Ty2
gcgucaucauugcgcca

SEQ ID NO: 3707214 - RNA, 15 nt, Salmonella enterica enterica serovar Typhi Ty2
gcgucauccaguguu

SEQ ID NO: 3707215 - RNA, 14 nt, Salmonella enterica enterica serovar Typhi Ty2
gcgucauccggcau

SEQ ID NO: 3707216 - RNA, 14 nt, Salmonella enterica enterica serovar Typhi Ty2
gcgucaucgcucca

SEQ ID NO: 3707217 - RNA, 22 nt, Salmonella enterica enterica serovar Typhi Ty2
gcgucaucggcgccagccuguu

SEQ ID NO: 3707218 - RNA, 19 nt, Salmonella enterica enterica serovar Typhi Ty2
gcgucaugucguuagaacc

SEQ ID NO: 3707219 - RNA, 22 nt, Salmonella enterica enterica serovar Typhi Ty2
gcguccaacuggcuuucaucca

SEQ ID NO: 3707220 - RNA, 23 nt, Salmonella enterica enterica serovar Typhi Ty2
gcguccacuuucucggcuuucca

SEQ ID NO: 3707221 - RNA, 15 nt, Salmonella enterica enterica serovar Typhi Ty2
gcguccagaggaucu

SEQ ID NO: 3707222 - RNA, 14 nt, Salmonella enterica enterica serovar Typhi Ty2
gcguccagaugcaa

SEQ ID NO: 3707223 - RNA, 20 nt, Salmonella enterica enterica serovar Typhi Ty2
gcguccagcccguccagaua

SEQ ID NO: 3707224 - RNA, 18 nt, Salmonella enterica enterica serovar Typhi Ty2
gcgucccagcgggcugua

SEQ ID NO: 3707225 - RNA, 15 nt, Salmonella enterica enterica serovar Typhi Ty2
gcguccccguucuga

SEQ ID NO: 3707226 - RNA, 12 nt, Salmonella enterica enterica serovar Typhi Ty2
gcgucccggcaa

SEQ ID NO: 3707227 - RNA, 14 nt, Salmonella enterica enterica serovar Typhi Ty2
gcgucccucuccag

SEQ ID NO: 3707228 - RNA, 11 nt, Salmonella enterica enterica serovar Typhi Ty2
gcguccgccgc

SEQ ID NO: 3707229 - RNA, 15 nt, Salmonella enterica enterica serovar Typhi Ty2
gcguccuucuuccgc

SEQ ID NO: 3707230 - RNA, 18 nt, Salmonella enterica enterica serovar Typhi Ty2
gcgucgcauucgauacgc

SEQ ID NO: 3707231 - RNA, 21 nt, Salmonella enterica enterica serovar Typhi Ty2
gcgucgccaaagcagcugcug

SEQ ID NO: 3707232 - RNA, 11 nt, Salmonella enterica enterica serovar Typhi Ty2
gcgucgccaua

SEQ ID NO: 3707233 - RNA, 19 nt, Salmonella enterica enterica serovar Typhi Ty2
gcgucgccauaaagcugua

SEQ ID NO: 3707234 - RNA, 15 nt, Salmonella enterica enterica serovar Typhi Ty2
gcgucgccauccggc

SEQ ID NO: 3707235 - RNA, 22 nt, Salmonella enterica enterica serovar Typhi Ty2
gcgucgccuguccggccuguaa

SEQ ID NO: 3707236 - RNA, 14 nt, Salmonella enterica enterica serovar Typhi Ty2
gcgucgcgcauggc

SEQ ID NO: 3707237 - RNA, 22 nt, Salmonella enterica enterica serovar Typhi Ty2
gcgucgcgcuuucaaucgucag

SEQ ID NO: 3707238 - RNA, 15 nt, Salmonella enterica enterica serovar Typhi Ty2
gcgucgcuaccaggc

SEQ ID NO: 3707239 - RNA, 15 nt, Salmonella enterica enterica serovar Typhi Ty2
gcgucgcugauugcc

SEQ ID NO: 3707240 - RNA, 15 nt, Salmonella enterica enterica serovar Typhi Ty2
gcgucggauggcgac

SEQ ID NO: 3707241 - RNA, 15 nt, Salmonella enterica enterica serovar Typhi Ty2
gcgucggcuucauca

SEQ ID NO: 3707242 - RNA, 14 nt, Salmonella enterica enterica serovar Typhi Ty2
gcgucgggccgcgc

SEQ ID NO: 3707243 - RNA, 23 nt, Salmonella enterica enterica serovar Typhi Ty2
gcgucgggggcgacaaacagcgc

SEQ ID NO: 3707244 - RNA, 15 nt, Salmonella enterica enterica serovar Typhi Ty2
gcgucgugcugggcg

SEQ ID NO: 3707245 - RNA, 17 nt, Salmonella enterica enterica serovar Typhi Ty2
gcgucguuccgucagug

SEQ ID NO: 3707246 - RNA, 20 nt, Salmonella enterica enterica serovar Typhi Ty2
gcgucguuggcauggucagc

SEQ ID NO: 3707247 - RNA, 19 nt, Salmonella enterica enterica serovar Typhi Ty2
gcgucuauagaugauaauc

SEQ ID NO: 3707248 - RNA, 14 nt, Salmonella enterica enterica serovar Typhi Ty2
gcgucucagcaggc

SEQ ID NO: 3707249 - RNA, 18 nt, Salmonella enterica enterica serovar Typhi Ty2
gcgucucaucaaaaaggc

SEQ ID NO: 3707250 - RNA, 15 nt, Salmonella enterica enterica serovar Typhi Ty2
gcgucucauccggca

SEQ ID NO: 3707251 - RNA, 16 nt, Salmonella enterica enterica serovar Typhi Ty2
gcgucucauccggcag

SEQ ID NO: 3707252 - RNA, 16 nt, Salmonella enterica enterica serovar Typhi Ty2
gcuauauuccagccag

SEQ ID NO: 3707253 - RNA, 15 nt, Salmonella enterica enterica serovar Typhi Ty2
gcuauauuuauaaaa

SEQ ID NO: 3707254 - RNA, 23 nt, Salmonella enterica enterica serovar Typhi Ty2
gcuaucaacgccuccaggcuacc

SEQ ID NO: 3707255 - RNA, 20 nt, Salmonella enterica enterica serovar Typhi Ty2
gcuaucaagauaaaaagaca

SEQ ID NO: 3707256 - RNA, 20 nt, Salmonella enterica enterica serovar Typhi Ty2
gcuaucaauaccgcuaauac

SEQ ID NO: 3707257 - RNA, 15 nt, Salmonella enterica enterica serovar Typhi Ty2
gcuaucagaauaucc

SEQ ID NO: 3707258 - RNA, 16 nt, Salmonella enterica enterica serovar Typhi Ty2
gcuaucaggccuacaa

SEQ ID NO: 3707259 - RNA, 14 nt, Salmonella enterica enterica serovar Typhi Ty2
gcuauccagcucac

SEQ ID NO: 3707260 - RNA, 14 nt, Salmonella enterica enterica serovar Typhi Ty2
gcuaucccgaugcu

SEQ ID NO: 3707261 - RNA, 23 nt, Salmonella enterica enterica serovar Typhi Ty2
gcuaucccgaugcucagggcauc

SEQ ID NO: 3707262 - RNA, 16 nt, Salmonella enterica enterica serovar Typhi Ty2
gcuauccggcgcgcug

SEQ ID NO: 3707263 - RNA, 19 nt, Salmonella enterica enterica serovar Typhi Ty2
gcuauccggcgcgcuggug

SEQ ID NO: 3707264 - RNA, 17 nt, Salmonella enterica enterica serovar Typhi Ty2
gcuaucgagaaugguuu

SEQ ID NO: 3707265 - RNA, 21 nt, Salmonella enterica enterica serovar Typhi Ty2
gcuaucgcgccggacagcagc

SEQ ID NO: 3707266 - RNA, 14 nt, Salmonella enterica enterica serovar Typhi Ty2
gcuaucgcggauaa

SEQ ID NO: 3707267 - RNA, 18 nt, Salmonella enterica enterica serovar Typhi Ty2
gcuaucucuuccagcguc

SEQ ID NO: 3707268 - RNA, 22 nt, Salmonella enterica enterica serovar Typhi Ty2
gcuaucugacagccaaacugcu

SEQ ID NO: 3707269 - RNA, 22 nt, Salmonella enterica enterica serovar Typhi Ty2
gcuaugaagaccugcuucaggu

SEQ ID NO: 3707270 - RNA, 21 nt, Salmonella enterica enterica serovar Typhi Ty2
gcuaugauggccgacuggcac

SEQ ID NO: 3707271 - RNA, 14 nt, Salmonella enterica enterica serovar Typhi Ty2
gcuaugccggagga

SEQ ID NO: 3707272 - RNA, 22 nt, Salmonella enterica enterica serovar Typhi Ty2
gcuaugccggaggauauuuauu

SEQ ID NO: 3707273 - RNA, 13 nt, Salmonella enterica enterica serovar Typhi Ty2
gcuaugcgccagu

SEQ ID NO: 3707274 - RNA, 23 nt, Salmonella enterica enterica serovar Typhi Ty2
gcuaugcuccaguuguuccagca

SEQ ID NO: 3707275 - RNA, 14 nt, Salmonella enterica enterica serovar Typhi Ty2
gcuaugcuuaccau

SEQ ID NO: 3707276 - RNA, 20 nt, Salmonella enterica enterica serovar Typhi Ty2
gcuaugcuuaccaucuggcc

SEQ ID NO: 3707277 - RNA, 14 nt, Salmonella enterica enterica serovar Typhi Ty2
gcuauggcaacaaa

SEQ ID NO: 3707278 - RNA, 17 nt, Salmonella enterica enterica serovar Typhi Ty2
gcuaugggaagggugac

SEQ ID NO: 3707279 - RNA, 23 nt, Salmonella enterica enterica serovar Typhi Ty2
gcuauggugcgggguuuccggca

SEQ ID NO: 3707280 - RNA, 23 nt, Salmonella enterica enterica serovar Typhi Ty2
gcuauuaccggcuggaagcccaa

SEQ ID NO: 3707281 - RNA, 12 nt, Salmonella enterica enterica serovar Typhi Ty2
gcuauuagccaa

SEQ ID NO: 3707282 - RNA, 22 nt, Salmonella enterica enterica serovar Typhi Ty2
gcuauucauuauuuuuaaauaa

SEQ ID NO: 3707283 - RNA, 19 nt, Salmonella enterica enterica serovar Typhi Ty2
gcuauuccucgaucgccug

SEQ ID NO: 3707284 - RNA, 15 nt, Salmonella enterica enterica serovar Typhi Ty2
gcuauugaucgccau

SEQ ID NO: 3707285 - RNA, 18 nt, Salmonella enterica enterica serovar Typhi Ty2
gcuauuuaacccugguuu

SEQ ID NO: 3707286 - RNA, 15 nt, Salmonella enterica enterica serovar Typhi Ty2
gcuauuuccagaaau

SEQ ID NO: 3707287 - RNA, 20 nt, Salmonella enterica enterica serovar Typhi Ty2
gcuauuuuuugcuggcggca

SEQ ID NO: 3707288 - RNA, 17 nt, Salmonella enterica enterica serovar Typhi Ty2
gcucaaaguuaccggca

SEQ ID NO: 3707289 - RNA, 23 nt, Salmonella enterica enterica serovar Typhi Ty2
gcucaaccaugauaaccagcccc

SEQ ID NO: 3707290 - RNA, 15 nt, Salmonella enterica enterica serovar Typhi Ty2
gcucaaccgcgcggc

SEQ ID NO: 3707291 - RNA, 16 nt, Salmonella enterica enterica serovar Typhi Ty2
gcucaaccgcgcggcg

SEQ ID NO: 3707292 - RNA, 22 nt, Salmonella enterica enterica serovar Typhi Ty2
gcucaaccgcgcggcguucugc

SEQ ID NO: 3707293 - RNA, 20 nt, Salmonella enterica enterica serovar Typhi Ty2
gcucaacgcccucaaguaaa

SEQ ID NO: 3707294 - RNA, 15 nt, Salmonella enterica enterica serovar Typhi Ty2
gcucaacuuccagag

SEQ ID NO: 3707295 - RNA, 18 nt, Salmonella enterica enterica serovar Typhi Ty2
gcucaagaguaggccgga

SEQ ID NO: 3707296 - RNA, 22 nt, Salmonella enterica enterica serovar Typhi Ty2
gcucaagaguaggccggauaag

SEQ ID NO: 3707297 - RNA, 15 nt, Salmonella enterica enterica serovar Typhi Ty2
gcucaagcgaaaaaa

SEQ ID NO: 3707298 - RNA, 16 nt, Salmonella enterica enterica serovar Typhi Ty2
gcucaagcgccgcgau

SEQ ID NO: 3707299 - RNA, 19 nt, Salmonella enterica enterica serovar Typhi Ty2
gcucaauaccuuaguaaaa

SEQ ID NO: 3707300 - RNA, 13 nt, Salmonella enterica enterica serovar Typhi Ty2
gcucaauauacuu

SEQ ID NO: 3707301 - RNA, 14 nt, Salmonella enterica enterica serovar Typhi Ty2
gcucaauccaggug

SEQ ID NO: 3707302 - RNA, 20 nt, Salmonella enterica enterica serovar Typhi Ty2
gcucaauguagcgucagccg

SEQ ID NO: 3707303 - RNA, 21 nt, Salmonella enterica enterica serovar Typhi Ty2
gcucacauucauugccgccag

SEQ ID NO: 3707304 - RNA, 15 nt, Salmonella enterica enterica serovar Typhi Ty2
gcucaccagcccaac

SEQ ID NO: 3707305 - RNA, 15 nt, Salmonella enterica enterica serovar Typhi Ty2
gcucaccgacuccuc

SEQ ID NO: 3707306 - RNA, 18 nt, Salmonella enterica enterica serovar Typhi Ty2
gcucaccgacuccucaac

SEQ ID NO: 3707307 - RNA, 23 nt, Salmonella enterica enterica serovar Typhi Ty2
gcucaccgagacugcccggcaua

SEQ ID NO: 3707308 - RNA, 16 nt, Salmonella enterica enterica serovar Typhi Ty2
gcucaccggucccgga

SEQ ID NO: 3707309 - RNA, 15 nt, Salmonella enterica enterica serovar Typhi Ty2
gcucacggcacgccc

SEQ ID NO: 3707310 - RNA, 20 nt, Salmonella enterica enterica serovar Typhi Ty2
gcucacggcacgcccuucgu

SEQ ID NO: 3707311 - RNA, 22 nt, Salmonella enterica enterica serovar Typhi Ty2
gcucacugcuaaggagauaacu

SEQ ID NO: 3707312 - RNA, 18 nt, Salmonella enterica enterica serovar Typhi Ty2
gcucacuuuucuuuccug

SEQ ID NO: 3707313 - RNA, 15 nt, Salmonella enterica enterica serovar Typhi Ty2
gcucagccagaaacg

SEQ ID NO: 3707314 - RNA, 18 nt, Salmonella enterica enterica serovar Typhi Ty2
gcucagcgccacgcccaa

SEQ ID NO: 3707315 - RNA, 15 nt, Salmonella enterica enterica serovar Typhi Ty2
gcucagcgcggcagc

SEQ ID NO: 3707316 - RNA, 13 nt, Salmonella enterica enterica serovar Typhi Ty2
gcucagcggcggc

SEQ ID NO: 3707317 - RNA, 15 nt, Salmonella enterica enterica serovar Typhi Ty2
gcucaggcuccgcgc

SEQ ID NO: 3707318 - RNA, 21 nt, Salmonella enterica enterica serovar Typhi Ty2
gcucaggguuuucuaccgcag

SEQ ID NO: 3707319 - RNA, 16 nt, Salmonella enterica enterica serovar Typhi Ty2
gcucagguuauacugu

SEQ ID NO: 3707320 - RNA, 22 nt, Salmonella enterica enterica serovar Typhi Ty2
gcucagugaaucgcaucauaaa

SEQ ID NO: 3707321 - RNA, 20 nt, Salmonella enterica enterica serovar Typhi Ty2
gcucauaaauugcagcgacc

SEQ ID NO: 3707322 - RNA, 16 nt, Salmonella enterica enterica serovar Typhi Ty2
gcucauaaccgcgauc

SEQ ID NO: 3707323 - RNA, 21 nt, Salmonella enterica enterica serovar Typhi Ty2
gcucauauacccugcggcgaa

SEQ ID NO: 3707324 - RNA, 23 nt, Salmonella enterica enterica serovar Typhi Ty2
gcucaucaccagcagcagaauca

SEQ ID NO: 3707325 - RNA, 14 nt, Salmonella enterica enterica serovar Typhi Ty2
gcucaucagcgcca

SEQ ID NO: 3707326 - RNA, 19 nt, Salmonella enterica enterica serovar Typhi Ty2
gcucaucagcgccauugcu

SEQ ID NO: 3707327 - RNA, 17 nt, Salmonella enterica enterica serovar Typhi Ty2
gcucaucaggcgugccc

SEQ ID NO: 3707328 - RNA, 13 nt, Salmonella enterica enterica serovar Typhi Ty2
gcucauccagcaa

SEQ ID NO: 3707329 - RNA, 16 nt, Salmonella enterica enterica serovar Typhi Ty2
gcucauccagcaacag

SEQ ID NO: 3707330 - RNA, 13 nt, Salmonella enterica enterica serovar Typhi Ty2
gcucaucggcggc

SEQ ID NO: 3707331 - RNA, 15 nt, Salmonella enterica enterica serovar Typhi Ty2
gcucaugacaucgcc

SEQ ID NO: 3707332 - RNA, 21 nt, Salmonella enterica enterica serovar Typhi Ty2
gcucaugauagggcagcaguu

SEQ ID NO: 3707333 - RNA, 23 nt, Salmonella enterica enterica serovar Typhi Ty2
gcucaugcgaucgggcaauccau

SEQ ID NO: 3707334 - RNA, 15 nt, Salmonella enterica enterica serovar Typhi Ty2
gcucucccgccacug

SEQ ID NO: 3707335 - RNA, 23 nt, Salmonella enterica enterica serovar Typhi Ty2
gcucucccgccacugaauuacug

SEQ ID NO: 3707336 - RNA, 18 nt, Salmonella enterica enterica serovar Typhi Ty2
gcucuccggcacauucac

SEQ ID NO: 3707337 - RNA, 21 nt, Salmonella enterica enterica serovar Typhi Ty2
gcucuccuggaugcgcugaau

SEQ ID NO: 3707338 - RNA, 13 nt, Salmonella enterica enterica serovar Typhi Ty2
gcucuccuggcau

SEQ ID NO: 3707339 - RNA, 19 nt, Salmonella enterica enterica serovar Typhi Ty2
gcucuccuggcauggcucg

SEQ ID NO: 3707340 - RNA, 21 nt, Salmonella enterica enterica serovar Typhi Ty2
gcucucgccgcgcuccaucau

SEQ ID NO: 3707341 - RNA, 23 nt, Salmonella enterica enterica serovar Typhi Ty2
gcucucuuucaccagcgccagaa

SEQ ID NO: 3707342 - RNA, 16 nt, Salmonella enterica enterica serovar Typhi Ty2
gcucucuuuucuuacu

SEQ ID NO: 3707343 - RNA, 16 nt, Salmonella enterica enterica serovar Typhi Ty2
gcucucuuuuggcgac

SEQ ID NO: 3707344 - RNA, 19 nt, Salmonella enterica enterica serovar Typhi Ty2
gcucugaaucucuucccag

SEQ ID NO: 3707345 - RNA, 11 nt, Salmonella enterica enterica serovar Typhi Ty2
gcucugcuguu

SEQ ID NO: 3707346 - RNA, 17 nt, Salmonella enterica enterica serovar Typhi Ty2
gcucugcuguuccuuca

SEQ ID NO: 3707347 - RNA, 15 nt, Salmonella enterica enterica serovar Typhi Ty2
gcucuguggggggaa

SEQ ID NO: 3707348 - RNA, 18 nt, Salmonella enterica enterica serovar Typhi Ty2
gcucuucaauuuccaucu

SEQ ID NO: 3707349 - RNA, 20 nt, Salmonella enterica enterica serovar Typhi Ty2
gcucuucaauuuccaucugu

SEQ ID NO: 3707350 - RNA, 20 nt, Salmonella enterica enterica serovar Typhi Ty2
gcucuucaggcguauauucg

SEQ ID NO: 3707351 - RNA, 19 nt, Salmonella enterica enterica serovar Typhi Ty2
gcucuucuccgccugcggu

SEQ ID NO: 3707352 - RNA, 15 nt, Salmonella enterica enterica serovar Typhi Ty2
gcucuucuuccggcg

SEQ ID NO: 3707353 - RNA, 22 nt, Salmonella enterica enterica serovar Typhi Ty2
gcucuuuaaugauguccagaau

SEQ ID NO: 3707354 - RNA, 17 nt, Salmonella enterica enterica serovar Typhi Ty2
gcucuuucaacuuccgc

SEQ ID NO: 3707355 - RNA, 20 nt, Salmonella enterica enterica serovar Typhi Ty2
gcucuuucauuucugccugc

SEQ ID NO: 3707356 - RNA, 15 nt, Salmonella enterica enterica serovar Typhi Ty2
gcucuuuuuuuugcu

SEQ ID NO: 3707357 - RNA, 23 nt, Salmonella enterica enterica serovar Typhi Ty2
gcugaaaacggcaucaagcccau

SEQ ID NO: 3707358 - RNA, 22 nt, Salmonella enterica enterica serovar Typhi Ty2
gcugaaacagaauaaacggcag

SEQ ID NO: 3707359 - RNA, 13 nt, Salmonella enterica enterica serovar Typhi Ty2
gcugaaagcgccu

SEQ ID NO: 3707360 - RNA, 15 nt, Salmonella enterica enterica serovar Typhi Ty2
gcugaaauagccccg

SEQ ID NO: 3707361 - RNA, 22 nt, Salmonella enterica enterica serovar Typhi Ty2
gcugaaccacccugaaaaguua

SEQ ID NO: 3707362 - RNA, 15 nt, Salmonella enterica enterica serovar Typhi Ty2
gcugaagugcggaua

SEQ ID NO: 3707363 - RNA, 17 nt, Salmonella enterica enterica serovar Typhi Ty2
gcugaauaaugccuucc

SEQ ID NO: 3707364 - RNA, 17 nt, Salmonella enterica enterica serovar Typhi Ty2
gcugacaaacccuguau

SEQ ID NO: 3707365 - RNA, 19 nt, Salmonella enterica enterica serovar Typhi Ty2
gcugacaaagguugcgcca

SEQ ID NO: 3707366 - RNA, 15 nt, Salmonella enterica enterica serovar Typhi Ty2
gcugacaaucugcug

SEQ ID NO: 3707367 - RNA, 14 nt, Salmonella enterica enterica serovar Typhi Ty2
gcugacacucaucc

SEQ ID NO: 3707368 - RNA, 22 nt, Salmonella enterica enterica serovar Typhi Ty2
gcugacaggauacccggcucgc

SEQ ID NO: 3707369 - RNA, 22 nt, Salmonella enterica enterica serovar Typhi Ty2
gcugacaucgcgauuguuggug

SEQ ID NO: 3707370 - RNA, 23 nt, Salmonella enterica enterica serovar Typhi Ty2
gcugacaucguguauaccaaaaa

SEQ ID NO: 3707371 - RNA, 16 nt, Salmonella enterica enterica serovar Typhi Ty2
gcugaccgaaccgcug

SEQ ID NO: 3707372 - RNA, 20 nt, Salmonella enterica enterica serovar Typhi Ty2
gcugaccgcuuucccggcau

SEQ ID NO: 3707373 - RNA, 15 nt, Salmonella enterica enterica serovar Typhi Ty2
gcugacgacauucag

SEQ ID NO: 3707374 - RNA, 14 nt, Salmonella enterica enterica serovar Typhi Ty2
gcugacgaccccag

SEQ ID NO: 3707375 - RNA, 16 nt, Salmonella enterica enterica serovar Typhi Ty2
gcugacgcagcaguuc

SEQ ID NO: 3707376 - RNA, 15 nt, Salmonella enterica enterica serovar Typhi Ty2
gcugacgcccaucag

SEQ ID NO: 3707377 - RNA, 20 nt, Salmonella enterica enterica serovar Typhi Ty2
gcugacgcccaucagcaucc

SEQ ID NO: 3707378 - RNA, 16 nt, Salmonella enterica enterica serovar Typhi Ty2
gcugacgcgaucgccg

SEQ ID NO: 3707379 - RNA, 15 nt, Salmonella enterica enterica serovar Typhi Ty2
gcugacgcugcccgc

SEQ ID NO: 3707380 - RNA, 15 nt, Salmonella enterica enterica serovar Typhi Ty2
gcugacggauacgcu

SEQ ID NO: 3707381 - RNA, 17 nt, Salmonella enterica enterica serovar Typhi Ty2
gcugacguagauucuga

SEQ ID NO: 3707382 - RNA, 12 nt, Salmonella enterica enterica serovar Typhi Ty2
gcugagaaaaau

SEQ ID NO: 3707383 - RNA, 13 nt, Salmonella enterica enterica serovar Typhi Ty2
gcugagaaaaaua

SEQ ID NO: 3707384 - RNA, 22 nt, Salmonella enterica enterica serovar Typhi Ty2
gcugagcaaaaccagacgccga

SEQ ID NO: 3707385 - RNA, 16 nt, Salmonella enterica enterica serovar Typhi Ty2
gcugagcuaaucaccc

SEQ ID NO: 3707386 - RNA, 23 nt, Salmonella enterica enterica serovar Typhi Ty2
gcugagcucugguugcagcgcca

SEQ ID NO: 3707387 - RNA, 14 nt, Salmonella enterica enterica serovar Typhi Ty2
gcugaggaucaccc

SEQ ID NO: 3707388 - RNA, 13 nt, Salmonella enterica enterica serovar Typhi Ty2
gcugaggccgcuc

SEQ ID NO: 3707389 - RNA, 17 nt, Salmonella enterica enterica serovar Typhi Ty2
gcugaggcuuugagcgu

SEQ ID NO: 3707390 - RNA, 21 nt, Salmonella enterica enterica serovar Typhi Ty2
gcugagucagaaacggccugg

SEQ ID NO: 3707391 - RNA, 17 nt, Salmonella enterica enterica serovar Typhi Ty2
gcugagucauccuuccc

SEQ ID NO: 3707392 - RNA, 20 nt, Salmonella enterica enterica serovar Typhi Ty2
gcugauaagcuaguaaagaa

SEQ ID NO: 3707393 - RNA, 13 nt, Salmonella enterica enterica serovar Typhi Ty2
gcugauaauacug

SEQ ID NO: 3707394 - RNA, 16 nt, Salmonella enterica enterica serovar Typhi Ty2
gcugauaaucaauggc

SEQ ID NO: 3707395 - RNA, 15 nt, Salmonella enterica enterica serovar Typhi Ty2
gcugauaggccugga

SEQ ID NO: 3707396 - RNA, 16 nt, Salmonella enterica enterica serovar Typhi Ty2
gcugaucaaugcgcaa

SEQ ID NO: 3707397 - RNA, 21 nt, Salmonella enterica enterica serovar Typhi Ty2
gcugaucgugauaggccagac

SEQ ID NO: 3707398 - RNA, 13 nt, Salmonella enterica enterica serovar Typhi Ty2
gcugaugacgcgc

SEQ ID NO: 3707399 - RNA, 23 nt, Salmonella enterica enterica serovar Typhi Ty2
gcugaugcccagguuagcagcca

SEQ ID NO: 3707400 - RNA, 12 nt, Salmonella enterica enterica serovar Typhi Ty2
gcugaugguuuc

SEQ ID NO: 3707401 - RNA, 16 nt, Salmonella enterica enterica serovar Typhi Ty2
gcugaugugcggccug

SEQ ID NO: 3707402 - RNA, 18 nt, Salmonella enterica enterica serovar Typhi Ty2
gcugauguuugcgcucuu

SEQ ID NO: 3707403 - RNA, 16 nt, Salmonella enterica enterica serovar Typhi Ty2
gcugauuaaugcgccc

SEQ ID NO: 3707404 - RNA, 19 nt, Salmonella enterica enterica serovar Typhi Ty2
gcugauuccggcgcaucca

SEQ ID NO: 3707405 - RNA, 15 nt, Salmonella enterica enterica serovar Typhi Ty2
gcugauuuguuaucu

SEQ ID NO: 3707406 - RNA, 20 nt, Salmonella enterica enterica serovar Typhi Ty2
gcugauuuguuaucuacagu

SEQ ID NO: 3707407 - RNA, 19 nt, Salmonella enterica enterica serovar Typhi Ty2
gcugauuuuuuugcuggcc

SEQ ID NO: 3707408 - RNA, 20 nt, Salmonella enterica enterica serovar Typhi Ty2
gcugcaauagcagaucgcgc

SEQ ID NO: 3707409 - RNA, 20 nt, Salmonella enterica enterica serovar Typhi Ty2
gcugcaauucgucgcuucgu

SEQ ID NO: 3707410 - RNA, 16 nt, Salmonella enterica enterica serovar Typhi Ty2
gcugcacaaaauacug

SEQ ID NO: 3707411 - RNA, 20 nt, Salmonella enterica enterica serovar Typhi Ty2
gcugcacccggagagaaaca

SEQ ID NO: 3707412 - RNA, 15 nt, Salmonella enterica enterica serovar Typhi Ty2
gcugcauccgcgcuu

SEQ ID NO: 3707413 - RNA, 20 nt, Salmonella enterica enterica serovar Typhi Ty2
gcugcaucguuugcaguucc

SEQ ID NO: 3707414 - RNA, 16 nt, Salmonella enterica enterica serovar Typhi Ty2
gcugcaucuuacugac

SEQ ID NO: 3707415 - RNA, 18 nt, Salmonella enterica enterica serovar Typhi Ty2
gcugcaucuuacugaccg

SEQ ID NO: 3707416 - RNA, 21 nt, Salmonella enterica enterica serovar Typhi Ty2
gcugcaucuuacugaccggcc

SEQ ID NO: 3707417 - RNA, 21 nt, Salmonella enterica enterica serovar Typhi Ty2
gcugcauuucuuguugacgac

SEQ ID NO: 3707418 - RNA, 19 nt, Salmonella enterica enterica serovar Typhi Ty2
gcugccacacucucuccag

SEQ ID NO: 3707419 - RNA, 13 nt, Salmonella enterica enterica serovar Typhi Ty2
gcugccagcgccg

SEQ ID NO: 3707420 - RNA, 18 nt, Salmonella enterica enterica serovar Typhi Ty2
gcugccagcugcgucagc

SEQ ID NO: 3707421 - RNA, 12 nt, Salmonella enterica enterica serovar Typhi Ty2
gcugccaucagg

SEQ ID NO: 3707422 - RNA, 14 nt, Salmonella enterica enterica serovar Typhi Ty2
gcugccaucaggca

SEQ ID NO: 3707423 - RNA, 15 nt, Salmonella enterica enterica serovar Typhi Ty2
gcugccccagacgcc

SEQ ID NO: 3707424 - RNA, 15 nt, Salmonella enterica enterica serovar Typhi Ty2
gcugcccgccgccgg

SEQ ID NO: 3707425 - RNA, 22 nt, Salmonella enterica enterica serovar Typhi Ty2
gcugccgacaaagagcucccca

SEQ ID NO: 3707426 - RNA, 19 nt, Salmonella enterica enterica serovar Typhi Ty2
gcugccgcaacggucgguc

SEQ ID NO: 3707427 - RNA, 13 nt, Salmonella enterica enterica serovar Typhi Ty2
gcugccgccagaa

SEQ ID NO: 3707428 - RNA, 21 nt, Salmonella enterica enterica serovar Typhi Ty2
gcugccgccauuugcgcggcu

SEQ ID NO: 3707429 - RNA, 15 nt, Salmonella enterica enterica serovar Typhi Ty2
gcugccgcccuuucc

SEQ ID NO: 3707430 - RNA, 14 nt, Salmonella enterica enterica serovar Typhi Ty2
gcugccucuuuguu

SEQ ID NO: 3707431 - RNA, 13 nt, Salmonella enterica enterica serovar Typhi Ty2
gcugccuuauccg

SEQ ID NO: 3707432 - RNA, 18 nt, Salmonella enterica enterica serovar Typhi Ty2
gcugccuuauccggccug

SEQ ID NO: 3707433 - RNA, 20 nt, Salmonella enterica enterica serovar Typhi Ty2
gcugcgaagccaccggauug

SEQ ID NO: 3707434 - RNA, 18 nt, Salmonella enterica enterica serovar Typhi Ty2
gcugcgauaaugaagcau

SEQ ID NO: 3707435 - RNA, 13 nt, Salmonella enterica enterica serovar Typhi Ty2
gcugcgcagcacu

SEQ ID NO: 3707436 - RNA, 12 nt, Salmonella enterica enterica serovar Typhi Ty2
gcugcgccagau

SEQ ID NO: 3707437 - RNA, 14 nt, Salmonella enterica enterica serovar Typhi Ty2
gcugcgccagcgca

SEQ ID NO: 3707438 - RNA, 23 nt, Salmonella enterica enterica serovar Typhi Ty2
gcugcgccauauccucgcugggc

SEQ ID NO: 3707439 - RNA, 13 nt, Salmonella enterica enterica serovar Typhi Ty2
gcugcgccguucc

SEQ ID NO: 3707440 - RNA, 22 nt, Salmonella enterica enterica serovar Typhi Ty2
gcugcgccuggaaaaaagcgcc

SEQ ID NO: 3707441 - RNA, 12 nt, Salmonella enterica enterica serovar Typhi Ty2
gcugcgcgcgau

SEQ ID NO: 3707442 - RNA, 13 nt, Salmonella enterica enterica serovar Typhi Ty2
gcugcgcucagaa

SEQ ID NO: 3707443 - RNA, 14 nt, Salmonella enterica enterica serovar Typhi Ty2
gcugcgcugccagc

SEQ ID NO: 3707444 - RNA, 17 nt, Salmonella enterica enterica serovar Typhi Ty2
gcugcgcuuaccgggcc

SEQ ID NO: 3707445 - RNA, 20 nt, Salmonella enterica enterica serovar Typhi Ty2
gcugcgcuuaccgggccuac

SEQ ID NO: 3707446 - RNA, 16 nt, Salmonella enterica enterica serovar Typhi Ty2
gcugcgcuuaucaggc

SEQ ID NO: 3707447 - RNA, 16 nt, Salmonella enterica enterica serovar Typhi Ty2
gcugcggaacaccagc

SEQ ID NO: 3707448 - RNA, 19 nt, Salmonella enterica enterica serovar Typhi Ty2
gcugcggaacaccagcgcc

SEQ ID NO: 3707449 - RNA, 18 nt, Salmonella enterica enterica serovar Typhi Ty2
gcugcggcaaacuggcga

SEQ ID NO: 3707450 - RNA, 13 nt, Salmonella enterica enterica serovar Typhi Ty2
gcugcggcgugga

SEQ ID NO: 3707451 - RNA, 19 nt, Salmonella enterica enterica serovar Typhi Ty2
gcugcgguuuacgccaugc

SEQ ID NO: 3707452 - RNA, 19 nt, Salmonella enterica enterica serovar Typhi Ty2
gcugcguaaugaagcgucg

SEQ ID NO: 3707453 - RNA, 18 nt, Salmonella enterica enterica serovar Typhi Ty2
gcugcgucagcgcuugcc

SEQ ID NO: 3707454 - RNA, 18 nt, Salmonella enterica enterica serovar Typhi Ty2
gcugcguucggaagacug

SEQ ID NO: 3707455 - RNA, 21 nt, Salmonella enterica enterica serovar Typhi Ty2
gcugcguucggaagacugcuc

SEQ ID NO: 3707456 - RNA, 21 nt, Salmonella enterica enterica serovar Typhi Ty2
gcugcuauguaaaauccggca

SEQ ID NO: 3707457 - RNA, 18 nt, Salmonella enterica enterica serovar Typhi Ty2
gcugcuauuucaguggcu

SEQ ID NO: 3707458 - RNA, 16 nt, Salmonella enterica enterica serovar Typhi Ty2
gcugcuggugcgccug

SEQ ID NO: 3707459 - RNA, 14 nt, Salmonella enterica enterica serovar Typhi Ty2
gcugcuguaacaga

SEQ ID NO: 3707460 - RNA, 20 nt, Salmonella enterica enterica serovar Typhi Ty2
gcugcuguggauuuauggcg

SEQ ID NO: 3707461 - RNA, 22 nt, Salmonella enterica enterica serovar Typhi Ty2
gcugcuguuaaccuugcgccuc

SEQ ID NO: 3707462 - RNA, 17 nt, Salmonella enterica enterica serovar Typhi Ty2
gcugcuuaccauacuga

SEQ ID NO: 3707463 - RNA, 21 nt, Salmonella enterica enterica serovar Typhi Ty2
gcugcuuagcaguagugagcc

SEQ ID NO: 3707464 - RNA, 12 nt, Salmonella enterica enterica serovar Typhi Ty2
gcugcuucacgg

SEQ ID NO: 3707465 - RNA, 21 nt, Salmonella enterica enterica serovar Typhi Ty2
gcugcuucacguuuuccaggu

SEQ ID NO: 3707466 - RNA, 21 nt, Salmonella enterica enterica serovar Typhi Ty2
gcuggaaaaauaagagggcgc

SEQ ID NO: 3707467 - RNA, 17 nt, Salmonella enterica enterica serovar Typhi Ty2
gcuggaaugcccacucc

SEQ ID NO: 3707468 - RNA, 17 nt, Salmonella enterica enterica serovar Typhi Ty2
gcuggacgucaugccgc

SEQ ID NO: 3707469 - RNA, 15 nt, Salmonella enterica enterica serovar Typhi Ty2
gcuggacgugauaau

SEQ ID NO: 3707470 - RNA, 21 nt, Salmonella enterica enterica serovar Typhi Ty2
gcuggagcaggugcggcuggg

SEQ ID NO: 3707471 - RNA, 14 nt, Salmonella enterica enterica serovar Typhi Ty2
gcuggagccacauc

SEQ ID NO: 3707472 - RNA, 22 nt, Salmonella enterica enterica serovar Typhi Ty2
gcuggauaccgcgccagcgaug

SEQ ID NO: 3707473 - RNA, 17 nt, Salmonella enterica enterica serovar Typhi Ty2
gcuggauagagcgcugc

SEQ ID NO: 3707474 - RNA, 14 nt, Salmonella enterica enterica serovar Typhi Ty2
gcuggaugaggcgc

SEQ ID NO: 3707475 - RNA, 16 nt, Salmonella enterica enterica serovar Typhi Ty2
gcuggauucucuccca

SEQ ID NO: 3707476 - RNA, 22 nt, Salmonella enterica enterica serovar Typhi Ty2
gcuggcaaaacgcauccagcgc

SEQ ID NO: 3707477 - RNA, 13 nt, Salmonella enterica enterica serovar Typhi Ty2
gcuggcaaacagg

SEQ ID NO: 3707478 - RNA, 14 nt, Salmonella enterica enterica serovar Typhi Ty2
gcuggcaggcgcga

SEQ ID NO: 3707479 - RNA, 17 nt, Salmonella enterica enterica serovar Typhi Ty2
gcuggcauuacgcuggc

SEQ ID NO: 3707480 - RNA, 16 nt, Salmonella enterica enterica serovar Typhi Ty2
gcuggccaaucagcgg

SEQ ID NO: 3707481 - RNA, 21 nt, Salmonella enterica enterica serovar Typhi Ty2
gcuggccgaauagcugauaaa

SEQ ID NO: 3707482 - RNA, 14 nt, Salmonella enterica enterica serovar Typhi Ty2
gcuggccgcgugcu

SEQ ID NO: 3707483 - RNA, 19 nt, Salmonella enterica enterica serovar Typhi Ty2
gcuggcgauaaugccguga

SEQ ID NO: 3707484 - RNA, 22 nt, Salmonella enterica enterica serovar Typhi Ty2
gcuggcgcacauuuacgccagc

SEQ ID NO: 3707485 - RNA, 15 nt, Salmonella enterica enterica serovar Typhi Ty2
gcuggcgcaugaucu

SEQ ID NO: 3707486 - RNA, 18 nt, Salmonella enterica enterica serovar Typhi Ty2
gcuggcgcggggaacaca

SEQ ID NO: 3707487 - RNA, 17 nt, Salmonella enterica enterica serovar Typhi Ty2
gcuggcgcggggaucgg

SEQ ID NO: 3707488 - RNA, 21 nt, Salmonella enterica enterica serovar Typhi Ty2
gcuggcgcgucacaacagccg

SEQ ID NO: 3707489 - RNA, 23 nt, Salmonella enterica enterica serovar Typhi Ty2
gcuggcgcgucuguguuuauccg

SEQ ID NO: 3707490 - RNA, 22 nt, Salmonella enterica enterica serovar Typhi Ty2
gcuggcgcucacgauaacgcag

SEQ ID NO: 3707491 - RNA, 12 nt, Salmonella enterica enterica serovar Typhi Ty2
gcuggcggcaag

SEQ ID NO: 3707492 - RNA, 14 nt, Salmonella enterica enterica serovar Typhi Ty2
gcuggcggccccuc

SEQ ID NO: 3707493 - RNA, 16 nt, Salmonella enterica enterica serovar Typhi Ty2
gcuggcggcgauggcc

SEQ ID NO: 3707494 - RNA, 19 nt, Salmonella enterica enterica serovar Typhi Ty2
gcuggcgguuuuugugggu

SEQ ID NO: 3707495 - RNA, 21 nt, Salmonella enterica enterica serovar Typhi Ty2
gcuggcguacaguuucgccgu

SEQ ID NO: 3707496 - RNA, 13 nt, Salmonella enterica enterica serovar Typhi Ty2
gcuggcguccagc

SEQ ID NO: 3707497 - RNA, 20 nt, Salmonella enterica enterica serovar Typhi Ty2
gcuggcgucccgggucagga

SEQ ID NO: 3707498 - RNA, 15 nt, Salmonella enterica enterica serovar Typhi Ty2
gcuuaaaaaauccug

SEQ ID NO: 3707499 - RNA, 17 nt, Salmonella enterica enterica serovar Typhi Ty2
gcuuaaaaaauccugca

SEQ ID NO: 3707500 - RNA, 19 nt, Salmonella enterica enterica serovar Typhi Ty2
gcuuaaacaguauuuaugu

SEQ ID NO: 3707501 - RNA, 20 nt, Salmonella enterica enterica serovar Typhi Ty2
gcuuaaacauauacugcugu

SEQ ID NO: 3707502 - RNA, 18 nt, Salmonella enterica enterica serovar Typhi Ty2
gcuuaaagccaauccaga

SEQ ID NO: 3707503 - RNA, 17 nt, Salmonella enterica enterica serovar Typhi Ty2
gcuuaaagggauuauca

SEQ ID NO: 3707504 - RNA, 19 nt, Salmonella enterica enterica serovar Typhi Ty2
gcuuaaaucgcggcgcuga

SEQ ID NO: 3707505 - RNA, 22 nt, Salmonella enterica enterica serovar Typhi Ty2
gcuuaacagcguacaggcggaa

SEQ ID NO: 3707506 - RNA, 19 nt, Salmonella enterica enterica serovar Typhi Ty2
gcuuaacgaugcggagaua

SEQ ID NO: 3707507 - RNA, 16 nt, Salmonella enterica enterica serovar Typhi Ty2
gcuuaacuucugcagg

SEQ ID NO: 3707508 - RNA, 20 nt, Salmonella enterica enterica serovar Typhi Ty2
gcuuaauaauaagcggccua

SEQ ID NO: 3707509 - RNA, 14 nt, Salmonella enterica enterica serovar Typhi Ty2
gcuuaaugcccggc

SEQ ID NO: 3707510 - RNA, 22 nt, Salmonella enterica enterica serovar Typhi Ty2
gcuuaaugcccggcccgucauc

SEQ ID NO: 3707511 - RNA, 16 nt, Salmonella enterica enterica serovar Typhi Ty2
gcuuaaugcucugcug

SEQ ID NO: 3707512 - RNA, 18 nt, Salmonella enterica enterica serovar Typhi Ty2
gcuuacacacccggccua

SEQ ID NO: 3707513 - RNA, 19 nt, Salmonella enterica enterica serovar Typhi Ty2
gcuuacacacccggccuau

SEQ ID NO: 3707514 - RNA, 16 nt, Salmonella enterica enterica serovar Typhi Ty2
gcuuacacagacugcu

SEQ ID NO: 3707515 - RNA, 13 nt, Salmonella enterica enterica serovar Typhi Ty2
gcuuacaggcacg

SEQ ID NO: 3707516 - RNA, 14 nt, Salmonella enterica enterica serovar Typhi Ty2
gcuuacauuucagg

SEQ ID NO: 3707517 - RNA, 14 nt, Salmonella enterica enterica serovar Typhi Ty2
gcuuaccaggccua

SEQ ID NO: 3707518 - RNA, 18 nt, Salmonella enterica enterica serovar Typhi Ty2
gcuuaccaucuggccuac

SEQ ID NO: 3707519 - RNA, 17 nt, Salmonella enterica enterica serovar Typhi Ty2
gcuuaccgggccuacag

SEQ ID NO: 3707520 - RNA, 22 nt, Salmonella enterica enterica serovar Typhi Ty2
gcuuaccggguuuggucaggua

SEQ ID NO: 3707521 - RNA, 19 nt, Salmonella enterica enterica serovar Typhi Ty2
gcuuaccguaucccaccau

SEQ ID NO: 3707522 - RNA, 18 nt, Salmonella enterica enterica serovar Typhi Ty2
gcuuaccuuguucuucca

SEQ ID NO: 3707523 - RNA, 23 nt, Salmonella enterica enterica serovar Typhi Ty2
gcuuaccuuguucuuccauugcu

SEQ ID NO: 3707524 - RNA, 17 nt, Salmonella enterica enterica serovar Typhi Ty2
gcuuacgcggcgcgcuc

SEQ ID NO: 3707525 - RNA, 17 nt, Salmonella enterica enterica serovar Typhi Ty2
gcuuacggcaaacugaa

SEQ ID NO: 3707526 - RNA, 23 nt, Salmonella enterica enterica serovar Typhi Ty2
gcuuacuuuccaaaauccaggga

SEQ ID NO: 3707527 - RNA, 20 nt, Salmonella enterica enterica serovar Typhi Ty2
gcuuauagcuacguagcgca

SEQ ID NO: 3707528 - RNA, 16 nt, Salmonella enterica enterica serovar Typhi Ty2
gcuuaucaaguaacgu

SEQ ID NO: 3707529 - RNA, 20 nt, Salmonella enterica enterica serovar Typhi Ty2
gcuuaucacguagccagagc

SEQ ID NO: 3707530 - RNA, 14 nt, Salmonella enterica enterica serovar Typhi Ty2
gcuuaucaggccua

SEQ ID NO: 3707531 - RNA, 16 nt, Salmonella enterica enterica serovar Typhi Ty2
gcuuaucaggccuaca

SEQ ID NO: 3707532 - RNA, 17 nt, Salmonella enterica enterica serovar Typhi Ty2
gcuuaucaggccuacaa

SEQ ID NO: 3707533 - RNA, 17 nt, Salmonella enterica enterica serovar Typhi Ty2
gcuuaucaggccuacau

SEQ ID NO: 3707534 - RNA, 23 nt, Salmonella enterica enterica serovar Typhi Ty2
gcuuaucaggccuacauccggcu

SEQ ID NO: 3707535 - RNA, 20 nt, Salmonella enterica enterica serovar Typhi Ty2
gcuuaucaggccuacgcucg

SEQ ID NO: 3707536 - RNA, 21 nt, Salmonella enterica enterica serovar Typhi Ty2
gcuuauccccauucugcugau

SEQ ID NO: 3707537 - RNA, 22 nt, Salmonella enterica enterica serovar Typhi Ty2
gcuuauccccauucugcugaug

SEQ ID NO: 3707538 - RNA, 14 nt, Salmonella enterica enterica serovar Typhi Ty2
gcuuauccggccua

SEQ ID NO: 3707539 - RNA, 15 nt, Salmonella enterica enterica serovar Typhi Ty2
gcuuauccggccuac

SEQ ID NO: 3707540 - RNA, 20 nt, Salmonella enterica enterica serovar Typhi Ty2
gcuuauccggccuacgauuu

SEQ ID NO: 3707541 - RNA, 17 nt, Salmonella enterica enterica serovar Typhi Ty2
gcuuauccggccugcac

SEQ ID NO: 3707542 - RNA, 21 nt, Salmonella enterica enterica serovar Typhi Ty2
gcuuaucgccaaaccagaccc

SEQ ID NO: 3707543 - RNA, 16 nt, Salmonella enterica enterica serovar Typhi Ty2
gcuuaucgccaaagau

SEQ ID NO: 3707544 - RNA, 14 nt, Salmonella enterica enterica serovar Typhi Ty2
gcuuaucgggccua

SEQ ID NO: 3707545 - RNA, 17 nt, Salmonella enterica enterica serovar Typhi Ty2
gcuuaucgggccuacga

SEQ ID NO: 3707546 - RNA, 19 nt, Salmonella enterica enterica serovar Typhi Ty2
gcuuaucucuacuuuccug

SEQ ID NO: 3707547 - RNA, 14 nt, Salmonella enterica enterica serovar Typhi Ty2
gcuuaucugaccau

SEQ ID NO: 3707548 - RNA, 18 nt, Salmonella enterica enterica serovar Typhi Ty2
gcuuaucugcugcugggu

SEQ ID NO: 3707549 - RNA, 16 nt, Salmonella enterica enterica serovar Typhi Ty2
gcuuaucuuuacgcuu

SEQ ID NO: 3707550 - RNA, 19 nt, Salmonella enterica enterica serovar Typhi Ty2
gcuuauuccagucauuaac

SEQ ID NO: 3707551 - RNA, 13 nt, Salmonella enterica enterica serovar Typhi Ty2
gcuuauugucgcc

SEQ ID NO: 3707552 - RNA, 16 nt, Salmonella enterica enterica serovar Typhi Ty2
gcuuauuuucgucguu

SEQ ID NO: 3707553 - RNA, 17 nt, Salmonella enterica enterica serovar Typhi Ty2
gcuucaacagcggcggc

SEQ ID NO: 3707554 - RNA, 18 nt, Salmonella enterica enterica serovar Typhi Ty2
gcuucaacagcggcggca

SEQ ID NO: 3707555 - RNA, 19 nt, Salmonella enterica enterica serovar Typhi Ty2
gcuucaaccguuucuuuuu

SEQ ID NO: 3707556 - RNA, 19 nt, Salmonella enterica enterica serovar Typhi Ty2
gcuucaauaagaaacugcu

SEQ ID NO: 3707557 - RNA, 14 nt, Salmonella enterica enterica serovar Typhi Ty2
gcuucaccgccaga

SEQ ID NO: 3707558 - RNA, 13 nt, Salmonella enterica enterica serovar Typhi Ty2
gcuucaccucagc

SEQ ID NO: 3707559 - RNA, 20 nt, Salmonella enterica enterica serovar Typhi Ty2
gcuucaccuuucgccgccag

SEQ ID NO: 3707560 - RNA, 17 nt, Salmonella enterica enterica serovar Typhi Ty2
gcuucacuaacugguac

SEQ ID NO: 3707561 - RNA, 19 nt, Salmonella enterica enterica serovar Typhi Ty2
gcuucagacaacgccgccu

SEQ ID NO: 3707562 - RNA, 13 nt, Salmonella enterica enterica serovar Typhi Ty2
gcuucagagcagg

SEQ ID NO: 3707563 - RNA, 17 nt, Salmonella enterica enterica serovar Typhi Ty2
gcuucagcaucaucucc

SEQ ID NO: 3707564 - RNA, 16 nt, Salmonella enterica enterica serovar Typhi Ty2
gcuucagccacuggcu

SEQ ID NO: 3707565 - RNA, 22 nt, Salmonella enterica enterica serovar Typhi Ty2
gcuucaggugugguacggcuuu

SEQ ID NO: 3707566 - RNA, 21 nt, Salmonella enterica enterica serovar Typhi Ty2
gcuucagucauaauccuuccu

SEQ ID NO: 3707567 - RNA, 20 nt, Salmonella enterica enterica serovar Typhi Ty2
gcuucauaucgcccagcagc

SEQ ID NO: 3707568 - RNA, 19 nt, Salmonella enterica enterica serovar Typhi Ty2
gcuuccacgcacgccggcc

SEQ ID NO: 3707569 - RNA, 21 nt, Salmonella enterica enterica serovar Typhi Ty2
gcuuccagaauucguacguuu

SEQ ID NO: 3707570 - RNA, 12 nt, Salmonella enterica enterica serovar Typhi Ty2
gcuuccagcaug

SEQ ID NO: 3707571 - RNA, 21 nt, Salmonella enterica enterica serovar Typhi Ty2
gcuuccagcgcgucggccggc

SEQ ID NO: 3707572 - RNA, 15 nt, Salmonella enterica enterica serovar Typhi Ty2
gcuuccaguugaaaa

SEQ ID NO: 3707573 - RNA, 22 nt, Salmonella enterica enterica serovar Typhi Ty2
gcuuccaguugaaaaccacaau

SEQ ID NO: 3707574 - RNA, 13 nt, Salmonella enterica enterica serovar Typhi Ty2
gcuucccacaguc

SEQ ID NO: 3707575 - RNA, 14 nt, Salmonella enterica enterica serovar Typhi Ty2
gcuucccgaaagga

SEQ ID NO: 3707576 - RNA, 16 nt, Salmonella enterica enterica serovar Typhi Ty2
gcuucccgaugccagc

SEQ ID NO: 3707577 - RNA, 18 nt, Salmonella enterica enterica serovar Typhi Ty2
gcuucccgaugccagcaa

SEQ ID NO: 3707578 - RNA, 14 nt, Salmonella enterica enterica serovar Typhi Ty2
gcuuccgccgggaa

SEQ ID NO: 3707579 - RNA, 19 nt, Salmonella enterica enterica serovar Typhi Ty2
gcuuccgcgacgaugcgca

SEQ ID NO: 3707580 - RNA, 17 nt, Salmonella enterica enterica serovar Typhi Ty2
gcuuugcgauagcccgg

SEQ ID NO: 3707581 - RNA, 21 nt, Salmonella enterica enterica serovar Typhi Ty2
gcuuugcgauagcccggcaug

SEQ ID NO: 3707582 - RNA, 17 nt, Salmonella enterica enterica serovar Typhi Ty2
gcuuugcguaaaaaaca

SEQ ID NO: 3707583 - RNA, 19 nt, Salmonella enterica enterica serovar Typhi Ty2
gcuuugcuuauccggccua

SEQ ID NO: 3707584 - RNA, 18 nt, Salmonella enterica enterica serovar Typhi Ty2
gcuuuggcaaacggcgcc

SEQ ID NO: 3707585 - RNA, 18 nt, Salmonella enterica enterica serovar Typhi Ty2
gcuuuguaaaacauucaa

SEQ ID NO: 3707586 - RNA, 19 nt, Salmonella enterica enterica serovar Typhi Ty2
gcuuuguuuccacugagcu

SEQ ID NO: 3707587 - RNA, 18 nt, Salmonella enterica enterica serovar Typhi Ty2
gcuuuguuuuccagauuc

SEQ ID NO: 3707588 - RNA, 21 nt, Salmonella enterica enterica serovar Typhi Ty2
gcuuuuaguuguacaaacugu

SEQ ID NO: 3707589 - RNA, 19 nt, Salmonella enterica enterica serovar Typhi Ty2
gcuuuucagcgucuuucuu

SEQ ID NO: 3707590 - RNA, 14 nt, Salmonella enterica enterica serovar Typhi Ty2
gcuuuucauuuguu

SEQ ID NO: 3707591 - RNA, 18 nt, Salmonella enterica enterica serovar Typhi Ty2
gcuuuuccuguucuggcu

SEQ ID NO: 3707592 - RNA, 23 nt, Salmonella enterica enterica serovar Typhi Ty2
gcuuuucgcuuaaacauauacug

SEQ ID NO: 3707593 - RNA, 12 nt, Salmonella enterica enterica serovar Typhi Ty2
gcuuuugccugc

SEQ ID NO: 3707594 - RNA, 18 nt, Salmonella enterica enterica serovar Typhi Ty2
gcuuuugcgcacugcucg

SEQ ID NO: 3707595 - RNA, 22 nt, Salmonella enterica enterica serovar Typhi Ty2
gcuuuuucauucugcuuaccag

SEQ ID NO: 3707596 - RNA, 15 nt, Salmonella enterica enterica serovar Typhi Ty2
gcuuuuugccgggcg

SEQ ID NO: 3707597 - RNA, 20 nt, Salmonella enterica enterica serovar Typhi Ty2
gcuuuuuuaacgauuucccc

SEQ ID NO: 3707598 - RNA, 14 nt, Salmonella enterica enterica serovar Typhi Ty2
gcuuuuuuaucuau

SEQ ID NO: 3707599 - RNA, 15 nt, Salmonella enterica enterica serovar Typhi Ty2
gcuuuuuucaccuuu

SEQ ID NO: 3707600 - RNA, 15 nt, Salmonella enterica enterica serovar Typhi Ty2
gcuuuuuucucugcu

SEQ ID NO: 3707601 - RNA, 17 nt, Salmonella enterica enterica serovar Typhi Ty2
ggaaaaaagcagcaucc

SEQ ID NO: 3707602 - RNA, 20 nt, Salmonella enterica enterica serovar Typhi Ty2
ggaaaaaauacugauaaaaa

SEQ ID NO: 3707603 - RNA, 15 nt, Salmonella enterica enterica serovar Typhi Ty2
ggaaaaagccgccgu

SEQ ID NO: 3707604 - RNA, 21 nt, Salmonella enterica enterica serovar Typhi Ty2
ggaaaacagcgccggcagcag

SEQ ID NO: 3707605 - RNA, 13 nt, Salmonella enterica enterica serovar Typhi Ty2
ggaaaacgcgcug

SEQ ID NO: 3707606 - RNA, 13 nt, Salmonella enterica enterica serovar Typhi Ty2
ggaaaacgcuucu

SEQ ID NO: 3707607 - RNA, 23 nt, Salmonella enterica enterica serovar Typhi Ty2
ggaaaacggccagugaaauaaau

SEQ ID NO: 3707608 - RNA, 21 nt, Salmonella enterica enterica serovar Typhi Ty2
ggaaaacuggaagaagaaagg

SEQ ID NO: 3707609 - RNA, 20 nt, Salmonella enterica enterica serovar Typhi Ty2
ggaaacgcuauuuaacccug

SEQ ID NO: 3707610 - RNA, 19 nt, Salmonella enterica enterica serovar Typhi Ty2
ggaaacuauccuggccuga

SEQ ID NO: 3707611 - RNA, 17 nt, Salmonella enterica enterica serovar Typhi Ty2
ggaaacuaugcaaaacg

SEQ ID NO: 3707612 - RNA, 15 nt, Salmonella enterica enterica serovar Typhi Ty2
ggaaacucuuuuccc

SEQ ID NO: 3707613 - RNA, 15 nt, Salmonella enterica enterica serovar Typhi Ty2
ggaaacuguaguaau

SEQ ID NO: 3707614 - RNA, 23 nt, Salmonella enterica enterica serovar Typhi Ty2
ggaaacugugcgacaaccugcgc

SEQ ID NO: 3707615 - RNA, 19 nt, Salmonella enterica enterica serovar Typhi Ty2
ggaaagacggcagcgccau

SEQ ID NO: 3707616 - RNA, 22 nt, Salmonella enterica enterica serovar Typhi Ty2
ggaaagacggcagcgccauccg

SEQ ID NO: 3707617 - RNA, 21 nt, Salmonella enterica enterica serovar Typhi Ty2
ggaaagauuacuucaggcugc

SEQ ID NO: 3707618 - RNA, 14 nt, Salmonella enterica enterica serovar Typhi Ty2
ggaaagggacgaug

SEQ ID NO: 3707619 - RNA, 22 nt, Salmonella enterica enterica serovar Typhi Ty2
ggaaaguaccaaaacagaaaag

SEQ ID NO: 3707620 - RNA, 14 nt, Salmonella enterica enterica serovar Typhi Ty2
ggaaauaaagguuc

SEQ ID NO: 3707621 - RNA, 14 nt, Salmonella enterica enterica serovar Typhi Ty2
ggaaauaccauccg

SEQ ID NO: 3707622 - RNA, 20 nt, Salmonella enterica enterica serovar Typhi Ty2
ggaaaucaaaccaucccagg

SEQ ID NO: 3707623 - RNA, 23 nt, Salmonella enterica enterica serovar Typhi Ty2
ggaaaucaaaccaucccagguua

SEQ ID NO: 3707624 - RNA, 19 nt, Salmonella enterica enterica serovar Typhi Ty2
ggaaaugccgggcaaaaaa

SEQ ID NO: 3707625 - RNA, 21 nt, Salmonella enterica enterica serovar Typhi Ty2
ggaaauggcgaacagcccgcu

SEQ ID NO: 3707626 - RNA, 19 nt, Salmonella enterica enterica serovar Typhi Ty2
ggaaauguagccccaggcc

SEQ ID NO: 3707627 - RNA, 22 nt, Salmonella enterica enterica serovar Typhi Ty2
ggaaauucugacgcagcuucug

SEQ ID NO: 3707628 - RNA, 13 nt, Salmonella enterica enterica serovar Typhi Ty2
ggaacaaaacgga

SEQ ID NO: 3707629 - RNA, 23 nt, Salmonella enterica enterica serovar Typhi Ty2
ggaacaaaccgacuuucaaaucg

SEQ ID NO: 3707630 - RNA, 15 nt, Salmonella enterica enterica serovar Typhi Ty2
ggaacaagcaaaccu

SEQ ID NO: 3707631 - RNA, 17 nt, Salmonella enterica enterica serovar Typhi Ty2
ggaacaagcaaaccuau

SEQ ID NO: 3707632 - RNA, 14 nt, Salmonella enterica enterica serovar Typhi Ty2
ggaacaccagcgcc

SEQ ID NO: 3707633 - RNA, 12 nt, Salmonella enterica enterica serovar Typhi Ty2
ggaacagauaaa

SEQ ID NO: 3707634 - RNA, 19 nt, Salmonella enterica enterica serovar Typhi Ty2
ggaacagcggagcgaagaa

SEQ ID NO: 3707635 - RNA, 16 nt, Salmonella enterica enterica serovar Typhi Ty2
ggaacaggccaaaccc

SEQ ID NO: 3707636 - RNA, 15 nt, Salmonella enterica enterica serovar Typhi Ty2
ggaacagggccgcau

SEQ ID NO: 3707637 - RNA, 14 nt, Salmonella enterica enterica serovar Typhi Ty2
ggaacaucagccag

SEQ ID NO: 3707638 - RNA, 16 nt, Salmonella enterica enterica serovar Typhi Ty2
ggaacaucagccagca

SEQ ID NO: 3707639 - RNA, 20 nt, Salmonella enterica enterica serovar Typhi Ty2
ggaacaucagccagcagcuc

SEQ ID NO: 3707640 - RNA, 19 nt, Salmonella enterica enterica serovar Typhi Ty2
ggaacaucuuuuaccugug

SEQ ID NO: 3707641 - RNA, 16 nt, Salmonella enterica enterica serovar Typhi Ty2
ggaaccaaaugcccag

SEQ ID NO: 3707642 - RNA, 14 nt, Salmonella enterica enterica serovar Typhi Ty2
ggaacccaggcacc

SEQ ID NO: 3707643 - RNA, 18 nt, Salmonella enterica enterica serovar Typhi Ty2
ggaaccggguugcggaag

SEQ ID NO: 3707644 - RNA, 19 nt, Salmonella enterica enterica serovar Typhi Ty2
ggaaccggguugcggaagc

SEQ ID NO: 3707645 - RNA, 13 nt, Salmonella enterica enterica serovar Typhi Ty2
ggaacgucaucau

SEQ ID NO: 3707646 - RNA, 14 nt, Salmonella enterica enterica serovar Typhi Ty2
ggaacgugccguuu

SEQ ID NO: 3707647 - RNA, 22 nt, Salmonella enterica enterica serovar Typhi Ty2
ggaacuaacccgcagccggaau

SEQ ID NO: 3707648 - RNA, 21 nt, Salmonella enterica enterica serovar Typhi Ty2
ggaacucugcgacgccaggcg

SEQ ID NO: 3707649 - RNA, 21 nt, Salmonella enterica enterica serovar Typhi Ty2
ggaacugacuccagcugguau

SEQ ID NO: 3707650 - RNA, 14 nt, Salmonella enterica enterica serovar Typhi Ty2
ggaacugcggccag

SEQ ID NO: 3707651 - RNA, 16 nt, Salmonella enterica enterica serovar Typhi Ty2
ggaacugggugccgug

SEQ ID NO: 3707652 - RNA, 16 nt, Salmonella enterica enterica serovar Typhi Ty2
ggaacuggugaaacag

SEQ ID NO: 3707653 - RNA, 15 nt, Salmonella enterica enterica serovar Typhi Ty2
ggaacuguucagcca

SEQ ID NO: 3707654 - RNA, 18 nt, Salmonella enterica enterica serovar Typhi Ty2
ggaacuguucagccagca

SEQ ID NO: 3707655 - RNA, 18 nt, Salmonella enterica enterica serovar Typhi Ty2
ggaagaaacgcuuaaagc

SEQ ID NO: 3707656 - RNA, 15 nt, Salmonella enterica enterica serovar Typhi Ty2
ggaagaccguuuaaa

SEQ ID NO: 3707657 - RNA, 15 nt, Salmonella enterica enterica serovar Typhi Ty2
ggaagacguuuacac

SEQ ID NO: 3707658 - RNA, 21 nt, Salmonella enterica enterica serovar Typhi Ty2
ggaagacguuuacaccgccau

SEQ ID NO: 3707659 - RNA, 17 nt, Salmonella enterica enterica serovar Typhi Ty2
ggaagacugcuccggca

SEQ ID NO: 3707660 - RNA, 17 nt, Salmonella enterica enterica serovar Typhi Ty2
ggaagacuggcgcagca

SEQ ID NO: 3707661 - RNA, 19 nt, Salmonella enterica enterica serovar Typhi Ty2
ggaagacuggcgcagcaaa

SEQ ID NO: 3707662 - RNA, 16 nt, Salmonella enterica enterica serovar Typhi Ty2
ggaucauguugagcuu

SEQ ID NO: 3707663 - RNA, 17 nt, Salmonella enterica enterica serovar Typhi Ty2
ggauccguucaucggca

SEQ ID NO: 3707664 - RNA, 17 nt, Salmonella enterica enterica serovar Typhi Ty2
ggaucggcacacagcca

SEQ ID NO: 3707665 - RNA, 16 nt, Salmonella enterica enterica serovar Typhi Ty2
ggaucggccauaucca

SEQ ID NO: 3707666 - RNA, 15 nt, Salmonella enterica enterica serovar Typhi Ty2
ggaucgguuuauccc

SEQ ID NO: 3707667 - RNA, 22 nt, Salmonella enterica enterica serovar Typhi Ty2
ggaucgucucugagaucaaaca

SEQ ID NO: 3707668 - RNA, 23 nt, Salmonella enterica enterica serovar Typhi Ty2
ggaucguucugcugauaauacug

SEQ ID NO: 3707669 - RNA, 20 nt, Salmonella enterica enterica serovar Typhi Ty2
ggaucugauacggaaauagc

SEQ ID NO: 3707670 - RNA, 20 nt, Salmonella enterica enterica serovar Typhi Ty2
ggaucugcuuaugaucgccc

SEQ ID NO: 3707671 - RNA, 22 nt, Salmonella enterica enterica serovar Typhi Ty2
ggaucugcuuaugaucgcccag

SEQ ID NO: 3707672 - RNA, 23 nt, Salmonella enterica enterica serovar Typhi Ty2
ggaucugcuuaugaucgcccagc

SEQ ID NO: 3707673 - RNA, 22 nt, Salmonella enterica enterica serovar Typhi Ty2
ggaugaacucuaugcaaaagaa

SEQ ID NO: 3707674 - RNA, 15 nt, Salmonella enterica enterica serovar Typhi Ty2
ggaugacagaaagcg

SEQ ID NO: 3707675 - RNA, 16 nt, Salmonella enterica enterica serovar Typhi Ty2
ggaugcauaaaaaaac

SEQ ID NO: 3707676 - RNA, 19 nt, Salmonella enterica enterica serovar Typhi Ty2
ggaugcaucaugcuaaaag

SEQ ID NO: 3707677 - RNA, 15 nt, Salmonella enterica enterica serovar Typhi Ty2
ggaugccaaccaccg

SEQ ID NO: 3707678 - RNA, 18 nt, Salmonella enterica enterica serovar Typhi Ty2
ggaugccugcgcauccuc

SEQ ID NO: 3707679 - RNA, 18 nt, Salmonella enterica enterica serovar Typhi Ty2
ggaugcgcagguaaaacc

SEQ ID NO: 3707680 - RNA, 16 nt, Salmonella enterica enterica serovar Typhi Ty2
ggaugcguaauccggc

SEQ ID NO: 3707681 - RNA, 13 nt, Salmonella enterica enterica serovar Typhi Ty2
ggauggcaaaaac

SEQ ID NO: 3707682 - RNA, 14 nt, Salmonella enterica enterica serovar Typhi Ty2
ggauggccagcacc

SEQ ID NO: 3707683 - RNA, 20 nt, Salmonella enterica enterica serovar Typhi Ty2
ggauggccagcaccagcauu

SEQ ID NO: 3707684 - RNA, 23 nt, Salmonella enterica enterica serovar Typhi Ty2
ggauggccagcaccagcauuagc

SEQ ID NO: 3707685 - RNA, 15 nt, Salmonella enterica enterica serovar Typhi Ty2
ggauggccugcucaa

SEQ ID NO: 3707686 - RNA, 20 nt, Salmonella enterica enterica serovar Typhi Ty2
ggauggcuggggaaguuaug

SEQ ID NO: 3707687 - RNA, 11 nt, Salmonella enterica enterica serovar Typhi Ty2
ggauggugguc

SEQ ID NO: 3707688 - RNA, 18 nt, Salmonella enterica enterica serovar Typhi Ty2
ggaugucggcuuacgccu

SEQ ID NO: 3707689 - RNA, 21 nt, Salmonella enterica enterica serovar Typhi Ty2
ggaugugaccuuugugcagga

SEQ ID NO: 3707690 - RNA, 22 nt, Salmonella enterica enterica serovar Typhi Ty2
ggaugugaccuuugugcaggau

SEQ ID NO: 3707691 - RNA, 13 nt, Salmonella enterica enterica serovar Typhi Ty2
ggaugugcauuga

SEQ ID NO: 3707692 - RNA, 18 nt, Salmonella enterica enterica serovar Typhi Ty2
ggaugugcauugacuacu

SEQ ID NO: 3707693 - RNA, 16 nt, Salmonella enterica enterica serovar Typhi Ty2
ggauguggugcggcuu

SEQ ID NO: 3707694 - RNA, 15 nt, Salmonella enterica enterica serovar Typhi Ty2
ggauguugccacagg

SEQ ID NO: 3707695 - RNA, 12 nt, Salmonella enterica enterica serovar Typhi Ty2
ggauuaucagaa

SEQ ID NO: 3707696 - RNA, 22 nt, Salmonella enterica enterica serovar Typhi Ty2
ggauuaucaggaugaauaugaa

SEQ ID NO: 3707697 - RNA, 20 nt, Salmonella enterica enterica serovar Typhi Ty2
ggauuccgccgcggccagca

SEQ ID NO: 3707698 - RNA, 14 nt, Salmonella enterica enterica serovar Typhi Ty2
ggauucgaaccugc

SEQ ID NO: 3707699 - RNA, 19 nt, Salmonella enterica enterica serovar Typhi Ty2
ggauucgccagcgugcuua

SEQ ID NO: 3707700 - RNA, 13 nt, Salmonella enterica enterica serovar Typhi Ty2
ggauucuccggcg

SEQ ID NO: 3707701 - RNA, 22 nt, Salmonella enterica enterica serovar Typhi Ty2
ggauucucuaacgucagcgcca

SEQ ID NO: 3707702 - RNA, 21 nt, Salmonella enterica enterica serovar Typhi Ty2
ggauuggauaaaucggucauu

SEQ ID NO: 3707703 - RNA, 15 nt, Salmonella enterica enterica serovar Typhi Ty2
ggauuguuuuuuagc

SEQ ID NO: 3707704 - RNA, 17 nt, Salmonella enterica enterica serovar Typhi Ty2
ggauuuaaaccgccccg

SEQ ID NO: 3707705 - RNA, 18 nt, Salmonella enterica enterica serovar Typhi Ty2
ggauuuccuggcaguuca

SEQ ID NO: 3707706 - RNA, 20 nt, Salmonella enterica enterica serovar Typhi Ty2
ggauuuuccguuaagcugga

SEQ ID NO: 3707707 - RNA, 20 nt, Salmonella enterica enterica serovar Typhi Ty2
ggcaaaaaucagccaaagcg

SEQ ID NO: 3707708 - RNA, 20 nt, Salmonella enterica enterica serovar Typhi Ty2
ggcaaaaauccuucuuccau

SEQ ID NO: 3707709 - RNA, 21 nt, Salmonella enterica enterica serovar Typhi Ty2
ggcaaaacgccgcagaaaaug

SEQ ID NO: 3707710 - RNA, 17 nt, Salmonella enterica enterica serovar Typhi Ty2
ggcaaaacgggcggcgg

SEQ ID NO: 3707711 - RNA, 23 nt, Salmonella enterica enterica serovar Typhi Ty2
ggcaaacacaaucacgcccagcg

SEQ ID NO: 3707712 - RNA, 14 nt, Salmonella enterica enterica serovar Typhi Ty2
ggcaaacauagccu

SEQ ID NO: 3707713 - RNA, 12 nt, Salmonella enterica enterica serovar Typhi Ty2
ggcaaaccagca

SEQ ID NO: 3707714 - RNA, 18 nt, Salmonella enterica enterica serovar Typhi Ty2
ggcaaaccauguacccuc

SEQ ID NO: 3707715 - RNA, 17 nt, Salmonella enterica enterica serovar Typhi Ty2
ggcaaacggcgccagcu

SEQ ID NO: 3707716 - RNA, 20 nt, Salmonella enterica enterica serovar Typhi Ty2
ggcaaacggcgccagcucau

SEQ ID NO: 3707717 - RNA, 18 nt, Salmonella enterica enterica serovar Typhi Ty2
ggcaaacgguuaauacug

SEQ ID NO: 3707718 - RNA, 15 nt, Salmonella enterica enterica serovar Typhi Ty2
ggcaaagucgaacga

SEQ ID NO: 3707719 - RNA, 22 nt, Salmonella enterica enterica serovar Typhi Ty2
ggcaaauagcguguguuuuccu

SEQ ID NO: 3707720 - RNA, 20 nt, Salmonella enterica enterica serovar Typhi Ty2
ggcaaauccuccauaaauaa

SEQ ID NO: 3707721 - RNA, 18 nt, Salmonella enterica enterica serovar Typhi Ty2
ggcaaauucuuuucacgc

SEQ ID NO: 3707722 - RNA, 15 nt, Salmonella enterica enterica serovar Typhi Ty2
ggcaacacccgccga

SEQ ID NO: 3707723 - RNA, 21 nt, Salmonella enterica enterica serovar Typhi Ty2
ggcaacaugaccagcgcaaac

SEQ ID NO: 3707724 - RNA, 17 nt, Salmonella enterica enterica serovar Typhi Ty2
ggcaacccgcuccagaa

SEQ ID NO: 3707725 - RNA, 18 nt, Salmonella enterica enterica serovar Typhi Ty2
ggcaaccugucaguacgu

SEQ ID NO: 3707726 - RNA, 19 nt, Salmonella enterica enterica serovar Typhi Ty2
ggcaacggccagcgcaggc

SEQ ID NO: 3707727 - RNA, 19 nt, Salmonella enterica enterica serovar Typhi Ty2
ggcaacguaagccaguucu

SEQ ID NO: 3707728 - RNA, 18 nt, Salmonella enterica enterica serovar Typhi Ty2
ggcaagacccgaaccugc

SEQ ID NO: 3707729 - RNA, 22 nt, Salmonella enterica enterica serovar Typhi Ty2
ggcaagagauucaggccgccag

SEQ ID NO: 3707730 - RNA, 23 nt, Salmonella enterica enterica serovar Typhi Ty2
ggcaagagauucaggccgccagc

SEQ ID NO: 3707731 - RNA, 19 nt, Salmonella enterica enterica serovar Typhi Ty2
ggcaagauuaaccagcagu

SEQ ID NO: 3707732 - RNA, 19 nt, Salmonella enterica enterica serovar Typhi Ty2
ggcaagccgaucagcgugu

SEQ ID NO: 3707733 - RNA, 14 nt, Salmonella enterica enterica serovar Typhi Ty2
ggcaagcgccagca

SEQ ID NO: 3707734 - RNA, 12 nt, Salmonella enterica enterica serovar Typhi Ty2
ggcaagcucagc

SEQ ID NO: 3707735 - RNA, 15 nt, Salmonella enterica enterica serovar Typhi Ty2
ggcaagcucagcggc

SEQ ID NO: 3707736 - RNA, 16 nt, Salmonella enterica enterica serovar Typhi Ty2
ggcaagcucagcggca

SEQ ID NO: 3707737 - RNA, 19 nt, Salmonella enterica enterica serovar Typhi Ty2
ggcaaguucuuguuucauc

SEQ ID NO: 3707738 - RNA, 19 nt, Salmonella enterica enterica serovar Typhi Ty2
ggcaaguuuaauuccgaau

SEQ ID NO: 3707739 - RNA, 14 nt, Salmonella enterica enterica serovar Typhi Ty2
ggcaauaaaguuua

SEQ ID NO: 3707740 - RNA, 23 nt, Salmonella enterica enterica serovar Typhi Ty2
ggcaauagaccagcggcccgcgc

SEQ ID NO: 3707741 - RNA, 21 nt, Salmonella enterica enterica serovar Typhi Ty2
ggcaauauaccgucaguacca

SEQ ID NO: 3707742 - RNA, 14 nt, Salmonella enterica enterica serovar Typhi Ty2
ggcaauaucaugaa

SEQ ID NO: 3707743 - RNA, 13 nt, Salmonella enterica enterica serovar Typhi Ty2
ggcaauauguuua

SEQ ID NO: 3707744 - RNA, 19 nt, Salmonella enterica enterica serovar Typhi Ty2
ggcauccagcgcucaauca

SEQ ID NO: 3707745 - RNA, 18 nt, Salmonella enterica enterica serovar Typhi Ty2
ggcauccaguuucuucgg

SEQ ID NO: 3707746 - RNA, 18 nt, Salmonella enterica enterica serovar Typhi Ty2
ggcauccgugaccugcug

SEQ ID NO: 3707747 - RNA, 20 nt, Salmonella enterica enterica serovar Typhi Ty2
ggcauccgugaccugcugac

SEQ ID NO: 3707748 - RNA, 16 nt, Salmonella enterica enterica serovar Typhi Ty2
ggcaucgccgcccagu

SEQ ID NO: 3707749 - RNA, 21 nt, Salmonella enterica enterica serovar Typhi Ty2
ggcaucgggauuuacaaccgc

SEQ ID NO: 3707750 - RNA, 14 nt, Salmonella enterica enterica serovar Typhi Ty2
ggcaucgucggcga

SEQ ID NO: 3707751 - RNA, 13 nt, Salmonella enterica enterica serovar Typhi Ty2
ggcaucucaucuu

SEQ ID NO: 3707752 - RNA, 19 nt, Salmonella enterica enterica serovar Typhi Ty2
ggcaucucaucuugcagga

SEQ ID NO: 3707753 - RNA, 12 nt, Salmonella enterica enterica serovar Typhi Ty2
ggcaucucgcca

SEQ ID NO: 3707754 - RNA, 13 nt, Salmonella enterica enterica serovar Typhi Ty2
ggcaucucgccaa

SEQ ID NO: 3707755 - RNA, 21 nt, Salmonella enterica enterica serovar Typhi Ty2
ggcaucugcaauucggcggca

SEQ ID NO: 3707756 - RNA, 15 nt, Salmonella enterica enterica serovar Typhi Ty2
ggcaugaagaaaaua

SEQ ID NO: 3707757 - RNA, 19 nt, Salmonella enterica enterica serovar Typhi Ty2
ggcaugacuuuaccgguuu

SEQ ID NO: 3707758 - RNA, 13 nt, Salmonella enterica enterica serovar Typhi Ty2
ggcaugaugccac

SEQ ID NO: 3707759 - RNA, 16 nt, Salmonella enterica enterica serovar Typhi Ty2
ggcaugauuaaagcca

SEQ ID NO: 3707760 - RNA, 19 nt, Salmonella enterica enterica serovar Typhi Ty2
ggcauggccuucaaucagc

SEQ ID NO: 3707761 - RNA, 22 nt, Salmonella enterica enterica serovar Typhi Ty2
ggcauggggucaggugggacca

SEQ ID NO: 3707762 - RNA, 21 nt, Salmonella enterica enterica serovar Typhi Ty2
ggcauguccggcgacuccaga

SEQ ID NO: 3707763 - RNA, 17 nt, Salmonella enterica enterica serovar Typhi Ty2
ggcaugucugucuaugc

SEQ ID NO: 3707764 - RNA, 16 nt, Salmonella enterica enterica serovar Typhi Ty2
ggcauguucacaucgc

SEQ ID NO: 3707765 - RNA, 23 nt, Salmonella enterica enterica serovar Typhi Ty2
ggcauguucucccugacacugua

SEQ ID NO: 3707766 - RNA, 15 nt, Salmonella enterica enterica serovar Typhi Ty2
ggcauuaacaaauca

SEQ ID NO: 3707767 - RNA, 18 nt, Salmonella enterica enterica serovar Typhi Ty2
ggcauuaagucauaccug

SEQ ID NO: 3707768 - RNA, 22 nt, Salmonella enterica enterica serovar Typhi Ty2
ggcauuagcaugggcuaaagca

SEQ ID NO: 3707769 - RNA, 18 nt, Salmonella enterica enterica serovar Typhi Ty2
ggcauuaugggcgugcug

SEQ ID NO: 3707770 - RNA, 17 nt, Salmonella enterica enterica serovar Typhi Ty2
ggcauuccgcuggugcg

SEQ ID NO: 3707771 - RNA, 18 nt, Salmonella enterica enterica serovar Typhi Ty2
ggcauucgaauccuccug

SEQ ID NO: 3707772 - RNA, 19 nt, Salmonella enterica enterica serovar Typhi Ty2
ggcauucgaauccuccugu

SEQ ID NO: 3707773 - RNA, 13 nt, Salmonella enterica enterica serovar Typhi Ty2
ggcauucgcacac

SEQ ID NO: 3707774 - RNA, 18 nt, Salmonella enterica enterica serovar Typhi Ty2
ggcauuggcaucugucau

SEQ ID NO: 3707775 - RNA, 16 nt, Salmonella enterica enterica serovar Typhi Ty2
ggcauuuaugccgcca

SEQ ID NO: 3707776 - RNA, 14 nt, Salmonella enterica enterica serovar Typhi Ty2
ggcauuucaaucgc

SEQ ID NO: 3707777 - RNA, 22 nt, Salmonella enterica enterica serovar Typhi Ty2
ggcauuucaccgucaauaacgg

SEQ ID NO: 3707778 - RNA, 15 nt, Salmonella enterica enterica serovar Typhi Ty2
ggcauuucaggcacu

SEQ ID NO: 3707779 - RNA, 18 nt, Salmonella enterica enterica serovar Typhi Ty2
ggcauuuuuauuuaacgc

SEQ ID NO: 3707780 - RNA, 20 nt, Salmonella enterica enterica serovar Typhi Ty2
ggcauuuuuauuuaacgcca

SEQ ID NO: 3707781 - RNA, 21 nt, Salmonella enterica enterica serovar Typhi Ty2
ggcauuuuuauuuaacgccag

SEQ ID NO: 3707782 - RNA, 20 nt, Salmonella enterica enterica serovar Typhi Ty2
ggccaaaacccaccagcagg

SEQ ID NO: 3707783 - RNA, 13 nt, Salmonella enterica enterica serovar Typhi Ty2
ggccaaauaaccc

SEQ ID NO: 3707784 - RNA, 15 nt, Salmonella enterica enterica serovar Typhi Ty2
ggccaaccgccacaa

SEQ ID NO: 3707785 - RNA, 22 nt, Salmonella enterica enterica serovar Typhi Ty2
ggccaacgcgcccucugagcug

SEQ ID NO: 3707786 - RNA, 21 nt, Salmonella enterica enterica serovar Typhi Ty2
ggccaagcgccuguucaacau

SEQ ID NO: 3707787 - RNA, 22 nt, Salmonella enterica enterica serovar Typhi Ty2
ggccaaugccgccuuuaucgac

SEQ ID NO: 3707788 - RNA, 22 nt, Salmonella enterica enterica serovar Typhi Ty2
ggccaauggcucaacuccgccg

SEQ ID NO: 3707789 - RNA, 20 nt, Salmonella enterica enterica serovar Typhi Ty2
ggccaauguacguaaaacca

SEQ ID NO: 3707790 - RNA, 16 nt, Salmonella enterica enterica serovar Typhi Ty2
ggccaauuccgccaua

SEQ ID NO: 3707791 - RNA, 22 nt, Salmonella enterica enterica serovar Typhi Ty2
ggccacaauuguagcugcgcca

SEQ ID NO: 3707792 - RNA, 18 nt, Salmonella enterica enterica serovar Typhi Ty2
ggccacagcgccagacac

SEQ ID NO: 3707793 - RNA, 23 nt, Salmonella enterica enterica serovar Typhi Ty2
ggccacauugaaugccgaauggc

SEQ ID NO: 3707794 - RNA, 12 nt, Salmonella enterica enterica serovar Typhi Ty2
ggccaccacaua

SEQ ID NO: 3707795 - RNA, 14 nt, Salmonella enterica enterica serovar Typhi Ty2
ggccaccagcgcca

SEQ ID NO: 3707796 - RNA, 19 nt, Salmonella enterica enterica serovar Typhi Ty2
ggccaccauaucuuccagg

SEQ ID NO: 3707797 - RNA, 12 nt, Salmonella enterica enterica serovar Typhi Ty2
ggccacccacca

SEQ ID NO: 3707798 - RNA, 22 nt, Salmonella enterica enterica serovar Typhi Ty2
ggccaccgauaaaaagcaaaga

SEQ ID NO: 3707799 - RNA, 15 nt, Salmonella enterica enterica serovar Typhi Ty2
ggccacgccgccauc

SEQ ID NO: 3707800 - RNA, 17 nt, Salmonella enterica enterica serovar Typhi Ty2
ggccacggagugcgcgg

SEQ ID NO: 3707801 - RNA, 21 nt, Salmonella enterica enterica serovar Typhi Ty2
ggccacgguguggcccagcgc

SEQ ID NO: 3707802 - RNA, 20 nt, Salmonella enterica enterica serovar Typhi Ty2
ggccagaaaccggucgccgu

SEQ ID NO: 3707803 - RNA, 18 nt, Salmonella enterica enterica serovar Typhi Ty2
ggccagauaguggcugag

SEQ ID NO: 3707804 - RNA, 15 nt, Salmonella enterica enterica serovar Typhi Ty2
ggccagauggcaaac

SEQ ID NO: 3707805 - RNA, 11 nt, Salmonella enterica enterica serovar Typhi Ty2
ggccagcacaa

SEQ ID NO: 3707806 - RNA, 21 nt, Salmonella enterica enterica serovar Typhi Ty2
ggccagccgacgcucuuccuc

SEQ ID NO: 3707807 - RNA, 22 nt, Salmonella enterica enterica serovar Typhi Ty2
ggccagccguaacgagugagga

SEQ ID NO: 3707808 - RNA, 19 nt, Salmonella enterica enterica serovar Typhi Ty2
ggccagcgaaaaccagcgc

SEQ ID NO: 3707809 - RNA, 16 nt, Salmonella enterica enterica serovar Typhi Ty2
ggccagcgcaggcugg

SEQ ID NO: 3707810 - RNA, 14 nt, Salmonella enterica enterica serovar Typhi Ty2
ggccagcgcgcggc

SEQ ID NO: 3707811 - RNA, 16 nt, Salmonella enterica enterica serovar Typhi Ty2
ggccagcguaccugcg

SEQ ID NO: 3707812 - RNA, 19 nt, Salmonella enterica enterica serovar Typhi Ty2
ggccagcguggaugaacuc

SEQ ID NO: 3707813 - RNA, 16 nt, Salmonella enterica enterica serovar Typhi Ty2
ggccaggcacguuaaa

SEQ ID NO: 3707814 - RNA, 16 nt, Salmonella enterica enterica serovar Typhi Ty2
ggccaggcauccggcc

SEQ ID NO: 3707815 - RNA, 15 nt, Salmonella enterica enterica serovar Typhi Ty2
ggccaggcgaccguc

SEQ ID NO: 3707816 - RNA, 16 nt, Salmonella enterica enterica serovar Typhi Ty2
ggccagggacaggaga

SEQ ID NO: 3707817 - RNA, 21 nt, Salmonella enterica enterica serovar Typhi Ty2
ggccaguagcgggggccggcu

SEQ ID NO: 3707818 - RNA, 20 nt, Salmonella enterica enterica serovar Typhi Ty2
ggccaguaucgcgccgccaa

SEQ ID NO: 3707819 - RNA, 14 nt, Salmonella enterica enterica serovar Typhi Ty2
ggccaguuuccuga

SEQ ID NO: 3707820 - RNA, 19 nt, Salmonella enterica enterica serovar Typhi Ty2
ggccaguuuccugacccgc

SEQ ID NO: 3707821 - RNA, 12 nt, Salmonella enterica enterica serovar Typhi Ty2
ggccaucaacuu

SEQ ID NO: 3707822 - RNA, 21 nt, Salmonella enterica enterica serovar Typhi Ty2
ggccaucaacuucucgcaggc

SEQ ID NO: 3707823 - RNA, 16 nt, Salmonella enterica enterica serovar Typhi Ty2
ggccaucauaccgcca

SEQ ID NO: 3707824 - RNA, 23 nt, Salmonella enterica enterica serovar Typhi Ty2
ggccaugauccugguccggcagg

SEQ ID NO: 3707825 - RNA, 15 nt, Salmonella enterica enterica serovar Typhi Ty2
ggccauuaccgcccu

SEQ ID NO: 3707826 - RNA, 14 nt, Salmonella enterica enterica serovar Typhi Ty2
ggccugcagagcgg

SEQ ID NO: 3707827 - RNA, 16 nt, Salmonella enterica enterica serovar Typhi Ty2
ggccugcagagcggca

SEQ ID NO: 3707828 - RNA, 22 nt, Salmonella enterica enterica serovar Typhi Ty2
ggccugcagagcggcaaauuca

SEQ ID NO: 3707829 - RNA, 15 nt, Salmonella enterica enterica serovar Typhi Ty2
ggccugccguccuga

SEQ ID NO: 3707830 - RNA, 15 nt, Salmonella enterica enterica serovar Typhi Ty2
ggccugcggaaaaag

SEQ ID NO: 3707831 - RNA, 20 nt, Salmonella enterica enterica serovar Typhi Ty2
ggccugguuaacaauauugc

SEQ ID NO: 3707832 - RNA, 13 nt, Salmonella enterica enterica serovar Typhi Ty2
ggccugucaggcc

SEQ ID NO: 3707833 - RNA, 22 nt, Salmonella enterica enterica serovar Typhi Ty2
ggccugugacguuaacgcagca

SEQ ID NO: 3707834 - RNA, 23 nt, Salmonella enterica enterica serovar Typhi Ty2
ggccugugccugacagcaaugag

SEQ ID NO: 3707835 - RNA, 14 nt, Salmonella enterica enterica serovar Typhi Ty2
ggccuuauccggcc

SEQ ID NO: 3707836 - RNA, 14 nt, Salmonella enterica enterica serovar Typhi Ty2
ggccuuauuuuuca

SEQ ID NO: 3707837 - RNA, 16 nt, Salmonella enterica enterica serovar Typhi Ty2
ggccuuauuuuucagc

SEQ ID NO: 3707838 - RNA, 15 nt, Salmonella enterica enterica serovar Typhi Ty2
ggccuucaaucagca

SEQ ID NO: 3707839 - RNA, 12 nt, Salmonella enterica enterica serovar Typhi Ty2
ggccuucugcua

SEQ ID NO: 3707840 - RNA, 19 nt, Salmonella enterica enterica serovar Typhi Ty2
ggccuucugcuaucaggau

SEQ ID NO: 3707841 - RNA, 18 nt, Salmonella enterica enterica serovar Typhi Ty2
ggccuugaaguuauccag

SEQ ID NO: 3707842 - RNA, 12 nt, Salmonella enterica enterica serovar Typhi Ty2
ggcgaaaaaccg

SEQ ID NO: 3707843 - RNA, 17 nt, Salmonella enterica enterica serovar Typhi Ty2
ggcgaaaaaguucacgc

SEQ ID NO: 3707844 - RNA, 13 nt, Salmonella enterica enterica serovar Typhi Ty2
ggcgaaagaaaau

SEQ ID NO: 3707845 - RNA, 14 nt, Salmonella enterica enterica serovar Typhi Ty2
ggcgaaagaaaauu

SEQ ID NO: 3707846 - RNA, 22 nt, Salmonella enterica enterica serovar Typhi Ty2
ggcgaaagaaaauuguccacgg

SEQ ID NO: 3707847 - RNA, 13 nt, Salmonella enterica enterica serovar Typhi Ty2
ggcgaaagaagcg

SEQ ID NO: 3707848 - RNA, 13 nt, Salmonella enterica enterica serovar Typhi Ty2
ggcgaaauagcgu

SEQ ID NO: 3707849 - RNA, 15 nt, Salmonella enterica enterica serovar Typhi Ty2
ggcgaacaauaccgu

SEQ ID NO: 3707850 - RNA, 14 nt, Salmonella enterica enterica serovar Typhi Ty2
ggcgaacagcccgc

SEQ ID NO: 3707851 - RNA, 15 nt, Salmonella enterica enterica serovar Typhi Ty2
ggcgaacaggcucag

SEQ ID NO: 3707852 - RNA, 21 nt, Salmonella enterica enterica serovar Typhi Ty2
ggcgaacaggcucagcgccac

SEQ ID NO: 3707853 - RNA, 16 nt, Salmonella enterica enterica serovar Typhi Ty2
ggcgaacgacucacgc

SEQ ID NO: 3707854 - RNA, 17 nt, Salmonella enterica enterica serovar Typhi Ty2
ggcgaacguuggcuggg

SEQ ID NO: 3707855 - RNA, 23 nt, Salmonella enterica enterica serovar Typhi Ty2
ggcgaacguuuuuucgcacgccu

SEQ ID NO: 3707856 - RNA, 17 nt, Salmonella enterica enterica serovar Typhi Ty2
ggcgaagcaucuuuccg

SEQ ID NO: 3707857 - RNA, 15 nt, Salmonella enterica enterica serovar Typhi Ty2
ggcgaauaaaauuca

SEQ ID NO: 3707858 - RNA, 20 nt, Salmonella enterica enterica serovar Typhi Ty2
ggcgaauaaaauucagcgca

SEQ ID NO: 3707859 - RNA, 21 nt, Salmonella enterica enterica serovar Typhi Ty2
ggcgaauauagcuaaugcaau

SEQ ID NO: 3707860 - RNA, 14 nt, Salmonella enterica enterica serovar Typhi Ty2
ggcgaaucgccugu

SEQ ID NO: 3707861 - RNA, 19 nt, Salmonella enterica enterica serovar Typhi Ty2
ggcgaauuguggucgaucc

SEQ ID NO: 3707862 - RNA, 18 nt, Salmonella enterica enterica serovar Typhi Ty2
ggcgaauuuacgggcgcg

SEQ ID NO: 3707863 - RNA, 17 nt, Salmonella enterica enterica serovar Typhi Ty2
ggcgaauuuaugccggu

SEQ ID NO: 3707864 - RNA, 16 nt, Salmonella enterica enterica serovar Typhi Ty2
ggcgacaaacagcgcc

SEQ ID NO: 3707865 - RNA, 17 nt, Salmonella enterica enterica serovar Typhi Ty2
ggcgacaaacagcgccc

SEQ ID NO: 3707866 - RNA, 15 nt, Salmonella enterica enterica serovar Typhi Ty2
ggcgacaagaauaug

SEQ ID NO: 3707867 - RNA, 17 nt, Salmonella enterica enterica serovar Typhi Ty2
ggcgacacaacggcaca

SEQ ID NO: 3707868 - RNA, 13 nt, Salmonella enterica enterica serovar Typhi Ty2
ggcgacagccgcg

SEQ ID NO: 3707869 - RNA, 14 nt, Salmonella enterica enterica serovar Typhi Ty2
ggcgacagccgcgu

SEQ ID NO: 3707870 - RNA, 20 nt, Salmonella enterica enterica serovar Typhi Ty2
ggcgacagggauauuccaua

SEQ ID NO: 3707871 - RNA, 17 nt, Salmonella enterica enterica serovar Typhi Ty2
ggcgaccaguuauucgg

SEQ ID NO: 3707872 - RNA, 19 nt, Salmonella enterica enterica serovar Typhi Ty2
ggcgacgcgauagcgcagc

SEQ ID NO: 3707873 - RNA, 16 nt, Salmonella enterica enterica serovar Typhi Ty2
ggcgacgcuuucaccu

SEQ ID NO: 3707874 - RNA, 18 nt, Salmonella enterica enterica serovar Typhi Ty2
ggcgacggcggucgccgc

SEQ ID NO: 3707875 - RNA, 21 nt, Salmonella enterica enterica serovar Typhi Ty2
ggcgacuaacgucuuauccgg

SEQ ID NO: 3707876 - RNA, 19 nt, Salmonella enterica enterica serovar Typhi Ty2
ggcgacuaccucuuauccg

SEQ ID NO: 3707877 - RNA, 20 nt, Salmonella enterica enterica serovar Typhi Ty2
ggcgacuaccucuuauccgg

SEQ ID NO: 3707878 - RNA, 18 nt, Salmonella enterica enterica serovar Typhi Ty2
ggcgacuagucgcccgcu

SEQ ID NO: 3707879 - RNA, 19 nt, Salmonella enterica enterica serovar Typhi Ty2
ggcgacuggaacaggccaa

SEQ ID NO: 3707880 - RNA, 14 nt, Salmonella enterica enterica serovar Typhi Ty2
ggcgacuuucacga

SEQ ID NO: 3707881 - RNA, 22 nt, Salmonella enterica enterica serovar Typhi Ty2
ggcgagaacucgucuuauccga

SEQ ID NO: 3707882 - RNA, 22 nt, Salmonella enterica enterica serovar Typhi Ty2
ggcgagagcauugccugauucg

SEQ ID NO: 3707883 - RNA, 23 nt, Salmonella enterica enterica serovar Typhi Ty2
ggcgagcggcaccggacauccca

SEQ ID NO: 3707884 - RNA, 15 nt, Salmonella enterica enterica serovar Typhi Ty2
ggcgaggcguaaaac

SEQ ID NO: 3707885 - RNA, 16 nt, Salmonella enterica enterica serovar Typhi Ty2
ggcgaggggcaggcgu

SEQ ID NO: 3707886 - RNA, 20 nt, Salmonella enterica enterica serovar Typhi Ty2
ggcgaguuuggugcccgcgu

SEQ ID NO: 3707887 - RNA, 22 nt, Salmonella enterica enterica serovar Typhi Ty2
ggcgauaaaaggcgguucccgg

SEQ ID NO: 3707888 - RNA, 21 nt, Salmonella enterica enterica serovar Typhi Ty2
ggcgauaaaccaacagccgcc

SEQ ID NO: 3707889 - RNA, 18 nt, Salmonella enterica enterica serovar Typhi Ty2
ggcgauaaaccagcccca

SEQ ID NO: 3707890 - RNA, 16 nt, Salmonella enterica enterica serovar Typhi Ty2
ggcgauaacccgcgca

SEQ ID NO: 3707891 - RNA, 21 nt, Salmonella enterica enterica serovar Typhi Ty2
ggcgauaaggucgcuauccag

SEQ ID NO: 3707892 - RNA, 12 nt, Salmonella enterica enterica serovar Typhi Ty2
ggcgauaaucuc

SEQ ID NO: 3707893 - RNA, 13 nt, Salmonella enterica enterica serovar Typhi Ty2
ggcgauaccagua

SEQ ID NO: 3707894 - RNA, 14 nt, Salmonella enterica enterica serovar Typhi Ty2
ggcgauagccccag

SEQ ID NO: 3707895 - RNA, 17 nt, Salmonella enterica enterica serovar Typhi Ty2
ggcgauagcgccccaaa

SEQ ID NO: 3707896 - RNA, 14 nt, Salmonella enterica enterica serovar Typhi Ty2
ggcgauaucuucgg

SEQ ID NO: 3707897 - RNA, 21 nt, Salmonella enterica enterica serovar Typhi Ty2
ggcgauaucuucggcgcgccg

SEQ ID NO: 3707898 - RNA, 14 nt, Salmonella enterica enterica serovar Typhi Ty2
ggcgaucaccacgc

SEQ ID NO: 3707899 - RNA, 19 nt, Salmonella enterica enterica serovar Typhi Ty2
ggcgaucgcuaaucaggac

SEQ ID NO: 3707900 - RNA, 12 nt, Salmonella enterica enterica serovar Typhi Ty2
ggcgaucggcgu

SEQ ID NO: 3707901 - RNA, 20 nt, Salmonella enterica enterica serovar Typhi Ty2
ggcgauguaacgccuuugcc

SEQ ID NO: 3707902 - RNA, 19 nt, Salmonella enterica enterica serovar Typhi Ty2
ggcgauguucuugccgcca

SEQ ID NO: 3707903 - RNA, 19 nt, Salmonella enterica enterica serovar Typhi Ty2
ggcgauguuggcgcccuga

SEQ ID NO: 3707904 - RNA, 15 nt, Salmonella enterica enterica serovar Typhi Ty2
ggcgauuaauacauc

SEQ ID NO: 3707905 - RNA, 17 nt, Salmonella enterica enterica serovar Typhi Ty2
ggcgauugcggaggccg

SEQ ID NO: 3707906 - RNA, 13 nt, Salmonella enterica enterica serovar Typhi Ty2
ggcgauuuucacc

SEQ ID NO: 3707907 - RNA, 18 nt, Salmonella enterica enterica serovar Typhi Ty2
ggcgauuuucagcaccuu

SEQ ID NO: 3707908 - RNA, 13 nt, Salmonella enterica enterica serovar Typhi Ty2
ggcgcuuuaccgg

SEQ ID NO: 3707909 - RNA, 15 nt, Salmonella enterica enterica serovar Typhi Ty2
ggcgcuuugccguuc

SEQ ID NO: 3707910 - RNA, 17 nt, Salmonella enterica enterica serovar Typhi Ty2
ggcgcuuuuccagcacg

SEQ ID NO: 3707911 - RNA, 18 nt, Salmonella enterica enterica serovar Typhi Ty2
ggcggaaaauagccagaa

SEQ ID NO: 3707912 - RNA, 13 nt, Salmonella enterica enterica serovar Typhi Ty2
ggcggaaaucaac

SEQ ID NO: 3707913 - RNA, 18 nt, Salmonella enterica enterica serovar Typhi Ty2
ggcggaaaugcggguccu

SEQ ID NO: 3707914 - RNA, 16 nt, Salmonella enterica enterica serovar Typhi Ty2
ggcggaagguuuccgc

SEQ ID NO: 3707915 - RNA, 23 nt, Salmonella enterica enterica serovar Typhi Ty2
ggcggaaguagccuccggcggug

SEQ ID NO: 3707916 - RNA, 13 nt, Salmonella enterica enterica serovar Typhi Ty2
ggcggacagcggc

SEQ ID NO: 3707917 - RNA, 21 nt, Salmonella enterica enterica serovar Typhi Ty2
ggcggacccaaaagaaguggc

SEQ ID NO: 3707918 - RNA, 16 nt, Salmonella enterica enterica serovar Typhi Ty2
ggcggagggauuuuaa

SEQ ID NO: 3707919 - RNA, 12 nt, Salmonella enterica enterica serovar Typhi Ty2
ggcggcaaaaaa

SEQ ID NO: 3707920 - RNA, 19 nt, Salmonella enterica enterica serovar Typhi Ty2
ggcggcaagggagugaguc

SEQ ID NO: 3707921 - RNA, 14 nt, Salmonella enterica enterica serovar Typhi Ty2
ggcggcacaucgcg

SEQ ID NO: 3707922 - RNA, 12 nt, Salmonella enterica enterica serovar Typhi Ty2
ggcggcacgcca

SEQ ID NO: 3707923 - RNA, 23 nt, Salmonella enterica enterica serovar Typhi Ty2
ggcggcauaaaugccuuauccgg

SEQ ID NO: 3707924 - RNA, 20 nt, Salmonella enterica enterica serovar Typhi Ty2
ggcggcgaaagagaaagcgc

SEQ ID NO: 3707925 - RNA, 16 nt, Salmonella enterica enterica serovar Typhi Ty2
ggcggcgaaaugccuu

SEQ ID NO: 3707926 - RNA, 23 nt, Salmonella enterica enterica serovar Typhi Ty2
ggcggcgcaaaggccuuauccgg

SEQ ID NO: 3707927 - RNA, 23 nt, Salmonella enterica enterica serovar Typhi Ty2
ggcggcgcgaacgccuuauccgg

SEQ ID NO: 3707928 - RNA, 14 nt, Salmonella enterica enterica serovar Typhi Ty2
ggcggcgcgcaggc

SEQ ID NO: 3707929 - RNA, 14 nt, Salmonella enterica enterica serovar Typhi Ty2
ggcggcguccggca

SEQ ID NO: 3707930 - RNA, 16 nt, Salmonella enterica enterica serovar Typhi Ty2
ggcggcgugaacgccu

SEQ ID NO: 3707931 - RNA, 23 nt, Salmonella enterica enterica serovar Typhi Ty2
ggcggcgugaacgucuuauccgg

SEQ ID NO: 3707932 - RNA, 23 nt, Salmonella enterica enterica serovar Typhi Ty2
ggcggcgugaccgccuuauccgg

SEQ ID NO: 3707933 - RNA, 14 nt, Salmonella enterica enterica serovar Typhi Ty2
ggcggcgugcgccc

SEQ ID NO: 3707934 - RNA, 15 nt, Salmonella enterica enterica serovar Typhi Ty2
ggcggcguuuuccgg

SEQ ID NO: 3707935 - RNA, 21 nt, Salmonella enterica enterica serovar Typhi Ty2
ggcggcuaacgccugauccgg

SEQ ID NO: 3707936 - RNA, 19 nt, Salmonella enterica enterica serovar Typhi Ty2
ggcggcuacgccuuauccg

SEQ ID NO: 3707937 - RNA, 20 nt, Salmonella enterica enterica serovar Typhi Ty2
ggcggcuacgccuuauccgg

SEQ ID NO: 3707938 - RNA, 19 nt, Salmonella enterica enterica serovar Typhi Ty2
ggcggcuucgccuuauccg

SEQ ID NO: 3707939 - RNA, 14 nt, Salmonella enterica enterica serovar Typhi Ty2
ggcggcuuggcugu

SEQ ID NO: 3707940 - RNA, 16 nt, Salmonella enterica enterica serovar Typhi Ty2
ggcggcuuucagcgua

SEQ ID NO: 3707941 - RNA, 15 nt, Salmonella enterica enterica serovar Typhi Ty2
ggcgggaucggggcg

SEQ ID NO: 3707942 - RNA, 20 nt, Salmonella enterica enterica serovar Typhi Ty2
ggcgggcagcagcaggcugg

SEQ ID NO: 3707943 - RNA, 20 nt, Salmonella enterica enterica serovar Typhi Ty2
ggcgggcgauagagaccgcu

SEQ ID NO: 3707944 - RNA, 20 nt, Salmonella enterica enterica serovar Typhi Ty2
ggcgggcugaaaucacgcca

SEQ ID NO: 3707945 - RNA, 16 nt, Salmonella enterica enterica serovar Typhi Ty2
ggcggggcagaaccug

SEQ ID NO: 3707946 - RNA, 15 nt, Salmonella enterica enterica serovar Typhi Ty2
ggcgggugccgggaa

SEQ ID NO: 3707947 - RNA, 17 nt, Salmonella enterica enterica serovar Typhi Ty2
ggcgguaaucgcgcugu

SEQ ID NO: 3707948 - RNA, 14 nt, Salmonella enterica enterica serovar Typhi Ty2
ggcgguaugaaagc

SEQ ID NO: 3707949 - RNA, 14 nt, Salmonella enterica enterica serovar Typhi Ty2
ggcgguauuauccg

SEQ ID NO: 3707950 - RNA, 14 nt, Salmonella enterica enterica serovar Typhi Ty2
ggcggucaucgccc

SEQ ID NO: 3707951 - RNA, 20 nt, Salmonella enterica enterica serovar Typhi Ty2
ggcggugaagacgacgggaa

SEQ ID NO: 3707952 - RNA, 18 nt, Salmonella enterica enterica serovar Typhi Ty2
ggcggugauuuaaggcug

SEQ ID NO: 3707953 - RNA, 20 nt, Salmonella enterica enterica serovar Typhi Ty2
ggcgguuaacagacccgcuu

SEQ ID NO: 3707954 - RNA, 12 nt, Salmonella enterica enterica serovar Typhi Ty2
ggcgguuauccg

SEQ ID NO: 3707955 - RNA, 20 nt, Salmonella enterica enterica serovar Typhi Ty2
ggcgguuauccgccagcgca

SEQ ID NO: 3707956 - RNA, 19 nt, Salmonella enterica enterica serovar Typhi Ty2
ggcgguucauccugcgcca

SEQ ID NO: 3707957 - RNA, 17 nt, Salmonella enterica enterica serovar Typhi Ty2
ggcgguuucaucgagcg

SEQ ID NO: 3707958 - RNA, 13 nt, Salmonella enterica enterica serovar Typhi Ty2
ggcguaagcgcgu

SEQ ID NO: 3707959 - RNA, 17 nt, Salmonella enterica enterica serovar Typhi Ty2
ggcguacacuucauccg

SEQ ID NO: 3707960 - RNA, 18 nt, Salmonella enterica enterica serovar Typhi Ty2
ggcguacacuucauccgg

SEQ ID NO: 3707961 - RNA, 12 nt, Salmonella enterica enterica serovar Typhi Ty2
ggcguaccagaa

SEQ ID NO: 3707962 - RNA, 14 nt, Salmonella enterica enterica serovar Typhi Ty2
ggcguacgggcaaa

SEQ ID NO: 3707963 - RNA, 21 nt, Salmonella enterica enterica serovar Typhi Ty2
ggcguacuaaauaggcggcau

SEQ ID NO: 3707964 - RNA, 13 nt, Salmonella enterica enterica serovar Typhi Ty2
ggcguagccgccg

SEQ ID NO: 3707965 - RNA, 16 nt, Salmonella enterica enterica serovar Typhi Ty2
ggcguauagccaggca

SEQ ID NO: 3707966 - RNA, 17 nt, Salmonella enterica enterica serovar Typhi Ty2
ggcguauagccgccccc

SEQ ID NO: 3707967 - RNA, 20 nt, Salmonella enterica enterica serovar Typhi Ty2
ggcguauucgcccggcagga

SEQ ID NO: 3707968 - RNA, 21 nt, Salmonella enterica enterica serovar Typhi Ty2
ggcgucaacguuuuucagccg

SEQ ID NO: 3707969 - RNA, 22 nt, Salmonella enterica enterica serovar Typhi Ty2
ggcgucaccaccgcaggcagcg

SEQ ID NO: 3707970 - RNA, 19 nt, Salmonella enterica enterica serovar Typhi Ty2
ggcgucacguucgucgccg

SEQ ID NO: 3707971 - RNA, 22 nt, Salmonella enterica enterica serovar Typhi Ty2
ggcgucagcaugguguguuccc

SEQ ID NO: 3707972 - RNA, 16 nt, Salmonella enterica enterica serovar Typhi Ty2
ggcgucauccugcagg

SEQ ID NO: 3707973 - RNA, 21 nt, Salmonella enterica enterica serovar Typhi Ty2
ggcgucaucggcgccagccug

SEQ ID NO: 3707974 - RNA, 21 nt, Salmonella enterica enterica serovar Typhi Ty2
ggcguccggccacuauuucgg

SEQ ID NO: 3707975 - RNA, 22 nt, Salmonella enterica enterica serovar Typhi Ty2
ggcgucuaccuggguagcgcca

SEQ ID NO: 3707976 - RNA, 16 nt, Salmonella enterica enterica serovar Typhi Ty2
ggcgucuuaaugcucu

SEQ ID NO: 3707977 - RNA, 19 nt, Salmonella enterica enterica serovar Typhi Ty2
ggcgugacaccgguuugcg

SEQ ID NO: 3707978 - RNA, 22 nt, Salmonella enterica enterica serovar Typhi Ty2
ggcgugaccgccuuauccggcc

SEQ ID NO: 3707979 - RNA, 19 nt, Salmonella enterica enterica serovar Typhi Ty2
ggcgugauaaaacauucca

SEQ ID NO: 3707980 - RNA, 17 nt, Salmonella enterica enterica serovar Typhi Ty2
ggcgugccgggcuggcg

SEQ ID NO: 3707981 - RNA, 22 nt, Salmonella enterica enterica serovar Typhi Ty2
ggcgugguggauauccagcaua

SEQ ID NO: 3707982 - RNA, 12 nt, Salmonella enterica enterica serovar Typhi Ty2
ggcguguaacug

SEQ ID NO: 3707983 - RNA, 17 nt, Salmonella enterica enterica serovar Typhi Ty2
ggcguguugaaauccuc

SEQ ID NO: 3707984 - RNA, 13 nt, Salmonella enterica enterica serovar Typhi Ty2
ggcguguuucagc

SEQ ID NO: 3707985 - RNA, 22 nt, Salmonella enterica enterica serovar Typhi Ty2
ggcguuaaucaccggcgcgggc

SEQ ID NO: 3707986 - RNA, 17 nt, Salmonella enterica enterica serovar Typhi Ty2
ggcguuacagacgcugc

SEQ ID NO: 3707987 - RNA, 18 nt, Salmonella enterica enterica serovar Typhi Ty2
ggcguuacccgucuggcg

SEQ ID NO: 3707988 - RNA, 19 nt, Salmonella enterica enterica serovar Typhi Ty2
ggcguuaccggcaggcugg

SEQ ID NO: 3707989 - RNA, 23 nt, Salmonella enterica enterica serovar Typhi Ty2
ggcguuacuggcgaccggcagcc

SEQ ID NO: 3707990 - RNA, 23 nt, Salmonella enterica enterica serovar Typhi Ty2
ggcuguggcguuuuaccgcccga

SEQ ID NO: 3707991 - RNA, 15 nt, Salmonella enterica enterica serovar Typhi Ty2
ggcugugggcguguc

SEQ ID NO: 3707992 - RNA, 15 nt, Salmonella enterica enterica serovar Typhi Ty2
ggcuguguucauccc

SEQ ID NO: 3707993 - RNA, 20 nt, Salmonella enterica enterica serovar Typhi Ty2
ggcuguucacguaccaggca

SEQ ID NO: 3707994 - RNA, 13 nt, Salmonella enterica enterica serovar Typhi Ty2
ggcuuaccugcuc

SEQ ID NO: 3707995 - RNA, 15 nt, Salmonella enterica enterica serovar Typhi Ty2
ggcuuagcgccagau

SEQ ID NO: 3707996 - RNA, 14 nt, Salmonella enterica enterica serovar Typhi Ty2
ggcuuauaccgaca

SEQ ID NO: 3707997 - RNA, 22 nt, Salmonella enterica enterica serovar Typhi Ty2
ggcuucaaucgucguuccgcca

SEQ ID NO: 3707998 - RNA, 23 nt, Salmonella enterica enterica serovar Typhi Ty2
ggcuuccauugcagaauauguuc

SEQ ID NO: 3707999 - RNA, 11 nt, Salmonella enterica enterica serovar Typhi Ty2
ggcuuccggca

SEQ ID NO: 3708000 - RNA, 14 nt, Salmonella enterica enterica serovar Typhi Ty2
ggcuuccucgccac

SEQ ID NO: 3708001 - RNA, 16 nt, Salmonella enterica enterica serovar Typhi Ty2
ggcuucgauuacagga

SEQ ID NO: 3708002 - RNA, 22 nt, Salmonella enterica enterica serovar Typhi Ty2
ggcuucguuaagcgguuuucaa

SEQ ID NO: 3708003 - RNA, 20 nt, Salmonella enterica enterica serovar Typhi Ty2
ggcuugaguuuuucucgcaa

SEQ ID NO: 3708004 - RNA, 13 nt, Salmonella enterica enterica serovar Typhi Ty2
ggcuugaucaacg

SEQ ID NO: 3708005 - RNA, 20 nt, Salmonella enterica enterica serovar Typhi Ty2
ggcuugaucgcgcagcaaau

SEQ ID NO: 3708006 - RNA, 22 nt, Salmonella enterica enterica serovar Typhi Ty2
ggcuugaucgcgcagcaaauca

SEQ ID NO: 3708007 - RNA, 14 nt, Salmonella enterica enterica serovar Typhi Ty2
ggcuugccagcaga

SEQ ID NO: 3708008 - RNA, 21 nt, Salmonella enterica enterica serovar Typhi Ty2
ggcuuguuaugcggaucggcg

SEQ ID NO: 3708009 - RNA, 19 nt, Salmonella enterica enterica serovar Typhi Ty2
ggcuuuacgaccgcagaaa

SEQ ID NO: 3708010 - RNA, 13 nt, Salmonella enterica enterica serovar Typhi Ty2
ggcuuuauauaaa

SEQ ID NO: 3708011 - RNA, 11 nt, Salmonella enterica enterica serovar Typhi Ty2
ggcuuucacgc

SEQ ID NO: 3708012 - RNA, 15 nt, Salmonella enterica enterica serovar Typhi Ty2
ggcuuucauccaaua

SEQ ID NO: 3708013 - RNA, 14 nt, Salmonella enterica enterica serovar Typhi Ty2
ggcuuugcugcugc

SEQ ID NO: 3708014 - RNA, 16 nt, Salmonella enterica enterica serovar Typhi Ty2
ggcuuuuugccgggcg

SEQ ID NO: 3708015 - RNA, 12 nt, Salmonella enterica enterica serovar Typhi Ty2
ggcuuuuuucuc

SEQ ID NO: 3708016 - RNA, 18 nt, Salmonella enterica enterica serovar Typhi Ty2
ggcuuuuuucuccaguug

SEQ ID NO: 3708017 - RNA, 16 nt, Salmonella enterica enterica serovar Typhi Ty2
ggcuuuuuuucaacug

SEQ ID NO: 3708018 - RNA, 20 nt, Salmonella enterica enterica serovar Typhi Ty2
gggaaaaauguguugcggcc

SEQ ID NO: 3708019 - RNA, 12 nt, Salmonella enterica enterica serovar Typhi Ty2
gggaaaagaagu

SEQ ID NO: 3708020 - RNA, 19 nt, Salmonella enterica enterica serovar Typhi Ty2
gggaaaagcgguaucacgc

SEQ ID NO: 3708021 - RNA, 17 nt, Salmonella enterica enterica serovar Typhi Ty2
gggaaaccauguugauc

SEQ ID NO: 3708022 - RNA, 22 nt, Salmonella enterica enterica serovar Typhi Ty2
gggaaacgcuauuuaacccugg

SEQ ID NO: 3708023 - RNA, 12 nt, Salmonella enterica enterica serovar Typhi Ty2
gggaaagggggg

SEQ ID NO: 3708024 - RNA, 19 nt, Salmonella enterica enterica serovar Typhi Ty2
gggaaaucucccuggcagu

SEQ ID NO: 3708025 - RNA, 14 nt, Salmonella enterica enterica serovar Typhi Ty2
gggaacacucuaaa

SEQ ID NO: 3708026 - RNA, 16 nt, Salmonella enterica enterica serovar Typhi Ty2
gggaacaugcauauua

SEQ ID NO: 3708027 - RNA, 16 nt, Salmonella enterica enterica serovar Typhi Ty2
gggaagaugugccacu

SEQ ID NO: 3708028 - RNA, 18 nt, Salmonella enterica enterica serovar Typhi Ty2
gggaagaugugccacucc

SEQ ID NO: 3708029 - RNA, 24 nt, Salmonella enterica enterica serovar Typhi Ty2
gggaagcacauccauguacuccug

SEQ ID NO: 3708030 - RNA, 23 nt, Salmonella enterica enterica serovar Typhi Ty2
gggaaggggauucuccggcgcgg

SEQ ID NO: 3708031 - RNA, 23 nt, Salmonella enterica enterica serovar Typhi Ty2
gggaaguugcccuuaucuggaug

SEQ ID NO: 3708032 - RNA, 14 nt, Salmonella enterica enterica serovar Typhi Ty2
gggaaucgcgauuc

SEQ ID NO: 3708033 - RNA, 15 nt, Salmonella enterica enterica serovar Typhi Ty2
gggacacugccggcu

SEQ ID NO: 3708034 - RNA, 23 nt, Salmonella enterica enterica serovar Typhi Ty2
gggacuaucgaaagagcaaauac

SEQ ID NO: 3708035 - RNA, 15 nt, Salmonella enterica enterica serovar Typhi Ty2
gggacucaccguuac

SEQ ID NO: 3708036 - RNA, 17 nt, Salmonella enterica enterica serovar Typhi Ty2
gggagaaaacgcggccu

SEQ ID NO: 3708037 - RNA, 19 nt, Salmonella enterica enterica serovar Typhi Ty2
gggagaaaacgcggccugg

SEQ ID NO: 3708038 - RNA, 14 nt, Salmonella enterica enterica serovar Typhi Ty2
gggagaacucaucu

SEQ ID NO: 3708039 - RNA, 13 nt, Salmonella enterica enterica serovar Typhi Ty2
gggagaccgggcu

SEQ ID NO: 3708040 - RNA, 13 nt, Salmonella enterica enterica serovar Typhi Ty2
gggaggggcuuuc

SEQ ID NO: 3708041 - RNA, 19 nt, Salmonella enterica enterica serovar Typhi Ty2
gggaggugauucugcaucc

SEQ ID NO: 3708042 - RNA, 21 nt, Salmonella enterica enterica serovar Typhi Ty2
gggaguaugcggucaaaagcu

SEQ ID NO: 3708043 - RNA, 14 nt, Salmonella enterica enterica serovar Typhi Ty2
gggauaagcgaugc

SEQ ID NO: 3708044 - RNA, 19 nt, Salmonella enterica enterica serovar Typhi Ty2
gggauaucuuccgggcggg

SEQ ID NO: 3708045 - RNA, 21 nt, Salmonella enterica enterica serovar Typhi Ty2
gggaucguucugcugauaaua

SEQ ID NO: 3708046 - RNA, 18 nt, Salmonella enterica enterica serovar Typhi Ty2
gggaucuuaucuuucagc

SEQ ID NO: 3708047 - RNA, 16 nt, Salmonella enterica enterica serovar Typhi Ty2
gggauuaucaggauga

SEQ ID NO: 3708048 - RNA, 15 nt, Salmonella enterica enterica serovar Typhi Ty2
gggauuuccuggcag

SEQ ID NO: 3708049 - RNA, 21 nt, Salmonella enterica enterica serovar Typhi Ty2
gggcaaaagggccauggcugg

SEQ ID NO: 3708050 - RNA, 13 nt, Salmonella enterica enterica serovar Typhi Ty2
gggcaacggccag

SEQ ID NO: 3708051 - RNA, 14 nt, Salmonella enterica enterica serovar Typhi Ty2
gggcaauccauuaa

SEQ ID NO: 3708052 - RNA, 18 nt, Salmonella enterica enterica serovar Typhi Ty2
gggcaaugccaccagcgc

SEQ ID NO: 3708053 - RNA, 23 nt, Salmonella enterica enterica serovar Typhi Ty2
gggcacgcugaccacgccgccgc

SEQ ID NO: 3708054 - RNA, 19 nt, Salmonella enterica enterica serovar Typhi Ty2
gggcacuccggcucgcaca

SEQ ID NO: 3708055 - RNA, 12 nt, Salmonella enterica enterica serovar Typhi Ty2
gggcagaaacgu

SEQ ID NO: 3708056 - RNA, 11 nt, Salmonella enterica enterica serovar Typhi Ty2
gggcagcaucu

SEQ ID NO: 3708057 - RNA, 18 nt, Salmonella enterica enterica serovar Typhi Ty2
gggcaggcgucaaaacag

SEQ ID NO: 3708058 - RNA, 22 nt, Salmonella enterica enterica serovar Typhi Ty2
gggcaguaaauuaaacagcugu

SEQ ID NO: 3708059 - RNA, 15 nt, Salmonella enterica enterica serovar Typhi Ty2
gggcagugcucgcca

SEQ ID NO: 3708060 - RNA, 16 nt, Salmonella enterica enterica serovar Typhi Ty2
gggcauaaaugguacu

SEQ ID NO: 3708061 - RNA, 12 nt, Salmonella enterica enterica serovar Typhi Ty2
gggcauccgccg

SEQ ID NO: 3708062 - RNA, 19 nt, Salmonella enterica enterica serovar Typhi Ty2
gggcaugauuacagauauc

SEQ ID NO: 3708063 - RNA, 17 nt, Salmonella enterica enterica serovar Typhi Ty2
gggcaugggaaauaacg

SEQ ID NO: 3708064 - RNA, 17 nt, Salmonella enterica enterica serovar Typhi Ty2
gggcauuuuccggcgac

SEQ ID NO: 3708065 - RNA, 17 nt, Salmonella enterica enterica serovar Typhi Ty2
gggccaccugccaggcu

SEQ ID NO: 3708066 - RNA, 17 nt, Salmonella enterica enterica serovar Typhi Ty2
gggccacuuacggacaa

SEQ ID NO: 3708067 - RNA, 15 nt, Salmonella enterica enterica serovar Typhi Ty2
gggccagauucuuag

SEQ ID NO: 3708068 - RNA, 15 nt, Salmonella enterica enterica serovar Typhi Ty2
gggccagcagccagg

SEQ ID NO: 3708069 - RNA, 17 nt, Salmonella enterica enterica serovar Typhi Ty2
gggccagcagcgcauca

SEQ ID NO: 3708070 - RNA, 19 nt, Salmonella enterica enterica serovar Typhi Ty2
gggccagcagcgcaucauc

SEQ ID NO: 3708071 - RNA, 15 nt, Salmonella enterica enterica serovar Typhi Ty2
gggccauucgccaua

SEQ ID NO: 3708072 - RNA, 14 nt, Salmonella enterica enterica serovar Typhi Ty2
ggguuaaggcauca

SEQ ID NO: 3708073 - RNA, 14 nt, Salmonella enterica enterica serovar Typhi Ty2
ggguuaauggcagc

SEQ ID NO: 3708074 - RNA, 23 nt, Salmonella enterica enterica serovar Typhi Ty2
ggguuacucuguuucgccgcagg

SEQ ID NO: 3708075 - RNA, 13 nt, Salmonella enterica enterica serovar Typhi Ty2
ggguuauuuccgc

SEQ ID NO: 3708076 - RNA, 17 nt, Salmonella enterica enterica serovar Typhi Ty2
ggguucaaguccccccc

SEQ ID NO: 3708077 - RNA, 13 nt, Salmonella enterica enterica serovar Typhi Ty2
ggguucacugcca

SEQ ID NO: 3708078 - RNA, 24 nt, Salmonella enterica enterica serovar Typhi Ty2
ggguuccaggcggagaccacggua

SEQ ID NO: 3708079 - RNA, 15 nt, Salmonella enterica enterica serovar Typhi Ty2
ggguucguaauaagg

SEQ ID NO: 3708080 - RNA, 19 nt, Salmonella enterica enterica serovar Typhi Ty2
ggguucguuaacccggcau

SEQ ID NO: 3708081 - RNA, 22 nt, Salmonella enterica enterica serovar Typhi Ty2
ggguugcacauuguugcaggga

SEQ ID NO: 3708082 - RNA, 18 nt, Salmonella enterica enterica serovar Typhi Ty2
gguaaaaagcuccggacg

SEQ ID NO: 3708083 - RNA, 13 nt, Salmonella enterica enterica serovar Typhi Ty2
gguaaaacgcugg

SEQ ID NO: 3708084 - RNA, 12 nt, Salmonella enterica enterica serovar Typhi Ty2
gguaaaauccuu

SEQ ID NO: 3708085 - RNA, 17 nt, Salmonella enterica enterica serovar Typhi Ty2
gguaaacucacccaggc

SEQ ID NO: 3708086 - RNA, 21 nt, Salmonella enterica enterica serovar Typhi Ty2
gguaaacucacccaggcgaug

SEQ ID NO: 3708087 - RNA, 22 nt, Salmonella enterica enterica serovar Typhi Ty2
gguaaagaaaccagaguccggc

SEQ ID NO: 3708088 - RNA, 20 nt, Salmonella enterica enterica serovar Typhi Ty2
gguaaauuuaugguuccuga

SEQ ID NO: 3708089 - RNA, 12 nt, Salmonella enterica enterica serovar Typhi Ty2
gguaaccauuuc

SEQ ID NO: 3708090 - RNA, 19 nt, Salmonella enterica enterica serovar Typhi Ty2
gguaaccuuaauuugugau

SEQ ID NO: 3708091 - RNA, 15 nt, Salmonella enterica enterica serovar Typhi Ty2
gguaacgaacgcugu

SEQ ID NO: 3708092 - RNA, 16 nt, Salmonella enterica enterica serovar Typhi Ty2
gguaacgauaaaaugc

SEQ ID NO: 3708093 - RNA, 17 nt, Salmonella enterica enterica serovar Typhi Ty2
gguaacgccuucgcaaa

SEQ ID NO: 3708094 - RNA, 22 nt, Salmonella enterica enterica serovar Typhi Ty2
gguaacgcucuuaccgcuaaaa

SEQ ID NO: 3708095 - RNA, 22 nt, Salmonella enterica enterica serovar Typhi Ty2
gguaagacguuuaugccgccau

SEQ ID NO: 3708096 - RNA, 20 nt, Salmonella enterica enterica serovar Typhi Ty2
gguaagagcguuacccagac

SEQ ID NO: 3708097 - RNA, 23 nt, Salmonella enterica enterica serovar Typhi Ty2
gguaagcccauggcaggcagcac

SEQ ID NO: 3708098 - RNA, 17 nt, Salmonella enterica enterica serovar Typhi Ty2
gguaagcgcagcgccau

SEQ ID NO: 3708099 - RNA, 17 nt, Salmonella enterica enterica serovar Typhi Ty2
gguaaguuuuucucuua

SEQ ID NO: 3708100 - RNA, 19 nt, Salmonella enterica enterica serovar Typhi Ty2
gguaauaacugacagacuc

SEQ ID NO: 3708101 - RNA, 16 nt, Salmonella enterica enterica serovar Typhi Ty2
gguaauggcgacugug

SEQ ID NO: 3708102 - RNA, 17 nt, Salmonella enterica enterica serovar Typhi Ty2
gguaauuaaaggcagcg

SEQ ID NO: 3708103 - RNA, 15 nt, Salmonella enterica enterica serovar Typhi Ty2
gguaauuugcgccau

SEQ ID NO: 3708104 - RNA, 18 nt, Salmonella enterica enterica serovar Typhi Ty2
gguaauuuugccaucgcg

SEQ ID NO: 3708105 - RNA, 19 nt, Salmonella enterica enterica serovar Typhi Ty2
gguacaccaggaguuaaac

SEQ ID NO: 3708106 - RNA, 15 nt, Salmonella enterica enterica serovar Typhi Ty2
gguacagaugcugua

SEQ ID NO: 3708107 - RNA, 17 nt, Salmonella enterica enterica serovar Typhi Ty2
gguacaggccgccgccu

SEQ ID NO: 3708108 - RNA, 17 nt, Salmonella enterica enterica serovar Typhi Ty2
gguacauccaugccauc

SEQ ID NO: 3708109 - RNA, 21 nt, Salmonella enterica enterica serovar Typhi Ty2
gguaccucaugccggcuggca

SEQ ID NO: 3708110 - RNA, 16 nt, Salmonella enterica enterica serovar Typhi Ty2
gguacgcaucaccagg

SEQ ID NO: 3708111 - RNA, 22 nt, Salmonella enterica enterica serovar Typhi Ty2
gguacguuaaccggaucggcca

SEQ ID NO: 3708112 - RNA, 21 nt, Salmonella enterica enterica serovar Typhi Ty2
gguacucgucccgauauaaag

SEQ ID NO: 3708113 - RNA, 16 nt, Salmonella enterica enterica serovar Typhi Ty2
gguacugcuggccuau

SEQ ID NO: 3708114 - RNA, 22 nt, Salmonella enterica enterica serovar Typhi Ty2
gguacuuuucauccacagcgcc

SEQ ID NO: 3708115 - RNA, 12 nt, Salmonella enterica enterica serovar Typhi Ty2
gguagcagaccg

SEQ ID NO: 3708116 - RNA, 13 nt, Salmonella enterica enterica serovar Typhi Ty2
gguagccacagau

SEQ ID NO: 3708117 - RNA, 14 nt, Salmonella enterica enterica serovar Typhi Ty2
gguagccaggcgcg

SEQ ID NO: 3708118 - RNA, 22 nt, Salmonella enterica enterica serovar Typhi Ty2
gguagcccggacaaggcgcgcc

SEQ ID NO: 3708119 - RNA, 18 nt, Salmonella enterica enterica serovar Typhi Ty2
gguagcccggcaggcugg

SEQ ID NO: 3708120 - RNA, 21 nt, Salmonella enterica enterica serovar Typhi Ty2
gguagcgcuuguuaucuggca

SEQ ID NO: 3708121 - RNA, 21 nt, Salmonella enterica enterica serovar Typhi Ty2
gguagcgucagguagcccggc

SEQ ID NO: 3708122 - RNA, 15 nt, Salmonella enterica enterica serovar Typhi Ty2
gguagcguuauccag

SEQ ID NO: 3708123 - RNA, 24 nt, Salmonella enterica enterica serovar Typhi Ty2
gguagcuccagacaggacgccagc

SEQ ID NO: 3708124 - RNA, 22 nt, Salmonella enterica enterica serovar Typhi Ty2
gguaggguugccagaggcagca

SEQ ID NO: 3708125 - RNA, 19 nt, Salmonella enterica enterica serovar Typhi Ty2
gguagucacggagagucgc

SEQ ID NO: 3708126 - RNA, 21 nt, Salmonella enterica enterica serovar Typhi Ty2
gguagucacggagagucgcac

SEQ ID NO: 3708127 - RNA, 12 nt, Salmonella enterica enterica serovar Typhi Ty2
gguagucaucgc

SEQ ID NO: 3708128 - RNA, 15 nt, Salmonella enterica enterica serovar Typhi Ty2
gguaguccugcucau

SEQ ID NO: 3708129 - RNA, 16 nt, Salmonella enterica enterica serovar Typhi Ty2
gguaguguuaucgccg

SEQ ID NO: 3708130 - RNA, 15 nt, Salmonella enterica enterica serovar Typhi Ty2
gguauaggccaggcu

SEQ ID NO: 3708131 - RNA, 14 nt, Salmonella enterica enterica serovar Typhi Ty2
gguaucagcgcguu

SEQ ID NO: 3708132 - RNA, 19 nt, Salmonella enterica enterica serovar Typhi Ty2
gguaucaucagauccugcg

SEQ ID NO: 3708133 - RNA, 20 nt, Salmonella enterica enterica serovar Typhi Ty2
gguaucauuaugggcagcac

SEQ ID NO: 3708134 - RNA, 13 nt, Salmonella enterica enterica serovar Typhi Ty2
gguauccgccaua

SEQ ID NO: 3708135 - RNA, 12 nt, Salmonella enterica enterica serovar Typhi Ty2
gguauccuccug

SEQ ID NO: 3708136 - RNA, 19 nt, Salmonella enterica enterica serovar Typhi Ty2
gguaugaacgccggcggcg

SEQ ID NO: 3708137 - RNA, 15 nt, Salmonella enterica enterica serovar Typhi Ty2
gguaugcggcuaaua

SEQ ID NO: 3708138 - RNA, 18 nt, Salmonella enterica enterica serovar Typhi Ty2
gguauguuccuggauaga

SEQ ID NO: 3708139 - RNA, 16 nt, Salmonella enterica enterica serovar Typhi Ty2
gguauuaacaggcgcc

SEQ ID NO: 3708140 - RNA, 14 nt, Salmonella enterica enterica serovar Typhi Ty2
gguauuacaugccg

SEQ ID NO: 3708141 - RNA, 23 nt, Salmonella enterica enterica serovar Typhi Ty2
gguauuacaugccguuaauaaug

SEQ ID NO: 3708142 - RNA, 21 nt, Salmonella enterica enterica serovar Typhi Ty2
gguauucaacgccaucuuccu

SEQ ID NO: 3708143 - RNA, 19 nt, Salmonella enterica enterica serovar Typhi Ty2
gguauucgcggccagauaa

SEQ ID NO: 3708144 - RNA, 19 nt, Salmonella enterica enterica serovar Typhi Ty2
gguauucguuaccagcauc

SEQ ID NO: 3708145 - RNA, 14 nt, Salmonella enterica enterica serovar Typhi Ty2
ggucaaaagcugca

SEQ ID NO: 3708146 - RNA, 19 nt, Salmonella enterica enterica serovar Typhi Ty2
ggucaaaugcgaaaaaaag

SEQ ID NO: 3708147 - RNA, 15 nt, Salmonella enterica enterica serovar Typhi Ty2
ggucaacaggcugaa

SEQ ID NO: 3708148 - RNA, 16 nt, Salmonella enterica enterica serovar Typhi Ty2
ggucaauacaucacgc

SEQ ID NO: 3708149 - RNA, 23 nt, Salmonella enterica enterica serovar Typhi Ty2
ggucacacuuaccgggcaucuga

SEQ ID NO: 3708150 - RNA, 15 nt, Salmonella enterica enterica serovar Typhi Ty2
ggucaccugaaaaug

SEQ ID NO: 3708151 - RNA, 12 nt, Salmonella enterica enterica serovar Typhi Ty2
ggucagauccuu

SEQ ID NO: 3708152 - RNA, 20 nt, Salmonella enterica enterica serovar Typhi Ty2
ggucagauccuuuuucugcg

SEQ ID NO: 3708153 - RNA, 21 nt, Salmonella enterica enterica serovar Typhi Ty2
ggucagcauuucauccauuaa

SEQ ID NO: 3708154 - RNA, 21 nt, Salmonella enterica enterica serovar Typhi Ty2
ggugcucucccagcugagcua

SEQ ID NO: 3708155 - RNA, 18 nt, Salmonella enterica enterica serovar Typhi Ty2
ggugcuuagcuggccaau

SEQ ID NO: 3708156 - RNA, 15 nt, Salmonella enterica enterica serovar Typhi Ty2
gguggaaagugcuga

SEQ ID NO: 3708157 - RNA, 22 nt, Salmonella enterica enterica serovar Typhi Ty2
gguggggauaucuucgauaaga

SEQ ID NO: 3708158 - RNA, 17 nt, Salmonella enterica enterica serovar Typhi Ty2
ggugggguucccgagcg

SEQ ID NO: 3708159 - RNA, 18 nt, Salmonella enterica enterica serovar Typhi Ty2
gguggguagcggcaauua

SEQ ID NO: 3708160 - RNA, 17 nt, Salmonella enterica enterica serovar Typhi Ty2
gguggguuccagcgcca

SEQ ID NO: 3708161 - RNA, 12 nt, Salmonella enterica enterica serovar Typhi Ty2
ggugguaaauca

SEQ ID NO: 3708162 - RNA, 20 nt, Salmonella enterica enterica serovar Typhi Ty2
gguggucaucgcggccagca

SEQ ID NO: 3708163 - RNA, 15 nt, Salmonella enterica enterica serovar Typhi Ty2
gguggucuggagccu

SEQ ID NO: 3708164 - RNA, 14 nt, Salmonella enterica enterica serovar Typhi Ty2
gguggugggcggca

SEQ ID NO: 3708165 - RNA, 17 nt, Salmonella enterica enterica serovar Typhi Ty2
gguggugggcggcacca

SEQ ID NO: 3708166 - RNA, 15 nt, Salmonella enterica enterica serovar Typhi Ty2
ggugguugcaucauc

SEQ ID NO: 3708167 - RNA, 16 nt, Salmonella enterica enterica serovar Typhi Ty2
ggugguuucccugacc

SEQ ID NO: 3708168 - RNA, 20 nt, Salmonella enterica enterica serovar Typhi Ty2
gguguaaaccaggcauuuua

SEQ ID NO: 3708169 - RNA, 14 nt, Salmonella enterica enterica serovar Typhi Ty2
gguguaccccgccu

SEQ ID NO: 3708170 - RNA, 14 nt, Salmonella enterica enterica serovar Typhi Ty2
ggugucaaagcgcc

SEQ ID NO: 3708171 - RNA, 18 nt, Salmonella enterica enterica serovar Typhi Ty2
ggugucaaagcgccagau

SEQ ID NO: 3708172 - RNA, 14 nt, Salmonella enterica enterica serovar Typhi Ty2
ggugucagauccuu

SEQ ID NO: 3708173 - RNA, 12 nt, Salmonella enterica enterica serovar Typhi Ty2
gguguccagaug

SEQ ID NO: 3708174 - RNA, 23 nt, Salmonella enterica enterica serovar Typhi Ty2
ggugugguacggcuuucacaccg

SEQ ID NO: 3708175 - RNA, 18 nt, Salmonella enterica enterica serovar Typhi Ty2
gguguuuacgccgccauc

SEQ ID NO: 3708176 - RNA, 18 nt, Salmonella enterica enterica serovar Typhi Ty2
gguuaaaaacagccagca

SEQ ID NO: 3708177 - RNA, 23 nt, Salmonella enterica enterica serovar Typhi Ty2
gguuaaauuaaauaacaaaugaa

SEQ ID NO: 3708178 - RNA, 13 nt, Salmonella enterica enterica serovar Typhi Ty2
gguuaaggaugua

SEQ ID NO: 3708179 - RNA, 20 nt, Salmonella enterica enterica serovar Typhi Ty2
gguuaaugaaaucgucgcca

SEQ ID NO: 3708180 - RNA, 13 nt, Salmonella enterica enterica serovar Typhi Ty2
gguuaauggcagc

SEQ ID NO: 3708181 - RNA, 15 nt, Salmonella enterica enterica serovar Typhi Ty2
gguuacaacccgacc

SEQ ID NO: 3708182 - RNA, 20 nt, Salmonella enterica enterica serovar Typhi Ty2
gguuacaacugcgaggucac

SEQ ID NO: 3708183 - RNA, 17 nt, Salmonella enterica enterica serovar Typhi Ty2
gguuacaggugccuggg

SEQ ID NO: 3708184 - RNA, 23 nt, Salmonella enterica enterica serovar Typhi Ty2
gguuaccaaacccuuuggcaaaa

SEQ ID NO: 3708185 - RNA, 17 nt, Salmonella enterica enterica serovar Typhi Ty2
gguuacuauuuuucacc

SEQ ID NO: 3708186 - RNA, 14 nt, Salmonella enterica enterica serovar Typhi Ty2
gguuacucuuccac

SEQ ID NO: 3708187 - RNA, 22 nt, Salmonella enterica enterica serovar Typhi Ty2
gguuauaaacccccuggccgga

SEQ ID NO: 3708188 - RNA, 14 nt, Salmonella enterica enterica serovar Typhi Ty2
gguuauaauaauaa

SEQ ID NO: 3708189 - RNA, 20 nt, Salmonella enterica enterica serovar Typhi Ty2
gguuaucaauaaugcgcugc

SEQ ID NO: 3708190 - RNA, 19 nt, Salmonella enterica enterica serovar Typhi Ty2
gguuauucgccuuucacgc

SEQ ID NO: 3708191 - RNA, 15 nt, Salmonella enterica enterica serovar Typhi Ty2
gguucaagucccccc

SEQ ID NO: 3708192 - RNA, 16 nt, Salmonella enterica enterica serovar Typhi Ty2
gguucacaauacagaa

SEQ ID NO: 3708193 - RNA, 21 nt, Salmonella enterica enterica serovar Typhi Ty2
gguucaccaccacccagugcc

SEQ ID NO: 3708194 - RNA, 22 nt, Salmonella enterica enterica serovar Typhi Ty2
gguucaccagcgcgccgccgcc

SEQ ID NO: 3708195 - RNA, 22 nt, Salmonella enterica enterica serovar Typhi Ty2
gguucagcaacgugaacugcgc

SEQ ID NO: 3708196 - RNA, 15 nt, Salmonella enterica enterica serovar Typhi Ty2
gguucaucgccacau

SEQ ID NO: 3708197 - RNA, 18 nt, Salmonella enterica enterica serovar Typhi Ty2
gguucccugcgccaggcc

SEQ ID NO: 3708198 - RNA, 22 nt, Salmonella enterica enterica serovar Typhi Ty2
gguuccguucccaaugcuuucg

SEQ ID NO: 3708199 - RNA, 19 nt, Salmonella enterica enterica serovar Typhi Ty2
gguucgcgaagugucuucc

SEQ ID NO: 3708200 - RNA, 19 nt, Salmonella enterica enterica serovar Typhi Ty2
gguucgcguacgcaucaua

SEQ ID NO: 3708201 - RNA, 22 nt, Salmonella enterica enterica serovar Typhi Ty2
gguucguacccgcaggccuggc

SEQ ID NO: 3708202 - RNA, 20 nt, Salmonella enterica enterica serovar Typhi Ty2
gguugaaggucugacaacua

SEQ ID NO: 3708203 - RNA, 12 nt, Salmonella enterica enterica serovar Typhi Ty2
gguugacgcugc

SEQ ID NO: 3708204 - RNA, 18 nt, Salmonella enterica enterica serovar Typhi Ty2
gguugacuuacaaaaaau

SEQ ID NO: 3708205 - RNA, 16 nt, Salmonella enterica enterica serovar Typhi Ty2
gguugcaauuccgcca

SEQ ID NO: 3708206 - RNA, 18 nt, Salmonella enterica enterica serovar Typhi Ty2
gguugccagaggcagcac

SEQ ID NO: 3708207 - RNA, 17 nt, Salmonella enterica enterica serovar Typhi Ty2
gguugcccgcaggcuuc

SEQ ID NO: 3708208 - RNA, 22 nt, Salmonella enterica enterica serovar Typhi Ty2
gguugcccgguggcgcugcgcu

SEQ ID NO: 3708209 - RNA, 17 nt, Salmonella enterica enterica serovar Typhi Ty2
gguugcgaauaaacaca

SEQ ID NO: 3708210 - RNA, 14 nt, Salmonella enterica enterica serovar Typhi Ty2
gguugcgcaaccuc

SEQ ID NO: 3708211 - RNA, 17 nt, Salmonella enterica enterica serovar Typhi Ty2
gguugcuucuguccuuu

SEQ ID NO: 3708212 - RNA, 20 nt, Salmonella enterica enterica serovar Typhi Ty2
gguuguaucauguuccggca

SEQ ID NO: 3708213 - RNA, 15 nt, Salmonella enterica enterica serovar Typhi Ty2
gguugucucaaaaaa

SEQ ID NO: 3708214 - RNA, 14 nt, Salmonella enterica enterica serovar Typhi Ty2
gguugugccaguaa

SEQ ID NO: 3708215 - RNA, 22 nt, Salmonella enterica enterica serovar Typhi Ty2
gguuuaccauuacgcuauaaag

SEQ ID NO: 3708216 - RNA, 22 nt, Salmonella enterica enterica serovar Typhi Ty2
gguuucaauauagccguggcug

SEQ ID NO: 3708217 - RNA, 18 nt, Salmonella enterica enterica serovar Typhi Ty2
gguuucaccauuaagcaa

SEQ ID NO: 3708218 - RNA, 13 nt, Salmonella enterica enterica serovar Typhi Ty2
gguuucccaguca

SEQ ID NO: 3708219 - RNA, 18 nt, Salmonella enterica enterica serovar Typhi Ty2
gguuucgccuaagcccac

SEQ ID NO: 3708220 - RNA, 15 nt, Salmonella enterica enterica serovar Typhi Ty2
gguuucuggcaacag

SEQ ID NO: 3708221 - RNA, 23 nt, Salmonella enterica enterica serovar Typhi Ty2
gguuugacccauuuuaaaaguua

SEQ ID NO: 3708222 - RNA, 17 nt, Salmonella enterica enterica serovar Typhi Ty2
gguuugagcaccacgcg

SEQ ID NO: 3708223 - RNA, 17 nt, Salmonella enterica enterica serovar Typhi Ty2
gguuugccagcaccagc

SEQ ID NO: 3708224 - RNA, 18 nt, Salmonella enterica enterica serovar Typhi Ty2
gguuuuaugcaucgcggu

SEQ ID NO: 3708225 - RNA, 18 nt, Salmonella enterica enterica serovar Typhi Ty2
gguuuucauccacccugg

SEQ ID NO: 3708226 - RNA, 21 nt, Salmonella enterica enterica serovar Typhi Ty2
gguuuuccugaaucaguaucc

SEQ ID NO: 3708227 - RNA, 22 nt, Salmonella enterica enterica serovar Typhi Ty2
gguuuuucgccgaccauccaga

SEQ ID NO: 3708228 - RNA, 15 nt, Salmonella enterica enterica serovar Typhi Ty2
gguuuuuuuacucug

SEQ ID NO: 3708229 - RNA, 21 nt, Salmonella enterica enterica serovar Typhi Ty2
gguuuuuuuguaucugcgcag

SEQ ID NO: 3708230 - RNA, 18 nt, Salmonella enterica enterica serovar Typhi Ty2
guaaaaauuguuccugua

SEQ ID NO: 3708231 - RNA, 21 nt, Salmonella enterica enterica serovar Typhi Ty2
guaaaaauuuuugaucugcuu

SEQ ID NO: 3708232 - RNA, 20 nt, Salmonella enterica enterica serovar Typhi Ty2
guaaaacacgccuccauaca

SEQ ID NO: 3708233 - RNA, 22 nt, Salmonella enterica enterica serovar Typhi Ty2
guaaaacgccaagaaugaaaca

SEQ ID NO: 3708234 - RNA, 12 nt, Salmonella enterica enterica serovar Typhi Ty2
guaaaacgcugg

SEQ ID NO: 3708235 - RNA, 12 nt, Salmonella enterica enterica serovar Typhi Ty2
guaaaaucagcg

SEQ ID NO: 3708236 - RNA, 11 nt, Salmonella enterica enterica serovar Typhi Ty2
guaauacuucc

SEQ ID NO: 3708237 - RNA, 19 nt, Salmonella enterica enterica serovar Typhi Ty2
guaauagucugcucgucgg

SEQ ID NO: 3708238 - RNA, 14 nt, Salmonella enterica enterica serovar Typhi Ty2
guaauaguuucgac

SEQ ID NO: 3708239 - RNA, 22 nt, Salmonella enterica enterica serovar Typhi Ty2
guaauaugugcgccacgcagcg

SEQ ID NO: 3708240 - RNA, 16 nt, Salmonella enterica enterica serovar Typhi Ty2
guaauccagaggguaa

SEQ ID NO: 3708241 - RNA, 13 nt, Salmonella enterica enterica serovar Typhi Ty2
guaaucgccgcga

SEQ ID NO: 3708242 - RNA, 13 nt, Salmonella enterica enterica serovar Typhi Ty2
guaaucgccguau

SEQ ID NO: 3708243 - RNA, 14 nt, Salmonella enterica enterica serovar Typhi Ty2
guaaucgccugaau

SEQ ID NO: 3708244 - RNA, 13 nt, Salmonella enterica enterica serovar Typhi Ty2
guaaucuaaaauu

SEQ ID NO: 3708245 - RNA, 14 nt, Salmonella enterica enterica serovar Typhi Ty2
guaaucuauucagc

SEQ ID NO: 3708246 - RNA, 17 nt, Salmonella enterica enterica serovar Typhi Ty2
guaaucuuccacccgcg

SEQ ID NO: 3708247 - RNA, 18 nt, Salmonella enterica enterica serovar Typhi Ty2
guaaugcgccaggcagca

SEQ ID NO: 3708248 - RNA, 19 nt, Salmonella enterica enterica serovar Typhi Ty2
guaaugcgccaggcagcac

SEQ ID NO: 3708249 - RNA, 22 nt, Salmonella enterica enterica serovar Typhi Ty2
guaaugcucgcccagaauuucc

SEQ ID NO: 3708250 - RNA, 17 nt, Salmonella enterica enterica serovar Typhi Ty2
guaauggccuacacacu

SEQ ID NO: 3708251 - RNA, 21 nt, Salmonella enterica enterica serovar Typhi Ty2
guaauggcgggaaaagguuuc

SEQ ID NO: 3708252 - RNA, 18 nt, Salmonella enterica enterica serovar Typhi Ty2
guaaugucuggugcagca

SEQ ID NO: 3708253 - RNA, 22 nt, Salmonella enterica enterica serovar Typhi Ty2
guaauguugcugcaucuccagc

SEQ ID NO: 3708254 - RNA, 19 nt, Salmonella enterica enterica serovar Typhi Ty2
guaauuaaggauugccgcc

SEQ ID NO: 3708255 - RNA, 15 nt, Salmonella enterica enterica serovar Typhi Ty2
guaauucagcucgcu

SEQ ID NO: 3708256 - RNA, 14 nt, Salmonella enterica enterica serovar Typhi Ty2
guaauucucccaaa

SEQ ID NO: 3708257 - RNA, 18 nt, Salmonella enterica enterica serovar Typhi Ty2
guaauucucccaaauuuu

SEQ ID NO: 3708258 - RNA, 12 nt, Salmonella enterica enterica serovar Typhi Ty2
guaauugacgcg

SEQ ID NO: 3708259 - RNA, 19 nt, Salmonella enterica enterica serovar Typhi Ty2
guaauuugaacauauccgc

SEQ ID NO: 3708260 - RNA, 14 nt, Salmonella enterica enterica serovar Typhi Ty2
guaauuugcuuucu

SEQ ID NO: 3708261 - RNA, 14 nt, Salmonella enterica enterica serovar Typhi Ty2
guaauuuuucuccc

SEQ ID NO: 3708262 - RNA, 17 nt, Salmonella enterica enterica serovar Typhi Ty2
guaauuuuucucccagc

SEQ ID NO: 3708263 - RNA, 13 nt, Salmonella enterica enterica serovar Typhi Ty2
guacaaacaaaua

SEQ ID NO: 3708264 - RNA, 20 nt, Salmonella enterica enterica serovar Typhi Ty2
guacaaacaaauaaauccau

SEQ ID NO: 3708265 - RNA, 21 nt, Salmonella enterica enterica serovar Typhi Ty2
guacaaaccccacccacugau

SEQ ID NO: 3708266 - RNA, 17 nt, Salmonella enterica enterica serovar Typhi Ty2
guacacacgcgcugacc

SEQ ID NO: 3708267 - RNA, 13 nt, Salmonella enterica enterica serovar Typhi Ty2
guacaccugcagg

SEQ ID NO: 3708268 - RNA, 17 nt, Salmonella enterica enterica serovar Typhi Ty2
guacaccuuaucugugg

SEQ ID NO: 3708269 - RNA, 22 nt, Salmonella enterica enterica serovar Typhi Ty2
guacacguauaaacgccgccgc

SEQ ID NO: 3708270 - RNA, 14 nt, Salmonella enterica enterica serovar Typhi Ty2
guacacuucagcca

SEQ ID NO: 3708271 - RNA, 17 nt, Salmonella enterica enterica serovar Typhi Ty2
guacacuucauccggcg

SEQ ID NO: 3708272 - RNA, 16 nt, Salmonella enterica enterica serovar Typhi Ty2
guacagaagguuauuc

SEQ ID NO: 3708273 - RNA, 12 nt, Salmonella enterica enterica serovar Typhi Ty2
guacagaugcug

SEQ ID NO: 3708274 - RNA, 20 nt, Salmonella enterica enterica serovar Typhi Ty2
guacagcuuaaucaccagcg

SEQ ID NO: 3708275 - RNA, 16 nt, Salmonella enterica enterica serovar Typhi Ty2
guacaggccgccgccu

SEQ ID NO: 3708276 - RNA, 16 nt, Salmonella enterica enterica serovar Typhi Ty2
guacauaacagcagca

SEQ ID NO: 3708277 - RNA, 12 nt, Salmonella enterica enterica serovar Typhi Ty2
guacauauacug

SEQ ID NO: 3708278 - RNA, 18 nt, Salmonella enterica enterica serovar Typhi Ty2
guacaucuacuucagcac

SEQ ID NO: 3708279 - RNA, 13 nt, Salmonella enterica enterica serovar Typhi Ty2
guacaucuuccau

SEQ ID NO: 3708280 - RNA, 19 nt, Salmonella enterica enterica serovar Typhi Ty2
guacaugaauaauaauaca

SEQ ID NO: 3708281 - RNA, 17 nt, Salmonella enterica enterica serovar Typhi Ty2
guacaugccauccggcg

SEQ ID NO: 3708282 - RNA, 17 nt, Salmonella enterica enterica serovar Typhi Ty2
guaccaaaacagaaaag

SEQ ID NO: 3708283 - RNA, 14 nt, Salmonella enterica enterica serovar Typhi Ty2
guaccaauacccag

SEQ ID NO: 3708284 - RNA, 15 nt, Salmonella enterica enterica serovar Typhi Ty2
guaccaauacccagc

SEQ ID NO: 3708285 - RNA, 20 nt, Salmonella enterica enterica serovar Typhi Ty2
guaccaccacgcccuucacg

SEQ ID NO: 3708286 - RNA, 20 nt, Salmonella enterica enterica serovar Typhi Ty2
guaccaccagaaucgccagc

SEQ ID NO: 3708287 - RNA, 18 nt, Salmonella enterica enterica serovar Typhi Ty2
guaccacccgggaaaaau

SEQ ID NO: 3708288 - RNA, 15 nt, Salmonella enterica enterica serovar Typhi Ty2
guaccacgccgcaca

SEQ ID NO: 3708289 - RNA, 12 nt, Salmonella enterica enterica serovar Typhi Ty2
guaccagcagcg

SEQ ID NO: 3708290 - RNA, 15 nt, Salmonella enterica enterica serovar Typhi Ty2
guaccagcagcgcca

SEQ ID NO: 3708291 - RNA, 22 nt, Salmonella enterica enterica serovar Typhi Ty2
guaccauaccggugcgccccag

SEQ ID NO: 3708292 - RNA, 13 nt, Salmonella enterica enterica serovar Typhi Ty2
guaccauugucaa

SEQ ID NO: 3708293 - RNA, 18 nt, Salmonella enterica enterica serovar Typhi Ty2
guaccauugucaaaaaua

SEQ ID NO: 3708294 - RNA, 17 nt, Salmonella enterica enterica serovar Typhi Ty2
guacccgcaggccuggc

SEQ ID NO: 3708295 - RNA, 23 nt, Salmonella enterica enterica serovar Typhi Ty2
guacccggcuuacaacauuguua

SEQ ID NO: 3708296 - RNA, 14 nt, Salmonella enterica enterica serovar Typhi Ty2
guacccucugcacc

SEQ ID NO: 3708297 - RNA, 13 nt, Salmonella enterica enterica serovar Typhi Ty2
guaccgaaagcga

SEQ ID NO: 3708298 - RNA, 14 nt, Salmonella enterica enterica serovar Typhi Ty2
guaccgaacagcca

SEQ ID NO: 3708299 - RNA, 21 nt, Salmonella enterica enterica serovar Typhi Ty2
guaccgaagaacauaaacagc

SEQ ID NO: 3708300 - RNA, 20 nt, Salmonella enterica enterica serovar Typhi Ty2
guaccgacgccauuccccag

SEQ ID NO: 3708301 - RNA, 23 nt, Salmonella enterica enterica serovar Typhi Ty2
guaccgauuguuuggugcugaaa

SEQ ID NO: 3708302 - RNA, 18 nt, Salmonella enterica enterica serovar Typhi Ty2
guaccgcuacgcaggcca

SEQ ID NO: 3708303 - RNA, 22 nt, Salmonella enterica enterica serovar Typhi Ty2
guaccgcuacgcaggccauuuc

SEQ ID NO: 3708304 - RNA, 15 nt, Salmonella enterica enterica serovar Typhi Ty2
guaccggauuuagcg

SEQ ID NO: 3708305 - RNA, 14 nt, Salmonella enterica enterica serovar Typhi Ty2
guaccggcaaccgg

SEQ ID NO: 3708306 - RNA, 21 nt, Salmonella enterica enterica serovar Typhi Ty2
guaccggcccaaacgaugacc

SEQ ID NO: 3708307 - RNA, 17 nt, Salmonella enterica enterica serovar Typhi Ty2
guaccggcgcucagcca

SEQ ID NO: 3708308 - RNA, 13 nt, Salmonella enterica enterica serovar Typhi Ty2
guaccgggcagac

SEQ ID NO: 3708309 - RNA, 22 nt, Salmonella enterica enterica serovar Typhi Ty2
guacgaucugacugaucgaucc

SEQ ID NO: 3708310 - RNA, 14 nt, Salmonella enterica enterica serovar Typhi Ty2
guacgcaagcguaa

SEQ ID NO: 3708311 - RNA, 16 nt, Salmonella enterica enterica serovar Typhi Ty2
guacgcagcaggcaga

SEQ ID NO: 3708312 - RNA, 22 nt, Salmonella enterica enterica serovar Typhi Ty2
guacgccaaaucuguucugucc

SEQ ID NO: 3708313 - RNA, 11 nt, Salmonella enterica enterica serovar Typhi Ty2
guacgccgcca

SEQ ID NO: 3708314 - RNA, 18 nt, Salmonella enterica enterica serovar Typhi Ty2
guacgccgccauccggca

SEQ ID NO: 3708315 - RNA, 22 nt, Salmonella enterica enterica serovar Typhi Ty2
guacgccuaaaugaacuuacac

SEQ ID NO: 3708316 - RNA, 16 nt, Salmonella enterica enterica serovar Typhi Ty2
guacgccugucgcaac

SEQ ID NO: 3708317 - RNA, 20 nt, Salmonella enterica enterica serovar Typhi Ty2
guacgcgcaaccgcaucacg

SEQ ID NO: 3708318 - RNA, 15 nt, Salmonella enterica enterica serovar Typhi Ty2
guaguguaauaccac

SEQ ID NO: 3708319 - RNA, 20 nt, Salmonella enterica enterica serovar Typhi Ty2
guaguguuuaagcgucaggc

SEQ ID NO: 3708320 - RNA, 16 nt, Salmonella enterica enterica serovar Typhi Ty2
guaguuggugggugau

SEQ ID NO: 3708321 - RNA, 14 nt, Salmonella enterica enterica serovar Typhi Ty2
guaguuuauucauc

SEQ ID NO: 3708322 - RNA, 19 nt, Salmonella enterica enterica serovar Typhi Ty2
guauaaaauggcaaagucg

SEQ ID NO: 3708323 - RNA, 17 nt, Salmonella enterica enterica serovar Typhi Ty2
guauaaacucagcaaua

SEQ ID NO: 3708324 - RNA, 10 nt, Salmonella enterica enterica serovar Typhi Ty2
guauaaagcu

SEQ ID NO: 3708325 - RNA, 19 nt, Salmonella enterica enterica serovar Typhi Ty2
guauaaaucccggugggga

SEQ ID NO: 3708326 - RNA, 18 nt, Salmonella enterica enterica serovar Typhi Ty2
guauaaauuuccgcagcc

SEQ ID NO: 3708327 - RNA, 21 nt, Salmonella enterica enterica serovar Typhi Ty2
guauaaauuuccgcagccaga

SEQ ID NO: 3708328 - RNA, 19 nt, Salmonella enterica enterica serovar Typhi Ty2
guauaauccaacauuauca

SEQ ID NO: 3708329 - RNA, 18 nt, Salmonella enterica enterica serovar Typhi Ty2
guauaaucccgcggcgga

SEQ ID NO: 3708330 - RNA, 14 nt, Salmonella enterica enterica serovar Typhi Ty2
guauacacuuucca

SEQ ID NO: 3708331 - RNA, 16 nt, Salmonella enterica enterica serovar Typhi Ty2
guauaccaucggcugg

SEQ ID NO: 3708332 - RNA, 14 nt, Salmonella enterica enterica serovar Typhi Ty2
guauagaaauagcc

SEQ ID NO: 3708333 - RNA, 19 nt, Salmonella enterica enterica serovar Typhi Ty2
guauagaauacuuccugcu

SEQ ID NO: 3708334 - RNA, 13 nt, Salmonella enterica enterica serovar Typhi Ty2
guauagccaggca

SEQ ID NO: 3708335 - RNA, 14 nt, Salmonella enterica enterica serovar Typhi Ty2
guauagccaggcag

SEQ ID NO: 3708336 - RNA, 14 nt, Salmonella enterica enterica serovar Typhi Ty2
guauaggccaggcu

SEQ ID NO: 3708337 - RNA, 16 nt, Salmonella enterica enterica serovar Typhi Ty2
guaucacugaagagag

SEQ ID NO: 3708338 - RNA, 18 nt, Salmonella enterica enterica serovar Typhi Ty2
guaucacugauauaaccc

SEQ ID NO: 3708339 - RNA, 12 nt, Salmonella enterica enterica serovar Typhi Ty2
guaucagcggaa

SEQ ID NO: 3708340 - RNA, 15 nt, Salmonella enterica enterica serovar Typhi Ty2
guaucaucagauccu

SEQ ID NO: 3708341 - RNA, 15 nt, Salmonella enterica enterica serovar Typhi Ty2
guaucaucgauuuua

SEQ ID NO: 3708342 - RNA, 21 nt, Salmonella enterica enterica serovar Typhi Ty2
guaucaucgcuuaacggccca

SEQ ID NO: 3708343 - RNA, 22 nt, Salmonella enterica enterica serovar Typhi Ty2
guaucaucgcuuaacggcccag

SEQ ID NO: 3708344 - RNA, 16 nt, Salmonella enterica enterica serovar Typhi Ty2
guaucauguuccggca

SEQ ID NO: 3708345 - RNA, 16 nt, Salmonella enterica enterica serovar Typhi Ty2
guauccagcaacagug

SEQ ID NO: 3708346 - RNA, 15 nt, Salmonella enterica enterica serovar Typhi Ty2
guauccagcgcguaa

SEQ ID NO: 3708347 - RNA, 21 nt, Salmonella enterica enterica serovar Typhi Ty2
guauccauucucaucagaccg

SEQ ID NO: 3708348 - RNA, 14 nt, Salmonella enterica enterica serovar Typhi Ty2
guauccauugccag

SEQ ID NO: 3708349 - RNA, 18 nt, Salmonella enterica enterica serovar Typhi Ty2
guauccccagucuuccug

SEQ ID NO: 3708350 - RNA, 12 nt, Salmonella enterica enterica serovar Typhi Ty2
guaucccgccag

SEQ ID NO: 3708351 - RNA, 12 nt, Salmonella enterica enterica serovar Typhi Ty2
guauccgccaua

SEQ ID NO: 3708352 - RNA, 19 nt, Salmonella enterica enterica serovar Typhi Ty2
guauccuaaugccacggcu

SEQ ID NO: 3708353 - RNA, 16 nt, Salmonella enterica enterica serovar Typhi Ty2
guauccugaaccagcg

SEQ ID NO: 3708354 - RNA, 17 nt, Salmonella enterica enterica serovar Typhi Ty2
guaucgccggcagacga

SEQ ID NO: 3708355 - RNA, 15 nt, Salmonella enterica enterica serovar Typhi Ty2
guaucgcgccgccaa

SEQ ID NO: 3708356 - RNA, 13 nt, Salmonella enterica enterica serovar Typhi Ty2
guaucgcucugcu

SEQ ID NO: 3708357 - RNA, 18 nt, Salmonella enterica enterica serovar Typhi Ty2
guaucguguuauuuucaa

SEQ ID NO: 3708358 - RNA, 22 nt, Salmonella enterica enterica serovar Typhi Ty2
guaucguuugcccaucauucaa

SEQ ID NO: 3708359 - RNA, 19 nt, Salmonella enterica enterica serovar Typhi Ty2
guaucugucccagccuucc

SEQ ID NO: 3708360 - RNA, 21 nt, Salmonella enterica enterica serovar Typhi Ty2
guaucugucccagccuuccug

SEQ ID NO: 3708361 - RNA, 13 nt, Salmonella enterica enterica serovar Typhi Ty2
guaucuuccagcg

SEQ ID NO: 3708362 - RNA, 16 nt, Salmonella enterica enterica serovar Typhi Ty2
guaucuuccagcguaa

SEQ ID NO: 3708363 - RNA, 22 nt, Salmonella enterica enterica serovar Typhi Ty2
guaucuucgccguguucuuacc

SEQ ID NO: 3708364 - RNA, 20 nt, Salmonella enterica enterica serovar Typhi Ty2
guaugauuuucuuauuacaa

SEQ ID NO: 3708365 - RNA, 19 nt, Salmonella enterica enterica serovar Typhi Ty2
guaugccgcacaaaauuuu

SEQ ID NO: 3708366 - RNA, 22 nt, Salmonella enterica enterica serovar Typhi Ty2
guaugccucgcgcaccauaaua

SEQ ID NO: 3708367 - RNA, 13 nt, Salmonella enterica enterica serovar Typhi Ty2
guaugccuuccag

SEQ ID NO: 3708368 - RNA, 14 nt, Salmonella enterica enterica serovar Typhi Ty2
guaugcgauacccc

SEQ ID NO: 3708369 - RNA, 15 nt, Salmonella enterica enterica serovar Typhi Ty2
guaugguggcggggu

SEQ ID NO: 3708370 - RNA, 19 nt, Salmonella enterica enterica serovar Typhi Ty2
guauguuaggguagaaaaa

SEQ ID NO: 3708371 - RNA, 12 nt, Salmonella enterica enterica serovar Typhi Ty2
guauuaaauaca

SEQ ID NO: 3708372 - RNA, 18 nt, Salmonella enterica enterica serovar Typhi Ty2
guauuaacagcuucuucu

SEQ ID NO: 3708373 - RNA, 15 nt, Salmonella enterica enterica serovar Typhi Ty2
guauuaacccagaua

SEQ ID NO: 3708374 - RNA, 18 nt, Salmonella enterica enterica serovar Typhi Ty2
guauuacaagcaguuaau

SEQ ID NO: 3708375 - RNA, 19 nt, Salmonella enterica enterica serovar Typhi Ty2
guauuauuaaugucgucca

SEQ ID NO: 3708376 - RNA, 22 nt, Salmonella enterica enterica serovar Typhi Ty2
guauucauaugcucuccuggca

SEQ ID NO: 3708377 - RNA, 20 nt, Salmonella enterica enterica serovar Typhi Ty2
guauuccagucgcuccacca

SEQ ID NO: 3708378 - RNA, 17 nt, Salmonella enterica enterica serovar Typhi Ty2
guauuccguuccuucuu

SEQ ID NO: 3708379 - RNA, 16 nt, Salmonella enterica enterica serovar Typhi Ty2
guauucgugcaucagg

SEQ ID NO: 3708380 - RNA, 14 nt, Salmonella enterica enterica serovar Typhi Ty2
guauucguuaccag

SEQ ID NO: 3708381 - RNA, 13 nt, Salmonella enterica enterica serovar Typhi Ty2
guauucuaacuga

SEQ ID NO: 3708382 - RNA, 21 nt, Salmonella enterica enterica serovar Typhi Ty2
guauucugcgccagccagcuc

SEQ ID NO: 3708383 - RNA, 14 nt, Salmonella enterica enterica serovar Typhi Ty2
guauucuuacccac

SEQ ID NO: 3708384 - RNA, 14 nt, Salmonella enterica enterica serovar Typhi Ty2
guauugcaccuggg

SEQ ID NO: 3708385 - RNA, 22 nt, Salmonella enterica enterica serovar Typhi Ty2
guauugcuuucaauuuccgcac

SEQ ID NO: 3708386 - RNA, 13 nt, Salmonella enterica enterica serovar Typhi Ty2
guauuggcaagaa

SEQ ID NO: 3708387 - RNA, 11 nt, Salmonella enterica enterica serovar Typhi Ty2
guauuuauucu

SEQ ID NO: 3708388 - RNA, 17 nt, Salmonella enterica enterica serovar Typhi Ty2
guauuuccauuuuucag

SEQ ID NO: 3708389 - RNA, 16 nt, Salmonella enterica enterica serovar Typhi Ty2
guauuuuauuuuucaa

SEQ ID NO: 3708390 - RNA, 18 nt, Salmonella enterica enterica serovar Typhi Ty2
gucaaaaaaucagcaauc

SEQ ID NO: 3708391 - RNA, 12 nt, Salmonella enterica enterica serovar Typhi Ty2
gucaaaagcugc

SEQ ID NO: 3708392 - RNA, 13 nt, Salmonella enterica enterica serovar Typhi Ty2
gucaaaaucgcgc

SEQ ID NO: 3708393 - RNA, 13 nt, Salmonella enterica enterica serovar Typhi Ty2
gucaaaaugauca

SEQ ID NO: 3708394 - RNA, 16 nt, Salmonella enterica enterica serovar Typhi Ty2
gucaaacuuuuauaaa

SEQ ID NO: 3708395 - RNA, 18 nt, Salmonella enterica enterica serovar Typhi Ty2
gucaaacuuuuauaaaua

SEQ ID NO: 3708396 - RNA, 22 nt, Salmonella enterica enterica serovar Typhi Ty2
gucaaaugggaucuucaaugaa

SEQ ID NO: 3708397 - RNA, 16 nt, Salmonella enterica enterica serovar Typhi Ty2
gucaaauuaagaaagu

SEQ ID NO: 3708398 - RNA, 18 nt, Salmonella enterica enterica serovar Typhi Ty2
gucaaauuaagaaaguag

SEQ ID NO: 3708399 - RNA, 21 nt, Salmonella enterica enterica serovar Typhi Ty2
gucaaauucacccguuauuca

SEQ ID NO: 3708400 - RNA, 22 nt, Salmonella enterica enterica serovar Typhi Ty2
gucaaauucacccguuauucau

SEQ ID NO: 3708401 - RNA, 12 nt, Salmonella enterica enterica serovar Typhi Ty2
gucauccuuccc

SEQ ID NO: 3708402 - RNA, 23 nt, Salmonella enterica enterica serovar Typhi Ty2
gucaucgcucaucucaagcccca

SEQ ID NO: 3708403 - RNA, 24 nt, Salmonella enterica enterica serovar Typhi Ty2
gucaucgcuucuauuaccgcagcg

SEQ ID NO: 3708404 - RNA, 20 nt, Salmonella enterica enterica serovar Typhi Ty2
gucaucggcacguaguaaug

SEQ ID NO: 3708405 - RNA, 13 nt, Salmonella enterica enterica serovar Typhi Ty2
gucaucggcguug

SEQ ID NO: 3708406 - RNA, 22 nt, Salmonella enterica enterica serovar Typhi Ty2
gucaucugccaguuaucgguaa

SEQ ID NO: 3708407 - RNA, 22 nt, Salmonella enterica enterica serovar Typhi Ty2
gucaugaaaagcuauauuuaua

SEQ ID NO: 3708408 - RNA, 23 nt, Salmonella enterica enterica serovar Typhi Ty2
gucaugauguuugucuuuuccag

SEQ ID NO: 3708409 - RNA, 19 nt, Salmonella enterica enterica serovar Typhi Ty2
gucaugauuaugcgaaugc

SEQ ID NO: 3708410 - RNA, 17 nt, Salmonella enterica enterica serovar Typhi Ty2
gucaugccaucauuaau

SEQ ID NO: 3708411 - RNA, 19 nt, Salmonella enterica enterica serovar Typhi Ty2
gucaugccaucauuaauuu

SEQ ID NO: 3708412 - RNA, 14 nt, Salmonella enterica enterica serovar Typhi Ty2
gucaugcgccacga

SEQ ID NO: 3708413 - RNA, 17 nt, Salmonella enterica enterica serovar Typhi Ty2
gucaugcgggagcuugg

SEQ ID NO: 3708414 - RNA, 18 nt, Salmonella enterica enterica serovar Typhi Ty2
gucaugcuggcgaugagu

SEQ ID NO: 3708415 - RNA, 13 nt, Salmonella enterica enterica serovar Typhi Ty2
gucauggcaaacg

SEQ ID NO: 3708416 - RNA, 17 nt, Salmonella enterica enterica serovar Typhi Ty2
gucauggcuuagcgcca

SEQ ID NO: 3708417 - RNA, 16 nt, Salmonella enterica enterica serovar Typhi Ty2
gucauggguagccguu

SEQ ID NO: 3708418 - RNA, 17 nt, Salmonella enterica enterica serovar Typhi Ty2
gucauggguagccguuu

SEQ ID NO: 3708419 - RNA, 20 nt, Salmonella enterica enterica serovar Typhi Ty2
gucauuaacgggaaacuguu

SEQ ID NO: 3708420 - RNA, 14 nt, Salmonella enterica enterica serovar Typhi Ty2
gucauucaggucua

SEQ ID NO: 3708421 - RNA, 22 nt, Salmonella enterica enterica serovar Typhi Ty2
gucauuccugcguugaccagcg

SEQ ID NO: 3708422 - RNA, 19 nt, Salmonella enterica enterica serovar Typhi Ty2
gucauucucuuucugcgcc

SEQ ID NO: 3708423 - RNA, 13 nt, Salmonella enterica enterica serovar Typhi Ty2
gucauugagccgc

SEQ ID NO: 3708424 - RNA, 17 nt, Salmonella enterica enterica serovar Typhi Ty2
gucauugcgcgcaugca

SEQ ID NO: 3708425 - RNA, 21 nt, Salmonella enterica enterica serovar Typhi Ty2
gucauuggggacgcgcaaacg

SEQ ID NO: 3708426 - RNA, 21 nt, Salmonella enterica enterica serovar Typhi Ty2
gucauuuaccagugcuaaaau

SEQ ID NO: 3708427 - RNA, 21 nt, Salmonella enterica enterica serovar Typhi Ty2
gucauuuucuuucaucaaacg

SEQ ID NO: 3708428 - RNA, 13 nt, Salmonella enterica enterica serovar Typhi Ty2
gucauuuuuucaa

SEQ ID NO: 3708429 - RNA, 23 nt, Salmonella enterica enterica serovar Typhi Ty2
guccaacaaggauauccgccagu

SEQ ID NO: 3708430 - RNA, 20 nt, Salmonella enterica enterica serovar Typhi Ty2
guccaacuggcuuucaucca

SEQ ID NO: 3708431 - RNA, 16 nt, Salmonella enterica enterica serovar Typhi Ty2
guccacauccagcgcc

SEQ ID NO: 3708432 - RNA, 19 nt, Salmonella enterica enterica serovar Typhi Ty2
guccaccgauuucaucgcu

SEQ ID NO: 3708433 - RNA, 19 nt, Salmonella enterica enterica serovar Typhi Ty2
guccacgacaauauccucg

SEQ ID NO: 3708434 - RNA, 13 nt, Salmonella enterica enterica serovar Typhi Ty2
guccacuuucugu

SEQ ID NO: 3708435 - RNA, 21 nt, Salmonella enterica enterica serovar Typhi Ty2
guccagacuccuuuuaccggc

SEQ ID NO: 3708436 - RNA, 19 nt, Salmonella enterica enterica serovar Typhi Ty2
guccagauagggccaggcg

SEQ ID NO: 3708437 - RNA, 20 nt, Salmonella enterica enterica serovar Typhi Ty2
guccagcagacucauggaca

SEQ ID NO: 3708438 - RNA, 16 nt, Salmonella enterica enterica serovar Typhi Ty2
guccagccggugguuc

SEQ ID NO: 3708439 - RNA, 14 nt, Salmonella enterica enterica serovar Typhi Ty2
guccagcggcagcu

SEQ ID NO: 3708440 - RNA, 22 nt, Salmonella enterica enterica serovar Typhi Ty2
guccaggccugauaagcacagg

SEQ ID NO: 3708441 - RNA, 15 nt, Salmonella enterica enterica serovar Typhi Ty2
guccagggaaaaaua

SEQ ID NO: 3708442 - RNA, 15 nt, Salmonella enterica enterica serovar Typhi Ty2
guccagggcaugauu

SEQ ID NO: 3708443 - RNA, 13 nt, Salmonella enterica enterica serovar Typhi Ty2
guccauauucagu

SEQ ID NO: 3708444 - RNA, 14 nt, Salmonella enterica enterica serovar Typhi Ty2
guccauauucaguu

SEQ ID NO: 3708445 - RNA, 15 nt, Salmonella enterica enterica serovar Typhi Ty2
guccaucagauucaa

SEQ ID NO: 3708446 - RNA, 12 nt, Salmonella enterica enterica serovar Typhi Ty2
guccaucaggcu

SEQ ID NO: 3708447 - RNA, 18 nt, Salmonella enterica enterica serovar Typhi Ty2
guccauccgcacgaacgc

SEQ ID NO: 3708448 - RNA, 21 nt, Salmonella enterica enterica serovar Typhi Ty2
guccaugaugaagauauucac

SEQ ID NO: 3708449 - RNA, 20 nt, Salmonella enterica enterica serovar Typhi Ty2
guccaugcccaacaucaguu

SEQ ID NO: 3708450 - RNA, 16 nt, Salmonella enterica enterica serovar Typhi Ty2
guccauugcgagaaaa

SEQ ID NO: 3708451 - RNA, 16 nt, Salmonella enterica enterica serovar Typhi Ty2
guccauuggcggacga

SEQ ID NO: 3708452 - RNA, 18 nt, Salmonella enterica enterica serovar Typhi Ty2
guccauuuauugcaggua

SEQ ID NO: 3708453 - RNA, 24 nt, Salmonella enterica enterica serovar Typhi Ty2
guccauuuauugcagguauugagu

SEQ ID NO: 3708454 - RNA, 14 nt, Salmonella enterica enterica serovar Typhi Ty2
guccauuuuuuauc

SEQ ID NO: 3708455 - RNA, 20 nt, Salmonella enterica enterica serovar Typhi Ty2
gucccaccagcgcggcacac

SEQ ID NO: 3708456 - RNA, 22 nt, Salmonella enterica enterica serovar Typhi Ty2
gucccagccccacauuggaaaa

SEQ ID NO: 3708457 - RNA, 11 nt, Salmonella enterica enterica serovar Typhi Ty2
gucccagccuu

SEQ ID NO: 3708458 - RNA, 12 nt, Salmonella enterica enterica serovar Typhi Ty2
gucccagccuuc

SEQ ID NO: 3708459 - RNA, 15 nt, Salmonella enterica enterica serovar Typhi Ty2
gucccagccuuccug

SEQ ID NO: 3708460 - RNA, 12 nt, Salmonella enterica enterica serovar Typhi Ty2
gucccaggccag

SEQ ID NO: 3708461 - RNA, 16 nt, Salmonella enterica enterica serovar Typhi Ty2
gucccaggccagaugc

SEQ ID NO: 3708462 - RNA, 18 nt, Salmonella enterica enterica serovar Typhi Ty2
guccccauaucccgcgcc

SEQ ID NO: 3708463 - RNA, 17 nt, Salmonella enterica enterica serovar Typhi Ty2
guccccggcgacgugaa

SEQ ID NO: 3708464 - RNA, 15 nt, Salmonella enterica enterica serovar Typhi Ty2
guccccguucugacc

SEQ ID NO: 3708465 - RNA, 15 nt, Salmonella enterica enterica serovar Typhi Ty2
guccccuuuucaccc

SEQ ID NO: 3708466 - RNA, 20 nt, Salmonella enterica enterica serovar Typhi Ty2
gucccgccuuguucaauaga

SEQ ID NO: 3708467 - RNA, 17 nt, Salmonella enterica enterica serovar Typhi Ty2
gucccggcaauacugga

SEQ ID NO: 3708468 - RNA, 18 nt, Salmonella enterica enterica serovar Typhi Ty2
gucccggcagugcauaaa

SEQ ID NO: 3708469 - RNA, 18 nt, Salmonella enterica enterica serovar Typhi Ty2
gucccuccgcuuccacuc

SEQ ID NO: 3708470 - RNA, 14 nt, Salmonella enterica enterica serovar Typhi Ty2
gucccugaagaaaa

SEQ ID NO: 3708471 - RNA, 21 nt, Salmonella enterica enterica serovar Typhi Ty2
gucccuuucccuuccagcgac

SEQ ID NO: 3708472 - RNA, 14 nt, Salmonella enterica enterica serovar Typhi Ty2
guccgacagcaaga

SEQ ID NO: 3708473 - RNA, 14 nt, Salmonella enterica enterica serovar Typhi Ty2
guccgacauuagcg

SEQ ID NO: 3708474 - RNA, 20 nt, Salmonella enterica enterica serovar Typhi Ty2
guccgcaaagacaacgacca

SEQ ID NO: 3708475 - RNA, 16 nt, Salmonella enterica enterica serovar Typhi Ty2
guccgccuuugacgcc

SEQ ID NO: 3708476 - RNA, 22 nt, Salmonella enterica enterica serovar Typhi Ty2
guccgcucacgauaaugaaccu

SEQ ID NO: 3708477 - RNA, 18 nt, Salmonella enterica enterica serovar Typhi Ty2
guccgcuggcguccagcc

SEQ ID NO: 3708478 - RNA, 17 nt, Salmonella enterica enterica serovar Typhi Ty2
guccggagcagcuuagc

SEQ ID NO: 3708479 - RNA, 14 nt, Salmonella enterica enterica serovar Typhi Ty2
guccggauucgcgg

SEQ ID NO: 3708480 - RNA, 16 nt, Salmonella enterica enterica serovar Typhi Ty2
guccggcacgcgcagc

SEQ ID NO: 3708481 - RNA, 17 nt, Salmonella enterica enterica serovar Typhi Ty2
guccggccccaaacugg

SEQ ID NO: 3708482 - RNA, 17 nt, Salmonella enterica enterica serovar Typhi Ty2
guccggcccgcuaucac

SEQ ID NO: 3708483 - RNA, 23 nt, Salmonella enterica enterica serovar Typhi Ty2
guccggcgaacaaacucuuucac

SEQ ID NO: 3708484 - RNA, 15 nt, Salmonella enterica enterica serovar Typhi Ty2
guccgggaaggacgc

SEQ ID NO: 3708485 - RNA, 17 nt, Salmonella enterica enterica serovar Typhi Ty2
guccggguucagcgaca

SEQ ID NO: 3708486 - RNA, 16 nt, Salmonella enterica enterica serovar Typhi Ty2
guccgguccgguggcg

SEQ ID NO: 3708487 - RNA, 14 nt, Salmonella enterica enterica serovar Typhi Ty2
guccgguguccauc

SEQ ID NO: 3708488 - RNA, 22 nt, Salmonella enterica enterica serovar Typhi Ty2
guccguauuauccacccccgca

SEQ ID NO: 3708489 - RNA, 22 nt, Salmonella enterica enterica serovar Typhi Ty2
guccuauugcaacgccgaugcu

SEQ ID NO: 3708490 - RNA, 20 nt, Salmonella enterica enterica serovar Typhi Ty2
guccucacacugauggcaga

SEQ ID NO: 3708491 - RNA, 21 nt, Salmonella enterica enterica serovar Typhi Ty2
guccucacacugauggcagac

SEQ ID NO: 3708492 - RNA, 17 nt, Salmonella enterica enterica serovar Typhi Ty2
guccuccaacgugcaga

SEQ ID NO: 3708493 - RNA, 16 nt, Salmonella enterica enterica serovar Typhi Ty2
guccugaucggcggcc

SEQ ID NO: 3708494 - RNA, 18 nt, Salmonella enterica enterica serovar Typhi Ty2
guccugccgcuacuccgc

SEQ ID NO: 3708495 - RNA, 18 nt, Salmonella enterica enterica serovar Typhi Ty2
guccuucacaaacuucuc

SEQ ID NO: 3708496 - RNA, 21 nt, Salmonella enterica enterica serovar Typhi Ty2
guccuuuaucugcccuuucuu

SEQ ID NO: 3708497 - RNA, 14 nt, Salmonella enterica enterica serovar Typhi Ty2
gucgaacgguaaca

SEQ ID NO: 3708498 - RNA, 22 nt, Salmonella enterica enterica serovar Typhi Ty2
gucgaacugaauagucggcugc

SEQ ID NO: 3708499 - RNA, 23 nt, Salmonella enterica enterica serovar Typhi Ty2
gucgaagagcacuuugguaaaac

SEQ ID NO: 3708500 - RNA, 21 nt, Salmonella enterica enterica serovar Typhi Ty2
gucgacauaauuuccggccag

SEQ ID NO: 3708501 - RNA, 14 nt, Salmonella enterica enterica serovar Typhi Ty2
gucgacaugcgcau

SEQ ID NO: 3708502 - RNA, 20 nt, Salmonella enterica enterica serovar Typhi Ty2
gucgaccaguccuuccgccg

SEQ ID NO: 3708503 - RNA, 19 nt, Salmonella enterica enterica serovar Typhi Ty2
gucgaccgcagaccggaug

SEQ ID NO: 3708504 - RNA, 17 nt, Salmonella enterica enterica serovar Typhi Ty2
gucgacgccuuccacuu

SEQ ID NO: 3708505 - RNA, 16 nt, Salmonella enterica enterica serovar Typhi Ty2
gucgacgucuuucuua

SEQ ID NO: 3708506 - RNA, 21 nt, Salmonella enterica enterica serovar Typhi Ty2
gucgagaaaccgcucgccgcc

SEQ ID NO: 3708507 - RNA, 18 nt, Salmonella enterica enterica serovar Typhi Ty2
gucgagcucaguccagcc

SEQ ID NO: 3708508 - RNA, 23 nt, Salmonella enterica enterica serovar Typhi Ty2
gucgauacucacgacuuucacca

SEQ ID NO: 3708509 - RNA, 15 nt, Salmonella enterica enterica serovar Typhi Ty2
gucgaucucggccac

SEQ ID NO: 3708510 - RNA, 15 nt, Salmonella enterica enterica serovar Typhi Ty2
gucgaugauuuucaa

SEQ ID NO: 3708511 - RNA, 17 nt, Salmonella enterica enterica serovar Typhi Ty2
gucgaugauuuucaagc

SEQ ID NO: 3708512 - RNA, 21 nt, Salmonella enterica enterica serovar Typhi Ty2
gucgauuuccgguuccagcgg

SEQ ID NO: 3708513 - RNA, 17 nt, Salmonella enterica enterica serovar Typhi Ty2
gucgcaagacgaaaaau

SEQ ID NO: 3708514 - RNA, 18 nt, Salmonella enterica enterica serovar Typhi Ty2
gucgcaaucuggcgcaau

SEQ ID NO: 3708515 - RNA, 22 nt, Salmonella enterica enterica serovar Typhi Ty2
gucgcagccacccuggcauaug

SEQ ID NO: 3708516 - RNA, 15 nt, Salmonella enterica enterica serovar Typhi Ty2
gucgcagcggcugcg

SEQ ID NO: 3708517 - RNA, 17 nt, Salmonella enterica enterica serovar Typhi Ty2
gucgcauacuuccucac

SEQ ID NO: 3708518 - RNA, 16 nt, Salmonella enterica enterica serovar Typhi Ty2
gucgccaagcugugga

SEQ ID NO: 3708519 - RNA, 23 nt, Salmonella enterica enterica serovar Typhi Ty2
gucgccagacccagcgcuaacgg

SEQ ID NO: 3708520 - RNA, 21 nt, Salmonella enterica enterica serovar Typhi Ty2
gucgccauauccaagccccuc

SEQ ID NO: 3708521 - RNA, 19 nt, Salmonella enterica enterica serovar Typhi Ty2
gucgccauauguuccaccg

SEQ ID NO: 3708522 - RNA, 15 nt, Salmonella enterica enterica serovar Typhi Ty2
gucgccgcccaucgg

SEQ ID NO: 3708523 - RNA, 22 nt, Salmonella enterica enterica serovar Typhi Ty2
gucgccgccgggcaguacgcac

SEQ ID NO: 3708524 - RNA, 11 nt, Salmonella enterica enterica serovar Typhi Ty2
gucgccgccgu

SEQ ID NO: 3708525 - RNA, 15 nt, Salmonella enterica enterica serovar Typhi Ty2
gucgccgcgcccagc

SEQ ID NO: 3708526 - RNA, 12 nt, Salmonella enterica enterica serovar Typhi Ty2
gucgccggccug

SEQ ID NO: 3708527 - RNA, 18 nt, Salmonella enterica enterica serovar Typhi Ty2
gucgccggggcgcuggcg

SEQ ID NO: 3708528 - RNA, 14 nt, Salmonella enterica enterica serovar Typhi Ty2
gucgccuuccagcg

SEQ ID NO: 3708529 - RNA, 20 nt, Salmonella enterica enterica serovar Typhi Ty2
gucgcgccauguugcguaaa

SEQ ID NO: 3708530 - RNA, 13 nt, Salmonella enterica enterica serovar Typhi Ty2
gucgcgcgcgcca

SEQ ID NO: 3708531 - RNA, 14 nt, Salmonella enterica enterica serovar Typhi Ty2
gucgcggcuuucag

SEQ ID NO: 3708532 - RNA, 15 nt, Salmonella enterica enterica serovar Typhi Ty2
gucgcggcuuucagc

SEQ ID NO: 3708533 - RNA, 16 nt, Salmonella enterica enterica serovar Typhi Ty2
gucgcguucagcgccu

SEQ ID NO: 3708534 - RNA, 21 nt, Salmonella enterica enterica serovar Typhi Ty2
gucgcuaaaacccaccaccuc

SEQ ID NO: 3708535 - RNA, 17 nt, Salmonella enterica enterica serovar Typhi Ty2
gucgcuauccagcagua

SEQ ID NO: 3708536 - RNA, 14 nt, Salmonella enterica enterica serovar Typhi Ty2
gucgcuccggaacg

SEQ ID NO: 3708537 - RNA, 15 nt, Salmonella enterica enterica serovar Typhi Ty2
gucgcuggcggaauc

SEQ ID NO: 3708538 - RNA, 18 nt, Salmonella enterica enterica serovar Typhi Ty2
gucgcuucgcuuaucugg

SEQ ID NO: 3708539 - RNA, 23 nt, Salmonella enterica enterica serovar Typhi Ty2
gucggaaaucuguuccagcgagc

SEQ ID NO: 3708540 - RNA, 17 nt, Salmonella enterica enterica serovar Typhi Ty2
gucggcaaucaccugca

SEQ ID NO: 3708541 - RNA, 23 nt, Salmonella enterica enterica serovar Typhi Ty2
gucggcaauuaacauuucacgau

SEQ ID NO: 3708542 - RNA, 15 nt, Salmonella enterica enterica serovar Typhi Ty2
gucggcagcaccgga

SEQ ID NO: 3708543 - RNA, 20 nt, Salmonella enterica enterica serovar Typhi Ty2
gucggcaucgugaaacucac

SEQ ID NO: 3708544 - RNA, 17 nt, Salmonella enterica enterica serovar Typhi Ty2
gucggccaggugccgag

SEQ ID NO: 3708545 - RNA, 19 nt, Salmonella enterica enterica serovar Typhi Ty2
gucggcgccaucaugcagc

SEQ ID NO: 3708546 - RNA, 22 nt, Salmonella enterica enterica serovar Typhi Ty2
gucggcgccggcgucgaucagc

SEQ ID NO: 3708547 - RNA, 20 nt, Salmonella enterica enterica serovar Typhi Ty2
gucggcgucugcgcgcuggu

SEQ ID NO: 3708548 - RNA, 21 nt, Salmonella enterica enterica serovar Typhi Ty2
gucggcuuacgccuuauccgg

SEQ ID NO: 3708549 - RNA, 20 nt, Salmonella enterica enterica serovar Typhi Ty2
gucgggaaagggcggcagcg

SEQ ID NO: 3708550 - RNA, 15 nt, Salmonella enterica enterica serovar Typhi Ty2
gucgggaacgcuguc

SEQ ID NO: 3708551 - RNA, 23 nt, Salmonella enterica enterica serovar Typhi Ty2
gucgggaagagagaaaaucggcg

SEQ ID NO: 3708552 - RNA, 22 nt, Salmonella enterica enterica serovar Typhi Ty2
gucgggauaagcgaugcgcgga

SEQ ID NO: 3708553 - RNA, 15 nt, Salmonella enterica enterica serovar Typhi Ty2
gucgggccaaucgga

SEQ ID NO: 3708554 - RNA, 17 nt, Salmonella enterica enterica serovar Typhi Ty2
gucgggccgcgcugcgc

SEQ ID NO: 3708555 - RNA, 15 nt, Salmonella enterica enterica serovar Typhi Ty2
gucggguucgcgcgc

SEQ ID NO: 3708556 - RNA, 23 nt, Salmonella enterica enterica serovar Typhi Ty2
gucggguucgcgcgccgcuuccg

SEQ ID NO: 3708557 - RNA, 15 nt, Salmonella enterica enterica serovar Typhi Ty2
gucggucugauaagc

SEQ ID NO: 3708558 - RNA, 19 nt, Salmonella enterica enterica serovar Typhi Ty2
gucguacucaccaguccgg

SEQ ID NO: 3708559 - RNA, 22 nt, Salmonella enterica enterica serovar Typhi Ty2
gucguauccccagucuuccugc

SEQ ID NO: 3708560 - RNA, 17 nt, Salmonella enterica enterica serovar Typhi Ty2
gucguauuuauuuucug

SEQ ID NO: 3708561 - RNA, 14 nt, Salmonella enterica enterica serovar Typhi Ty2
gucgucauggcgua

SEQ ID NO: 3708562 - RNA, 21 nt, Salmonella enterica enterica serovar Typhi Ty2
gucgucauuugaaucugcggu

SEQ ID NO: 3708563 - RNA, 14 nt, Salmonella enterica enterica serovar Typhi Ty2
gucgucgaucgcgc

SEQ ID NO: 3708564 - RNA, 22 nt, Salmonella enterica enterica serovar Typhi Ty2
gucuuugcguuuacuuacaaau

SEQ ID NO: 3708565 - RNA, 18 nt, Salmonella enterica enterica serovar Typhi Ty2
gucuuuguugguauucau

SEQ ID NO: 3708566 - RNA, 21 nt, Salmonella enterica enterica serovar Typhi Ty2
gucuuuugaauaguaacuggc

SEQ ID NO: 3708567 - RNA, 22 nt, Salmonella enterica enterica serovar Typhi Ty2
gugaaaaaauaucgcugcccag

SEQ ID NO: 3708568 - RNA, 23 nt, Salmonella enterica enterica serovar Typhi Ty2
gugaaaaagcggcuguagccagc

SEQ ID NO: 3708569 - RNA, 20 nt, Salmonella enterica enterica serovar Typhi Ty2
gugaaaagcgggggcgacag

SEQ ID NO: 3708570 - RNA, 14 nt, Salmonella enterica enterica serovar Typhi Ty2
gugaaaagcuuaga

SEQ ID NO: 3708571 - RNA, 17 nt, Salmonella enterica enterica serovar Typhi Ty2
gugaaaccggcgcgccu

SEQ ID NO: 3708572 - RNA, 14 nt, Salmonella enterica enterica serovar Typhi Ty2
gugaaacuguuuua

SEQ ID NO: 3708573 - RNA, 17 nt, Salmonella enterica enterica serovar Typhi Ty2
gugaaagcgcuugauaa

SEQ ID NO: 3708574 - RNA, 11 nt, Salmonella enterica enterica serovar Typhi Ty2
gugaaauaaau

SEQ ID NO: 3708575 - RNA, 22 nt, Salmonella enterica enterica serovar Typhi Ty2
gugaaaugguugcguuucggca

SEQ ID NO: 3708576 - RNA, 20 nt, Salmonella enterica enterica serovar Typhi Ty2
gugaacaaaggcagccaaca

SEQ ID NO: 3708577 - RNA, 19 nt, Salmonella enterica enterica serovar Typhi Ty2
gugaacauuacaauguaca

SEQ ID NO: 3708578 - RNA, 21 nt, Salmonella enterica enterica serovar Typhi Ty2
gugaaccagcaucccacgaau

SEQ ID NO: 3708579 - RNA, 12 nt, Salmonella enterica enterica serovar Typhi Ty2
gugaaccauggc

SEQ ID NO: 3708580 - RNA, 17 nt, Salmonella enterica enterica serovar Typhi Ty2
gugaacgccuccauuuu

SEQ ID NO: 3708581 - RNA, 19 nt, Salmonella enterica enterica serovar Typhi Ty2
gugaacgccuuauccggcc

SEQ ID NO: 3708582 - RNA, 17 nt, Salmonella enterica enterica serovar Typhi Ty2
gugaacgguugagcuuu

SEQ ID NO: 3708583 - RNA, 19 nt, Salmonella enterica enterica serovar Typhi Ty2
gugaagacacaacgugcca

SEQ ID NO: 3708584 - RNA, 15 nt, Salmonella enterica enterica serovar Typhi Ty2
gugaagauuagcaga

SEQ ID NO: 3708585 - RNA, 12 nt, Salmonella enterica enterica serovar Typhi Ty2
gugaaggcaaaa

SEQ ID NO: 3708586 - RNA, 17 nt, Salmonella enterica enterica serovar Typhi Ty2
gugaaggcaaaacacca

SEQ ID NO: 3708587 - RNA, 21 nt, Salmonella enterica enterica serovar Typhi Ty2
gugaaggcaaaacaccauauu

SEQ ID NO: 3708588 - RNA, 13 nt, Salmonella enterica enterica serovar Typhi Ty2
gugaauaaauccu

SEQ ID NO: 3708589 - RNA, 16 nt, Salmonella enterica enterica serovar Typhi Ty2
gugaauaccaaagccc

SEQ ID NO: 3708590 - RNA, 16 nt, Salmonella enterica enterica serovar Typhi Ty2
gugaauaccagcggca

SEQ ID NO: 3708591 - RNA, 17 nt, Salmonella enterica enterica serovar Typhi Ty2
gugaauagguauguagu

SEQ ID NO: 3708592 - RNA, 18 nt, Salmonella enterica enterica serovar Typhi Ty2
gugaauagguauguagua

SEQ ID NO: 3708593 - RNA, 18 nt, Salmonella enterica enterica serovar Typhi Ty2
gugaauaugaucugcaca

SEQ ID NO: 3708594 - RNA, 21 nt, Salmonella enterica enterica serovar Typhi Ty2
gugaauaugaucugcacaaca

SEQ ID NO: 3708595 - RNA, 21 nt, Salmonella enterica enterica serovar Typhi Ty2
gugaauaugaucugcgcaaca

SEQ ID NO: 3708596 - RNA, 13 nt, Salmonella enterica enterica serovar Typhi Ty2
gugaauauucaga

SEQ ID NO: 3708597 - RNA, 16 nt, Salmonella enterica enterica serovar Typhi Ty2
gugaaucagauaacug

SEQ ID NO: 3708598 - RNA, 21 nt, Salmonella enterica enterica serovar Typhi Ty2
gugaaucaucaucauccgcgc

SEQ ID NO: 3708599 - RNA, 12 nt, Salmonella enterica enterica serovar Typhi Ty2
gugaauccaggc

SEQ ID NO: 3708600 - RNA, 19 nt, Salmonella enterica enterica serovar Typhi Ty2
gugaaucgacggcaauauu

SEQ ID NO: 3708601 - RNA, 17 nt, Salmonella enterica enterica serovar Typhi Ty2
gugaaugcacuguuucu

SEQ ID NO: 3708602 - RNA, 14 nt, Salmonella enterica enterica serovar Typhi Ty2
gugaauguccugcg

SEQ ID NO: 3708603 - RNA, 20 nt, Salmonella enterica enterica serovar Typhi Ty2
gugacauuuaucuuccggca

SEQ ID NO: 3708604 - RNA, 19 nt, Salmonella enterica enterica serovar Typhi Ty2
gugaccacgguuaucuggc

SEQ ID NO: 3708605 - RNA, 20 nt, Salmonella enterica enterica serovar Typhi Ty2
gugaccccggccucgcccgc

SEQ ID NO: 3708606 - RNA, 15 nt, Salmonella enterica enterica serovar Typhi Ty2
gugacccgccgccag

SEQ ID NO: 3708607 - RNA, 16 nt, Salmonella enterica enterica serovar Typhi Ty2
gugacccgccgccagc

SEQ ID NO: 3708608 - RNA, 18 nt, Salmonella enterica enterica serovar Typhi Ty2
gugacccgccgccagcac

SEQ ID NO: 3708609 - RNA, 19 nt, Salmonella enterica enterica serovar Typhi Ty2
gugacccgccgccagcacc

SEQ ID NO: 3708610 - RNA, 14 nt, Salmonella enterica enterica serovar Typhi Ty2
gugaccgauaaaaa

SEQ ID NO: 3708611 - RNA, 17 nt, Salmonella enterica enterica serovar Typhi Ty2
gugaccgccuuaaaauu

SEQ ID NO: 3708612 - RNA, 12 nt, Salmonella enterica enterica serovar Typhi Ty2
gugaccugcuga

SEQ ID NO: 3708613 - RNA, 17 nt, Salmonella enterica enterica serovar Typhi Ty2
gugaccuuucaacggau

SEQ ID NO: 3708614 - RNA, 21 nt, Salmonella enterica enterica serovar Typhi Ty2
gugacgaagaucgcguacagc

SEQ ID NO: 3708615 - RNA, 13 nt, Salmonella enterica enterica serovar Typhi Ty2
gugacgaccggca

SEQ ID NO: 3708616 - RNA, 16 nt, Salmonella enterica enterica serovar Typhi Ty2
gugacgcaggccgggu

SEQ ID NO: 3708617 - RNA, 20 nt, Salmonella enterica enterica serovar Typhi Ty2
gugacgccaugcaaaaaaga

SEQ ID NO: 3708618 - RNA, 19 nt, Salmonella enterica enterica serovar Typhi Ty2
gugacggaggucauuccug

SEQ ID NO: 3708619 - RNA, 22 nt, Salmonella enterica enterica serovar Typhi Ty2
gugacggcggaaauuagcccgc

SEQ ID NO: 3708620 - RNA, 22 nt, Salmonella enterica enterica serovar Typhi Ty2
gugacgguaucgugacgcgaau

SEQ ID NO: 3708621 - RNA, 18 nt, Salmonella enterica enterica serovar Typhi Ty2
gugacgucaagaucgcgc

SEQ ID NO: 3708622 - RNA, 23 nt, Salmonella enterica enterica serovar Typhi Ty2
gugacgucaagaucgcgcagcag

SEQ ID NO: 3708623 - RNA, 16 nt, Salmonella enterica enterica serovar Typhi Ty2
gugacuaaaagacgcc

SEQ ID NO: 3708624 - RNA, 18 nt, Salmonella enterica enterica serovar Typhi Ty2
gugacuaauagccaaaag

SEQ ID NO: 3708625 - RNA, 15 nt, Salmonella enterica enterica serovar Typhi Ty2
gugacuuugcccuuu

SEQ ID NO: 3708626 - RNA, 15 nt, Salmonella enterica enterica serovar Typhi Ty2
gugagaaacgcgcca

SEQ ID NO: 3708627 - RNA, 21 nt, Salmonella enterica enterica serovar Typhi Ty2
gugagacgcagccucucuucu

SEQ ID NO: 3708628 - RNA, 23 nt, Salmonella enterica enterica serovar Typhi Ty2
gugagaucguuauuaaacagaca

SEQ ID NO: 3708629 - RNA, 18 nt, Salmonella enterica enterica serovar Typhi Ty2
gugagccaaugaccauua

SEQ ID NO: 3708630 - RNA, 23 nt, Salmonella enterica enterica serovar Typhi Ty2
gugagcccuccuccagcgcgucc

SEQ ID NO: 3708631 - RNA, 15 nt, Salmonella enterica enterica serovar Typhi Ty2
gugagccuaaaacau

SEQ ID NO: 3708632 - RNA, 14 nt, Salmonella enterica enterica serovar Typhi Ty2
gugagcgaacaggu

SEQ ID NO: 3708633 - RNA, 16 nt, Salmonella enterica enterica serovar Typhi Ty2
gugaggagcuuuagcu

SEQ ID NO: 3708634 - RNA, 20 nt, Salmonella enterica enterica serovar Typhi Ty2
gugaggagcuuuagcuccga

SEQ ID NO: 3708635 - RNA, 21 nt, Salmonella enterica enterica serovar Typhi Ty2
gugaggcagauaugcgggcuc

SEQ ID NO: 3708636 - RNA, 21 nt, Salmonella enterica enterica serovar Typhi Ty2
gugaggcaucgcccuguaaga

SEQ ID NO: 3708637 - RNA, 16 nt, Salmonella enterica enterica serovar Typhi Ty2
gugaguaaagagauca

SEQ ID NO: 3708638 - RNA, 18 nt, Salmonella enterica enterica serovar Typhi Ty2
gugaguaacgggcagcgg

SEQ ID NO: 3708639 - RNA, 15 nt, Salmonella enterica enterica serovar Typhi Ty2
gugaguacgcaggag

SEQ ID NO: 3708640 - RNA, 19 nt, Salmonella enterica enterica serovar Typhi Ty2
gugaguguuacucuuccuc

SEQ ID NO: 3708641 - RNA, 16 nt, Salmonella enterica enterica serovar Typhi Ty2
gugauaaagcagacca

SEQ ID NO: 3708642 - RNA, 18 nt, Salmonella enterica enterica serovar Typhi Ty2
gugauaaauacgcugcgg

SEQ ID NO: 3708643 - RNA, 22 nt, Salmonella enterica enterica serovar Typhi Ty2
gugauaaauacgcugcggccug

SEQ ID NO: 3708644 - RNA, 19 nt, Salmonella enterica enterica serovar Typhi Ty2
gugauaagccccuuuacgc

SEQ ID NO: 3708645 - RNA, 12 nt, Salmonella enterica enterica serovar Typhi Ty2
gugauaauagug

SEQ ID NO: 3708646 - RNA, 14 nt, Salmonella enterica enterica serovar Typhi Ty2
gugcguucauggcg

SEQ ID NO: 3708647 - RNA, 13 nt, Salmonella enterica enterica serovar Typhi Ty2
gugcguucugccg

SEQ ID NO: 3708648 - RNA, 13 nt, Salmonella enterica enterica serovar Typhi Ty2
gugcguucuucca

SEQ ID NO: 3708649 - RNA, 14 nt, Salmonella enterica enterica serovar Typhi Ty2
gugcguucuuccac

SEQ ID NO: 3708650 - RNA, 22 nt, Salmonella enterica enterica serovar Typhi Ty2
gugcuaaguucucguucaacgg

SEQ ID NO: 3708651 - RNA, 18 nt, Salmonella enterica enterica serovar Typhi Ty2
gugcuaucaggccuacaa

SEQ ID NO: 3708652 - RNA, 16 nt, Salmonella enterica enterica serovar Typhi Ty2
gugcucagccccuggg

SEQ ID NO: 3708653 - RNA, 18 nt, Salmonella enterica enterica serovar Typhi Ty2
gugcucauuugcggcguc

SEQ ID NO: 3708654 - RNA, 20 nt, Salmonella enterica enterica serovar Typhi Ty2
gugcucgaaauccucacggu

SEQ ID NO: 3708655 - RNA, 19 nt, Salmonella enterica enterica serovar Typhi Ty2
gugcugccacaucgccagc

SEQ ID NO: 3708656 - RNA, 17 nt, Salmonella enterica enterica serovar Typhi Ty2
gugcugcgcaaauacgu

SEQ ID NO: 3708657 - RNA, 23 nt, Salmonella enterica enterica serovar Typhi Ty2
gugcuggcggaaguagccuccgg

SEQ ID NO: 3708658 - RNA, 14 nt, Salmonella enterica enterica serovar Typhi Ty2
gugcuggcggccgu

SEQ ID NO: 3708659 - RNA, 13 nt, Salmonella enterica enterica serovar Typhi Ty2
gugcugguggugg

SEQ ID NO: 3708660 - RNA, 18 nt, Salmonella enterica enterica serovar Typhi Ty2
gugcuuauggguuuccuc

SEQ ID NO: 3708661 - RNA, 13 nt, Salmonella enterica enterica serovar Typhi Ty2
gugcuuccagcuc

SEQ ID NO: 3708662 - RNA, 14 nt, Salmonella enterica enterica serovar Typhi Ty2
gugcuuccagcucc

SEQ ID NO: 3708663 - RNA, 15 nt, Salmonella enterica enterica serovar Typhi Ty2
gugcuuccagcucca

SEQ ID NO: 3708664 - RNA, 16 nt, Salmonella enterica enterica serovar Typhi Ty2
gugcuugagcugcggu

SEQ ID NO: 3708665 - RNA, 19 nt, Salmonella enterica enterica serovar Typhi Ty2
gugcuugagcugcgguggu

SEQ ID NO: 3708666 - RNA, 17 nt, Salmonella enterica enterica serovar Typhi Ty2
gugcuugcguuucuaga

SEQ ID NO: 3708667 - RNA, 14 nt, Salmonella enterica enterica serovar Typhi Ty2
guggaaaacagcau

SEQ ID NO: 3708668 - RNA, 16 nt, Salmonella enterica enterica serovar Typhi Ty2
guggaaaacagcgccg

SEQ ID NO: 3708669 - RNA, 13 nt, Salmonella enterica enterica serovar Typhi Ty2
guggaaggcauua

SEQ ID NO: 3708670 - RNA, 13 nt, Salmonella enterica enterica serovar Typhi Ty2
guggaaucagcca

SEQ ID NO: 3708671 - RNA, 15 nt, Salmonella enterica enterica serovar Typhi Ty2
guggaaucagccagg

SEQ ID NO: 3708672 - RNA, 23 nt, Salmonella enterica enterica serovar Typhi Ty2
guggacaaucaggcugcggauga

SEQ ID NO: 3708673 - RNA, 14 nt, Salmonella enterica enterica serovar Typhi Ty2
guggacaucgccau

SEQ ID NO: 3708674 - RNA, 22 nt, Salmonella enterica enterica serovar Typhi Ty2
guggagaggccaccagcgccag

SEQ ID NO: 3708675 - RNA, 18 nt, Salmonella enterica enterica serovar Typhi Ty2
guggagggguauuuaucc

SEQ ID NO: 3708676 - RNA, 19 nt, Salmonella enterica enterica serovar Typhi Ty2
guggaucucgucgccggug

SEQ ID NO: 3708677 - RNA, 14 nt, Salmonella enterica enterica serovar Typhi Ty2
guggcaaaauccaa

SEQ ID NO: 3708678 - RNA, 15 nt, Salmonella enterica enterica serovar Typhi Ty2
guggcaaaauccaac

SEQ ID NO: 3708679 - RNA, 14 nt, Salmonella enterica enterica serovar Typhi Ty2
guggcaaucagcaa

SEQ ID NO: 3708680 - RNA, 18 nt, Salmonella enterica enterica serovar Typhi Ty2
guggcaucuuaucaggcc

SEQ ID NO: 3708681 - RNA, 18 nt, Salmonella enterica enterica serovar Typhi Ty2
guggccaaaaaaucgcug

SEQ ID NO: 3708682 - RNA, 15 nt, Salmonella enterica enterica serovar Typhi Ty2
guggccaucuuccag

SEQ ID NO: 3708683 - RNA, 16 nt, Salmonella enterica enterica serovar Typhi Ty2
guggcccagcgcggug

SEQ ID NO: 3708684 - RNA, 18 nt, Salmonella enterica enterica serovar Typhi Ty2
guggcccagcgcgguggc

SEQ ID NO: 3708685 - RNA, 22 nt, Salmonella enterica enterica serovar Typhi Ty2
guggccgagaguccagcgccag

SEQ ID NO: 3708686 - RNA, 12 nt, Salmonella enterica enterica serovar Typhi Ty2
guggccguggug

SEQ ID NO: 3708687 - RNA, 17 nt, Salmonella enterica enterica serovar Typhi Ty2
guggccugcagagcggc

SEQ ID NO: 3708688 - RNA, 20 nt, Salmonella enterica enterica serovar Typhi Ty2
guggcgaauacuguuccagg

SEQ ID NO: 3708689 - RNA, 22 nt, Salmonella enterica enterica serovar Typhi Ty2
guggcgacgccuauucucgccg

SEQ ID NO: 3708690 - RNA, 20 nt, Salmonella enterica enterica serovar Typhi Ty2
guggcgacgcguggcaucuu

SEQ ID NO: 3708691 - RNA, 22 nt, Salmonella enterica enterica serovar Typhi Ty2
guggcgaucaguggcgccgcaa

SEQ ID NO: 3708692 - RNA, 18 nt, Salmonella enterica enterica serovar Typhi Ty2
guggcgcaaccgauagcu

SEQ ID NO: 3708693 - RNA, 21 nt, Salmonella enterica enterica serovar Typhi Ty2
guggcgcuguucuugcugcug

SEQ ID NO: 3708694 - RNA, 23 nt, Salmonella enterica enterica serovar Typhi Ty2
guggcgcuuuccggcgcuuccug

SEQ ID NO: 3708695 - RNA, 17 nt, Salmonella enterica enterica serovar Typhi Ty2
guggcggaaaugcgcgg

SEQ ID NO: 3708696 - RNA, 19 nt, Salmonella enterica enterica serovar Typhi Ty2
guggcggaaaugcgcggug

SEQ ID NO: 3708697 - RNA, 21 nt, Salmonella enterica enterica serovar Typhi Ty2
guggcggcuacgccuuacccg

SEQ ID NO: 3708698 - RNA, 14 nt, Salmonella enterica enterica serovar Typhi Ty2
guggcgucggcugu

SEQ ID NO: 3708699 - RNA, 16 nt, Salmonella enterica enterica serovar Typhi Ty2
guggcuaucggccuga

SEQ ID NO: 3708700 - RNA, 20 nt, Salmonella enterica enterica serovar Typhi Ty2
guggcugaggccgcucgcca

SEQ ID NO: 3708701 - RNA, 21 nt, Salmonella enterica enterica serovar Typhi Ty2
guggcugaggccgcucgccau

SEQ ID NO: 3708702 - RNA, 12 nt, Salmonella enterica enterica serovar Typhi Ty2
gugggccguucc

SEQ ID NO: 3708703 - RNA, 16 nt, Salmonella enterica enterica serovar Typhi Ty2
gugggcggcaccagcg

SEQ ID NO: 3708704 - RNA, 17 nt, Salmonella enterica enterica serovar Typhi Ty2
gugggcgugucgccggg

SEQ ID NO: 3708705 - RNA, 14 nt, Salmonella enterica enterica serovar Typhi Ty2
guggguaaauccgc

SEQ ID NO: 3708706 - RNA, 17 nt, Salmonella enterica enterica serovar Typhi Ty2
gugguacaccaguacau

SEQ ID NO: 3708707 - RNA, 17 nt, Salmonella enterica enterica serovar Typhi Ty2
guggucaggcgaccaau

SEQ ID NO: 3708708 - RNA, 22 nt, Salmonella enterica enterica serovar Typhi Ty2
guggucgacauauucaugguuc

SEQ ID NO: 3708709 - RNA, 14 nt, Salmonella enterica enterica serovar Typhi Ty2
guggucgcggcuca

SEQ ID NO: 3708710 - RNA, 16 nt, Salmonella enterica enterica serovar Typhi Ty2
guggugagcucaucca

SEQ ID NO: 3708711 - RNA, 23 nt, Salmonella enterica enterica serovar Typhi Ty2
guggugcaagcaccuuauccggc

SEQ ID NO: 3708712 - RNA, 13 nt, Salmonella enterica enterica serovar Typhi Ty2
guggugccguuac

SEQ ID NO: 3708713 - RNA, 15 nt, Salmonella enterica enterica serovar Typhi Ty2
gugguggucaacguu

SEQ ID NO: 3708714 - RNA, 21 nt, Salmonella enterica enterica serovar Typhi Ty2
gugguggucauccgcccggca

SEQ ID NO: 3708715 - RNA, 21 nt, Salmonella enterica enterica serovar Typhi Ty2
guggugucucgucgccagggc

SEQ ID NO: 3708716 - RNA, 12 nt, Salmonella enterica enterica serovar Typhi Ty2
guggugugccug

SEQ ID NO: 3708717 - RNA, 17 nt, Salmonella enterica enterica serovar Typhi Ty2
gugguuaacagcgcagg

SEQ ID NO: 3708718 - RNA, 15 nt, Salmonella enterica enterica serovar Typhi Ty2
gugguucgccaucca

SEQ ID NO: 3708719 - RNA, 13 nt, Salmonella enterica enterica serovar Typhi Ty2
gugguuuauccgc

SEQ ID NO: 3708720 - RNA, 16 nt, Salmonella enterica enterica serovar Typhi Ty2
gugguuuccggcagcu

SEQ ID NO: 3708721 - RNA, 14 nt, Salmonella enterica enterica serovar Typhi Ty2
gugguuucuuuuaa

SEQ ID NO: 3708722 - RNA, 13 nt, Salmonella enterica enterica serovar Typhi Ty2
guguaaaaauuuu

SEQ ID NO: 3708723 - RNA, 14 nt, Salmonella enterica enterica serovar Typhi Ty2
guguaaaaauuuuu

SEQ ID NO: 3708724 - RNA, 14 nt, Salmonella enterica enterica serovar Typhi Ty2
guguaaaagccagc

SEQ ID NO: 3708725 - RNA, 12 nt, Salmonella enterica enterica serovar Typhi Ty2
guguaacagcaa

SEQ ID NO: 3708726 - RNA, 23 nt, Salmonella enterica enterica serovar Typhi Ty2
guguaaccaccugggugagcguc

SEQ ID NO: 3708727 - RNA, 17 nt, Salmonella enterica enterica serovar Typhi Ty2
guguaaggcuuccggca

SEQ ID NO: 3708728 - RNA, 17 nt, Salmonella enterica enterica serovar Typhi Ty2
guuacucuucugaccau

SEQ ID NO: 3708729 - RNA, 18 nt, Salmonella enterica enterica serovar Typhi Ty2
guuacuggccuucuuucu

SEQ ID NO: 3708730 - RNA, 21 nt, Salmonella enterica enterica serovar Typhi Ty2
guuagaaaauacugcuagaac

SEQ ID NO: 3708731 - RNA, 20 nt, Salmonella enterica enterica serovar Typhi Ty2
guuagauuagguacguacau

SEQ ID NO: 3708732 - RNA, 15 nt, Salmonella enterica enterica serovar Typhi Ty2
guuagcaaaaaugcc

SEQ ID NO: 3708733 - RNA, 12 nt, Salmonella enterica enterica serovar Typhi Ty2
guuagccccuua

SEQ ID NO: 3708734 - RNA, 20 nt, Salmonella enterica enterica serovar Typhi Ty2
guuagccggaagauccuguu

SEQ ID NO: 3708735 - RNA, 23 nt, Salmonella enterica enterica serovar Typhi Ty2
guuagcgagguucccgccgccau

SEQ ID NO: 3708736 - RNA, 17 nt, Salmonella enterica enterica serovar Typhi Ty2
guuagcgccauccggca

SEQ ID NO: 3708737 - RNA, 16 nt, Salmonella enterica enterica serovar Typhi Ty2
guuagcgucaguaaac

SEQ ID NO: 3708738 - RNA, 19 nt, Salmonella enterica enterica serovar Typhi Ty2
guuagcgucauccggcaua

SEQ ID NO: 3708739 - RNA, 13 nt, Salmonella enterica enterica serovar Typhi Ty2
guuagcucuuuca

SEQ ID NO: 3708740 - RNA, 17 nt, Salmonella enterica enterica serovar Typhi Ty2
guuagggcgcggcuggu

SEQ ID NO: 3708741 - RNA, 21 nt, Salmonella enterica enterica serovar Typhi Ty2
guuagggcgcggcugguaaga

SEQ ID NO: 3708742 - RNA, 19 nt, Salmonella enterica enterica serovar Typhi Ty2
guuaggguagaaaaaggua

SEQ ID NO: 3708743 - RNA, 14 nt, Salmonella enterica enterica serovar Typhi Ty2
guuaguaguagcug

SEQ ID NO: 3708744 - RNA, 21 nt, Salmonella enterica enterica serovar Typhi Ty2
guuauaaauccccgccgccau

SEQ ID NO: 3708745 - RNA, 22 nt, Salmonella enterica enterica serovar Typhi Ty2
guuauaaccgaugcagccugga

SEQ ID NO: 3708746 - RNA, 14 nt, Salmonella enterica enterica serovar Typhi Ty2
guuauacagugcca

SEQ ID NO: 3708747 - RNA, 21 nt, Salmonella enterica enterica serovar Typhi Ty2
guuauagacgccggucaugcc

SEQ ID NO: 3708748 - RNA, 23 nt, Salmonella enterica enterica serovar Typhi Ty2
guuauaucuccccuucagaguga

SEQ ID NO: 3708749 - RNA, 14 nt, Salmonella enterica enterica serovar Typhi Ty2
guuauaugaauaaa

SEQ ID NO: 3708750 - RNA, 15 nt, Salmonella enterica enterica serovar Typhi Ty2
guuauauuacuggcu

SEQ ID NO: 3708751 - RNA, 14 nt, Salmonella enterica enterica serovar Typhi Ty2
guuaucccugcuga

SEQ ID NO: 3708752 - RNA, 18 nt, Salmonella enterica enterica serovar Typhi Ty2
guuaucgaggcgcuggcg

SEQ ID NO: 3708753 - RNA, 16 nt, Salmonella enterica enterica serovar Typhi Ty2
guuaucgccgaucaca

SEQ ID NO: 3708754 - RNA, 20 nt, Salmonella enterica enterica serovar Typhi Ty2
guuaucucgccaggaaccgc

SEQ ID NO: 3708755 - RNA, 15 nt, Salmonella enterica enterica serovar Typhi Ty2
guuaucugaccuaca

SEQ ID NO: 3708756 - RNA, 21 nt, Salmonella enterica enterica serovar Typhi Ty2
guuaugcaaguucgaauagcc

SEQ ID NO: 3708757 - RNA, 21 nt, Salmonella enterica enterica serovar Typhi Ty2
guuaugccaucuaacacaaau

SEQ ID NO: 3708758 - RNA, 20 nt, Salmonella enterica enterica serovar Typhi Ty2
guuaugcgcaucaccguuac

SEQ ID NO: 3708759 - RNA, 15 nt, Salmonella enterica enterica serovar Typhi Ty2
guuauggcaggcgaa

SEQ ID NO: 3708760 - RNA, 15 nt, Salmonella enterica enterica serovar Typhi Ty2
guuauguccuuccag

SEQ ID NO: 3708761 - RNA, 17 nt, Salmonella enterica enterica serovar Typhi Ty2
guuauguguuucuacgc

SEQ ID NO: 3708762 - RNA, 14 nt, Salmonella enterica enterica serovar Typhi Ty2
guuauucgaugcgg

SEQ ID NO: 3708763 - RNA, 14 nt, Salmonella enterica enterica serovar Typhi Ty2
guuauucgcuggcc

SEQ ID NO: 3708764 - RNA, 21 nt, Salmonella enterica enterica serovar Typhi Ty2
guuauugucaugcuaaaacag

SEQ ID NO: 3708765 - RNA, 22 nt, Salmonella enterica enterica serovar Typhi Ty2
guuauugugguguuccauugcu

SEQ ID NO: 3708766 - RNA, 18 nt, Salmonella enterica enterica serovar Typhi Ty2
guuauuugccucuggcca

SEQ ID NO: 3708767 - RNA, 17 nt, Salmonella enterica enterica serovar Typhi Ty2
guuauuuucaaaaacaa

SEQ ID NO: 3708768 - RNA, 22 nt, Salmonella enterica enterica serovar Typhi Ty2
guuauuuuccugaaaaaauucc

SEQ ID NO: 3708769 - RNA, 20 nt, Salmonella enterica enterica serovar Typhi Ty2
guucaaaacgcuaacgcguu

SEQ ID NO: 3708770 - RNA, 15 nt, Salmonella enterica enterica serovar Typhi Ty2
guucaaacaucagcg

SEQ ID NO: 3708771 - RNA, 15 nt, Salmonella enterica enterica serovar Typhi Ty2
guucaaaucgaugcc

SEQ ID NO: 3708772 - RNA, 16 nt, Salmonella enterica enterica serovar Typhi Ty2
guucaaaucgaugcca

SEQ ID NO: 3708773 - RNA, 20 nt, Salmonella enterica enterica serovar Typhi Ty2
guucaaccugcgcugacggc

SEQ ID NO: 3708774 - RNA, 22 nt, Salmonella enterica enterica serovar Typhi Ty2
guucaacggcaaaucgcgguaa

SEQ ID NO: 3708775 - RNA, 14 nt, Salmonella enterica enterica serovar Typhi Ty2
guucaagucucgcc

SEQ ID NO: 3708776 - RNA, 20 nt, Salmonella enterica enterica serovar Typhi Ty2
guucaauucauagagcgcgu

SEQ ID NO: 3708777 - RNA, 20 nt, Salmonella enterica enterica serovar Typhi Ty2
guucaccaccacccagugcc

SEQ ID NO: 3708778 - RNA, 13 nt, Salmonella enterica enterica serovar Typhi Ty2
guucaccggcggc

SEQ ID NO: 3708779 - RNA, 20 nt, Salmonella enterica enterica serovar Typhi Ty2
guucacgccaaauaauguaa

SEQ ID NO: 3708780 - RNA, 20 nt, Salmonella enterica enterica serovar Typhi Ty2
guucacgccgccauccggca

SEQ ID NO: 3708781 - RNA, 21 nt, Salmonella enterica enterica serovar Typhi Ty2
guucacggccaaagcgcgacu

SEQ ID NO: 3708782 - RNA, 21 nt, Salmonella enterica enterica serovar Typhi Ty2
guucacgggaacggcguacca

SEQ ID NO: 3708783 - RNA, 21 nt, Salmonella enterica enterica serovar Typhi Ty2
guucacuaacgcggcaucaag

SEQ ID NO: 3708784 - RNA, 17 nt, Salmonella enterica enterica serovar Typhi Ty2
guucacuccuaagagaa

SEQ ID NO: 3708785 - RNA, 20 nt, Salmonella enterica enterica serovar Typhi Ty2
guucagaaauguauucuccc

SEQ ID NO: 3708786 - RNA, 13 nt, Salmonella enterica enterica serovar Typhi Ty2
guucagccgccag

SEQ ID NO: 3708787 - RNA, 18 nt, Salmonella enterica enterica serovar Typhi Ty2
guucagcgacaggcuguc

SEQ ID NO: 3708788 - RNA, 17 nt, Salmonella enterica enterica serovar Typhi Ty2
guucagcgcagagugac

SEQ ID NO: 3708789 - RNA, 16 nt, Salmonella enterica enterica serovar Typhi Ty2
guucagcgccugaaug

SEQ ID NO: 3708790 - RNA, 19 nt, Salmonella enterica enterica serovar Typhi Ty2
guucaggcacgugcauaaa

SEQ ID NO: 3708791 - RNA, 17 nt, Salmonella enterica enterica serovar Typhi Ty2
guucaggcggcaaaaaa

SEQ ID NO: 3708792 - RNA, 11 nt, Salmonella enterica enterica serovar Typhi Ty2
guucagguuuu

SEQ ID NO: 3708793 - RNA, 13 nt, Salmonella enterica enterica serovar Typhi Ty2
guucagguuuuuu

SEQ ID NO: 3708794 - RNA, 16 nt, Salmonella enterica enterica serovar Typhi Ty2
guucaguaugaucaug

SEQ ID NO: 3708795 - RNA, 20 nt, Salmonella enterica enterica serovar Typhi Ty2
guucaguuaaauaaacaaaa

SEQ ID NO: 3708796 - RNA, 12 nt, Salmonella enterica enterica serovar Typhi Ty2
guucaguuucaa

SEQ ID NO: 3708797 - RNA, 18 nt, Salmonella enterica enterica serovar Typhi Ty2
guucauaagucauccaga

SEQ ID NO: 3708798 - RNA, 14 nt, Salmonella enterica enterica serovar Typhi Ty2
guucauaauccgga

SEQ ID NO: 3708799 - RNA, 12 nt, Salmonella enterica enterica serovar Typhi Ty2
guucauagccgu

SEQ ID NO: 3708800 - RNA, 22 nt, Salmonella enterica enterica serovar Typhi Ty2
guucaucaggcaauaaacauca

SEQ ID NO: 3708801 - RNA, 19 nt, Salmonella enterica enterica serovar Typhi Ty2
guucaucaggccugcaaac

SEQ ID NO: 3708802 - RNA, 21 nt, Salmonella enterica enterica serovar Typhi Ty2
guucaucaggccugcaaaccu

SEQ ID NO: 3708803 - RNA, 17 nt, Salmonella enterica enterica serovar Typhi Ty2
guucaucauccugcagg

SEQ ID NO: 3708804 - RNA, 24 nt, Salmonella enterica enterica serovar Typhi Ty2
guucauccaccgcccgcguauugc

SEQ ID NO: 3708805 - RNA, 16 nt, Salmonella enterica enterica serovar Typhi Ty2
guucauccugcgccau

SEQ ID NO: 3708806 - RNA, 20 nt, Salmonella enterica enterica serovar Typhi Ty2
guucaucgccacaugcggca

SEQ ID NO: 3708807 - RNA, 13 nt, Salmonella enterica enterica serovar Typhi Ty2
guucaucgguuuu

SEQ ID NO: 3708808 - RNA, 15 nt, Salmonella enterica enterica serovar Typhi Ty2
guucaucuaucgcca

SEQ ID NO: 3708809 - RNA, 16 nt, Salmonella enterica enterica serovar Typhi Ty2
guucaucuaucgccag

SEQ ID NO: 3708810 - RNA, 14 nt, Salmonella enterica enterica serovar Typhi Ty2
guugacgcuucaag

SEQ ID NO: 3708811 - RNA, 20 nt, Salmonella enterica enterica serovar Typhi Ty2
guugacggcuaccccggcgc

SEQ ID NO: 3708812 - RNA, 15 nt, Salmonella enterica enterica serovar Typhi Ty2
guugacugccaggua

SEQ ID NO: 3708813 - RNA, 19 nt, Salmonella enterica enterica serovar Typhi Ty2
guugacuuaaaaagcggau

SEQ ID NO: 3708814 - RNA, 17 nt, Salmonella enterica enterica serovar Typhi Ty2
guugacuuacaaaaaau

SEQ ID NO: 3708815 - RNA, 14 nt, Salmonella enterica enterica serovar Typhi Ty2
guugagauuggccc

SEQ ID NO: 3708816 - RNA, 19 nt, Salmonella enterica enterica serovar Typhi Ty2
guugagccauuccagcgua

SEQ ID NO: 3708817 - RNA, 15 nt, Salmonella enterica enterica serovar Typhi Ty2
guugagcgcauuugc

SEQ ID NO: 3708818 - RNA, 17 nt, Salmonella enterica enterica serovar Typhi Ty2
guugagcgcuugcugcg

SEQ ID NO: 3708819 - RNA, 20 nt, Salmonella enterica enterica serovar Typhi Ty2
guugagcguuacgggaacag

SEQ ID NO: 3708820 - RNA, 14 nt, Salmonella enterica enterica serovar Typhi Ty2
guugagcuuauccg

SEQ ID NO: 3708821 - RNA, 16 nt, Salmonella enterica enterica serovar Typhi Ty2
guugaggaaauucuga

SEQ ID NO: 3708822 - RNA, 23 nt, Salmonella enterica enterica serovar Typhi Ty2
guugauacagaaaaccggcaaau

SEQ ID NO: 3708823 - RNA, 19 nt, Salmonella enterica enterica serovar Typhi Ty2
guugauacaggaauaacca

SEQ ID NO: 3708824 - RNA, 14 nt, Salmonella enterica enterica serovar Typhi Ty2
guugauaccggagg

SEQ ID NO: 3708825 - RNA, 16 nt, Salmonella enterica enterica serovar Typhi Ty2
guugaucggccagcaa

SEQ ID NO: 3708826 - RNA, 17 nt, Salmonella enterica enterica serovar Typhi Ty2
guugaucguaaaaugaa

SEQ ID NO: 3708827 - RNA, 18 nt, Salmonella enterica enterica serovar Typhi Ty2
guugaucguaaagcgcau

SEQ ID NO: 3708828 - RNA, 18 nt, Salmonella enterica enterica serovar Typhi Ty2
guugaucugguucacaga

SEQ ID NO: 3708829 - RNA, 12 nt, Salmonella enterica enterica serovar Typhi Ty2
guugaugccgga

SEQ ID NO: 3708830 - RNA, 13 nt, Salmonella enterica enterica serovar Typhi Ty2
guugauggagguu

SEQ ID NO: 3708831 - RNA, 13 nt, Salmonella enterica enterica serovar Typhi Ty2
guugauuacgcuc

SEQ ID NO: 3708832 - RNA, 16 nt, Salmonella enterica enterica serovar Typhi Ty2
guugauuacucccguc

SEQ ID NO: 3708833 - RNA, 20 nt, Salmonella enterica enterica serovar Typhi Ty2
guugauucgcuaauaauucu

SEQ ID NO: 3708834 - RNA, 16 nt, Salmonella enterica enterica serovar Typhi Ty2
guugcagcccaccggc

SEQ ID NO: 3708835 - RNA, 21 nt, Salmonella enterica enterica serovar Typhi Ty2
guugccaggguucaaccugau

SEQ ID NO: 3708836 - RNA, 14 nt, Salmonella enterica enterica serovar Typhi Ty2
guugccaguacagc

SEQ ID NO: 3708837 - RNA, 21 nt, Salmonella enterica enterica serovar Typhi Ty2
guugccgaccugucgaucauc

SEQ ID NO: 3708838 - RNA, 17 nt, Salmonella enterica enterica serovar Typhi Ty2
guugccgaugacuccca

SEQ ID NO: 3708839 - RNA, 19 nt, Salmonella enterica enterica serovar Typhi Ty2
guugccguguccuuguccg

SEQ ID NO: 3708840 - RNA, 11 nt, Salmonella enterica enterica serovar Typhi Ty2
guugccuucga

SEQ ID NO: 3708841 - RNA, 17 nt, Salmonella enterica enterica serovar Typhi Ty2
guugccuuugucaucca

SEQ ID NO: 3708842 - RNA, 21 nt, Salmonella enterica enterica serovar Typhi Ty2
guugcgacuguucaucaaaga

SEQ ID NO: 3708843 - RNA, 21 nt, Salmonella enterica enterica serovar Typhi Ty2
guugcgcaagcacugaaugcu

SEQ ID NO: 3708844 - RNA, 13 nt, Salmonella enterica enterica serovar Typhi Ty2
guugcgccgccag

SEQ ID NO: 3708845 - RNA, 15 nt, Salmonella enterica enterica serovar Typhi Ty2
guugcggauaaccga

SEQ ID NO: 3708846 - RNA, 21 nt, Salmonella enterica enterica serovar Typhi Ty2
guugcguuggaagugcguuaa

SEQ ID NO: 3708847 - RNA, 21 nt, Salmonella enterica enterica serovar Typhi Ty2
guugcuccuguaagucaggua

SEQ ID NO: 3708848 - RNA, 13 nt, Salmonella enterica enterica serovar Typhi Ty2
guugcuucugucc

SEQ ID NO: 3708849 - RNA, 16 nt, Salmonella enterica enterica serovar Typhi Ty2
guugcuuuauaaaaag

SEQ ID NO: 3708850 - RNA, 20 nt, Salmonella enterica enterica serovar Typhi Ty2
guuggaugaaccauaucaaa

SEQ ID NO: 3708851 - RNA, 23 nt, Salmonella enterica enterica serovar Typhi Ty2
guuggcauucuuacgauacccca

SEQ ID NO: 3708852 - RNA, 18 nt, Salmonella enterica enterica serovar Typhi Ty2
guuggcgaaggcggcggc

SEQ ID NO: 3708853 - RNA, 17 nt, Salmonella enterica enterica serovar Typhi Ty2
guuggcuauacgcggcg

SEQ ID NO: 3708854 - RNA, 18 nt, Salmonella enterica enterica serovar Typhi Ty2
guuggcuugaucaacgcc

SEQ ID NO: 3708855 - RNA, 15 nt, Salmonella enterica enterica serovar Typhi Ty2
guugggcagaaacgu

SEQ ID NO: 3708856 - RNA, 18 nt, Salmonella enterica enterica serovar Typhi Ty2
guuggggauaaccagaaa

SEQ ID NO: 3708857 - RNA, 20 nt, Salmonella enterica enterica serovar Typhi Ty2
guugguaaauuuaugguucc

SEQ ID NO: 3708858 - RNA, 14 nt, Salmonella enterica enterica serovar Typhi Ty2
guugguuguagcac

SEQ ID NO: 3708859 - RNA, 22 nt, Salmonella enterica enterica serovar Typhi Ty2
guuguacggaugggguaucgcc

SEQ ID NO: 3708860 - RNA, 15 nt, Salmonella enterica enterica serovar Typhi Ty2
guuguagcacagccc

SEQ ID NO: 3708861 - RNA, 16 nt, Salmonella enterica enterica serovar Typhi Ty2
guuguaggcucaaagu

SEQ ID NO: 3708862 - RNA, 15 nt, Salmonella enterica enterica serovar Typhi Ty2
guugucaaaaaauca

SEQ ID NO: 3708863 - RNA, 19 nt, Salmonella enterica enterica serovar Typhi Ty2
guuguccggcgaccuuauu

SEQ ID NO: 3708864 - RNA, 16 nt, Salmonella enterica enterica serovar Typhi Ty2
guugucgagguuauaa

SEQ ID NO: 3708865 - RNA, 19 nt, Salmonella enterica enterica serovar Typhi Ty2
guugucggcggucgcggca

SEQ ID NO: 3708866 - RNA, 14 nt, Salmonella enterica enterica serovar Typhi Ty2
guugucuucaucua

SEQ ID NO: 3708867 - RNA, 22 nt, Salmonella enterica enterica serovar Typhi Ty2
guugugcagaaucauuaauaca

SEQ ID NO: 3708868 - RNA, 15 nt, Salmonella enterica enterica serovar Typhi Ty2
guuguuaauuugauu

SEQ ID NO: 3708869 - RNA, 15 nt, Salmonella enterica enterica serovar Typhi Ty2
guuguuccagcagcu

SEQ ID NO: 3708870 - RNA, 17 nt, Salmonella enterica enterica serovar Typhi Ty2
guuguuccgcgcugaug

SEQ ID NO: 3708871 - RNA, 21 nt, Salmonella enterica enterica serovar Typhi Ty2
guuguucuuuuuauggcgggg

SEQ ID NO: 3708872 - RNA, 18 nt, Salmonella enterica enterica serovar Typhi Ty2
guuguuuggguaacacaa

SEQ ID NO: 3708873 - RNA, 15 nt, Salmonella enterica enterica serovar Typhi Ty2
guuuaaaagcggaua

SEQ ID NO: 3708874 - RNA, 12 nt, Salmonella enterica enterica serovar Typhi Ty2
guuuaaaccacu

SEQ ID NO: 3708875 - RNA, 20 nt, Salmonella enterica enterica serovar Typhi Ty2
guuuaaacucccggcuaaac

SEQ ID NO: 3708876 - RNA, 16 nt, Salmonella enterica enterica serovar Typhi Ty2
guuuaaaucgcuaagc

SEQ ID NO: 3708877 - RNA, 20 nt, Salmonella enterica enterica serovar Typhi Ty2
guuuaaaucgcuaagcagaa

SEQ ID NO: 3708878 - RNA, 21 nt, Salmonella enterica enterica serovar Typhi Ty2
guuuaaccguuccaacgcguu

SEQ ID NO: 3708879 - RNA, 19 nt, Salmonella enterica enterica serovar Typhi Ty2
guuuaauaccgcguaaaaa

SEQ ID NO: 3708880 - RNA, 12 nt, Salmonella enterica enterica serovar Typhi Ty2
guuuaaucgccc

SEQ ID NO: 3708881 - RNA, 19 nt, Salmonella enterica enterica serovar Typhi Ty2
guuuaaugcuuucaauacu

SEQ ID NO: 3708882 - RNA, 17 nt, Salmonella enterica enterica serovar Typhi Ty2
guuuaauuccaucggca

SEQ ID NO: 3708883 - RNA, 14 nt, Salmonella enterica enterica serovar Typhi Ty2
guuuaauuucugac

SEQ ID NO: 3708884 - RNA, 19 nt, Salmonella enterica enterica serovar Typhi Ty2
guuuacccagcgaaugcug

SEQ ID NO: 3708885 - RNA, 16 nt, Salmonella enterica enterica serovar Typhi Ty2
guuuaccugcaaaaac

SEQ ID NO: 3708886 - RNA, 15 nt, Salmonella enterica enterica serovar Typhi Ty2
guuuacgccgccauc

SEQ ID NO: 3708887 - RNA, 16 nt, Salmonella enterica enterica serovar Typhi Ty2
guuuacgcugcuaucc

SEQ ID NO: 3708888 - RNA, 14 nt, Salmonella enterica enterica serovar Typhi Ty2
guuuacgcugcucc

SEQ ID NO: 3708889 - RNA, 23 nt, Salmonella enterica enterica serovar Typhi Ty2
guuuacguagcaaauagauaaag

SEQ ID NO: 3708890 - RNA, 18 nt, Salmonella enterica enterica serovar Typhi Ty2
guuuacuaaaacgguuuu

SEQ ID NO: 3708891 - RNA, 20 nt, Salmonella enterica enterica serovar Typhi Ty2
guuuacuccauucccagcuc

SEQ ID NO: 3708892 - RNA, 12 nt, Salmonella enterica enterica serovar Typhi Ty2
uaaaauccugca

SEQ ID NO: 3708893 - RNA, 17 nt, Salmonella enterica enterica serovar Typhi Ty2
uaaaauccuuuuucaug

SEQ ID NO: 3708894 - RNA, 12 nt, Salmonella enterica enterica serovar Typhi Ty2
uaaaaucgccaa

SEQ ID NO: 3708895 - RNA, 11 nt, Salmonella enterica enterica serovar Typhi Ty2
uaaaaucgcgu

SEQ ID NO: 3708896 - RNA, 20 nt, Salmonella enterica enterica serovar Typhi Ty2
uaaaaucggggucuuccagc

SEQ ID NO: 3708897 - RNA, 23 nt, Salmonella enterica enterica serovar Typhi Ty2
uaaaaucggggucuuccagcaga

SEQ ID NO: 3708898 - RNA, 23 nt, Salmonella enterica enterica serovar Typhi Ty2
uaaaaucuaagagccugucccac

SEQ ID NO: 3708899 - RNA, 10 nt, Salmonella enterica enterica serovar Typhi Ty2
uaaaaugacc

SEQ ID NO: 3708900 - RNA, 18 nt, Salmonella enterica enterica serovar Typhi Ty2
uaaaaugcccgucucauu

SEQ ID NO: 3708901 - RNA, 17 nt, Salmonella enterica enterica serovar Typhi Ty2
uaaaauggcuugugaau

SEQ ID NO: 3708902 - RNA, 12 nt, Salmonella enterica enterica serovar Typhi Ty2
uaaaaugucugu

SEQ ID NO: 3708903 - RNA, 23 nt, Salmonella enterica enterica serovar Typhi Ty2
uaaaauguuuuuguuguuaauuu

SEQ ID NO: 3708904 - RNA, 13 nt, Salmonella enterica enterica serovar Typhi Ty2
uaaaauuauaaac

SEQ ID NO: 3708905 - RNA, 16 nt, Salmonella enterica enterica serovar Typhi Ty2
uaaaauuauauucuaa

SEQ ID NO: 3708906 - RNA, 23 nt, Salmonella enterica enterica serovar Typhi Ty2
uaaaauuauuggcuuuguaaaua

SEQ ID NO: 3708907 - RNA, 17 nt, Salmonella enterica enterica serovar Typhi Ty2
uaaaauuauuuuuacuu

SEQ ID NO: 3708908 - RNA, 13 nt, Salmonella enterica enterica serovar Typhi Ty2
uaaaauugaauua

SEQ ID NO: 3708909 - RNA, 17 nt, Salmonella enterica enterica serovar Typhi Ty2
uaaaauugcucagccaa

SEQ ID NO: 3708910 - RNA, 17 nt, Salmonella enterica enterica serovar Typhi Ty2
uaaacaacgccauaaua

SEQ ID NO: 3708911 - RNA, 14 nt, Salmonella enterica enterica serovar Typhi Ty2
uaaacaaugcaggu

SEQ ID NO: 3708912 - RNA, 20 nt, Salmonella enterica enterica serovar Typhi Ty2
uaaacaauuugcccagcgcu

SEQ ID NO: 3708913 - RNA, 20 nt, Salmonella enterica enterica serovar Typhi Ty2
uaaacaccggggcauuucca

SEQ ID NO: 3708914 - RNA, 23 nt, Salmonella enterica enterica serovar Typhi Ty2
uaaacacgccgcgcuggauagcg

SEQ ID NO: 3708915 - RNA, 17 nt, Salmonella enterica enterica serovar Typhi Ty2
uaaacacguuaucugac

SEQ ID NO: 3708916 - RNA, 15 nt, Salmonella enterica enterica serovar Typhi Ty2
uaaacacuaaaucau

SEQ ID NO: 3708917 - RNA, 19 nt, Salmonella enterica enterica serovar Typhi Ty2
uaaacacucuccaccaaau

SEQ ID NO: 3708918 - RNA, 12 nt, Salmonella enterica enterica serovar Typhi Ty2
uaaacagcagcg

SEQ ID NO: 3708919 - RNA, 17 nt, Salmonella enterica enterica serovar Typhi Ty2
uaaacagcguuuucaua

SEQ ID NO: 3708920 - RNA, 15 nt, Salmonella enterica enterica serovar Typhi Ty2
uaaacaggcaggccc

SEQ ID NO: 3708921 - RNA, 17 nt, Salmonella enterica enterica serovar Typhi Ty2
uaaacaggcgcggcgcg

SEQ ID NO: 3708922 - RNA, 16 nt, Salmonella enterica enterica serovar Typhi Ty2
uaaacagguaaaacaa

SEQ ID NO: 3708923 - RNA, 13 nt, Salmonella enterica enterica serovar Typhi Ty2
uaaaccaaagcag

SEQ ID NO: 3708924 - RNA, 15 nt, Salmonella enterica enterica serovar Typhi Ty2
uaaaccaaagcagag

SEQ ID NO: 3708925 - RNA, 21 nt, Salmonella enterica enterica serovar Typhi Ty2
uaaaccacaugaccagcgccg

SEQ ID NO: 3708926 - RNA, 17 nt, Salmonella enterica enterica serovar Typhi Ty2
uaaaccaccggauggcg

SEQ ID NO: 3708927 - RNA, 18 nt, Salmonella enterica enterica serovar Typhi Ty2
uaaaccaggcagcguggc

SEQ ID NO: 3708928 - RNA, 18 nt, Salmonella enterica enterica serovar Typhi Ty2
uaaaccccgauaaaccag

SEQ ID NO: 3708929 - RNA, 19 nt, Salmonella enterica enterica serovar Typhi Ty2
uaaacccgauucugccagu

SEQ ID NO: 3708930 - RNA, 19 nt, Salmonella enterica enterica serovar Typhi Ty2
uaaaccgucauuuaccagu

SEQ ID NO: 3708931 - RNA, 15 nt, Salmonella enterica enterica serovar Typhi Ty2
uaaaccguuaugaau

SEQ ID NO: 3708932 - RNA, 12 nt, Salmonella enterica enterica serovar Typhi Ty2
uaaaccucuuug

SEQ ID NO: 3708933 - RNA, 20 nt, Salmonella enterica enterica serovar Typhi Ty2
uaaaccuguuuguuuauugu

SEQ ID NO: 3708934 - RNA, 15 nt, Salmonella enterica enterica serovar Typhi Ty2
uaaacgcaacaccau

SEQ ID NO: 3708935 - RNA, 14 nt, Salmonella enterica enterica serovar Typhi Ty2
uaaacgccccuucg

SEQ ID NO: 3708936 - RNA, 17 nt, Salmonella enterica enterica serovar Typhi Ty2
uaaacgccggauuccag

SEQ ID NO: 3708937 - RNA, 16 nt, Salmonella enterica enterica serovar Typhi Ty2
uaaacgccucauccgg

SEQ ID NO: 3708938 - RNA, 17 nt, Salmonella enterica enterica serovar Typhi Ty2
uaaacgccucauccggc

SEQ ID NO: 3708939 - RNA, 15 nt, Salmonella enterica enterica serovar Typhi Ty2
uaaacgccugcacca

SEQ ID NO: 3708940 - RNA, 16 nt, Salmonella enterica enterica serovar Typhi Ty2
uaaacgccugcaccau

SEQ ID NO: 3708941 - RNA, 19 nt, Salmonella enterica enterica serovar Typhi Ty2
uaaacgcgucuucaucagc

SEQ ID NO: 3708942 - RNA, 22 nt, Salmonella enterica enterica serovar Typhi Ty2
uaaacggcagccgccaccacaa

SEQ ID NO: 3708943 - RNA, 18 nt, Salmonella enterica enterica serovar Typhi Ty2
uaaacgggcagagucgau

SEQ ID NO: 3708944 - RNA, 14 nt, Salmonella enterica enterica serovar Typhi Ty2
uaaacggucaggau

SEQ ID NO: 3708945 - RNA, 22 nt, Salmonella enterica enterica serovar Typhi Ty2
uaaacguaaguuaaaacgccau

SEQ ID NO: 3708946 - RNA, 16 nt, Salmonella enterica enterica serovar Typhi Ty2
uaaacguaggccgggc

SEQ ID NO: 3708947 - RNA, 13 nt, Salmonella enterica enterica serovar Typhi Ty2
uaaacguuccugc

SEQ ID NO: 3708948 - RNA, 13 nt, Salmonella enterica enterica serovar Typhi Ty2
uaaacuaucgucu

SEQ ID NO: 3708949 - RNA, 15 nt, Salmonella enterica enterica serovar Typhi Ty2
uaaacucaaucaggc

SEQ ID NO: 3708950 - RNA, 17 nt, Salmonella enterica enterica serovar Typhi Ty2
uaaacucaaucaggcua

SEQ ID NO: 3708951 - RNA, 11 nt, Salmonella enterica enterica serovar Typhi Ty2
uaaacugccuu

SEQ ID NO: 3708952 - RNA, 13 nt, Salmonella enterica enterica serovar Typhi Ty2
uaaacugccuucg

SEQ ID NO: 3708953 - RNA, 22 nt, Salmonella enterica enterica serovar Typhi Ty2
uaaacuguccaguuuuugcauu

SEQ ID NO: 3708954 - RNA, 15 nt, Salmonella enterica enterica serovar Typhi Ty2
uaaacuguuuccagu

SEQ ID NO: 3708955 - RNA, 21 nt, Salmonella enterica enterica serovar Typhi Ty2
uaaacuucacgucgcucacau

SEQ ID NO: 3708956 - RNA, 22 nt, Salmonella enterica enterica serovar Typhi Ty2
uaaacuucacgucgcucacauu

SEQ ID NO: 3708957 - RNA, 18 nt, Salmonella enterica enterica serovar Typhi Ty2
uaaagaaaguagaucacc

SEQ ID NO: 3708958 - RNA, 13 nt, Salmonella enterica enterica serovar Typhi Ty2
uaaagaaauuuaa

SEQ ID NO: 3708959 - RNA, 21 nt, Salmonella enterica enterica serovar Typhi Ty2
uaaagaacggccucccaaacu

SEQ ID NO: 3708960 - RNA, 19 nt, Salmonella enterica enterica serovar Typhi Ty2
uaaagaaugaaaaaaaaau

SEQ ID NO: 3708961 - RNA, 15 nt, Salmonella enterica enterica serovar Typhi Ty2
uaaagaccggcacaa

SEQ ID NO: 3708962 - RNA, 18 nt, Salmonella enterica enterica serovar Typhi Ty2
uaaagacgguaaucagac

SEQ ID NO: 3708963 - RNA, 20 nt, Salmonella enterica enterica serovar Typhi Ty2
uaaagacuuuaccgccguua

SEQ ID NO: 3708964 - RNA, 13 nt, Salmonella enterica enterica serovar Typhi Ty2
uaaagaucugaug

SEQ ID NO: 3708965 - RNA, 23 nt, Salmonella enterica enterica serovar Typhi Ty2
uaaagauuagcguuuuuaucuuu

SEQ ID NO: 3708966 - RNA, 15 nt, Salmonella enterica enterica serovar Typhi Ty2
uaaagauuguuucgg

SEQ ID NO: 3708967 - RNA, 16 nt, Salmonella enterica enterica serovar Typhi Ty2
uaaagcacaagaacuu

SEQ ID NO: 3708968 - RNA, 17 nt, Salmonella enterica enterica serovar Typhi Ty2
uaaagcacugguggaau

SEQ ID NO: 3708969 - RNA, 19 nt, Salmonella enterica enterica serovar Typhi Ty2
uaaagcagugcaguauugc

SEQ ID NO: 3708970 - RNA, 23 nt, Salmonella enterica enterica serovar Typhi Ty2
uaaagcauagcgucaucaacaua

SEQ ID NO: 3708971 - RNA, 15 nt, Salmonella enterica enterica serovar Typhi Ty2
uaaagccaauccaga

SEQ ID NO: 3708972 - RNA, 21 nt, Salmonella enterica enterica serovar Typhi Ty2
uaaagccauccaucuccggca

SEQ ID NO: 3708973 - RNA, 17 nt, Salmonella enterica enterica serovar Typhi Ty2
uaaagcccagcacggca

SEQ ID NO: 3708974 - RNA, 14 nt, Salmonella enterica enterica serovar Typhi Ty2
uaaagcccugacag

SEQ ID NO: 3708975 - RNA, 15 nt, Salmonella enterica enterica serovar Typhi Ty2
uaaagcccuguuauu

SEQ ID NO: 3708976 - RNA, 13 nt, Salmonella enterica enterica serovar Typhi Ty2
uaaagccuucaug

SEQ ID NO: 3708977 - RNA, 13 nt, Salmonella enterica enterica serovar Typhi Ty2
uaaagcgaauacu

SEQ ID NO: 3708978 - RNA, 19 nt, Salmonella enterica enterica serovar Typhi Ty2
uaaagcgcucguuauaauu

SEQ ID NO: 3708979 - RNA, 16 nt, Salmonella enterica enterica serovar Typhi Ty2
uaaaggauaauagugu

SEQ ID NO: 3708980 - RNA, 14 nt, Salmonella enterica enterica serovar Typhi Ty2
uaaaggaugccacu

SEQ ID NO: 3708981 - RNA, 22 nt, Salmonella enterica enterica serovar Typhi Ty2
uaaaggcguguguuuagauaac

SEQ ID NO: 3708982 - RNA, 20 nt, Salmonella enterica enterica serovar Typhi Ty2
uaaaggggagcccaguagcc

SEQ ID NO: 3708983 - RNA, 17 nt, Salmonella enterica enterica serovar Typhi Ty2
uaaaguaguuggugggu

SEQ ID NO: 3708984 - RNA, 13 nt, Salmonella enterica enterica serovar Typhi Ty2
uaaagucagcaag

SEQ ID NO: 3708985 - RNA, 13 nt, Salmonella enterica enterica serovar Typhi Ty2
uaaagucucaggg

SEQ ID NO: 3708986 - RNA, 15 nt, Salmonella enterica enterica serovar Typhi Ty2
uaaauaaaaauuccc

SEQ ID NO: 3708987 - RNA, 16 nt, Salmonella enterica enterica serovar Typhi Ty2
uaaauaacaaaugaag

SEQ ID NO: 3708988 - RNA, 14 nt, Salmonella enterica enterica serovar Typhi Ty2
uaaauaacaggaau

SEQ ID NO: 3708989 - RNA, 20 nt, Salmonella enterica enterica serovar Typhi Ty2
uaaauaacauuucagucuaa

SEQ ID NO: 3708990 - RNA, 21 nt, Salmonella enterica enterica serovar Typhi Ty2
uaaauaagaagguuaauauac

SEQ ID NO: 3708991 - RNA, 13 nt, Salmonella enterica enterica serovar Typhi Ty2
uaaauaauucacg

SEQ ID NO: 3708992 - RNA, 18 nt, Salmonella enterica enterica serovar Typhi Ty2
uaaauacaauucaacuca

SEQ ID NO: 3708993 - RNA, 19 nt, Salmonella enterica enterica serovar Typhi Ty2
uaaauacaauucaacucac

SEQ ID NO: 3708994 - RNA, 13 nt, Salmonella enterica enterica serovar Typhi Ty2
uaaauacacgagg

SEQ ID NO: 3708995 - RNA, 15 nt, Salmonella enterica enterica serovar Typhi Ty2
uaaauaccaggcacu

SEQ ID NO: 3708996 - RNA, 22 nt, Salmonella enterica enterica serovar Typhi Ty2
uaaauacccaggccaucagaau

SEQ ID NO: 3708997 - RNA, 18 nt, Salmonella enterica enterica serovar Typhi Ty2
uaaauaccgcaauaaaca

SEQ ID NO: 3708998 - RNA, 15 nt, Salmonella enterica enterica serovar Typhi Ty2
uaaauaccuuauuca

SEQ ID NO: 3708999 - RNA, 17 nt, Salmonella enterica enterica serovar Typhi Ty2
uaaauacgccgccagca

SEQ ID NO: 3709000 - RNA, 21 nt, Salmonella enterica enterica serovar Typhi Ty2
uaaauacuuuuuuagcgcaca

SEQ ID NO: 3709001 - RNA, 15 nt, Salmonella enterica enterica serovar Typhi Ty2
uaaauagaaaauaau

SEQ ID NO: 3709002 - RNA, 14 nt, Salmonella enterica enterica serovar Typhi Ty2
uaaauagcaauuau

SEQ ID NO: 3709003 - RNA, 17 nt, Salmonella enterica enterica serovar Typhi Ty2
uaaauagcaauuauauu

SEQ ID NO: 3709004 - RNA, 13 nt, Salmonella enterica enterica serovar Typhi Ty2
uaaauagcaggca

SEQ ID NO: 3709005 - RNA, 14 nt, Salmonella enterica enterica serovar Typhi Ty2
uaaauagccagcau

SEQ ID NO: 3709006 - RNA, 20 nt, Salmonella enterica enterica serovar Typhi Ty2
uaaauaggagaugcacggau

SEQ ID NO: 3709007 - RNA, 14 nt, Salmonella enterica enterica serovar Typhi Ty2
uaaauaggcggcau

SEQ ID NO: 3709008 - RNA, 19 nt, Salmonella enterica enterica serovar Typhi Ty2
uaaauaguaaauagaaaau

SEQ ID NO: 3709009 - RNA, 18 nt, Salmonella enterica enterica serovar Typhi Ty2
uaaauauaagaucuauuu

SEQ ID NO: 3709010 - RNA, 16 nt, Salmonella enterica enterica serovar Typhi Ty2
uaaauaugaaagagaa

SEQ ID NO: 3709011 - RNA, 22 nt, Salmonella enterica enterica serovar Typhi Ty2
uaaauaugaaagagaaaucuca

SEQ ID NO: 3709012 - RNA, 16 nt, Salmonella enterica enterica serovar Typhi Ty2
uaaauauucaucaaaa

SEQ ID NO: 3709013 - RNA, 17 nt, Salmonella enterica enterica serovar Typhi Ty2
uaaauauucaucaaaau

SEQ ID NO: 3709014 - RNA, 16 nt, Salmonella enterica enterica serovar Typhi Ty2
uaaauauugauggacg

SEQ ID NO: 3709015 - RNA, 15 nt, Salmonella enterica enterica serovar Typhi Ty2
uaaaucagauaacaa

SEQ ID NO: 3709016 - RNA, 17 nt, Salmonella enterica enterica serovar Typhi Ty2
uaaaucagcacacgcca

SEQ ID NO: 3709017 - RNA, 10 nt, Salmonella enterica enterica serovar Typhi Ty2
uaaaucagcc

SEQ ID NO: 3709018 - RNA, 18 nt, Salmonella enterica enterica serovar Typhi Ty2
uaaaucagcgauaaccag

SEQ ID NO: 3709019 - RNA, 16 nt, Salmonella enterica enterica serovar Typhi Ty2
uaaaucagcgcggcaa

SEQ ID NO: 3709020 - RNA, 17 nt, Salmonella enterica enterica serovar Typhi Ty2
uaaaucagcgugauaua

SEQ ID NO: 3709021 - RNA, 15 nt, Salmonella enterica enterica serovar Typhi Ty2
uaaaucaggaaaaag

SEQ ID NO: 3709022 - RNA, 13 nt, Salmonella enterica enterica serovar Typhi Ty2
uaaaucauaauuu

SEQ ID NO: 3709023 - RNA, 17 nt, Salmonella enterica enterica serovar Typhi Ty2
uaaaucauccugcggca

SEQ ID NO: 3709024 - RNA, 15 nt, Salmonella enterica enterica serovar Typhi Ty2
uaaaucauuacuuau

SEQ ID NO: 3709025 - RNA, 19 nt, Salmonella enterica enterica serovar Typhi Ty2
uaaaucauuuguacaaaaa

SEQ ID NO: 3709026 - RNA, 21 nt, Salmonella enterica enterica serovar Typhi Ty2
uaaaucauuuguacaaaaaau

SEQ ID NO: 3709027 - RNA, 21 nt, Salmonella enterica enterica serovar Typhi Ty2
uaaauccaauagacuucacuu

SEQ ID NO: 3709028 - RNA, 17 nt, Salmonella enterica enterica serovar Typhi Ty2
uaaauccacauuccaga

SEQ ID NO: 3709029 - RNA, 17 nt, Salmonella enterica enterica serovar Typhi Ty2
uaaaucccgcaucaccc

SEQ ID NO: 3709030 - RNA, 14 nt, Salmonella enterica enterica serovar Typhi Ty2
uaaauccggcgcuu

SEQ ID NO: 3709031 - RNA, 19 nt, Salmonella enterica enterica serovar Typhi Ty2
uaaauccguuaagcccuga

SEQ ID NO: 3709032 - RNA, 14 nt, Salmonella enterica enterica serovar Typhi Ty2
uaaauccuucgccg

SEQ ID NO: 3709033 - RNA, 21 nt, Salmonella enterica enterica serovar Typhi Ty2
uaaaucgcgcaaauauuacaa

SEQ ID NO: 3709034 - RNA, 16 nt, Salmonella enterica enterica serovar Typhi Ty2
uaaaucgcuaagcaga

SEQ ID NO: 3709035 - RNA, 21 nt, Salmonella enterica enterica serovar Typhi Ty2
uaaaucugccgucaucgacuu

SEQ ID NO: 3709036 - RNA, 22 nt, Salmonella enterica enterica serovar Typhi Ty2
uaaaucugccgucaucgacuuc

SEQ ID NO: 3709037 - RNA, 14 nt, Salmonella enterica enterica serovar Typhi Ty2
uaaaugaacuuaca

SEQ ID NO: 3709038 - RNA, 14 nt, Salmonella enterica enterica serovar Typhi Ty2
uaaaugaauuauuu

SEQ ID NO: 3709039 - RNA, 17 nt, Salmonella enterica enterica serovar Typhi Ty2
uaaaugccacuauagau

SEQ ID NO: 3709040 - RNA, 17 nt, Salmonella enterica enterica serovar Typhi Ty2
uaaaugcuugcuuuagc

SEQ ID NO: 3709041 - RNA, 13 nt, Salmonella enterica enterica serovar Typhi Ty2
uaaaugucaggau

SEQ ID NO: 3709042 - RNA, 16 nt, Salmonella enterica enterica serovar Typhi Ty2
uaaaugucaggaucag

SEQ ID NO: 3709043 - RNA, 20 nt, Salmonella enterica enterica serovar Typhi Ty2
uaaauuaaacagcuguaaau

SEQ ID NO: 3709044 - RNA, 14 nt, Salmonella enterica enterica serovar Typhi Ty2
uaaauuacuuauga

SEQ ID NO: 3709045 - RNA, 14 nt, Salmonella enterica enterica serovar Typhi Ty2
uaaauucauauuua

SEQ ID NO: 3709046 - RNA, 13 nt, Salmonella enterica enterica serovar Typhi Ty2
uaaauucgcuacg

SEQ ID NO: 3709047 - RNA, 14 nt, Salmonella enterica enterica serovar Typhi Ty2
uaaauucucuauac

SEQ ID NO: 3709048 - RNA, 16 nt, Salmonella enterica enterica serovar Typhi Ty2
uaaauucugucucaau

SEQ ID NO: 3709049 - RNA, 15 nt, Salmonella enterica enterica serovar Typhi Ty2
uaaauugaguggaca

SEQ ID NO: 3709050 - RNA, 12 nt, Salmonella enterica enterica serovar Typhi Ty2
uaaauugguuau

SEQ ID NO: 3709051 - RNA, 20 nt, Salmonella enterica enterica serovar Typhi Ty2
uaaauuuaacucguccuguu

SEQ ID NO: 3709052 - RNA, 14 nt, Salmonella enterica enterica serovar Typhi Ty2
uaaauuuacucagu

SEQ ID NO: 3709053 - RNA, 22 nt, Salmonella enterica enterica serovar Typhi Ty2
uaaauuuaugguuccugaaaua

SEQ ID NO: 3709054 - RNA, 17 nt, Salmonella enterica enterica serovar Typhi Ty2
uaaauuuauuuuuugcu

SEQ ID NO: 3709055 - RNA, 22 nt, Salmonella enterica enterica serovar Typhi Ty2
uaaauuucaacccgaucgccau

SEQ ID NO: 3709056 - RNA, 17 nt, Salmonella enterica enterica serovar Typhi Ty2
uaaauuuccgcagccag

SEQ ID NO: 3709057 - RNA, 15 nt, Salmonella enterica enterica serovar Typhi Ty2
uaacgcaacaacagu

SEQ ID NO: 3709058 - RNA, 12 nt, Salmonella enterica enterica serovar Typhi Ty2
uaacgcaaccgu

SEQ ID NO: 3709059 - RNA, 22 nt, Salmonella enterica enterica serovar Typhi Ty2
uaacgcaacggaaggaaauaac

SEQ ID NO: 3709060 - RNA, 14 nt, Salmonella enterica enterica serovar Typhi Ty2
uaacgcacuaccag

SEQ ID NO: 3709061 - RNA, 23 nt, Salmonella enterica enterica serovar Typhi Ty2
uaacgcacuggucgggcaggcuu

SEQ ID NO: 3709062 - RNA, 16 nt, Salmonella enterica enterica serovar Typhi Ty2
uaacgcacuuuuccag

SEQ ID NO: 3709063 - RNA, 17 nt, Salmonella enterica enterica serovar Typhi Ty2
uaacgcacuuuuccagc

SEQ ID NO: 3709064 - RNA, 19 nt, Salmonella enterica enterica serovar Typhi Ty2
uaacgcagaagacagaagc

SEQ ID NO: 3709065 - RNA, 15 nt, Salmonella enterica enterica serovar Typhi Ty2
uaacgcagcaucgcc

SEQ ID NO: 3709066 - RNA, 17 nt, Salmonella enterica enterica serovar Typhi Ty2
uaacgccggcaaauagc

SEQ ID NO: 3709067 - RNA, 16 nt, Salmonella enterica enterica serovar Typhi Ty2
uaacgcgaaaaaagau

SEQ ID NO: 3709068 - RNA, 15 nt, Salmonella enterica enterica serovar Typhi Ty2
uaacgcgagaagaag

SEQ ID NO: 3709069 - RNA, 21 nt, Salmonella enterica enterica serovar Typhi Ty2
uaacgcgagugucauccugcg

SEQ ID NO: 3709070 - RNA, 16 nt, Salmonella enterica enterica serovar Typhi Ty2
uaacgcgccaucuuuc

SEQ ID NO: 3709071 - RNA, 23 nt, Salmonella enterica enterica serovar Typhi Ty2
uaacgcgccaucuuucacccauu

SEQ ID NO: 3709072 - RNA, 17 nt, Salmonella enterica enterica serovar Typhi Ty2
uaacgcgcuggaugcgc

SEQ ID NO: 3709073 - RNA, 24 nt, Salmonella enterica enterica serovar Typhi Ty2
uaacgcgcuggcggaauaucgcgg

SEQ ID NO: 3709074 - RNA, 18 nt, Salmonella enterica enterica serovar Typhi Ty2
uaacgcguaaucuuccac

SEQ ID NO: 3709075 - RNA, 16 nt, Salmonella enterica enterica serovar Typhi Ty2
uaacgcuuauccggcc

SEQ ID NO: 3709076 - RNA, 20 nt, Salmonella enterica enterica serovar Typhi Ty2
uaacgcuuaugcugccuaca

SEQ ID NO: 3709077 - RNA, 16 nt, Salmonella enterica enterica serovar Typhi Ty2
uaacggaaaagcauug

SEQ ID NO: 3709078 - RNA, 14 nt, Salmonella enterica enterica serovar Typhi Ty2
uaacggacucaggc

SEQ ID NO: 3709079 - RNA, 16 nt, Salmonella enterica enterica serovar Typhi Ty2
uaacggacucaggccu

SEQ ID NO: 3709080 - RNA, 19 nt, Salmonella enterica enterica serovar Typhi Ty2
uaacggcgccacgcccacg

SEQ ID NO: 3709081 - RNA, 22 nt, Salmonella enterica enterica serovar Typhi Ty2
uaacggcugacgcccaucagca

SEQ ID NO: 3709082 - RNA, 13 nt, Salmonella enterica enterica serovar Typhi Ty2
uaacgggaauaac

SEQ ID NO: 3709083 - RNA, 14 nt, Salmonella enterica enterica serovar Typhi Ty2
uaacgggacacugc

SEQ ID NO: 3709084 - RNA, 15 nt, Salmonella enterica enterica serovar Typhi Ty2
uaacgggacacugcc

SEQ ID NO: 3709085 - RNA, 16 nt, Salmonella enterica enterica serovar Typhi Ty2
uaacgguaacggacau

SEQ ID NO: 3709086 - RNA, 16 nt, Salmonella enterica enterica serovar Typhi Ty2
uaacguaaauacccag

SEQ ID NO: 3709087 - RNA, 17 nt, Salmonella enterica enterica serovar Typhi Ty2
uaacguauuucuuuugc

SEQ ID NO: 3709088 - RNA, 15 nt, Salmonella enterica enterica serovar Typhi Ty2
uaacgucagcgccac

SEQ ID NO: 3709089 - RNA, 22 nt, Salmonella enterica enterica serovar Typhi Ty2
uaacguguuuucgauuucauuc

SEQ ID NO: 3709090 - RNA, 15 nt, Salmonella enterica enterica serovar Typhi Ty2
uaacguuaaggaaac

SEQ ID NO: 3709091 - RNA, 13 nt, Salmonella enterica enterica serovar Typhi Ty2
uaacguuuaaacu

SEQ ID NO: 3709092 - RNA, 21 nt, Salmonella enterica enterica serovar Typhi Ty2
uaacguuuaaacucccggcua

SEQ ID NO: 3709093 - RNA, 13 nt, Salmonella enterica enterica serovar Typhi Ty2
uaacguuuucagu

SEQ ID NO: 3709094 - RNA, 15 nt, Salmonella enterica enterica serovar Typhi Ty2
uaacuaaacucaucu

SEQ ID NO: 3709095 - RNA, 23 nt, Salmonella enterica enterica serovar Typhi Ty2
uaacuaauuguuuguagaaagug

SEQ ID NO: 3709096 - RNA, 20 nt, Salmonella enterica enterica serovar Typhi Ty2
uaacuauaauugcuuuuuuc

SEQ ID NO: 3709097 - RNA, 23 nt, Salmonella enterica enterica serovar Typhi Ty2
uaacuauuucuaucagguaacau

SEQ ID NO: 3709098 - RNA, 19 nt, Salmonella enterica enterica serovar Typhi Ty2
uaacucaagcgaauccaga

SEQ ID NO: 3709099 - RNA, 18 nt, Salmonella enterica enterica serovar Typhi Ty2
uaacuccaugcccacaca

SEQ ID NO: 3709100 - RNA, 21 nt, Salmonella enterica enterica serovar Typhi Ty2
uaacuccccgccccagcagca

SEQ ID NO: 3709101 - RNA, 22 nt, Salmonella enterica enterica serovar Typhi Ty2
uaacuccuucuaauuccaggau

SEQ ID NO: 3709102 - RNA, 22 nt, Salmonella enterica enterica serovar Typhi Ty2
uaacucucguucggucaggaua

SEQ ID NO: 3709103 - RNA, 17 nt, Salmonella enterica enterica serovar Typhi Ty2
uaacucuuaauuauaaa

SEQ ID NO: 3709104 - RNA, 19 nt, Salmonella enterica enterica serovar Typhi Ty2
uaacucuuccgcaaucaca

SEQ ID NO: 3709105 - RNA, 19 nt, Salmonella enterica enterica serovar Typhi Ty2
uaacucuuuuucagcaaau

SEQ ID NO: 3709106 - RNA, 20 nt, Salmonella enterica enterica serovar Typhi Ty2
uaacucuuuuucagcaaaua

SEQ ID NO: 3709107 - RNA, 23 nt, Salmonella enterica enterica serovar Typhi Ty2
uaacucuuuuucagcaaauacag

SEQ ID NO: 3709108 - RNA, 17 nt, Salmonella enterica enterica serovar Typhi Ty2
uaacugaagguuuuucc

SEQ ID NO: 3709109 - RNA, 21 nt, Salmonella enterica enterica serovar Typhi Ty2
uaacugcaaaucuucggcaaa

SEQ ID NO: 3709110 - RNA, 23 nt, Salmonella enterica enterica serovar Typhi Ty2
uaacugcaccuuuuuuuccagcg

SEQ ID NO: 3709111 - RNA, 19 nt, Salmonella enterica enterica serovar Typhi Ty2
uaacugcauuacauucaua

SEQ ID NO: 3709112 - RNA, 12 nt, Salmonella enterica enterica serovar Typhi Ty2
uaacugcccguc

SEQ ID NO: 3709113 - RNA, 18 nt, Salmonella enterica enterica serovar Typhi Ty2
uaacugcccguuacgcau

SEQ ID NO: 3709114 - RNA, 21 nt, Salmonella enterica enterica serovar Typhi Ty2
uaacugcccguuacgcauuuc

SEQ ID NO: 3709115 - RNA, 11 nt, Salmonella enterica enterica serovar Typhi Ty2
uaacugcggua

SEQ ID NO: 3709116 - RNA, 12 nt, Salmonella enterica enterica serovar Typhi Ty2
uaacugcugcuc

SEQ ID NO: 3709117 - RNA, 21 nt, Salmonella enterica enterica serovar Typhi Ty2
uaacuggaaaaagaccaauac

SEQ ID NO: 3709118 - RNA, 15 nt, Salmonella enterica enterica serovar Typhi Ty2
uaacugucuuauccg

SEQ ID NO: 3709119 - RNA, 19 nt, Salmonella enterica enterica serovar Typhi Ty2
uaacuuagcaacugccggc

SEQ ID NO: 3709120 - RNA, 13 nt, Salmonella enterica enterica serovar Typhi Ty2
uaacuuauccacu

SEQ ID NO: 3709121 - RNA, 21 nt, Salmonella enterica enterica serovar Typhi Ty2
uaacuugacuuugcucuccuu

SEQ ID NO: 3709122 - RNA, 21 nt, Salmonella enterica enterica serovar Typhi Ty2
uaagaaacugcuguagcacau

SEQ ID NO: 3709123 - RNA, 13 nt, Salmonella enterica enterica serovar Typhi Ty2
uaagaacgagaac

SEQ ID NO: 3709124 - RNA, 15 nt, Salmonella enterica enterica serovar Typhi Ty2
uaagaaguaaacaga

SEQ ID NO: 3709125 - RNA, 19 nt, Salmonella enterica enterica serovar Typhi Ty2
uaagaaguaaacagaauca

SEQ ID NO: 3709126 - RNA, 21 nt, Salmonella enterica enterica serovar Typhi Ty2
uaagaaucagaugcucaucaa

SEQ ID NO: 3709127 - RNA, 13 nt, Salmonella enterica enterica serovar Typhi Ty2
uaagaaucgaugu

SEQ ID NO: 3709128 - RNA, 18 nt, Salmonella enterica enterica serovar Typhi Ty2
uaagaccgguacgcaacg

SEQ ID NO: 3709129 - RNA, 19 nt, Salmonella enterica enterica serovar Typhi Ty2
uaagaccgguacgcaacgc

SEQ ID NO: 3709130 - RNA, 23 nt, Salmonella enterica enterica serovar Typhi Ty2
uaagacgcuacgcgucgccaucc

SEQ ID NO: 3709131 - RNA, 20 nt, Salmonella enterica enterica serovar Typhi Ty2
uaagacgcuuacaucgccau

SEQ ID NO: 3709132 - RNA, 21 nt, Salmonella enterica enterica serovar Typhi Ty2
uaagagacugacaaugacgca

SEQ ID NO: 3709133 - RNA, 22 nt, Salmonella enterica enterica serovar Typhi Ty2
uaagagagccuuacaggcgcau

SEQ ID NO: 3709134 - RNA, 14 nt, Salmonella enterica enterica serovar Typhi Ty2
uaagagcuggccgg

SEQ ID NO: 3709135 - RNA, 16 nt, Salmonella enterica enterica serovar Typhi Ty2
uaagaggcauaaaaaa

SEQ ID NO: 3709136 - RNA, 20 nt, Salmonella enterica enterica serovar Typhi Ty2
uaagaggguggcgagcaacu

SEQ ID NO: 3709137 - RNA, 19 nt, Salmonella enterica enterica serovar Typhi Ty2
uaagaguccauucggccug

SEQ ID NO: 3709138 - RNA, 18 nt, Salmonella enterica enterica serovar Typhi Ty2
uaagauauccugcuugcc

SEQ ID NO: 3709139 - RNA, 22 nt, Salmonella enterica enterica serovar Typhi Ty2
uaaguccgcgggcaaaagggcc

SEQ ID NO: 3709140 - RNA, 16 nt, Salmonella enterica enterica serovar Typhi Ty2
uaaguucaaacucauu

SEQ ID NO: 3709141 - RNA, 16 nt, Salmonella enterica enterica serovar Typhi Ty2
uaaguugaaaggaaag

SEQ ID NO: 3709142 - RNA, 17 nt, Salmonella enterica enterica serovar Typhi Ty2
uaaguuggacaaggcac

SEQ ID NO: 3709143 - RNA, 16 nt, Salmonella enterica enterica serovar Typhi Ty2
uaaguuuuucucuuau

SEQ ID NO: 3709144 - RNA, 13 nt, Salmonella enterica enterica serovar Typhi Ty2
uaauaaaauaacu

SEQ ID NO: 3709145 - RNA, 11 nt, Salmonella enterica enterica serovar Typhi Ty2
uaauaaagaaa

SEQ ID NO: 3709146 - RNA, 11 nt, Salmonella enterica enterica serovar Typhi Ty2
uaauaaauauu

SEQ ID NO: 3709147 - RNA, 20 nt, Salmonella enterica enterica serovar Typhi Ty2
uaauaaccccagcugcggca

SEQ ID NO: 3709148 - RNA, 19 nt, Salmonella enterica enterica serovar Typhi Ty2
uaauaacgaacugauggcg

SEQ ID NO: 3709149 - RNA, 9 nt, Salmonella enterica enterica serovar Typhi Ty2
uaauaacgg

SEQ ID NO: 3709150 - RNA, 12 nt, Salmonella enterica enterica serovar Typhi Ty2
uaauaaggcgga

SEQ ID NO: 3709151 - RNA, 13 nt, Salmonella enterica enterica serovar Typhi Ty2
uaauaaggcuggc

SEQ ID NO: 3709152 - RNA, 13 nt, Salmonella enterica enterica serovar Typhi Ty2
uaauaauauaaag

SEQ ID NO: 3709153 - RNA, 19 nt, Salmonella enterica enterica serovar Typhi Ty2
uaauaauuagcauccagca

SEQ ID NO: 3709154 - RNA, 21 nt, Salmonella enterica enterica serovar Typhi Ty2
uaauaauugcgguggcgcaaa

SEQ ID NO: 3709155 - RNA, 20 nt, Salmonella enterica enterica serovar Typhi Ty2
uaauacacgguaaauucuuu

SEQ ID NO: 3709156 - RNA, 12 nt, Salmonella enterica enterica serovar Typhi Ty2
uaauacaggcca

SEQ ID NO: 3709157 - RNA, 16 nt, Salmonella enterica enterica serovar Typhi Ty2
uaauacaggccagcau

SEQ ID NO: 3709158 - RNA, 13 nt, Salmonella enterica enterica serovar Typhi Ty2
uaauacaggguuu

SEQ ID NO: 3709159 - RNA, 15 nt, Salmonella enterica enterica serovar Typhi Ty2
uaauacauaucauuu

SEQ ID NO: 3709160 - RNA, 19 nt, Salmonella enterica enterica serovar Typhi Ty2
uaauacaucacuuuaugac

SEQ ID NO: 3709161 - RNA, 17 nt, Salmonella enterica enterica serovar Typhi Ty2
uaauacaucagaaaaca

SEQ ID NO: 3709162 - RNA, 14 nt, Salmonella enterica enterica serovar Typhi Ty2
uaauacaucaugcu

SEQ ID NO: 3709163 - RNA, 15 nt, Salmonella enterica enterica serovar Typhi Ty2
uaauacauugccgca

SEQ ID NO: 3709164 - RNA, 16 nt, Salmonella enterica enterica serovar Typhi Ty2
uaauaccgaaauccgc

SEQ ID NO: 3709165 - RNA, 22 nt, Salmonella enterica enterica serovar Typhi Ty2
uaauacgcgaugagauaauaaa

SEQ ID NO: 3709166 - RNA, 12 nt, Salmonella enterica enterica serovar Typhi Ty2
uaauacucgccc

SEQ ID NO: 3709167 - RNA, 21 nt, Salmonella enterica enterica serovar Typhi Ty2
uaauagagauccuggcgaaag

SEQ ID NO: 3709168 - RNA, 16 nt, Salmonella enterica enterica serovar Typhi Ty2
uaauagaugcgucgca

SEQ ID NO: 3709169 - RNA, 14 nt, Salmonella enterica enterica serovar Typhi Ty2
uaauagauugcgcc

SEQ ID NO: 3709170 - RNA, 23 nt, Salmonella enterica enterica serovar Typhi Ty2
uaauagguacggggcaucuauuu

SEQ ID NO: 3709171 - RNA, 20 nt, Salmonella enterica enterica serovar Typhi Ty2
uaauauaaccaauuuaaaau

SEQ ID NO: 3709172 - RNA, 12 nt, Salmonella enterica enterica serovar Typhi Ty2
uaauauacauuc

SEQ ID NO: 3709173 - RNA, 16 nt, Salmonella enterica enterica serovar Typhi Ty2
uaauauagaguuguga

SEQ ID NO: 3709174 - RNA, 15 nt, Salmonella enterica enterica serovar Typhi Ty2
uaauauccaggagca

SEQ ID NO: 3709175 - RNA, 20 nt, Salmonella enterica enterica serovar Typhi Ty2
uaauauccaggagcauugga

SEQ ID NO: 3709176 - RNA, 21 nt, Salmonella enterica enterica serovar Typhi Ty2
uaauauccaguugcgccagcg

SEQ ID NO: 3709177 - RNA, 24 nt, Salmonella enterica enterica serovar Typhi Ty2
uaauaugccaggcuuccugcgcug

SEQ ID NO: 3709178 - RNA, 20 nt, Salmonella enterica enterica serovar Typhi Ty2
uaauaugcgcaaucaccuca

SEQ ID NO: 3709179 - RNA, 19 nt, Salmonella enterica enterica serovar Typhi Ty2
uaauaugcucaacuuccag

SEQ ID NO: 3709180 - RNA, 16 nt, Salmonella enterica enterica serovar Typhi Ty2
uaauauuaagcagcuu

SEQ ID NO: 3709181 - RNA, 20 nt, Salmonella enterica enterica serovar Typhi Ty2
uaauauuaagcagcuuaucg

SEQ ID NO: 3709182 - RNA, 13 nt, Salmonella enterica enterica serovar Typhi Ty2
uaauauuuauuau

SEQ ID NO: 3709183 - RNA, 16 nt, Salmonella enterica enterica serovar Typhi Ty2
uaaucaaacccuuccg

SEQ ID NO: 3709184 - RNA, 20 nt, Salmonella enterica enterica serovar Typhi Ty2
uaaucaauaaguuuuuucuu

SEQ ID NO: 3709185 - RNA, 19 nt, Salmonella enterica enterica serovar Typhi Ty2
uaaucaauguauuuaaguc

SEQ ID NO: 3709186 - RNA, 16 nt, Salmonella enterica enterica serovar Typhi Ty2
uaaucacaucauuaaa

SEQ ID NO: 3709187 - RNA, 15 nt, Salmonella enterica enterica serovar Typhi Ty2
uaaucaccaccucaa

SEQ ID NO: 3709188 - RNA, 12 nt, Salmonella enterica enterica serovar Typhi Ty2
uaaucaccagcc

SEQ ID NO: 3709189 - RNA, 15 nt, Salmonella enterica enterica serovar Typhi Ty2
uaaucaccagcgcau

SEQ ID NO: 3709190 - RNA, 14 nt, Salmonella enterica enterica serovar Typhi Ty2
uaaucacugcaccu

SEQ ID NO: 3709191 - RNA, 15 nt, Salmonella enterica enterica serovar Typhi Ty2
uaaucacuuuuaccg

SEQ ID NO: 3709192 - RNA, 12 nt, Salmonella enterica enterica serovar Typhi Ty2
uaaucagcagcg

SEQ ID NO: 3709193 - RNA, 16 nt, Salmonella enterica enterica serovar Typhi Ty2
uaaucaggacaucaaa

SEQ ID NO: 3709194 - RNA, 20 nt, Salmonella enterica enterica serovar Typhi Ty2
uaaucaggcauucagcgggu

SEQ ID NO: 3709195 - RNA, 16 nt, Salmonella enterica enterica serovar Typhi Ty2
uaaucauauaagaaau

SEQ ID NO: 3709196 - RNA, 20 nt, Salmonella enterica enterica serovar Typhi Ty2
uaaucauauaagaaauaguu

SEQ ID NO: 3709197 - RNA, 13 nt, Salmonella enterica enterica serovar Typhi Ty2
uaaucaucacgcu

SEQ ID NO: 3709198 - RNA, 18 nt, Salmonella enterica enterica serovar Typhi Ty2
uaauccaggaauuuuccc

SEQ ID NO: 3709199 - RNA, 19 nt, Salmonella enterica enterica serovar Typhi Ty2
uaauccaggaauuuuccca

SEQ ID NO: 3709200 - RNA, 17 nt, Salmonella enterica enterica serovar Typhi Ty2
uaaucccgccagccuua

SEQ ID NO: 3709201 - RNA, 18 nt, Salmonella enterica enterica serovar Typhi Ty2
uaaucccuucuuuuacug

SEQ ID NO: 3709202 - RNA, 11 nt, Salmonella enterica enterica serovar Typhi Ty2
uaaucccuugc

SEQ ID NO: 3709203 - RNA, 19 nt, Salmonella enterica enterica serovar Typhi Ty2
uaauccgacgcuucaaagc

SEQ ID NO: 3709204 - RNA, 15 nt, Salmonella enterica enterica serovar Typhi Ty2
uaauccggcaacugc

SEQ ID NO: 3709205 - RNA, 20 nt, Salmonella enterica enterica serovar Typhi Ty2
uaauccggcaacugccgggg

SEQ ID NO: 3709206 - RNA, 20 nt, Salmonella enterica enterica serovar Typhi Ty2
uaauccuuguccauguaaac

SEQ ID NO: 3709207 - RNA, 17 nt, Salmonella enterica enterica serovar Typhi Ty2
uaaucgaaucgccucaa

SEQ ID NO: 3709208 - RNA, 20 nt, Salmonella enterica enterica serovar Typhi Ty2
uaaucgaaucgccucaacca

SEQ ID NO: 3709209 - RNA, 19 nt, Salmonella enterica enterica serovar Typhi Ty2
uaaucgacaacgcguuuau

SEQ ID NO: 3709210 - RNA, 21 nt, Salmonella enterica enterica serovar Typhi Ty2
uaaucgagacuguuugacacu

SEQ ID NO: 3709211 - RNA, 13 nt, Salmonella enterica enterica serovar Typhi Ty2
uaaucgagcccag

SEQ ID NO: 3709212 - RNA, 15 nt, Salmonella enterica enterica serovar Typhi Ty2
uaaucgauaagccag

SEQ ID NO: 3709213 - RNA, 19 nt, Salmonella enterica enterica serovar Typhi Ty2
uaaucgauaagccagcgau

SEQ ID NO: 3709214 - RNA, 21 nt, Salmonella enterica enterica serovar Typhi Ty2
uaaucgccauugcaauaccgg

SEQ ID NO: 3709215 - RNA, 22 nt, Salmonella enterica enterica serovar Typhi Ty2
uaaucgcccugcgguagcgccg

SEQ ID NO: 3709216 - RNA, 22 nt, Salmonella enterica enterica serovar Typhi Ty2
uaaucgccgugcaguucuucau

SEQ ID NO: 3709217 - RNA, 15 nt, Salmonella enterica enterica serovar Typhi Ty2
uaaucgccugccagc

SEQ ID NO: 3709218 - RNA, 18 nt, Salmonella enterica enterica serovar Typhi Ty2
uaaucgcgagaaaauaga

SEQ ID NO: 3709219 - RNA, 15 nt, Salmonella enterica enterica serovar Typhi Ty2
uaaucgcuucaauca

SEQ ID NO: 3709220 - RNA, 17 nt, Salmonella enterica enterica serovar Typhi Ty2
uaaucggcaggccaacg

SEQ ID NO: 3709221 - RNA, 14 nt, Salmonella enterica enterica serovar Typhi Ty2
uaauuugaaucgcc

SEQ ID NO: 3709222 - RNA, 17 nt, Salmonella enterica enterica serovar Typhi Ty2
uaauuugcaaaccauga

SEQ ID NO: 3709223 - RNA, 23 nt, Salmonella enterica enterica serovar Typhi Ty2
uaauuugcaaaccaugauaauaa

SEQ ID NO: 3709224 - RNA, 15 nt, Salmonella enterica enterica serovar Typhi Ty2
uaauuugcuccagaa

SEQ ID NO: 3709225 - RNA, 16 nt, Salmonella enterica enterica serovar Typhi Ty2
uaauuuuacuuucauu

SEQ ID NO: 3709226 - RNA, 11 nt, Salmonella enterica enterica serovar Typhi Ty2
uaauuuuagaa

SEQ ID NO: 3709227 - RNA, 17 nt, Salmonella enterica enterica serovar Typhi Ty2
uaauuuuagaaauagaa

SEQ ID NO: 3709228 - RNA, 13 nt, Salmonella enterica enterica serovar Typhi Ty2
uaauuuucaccuc

SEQ ID NO: 3709229 - RNA, 17 nt, Salmonella enterica enterica serovar Typhi Ty2
uaauuuucaccuccggg

SEQ ID NO: 3709230 - RNA, 19 nt, Salmonella enterica enterica serovar Typhi Ty2
uaauuuucccaguucaucc

SEQ ID NO: 3709231 - RNA, 20 nt, Salmonella enterica enterica serovar Typhi Ty2
uaauuuucccaguucaucca

SEQ ID NO: 3709232 - RNA, 19 nt, Salmonella enterica enterica serovar Typhi Ty2
uaauuuuguuaaagugagu

SEQ ID NO: 3709233 - RNA, 20 nt, Salmonella enterica enterica serovar Typhi Ty2
uaauuuuuaugucauuuauu

SEQ ID NO: 3709234 - RNA, 15 nt, Salmonella enterica enterica serovar Typhi Ty2
uacaaaaaagauaac

SEQ ID NO: 3709235 - RNA, 12 nt, Salmonella enterica enterica serovar Typhi Ty2
uacaaaaaauac

SEQ ID NO: 3709236 - RNA, 15 nt, Salmonella enterica enterica serovar Typhi Ty2
uacaaaauaagucau

SEQ ID NO: 3709237 - RNA, 21 nt, Salmonella enterica enterica serovar Typhi Ty2
uacaaaauaagucauaucaau

SEQ ID NO: 3709238 - RNA, 18 nt, Salmonella enterica enterica serovar Typhi Ty2
uacaaacaaauaaaucca

SEQ ID NO: 3709239 - RNA, 23 nt, Salmonella enterica enterica serovar Typhi Ty2
uacaaacaguuuuuccuuucugc

SEQ ID NO: 3709240 - RNA, 19 nt, Salmonella enterica enterica serovar Typhi Ty2
uacaaaccccacccacuga

SEQ ID NO: 3709241 - RNA, 15 nt, Salmonella enterica enterica serovar Typhi Ty2
uacaaacgcaccgcc

SEQ ID NO: 3709242 - RNA, 17 nt, Salmonella enterica enterica serovar Typhi Ty2
uacaaaucucagggugu

SEQ ID NO: 3709243 - RNA, 13 nt, Salmonella enterica enterica serovar Typhi Ty2
uacaaccgcaccg

SEQ ID NO: 3709244 - RNA, 21 nt, Salmonella enterica enterica serovar Typhi Ty2
uacaacgacuacguucaucag

SEQ ID NO: 3709245 - RNA, 22 nt, Salmonella enterica enterica serovar Typhi Ty2
uacaacgacuacguucaucagg

SEQ ID NO: 3709246 - RNA, 21 nt, Salmonella enterica enterica serovar Typhi Ty2
uacaacguucggucauggaua

SEQ ID NO: 3709247 - RNA, 22 nt, Salmonella enterica enterica serovar Typhi Ty2
uacaacuacucguaaucuaaaa

SEQ ID NO: 3709248 - RNA, 16 nt, Salmonella enterica enterica serovar Typhi Ty2
uacaacucauccaccu

SEQ ID NO: 3709249 - RNA, 12 nt, Salmonella enterica enterica serovar Typhi Ty2
uacaacugucgu

SEQ ID NO: 3709250 - RNA, 18 nt, Salmonella enterica enterica serovar Typhi Ty2
uacaagaauaugcagugc

SEQ ID NO: 3709251 - RNA, 20 nt, Salmonella enterica enterica serovar Typhi Ty2
uacaagaauuuaucgcaaua

SEQ ID NO: 3709252 - RNA, 16 nt, Salmonella enterica enterica serovar Typhi Ty2
uacaagcaguuaauac

SEQ ID NO: 3709253 - RNA, 23 nt, Salmonella enterica enterica serovar Typhi Ty2
uacaagcguuuaauuccaucggc

SEQ ID NO: 3709254 - RNA, 17 nt, Salmonella enterica enterica serovar Typhi Ty2
uacaagguauccgccau

SEQ ID NO: 3709255 - RNA, 15 nt, Salmonella enterica enterica serovar Typhi Ty2
uacaaguaauaaaau

SEQ ID NO: 3709256 - RNA, 17 nt, Salmonella enterica enterica serovar Typhi Ty2
uacaaguaauaaaauaa

SEQ ID NO: 3709257 - RNA, 19 nt, Salmonella enterica enterica serovar Typhi Ty2
uacaaguaauaaaauaaua

SEQ ID NO: 3709258 - RNA, 14 nt, Salmonella enterica enterica serovar Typhi Ty2
uacaauggcaggca

SEQ ID NO: 3709259 - RNA, 21 nt, Salmonella enterica enterica serovar Typhi Ty2
uacaauuauugcguugcuuua

SEQ ID NO: 3709260 - RNA, 15 nt, Salmonella enterica enterica serovar Typhi Ty2
uacaauuuaucugcg

SEQ ID NO: 3709261 - RNA, 10 nt, Salmonella enterica enterica serovar Typhi Ty2
uacaauuucg

SEQ ID NO: 3709262 - RNA, 14 nt, Salmonella enterica enterica serovar Typhi Ty2
uacaauuucgcaaa

SEQ ID NO: 3709263 - RNA, 14 nt, Salmonella enterica enterica serovar Typhi Ty2
uacacagacugcuu

SEQ ID NO: 3709264 - RNA, 16 nt, Salmonella enterica enterica serovar Typhi Ty2
uacacaucaggaaugc

SEQ ID NO: 3709265 - RNA, 18 nt, Salmonella enterica enterica serovar Typhi Ty2
uacaccccuucuggagaa

SEQ ID NO: 3709266 - RNA, 14 nt, Salmonella enterica enterica serovar Typhi Ty2
uacaccgccauaua

SEQ ID NO: 3709267 - RNA, 16 nt, Salmonella enterica enterica serovar Typhi Ty2
uacaccgccauccggc

SEQ ID NO: 3709268 - RNA, 22 nt, Salmonella enterica enterica serovar Typhi Ty2
uacaccgccuagcgucccggca

SEQ ID NO: 3709269 - RNA, 18 nt, Salmonella enterica enterica serovar Typhi Ty2
uacaccguaaagcaccau

SEQ ID NO: 3709270 - RNA, 20 nt, Salmonella enterica enterica serovar Typhi Ty2
uacaccugacggcagccacg

SEQ ID NO: 3709271 - RNA, 20 nt, Salmonella enterica enterica serovar Typhi Ty2
uacacgauaaaccucacgca

SEQ ID NO: 3709272 - RNA, 23 nt, Salmonella enterica enterica serovar Typhi Ty2
uacacgcaucgggucgcgcgccg

SEQ ID NO: 3709273 - RNA, 19 nt, Salmonella enterica enterica serovar Typhi Ty2
uacacgccgacgcauccgc

SEQ ID NO: 3709274 - RNA, 15 nt, Salmonella enterica enterica serovar Typhi Ty2
uacacgccuuccucc

SEQ ID NO: 3709275 - RNA, 17 nt, Salmonella enterica enterica serovar Typhi Ty2
uacacgccuuccuccag

SEQ ID NO: 3709276 - RNA, 16 nt, Salmonella enterica enterica serovar Typhi Ty2
uacacucaaccaucaa

SEQ ID NO: 3709277 - RNA, 21 nt, Salmonella enterica enterica serovar Typhi Ty2
uacacugaagccuggugccca

SEQ ID NO: 3709278 - RNA, 17 nt, Salmonella enterica enterica serovar Typhi Ty2
uacagaaaaccggcaaa

SEQ ID NO: 3709279 - RNA, 12 nt, Salmonella enterica enterica serovar Typhi Ty2
uacagacaucau

SEQ ID NO: 3709280 - RNA, 20 nt, Salmonella enterica enterica serovar Typhi Ty2
uacagacaucaucgaacgcc

SEQ ID NO: 3709281 - RNA, 13 nt, Salmonella enterica enterica serovar Typhi Ty2
uacagagucgcuu

SEQ ID NO: 3709282 - RNA, 17 nt, Salmonella enterica enterica serovar Typhi Ty2
uacagaugaacguaacg

SEQ ID NO: 3709283 - RNA, 22 nt, Salmonella enterica enterica serovar Typhi Ty2
uacagaugccguccauccggcg

SEQ ID NO: 3709284 - RNA, 13 nt, Salmonella enterica enterica serovar Typhi Ty2
uacagaugcugua

SEQ ID NO: 3709285 - RNA, 17 nt, Salmonella enterica enterica serovar Typhi Ty2
uacagcaauaaaaggaa

SEQ ID NO: 3709286 - RNA, 19 nt, Salmonella enterica enterica serovar Typhi Ty2
uacagcacgacguagccca

SEQ ID NO: 3709287 - RNA, 13 nt, Salmonella enterica enterica serovar Typhi Ty2
uacagcacgccgg

SEQ ID NO: 3709288 - RNA, 14 nt, Salmonella enterica enterica serovar Typhi Ty2
uacagcacuucccg

SEQ ID NO: 3709289 - RNA, 15 nt, Salmonella enterica enterica serovar Typhi Ty2
uacagcagcgacgca

SEQ ID NO: 3709290 - RNA, 18 nt, Salmonella enterica enterica serovar Typhi Ty2
uacagccaaaucagcagg

SEQ ID NO: 3709291 - RNA, 20 nt, Salmonella enterica enterica serovar Typhi Ty2
uacagcccgccagcaccagg

SEQ ID NO: 3709292 - RNA, 21 nt, Salmonella enterica enterica serovar Typhi Ty2
uacagccgacuauuccgcaaa

SEQ ID NO: 3709293 - RNA, 16 nt, Salmonella enterica enterica serovar Typhi Ty2
uacagccgcgaugcua

SEQ ID NO: 3709294 - RNA, 18 nt, Salmonella enterica enterica serovar Typhi Ty2
uacagccugcgugaaucc

SEQ ID NO: 3709295 - RNA, 15 nt, Salmonella enterica enterica serovar Typhi Ty2
uacagcguguucaug

SEQ ID NO: 3709296 - RNA, 19 nt, Salmonella enterica enterica serovar Typhi Ty2
uacagcucauaaacgcgau

SEQ ID NO: 3709297 - RNA, 18 nt, Salmonella enterica enterica serovar Typhi Ty2
uacagcuuaaucaccagc

SEQ ID NO: 3709298 - RNA, 19 nt, Salmonella enterica enterica serovar Typhi Ty2
uacagcuuaaucaccagcg

SEQ ID NO: 3709299 - RNA, 19 nt, Salmonella enterica enterica serovar Typhi Ty2
uacagcuuuuacaaccaau

SEQ ID NO: 3709300 - RNA, 20 nt, Salmonella enterica enterica serovar Typhi Ty2
uacaggaguuagcauguggg

SEQ ID NO: 3709301 - RNA, 13 nt, Salmonella enterica enterica serovar Typhi Ty2
uacaggcaucuuc

SEQ ID NO: 3709302 - RNA, 16 nt, Salmonella enterica enterica serovar Typhi Ty2
uacaggcaucuuccag

SEQ ID NO: 3709303 - RNA, 20 nt, Salmonella enterica enterica serovar Typhi Ty2
uaccugccgccauaacgccg

SEQ ID NO: 3709304 - RNA, 17 nt, Salmonella enterica enterica serovar Typhi Ty2
uaccugccugucacgca

SEQ ID NO: 3709305 - RNA, 17 nt, Salmonella enterica enterica serovar Typhi Ty2
uaccuggguagcgccau

SEQ ID NO: 3709306 - RNA, 14 nt, Salmonella enterica enterica serovar Typhi Ty2
uaccuguuuaucug

SEQ ID NO: 3709307 - RNA, 15 nt, Salmonella enterica enterica serovar Typhi Ty2
uaccuuaaugaugug

SEQ ID NO: 3709308 - RNA, 22 nt, Salmonella enterica enterica serovar Typhi Ty2
uaccuuacggacugcggccugc

SEQ ID NO: 3709309 - RNA, 16 nt, Salmonella enterica enterica serovar Typhi Ty2
uaccuuauucagccca

SEQ ID NO: 3709310 - RNA, 19 nt, Salmonella enterica enterica serovar Typhi Ty2
uaccuucacccccaucgcc

SEQ ID NO: 3709311 - RNA, 19 nt, Salmonella enterica enterica serovar Typhi Ty2
uaccuucccgcgauaaaaa

SEQ ID NO: 3709312 - RNA, 21 nt, Salmonella enterica enterica serovar Typhi Ty2
uaccuucgcguuuaucaccaa

SEQ ID NO: 3709313 - RNA, 23 nt, Salmonella enterica enterica serovar Typhi Ty2
uaccuucggccuccgcuuccugc

SEQ ID NO: 3709314 - RNA, 16 nt, Salmonella enterica enterica serovar Typhi Ty2
uaccuucuauuuuucc

SEQ ID NO: 3709315 - RNA, 13 nt, Salmonella enterica enterica serovar Typhi Ty2
uaccuucugccgc

SEQ ID NO: 3709316 - RNA, 23 nt, Salmonella enterica enterica serovar Typhi Ty2
uaccuucuucacuaaaaacaggc

SEQ ID NO: 3709317 - RNA, 14 nt, Salmonella enterica enterica serovar Typhi Ty2
uaccuuguucuucc

SEQ ID NO: 3709318 - RNA, 19 nt, Salmonella enterica enterica serovar Typhi Ty2
uaccuuuaaacuguuucca

SEQ ID NO: 3709319 - RNA, 23 nt, Salmonella enterica enterica serovar Typhi Ty2
uaccuuuuccggcggcaguccca

SEQ ID NO: 3709320 - RNA, 12 nt, Salmonella enterica enterica serovar Typhi Ty2
uaccuuuuccuc

SEQ ID NO: 3709321 - RNA, 22 nt, Salmonella enterica enterica serovar Typhi Ty2
uaccuuuuccucgucauaucug

SEQ ID NO: 3709322 - RNA, 18 nt, Salmonella enterica enterica serovar Typhi Ty2
uaccuuuuuucaguaauu

SEQ ID NO: 3709323 - RNA, 18 nt, Salmonella enterica enterica serovar Typhi Ty2
uacgaaaauacgcggaug

SEQ ID NO: 3709324 - RNA, 20 nt, Salmonella enterica enterica serovar Typhi Ty2
uacgaauuuuaucuuccggc

SEQ ID NO: 3709325 - RNA, 20 nt, Salmonella enterica enterica serovar Typhi Ty2
uacgacacccgauacacgcc

SEQ ID NO: 3709326 - RNA, 13 nt, Salmonella enterica enterica serovar Typhi Ty2
uacgaccgcagaa

SEQ ID NO: 3709327 - RNA, 16 nt, Salmonella enterica enterica serovar Typhi Ty2
uacgaccgcagaaaca

SEQ ID NO: 3709328 - RNA, 12 nt, Salmonella enterica enterica serovar Typhi Ty2
uacgacgcgcca

SEQ ID NO: 3709329 - RNA, 21 nt, Salmonella enterica enterica serovar Typhi Ty2
uacgacugcacccaucuuuac

SEQ ID NO: 3709330 - RNA, 19 nt, Salmonella enterica enterica serovar Typhi Ty2
uacgagugacauuauucac

SEQ ID NO: 3709331 - RNA, 17 nt, Salmonella enterica enterica serovar Typhi Ty2
uacgauagcaauuaaua

SEQ ID NO: 3709332 - RNA, 18 nt, Salmonella enterica enterica serovar Typhi Ty2
uacgauagcaauuaauaa

SEQ ID NO: 3709333 - RNA, 23 nt, Salmonella enterica enterica serovar Typhi Ty2
uacgaucgucuggcgagaacacg

SEQ ID NO: 3709334 - RNA, 13 nt, Salmonella enterica enterica serovar Typhi Ty2
uacgaucugacau

SEQ ID NO: 3709335 - RNA, 18 nt, Salmonella enterica enterica serovar Typhi Ty2
uacgauucagguuuugcu

SEQ ID NO: 3709336 - RNA, 23 nt, Salmonella enterica enterica serovar Typhi Ty2
uacgauucagguuuugcugauca

SEQ ID NO: 3709337 - RNA, 16 nt, Salmonella enterica enterica serovar Typhi Ty2
uacgcaaaaaaagcca

SEQ ID NO: 3709338 - RNA, 17 nt, Salmonella enterica enterica serovar Typhi Ty2
uacgcaaaaaaagccau

SEQ ID NO: 3709339 - RNA, 12 nt, Salmonella enterica enterica serovar Typhi Ty2
uacgcaaaucac

SEQ ID NO: 3709340 - RNA, 13 nt, Salmonella enterica enterica serovar Typhi Ty2
uacgcaaggaaau

SEQ ID NO: 3709341 - RNA, 17 nt, Salmonella enterica enterica serovar Typhi Ty2
uacgcaaggaaauauua

SEQ ID NO: 3709342 - RNA, 21 nt, Salmonella enterica enterica serovar Typhi Ty2
uacgcaccagcucuacaucgc

SEQ ID NO: 3709343 - RNA, 23 nt, Salmonella enterica enterica serovar Typhi Ty2
uacgcaccagcucuacaucgccg

SEQ ID NO: 3709344 - RNA, 19 nt, Salmonella enterica enterica serovar Typhi Ty2
uacgcaccgucgagaaacc

SEQ ID NO: 3709345 - RNA, 23 nt, Salmonella enterica enterica serovar Typhi Ty2
uacgcagauaacuuccuuugccu

SEQ ID NO: 3709346 - RNA, 18 nt, Salmonella enterica enterica serovar Typhi Ty2
uacgcagaucguauccag

SEQ ID NO: 3709347 - RNA, 20 nt, Salmonella enterica enterica serovar Typhi Ty2
uacgcagaucuuuuugcucc

SEQ ID NO: 3709348 - RNA, 16 nt, Salmonella enterica enterica serovar Typhi Ty2
uacgcagcaggcagac

SEQ ID NO: 3709349 - RNA, 16 nt, Salmonella enterica enterica serovar Typhi Ty2
uacgcagccccauuug

SEQ ID NO: 3709350 - RNA, 17 nt, Salmonella enterica enterica serovar Typhi Ty2
uacgcagcgccuucgcu

SEQ ID NO: 3709351 - RNA, 18 nt, Salmonella enterica enterica serovar Typhi Ty2
uacgcaggacuuucgcuu

SEQ ID NO: 3709352 - RNA, 13 nt, Salmonella enterica enterica serovar Typhi Ty2
uacgcaucaccag

SEQ ID NO: 3709353 - RNA, 18 nt, Salmonella enterica enterica serovar Typhi Ty2
uacgcaucaccaggcaau

SEQ ID NO: 3709354 - RNA, 16 nt, Salmonella enterica enterica serovar Typhi Ty2
uacgccagacagcauu

SEQ ID NO: 3709355 - RNA, 16 nt, Salmonella enterica enterica serovar Typhi Ty2
uacgccagcagacagg

SEQ ID NO: 3709356 - RNA, 15 nt, Salmonella enterica enterica serovar Typhi Ty2
uacgccagccuaucg

SEQ ID NO: 3709357 - RNA, 22 nt, Salmonella enterica enterica serovar Typhi Ty2
uacgccaucaggcauggcagca

SEQ ID NO: 3709358 - RNA, 18 nt, Salmonella enterica enterica serovar Typhi Ty2
uacgccaucuuucuuuuc

SEQ ID NO: 3709359 - RNA, 22 nt, Salmonella enterica enterica serovar Typhi Ty2
uacgcccagccgugaaugguca

SEQ ID NO: 3709360 - RNA, 22 nt, Salmonella enterica enterica serovar Typhi Ty2
uacgcccaggucgcccagccau

SEQ ID NO: 3709361 - RNA, 20 nt, Salmonella enterica enterica serovar Typhi Ty2
uacgcccaucagcccgcaaa

SEQ ID NO: 3709362 - RNA, 15 nt, Salmonella enterica enterica serovar Typhi Ty2
uacgccccacuuuca

SEQ ID NO: 3709363 - RNA, 14 nt, Salmonella enterica enterica serovar Typhi Ty2
uacgccccugcugg

SEQ ID NO: 3709364 - RNA, 18 nt, Salmonella enterica enterica serovar Typhi Ty2
uacgcccgugacgccagg

SEQ ID NO: 3709365 - RNA, 15 nt, Salmonella enterica enterica serovar Typhi Ty2
uacgcccucaucggc

SEQ ID NO: 3709366 - RNA, 18 nt, Salmonella enterica enterica serovar Typhi Ty2
uacgcccucaucggcaaa

SEQ ID NO: 3709367 - RNA, 19 nt, Salmonella enterica enterica serovar Typhi Ty2
uacgccguccggcgaacaa

SEQ ID NO: 3709368 - RNA, 24 nt, Salmonella enterica enterica serovar Typhi Ty2
uacgccuaaauuuaacucguccug

SEQ ID NO: 3709369 - RNA, 14 nt, Salmonella enterica enterica serovar Typhi Ty2
uacgccucuuucag

SEQ ID NO: 3709370 - RNA, 13 nt, Salmonella enterica enterica serovar Typhi Ty2
uacgccugccugg

SEQ ID NO: 3709371 - RNA, 13 nt, Salmonella enterica enterica serovar Typhi Ty2
uacgccugucgca

SEQ ID NO: 3709372 - RNA, 12 nt, Salmonella enterica enterica serovar Typhi Ty2
uacgccuuaucc

SEQ ID NO: 3709373 - RNA, 16 nt, Salmonella enterica enterica serovar Typhi Ty2
uacgccuuauccggcc

SEQ ID NO: 3709374 - RNA, 23 nt, Salmonella enterica enterica serovar Typhi Ty2
uacgcgauaaaaacccaccagcg

SEQ ID NO: 3709375 - RNA, 20 nt, Salmonella enterica enterica serovar Typhi Ty2
uacgcgcaaccgcaucacgc

SEQ ID NO: 3709376 - RNA, 18 nt, Salmonella enterica enterica serovar Typhi Ty2
uacgcgccacgccauugc

SEQ ID NO: 3709377 - RNA, 15 nt, Salmonella enterica enterica serovar Typhi Ty2
uacgcgccugccuga

SEQ ID NO: 3709378 - RNA, 23 nt, Salmonella enterica enterica serovar Typhi Ty2
uacgcggccaaaacccaccagca

SEQ ID NO: 3709379 - RNA, 20 nt, Salmonella enterica enterica serovar Typhi Ty2
uacgcggcgcgccguaaaca

SEQ ID NO: 3709380 - RNA, 17 nt, Salmonella enterica enterica serovar Typhi Ty2
uacgcuauaaaguuccc

SEQ ID NO: 3709381 - RNA, 15 nt, Salmonella enterica enterica serovar Typhi Ty2
uacgcuauuuaaaaa

SEQ ID NO: 3709382 - RNA, 17 nt, Salmonella enterica enterica serovar Typhi Ty2
uacgcuccagcuggcug

SEQ ID NO: 3709383 - RNA, 14 nt, Salmonella enterica enterica serovar Typhi Ty2
uacgcucgcugaug

SEQ ID NO: 3709384 - RNA, 21 nt, Salmonella enterica enterica serovar Typhi Ty2
uacgcucgcugauggcgagaa

SEQ ID NO: 3709385 - RNA, 13 nt, Salmonella enterica enterica serovar Typhi Ty2
uacugaccagaca

SEQ ID NO: 3709386 - RNA, 16 nt, Salmonella enterica enterica serovar Typhi Ty2
uacugaccggcccguu

SEQ ID NO: 3709387 - RNA, 13 nt, Salmonella enterica enterica serovar Typhi Ty2
uacugacuaacgc

SEQ ID NO: 3709388 - RNA, 18 nt, Salmonella enterica enterica serovar Typhi Ty2
uacugauaaaggauaaua

SEQ ID NO: 3709389 - RNA, 18 nt, Salmonella enterica enterica serovar Typhi Ty2
uacugauuaauugcgaca

SEQ ID NO: 3709390 - RNA, 17 nt, Salmonella enterica enterica serovar Typhi Ty2
uacugcaacgccagaug

SEQ ID NO: 3709391 - RNA, 20 nt, Salmonella enterica enterica serovar Typhi Ty2
uacugcaacgccagaugcgu

SEQ ID NO: 3709392 - RNA, 15 nt, Salmonella enterica enterica serovar Typhi Ty2
uacugcauuuucaau

SEQ ID NO: 3709393 - RNA, 22 nt, Salmonella enterica enterica serovar Typhi Ty2
uacugccgcccaucgccacagc

SEQ ID NO: 3709394 - RNA, 20 nt, Salmonella enterica enterica serovar Typhi Ty2
uacugcuggccuaucuguuc

SEQ ID NO: 3709395 - RNA, 18 nt, Salmonella enterica enterica serovar Typhi Ty2
uacugcuuagcucaucag

SEQ ID NO: 3709396 - RNA, 22 nt, Salmonella enterica enterica serovar Typhi Ty2
uacugcuuuuccggcagcgcau

SEQ ID NO: 3709397 - RNA, 14 nt, Salmonella enterica enterica serovar Typhi Ty2
uacuggaaaaaacg

SEQ ID NO: 3709398 - RNA, 15 nt, Salmonella enterica enterica serovar Typhi Ty2
uacuggaucauacau

SEQ ID NO: 3709399 - RNA, 17 nt, Salmonella enterica enterica serovar Typhi Ty2
uacuggaucgcuccauu

SEQ ID NO: 3709400 - RNA, 15 nt, Salmonella enterica enterica serovar Typhi Ty2
uacuggcgauuuuca

SEQ ID NO: 3709401 - RNA, 15 nt, Salmonella enterica enterica serovar Typhi Ty2
uacuggcuaucuuua

SEQ ID NO: 3709402 - RNA, 16 nt, Salmonella enterica enterica serovar Typhi Ty2
uacuguuuuugcuuua

SEQ ID NO: 3709403 - RNA, 20 nt, Salmonella enterica enterica serovar Typhi Ty2
uacuguuuuugcuuuaauau

SEQ ID NO: 3709404 - RNA, 22 nt, Salmonella enterica enterica serovar Typhi Ty2
uacuguuuuugcuuuaauauuc

SEQ ID NO: 3709405 - RNA, 14 nt, Salmonella enterica enterica serovar Typhi Ty2
uacuuaaaauugaa

SEQ ID NO: 3709406 - RNA, 19 nt, Salmonella enterica enterica serovar Typhi Ty2
uacuuauagcuggcuuuau

SEQ ID NO: 3709407 - RNA, 14 nt, Salmonella enterica enterica serovar Typhi Ty2
uacuuauauuuauu

SEQ ID NO: 3709408 - RNA, 15 nt, Salmonella enterica enterica serovar Typhi Ty2
uacuuauauuuauuu

SEQ ID NO: 3709409 - RNA, 22 nt, Salmonella enterica enterica serovar Typhi Ty2
uacuucacaauaagaaauuuag

SEQ ID NO: 3709410 - RNA, 22 nt, Salmonella enterica enterica serovar Typhi Ty2
uacuuccgguugaccgcauaau

SEQ ID NO: 3709411 - RNA, 17 nt, Salmonella enterica enterica serovar Typhi Ty2
uacuugcgccgccaucc

SEQ ID NO: 3709412 - RNA, 16 nt, Salmonella enterica enterica serovar Typhi Ty2
uacuuguugagugaau

SEQ ID NO: 3709413 - RNA, 12 nt, Salmonella enterica enterica serovar Typhi Ty2
uacuuucaaaau

SEQ ID NO: 3709414 - RNA, 15 nt, Salmonella enterica enterica serovar Typhi Ty2
uacuuucaaaauacu

SEQ ID NO: 3709415 - RNA, 21 nt, Salmonella enterica enterica serovar Typhi Ty2
uacuuucacuaccacuuucuu

SEQ ID NO: 3709416 - RNA, 19 nt, Salmonella enterica enterica serovar Typhi Ty2
uacuuucagauaauucuaa

SEQ ID NO: 3709417 - RNA, 13 nt, Salmonella enterica enterica serovar Typhi Ty2
uacuuuccagcaa

SEQ ID NO: 3709418 - RNA, 16 nt, Salmonella enterica enterica serovar Typhi Ty2
uacuuuccauauacuc

SEQ ID NO: 3709419 - RNA, 18 nt, Salmonella enterica enterica serovar Typhi Ty2
uacuuucuugccacuggc

SEQ ID NO: 3709420 - RNA, 19 nt, Salmonella enterica enterica serovar Typhi Ty2
uacuuugcgcccagauaau

SEQ ID NO: 3709421 - RNA, 17 nt, Salmonella enterica enterica serovar Typhi Ty2
uacuuuggccuaacagu

SEQ ID NO: 3709422 - RNA, 13 nt, Salmonella enterica enterica serovar Typhi Ty2
uacuuuuuuaaau

SEQ ID NO: 3709423 - RNA, 14 nt, Salmonella enterica enterica serovar Typhi Ty2
uagaaaaaauuaaa

SEQ ID NO: 3709424 - RNA, 16 nt, Salmonella enterica enterica serovar Typhi Ty2
uagaaaaaauuaaaaa

SEQ ID NO: 3709425 - RNA, 16 nt, Salmonella enterica enterica serovar Typhi Ty2
uagaaaaggucgucag

SEQ ID NO: 3709426 - RNA, 19 nt, Salmonella enterica enterica serovar Typhi Ty2
uagaaaaggucgucaggcc

SEQ ID NO: 3709427 - RNA, 17 nt, Salmonella enterica enterica serovar Typhi Ty2
uagaaagauuucaucag

SEQ ID NO: 3709428 - RNA, 22 nt, Salmonella enterica enterica serovar Typhi Ty2
uagaaagauuucaucaggcuga

SEQ ID NO: 3709429 - RNA, 23 nt, Salmonella enterica enterica serovar Typhi Ty2
uagaaagucuuuuguuuuucucu

SEQ ID NO: 3709430 - RNA, 14 nt, Salmonella enterica enterica serovar Typhi Ty2
uagaacagcaugaa

SEQ ID NO: 3709431 - RNA, 14 nt, Salmonella enterica enterica serovar Typhi Ty2
uagaacccaaagcc

SEQ ID NO: 3709432 - RNA, 16 nt, Salmonella enterica enterica serovar Typhi Ty2
uagaacggaaguugca

SEQ ID NO: 3709433 - RNA, 16 nt, Salmonella enterica enterica serovar Typhi Ty2
uagaagccacaaucug

SEQ ID NO: 3709434 - RNA, 19 nt, Salmonella enterica enterica serovar Typhi Ty2
uagaagcucaugugcagca

SEQ ID NO: 3709435 - RNA, 20 nt, Salmonella enterica enterica serovar Typhi Ty2
uagaagcucaugugcagcau

SEQ ID NO: 3709436 - RNA, 14 nt, Salmonella enterica enterica serovar Typhi Ty2
uagaaguuaugcau

SEQ ID NO: 3709437 - RNA, 16 nt, Salmonella enterica enterica serovar Typhi Ty2
uagaauacuuccugcu

SEQ ID NO: 3709438 - RNA, 16 nt, Salmonella enterica enterica serovar Typhi Ty2
uagaauagaaucaauu

SEQ ID NO: 3709439 - RNA, 21 nt, Salmonella enterica enterica serovar Typhi Ty2
uagaauagaaucaauuucucu

SEQ ID NO: 3709440 - RNA, 16 nt, Salmonella enterica enterica serovar Typhi Ty2
uagaauaggaaauaau

SEQ ID NO: 3709441 - RNA, 23 nt, Salmonella enterica enterica serovar Typhi Ty2
uagaaucaauuucucuuuuauua

SEQ ID NO: 3709442 - RNA, 18 nt, Salmonella enterica enterica serovar Typhi Ty2
uagaaucugguuguuucg

SEQ ID NO: 3709443 - RNA, 15 nt, Salmonella enterica enterica serovar Typhi Ty2
uagaaugcuucuucg

SEQ ID NO: 3709444 - RNA, 18 nt, Salmonella enterica enterica serovar Typhi Ty2
uagaaugcuucuucgcca

SEQ ID NO: 3709445 - RNA, 17 nt, Salmonella enterica enterica serovar Typhi Ty2
uagaauuaucugaaagu

SEQ ID NO: 3709446 - RNA, 19 nt, Salmonella enterica enterica serovar Typhi Ty2
uagaauuuucacuuauaaa

SEQ ID NO: 3709447 - RNA, 20 nt, Salmonella enterica enterica serovar Typhi Ty2
uagacaacaucccagaaaau

SEQ ID NO: 3709448 - RNA, 21 nt, Salmonella enterica enterica serovar Typhi Ty2
uagacaauugcugcguaacug

SEQ ID NO: 3709449 - RNA, 20 nt, Salmonella enterica enterica serovar Typhi Ty2
uagacagcggcuaauuuauu

SEQ ID NO: 3709450 - RNA, 22 nt, Salmonella enterica enterica serovar Typhi Ty2
uagacaguuuuuucguuccaga

SEQ ID NO: 3709451 - RNA, 21 nt, Salmonella enterica enterica serovar Typhi Ty2
uagaccacgccaucaacagcg

SEQ ID NO: 3709452 - RNA, 17 nt, Salmonella enterica enterica serovar Typhi Ty2
uagaccugaaaucagcc

SEQ ID NO: 3709453 - RNA, 18 nt, Salmonella enterica enterica serovar Typhi Ty2
uagaccugaaaucagccu

SEQ ID NO: 3709454 - RNA, 22 nt, Salmonella enterica enterica serovar Typhi Ty2
uagaccugcuccaugacguuca

SEQ ID NO: 3709455 - RNA, 22 nt, Salmonella enterica enterica serovar Typhi Ty2
uagacgacaucuuuuccugaag

SEQ ID NO: 3709456 - RNA, 23 nt, Salmonella enterica enterica serovar Typhi Ty2
uagacgagcgaaaaacugucgcc

SEQ ID NO: 3709457 - RNA, 18 nt, Salmonella enterica enterica serovar Typhi Ty2
uagacgcgcuagcuucag

SEQ ID NO: 3709458 - RNA, 15 nt, Salmonella enterica enterica serovar Typhi Ty2
uagacggccugcaaa

SEQ ID NO: 3709459 - RNA, 24 nt, Salmonella enterica enterica serovar Typhi Ty2
uagacggccugcaaacgaaucacc

SEQ ID NO: 3709460 - RNA, 21 nt, Salmonella enterica enterica serovar Typhi Ty2
uagacuggcgccgucacguuc

SEQ ID NO: 3709461 - RNA, 14 nt, Salmonella enterica enterica serovar Typhi Ty2
uagagaaaauaaca

SEQ ID NO: 3709462 - RNA, 21 nt, Salmonella enterica enterica serovar Typhi Ty2
uagagaacagcaucaccggcc

SEQ ID NO: 3709463 - RNA, 15 nt, Salmonella enterica enterica serovar Typhi Ty2
uagagcaucgcggca

SEQ ID NO: 3709464 - RNA, 18 nt, Salmonella enterica enterica serovar Typhi Ty2
uagagcguggucauuagg

SEQ ID NO: 3709465 - RNA, 16 nt, Salmonella enterica enterica serovar Typhi Ty2
uagagguguuauggca

SEQ ID NO: 3709466 - RNA, 15 nt, Salmonella enterica enterica serovar Typhi Ty2
uagauaacaccgcau

SEQ ID NO: 3709467 - RNA, 19 nt, Salmonella enterica enterica serovar Typhi Ty2
uagcgcugugcuaucaggc

SEQ ID NO: 3709468 - RNA, 13 nt, Salmonella enterica enterica serovar Typhi Ty2
uagcggaacugcg

SEQ ID NO: 3709469 - RNA, 22 nt, Salmonella enterica enterica serovar Typhi Ty2
uagcggaacugcguuugaaaua

SEQ ID NO: 3709470 - RNA, 21 nt, Salmonella enterica enterica serovar Typhi Ty2
uagcggcacagauacgaggug

SEQ ID NO: 3709471 - RNA, 21 nt, Salmonella enterica enterica serovar Typhi Ty2
uagcggcagccaugcuauuca

SEQ ID NO: 3709472 - RNA, 12 nt, Salmonella enterica enterica serovar Typhi Ty2
uagcggcaggga

SEQ ID NO: 3709473 - RNA, 14 nt, Salmonella enterica enterica serovar Typhi Ty2
uagcggccagaugg

SEQ ID NO: 3709474 - RNA, 19 nt, Salmonella enterica enterica serovar Typhi Ty2
uagcggcuaaucaccaccu

SEQ ID NO: 3709475 - RNA, 16 nt, Salmonella enterica enterica serovar Typhi Ty2
uagcggcugcggcgca

SEQ ID NO: 3709476 - RNA, 16 nt, Salmonella enterica enterica serovar Typhi Ty2
uagcgggcaaugccac

SEQ ID NO: 3709477 - RNA, 18 nt, Salmonella enterica enterica serovar Typhi Ty2
uagcgggcaaugccacca

SEQ ID NO: 3709478 - RNA, 14 nt, Salmonella enterica enterica serovar Typhi Ty2
uagcgggggccggc

SEQ ID NO: 3709479 - RNA, 16 nt, Salmonella enterica enterica serovar Typhi Ty2
uagcggguaaacagau

SEQ ID NO: 3709480 - RNA, 15 nt, Salmonella enterica enterica serovar Typhi Ty2
uagcgguuugcaaac

SEQ ID NO: 3709481 - RNA, 13 nt, Salmonella enterica enterica serovar Typhi Ty2
uagcgucaacgcu

SEQ ID NO: 3709482 - RNA, 18 nt, Salmonella enterica enterica serovar Typhi Ty2
uagcgucucaucaaaaag

SEQ ID NO: 3709483 - RNA, 16 nt, Salmonella enterica enterica serovar Typhi Ty2
uagcgucugcggcuga

SEQ ID NO: 3709484 - RNA, 17 nt, Salmonella enterica enterica serovar Typhi Ty2
uagcgucuuauccggcc

SEQ ID NO: 3709485 - RNA, 14 nt, Salmonella enterica enterica serovar Typhi Ty2
uagcgucuucagua

SEQ ID NO: 3709486 - RNA, 12 nt, Salmonella enterica enterica serovar Typhi Ty2
uagcgugccauu

SEQ ID NO: 3709487 - RNA, 17 nt, Salmonella enterica enterica serovar Typhi Ty2
uagcgugccgacguuca

SEQ ID NO: 3709488 - RNA, 13 nt, Salmonella enterica enterica serovar Typhi Ty2
uagcguugauaug

SEQ ID NO: 3709489 - RNA, 19 nt, Salmonella enterica enterica serovar Typhi Ty2
uagcguuuaaaaagcugca

SEQ ID NO: 3709490 - RNA, 16 nt, Salmonella enterica enterica serovar Typhi Ty2
uagcguuucgaacucu

SEQ ID NO: 3709491 - RNA, 14 nt, Salmonella enterica enterica serovar Typhi Ty2
uagcguuuuccagc

SEQ ID NO: 3709492 - RNA, 12 nt, Salmonella enterica enterica serovar Typhi Ty2
uagcuaaugcaa

SEQ ID NO: 3709493 - RNA, 13 nt, Salmonella enterica enterica serovar Typhi Ty2
uagcuaauggcuu

SEQ ID NO: 3709494 - RNA, 17 nt, Salmonella enterica enterica serovar Typhi Ty2
uagcuccagacaggacg

SEQ ID NO: 3709495 - RNA, 20 nt, Salmonella enterica enterica serovar Typhi Ty2
uagcucuucaucuuuuucau

SEQ ID NO: 3709496 - RNA, 21 nt, Salmonella enterica enterica serovar Typhi Ty2
uagcucuuucauuucugccug

SEQ ID NO: 3709497 - RNA, 14 nt, Salmonella enterica enterica serovar Typhi Ty2
uagcugcccggaua

SEQ ID NO: 3709498 - RNA, 14 nt, Salmonella enterica enterica serovar Typhi Ty2
uagcugcgccagcg

SEQ ID NO: 3709499 - RNA, 21 nt, Salmonella enterica enterica serovar Typhi Ty2
uagcugcuguaaguuuccguc

SEQ ID NO: 3709500 - RNA, 12 nt, Salmonella enterica enterica serovar Typhi Ty2
uagcuguucaau

SEQ ID NO: 3709501 - RNA, 15 nt, Salmonella enterica enterica serovar Typhi Ty2
uagcuguuccgcaac

SEQ ID NO: 3709502 - RNA, 22 nt, Salmonella enterica enterica serovar Typhi Ty2
uagcuguuguuuaauggcuaac

SEQ ID NO: 3709503 - RNA, 19 nt, Salmonella enterica enterica serovar Typhi Ty2
uagcuuaaaaaauccugca

SEQ ID NO: 3709504 - RNA, 16 nt, Salmonella enterica enterica serovar Typhi Ty2
uagcuuacuuucagau

SEQ ID NO: 3709505 - RNA, 17 nt, Salmonella enterica enterica serovar Typhi Ty2
uagcuuacuuucagaua

SEQ ID NO: 3709506 - RNA, 15 nt, Salmonella enterica enterica serovar Typhi Ty2
uagcuuagcugcgca

SEQ ID NO: 3709507 - RNA, 20 nt, Salmonella enterica enterica serovar Typhi Ty2
uagcuuaucgccaaagauau

SEQ ID NO: 3709508 - RNA, 11 nt, Salmonella enterica enterica serovar Typhi Ty2
uagcuuccagc

SEQ ID NO: 3709509 - RNA, 17 nt, Salmonella enterica enterica serovar Typhi Ty2
uagcuuuuccgcuggaa

SEQ ID NO: 3709510 - RNA, 19 nt, Salmonella enterica enterica serovar Typhi Ty2
uaggaguaaauaauuuugu

SEQ ID NO: 3709511 - RNA, 17 nt, Salmonella enterica enterica serovar Typhi Ty2
uaggaucaaccaccuuc

SEQ ID NO: 3709512 - RNA, 15 nt, Salmonella enterica enterica serovar Typhi Ty2
uaggcaggaaaucca

SEQ ID NO: 3709513 - RNA, 17 nt, Salmonella enterica enterica serovar Typhi Ty2
uaggccagccgacgcuc

SEQ ID NO: 3709514 - RNA, 21 nt, Salmonella enterica enterica serovar Typhi Ty2
uaggccagccgacgcucuucc

SEQ ID NO: 3709515 - RNA, 19 nt, Salmonella enterica enterica serovar Typhi Ty2
uaggcccgguaagcgcagc

SEQ ID NO: 3709516 - RNA, 20 nt, Salmonella enterica enterica serovar Typhi Ty2
uaggcccgguaagcgcuagc

SEQ ID NO: 3709517 - RNA, 12 nt, Salmonella enterica enterica serovar Typhi Ty2
uaggccggauaa

SEQ ID NO: 3709518 - RNA, 18 nt, Salmonella enterica enterica serovar Typhi Ty2
uaggccggauaagcaacg

SEQ ID NO: 3709519 - RNA, 21 nt, Salmonella enterica enterica serovar Typhi Ty2
uaggccggauaaggcgcuagc

SEQ ID NO: 3709520 - RNA, 20 nt, Salmonella enterica enterica serovar Typhi Ty2
uaggccggaugagcguuagc

SEQ ID NO: 3709521 - RNA, 13 nt, Salmonella enterica enterica serovar Typhi Ty2
uaggccugauaag

SEQ ID NO: 3709522 - RNA, 18 nt, Salmonella enterica enterica serovar Typhi Ty2
uaggccugauaagcguag

SEQ ID NO: 3709523 - RNA, 19 nt, Salmonella enterica enterica serovar Typhi Ty2
uaggccugguaagcguagc

SEQ ID NO: 3709524 - RNA, 17 nt, Salmonella enterica enterica serovar Typhi Ty2
uaggcgaggaaaacauu

SEQ ID NO: 3709525 - RNA, 17 nt, Salmonella enterica enterica serovar Typhi Ty2
uaggcgccgccgacaau

SEQ ID NO: 3709526 - RNA, 19 nt, Salmonella enterica enterica serovar Typhi Ty2
uaggcguugaacauuucau

SEQ ID NO: 3709527 - RNA, 18 nt, Salmonella enterica enterica serovar Typhi Ty2
uaggcuauaaaaaucauc

SEQ ID NO: 3709528 - RNA, 14 nt, Salmonella enterica enterica serovar Typhi Ty2
uaggcugaaagcgc

SEQ ID NO: 3709529 - RNA, 13 nt, Salmonella enterica enterica serovar Typhi Ty2
uagggcaucagac

SEQ ID NO: 3709530 - RNA, 19 nt, Salmonella enterica enterica serovar Typhi Ty2
uagggccgauaccggcaac

SEQ ID NO: 3709531 - RNA, 16 nt, Salmonella enterica enterica serovar Typhi Ty2
uagggccgggcagugc

SEQ ID NO: 3709532 - RNA, 18 nt, Salmonella enterica enterica serovar Typhi Ty2
uagggcgcggcugguaag

SEQ ID NO: 3709533 - RNA, 14 nt, Salmonella enterica enterica serovar Typhi Ty2
uaggguugccagag

SEQ ID NO: 3709534 - RNA, 22 nt, Salmonella enterica enterica serovar Typhi Ty2
uagguacggggcaucuauuuaa

SEQ ID NO: 3709535 - RNA, 14 nt, Salmonella enterica enterica serovar Typhi Ty2
uagguauccagcag

SEQ ID NO: 3709536 - RNA, 12 nt, Salmonella enterica enterica serovar Typhi Ty2
uaggucagcgau

SEQ ID NO: 3709537 - RNA, 20 nt, Salmonella enterica enterica serovar Typhi Ty2
uaggucggguaaggcguagc

SEQ ID NO: 3709538 - RNA, 23 nt, Salmonella enterica enterica serovar Typhi Ty2
uagguuaaauagcaggcaaugau

SEQ ID NO: 3709539 - RNA, 22 nt, Salmonella enterica enterica serovar Typhi Ty2
uagguucgguaugccuuccaga

SEQ ID NO: 3709540 - RNA, 13 nt, Salmonella enterica enterica serovar Typhi Ty2
uaguaaagaaauu

SEQ ID NO: 3709541 - RNA, 16 nt, Salmonella enterica enterica serovar Typhi Ty2
uaguaaauagaaaaua

SEQ ID NO: 3709542 - RNA, 21 nt, Salmonella enterica enterica serovar Typhi Ty2
uaguaaccccaguagcccuga

SEQ ID NO: 3709543 - RNA, 16 nt, Salmonella enterica enterica serovar Typhi Ty2
uaguaauaaagcguag

SEQ ID NO: 3709544 - RNA, 15 nt, Salmonella enterica enterica serovar Typhi Ty2
uaguaaucauacgcg

SEQ ID NO: 3709545 - RNA, 13 nt, Salmonella enterica enterica serovar Typhi Ty2
uaguaccgacacc

SEQ ID NO: 3709546 - RNA, 16 nt, Salmonella enterica enterica serovar Typhi Ty2
uaguacgcaaggaaau

SEQ ID NO: 3709547 - RNA, 20 nt, Salmonella enterica enterica serovar Typhi Ty2
uaguacgcaaggaaauauua

SEQ ID NO: 3709548 - RNA, 23 nt, Salmonella enterica enterica serovar Typhi Ty2
uaguacguuccagcguuuccgga

SEQ ID NO: 3709549 - RNA, 15 nt, Salmonella enterica enterica serovar Typhi Ty2
uaguauccauaauuu

SEQ ID NO: 3709550 - RNA, 22 nt, Salmonella enterica enterica serovar Typhi Ty2
uaguauccccggcaaccuuaaa

SEQ ID NO: 3709551 - RNA, 22 nt, Salmonella enterica enterica serovar Typhi Ty2
uaguaucgcucuauauccugcc

SEQ ID NO: 3709552 - RNA, 20 nt, Salmonella enterica enterica serovar Typhi Ty2
uaguauggagcaggaaaaga

SEQ ID NO: 3709553 - RNA, 16 nt, Salmonella enterica enterica serovar Typhi Ty2
uagucauaauuaaaaa

SEQ ID NO: 3709554 - RNA, 17 nt, Salmonella enterica enterica serovar Typhi Ty2
uagucauaauuaaaaag

SEQ ID NO: 3709555 - RNA, 19 nt, Salmonella enterica enterica serovar Typhi Ty2
uagucaucgccuucauccg

SEQ ID NO: 3709556 - RNA, 20 nt, Salmonella enterica enterica serovar Typhi Ty2
uagucaucgccuucauccgc

SEQ ID NO: 3709557 - RNA, 17 nt, Salmonella enterica enterica serovar Typhi Ty2
uagucauugacagcaag

SEQ ID NO: 3709558 - RNA, 11 nt, Salmonella enterica enterica serovar Typhi Ty2
uaguccagcag

SEQ ID NO: 3709559 - RNA, 14 nt, Salmonella enterica enterica serovar Typhi Ty2
uaguccagcagcca

SEQ ID NO: 3709560 - RNA, 15 nt, Salmonella enterica enterica serovar Typhi Ty2
uaguccagcagccau

SEQ ID NO: 3709561 - RNA, 15 nt, Salmonella enterica enterica serovar Typhi Ty2
uaguccauuacgcag

SEQ ID NO: 3709562 - RNA, 20 nt, Salmonella enterica enterica serovar Typhi Ty2
uaguccgccagcaccugaua

SEQ ID NO: 3709563 - RNA, 21 nt, Salmonella enterica enterica serovar Typhi Ty2
uaguccucagcgaauaucucu

SEQ ID NO: 3709564 - RNA, 22 nt, Salmonella enterica enterica serovar Typhi Ty2
uaguccuuaccccugcggcuga

SEQ ID NO: 3709565 - RNA, 14 nt, Salmonella enterica enterica serovar Typhi Ty2
uagucgagggugau

SEQ ID NO: 3709566 - RNA, 16 nt, Salmonella enterica enterica serovar Typhi Ty2
uagucgauccccaacg

SEQ ID NO: 3709567 - RNA, 23 nt, Salmonella enterica enterica serovar Typhi Ty2
uagucgauggucucguugccauu

SEQ ID NO: 3709568 - RNA, 14 nt, Salmonella enterica enterica serovar Typhi Ty2
uagucgccgguaag

SEQ ID NO: 3709569 - RNA, 13 nt, Salmonella enterica enterica serovar Typhi Ty2
uagucguugcgcc

SEQ ID NO: 3709570 - RNA, 15 nt, Salmonella enterica enterica serovar Typhi Ty2
uagucucccuccugc

SEQ ID NO: 3709571 - RNA, 22 nt, Salmonella enterica enterica serovar Typhi Ty2
uagugcaggaaggcgugcagcg

SEQ ID NO: 3709572 - RNA, 14 nt, Salmonella enterica enterica serovar Typhi Ty2
uaguggcgaucuga

SEQ ID NO: 3709573 - RNA, 15 nt, Salmonella enterica enterica serovar Typhi Ty2
uagugugcugauugu

SEQ ID NO: 3709574 - RNA, 11 nt, Salmonella enterica enterica serovar Typhi Ty2
uaguuaaaaaa

SEQ ID NO: 3709575 - RNA, 18 nt, Salmonella enterica enterica serovar Typhi Ty2
uaguuaaaggugguguua

SEQ ID NO: 3709576 - RNA, 20 nt, Salmonella enterica enterica serovar Typhi Ty2
uaguucaaguuuagaaaaaa

SEQ ID NO: 3709577 - RNA, 16 nt, Salmonella enterica enterica serovar Typhi Ty2
uaguucggauucaaua

SEQ ID NO: 3709578 - RNA, 17 nt, Salmonella enterica enterica serovar Typhi Ty2
uaguugaauaaccucaa

SEQ ID NO: 3709579 - RNA, 22 nt, Salmonella enterica enterica serovar Typhi Ty2
uaguugacgccccauguggcca

SEQ ID NO: 3709580 - RNA, 22 nt, Salmonella enterica enterica serovar Typhi Ty2
uaguugucggcggucgcggcaa

SEQ ID NO: 3709581 - RNA, 21 nt, Salmonella enterica enterica serovar Typhi Ty2
uaguuuagcgagcguucugca

SEQ ID NO: 3709582 - RNA, 14 nt, Salmonella enterica enterica serovar Typhi Ty2
uaguuucaccuucu

SEQ ID NO: 3709583 - RNA, 23 nt, Salmonella enterica enterica serovar Typhi Ty2
uaguuuccgccgcgguauucaua

SEQ ID NO: 3709584 - RNA, 16 nt, Salmonella enterica enterica serovar Typhi Ty2
uaguuucuauuaaauc

SEQ ID NO: 3709585 - RNA, 18 nt, Salmonella enterica enterica serovar Typhi Ty2
uaguuucuauuaaaucag

SEQ ID NO: 3709586 - RNA, 19 nt, Salmonella enterica enterica serovar Typhi Ty2
uaguuucuauuaaaucaga

SEQ ID NO: 3709587 - RNA, 14 nt, Salmonella enterica enterica serovar Typhi Ty2
uaguuugcauaacc

SEQ ID NO: 3709588 - RNA, 12 nt, Salmonella enterica enterica serovar Typhi Ty2
uauaaaaaccga

SEQ ID NO: 3709589 - RNA, 18 nt, Salmonella enterica enterica serovar Typhi Ty2
uauaaaaauagcuggcug

SEQ ID NO: 3709590 - RNA, 22 nt, Salmonella enterica enterica serovar Typhi Ty2
uauaaaacgggccacugcuggc

SEQ ID NO: 3709591 - RNA, 14 nt, Salmonella enterica enterica serovar Typhi Ty2
uauaaacucagcaa

SEQ ID NO: 3709592 - RNA, 17 nt, Salmonella enterica enterica serovar Typhi Ty2
uauaaaguucccaugcu

SEQ ID NO: 3709593 - RNA, 13 nt, Salmonella enterica enterica serovar Typhi Ty2
uauaaauauuaau

SEQ ID NO: 3709594 - RNA, 19 nt, Salmonella enterica enterica serovar Typhi Ty2
uauaaauauuaaugaauaa

SEQ ID NO: 3709595 - RNA, 21 nt, Salmonella enterica enterica serovar Typhi Ty2
uauaaauauuaaugaauaaau

SEQ ID NO: 3709596 - RNA, 12 nt, Salmonella enterica enterica serovar Typhi Ty2
uauaaaucaaua

SEQ ID NO: 3709597 - RNA, 22 nt, Salmonella enterica enterica serovar Typhi Ty2
uauaaauuuauuuuuugcuggg

SEQ ID NO: 3709598 - RNA, 15 nt, Salmonella enterica enterica serovar Typhi Ty2
uauaaccacgaaaau

SEQ ID NO: 3709599 - RNA, 21 nt, Salmonella enterica enterica serovar Typhi Ty2
uauaacgacagccuauuaauc

SEQ ID NO: 3709600 - RNA, 19 nt, Salmonella enterica enterica serovar Typhi Ty2
uauaacgaugauuauuguu

SEQ ID NO: 3709601 - RNA, 23 nt, Salmonella enterica enterica serovar Typhi Ty2
uauaacuaaacucaucuuuauuc

SEQ ID NO: 3709602 - RNA, 18 nt, Salmonella enterica enterica serovar Typhi Ty2
uauaacucuuaauuauaa

SEQ ID NO: 3709603 - RNA, 20 nt, Salmonella enterica enterica serovar Typhi Ty2
uauaacucuuaauuauaaag

SEQ ID NO: 3709604 - RNA, 16 nt, Salmonella enterica enterica serovar Typhi Ty2
uauaagcgugcaaccc

SEQ ID NO: 3709605 - RNA, 17 nt, Salmonella enterica enterica serovar Typhi Ty2
uauaagcugccucuuug

SEQ ID NO: 3709606 - RNA, 15 nt, Salmonella enterica enterica serovar Typhi Ty2
uauaagcuuuaacca

SEQ ID NO: 3709607 - RNA, 16 nt, Salmonella enterica enterica serovar Typhi Ty2
uauaaggucgauaucg

SEQ ID NO: 3709608 - RNA, 13 nt, Salmonella enterica enterica serovar Typhi Ty2
uauaaguaacugg

SEQ ID NO: 3709609 - RNA, 14 nt, Salmonella enterica enterica serovar Typhi Ty2
uauaaguacgccug

SEQ ID NO: 3709610 - RNA, 20 nt, Salmonella enterica enterica serovar Typhi Ty2
uauaaucaaacccuuccgca

SEQ ID NO: 3709611 - RNA, 16 nt, Salmonella enterica enterica serovar Typhi Ty2
uauaaucacagggguc

SEQ ID NO: 3709612 - RNA, 20 nt, Salmonella enterica enterica serovar Typhi Ty2
uauaauuaacauuuaagaaa

SEQ ID NO: 3709613 - RNA, 18 nt, Salmonella enterica enterica serovar Typhi Ty2
uauaauuaagaccauacu

SEQ ID NO: 3709614 - RNA, 20 nt, Salmonella enterica enterica serovar Typhi Ty2
uauaauucgucaauaccuaa

SEQ ID NO: 3709615 - RNA, 20 nt, Salmonella enterica enterica serovar Typhi Ty2
uauaauugcccgcaaucucu

SEQ ID NO: 3709616 - RNA, 18 nt, Salmonella enterica enterica serovar Typhi Ty2
uauaauuuuauuauauuu

SEQ ID NO: 3709617 - RNA, 14 nt, Salmonella enterica enterica serovar Typhi Ty2
uauacagacaaugc

SEQ ID NO: 3709618 - RNA, 22 nt, Salmonella enterica enterica serovar Typhi Ty2
uauacauacauaccacgcagcg

SEQ ID NO: 3709619 - RNA, 18 nt, Salmonella enterica enterica serovar Typhi Ty2
uauacauauuguuuucua

SEQ ID NO: 3709620 - RNA, 13 nt, Salmonella enterica enterica serovar Typhi Ty2
uauacauucauuu

SEQ ID NO: 3709621 - RNA, 16 nt, Salmonella enterica enterica serovar Typhi Ty2
uauacauucauuuuau

SEQ ID NO: 3709622 - RNA, 12 nt, Salmonella enterica enterica serovar Typhi Ty2
uauacauuucac

SEQ ID NO: 3709623 - RNA, 21 nt, Salmonella enterica enterica serovar Typhi Ty2
uauaccaugcugccauuuuau

SEQ ID NO: 3709624 - RNA, 15 nt, Salmonella enterica enterica serovar Typhi Ty2
uauaccguuuggcga

SEQ ID NO: 3709625 - RNA, 15 nt, Salmonella enterica enterica serovar Typhi Ty2
uauacguugauuggc

SEQ ID NO: 3709626 - RNA, 12 nt, Salmonella enterica enterica serovar Typhi Ty2
uauacucaaaaa

SEQ ID NO: 3709627 - RNA, 11 nt, Salmonella enterica enterica serovar Typhi Ty2
uauacugucuu

SEQ ID NO: 3709628 - RNA, 15 nt, Salmonella enterica enterica serovar Typhi Ty2
uauacuuauugaucc

SEQ ID NO: 3709629 - RNA, 13 nt, Salmonella enterica enterica serovar Typhi Ty2
uauacuucaucag

SEQ ID NO: 3709630 - RNA, 16 nt, Salmonella enterica enterica serovar Typhi Ty2
uauagaauacuuccug

SEQ ID NO: 3709631 - RNA, 23 nt, Salmonella enterica enterica serovar Typhi Ty2
uaucccaaacgucguaaaaccug

SEQ ID NO: 3709632 - RNA, 18 nt, Salmonella enterica enterica serovar Typhi Ty2
uaucccacugcacgccag

SEQ ID NO: 3709633 - RNA, 21 nt, Salmonella enterica enterica serovar Typhi Ty2
uaucccauacguuuuuauuau

SEQ ID NO: 3709634 - RNA, 14 nt, Salmonella enterica enterica serovar Typhi Ty2
uaucccuauucuga

SEQ ID NO: 3709635 - RNA, 20 nt, Salmonella enterica enterica serovar Typhi Ty2
uaucccuuccucauuuuugc

SEQ ID NO: 3709636 - RNA, 15 nt, Salmonella enterica enterica serovar Typhi Ty2
uaucccuuucaaaaa

SEQ ID NO: 3709637 - RNA, 16 nt, Salmonella enterica enterica serovar Typhi Ty2
uauccgacgcaacuca

SEQ ID NO: 3709638 - RNA, 14 nt, Salmonella enterica enterica serovar Typhi Ty2
uauccgcauucuaa

SEQ ID NO: 3709639 - RNA, 12 nt, Salmonella enterica enterica serovar Typhi Ty2
uauccgccauau

SEQ ID NO: 3709640 - RNA, 16 nt, Salmonella enterica enterica serovar Typhi Ty2
uauccgccgcaaauuc

SEQ ID NO: 3709641 - RNA, 20 nt, Salmonella enterica enterica serovar Typhi Ty2
uauccgcgaguguaaagauu

SEQ ID NO: 3709642 - RNA, 18 nt, Salmonella enterica enterica serovar Typhi Ty2
uauccgcuauuaccagua

SEQ ID NO: 3709643 - RNA, 20 nt, Salmonella enterica enterica serovar Typhi Ty2
uauccggccuacaaaugagu

SEQ ID NO: 3709644 - RNA, 20 nt, Salmonella enterica enterica serovar Typhi Ty2
uauccggccugcaggcaacg

SEQ ID NO: 3709645 - RNA, 14 nt, Salmonella enterica enterica serovar Typhi Ty2
uauccggcuuaucc

SEQ ID NO: 3709646 - RNA, 16 nt, Salmonella enterica enterica serovar Typhi Ty2
uauccguccucuuucc

SEQ ID NO: 3709647 - RNA, 21 nt, Salmonella enterica enterica serovar Typhi Ty2
uauccgugcgcaauuccagca

SEQ ID NO: 3709648 - RNA, 19 nt, Salmonella enterica enterica serovar Typhi Ty2
uauccguuauuuaauucuu

SEQ ID NO: 3709649 - RNA, 15 nt, Salmonella enterica enterica serovar Typhi Ty2
uauccuaaaucugcc

SEQ ID NO: 3709650 - RNA, 19 nt, Salmonella enterica enterica serovar Typhi Ty2
uauccuaaugccacggcug

SEQ ID NO: 3709651 - RNA, 21 nt, Salmonella enterica enterica serovar Typhi Ty2
uauccucgcauccuccaucca

SEQ ID NO: 3709652 - RNA, 13 nt, Salmonella enterica enterica serovar Typhi Ty2
uauccuggcgaga

SEQ ID NO: 3709653 - RNA, 19 nt, Salmonella enterica enterica serovar Typhi Ty2
uauccuggcgcguagaucu

SEQ ID NO: 3709654 - RNA, 18 nt, Salmonella enterica enterica serovar Typhi Ty2
uauccuguaacucaucug

SEQ ID NO: 3709655 - RNA, 15 nt, Salmonella enterica enterica serovar Typhi Ty2
uauccuuaaguacaa

SEQ ID NO: 3709656 - RNA, 18 nt, Salmonella enterica enterica serovar Typhi Ty2
uauccuuaucagacucag

SEQ ID NO: 3709657 - RNA, 14 nt, Salmonella enterica enterica serovar Typhi Ty2
uaucgaaagagcaa

SEQ ID NO: 3709658 - RNA, 22 nt, Salmonella enterica enterica serovar Typhi Ty2
uaucgaauggggaaauaaauau

SEQ ID NO: 3709659 - RNA, 14 nt, Salmonella enterica enterica serovar Typhi Ty2
uaucgacgcagaca

SEQ ID NO: 3709660 - RNA, 13 nt, Salmonella enterica enterica serovar Typhi Ty2
uaucgagauaaug

SEQ ID NO: 3709661 - RNA, 13 nt, Salmonella enterica enterica serovar Typhi Ty2
uaucgagcggcag

SEQ ID NO: 3709662 - RNA, 23 nt, Salmonella enterica enterica serovar Typhi Ty2
uaucgauaaucaacaaugucgcc

SEQ ID NO: 3709663 - RNA, 16 nt, Salmonella enterica enterica serovar Typhi Ty2
uaucgauaucugccug

SEQ ID NO: 3709664 - RNA, 22 nt, Salmonella enterica enterica serovar Typhi Ty2
uaucgauggcagucgcaucaug

SEQ ID NO: 3709665 - RNA, 17 nt, Salmonella enterica enterica serovar Typhi Ty2
uaucgcaguagccaugc

SEQ ID NO: 3709666 - RNA, 14 nt, Salmonella enterica enterica serovar Typhi Ty2
uaucgccaaaccag

SEQ ID NO: 3709667 - RNA, 17 nt, Salmonella enterica enterica serovar Typhi Ty2
uaucgccaagcgguaag

SEQ ID NO: 3709668 - RNA, 14 nt, Salmonella enterica enterica serovar Typhi Ty2
uaucgccauuauuc

SEQ ID NO: 3709669 - RNA, 15 nt, Salmonella enterica enterica serovar Typhi Ty2
uaucgcccagauggc

SEQ ID NO: 3709670 - RNA, 19 nt, Salmonella enterica enterica serovar Typhi Ty2
uaucgccgacaaacaguga

SEQ ID NO: 3709671 - RNA, 14 nt, Salmonella enterica enterica serovar Typhi Ty2
uaucgccgaucaca

SEQ ID NO: 3709672 - RNA, 21 nt, Salmonella enterica enterica serovar Typhi Ty2
uaucgccgcccguuuccgcua

SEQ ID NO: 3709673 - RNA, 19 nt, Salmonella enterica enterica serovar Typhi Ty2
uaucgccguaaccgccugc

SEQ ID NO: 3709674 - RNA, 19 nt, Salmonella enterica enterica serovar Typhi Ty2
uaucgccguucaaacggua

SEQ ID NO: 3709675 - RNA, 15 nt, Salmonella enterica enterica serovar Typhi Ty2
uaucgccuggagcug

SEQ ID NO: 3709676 - RNA, 17 nt, Salmonella enterica enterica serovar Typhi Ty2
uaucgcgccagguauac

SEQ ID NO: 3709677 - RNA, 23 nt, Salmonella enterica enterica serovar Typhi Ty2
uaucgcgccgccaauauccauuu

SEQ ID NO: 3709678 - RNA, 20 nt, Salmonella enterica enterica serovar Typhi Ty2
uaucgcgccggacagcagca

SEQ ID NO: 3709679 - RNA, 13 nt, Salmonella enterica enterica serovar Typhi Ty2
uaucgcgcuggca

SEQ ID NO: 3709680 - RNA, 14 nt, Salmonella enterica enterica serovar Typhi Ty2
uaucgcggauaagc

SEQ ID NO: 3709681 - RNA, 14 nt, Salmonella enterica enterica serovar Typhi Ty2
uaucgcuccggaac

SEQ ID NO: 3709682 - RNA, 22 nt, Salmonella enterica enterica serovar Typhi Ty2
uaucgcugcuaaacgagccguc

SEQ ID NO: 3709683 - RNA, 17 nt, Salmonella enterica enterica serovar Typhi Ty2
uaucgcugucggucaga

SEQ ID NO: 3709684 - RNA, 23 nt, Salmonella enterica enterica serovar Typhi Ty2
uaucgcugucggucagauucaga

SEQ ID NO: 3709685 - RNA, 17 nt, Salmonella enterica enterica serovar Typhi Ty2
uaucgcuuuaaucaguu

SEQ ID NO: 3709686 - RNA, 16 nt, Salmonella enterica enterica serovar Typhi Ty2
uaucggccagcgccag

SEQ ID NO: 3709687 - RNA, 18 nt, Salmonella enterica enterica serovar Typhi Ty2
uaucggccggaugccagu

SEQ ID NO: 3709688 - RNA, 23 nt, Salmonella enterica enterica serovar Typhi Ty2
uaucggcguguuucaucucauca

SEQ ID NO: 3709689 - RNA, 14 nt, Salmonella enterica enterica serovar Typhi Ty2
uaucgggccuacca

SEQ ID NO: 3709690 - RNA, 12 nt, Salmonella enterica enterica serovar Typhi Ty2
uaucgucuuauu

SEQ ID NO: 3709691 - RNA, 16 nt, Salmonella enterica enterica serovar Typhi Ty2
uaucgugccggauggc

SEQ ID NO: 3709692 - RNA, 18 nt, Salmonella enterica enterica serovar Typhi Ty2
uaucguugcgcgcaauca

SEQ ID NO: 3709693 - RNA, 17 nt, Salmonella enterica enterica serovar Typhi Ty2
uaucguuuacguuauca

SEQ ID NO: 3709694 - RNA, 20 nt, Salmonella enterica enterica serovar Typhi Ty2
uaucuauuucuuagcgccag

SEQ ID NO: 3709695 - RNA, 22 nt, Salmonella enterica enterica serovar Typhi Ty2
uaucuauuucuuagcgccagca

SEQ ID NO: 3709696 - RNA, 22 nt, Salmonella enterica enterica serovar Typhi Ty2
uaucucuacuuuccugaaggua

SEQ ID NO: 3709697 - RNA, 20 nt, Salmonella enterica enterica serovar Typhi Ty2
uaucucuauugcuuauuaga

SEQ ID NO: 3709698 - RNA, 15 nt, Salmonella enterica enterica serovar Typhi Ty2
uaucucucuggcgca

SEQ ID NO: 3709699 - RNA, 22 nt, Salmonella enterica enterica serovar Typhi Ty2
uaucugaaaguaagcuauuccu

SEQ ID NO: 3709700 - RNA, 17 nt, Salmonella enterica enterica serovar Typhi Ty2
uaucugaccaugccagc

SEQ ID NO: 3709701 - RNA, 13 nt, Salmonella enterica enterica serovar Typhi Ty2
uaucugaccuaca

SEQ ID NO: 3709702 - RNA, 14 nt, Salmonella enterica enterica serovar Typhi Ty2
uaucugaugaacua

SEQ ID NO: 3709703 - RNA, 17 nt, Salmonella enterica enterica serovar Typhi Ty2
uaucugcauaggcuuua

SEQ ID NO: 3709704 - RNA, 21 nt, Salmonella enterica enterica serovar Typhi Ty2
uaucugccagccgauuuuucg

SEQ ID NO: 3709705 - RNA, 12 nt, Salmonella enterica enterica serovar Typhi Ty2
uaucugcccuuu

SEQ ID NO: 3709706 - RNA, 15 nt, Salmonella enterica enterica serovar Typhi Ty2
uaucugcccuuucuu

SEQ ID NO: 3709707 - RNA, 18 nt, Salmonella enterica enterica serovar Typhi Ty2
uaucugcccuuucuuaug

SEQ ID NO: 3709708 - RNA, 23 nt, Salmonella enterica enterica serovar Typhi Ty2
uaucugccgcgcccgccaucgcc

SEQ ID NO: 3709709 - RNA, 18 nt, Salmonella enterica enterica serovar Typhi Ty2
uaucugcugacacccucu

SEQ ID NO: 3709710 - RNA, 19 nt, Salmonella enterica enterica serovar Typhi Ty2
uaucuguaauuauaaauau

SEQ ID NO: 3709711 - RNA, 20 nt, Salmonella enterica enterica serovar Typhi Ty2
uaucuucaucgguaagcgca

SEQ ID NO: 3709712 - RNA, 17 nt, Salmonella enterica enterica serovar Typhi Ty2
uaucuucauguucuaac

SEQ ID NO: 3709713 - RNA, 16 nt, Salmonella enterica enterica serovar Typhi Ty2
uauuacaugccguuaa

SEQ ID NO: 3709714 - RNA, 19 nt, Salmonella enterica enterica serovar Typhi Ty2
uauuacaugccguuaauaa

SEQ ID NO: 3709715 - RNA, 15 nt, Salmonella enterica enterica serovar Typhi Ty2
uauuaccaaugagcu

SEQ ID NO: 3709716 - RNA, 18 nt, Salmonella enterica enterica serovar Typhi Ty2
uauuacccaacaccagac

SEQ ID NO: 3709717 - RNA, 15 nt, Salmonella enterica enterica serovar Typhi Ty2
uauuaccuccugcau

SEQ ID NO: 3709718 - RNA, 16 nt, Salmonella enterica enterica serovar Typhi Ty2
uauuaccucgcgcuua

SEQ ID NO: 3709719 - RNA, 22 nt, Salmonella enterica enterica serovar Typhi Ty2
uauuaccugguauuauugucuu

SEQ ID NO: 3709720 - RNA, 19 nt, Salmonella enterica enterica serovar Typhi Ty2
uauuacgcaucauauaacc

SEQ ID NO: 3709721 - RNA, 15 nt, Salmonella enterica enterica serovar Typhi Ty2
uauuacugauaaagu

SEQ ID NO: 3709722 - RNA, 20 nt, Salmonella enterica enterica serovar Typhi Ty2
uauuagaauucccuauguaa

SEQ ID NO: 3709723 - RNA, 15 nt, Salmonella enterica enterica serovar Typhi Ty2
uauuagccaaagcgg

SEQ ID NO: 3709724 - RNA, 16 nt, Salmonella enterica enterica serovar Typhi Ty2
uauuagcguuuuuacc

SEQ ID NO: 3709725 - RNA, 11 nt, Salmonella enterica enterica serovar Typhi Ty2
uauuauaaaau

SEQ ID NO: 3709726 - RNA, 12 nt, Salmonella enterica enterica serovar Typhi Ty2
uauuauaaaaua

SEQ ID NO: 3709727 - RNA, 20 nt, Salmonella enterica enterica serovar Typhi Ty2
uauuauauagacuccgucaa

SEQ ID NO: 3709728 - RNA, 15 nt, Salmonella enterica enterica serovar Typhi Ty2
uauuaucggcgucau

SEQ ID NO: 3709729 - RNA, 15 nt, Salmonella enterica enterica serovar Typhi Ty2
uauuaucugauucaa

SEQ ID NO: 3709730 - RNA, 20 nt, Salmonella enterica enterica serovar Typhi Ty2
uauuaucugauucaauuaau

SEQ ID NO: 3709731 - RNA, 19 nt, Salmonella enterica enterica serovar Typhi Ty2
uauuaugcguuuuuaucuu

SEQ ID NO: 3709732 - RNA, 15 nt, Salmonella enterica enterica serovar Typhi Ty2
uauuaugcuggccug

SEQ ID NO: 3709733 - RNA, 19 nt, Salmonella enterica enterica serovar Typhi Ty2
uauuauuagaggucagaau

SEQ ID NO: 3709734 - RNA, 13 nt, Salmonella enterica enterica serovar Typhi Ty2
uauuauuauauag

SEQ ID NO: 3709735 - RNA, 19 nt, Salmonella enterica enterica serovar Typhi Ty2
uauuauugcccuuuuguuu

SEQ ID NO: 3709736 - RNA, 13 nt, Salmonella enterica enterica serovar Typhi Ty2
uauuauugucuua

SEQ ID NO: 3709737 - RNA, 19 nt, Salmonella enterica enterica serovar Typhi Ty2
uauucaaaauccgccaccg

SEQ ID NO: 3709738 - RNA, 16 nt, Salmonella enterica enterica serovar Typhi Ty2
uauucaccucccugca

SEQ ID NO: 3709739 - RNA, 18 nt, Salmonella enterica enterica serovar Typhi Ty2
uauucacgcgaauuccuu

SEQ ID NO: 3709740 - RNA, 18 nt, Salmonella enterica enterica serovar Typhi Ty2
uauucagaauaugccagg

SEQ ID NO: 3709741 - RNA, 13 nt, Salmonella enterica enterica serovar Typhi Ty2
uauucagcaaaug

SEQ ID NO: 3709742 - RNA, 17 nt, Salmonella enterica enterica serovar Typhi Ty2
uauucagcacaucagcc

SEQ ID NO: 3709743 - RNA, 18 nt, Salmonella enterica enterica serovar Typhi Ty2
uauucagcaguucauucg

SEQ ID NO: 3709744 - RNA, 15 nt, Salmonella enterica enterica serovar Typhi Ty2
uauucaggccuccug

SEQ ID NO: 3709745 - RNA, 17 nt, Salmonella enterica enterica serovar Typhi Ty2
uauucagggcuuuauuu

SEQ ID NO: 3709746 - RNA, 22 nt, Salmonella enterica enterica serovar Typhi Ty2
uauucauaacgccgaugccgcc

SEQ ID NO: 3709747 - RNA, 16 nt, Salmonella enterica enterica serovar Typhi Ty2
uauucaucaaaaugca

SEQ ID NO: 3709748 - RNA, 17 nt, Salmonella enterica enterica serovar Typhi Ty2
uauucaucaucuugucc

SEQ ID NO: 3709749 - RNA, 14 nt, Salmonella enterica enterica serovar Typhi Ty2
uauucaucgauacg

SEQ ID NO: 3709750 - RNA, 12 nt, Salmonella enterica enterica serovar Typhi Ty2
uauucaucgccg

SEQ ID NO: 3709751 - RNA, 19 nt, Salmonella enterica enterica serovar Typhi Ty2
uauucaugccagaagcaaa

SEQ ID NO: 3709752 - RNA, 22 nt, Salmonella enterica enterica serovar Typhi Ty2
uauucauucacccaauaaauaa

SEQ ID NO: 3709753 - RNA, 16 nt, Salmonella enterica enterica serovar Typhi Ty2
uauucauuucaaugua

SEQ ID NO: 3709754 - RNA, 16 nt, Salmonella enterica enterica serovar Typhi Ty2
uauucauuuccagcac

SEQ ID NO: 3709755 - RNA, 16 nt, Salmonella enterica enterica serovar Typhi Ty2
uauuccaaaauaauaa

SEQ ID NO: 3709756 - RNA, 17 nt, Salmonella enterica enterica serovar Typhi Ty2
uauuccagaaaggaugc

SEQ ID NO: 3709757 - RNA, 19 nt, Salmonella enterica enterica serovar Typhi Ty2
uauuccagggcauuuuuuc

SEQ ID NO: 3709758 - RNA, 20 nt, Salmonella enterica enterica serovar Typhi Ty2
uauuccagucgcuccaccac

SEQ ID NO: 3709759 - RNA, 17 nt, Salmonella enterica enterica serovar Typhi Ty2
uauucccauuccugcaa

SEQ ID NO: 3709760 - RNA, 20 nt, Salmonella enterica enterica serovar Typhi Ty2
uauuccccccggcagcuuua

SEQ ID NO: 3709761 - RNA, 11 nt, Salmonella enterica enterica serovar Typhi Ty2
uauucccggcc

SEQ ID NO: 3709762 - RNA, 16 nt, Salmonella enterica enterica serovar Typhi Ty2
uauucccguuccagcu

SEQ ID NO: 3709763 - RNA, 20 nt, Salmonella enterica enterica serovar Typhi Ty2
uauuccgagucgaucucuuu

SEQ ID NO: 3709764 - RNA, 13 nt, Salmonella enterica enterica serovar Typhi Ty2
uauuccgcaaacg

SEQ ID NO: 3709765 - RNA, 16 nt, Salmonella enterica enterica serovar Typhi Ty2
uauuccggcgacgcuu

SEQ ID NO: 3709766 - RNA, 16 nt, Salmonella enterica enterica serovar Typhi Ty2
uauuccggcgcuggcg

SEQ ID NO: 3709767 - RNA, 22 nt, Salmonella enterica enterica serovar Typhi Ty2
uauuccuguauaauuauuuguu

SEQ ID NO: 3709768 - RNA, 20 nt, Salmonella enterica enterica serovar Typhi Ty2
uauuccuuguccgaugcaga

SEQ ID NO: 3709769 - RNA, 19 nt, Salmonella enterica enterica serovar Typhi Ty2
uauucgcgaugcucaacca

SEQ ID NO: 3709770 - RNA, 17 nt, Salmonella enterica enterica serovar Typhi Ty2
uauucgcgcccucauuc

SEQ ID NO: 3709771 - RNA, 15 nt, Salmonella enterica enterica serovar Typhi Ty2
uauucgcuaucagaa

SEQ ID NO: 3709772 - RNA, 22 nt, Salmonella enterica enterica serovar Typhi Ty2
uauucgguagcuguaccagauc

SEQ ID NO: 3709773 - RNA, 13 nt, Salmonella enterica enterica serovar Typhi Ty2
uauucuauuccuu

SEQ ID NO: 3709774 - RNA, 13 nt, Salmonella enterica enterica serovar Typhi Ty2
uauucucgccgua

SEQ ID NO: 3709775 - RNA, 21 nt, Salmonella enterica enterica serovar Typhi Ty2
uauucugggcuuacuuuccaa

SEQ ID NO: 3709776 - RNA, 17 nt, Salmonella enterica enterica serovar Typhi Ty2
uauucuuccccuucacu

SEQ ID NO: 3709777 - RNA, 20 nt, Salmonella enterica enterica serovar Typhi Ty2
uauugaacggcucaaaauaa

SEQ ID NO: 3709778 - RNA, 16 nt, Salmonella enterica enterica serovar Typhi Ty2
uauugaagauguagac

SEQ ID NO: 3709779 - RNA, 23 nt, Salmonella enterica enterica serovar Typhi Ty2
uauugaagugcgaaauuuaauau

SEQ ID NO: 3709780 - RNA, 16 nt, Salmonella enterica enterica serovar Typhi Ty2
uauugaauaguuacca

SEQ ID NO: 3709781 - RNA, 22 nt, Salmonella enterica enterica serovar Typhi Ty2
uauugacacuaacgcucuucuc

SEQ ID NO: 3709782 - RNA, 15 nt, Salmonella enterica enterica serovar Typhi Ty2
uauugaccaucucuu

SEQ ID NO: 3709783 - RNA, 17 nt, Salmonella enterica enterica serovar Typhi Ty2
uauugacgcuuucuucc

SEQ ID NO: 3709784 - RNA, 15 nt, Salmonella enterica enterica serovar Typhi Ty2
uauugagaauaaacu

SEQ ID NO: 3709785 - RNA, 12 nt, Salmonella enterica enterica serovar Typhi Ty2
uauugagauaau

SEQ ID NO: 3709786 - RNA, 21 nt, Salmonella enterica enterica serovar Typhi Ty2
uauugauaagcgucagcgugc

SEQ ID NO: 3709787 - RNA, 21 nt, Salmonella enterica enterica serovar Typhi Ty2
uauugauaccuuuaaccucuu

SEQ ID NO: 3709788 - RNA, 11 nt, Salmonella enterica enterica serovar Typhi Ty2
uauugauuuuu

SEQ ID NO: 3709789 - RNA, 14 nt, Salmonella enterica enterica serovar Typhi Ty2
uauugauuuuuaaa

SEQ ID NO: 3709790 - RNA, 15 nt, Salmonella enterica enterica serovar Typhi Ty2
uauugauuuuuaaaa

SEQ ID NO: 3709791 - RNA, 15 nt, Salmonella enterica enterica serovar Typhi Ty2
uauugcaacuauuaa

SEQ ID NO: 3709792 - RNA, 19 nt, Salmonella enterica enterica serovar Typhi Ty2
uauugcaacuauuaauucu

SEQ ID NO: 3709793 - RNA, 14 nt, Salmonella enterica enterica serovar Typhi Ty2
uauugcauggcaau

SEQ ID NO: 3709794 - RNA, 17 nt, Salmonella enterica enterica serovar Typhi Ty2
uauugccacaauaucau

SEQ ID NO: 3709795 - RNA, 18 nt, Salmonella enterica enterica serovar Typhi Ty2
ucaaaccagcuuuucauu

SEQ ID NO: 3709796 - RNA, 15 nt, Salmonella enterica enterica serovar Typhi Ty2
ucaaacccuuccgca

SEQ ID NO: 3709797 - RNA, 14 nt, Salmonella enterica enterica serovar Typhi Ty2
ucaaacgcgccgcu

SEQ ID NO: 3709798 - RNA, 23 nt, Salmonella enterica enterica serovar Typhi Ty2
ucaaacucgcugccgaccuggcu

SEQ ID NO: 3709799 - RNA, 19 nt, Salmonella enterica enterica serovar Typhi Ty2
ucaaacucuuccgggcuga

SEQ ID NO: 3709800 - RNA, 20 nt, Salmonella enterica enterica serovar Typhi Ty2
ucaaacuugcccagcgccuu

SEQ ID NO: 3709801 - RNA, 15 nt, Salmonella enterica enterica serovar Typhi Ty2
ucaaacuuuuaaauu

SEQ ID NO: 3709802 - RNA, 18 nt, Salmonella enterica enterica serovar Typhi Ty2
ucaaacuuuuaaauugaa

SEQ ID NO: 3709803 - RNA, 20 nt, Salmonella enterica enterica serovar Typhi Ty2
ucaaacuuuuauaaauauag

SEQ ID NO: 3709804 - RNA, 13 nt, Salmonella enterica enterica serovar Typhi Ty2
ucaaagaaaacau

SEQ ID NO: 3709805 - RNA, 18 nt, Salmonella enterica enterica serovar Typhi Ty2
ucaaagaaaacaucagcc

SEQ ID NO: 3709806 - RNA, 18 nt, Salmonella enterica enterica serovar Typhi Ty2
ucaaagaaaacuuucauu

SEQ ID NO: 3709807 - RNA, 22 nt, Salmonella enterica enterica serovar Typhi Ty2
ucaaagaacagggggcgcauca

SEQ ID NO: 3709808 - RNA, 21 nt, Salmonella enterica enterica serovar Typhi Ty2
ucaaagaagcggaaaccccag

SEQ ID NO: 3709809 - RNA, 13 nt, Salmonella enterica enterica serovar Typhi Ty2
ucaaagaccuccg

SEQ ID NO: 3709810 - RNA, 13 nt, Salmonella enterica enterica serovar Typhi Ty2
ucaaaggccugca

SEQ ID NO: 3709811 - RNA, 17 nt, Salmonella enterica enterica serovar Typhi Ty2
ucaaaggccugcaucaa

SEQ ID NO: 3709812 - RNA, 22 nt, Salmonella enterica enterica serovar Typhi Ty2
ucaaaggccugcaucaacaggc

SEQ ID NO: 3709813 - RNA, 19 nt, Salmonella enterica enterica serovar Typhi Ty2
ucaaaguugguucccagca

SEQ ID NO: 3709814 - RNA, 22 nt, Salmonella enterica enterica serovar Typhi Ty2
ucaaauaagacauggaguucca

SEQ ID NO: 3709815 - RNA, 22 nt, Salmonella enterica enterica serovar Typhi Ty2
ucaaauaauacgccgguaucau

SEQ ID NO: 3709816 - RNA, 17 nt, Salmonella enterica enterica serovar Typhi Ty2
ucaaauaccuuuucauu

SEQ ID NO: 3709817 - RNA, 15 nt, Salmonella enterica enterica serovar Typhi Ty2
ucaaauagagaaaau

SEQ ID NO: 3709818 - RNA, 16 nt, Salmonella enterica enterica serovar Typhi Ty2
ucaaauagagaaaaua

SEQ ID NO: 3709819 - RNA, 17 nt, Salmonella enterica enterica serovar Typhi Ty2
ucaaauagagaaaauaa

SEQ ID NO: 3709820 - RNA, 22 nt, Salmonella enterica enterica serovar Typhi Ty2
ucaaauagagaaaauaacaaua

SEQ ID NO: 3709821 - RNA, 12 nt, Salmonella enterica enterica serovar Typhi Ty2
ucaaauauauug

SEQ ID NO: 3709822 - RNA, 22 nt, Salmonella enterica enterica serovar Typhi Ty2
ucaaaucagacgcuucauuggu

SEQ ID NO: 3709823 - RNA, 17 nt, Salmonella enterica enterica serovar Typhi Ty2
ucaaaucgugugcggua

SEQ ID NO: 3709824 - RNA, 13 nt, Salmonella enterica enterica serovar Typhi Ty2
ucaaaugaucguu

SEQ ID NO: 3709825 - RNA, 17 nt, Salmonella enterica enterica serovar Typhi Ty2
ucaaaugaucguuuuuu

SEQ ID NO: 3709826 - RNA, 14 nt, Salmonella enterica enterica serovar Typhi Ty2
ucaaaugcgaaaaa

SEQ ID NO: 3709827 - RNA, 22 nt, Salmonella enterica enterica serovar Typhi Ty2
ucaaauguuguuugaaaaguga

SEQ ID NO: 3709828 - RNA, 21 nt, Salmonella enterica enterica serovar Typhi Ty2
ucaaauucacccguuauucau

SEQ ID NO: 3709829 - RNA, 19 nt, Salmonella enterica enterica serovar Typhi Ty2
ucaacaaucguuaauucau

SEQ ID NO: 3709830 - RNA, 14 nt, Salmonella enterica enterica serovar Typhi Ty2
ucaacaaugucgcc

SEQ ID NO: 3709831 - RNA, 16 nt, Salmonella enterica enterica serovar Typhi Ty2
ucaacacgcagaccca

SEQ ID NO: 3709832 - RNA, 16 nt, Salmonella enterica enterica serovar Typhi Ty2
ucaacacuuagaacgc

SEQ ID NO: 3709833 - RNA, 21 nt, Salmonella enterica enterica serovar Typhi Ty2
ucaacacuuagaacgcggaag

SEQ ID NO: 3709834 - RNA, 21 nt, Salmonella enterica enterica serovar Typhi Ty2
ucaacagcgugagcugucgcu

SEQ ID NO: 3709835 - RNA, 16 nt, Salmonella enterica enterica serovar Typhi Ty2
ucaacauacgccgcca

SEQ ID NO: 3709836 - RNA, 21 nt, Salmonella enterica enterica serovar Typhi Ty2
ucaacauauuuuucacacaua

SEQ ID NO: 3709837 - RNA, 22 nt, Salmonella enterica enterica serovar Typhi Ty2
ucaacaucagcgcuaccagcgc

SEQ ID NO: 3709838 - RNA, 12 nt, Salmonella enterica enterica serovar Typhi Ty2
ucaacaucaucc

SEQ ID NO: 3709839 - RNA, 14 nt, Salmonella enterica enterica serovar Typhi Ty2
ucaacaucaucgga

SEQ ID NO: 3709840 - RNA, 15 nt, Salmonella enterica enterica serovar Typhi Ty2
ucaacauuauuaaaa

SEQ ID NO: 3709841 - RNA, 16 nt, Salmonella enterica enterica serovar Typhi Ty2
ucaacauuauuaaaau

SEQ ID NO: 3709842 - RNA, 15 nt, Salmonella enterica enterica serovar Typhi Ty2
ucaaccaacggcgcu

SEQ ID NO: 3709843 - RNA, 19 nt, Salmonella enterica enterica serovar Typhi Ty2
ucaaccacaaguuuaucca

SEQ ID NO: 3709844 - RNA, 20 nt, Salmonella enterica enterica serovar Typhi Ty2
ucaaccaccaccgauaaacg

SEQ ID NO: 3709845 - RNA, 22 nt, Salmonella enterica enterica serovar Typhi Ty2
ucaaccagccgaucaucacgaa

SEQ ID NO: 3709846 - RNA, 21 nt, Salmonella enterica enterica serovar Typhi Ty2
ucaaccagggucaauacgccg

SEQ ID NO: 3709847 - RNA, 18 nt, Salmonella enterica enterica serovar Typhi Ty2
ucaaccaucaaaaaaaau

SEQ ID NO: 3709848 - RNA, 20 nt, Salmonella enterica enterica serovar Typhi Ty2
ucaaccaucaaaaaaaauag

SEQ ID NO: 3709849 - RNA, 18 nt, Salmonella enterica enterica serovar Typhi Ty2
ucaaccaugaucaccauc

SEQ ID NO: 3709850 - RNA, 16 nt, Salmonella enterica enterica serovar Typhi Ty2
ucaacccgcuaccgca

SEQ ID NO: 3709851 - RNA, 20 nt, Salmonella enterica enterica serovar Typhi Ty2
ucaaccguuucuuuuucgau

SEQ ID NO: 3709852 - RNA, 15 nt, Salmonella enterica enterica serovar Typhi Ty2
ucaaccucuauaacu

SEQ ID NO: 3709853 - RNA, 17 nt, Salmonella enterica enterica serovar Typhi Ty2
ucaaccugcgaaaagcg

SEQ ID NO: 3709854 - RNA, 18 nt, Salmonella enterica enterica serovar Typhi Ty2
ucaacgaaugccugcaua

SEQ ID NO: 3709855 - RNA, 19 nt, Salmonella enterica enterica serovar Typhi Ty2
ucaacgauagagugaaggc

SEQ ID NO: 3709856 - RNA, 16 nt, Salmonella enterica enterica serovar Typhi Ty2
ucaacgcccugcuccc

SEQ ID NO: 3709857 - RNA, 17 nt, Salmonella enterica enterica serovar Typhi Ty2
ucaacgccuccaggcua

SEQ ID NO: 3709858 - RNA, 14 nt, Salmonella enterica enterica serovar Typhi Ty2
ucaacgcgccgcca

SEQ ID NO: 3709859 - RNA, 17 nt, Salmonella enterica enterica serovar Typhi Ty2
ucaacgcgcugcagcuu

SEQ ID NO: 3709860 - RNA, 18 nt, Salmonella enterica enterica serovar Typhi Ty2
ucaacgcggcuaccgaag

SEQ ID NO: 3709861 - RNA, 15 nt, Salmonella enterica enterica serovar Typhi Ty2
ucaacggucaaaaua

SEQ ID NO: 3709862 - RNA, 19 nt, Salmonella enterica enterica serovar Typhi Ty2
ucaacgguucgacggagau

SEQ ID NO: 3709863 - RNA, 15 nt, Salmonella enterica enterica serovar Typhi Ty2
ucaacgugcaucucc

SEQ ID NO: 3709864 - RNA, 14 nt, Salmonella enterica enterica serovar Typhi Ty2
ucaacguuuuucag

SEQ ID NO: 3709865 - RNA, 21 nt, Salmonella enterica enterica serovar Typhi Ty2
ucaacuauuaaagcacaagaa

SEQ ID NO: 3709866 - RNA, 21 nt, Salmonella enterica enterica serovar Typhi Ty2
ucaacugcucuaccaacugag

SEQ ID NO: 3709867 - RNA, 21 nt, Salmonella enterica enterica serovar Typhi Ty2
ucaacuggaugacugaauuau

SEQ ID NO: 3709868 - RNA, 23 nt, Salmonella enterica enterica serovar Typhi Ty2
ucaacugggcgagggaggcaauc

SEQ ID NO: 3709869 - RNA, 23 nt, Salmonella enterica enterica serovar Typhi Ty2
ucaacuguaccugauccagcucu

SEQ ID NO: 3709870 - RNA, 22 nt, Salmonella enterica enterica serovar Typhi Ty2
ucaacuuccaccaccuccugcu

SEQ ID NO: 3709871 - RNA, 18 nt, Salmonella enterica enterica serovar Typhi Ty2
ucaacuucucgcaggcca

SEQ ID NO: 3709872 - RNA, 21 nt, Salmonella enterica enterica serovar Typhi Ty2
ucaagacgcucgacguccagc

SEQ ID NO: 3709873 - RNA, 14 nt, Salmonella enterica enterica serovar Typhi Ty2
ucaagauaaaaaga

SEQ ID NO: 3709874 - RNA, 17 nt, Salmonella enterica enterica serovar Typhi Ty2
ucaagaugauagccauu

SEQ ID NO: 3709875 - RNA, 14 nt, Salmonella enterica enterica serovar Typhi Ty2
ucaagcaacuguag

SEQ ID NO: 3709876 - RNA, 17 nt, Salmonella enterica enterica serovar Typhi Ty2
ucaagcaacuguagaau

SEQ ID NO: 3709877 - RNA, 15 nt, Salmonella enterica enterica serovar Typhi Ty2
ucacaggcuucgaca

SEQ ID NO: 3709878 - RNA, 16 nt, Salmonella enterica enterica serovar Typhi Ty2
ucacaggcuuggcagc

SEQ ID NO: 3709879 - RNA, 21 nt, Salmonella enterica enterica serovar Typhi Ty2
ucacauaacaaaaccagcauc

SEQ ID NO: 3709880 - RNA, 21 nt, Salmonella enterica enterica serovar Typhi Ty2
ucacauacaaagagaaaauga

SEQ ID NO: 3709881 - RNA, 19 nt, Salmonella enterica enterica serovar Typhi Ty2
ucacauaggcguagcuggu

SEQ ID NO: 3709882 - RNA, 17 nt, Salmonella enterica enterica serovar Typhi Ty2
ucacauaucccagaccg

SEQ ID NO: 3709883 - RNA, 18 nt, Salmonella enterica enterica serovar Typhi Ty2
ucacauauucaauaauau

SEQ ID NO: 3709884 - RNA, 17 nt, Salmonella enterica enterica serovar Typhi Ty2
ucacaucaaagccccau

SEQ ID NO: 3709885 - RNA, 14 nt, Salmonella enterica enterica serovar Typhi Ty2
ucacaucaucgcca

SEQ ID NO: 3709886 - RNA, 11 nt, Salmonella enterica enterica serovar Typhi Ty2
ucacaucauua

SEQ ID NO: 3709887 - RNA, 13 nt, Salmonella enterica enterica serovar Typhi Ty2
ucacauccagccc

SEQ ID NO: 3709888 - RNA, 15 nt, Salmonella enterica enterica serovar Typhi Ty2
ucacaucgcccugau

SEQ ID NO: 3709889 - RNA, 22 nt, Salmonella enterica enterica serovar Typhi Ty2
ucacaucgccggagaucagcag

SEQ ID NO: 3709890 - RNA, 15 nt, Salmonella enterica enterica serovar Typhi Ty2
ucacaucgcgcagca

SEQ ID NO: 3709891 - RNA, 17 nt, Salmonella enterica enterica serovar Typhi Ty2
ucacaucguaaaucagc

SEQ ID NO: 3709892 - RNA, 20 nt, Salmonella enterica enterica serovar Typhi Ty2
ucacaucguaaaucagcgug

SEQ ID NO: 3709893 - RNA, 22 nt, Salmonella enterica enterica serovar Typhi Ty2
ucacaucguuggcgccaaaacc

SEQ ID NO: 3709894 - RNA, 20 nt, Salmonella enterica enterica serovar Typhi Ty2
ucacaugcgggagcaaaaua

SEQ ID NO: 3709895 - RNA, 20 nt, Salmonella enterica enterica serovar Typhi Ty2
ucacauggcgaaaaucacua

SEQ ID NO: 3709896 - RNA, 21 nt, Salmonella enterica enterica serovar Typhi Ty2
ucacauggcgaaaaucacuau

SEQ ID NO: 3709897 - RNA, 21 nt, Salmonella enterica enterica serovar Typhi Ty2
ucacauuggcaaaccccugcu

SEQ ID NO: 3709898 - RNA, 14 nt, Salmonella enterica enterica serovar Typhi Ty2
ucaccaacugcuga

SEQ ID NO: 3709899 - RNA, 17 nt, Salmonella enterica enterica serovar Typhi Ty2
ucaccaccgcaggcagc

SEQ ID NO: 3709900 - RNA, 18 nt, Salmonella enterica enterica serovar Typhi Ty2
ucaccaccgcaggcagcg

SEQ ID NO: 3709901 - RNA, 16 nt, Salmonella enterica enterica serovar Typhi Ty2
ucaccaccgccgcgag

SEQ ID NO: 3709902 - RNA, 19 nt, Salmonella enterica enterica serovar Typhi Ty2
ucaccacgggguuggcccu

SEQ ID NO: 3709903 - RNA, 20 nt, Salmonella enterica enterica serovar Typhi Ty2
ucaccacgggguuggcccuc

SEQ ID NO: 3709904 - RNA, 22 nt, Salmonella enterica enterica serovar Typhi Ty2
ucaccacgggguuggcccuccc

SEQ ID NO: 3709905 - RNA, 17 nt, Salmonella enterica enterica serovar Typhi Ty2
ucaccacgucauccggc

SEQ ID NO: 3709906 - RNA, 18 nt, Salmonella enterica enterica serovar Typhi Ty2
ucaccagcugacgcagca

SEQ ID NO: 3709907 - RNA, 12 nt, Salmonella enterica enterica serovar Typhi Ty2
ucaccaggaugc

SEQ ID NO: 3709908 - RNA, 22 nt, Salmonella enterica enterica serovar Typhi Ty2
ucaccaggcguaagaucccagg

SEQ ID NO: 3709909 - RNA, 15 nt, Salmonella enterica enterica serovar Typhi Ty2
ucaccagugauuggc

SEQ ID NO: 3709910 - RNA, 24 nt, Salmonella enterica enterica serovar Typhi Ty2
ucaccaucaguagcacaacgaguc

SEQ ID NO: 3709911 - RNA, 16 nt, Salmonella enterica enterica serovar Typhi Ty2
ucaccaucauaaagcc

SEQ ID NO: 3709912 - RNA, 16 nt, Salmonella enterica enterica serovar Typhi Ty2
ucaccaucccaugaug

SEQ ID NO: 3709913 - RNA, 19 nt, Salmonella enterica enterica serovar Typhi Ty2
ucaccaucguugccagcgg

SEQ ID NO: 3709914 - RNA, 13 nt, Salmonella enterica enterica serovar Typhi Ty2
ucaccaugacgca

SEQ ID NO: 3709915 - RNA, 15 nt, Salmonella enterica enterica serovar Typhi Ty2
ucaccauuaacauca

SEQ ID NO: 3709916 - RNA, 17 nt, Salmonella enterica enterica serovar Typhi Ty2
ucaccauuaacaucaga

SEQ ID NO: 3709917 - RNA, 15 nt, Salmonella enterica enterica serovar Typhi Ty2
ucaccauucccagcg

SEQ ID NO: 3709918 - RNA, 16 nt, Salmonella enterica enterica serovar Typhi Ty2
ucaccauucccagcgc

SEQ ID NO: 3709919 - RNA, 18 nt, Salmonella enterica enterica serovar Typhi Ty2
ucacccaacauuuuuagc

SEQ ID NO: 3709920 - RNA, 16 nt, Salmonella enterica enterica serovar Typhi Ty2
ucacccaauaaauaau

SEQ ID NO: 3709921 - RNA, 18 nt, Salmonella enterica enterica serovar Typhi Ty2
ucacccacaggagccagu

SEQ ID NO: 3709922 - RNA, 15 nt, Salmonella enterica enterica serovar Typhi Ty2
ucacccacuuguagc

SEQ ID NO: 3709923 - RNA, 23 nt, Salmonella enterica enterica serovar Typhi Ty2
ucacccagagauuaauuacgcac

SEQ ID NO: 3709924 - RNA, 22 nt, Salmonella enterica enterica serovar Typhi Ty2
ucacccagaugcgaaucuucau

SEQ ID NO: 3709925 - RNA, 19 nt, Salmonella enterica enterica serovar Typhi Ty2
ucacccaggcgaugcgcgg

SEQ ID NO: 3709926 - RNA, 24 nt, Salmonella enterica enterica serovar Typhi Ty2
ucacccagucgcagccacccuggc

SEQ ID NO: 3709927 - RNA, 20 nt, Salmonella enterica enterica serovar Typhi Ty2
ucaccccaacaaauagcaca

SEQ ID NO: 3709928 - RNA, 21 nt, Salmonella enterica enterica serovar Typhi Ty2
ucacccgaaucacugacggaa

SEQ ID NO: 3709929 - RNA, 14 nt, Salmonella enterica enterica serovar Typhi Ty2
ucacccgauaaaau

SEQ ID NO: 3709930 - RNA, 19 nt, Salmonella enterica enterica serovar Typhi Ty2
ucacccgccggcagcagcu

SEQ ID NO: 3709931 - RNA, 17 nt, Salmonella enterica enterica serovar Typhi Ty2
ucacccgcgccagcagg

SEQ ID NO: 3709932 - RNA, 18 nt, Salmonella enterica enterica serovar Typhi Ty2
ucacccggauacgcggca

SEQ ID NO: 3709933 - RNA, 23 nt, Salmonella enterica enterica serovar Typhi Ty2
ucacccguuauucauucacccaa

SEQ ID NO: 3709934 - RNA, 17 nt, Salmonella enterica enterica serovar Typhi Ty2
ucacccuauaagcugcc

SEQ ID NO: 3709935 - RNA, 14 nt, Salmonella enterica enterica serovar Typhi Ty2
ucacccugaauuuc

SEQ ID NO: 3709936 - RNA, 20 nt, Salmonella enterica enterica serovar Typhi Ty2
ucacccugaauuucaauaau

SEQ ID NO: 3709937 - RNA, 13 nt, Salmonella enterica enterica serovar Typhi Ty2
ucaccgccagagc

SEQ ID NO: 3709938 - RNA, 14 nt, Salmonella enterica enterica serovar Typhi Ty2
ucaccgccaguccc

SEQ ID NO: 3709939 - RNA, 20 nt, Salmonella enterica enterica serovar Typhi Ty2
ucaccgccgcccguccgcua

SEQ ID NO: 3709940 - RNA, 21 nt, Salmonella enterica enterica serovar Typhi Ty2
ucaccgcggcaaccagcccau

SEQ ID NO: 3709941 - RNA, 17 nt, Salmonella enterica enterica serovar Typhi Ty2
ucaccgcugacugaacu

SEQ ID NO: 3709942 - RNA, 16 nt, Salmonella enterica enterica serovar Typhi Ty2
ucaccggaugcgcagg

SEQ ID NO: 3709943 - RNA, 18 nt, Salmonella enterica enterica serovar Typhi Ty2
ucaccguaauauaaucua

SEQ ID NO: 3709944 - RNA, 21 nt, Salmonella enterica enterica serovar Typhi Ty2
ucaccguauuaucaaaucuuc

SEQ ID NO: 3709945 - RNA, 18 nt, Salmonella enterica enterica serovar Typhi Ty2
ucaccguggcaaaaucca

SEQ ID NO: 3709946 - RNA, 17 nt, Salmonella enterica enterica serovar Typhi Ty2
ucaccguggcaucauca

SEQ ID NO: 3709947 - RNA, 19 nt, Salmonella enterica enterica serovar Typhi Ty2
ucaccguuuaaaaacauca

SEQ ID NO: 3709948 - RNA, 21 nt, Salmonella enterica enterica serovar Typhi Ty2
ucaccguuuaaaaacaucauu

SEQ ID NO: 3709949 - RNA, 18 nt, Salmonella enterica enterica serovar Typhi Ty2
ucaccucacuccagaccu

SEQ ID NO: 3709950 - RNA, 17 nt, Salmonella enterica enterica serovar Typhi Ty2
ucaccucaucaacgcca

SEQ ID NO: 3709951 - RNA, 12 nt, Salmonella enterica enterica serovar Typhi Ty2
ucaccuccagca

SEQ ID NO: 3709952 - RNA, 12 nt, Salmonella enterica enterica serovar Typhi Ty2
ucaccuccgcca

SEQ ID NO: 3709953 - RNA, 16 nt, Salmonella enterica enterica serovar Typhi Ty2
ucaccuccgcuuuuau

SEQ ID NO: 3709954 - RNA, 20 nt, Salmonella enterica enterica serovar Typhi Ty2
ucaccucuuucuccacaucg

SEQ ID NO: 3709955 - RNA, 18 nt, Salmonella enterica enterica serovar Typhi Ty2
ucaccuggaugcugccug

SEQ ID NO: 3709956 - RNA, 19 nt, Salmonella enterica enterica serovar Typhi Ty2
ucaccuggcugguggccuu

SEQ ID NO: 3709957 - RNA, 18 nt, Salmonella enterica enterica serovar Typhi Ty2
ucaccugguaagcgccaa

SEQ ID NO: 3709958 - RNA, 20 nt, Salmonella enterica enterica serovar Typhi Ty2
ucaccuucggucccaucgcg

SEQ ID NO: 3709959 - RNA, 16 nt, Salmonella enterica enterica serovar Typhi Ty2
ucagaaaaccuuugcu

SEQ ID NO: 3709960 - RNA, 19 nt, Salmonella enterica enterica serovar Typhi Ty2
ucagaaauauucaguacug

SEQ ID NO: 3709961 - RNA, 13 nt, Salmonella enterica enterica serovar Typhi Ty2
ucagaaauccgcg

SEQ ID NO: 3709962 - RNA, 19 nt, Salmonella enterica enterica serovar Typhi Ty2
ucagaaaucggcagcaccc

SEQ ID NO: 3709963 - RNA, 13 nt, Salmonella enterica enterica serovar Typhi Ty2
ucagaaauucgca

SEQ ID NO: 3709964 - RNA, 17 nt, Salmonella enterica enterica serovar Typhi Ty2
ucagaaccugcgauacc

SEQ ID NO: 3709965 - RNA, 12 nt, Salmonella enterica enterica serovar Typhi Ty2
ucagaacgccuu

SEQ ID NO: 3709966 - RNA, 15 nt, Salmonella enterica enterica serovar Typhi Ty2
ucagaagaagacaac

SEQ ID NO: 3709967 - RNA, 12 nt, Salmonella enterica enterica serovar Typhi Ty2
ucagaauaaugc

SEQ ID NO: 3709968 - RNA, 13 nt, Salmonella enterica enterica serovar Typhi Ty2
ucagaauaaugcu

SEQ ID NO: 3709969 - RNA, 16 nt, Salmonella enterica enterica serovar Typhi Ty2
ucagaauaguuuugcc

SEQ ID NO: 3709970 - RNA, 15 nt, Salmonella enterica enterica serovar Typhi Ty2
ucagaauaugccagg

SEQ ID NO: 3709971 - RNA, 16 nt, Salmonella enterica enterica serovar Typhi Ty2
ucagaauaugccaggg

SEQ ID NO: 3709972 - RNA, 19 nt, Salmonella enterica enterica serovar Typhi Ty2
ucagaaucguccagauuga

SEQ ID NO: 3709973 - RNA, 21 nt, Salmonella enterica enterica serovar Typhi Ty2
ucagacaugauaaguuucucu

SEQ ID NO: 3709974 - RNA, 19 nt, Salmonella enterica enterica serovar Typhi Ty2
ucagaccagucggacagcg

SEQ ID NO: 3709975 - RNA, 18 nt, Salmonella enterica enterica serovar Typhi Ty2
ucagaccgagacccagcg

SEQ ID NO: 3709976 - RNA, 18 nt, Salmonella enterica enterica serovar Typhi Ty2
ucagaccgauaaauaccg

SEQ ID NO: 3709977 - RNA, 18 nt, Salmonella enterica enterica serovar Typhi Ty2
ucagaccgccaagcgcgg

SEQ ID NO: 3709978 - RNA, 16 nt, Salmonella enterica enterica serovar Typhi Ty2
ucagaccuccgccauc

SEQ ID NO: 3709979 - RNA, 23 nt, Salmonella enterica enterica serovar Typhi Ty2
ucagacgaccauccaccagaacc

SEQ ID NO: 3709980 - RNA, 14 nt, Salmonella enterica enterica serovar Typhi Ty2
ucagacgaggcgcg

SEQ ID NO: 3709981 - RNA, 15 nt, Salmonella enterica enterica serovar Typhi Ty2
ucagacgcaucagga

SEQ ID NO: 3709982 - RNA, 16 nt, Salmonella enterica enterica serovar Typhi Ty2
ucagacgcucagccuu

SEQ ID NO: 3709983 - RNA, 19 nt, Salmonella enterica enterica serovar Typhi Ty2
ucagacgcucagccuuaua

SEQ ID NO: 3709984 - RNA, 16 nt, Salmonella enterica enterica serovar Typhi Ty2
ucagacggacaucaga

SEQ ID NO: 3709985 - RNA, 17 nt, Salmonella enterica enterica serovar Typhi Ty2
ucagacggacaucagag

SEQ ID NO: 3709986 - RNA, 15 nt, Salmonella enterica enterica serovar Typhi Ty2
ucagacggcuccagc

SEQ ID NO: 3709987 - RNA, 15 nt, Salmonella enterica enterica serovar Typhi Ty2
ucagacggcugaccu

SEQ ID NO: 3709988 - RNA, 17 nt, Salmonella enterica enterica serovar Typhi Ty2
ucagacguagcgccauc

SEQ ID NO: 3709989 - RNA, 24 nt, Salmonella enterica enterica serovar Typhi Ty2
ucagacuuuggauaaagccaaugg

SEQ ID NO: 3709990 - RNA, 20 nt, Salmonella enterica enterica serovar Typhi Ty2
ucagagcguccacgccauca

SEQ ID NO: 3709991 - RNA, 21 nt, Salmonella enterica enterica serovar Typhi Ty2
ucagaggccuuuugcagcagc

SEQ ID NO: 3709992 - RNA, 13 nt, Salmonella enterica enterica serovar Typhi Ty2
ucagauaaauaac

SEQ ID NO: 3709993 - RNA, 15 nt, Salmonella enterica enterica serovar Typhi Ty2
ucagauaacgaacca

SEQ ID NO: 3709994 - RNA, 22 nt, Salmonella enterica enterica serovar Typhi Ty2
ucagauaacgaaccaucauuaa

SEQ ID NO: 3709995 - RNA, 14 nt, Salmonella enterica enterica serovar Typhi Ty2
ucagauaauucuaa

SEQ ID NO: 3709996 - RNA, 18 nt, Salmonella enterica enterica serovar Typhi Ty2
ucagauacggcuccagca

SEQ ID NO: 3709997 - RNA, 19 nt, Salmonella enterica enterica serovar Typhi Ty2
ucagauaucccaugaaacu

SEQ ID NO: 3709998 - RNA, 14 nt, Salmonella enterica enterica serovar Typhi Ty2
ucagauauuccagc

SEQ ID NO: 3709999 - RNA, 16 nt, Salmonella enterica enterica serovar Typhi Ty2
ucagauccuucauuca

SEQ ID NO: 3710000 - RNA, 12 nt, Salmonella enterica enterica serovar Typhi Ty2
ucagauccuuuu

SEQ ID NO: 3710001 - RNA, 13 nt, Salmonella enterica enterica serovar Typhi Ty2
ucagauccuuuuu

SEQ ID NO: 3710002 - RNA, 16 nt, Salmonella enterica enterica serovar Typhi Ty2
ucagaucguaugcgcc

SEQ ID NO: 3710003 - RNA, 20 nt, Salmonella enterica enterica serovar Typhi Ty2
ucagaucuuauaugagcggg

SEQ ID NO: 3710004 - RNA, 19 nt, Salmonella enterica enterica serovar Typhi Ty2
ucagauguccaccgauuuc

SEQ ID NO: 3710005 - RNA, 18 nt, Salmonella enterica enterica serovar Typhi Ty2
ucagauuacccucugcgu

SEQ ID NO: 3710006 - RNA, 18 nt, Salmonella enterica enterica serovar Typhi Ty2
ucagauucagcauuggca

SEQ ID NO: 3710007 - RNA, 17 nt, Salmonella enterica enterica serovar Typhi Ty2
ucagauugccacaggac

SEQ ID NO: 3710008 - RNA, 14 nt, Salmonella enterica enterica serovar Typhi Ty2
ucagcaaaaacauu

SEQ ID NO: 3710009 - RNA, 17 nt, Salmonella enterica enterica serovar Typhi Ty2
ucagcaaaauaccggca

SEQ ID NO: 3710010 - RNA, 13 nt, Salmonella enterica enterica serovar Typhi Ty2
ucagcaaaugaac

SEQ ID NO: 3710011 - RNA, 16 nt, Salmonella enterica enterica serovar Typhi Ty2
ucagcaacggaagcug

SEQ ID NO: 3710012 - RNA, 19 nt, Salmonella enterica enterica serovar Typhi Ty2
ucagcaacggaagcugacc

SEQ ID NO: 3710013 - RNA, 15 nt, Salmonella enterica enterica serovar Typhi Ty2
ucagcaacugcugcg

SEQ ID NO: 3710014 - RNA, 19 nt, Salmonella enterica enterica serovar Typhi Ty2
ucagcaagaaguuccgcuu

SEQ ID NO: 3710015 - RNA, 15 nt, Salmonella enterica enterica serovar Typhi Ty2
ucagcaaugauuuuu

SEQ ID NO: 3710016 - RNA, 17 nt, Salmonella enterica enterica serovar Typhi Ty2
ucagcaauuucucgccc

SEQ ID NO: 3710017 - RNA, 21 nt, Salmonella enterica enterica serovar Typhi Ty2
ucagcaauuucucgcccgcca

SEQ ID NO: 3710018 - RNA, 20 nt, Salmonella enterica enterica serovar Typhi Ty2
ucagcaauuuuguuaaaucc

SEQ ID NO: 3710019 - RNA, 21 nt, Salmonella enterica enterica serovar Typhi Ty2
ucagcacaaaaucccacauac

SEQ ID NO: 3710020 - RNA, 20 nt, Salmonella enterica enterica serovar Typhi Ty2
ucagcaccucaucgcuaccu

SEQ ID NO: 3710021 - RNA, 13 nt, Salmonella enterica enterica serovar Typhi Ty2
ucagcaccuccag

SEQ ID NO: 3710022 - RNA, 14 nt, Salmonella enterica enterica serovar Typhi Ty2
ucagcaccuccagc

SEQ ID NO: 3710023 - RNA, 15 nt, Salmonella enterica enterica serovar Typhi Ty2
ucagcaccuccagcg

SEQ ID NO: 3710024 - RNA, 20 nt, Salmonella enterica enterica serovar Typhi Ty2
ucagcaccucuuugcggccu

SEQ ID NO: 3710025 - RNA, 13 nt, Salmonella enterica enterica serovar Typhi Ty2
ucagcagaacaaa

SEQ ID NO: 3710026 - RNA, 21 nt, Salmonella enterica enterica serovar Typhi Ty2
ucagcagcaccgguuuuuccg

SEQ ID NO: 3710027 - RNA, 15 nt, Salmonella enterica enterica serovar Typhi Ty2
ucagcagccgggcca

SEQ ID NO: 3710028 - RNA, 16 nt, Salmonella enterica enterica serovar Typhi Ty2
ucagcagcgaauagcg

SEQ ID NO: 3710029 - RNA, 23 nt, Salmonella enterica enterica serovar Typhi Ty2
ucagcagcgaggugauaaucagc

SEQ ID NO: 3710030 - RNA, 11 nt, Salmonella enterica enterica serovar Typhi Ty2
ucagcaggagc

SEQ ID NO: 3710031 - RNA, 14 nt, Salmonella enterica enterica serovar Typhi Ty2
ucagcaggcgggcu

SEQ ID NO: 3710032 - RNA, 17 nt, Salmonella enterica enterica serovar Typhi Ty2
ucagcagugcaaaggcc

SEQ ID NO: 3710033 - RNA, 12 nt, Salmonella enterica enterica serovar Typhi Ty2
ucagcaguucau

SEQ ID NO: 3710034 - RNA, 17 nt, Salmonella enterica enterica serovar Typhi Ty2
ucagcauaaagccucuc

SEQ ID NO: 3710035 - RNA, 19 nt, Salmonella enterica enterica serovar Typhi Ty2
ucagcauccgcaagacacg

SEQ ID NO: 3710036 - RNA, 12 nt, Salmonella enterica enterica serovar Typhi Ty2
ucagcauggugu

SEQ ID NO: 3710037 - RNA, 13 nt, Salmonella enterica enterica serovar Typhi Ty2
ucagcauggugug

SEQ ID NO: 3710038 - RNA, 16 nt, Salmonella enterica enterica serovar Typhi Ty2
ucagccacuucuucca

SEQ ID NO: 3710039 - RNA, 19 nt, Salmonella enterica enterica serovar Typhi Ty2
ucagccacuucuuccagcg

SEQ ID NO: 3710040 - RNA, 14 nt, Salmonella enterica enterica serovar Typhi Ty2
ucagccagaacgaa

SEQ ID NO: 3710041 - RNA, 16 nt, Salmonella enterica enterica serovar Typhi Ty2
ucagccagcagcucaa

SEQ ID NO: 3710042 - RNA, 18 nt, Salmonella enterica enterica serovar Typhi Ty2
ucaggcuguuguucuuuu

SEQ ID NO: 3710043 - RNA, 21 nt, Salmonella enterica enterica serovar Typhi Ty2
ucaggcuguuguucuuuucuu

SEQ ID NO: 3710044 - RNA, 14 nt, Salmonella enterica enterica serovar Typhi Ty2
ucaggcuugucgcg

SEQ ID NO: 3710045 - RNA, 12 nt, Salmonella enterica enterica serovar Typhi Ty2
ucaggcuuucca

SEQ ID NO: 3710046 - RNA, 22 nt, Salmonella enterica enterica serovar Typhi Ty2
ucagggcaaaaaugaucacuuc

SEQ ID NO: 3710047 - RNA, 22 nt, Salmonella enterica enterica serovar Typhi Ty2
ucagggcgcggcgcaacuuuuu

SEQ ID NO: 3710048 - RNA, 17 nt, Salmonella enterica enterica serovar Typhi Ty2
ucagggcggaacagcgg

SEQ ID NO: 3710049 - RNA, 21 nt, Salmonella enterica enterica serovar Typhi Ty2
ucagggcuuacucccugguga

SEQ ID NO: 3710050 - RNA, 17 nt, Salmonella enterica enterica serovar Typhi Ty2
ucaggggcgaacccauc

SEQ ID NO: 3710051 - RNA, 18 nt, Salmonella enterica enterica serovar Typhi Ty2
ucaggguuuucuaccgca

SEQ ID NO: 3710052 - RNA, 21 nt, Salmonella enterica enterica serovar Typhi Ty2
ucaggguuuucuaccgcagcc

SEQ ID NO: 3710053 - RNA, 14 nt, Salmonella enterica enterica serovar Typhi Ty2
ucagguaucccgcc

SEQ ID NO: 3710054 - RNA, 19 nt, Salmonella enterica enterica serovar Typhi Ty2
ucagguaucccgccagcgg

SEQ ID NO: 3710055 - RNA, 16 nt, Salmonella enterica enterica serovar Typhi Ty2
ucagguauuuccugcu

SEQ ID NO: 3710056 - RNA, 15 nt, Salmonella enterica enterica serovar Typhi Ty2
ucaggucauacggca

SEQ ID NO: 3710057 - RNA, 16 nt, Salmonella enterica enterica serovar Typhi Ty2
ucaggucuauugccua

SEQ ID NO: 3710058 - RNA, 20 nt, Salmonella enterica enterica serovar Typhi Ty2
ucaggugaauaccaaagccc

SEQ ID NO: 3710059 - RNA, 19 nt, Salmonella enterica enterica serovar Typhi Ty2
ucaggugacaguccgggcc

SEQ ID NO: 3710060 - RNA, 23 nt, Salmonella enterica enterica serovar Typhi Ty2
ucaggugauugcccuccagccau

SEQ ID NO: 3710061 - RNA, 13 nt, Salmonella enterica enterica serovar Typhi Ty2
ucagguggaagaa

SEQ ID NO: 3710062 - RNA, 16 nt, Salmonella enterica enterica serovar Typhi Ty2
ucaguaaaagcccgcc

SEQ ID NO: 3710063 - RNA, 18 nt, Salmonella enterica enterica serovar Typhi Ty2
ucaguaaaggaugccacu

SEQ ID NO: 3710064 - RNA, 15 nt, Salmonella enterica enterica serovar Typhi Ty2
ucaguaaccagggag

SEQ ID NO: 3710065 - RNA, 20 nt, Salmonella enterica enterica serovar Typhi Ty2
ucaguaauguccagauuacg

SEQ ID NO: 3710066 - RNA, 18 nt, Salmonella enterica enterica serovar Typhi Ty2
ucaguacagccaaaaaua

SEQ ID NO: 3710067 - RNA, 21 nt, Salmonella enterica enterica serovar Typhi Ty2
ucaguacgcuuuggcaggccu

SEQ ID NO: 3710068 - RNA, 23 nt, Salmonella enterica enterica serovar Typhi Ty2
ucaguaugaucaugcccggcaaa

SEQ ID NO: 3710069 - RNA, 16 nt, Salmonella enterica enterica serovar Typhi Ty2
ucaguccccacauuac

SEQ ID NO: 3710070 - RNA, 23 nt, Salmonella enterica enterica serovar Typhi Ty2
ucaguccccagcguaccacgccg

SEQ ID NO: 3710071 - RNA, 22 nt, Salmonella enterica enterica serovar Typhi Ty2
ucagucccgggcuaaucgcaaa

SEQ ID NO: 3710072 - RNA, 21 nt, Salmonella enterica enterica serovar Typhi Ty2
ucaguccuuccgcuuuaagcg

SEQ ID NO: 3710073 - RNA, 20 nt, Salmonella enterica enterica serovar Typhi Ty2
ucagugaaaagcuggaggug

SEQ ID NO: 3710074 - RNA, 13 nt, Salmonella enterica enterica serovar Typhi Ty2
ucagugaacaccc

SEQ ID NO: 3710075 - RNA, 14 nt, Salmonella enterica enterica serovar Typhi Ty2
ucaguggaaaacag

SEQ ID NO: 3710076 - RNA, 22 nt, Salmonella enterica enterica serovar Typhi Ty2
ucaguggcggcaaaaaauauag

SEQ ID NO: 3710077 - RNA, 21 nt, Salmonella enterica enterica serovar Typhi Ty2
ucagugugguuucaagcggca

SEQ ID NO: 3710078 - RNA, 21 nt, Salmonella enterica enterica serovar Typhi Ty2
ucaguguuuccauacauuuuu

SEQ ID NO: 3710079 - RNA, 15 nt, Salmonella enterica enterica serovar Typhi Ty2
ucaguucagaaacgg

SEQ ID NO: 3710080 - RNA, 17 nt, Salmonella enterica enterica serovar Typhi Ty2
ucaguucauagccgugg

SEQ ID NO: 3710081 - RNA, 17 nt, Salmonella enterica enterica serovar Typhi Ty2
ucaguucggcgcgccag

SEQ ID NO: 3710082 - RNA, 21 nt, Salmonella enterica enterica serovar Typhi Ty2
ucaguucucgcgccaccugca

SEQ ID NO: 3710083 - RNA, 14 nt, Salmonella enterica enterica serovar Typhi Ty2
ucaguugguuagaa

SEQ ID NO: 3710084 - RNA, 13 nt, Salmonella enterica enterica serovar Typhi Ty2
ucaguuucggccc

SEQ ID NO: 3710085 - RNA, 14 nt, Salmonella enterica enterica serovar Typhi Ty2
ucauaacaccaaua

SEQ ID NO: 3710086 - RNA, 19 nt, Salmonella enterica enterica serovar Typhi Ty2
ucauaacaccaauacguga

SEQ ID NO: 3710087 - RNA, 21 nt, Salmonella enterica enterica serovar Typhi Ty2
ucauaaccgcagucuccggua

SEQ ID NO: 3710088 - RNA, 15 nt, Salmonella enterica enterica serovar Typhi Ty2
ucauaagucauccag

SEQ ID NO: 3710089 - RNA, 16 nt, Salmonella enterica enterica serovar Typhi Ty2
ucauaauaaacugcau

SEQ ID NO: 3710090 - RNA, 13 nt, Salmonella enterica enterica serovar Typhi Ty2
ucauaauaagcgc

SEQ ID NO: 3710091 - RNA, 20 nt, Salmonella enterica enterica serovar Typhi Ty2
ucauaauaagcgcucaggca

SEQ ID NO: 3710092 - RNA, 16 nt, Salmonella enterica enterica serovar Typhi Ty2
ucauaaucgcgauacu

SEQ ID NO: 3710093 - RNA, 16 nt, Salmonella enterica enterica serovar Typhi Ty2
ucauaaugaauacgcu

SEQ ID NO: 3710094 - RNA, 12 nt, Salmonella enterica enterica serovar Typhi Ty2
ucauaauguucg

SEQ ID NO: 3710095 - RNA, 15 nt, Salmonella enterica enterica serovar Typhi Ty2
ucauaauucagcuca

SEQ ID NO: 3710096 - RNA, 14 nt, Salmonella enterica enterica serovar Typhi Ty2
ucauacaccgcauc

SEQ ID NO: 3710097 - RNA, 21 nt, Salmonella enterica enterica serovar Typhi Ty2
ucauacauuugaauaauucug

SEQ ID NO: 3710098 - RNA, 18 nt, Salmonella enterica enterica serovar Typhi Ty2
ucauacgcuuuacgcuua

SEQ ID NO: 3710099 - RNA, 14 nt, Salmonella enterica enterica serovar Typhi Ty2
ucauacgcuuucug

SEQ ID NO: 3710100 - RNA, 22 nt, Salmonella enterica enterica serovar Typhi Ty2
ucauacgcuuucugaauuuccu

SEQ ID NO: 3710101 - RNA, 18 nt, Salmonella enterica enterica serovar Typhi Ty2
ucauacggauauuacgcu

SEQ ID NO: 3710102 - RNA, 23 nt, Salmonella enterica enterica serovar Typhi Ty2
ucauacggcaugccaucucuuaa

SEQ ID NO: 3710103 - RNA, 14 nt, Salmonella enterica enterica serovar Typhi Ty2
ucauagacugcgcu

SEQ ID NO: 3710104 - RNA, 16 nt, Salmonella enterica enterica serovar Typhi Ty2
ucauagcggcuaccgc

SEQ ID NO: 3710105 - RNA, 14 nt, Salmonella enterica enterica serovar Typhi Ty2
ucauagugcgcgcg

SEQ ID NO: 3710106 - RNA, 13 nt, Salmonella enterica enterica serovar Typhi Ty2
ucauauaagaaau

SEQ ID NO: 3710107 - RNA, 15 nt, Salmonella enterica enterica serovar Typhi Ty2
ucauauaagaaauag

SEQ ID NO: 3710108 - RNA, 19 nt, Salmonella enterica enterica serovar Typhi Ty2
ucauaucugcgccgccaaa

SEQ ID NO: 3710109 - RNA, 19 nt, Salmonella enterica enterica serovar Typhi Ty2
ucauauggaagcuguuaau

SEQ ID NO: 3710110 - RNA, 14 nt, Salmonella enterica enterica serovar Typhi Ty2
ucauaugugccgau

SEQ ID NO: 3710111 - RNA, 19 nt, Salmonella enterica enterica serovar Typhi Ty2
ucauauuaaauuccggcuc

SEQ ID NO: 3710112 - RNA, 15 nt, Salmonella enterica enterica serovar Typhi Ty2
ucauauugcgccgca

SEQ ID NO: 3710113 - RNA, 22 nt, Salmonella enterica enterica serovar Typhi Ty2
ucauauuugcuggcuugcucag

SEQ ID NO: 3710114 - RNA, 23 nt, Salmonella enterica enterica serovar Typhi Ty2
ucauauuugugaccaacaucauu

SEQ ID NO: 3710115 - RNA, 13 nt, Salmonella enterica enterica serovar Typhi Ty2
ucaucaaaaugca

SEQ ID NO: 3710116 - RNA, 13 nt, Salmonella enterica enterica serovar Typhi Ty2
ucaucaaguaccg

SEQ ID NO: 3710117 - RNA, 20 nt, Salmonella enterica enterica serovar Typhi Ty2
ucaucacaucgcgcagcagg

SEQ ID NO: 3710118 - RNA, 23 nt, Salmonella enterica enterica serovar Typhi Ty2
ucaucaccagcagcagaaucagg

SEQ ID NO: 3710119 - RNA, 18 nt, Salmonella enterica enterica serovar Typhi Ty2
ucaucacgaucgagucag

SEQ ID NO: 3710120 - RNA, 15 nt, Salmonella enterica enterica serovar Typhi Ty2
ucaucagaagaagac

SEQ ID NO: 3710121 - RNA, 18 nt, Salmonella enterica enterica serovar Typhi Ty2
ucaucagacccgcauaca

SEQ ID NO: 3710122 - RNA, 17 nt, Salmonella enterica enterica serovar Typhi Ty2
ucaucagaccgagaccc

SEQ ID NO: 3710123 - RNA, 23 nt, Salmonella enterica enterica serovar Typhi Ty2
ucaucagaucaugaggaugagcg

SEQ ID NO: 3710124 - RNA, 23 nt, Salmonella enterica enterica serovar Typhi Ty2
ucaugcgcgucccggcagugcau

SEQ ID NO: 3710125 - RNA, 14 nt, Salmonella enterica enterica serovar Typhi Ty2
ucaugcuaaaacag

SEQ ID NO: 3710126 - RNA, 23 nt, Salmonella enterica enterica serovar Typhi Ty2
ucaugcugcgguuauaauaauaa

SEQ ID NO: 3710127 - RNA, 20 nt, Salmonella enterica enterica serovar Typhi Ty2
ucaugcugcguacaaucgcg

SEQ ID NO: 3710128 - RNA, 16 nt, Salmonella enterica enterica serovar Typhi Ty2
ucaugcuggucagcaa

SEQ ID NO: 3710129 - RNA, 23 nt, Salmonella enterica enterica serovar Typhi Ty2
ucaugcuguauaaacucagcaau

SEQ ID NO: 3710130 - RNA, 18 nt, Salmonella enterica enterica serovar Typhi Ty2
ucauggacagauuuccac

SEQ ID NO: 3710131 - RNA, 18 nt, Salmonella enterica enterica serovar Typhi Ty2
ucauggcauagccaaaga

SEQ ID NO: 3710132 - RNA, 17 nt, Salmonella enterica enterica serovar Typhi Ty2
ucauggcuuagcgccag

SEQ ID NO: 3710133 - RNA, 21 nt, Salmonella enterica enterica serovar Typhi Ty2
ucauggcuuuuacccuucaug

SEQ ID NO: 3710134 - RNA, 14 nt, Salmonella enterica enterica serovar Typhi Ty2
ucaugggaaaucac

SEQ ID NO: 3710135 - RNA, 16 nt, Salmonella enterica enterica serovar Typhi Ty2
ucaugggcucaucaaa

SEQ ID NO: 3710136 - RNA, 18 nt, Salmonella enterica enterica serovar Typhi Ty2
ucaugguaaaauccuuuu

SEQ ID NO: 3710137 - RNA, 17 nt, Salmonella enterica enterica serovar Typhi Ty2
ucaugguagucaaauuc

SEQ ID NO: 3710138 - RNA, 15 nt, Salmonella enterica enterica serovar Typhi Ty2
ucauggugaugaucg

SEQ ID NO: 3710139 - RNA, 13 nt, Salmonella enterica enterica serovar Typhi Ty2
ucauguaaaggcg

SEQ ID NO: 3710140 - RNA, 13 nt, Salmonella enterica enterica serovar Typhi Ty2
ucauguccccagg

SEQ ID NO: 3710141 - RNA, 19 nt, Salmonella enterica enterica serovar Typhi Ty2
ucaugugcagcauccagcu

SEQ ID NO: 3710142 - RNA, 23 nt, Salmonella enterica enterica serovar Typhi Ty2
ucauguuauaagcgcgcagguag

SEQ ID NO: 3710143 - RNA, 23 nt, Salmonella enterica enterica serovar Typhi Ty2
ucauguugccggauagcucgcug

SEQ ID NO: 3710144 - RNA, 11 nt, Salmonella enterica enterica serovar Typhi Ty2
ucauuaaaaaa

SEQ ID NO: 3710145 - RNA, 13 nt, Salmonella enterica enterica serovar Typhi Ty2
ucauuaaaaaacc

SEQ ID NO: 3710146 - RNA, 14 nt, Salmonella enterica enterica serovar Typhi Ty2
ucauuaaaauugaa

SEQ ID NO: 3710147 - RNA, 22 nt, Salmonella enterica enterica serovar Typhi Ty2
ucauuaacgacaacuucuaauu

SEQ ID NO: 3710148 - RNA, 17 nt, Salmonella enterica enterica serovar Typhi Ty2
ucauuaacgggaaacug

SEQ ID NO: 3710149 - RNA, 20 nt, Salmonella enterica enterica serovar Typhi Ty2
ucauuaagcccauaaagcac

SEQ ID NO: 3710150 - RNA, 13 nt, Salmonella enterica enterica serovar Typhi Ty2
ucauuaauauaau

SEQ ID NO: 3710151 - RNA, 21 nt, Salmonella enterica enterica serovar Typhi Ty2
ucauuaauuauacugucgcuc

SEQ ID NO: 3710152 - RNA, 12 nt, Salmonella enterica enterica serovar Typhi Ty2
ucauuacaggcg

SEQ ID NO: 3710153 - RNA, 16 nt, Salmonella enterica enterica serovar Typhi Ty2
ucauuaccaacguaaa

SEQ ID NO: 3710154 - RNA, 13 nt, Salmonella enterica enterica serovar Typhi Ty2
ucauuaccuuuuc

SEQ ID NO: 3710155 - RNA, 19 nt, Salmonella enterica enterica serovar Typhi Ty2
ucauuacgaaguuuaauuc

SEQ ID NO: 3710156 - RNA, 20 nt, Salmonella enterica enterica serovar Typhi Ty2
ucauuacgcuuccugccgug

SEQ ID NO: 3710157 - RNA, 18 nt, Salmonella enterica enterica serovar Typhi Ty2
ucauuacuuauauuuauu

SEQ ID NO: 3710158 - RNA, 13 nt, Salmonella enterica enterica serovar Typhi Ty2
ucauuagcgcggu

SEQ ID NO: 3710159 - RNA, 23 nt, Salmonella enterica enterica serovar Typhi Ty2
ucauuaggcguaauuauuacaga

SEQ ID NO: 3710160 - RNA, 22 nt, Salmonella enterica enterica serovar Typhi Ty2
ucauuaucaauagcuucaauga

SEQ ID NO: 3710161 - RNA, 14 nt, Salmonella enterica enterica serovar Typhi Ty2
ucauuauucaggcc

SEQ ID NO: 3710162 - RNA, 19 nt, Salmonella enterica enterica serovar Typhi Ty2
ucauuauucaggccuccug

SEQ ID NO: 3710163 - RNA, 17 nt, Salmonella enterica enterica serovar Typhi Ty2
ucauuauuuuuaaauaa

SEQ ID NO: 3710164 - RNA, 18 nt, Salmonella enterica enterica serovar Typhi Ty2
ucauuauuuuuaaauaac

SEQ ID NO: 3710165 - RNA, 21 nt, Salmonella enterica enterica serovar Typhi Ty2
ucauucacccaauaaauaaua

SEQ ID NO: 3710166 - RNA, 17 nt, Salmonella enterica enterica serovar Typhi Ty2
ucauucagaucaaaaau

SEQ ID NO: 3710167 - RNA, 14 nt, Salmonella enterica enterica serovar Typhi Ty2
ucauucccauacug

SEQ ID NO: 3710168 - RNA, 24 nt, Salmonella enterica enterica serovar Typhi Ty2
ucauuccgaggguggacaugauaa

SEQ ID NO: 3710169 - RNA, 20 nt, Salmonella enterica enterica serovar Typhi Ty2
ucauucgguuaggaauagca

SEQ ID NO: 3710170 - RNA, 15 nt, Salmonella enterica enterica serovar Typhi Ty2
ucauucugauuuuac

SEQ ID NO: 3710171 - RNA, 20 nt, Salmonella enterica enterica serovar Typhi Ty2
ucauucugcuuaccagaccg

SEQ ID NO: 3710172 - RNA, 18 nt, Salmonella enterica enterica serovar Typhi Ty2
ucauugacccgaucgcua

SEQ ID NO: 3710173 - RNA, 19 nt, Salmonella enterica enterica serovar Typhi Ty2
ucauugacgguggccgcca

SEQ ID NO: 3710174 - RNA, 20 nt, Salmonella enterica enterica serovar Typhi Ty2
ucauugaggcgcgaaaaaua

SEQ ID NO: 3710175 - RNA, 18 nt, Salmonella enterica enterica serovar Typhi Ty2
ucauugaguuugcaaucc

SEQ ID NO: 3710176 - RNA, 17 nt, Salmonella enterica enterica serovar Typhi Ty2
ucauugccguaaauuga

SEQ ID NO: 3710177 - RNA, 21 nt, Salmonella enterica enterica serovar Typhi Ty2
ucauugccguuaacugcugcu

SEQ ID NO: 3710178 - RNA, 14 nt, Salmonella enterica enterica serovar Typhi Ty2
ucauugcgcuaaaa

SEQ ID NO: 3710179 - RNA, 17 nt, Salmonella enterica enterica serovar Typhi Ty2
ucauugcgcuaaaaucc

SEQ ID NO: 3710180 - RNA, 18 nt, Salmonella enterica enterica serovar Typhi Ty2
ucauugcgcuaaaaucca

SEQ ID NO: 3710181 - RNA, 21 nt, Salmonella enterica enterica serovar Typhi Ty2
ucauuggaagagacacgcuga

SEQ ID NO: 3710182 - RNA, 17 nt, Salmonella enterica enterica serovar Typhi Ty2
ucauuggauuaacggca

SEQ ID NO: 3710183 - RNA, 18 nt, Salmonella enterica enterica serovar Typhi Ty2
ucauuggggaaccuggca

SEQ ID NO: 3710184 - RNA, 16 nt, Salmonella enterica enterica serovar Typhi Ty2
ucauuggggacgcgca

SEQ ID NO: 3710185 - RNA, 17 nt, Salmonella enterica enterica serovar Typhi Ty2
ucauuggggggaaauua

SEQ ID NO: 3710186 - RNA, 14 nt, Salmonella enterica enterica serovar Typhi Ty2
ucauuguaaaaccg

SEQ ID NO: 3710187 - RNA, 14 nt, Salmonella enterica enterica serovar Typhi Ty2
ucauuucaggcaaa

SEQ ID NO: 3710188 - RNA, 15 nt, Salmonella enterica enterica serovar Typhi Ty2
ucauuucgaucuguu

SEQ ID NO: 3710189 - RNA, 13 nt, Salmonella enterica enterica serovar Typhi Ty2
ucauuucugccug

SEQ ID NO: 3710190 - RNA, 23 nt, Salmonella enterica enterica serovar Typhi Ty2
ucauuugcgagaaaaaguguccg

SEQ ID NO: 3710191 - RNA, 17 nt, Salmonella enterica enterica serovar Typhi Ty2
ucauuugcgcuuuuaau

SEQ ID NO: 3710192 - RNA, 15 nt, Salmonella enterica enterica serovar Typhi Ty2
ucauuuguacaaaaa

SEQ ID NO: 3710193 - RNA, 20 nt, Salmonella enterica enterica serovar Typhi Ty2
ucauuuguacaaaaaaugug

SEQ ID NO: 3710194 - RNA, 21 nt, Salmonella enterica enterica serovar Typhi Ty2
ucauuuguacaaaaaauguga

SEQ ID NO: 3710195 - RNA, 13 nt, Salmonella enterica enterica serovar Typhi Ty2
ucauuuguuccuc

SEQ ID NO: 3710196 - RNA, 24 nt, Salmonella enterica enterica serovar Typhi Ty2
ucauuuuacugcguaaucuuuuca

SEQ ID NO: 3710197 - RNA, 20 nt, Salmonella enterica enterica serovar Typhi Ty2
ucauuuuguugcuccagcau

SEQ ID NO: 3710198 - RNA, 15 nt, Salmonella enterica enterica serovar Typhi Ty2
uccaaaaauaaacac

SEQ ID NO: 3710199 - RNA, 13 nt, Salmonella enterica enterica serovar Typhi Ty2
uccaaaauaauaa

SEQ ID NO: 3710200 - RNA, 21 nt, Salmonella enterica enterica serovar Typhi Ty2
uccaaacuggcugugccaaua

SEQ ID NO: 3710201 - RNA, 16 nt, Salmonella enterica enterica serovar Typhi Ty2
uccaaagcgaagcugc

SEQ ID NO: 3710202 - RNA, 14 nt, Salmonella enterica enterica serovar Typhi Ty2
uccaaauaaggacu

SEQ ID NO: 3710203 - RNA, 22 nt, Salmonella enterica enterica serovar Typhi Ty2
uccaaauggcguacuaaauagg

SEQ ID NO: 3710204 - RNA, 22 nt, Salmonella enterica enterica serovar Typhi Ty2
uccaacacaucgacaugcagau

SEQ ID NO: 3710205 - RNA, 16 nt, Salmonella enterica enterica serovar Typhi Ty2
uccaacagaaggcuuc

SEQ ID NO: 3710206 - RNA, 13 nt, Salmonella enterica enterica serovar Typhi Ty2
uccaucagccagg

SEQ ID NO: 3710207 - RNA, 17 nt, Salmonella enterica enterica serovar Typhi Ty2
uccaucagcgcuuugau

SEQ ID NO: 3710208 - RNA, 19 nt, Salmonella enterica enterica serovar Typhi Ty2
uccaucaugggcgcggcga

SEQ ID NO: 3710209 - RNA, 13 nt, Salmonella enterica enterica serovar Typhi Ty2
uccaucauuuccg

SEQ ID NO: 3710210 - RNA, 15 nt, Salmonella enterica enterica serovar Typhi Ty2
uccauccauugcgcc

SEQ ID NO: 3710211 - RNA, 16 nt, Salmonella enterica enterica serovar Typhi Ty2
uccauccggguaauuu

SEQ ID NO: 3710212 - RNA, 12 nt, Salmonella enterica enterica serovar Typhi Ty2
uccaucgccgug

SEQ ID NO: 3710213 - RNA, 19 nt, Salmonella enterica enterica serovar Typhi Ty2
uccaucgggcucggcgcuu

SEQ ID NO: 3710214 - RNA, 19 nt, Salmonella enterica enterica serovar Typhi Ty2
uccaucgguucucugccau

SEQ ID NO: 3710215 - RNA, 18 nt, Salmonella enterica enterica serovar Typhi Ty2
uccaugacgaccacagcc

SEQ ID NO: 3710216 - RNA, 20 nt, Salmonella enterica enterica serovar Typhi Ty2
uccaugacgaccacagccgu

SEQ ID NO: 3710217 - RNA, 15 nt, Salmonella enterica enterica serovar Typhi Ty2
uccaugagaagaaaa

SEQ ID NO: 3710218 - RNA, 16 nt, Salmonella enterica enterica serovar Typhi Ty2
uccaugagaagaaaaa

SEQ ID NO: 3710219 - RNA, 15 nt, Salmonella enterica enterica serovar Typhi Ty2
uccaugccggcccga

SEQ ID NO: 3710220 - RNA, 21 nt, Salmonella enterica enterica serovar Typhi Ty2
uccaugccuuuggccuggaga

SEQ ID NO: 3710221 - RNA, 13 nt, Salmonella enterica enterica serovar Typhi Ty2
uccaugcuucgau

SEQ ID NO: 3710222 - RNA, 18 nt, Salmonella enterica enterica serovar Typhi Ty2
uccaugcuuucaauaaau

SEQ ID NO: 3710223 - RNA, 20 nt, Salmonella enterica enterica serovar Typhi Ty2
uccauggucucuuuuuuagg

SEQ ID NO: 3710224 - RNA, 15 nt, Salmonella enterica enterica serovar Typhi Ty2
uccauguaaacucca

SEQ ID NO: 3710225 - RNA, 19 nt, Salmonella enterica enterica serovar Typhi Ty2
uccauguaaacuccauuaa

SEQ ID NO: 3710226 - RNA, 18 nt, Salmonella enterica enterica serovar Typhi Ty2
uccauguacgcaggcgac

SEQ ID NO: 3710227 - RNA, 16 nt, Salmonella enterica enterica serovar Typhi Ty2
uccaugucuugcuauc

SEQ ID NO: 3710228 - RNA, 19 nt, Salmonella enterica enterica serovar Typhi Ty2
uccauguugccaugguuca

SEQ ID NO: 3710229 - RNA, 20 nt, Salmonella enterica enterica serovar Typhi Ty2
uccauguuuccccuucuggu

SEQ ID NO: 3710230 - RNA, 22 nt, Salmonella enterica enterica serovar Typhi Ty2
uccauuagcgccugaugcacau

SEQ ID NO: 3710231 - RNA, 20 nt, Salmonella enterica enterica serovar Typhi Ty2
uccauucacacaauuuucuu

SEQ ID NO: 3710232 - RNA, 14 nt, Salmonella enterica enterica serovar Typhi Ty2
uccauucaucgauu

SEQ ID NO: 3710233 - RNA, 13 nt, Salmonella enterica enterica serovar Typhi Ty2
uccauucccagcu

SEQ ID NO: 3710234 - RNA, 19 nt, Salmonella enterica enterica serovar Typhi Ty2
uccauucggcgaaagaagc

SEQ ID NO: 3710235 - RNA, 14 nt, Salmonella enterica enterica serovar Typhi Ty2
uccauuuuaaauac

SEQ ID NO: 3710236 - RNA, 12 nt, Salmonella enterica enterica serovar Typhi Ty2
uccauuuuccua

SEQ ID NO: 3710237 - RNA, 21 nt, Salmonella enterica enterica serovar Typhi Ty2
uccauuuuggggaaaauaccg

SEQ ID NO: 3710238 - RNA, 12 nt, Salmonella enterica enterica serovar Typhi Ty2
uccauuuuucag

SEQ ID NO: 3710239 - RNA, 18 nt, Salmonella enterica enterica serovar Typhi Ty2
ucccaacaaugccacgcc

SEQ ID NO: 3710240 - RNA, 15 nt, Salmonella enterica enterica serovar Typhi Ty2
ucccaacagcgagcu

SEQ ID NO: 3710241 - RNA, 21 nt, Salmonella enterica enterica serovar Typhi Ty2
ucccaacccgaccaggacaaa

SEQ ID NO: 3710242 - RNA, 20 nt, Salmonella enterica enterica serovar Typhi Ty2
ucccaaugcggaaaccaguu

SEQ ID NO: 3710243 - RNA, 13 nt, Salmonella enterica enterica serovar Typhi Ty2
ucccaaugcuuuc

SEQ ID NO: 3710244 - RNA, 18 nt, Salmonella enterica enterica serovar Typhi Ty2
ucccacaguuaacgccaa

SEQ ID NO: 3710245 - RNA, 19 nt, Salmonella enterica enterica serovar Typhi Ty2
ucccacaguuaacgccaac

SEQ ID NO: 3710246 - RNA, 21 nt, Salmonella enterica enterica serovar Typhi Ty2
ucccacauacggcugaaaaau

SEQ ID NO: 3710247 - RNA, 12 nt, Salmonella enterica enterica serovar Typhi Ty2
ucccaccagcag

SEQ ID NO: 3710248 - RNA, 15 nt, Salmonella enterica enterica serovar Typhi Ty2
ucccacgcauagucc

SEQ ID NO: 3710249 - RNA, 19 nt, Salmonella enterica enterica serovar Typhi Ty2
ucccacggagaaaagcgaa

SEQ ID NO: 3710250 - RNA, 20 nt, Salmonella enterica enterica serovar Typhi Ty2
ucccacucuucaaccggcag

SEQ ID NO: 3710251 - RNA, 13 nt, Salmonella enterica enterica serovar Typhi Ty2
ucccacucuucca

SEQ ID NO: 3710252 - RNA, 16 nt, Salmonella enterica enterica serovar Typhi Ty2
ucccacuuugcucacc

SEQ ID NO: 3710253 - RNA, 13 nt, Salmonella enterica enterica serovar Typhi Ty2
ucccagaaaauga

SEQ ID NO: 3710254 - RNA, 12 nt, Salmonella enterica enterica serovar Typhi Ty2
ucccagaagaaa

SEQ ID NO: 3710255 - RNA, 17 nt, Salmonella enterica enterica serovar Typhi Ty2
ucccagauuaaaucauc

SEQ ID NO: 3710256 - RNA, 23 nt, Salmonella enterica enterica serovar Typhi Ty2
ucccagccgggcaggaaaagcug

SEQ ID NO: 3710257 - RNA, 20 nt, Salmonella enterica enterica serovar Typhi Ty2
ucccagcgcgcgcgcaaagc

SEQ ID NO: 3710258 - RNA, 14 nt, Salmonella enterica enterica serovar Typhi Ty2
ucccagcugagcua

SEQ ID NO: 3710259 - RNA, 19 nt, Salmonella enterica enterica serovar Typhi Ty2
ucccaggccgccaccgccu

SEQ ID NO: 3710260 - RNA, 18 nt, Salmonella enterica enterica serovar Typhi Ty2
ucccaggccggcauaaug

SEQ ID NO: 3710261 - RNA, 23 nt, Salmonella enterica enterica serovar Typhi Ty2
ucccaguaguuaccguaaucauc

SEQ ID NO: 3710262 - RNA, 21 nt, Salmonella enterica enterica serovar Typhi Ty2
ucccauaccuguaucaaacca

SEQ ID NO: 3710263 - RNA, 16 nt, Salmonella enterica enterica serovar Typhi Ty2
ucccauacugcccagc

SEQ ID NO: 3710264 - RNA, 19 nt, Salmonella enterica enterica serovar Typhi Ty2
ucccaucaauaagcgaauu

SEQ ID NO: 3710265 - RNA, 14 nt, Salmonella enterica enterica serovar Typhi Ty2
ucccauccgggcca

SEQ ID NO: 3710266 - RNA, 19 nt, Salmonella enterica enterica serovar Typhi Ty2
ucccauccgugcgaugaga

SEQ ID NO: 3710267 - RNA, 22 nt, Salmonella enterica enterica serovar Typhi Ty2
ucccaucgcuuugcagaaaauc

SEQ ID NO: 3710268 - RNA, 16 nt, Salmonella enterica enterica serovar Typhi Ty2
ucccaucguaacgccg

SEQ ID NO: 3710269 - RNA, 17 nt, Salmonella enterica enterica serovar Typhi Ty2
ucccaucguaacgccgu

SEQ ID NO: 3710270 - RNA, 19 nt, Salmonella enterica enterica serovar Typhi Ty2
ucccaugacgacagguuua

SEQ ID NO: 3710271 - RNA, 19 nt, Salmonella enterica enterica serovar Typhi Ty2
ucccauucacguagcggcg

SEQ ID NO: 3710272 - RNA, 18 nt, Salmonella enterica enterica serovar Typhi Ty2
ucccauuccugcaagaag

SEQ ID NO: 3710273 - RNA, 16 nt, Salmonella enterica enterica serovar Typhi Ty2
uccccaacagcgacca

SEQ ID NO: 3710274 - RNA, 14 nt, Salmonella enterica enterica serovar Typhi Ty2
uccccaaccgccag

SEQ ID NO: 3710275 - RNA, 16 nt, Salmonella enterica enterica serovar Typhi Ty2
uccccaaccgccagcc

SEQ ID NO: 3710276 - RNA, 22 nt, Salmonella enterica enterica serovar Typhi Ty2
uccccaacgacagcacuacgcu

SEQ ID NO: 3710277 - RNA, 17 nt, Salmonella enterica enterica serovar Typhi Ty2
uccccacaaucccgcca

SEQ ID NO: 3710278 - RNA, 14 nt, Salmonella enterica enterica serovar Typhi Ty2
uccccaccaccgcc

SEQ ID NO: 3710279 - RNA, 15 nt, Salmonella enterica enterica serovar Typhi Ty2
uccccaccaccgcca

SEQ ID NO: 3710280 - RNA, 14 nt, Salmonella enterica enterica serovar Typhi Ty2
uccccaccaggaau

SEQ ID NO: 3710281 - RNA, 15 nt, Salmonella enterica enterica serovar Typhi Ty2
uccccaccgcugaug

SEQ ID NO: 3710282 - RNA, 18 nt, Salmonella enterica enterica serovar Typhi Ty2
uccccaccgcugauggcg

SEQ ID NO: 3710283 - RNA, 22 nt, Salmonella enterica enterica serovar Typhi Ty2
uccccaccugacuauacccaaa

SEQ ID NO: 3710284 - RNA, 12 nt, Salmonella enterica enterica serovar Typhi Ty2
uccccagcaccg

SEQ ID NO: 3710285 - RNA, 19 nt, Salmonella enterica enterica serovar Typhi Ty2
uccccaggcgcuauuccca

SEQ ID NO: 3710286 - RNA, 21 nt, Salmonella enterica enterica serovar Typhi Ty2
uccccauaaucgaccguaucc

SEQ ID NO: 3710287 - RNA, 23 nt, Salmonella enterica enterica serovar Typhi Ty2
uccccauacugacggcgcucuuu

SEQ ID NO: 3710288 - RNA, 14 nt, Salmonella enterica enterica serovar Typhi Ty2
ucccucuccagggc

SEQ ID NO: 3710289 - RNA, 16 nt, Salmonella enterica enterica serovar Typhi Ty2
ucccucuccagggcaa

SEQ ID NO: 3710290 - RNA, 13 nt, Salmonella enterica enterica serovar Typhi Ty2
ucccugaagaaaa

SEQ ID NO: 3710291 - RNA, 18 nt, Salmonella enterica enterica serovar Typhi Ty2
ucccugaccuuccaucca

SEQ ID NO: 3710292 - RNA, 19 nt, Salmonella enterica enterica serovar Typhi Ty2
ucccugagucuugccuguc

SEQ ID NO: 3710293 - RNA, 16 nt, Salmonella enterica enterica serovar Typhi Ty2
ucccugcaacgccugc

SEQ ID NO: 3710294 - RNA, 21 nt, Salmonella enterica enterica serovar Typhi Ty2
ucccugccagugaaaguuuuc

SEQ ID NO: 3710295 - RNA, 21 nt, Salmonella enterica enterica serovar Typhi Ty2
ucccuuccgccaccagguuca

SEQ ID NO: 3710296 - RNA, 20 nt, Salmonella enterica enterica serovar Typhi Ty2
uccgaaacaaucaccugaug

SEQ ID NO: 3710297 - RNA, 15 nt, Salmonella enterica enterica serovar Typhi Ty2
uccgaacucaugccg

SEQ ID NO: 3710298 - RNA, 21 nt, Salmonella enterica enterica serovar Typhi Ty2
uccgaauacggacauuuauuu

SEQ ID NO: 3710299 - RNA, 22 nt, Salmonella enterica enterica serovar Typhi Ty2
uccgacagugaacggcauaauc

SEQ ID NO: 3710300 - RNA, 19 nt, Salmonella enterica enterica serovar Typhi Ty2
uccgaccacggccacagcc

SEQ ID NO: 3710301 - RNA, 12 nt, Salmonella enterica enterica serovar Typhi Ty2
uccgacgccugu

SEQ ID NO: 3710302 - RNA, 18 nt, Salmonella enterica enterica serovar Typhi Ty2
uccgacugaccagacaga

SEQ ID NO: 3710303 - RNA, 22 nt, Salmonella enterica enterica serovar Typhi Ty2
uccgagacgguaagaauaauaa

SEQ ID NO: 3710304 - RNA, 23 nt, Salmonella enterica enterica serovar Typhi Ty2
uccgaggaacgugaguccuucaa

SEQ ID NO: 3710305 - RNA, 19 nt, Salmonella enterica enterica serovar Typhi Ty2
uccgaggcguaucccagua

SEQ ID NO: 3710306 - RNA, 19 nt, Salmonella enterica enterica serovar Typhi Ty2
uccgauuucaugcgcagca

SEQ ID NO: 3710307 - RNA, 22 nt, Salmonella enterica enterica serovar Typhi Ty2
uccgcaaagacaacgaccagug

SEQ ID NO: 3710308 - RNA, 19 nt, Salmonella enterica enterica serovar Typhi Ty2
uccgcaaagcccaucagcg

SEQ ID NO: 3710309 - RNA, 12 nt, Salmonella enterica enterica serovar Typhi Ty2
uccgcaaagugg

SEQ ID NO: 3710310 - RNA, 11 nt, Salmonella enterica enterica serovar Typhi Ty2
uccgcaacaag

SEQ ID NO: 3710311 - RNA, 22 nt, Salmonella enterica enterica serovar Typhi Ty2
uccgcaagacacgcuuccagau

SEQ ID NO: 3710312 - RNA, 13 nt, Salmonella enterica enterica serovar Typhi Ty2
uccgcaauaagug

SEQ ID NO: 3710313 - RNA, 14 nt, Salmonella enterica enterica serovar Typhi Ty2
uccgcaauccuggc

SEQ ID NO: 3710314 - RNA, 16 nt, Salmonella enterica enterica serovar Typhi Ty2
uccgcaauuaauuuau

SEQ ID NO: 3710315 - RNA, 17 nt, Salmonella enterica enterica serovar Typhi Ty2
uccgcacauaaucaccg

SEQ ID NO: 3710316 - RNA, 21 nt, Salmonella enterica enterica serovar Typhi Ty2
uccgcacgccugcauaaagga

SEQ ID NO: 3710317 - RNA, 22 nt, Salmonella enterica enterica serovar Typhi Ty2
uccgcagauccagcacggccuu

SEQ ID NO: 3710318 - RNA, 20 nt, Salmonella enterica enterica serovar Typhi Ty2
uccgcagccagaaucagccg

SEQ ID NO: 3710319 - RNA, 17 nt, Salmonella enterica enterica serovar Typhi Ty2
uccgcagccgacgcauu

SEQ ID NO: 3710320 - RNA, 12 nt, Salmonella enterica enterica serovar Typhi Ty2
uccgcaggcaac

SEQ ID NO: 3710321 - RNA, 21 nt, Salmonella enterica enterica serovar Typhi Ty2
uccgcaggcgacgugacggug

SEQ ID NO: 3710322 - RNA, 15 nt, Salmonella enterica enterica serovar Typhi Ty2
uccgcauagcgcaac

SEQ ID NO: 3710323 - RNA, 15 nt, Salmonella enterica enterica serovar Typhi Ty2
uccgcaucgacguuc

SEQ ID NO: 3710324 - RNA, 14 nt, Salmonella enterica enterica serovar Typhi Ty2
uccgccaacagccg

SEQ ID NO: 3710325 - RNA, 12 nt, Salmonella enterica enterica serovar Typhi Ty2
uccgccacggcu

SEQ ID NO: 3710326 - RNA, 18 nt, Salmonella enterica enterica serovar Typhi Ty2
uccgccacggcuuucacg

SEQ ID NO: 3710327 - RNA, 17 nt, Salmonella enterica enterica serovar Typhi Ty2
uccgccacuuccugagc

SEQ ID NO: 3710328 - RNA, 19 nt, Salmonella enterica enterica serovar Typhi Ty2
uccgccagacucagccagg

SEQ ID NO: 3710329 - RNA, 20 nt, Salmonella enterica enterica serovar Typhi Ty2
uccgccauaacggcugucca

SEQ ID NO: 3710330 - RNA, 22 nt, Salmonella enterica enterica serovar Typhi Ty2
uccgccaugaaaaaaacgcauu

SEQ ID NO: 3710331 - RNA, 18 nt, Salmonella enterica enterica serovar Typhi Ty2
uccgcccaagaacaugac

SEQ ID NO: 3710332 - RNA, 23 nt, Salmonella enterica enterica serovar Typhi Ty2
uccgcccaagaacaugacggcag

SEQ ID NO: 3710333 - RNA, 19 nt, Salmonella enterica enterica serovar Typhi Ty2
uccgcccaguaccagcacu

SEQ ID NO: 3710334 - RNA, 13 nt, Salmonella enterica enterica serovar Typhi Ty2
uccgccccgcugg

SEQ ID NO: 3710335 - RNA, 13 nt, Salmonella enterica enterica serovar Typhi Ty2
uccgcccgccuuc

SEQ ID NO: 3710336 - RNA, 16 nt, Salmonella enterica enterica serovar Typhi Ty2
uccgccgcaauagcca

SEQ ID NO: 3710337 - RNA, 14 nt, Salmonella enterica enterica serovar Typhi Ty2
uccgccgccgccau

SEQ ID NO: 3710338 - RNA, 15 nt, Salmonella enterica enterica serovar Typhi Ty2
uccgccgucgucacc

SEQ ID NO: 3710339 - RNA, 17 nt, Salmonella enterica enterica serovar Typhi Ty2
uccgccugaucuuucug

SEQ ID NO: 3710340 - RNA, 11 nt, Salmonella enterica enterica serovar Typhi Ty2
uccgccugcug

SEQ ID NO: 3710341 - RNA, 16 nt, Salmonella enterica enterica serovar Typhi Ty2
uccgccugcugugccg

SEQ ID NO: 3710342 - RNA, 16 nt, Salmonella enterica enterica serovar Typhi Ty2
uccgccuggaacccag

SEQ ID NO: 3710343 - RNA, 17 nt, Salmonella enterica enterica serovar Typhi Ty2
uccgccuggaacccagg

SEQ ID NO: 3710344 - RNA, 20 nt, Salmonella enterica enterica serovar Typhi Ty2
uccgccuggaacccaggcac

SEQ ID NO: 3710345 - RNA, 19 nt, Salmonella enterica enterica serovar Typhi Ty2
uccgccuuaucaggccugu

SEQ ID NO: 3710346 - RNA, 23 nt, Salmonella enterica enterica serovar Typhi Ty2
uccgcgagagaaaaaaauccagu

SEQ ID NO: 3710347 - RNA, 14 nt, Salmonella enterica enterica serovar Typhi Ty2
uccgcgagcagcca

SEQ ID NO: 3710348 - RNA, 23 nt, Salmonella enterica enterica serovar Typhi Ty2
uccgcgauaucaaucaccucuuc

SEQ ID NO: 3710349 - RNA, 13 nt, Salmonella enterica enterica serovar Typhi Ty2
uccgcgaugugua

SEQ ID NO: 3710350 - RNA, 18 nt, Salmonella enterica enterica serovar Typhi Ty2
uccgcgcaaauacugaaa

SEQ ID NO: 3710351 - RNA, 16 nt, Salmonella enterica enterica serovar Typhi Ty2
uccgcgcaauaugcgg

SEQ ID NO: 3710352 - RNA, 12 nt, Salmonella enterica enterica serovar Typhi Ty2
uccgcgccgccg

SEQ ID NO: 3710353 - RNA, 18 nt, Salmonella enterica enterica serovar Typhi Ty2
uccgcgccgccgccgaag

SEQ ID NO: 3710354 - RNA, 14 nt, Salmonella enterica enterica serovar Typhi Ty2
uccgcggcaaaccc

SEQ ID NO: 3710355 - RNA, 18 nt, Salmonella enterica enterica serovar Typhi Ty2
uccgcgguagagcgcggu

SEQ ID NO: 3710356 - RNA, 15 nt, Salmonella enterica enterica serovar Typhi Ty2
uccgcgguguccugc

SEQ ID NO: 3710357 - RNA, 23 nt, Salmonella enterica enterica serovar Typhi Ty2
uccgcguuagcaagaccgggcug

SEQ ID NO: 3710358 - RNA, 17 nt, Salmonella enterica enterica serovar Typhi Ty2
uccgcguuuaucgcaua

SEQ ID NO: 3710359 - RNA, 18 nt, Salmonella enterica enterica serovar Typhi Ty2
uccgcguuuaucgcauac

SEQ ID NO: 3710360 - RNA, 20 nt, Salmonella enterica enterica serovar Typhi Ty2
uccgcuaccugcgagcugua

SEQ ID NO: 3710361 - RNA, 14 nt, Salmonella enterica enterica serovar Typhi Ty2
uccgcuagggcauc

SEQ ID NO: 3710362 - RNA, 20 nt, Salmonella enterica enterica serovar Typhi Ty2
uccgcuauuaccaguaauga

SEQ ID NO: 3710363 - RNA, 15 nt, Salmonella enterica enterica serovar Typhi Ty2
uccgcucacgccaac

SEQ ID NO: 3710364 - RNA, 13 nt, Salmonella enterica enterica serovar Typhi Ty2
uccgcucaugauu

SEQ ID NO: 3710365 - RNA, 16 nt, Salmonella enterica enterica serovar Typhi Ty2
uccgcuccacauccug

SEQ ID NO: 3710366 - RNA, 16 nt, Salmonella enterica enterica serovar Typhi Ty2
uccgcuggcguccagc

SEQ ID NO: 3710367 - RNA, 18 nt, Salmonella enterica enterica serovar Typhi Ty2
uccgcuggcguccagccc

SEQ ID NO: 3710368 - RNA, 23 nt, Salmonella enterica enterica serovar Typhi Ty2
uccgcuggcguccagcccgucca

SEQ ID NO: 3710369 - RNA, 22 nt, Salmonella enterica enterica serovar Typhi Ty2
uccgcuggugcguaacguaacc

SEQ ID NO: 3710370 - RNA, 17 nt, Salmonella enterica enterica serovar Typhi Ty2
uccguuauuucacagca

SEQ ID NO: 3710371 - RNA, 18 nt, Salmonella enterica enterica serovar Typhi Ty2
uccguucaucggcauaca

SEQ ID NO: 3710372 - RNA, 16 nt, Salmonella enterica enterica serovar Typhi Ty2
uccguucccaaugcuu

SEQ ID NO: 3710373 - RNA, 16 nt, Salmonella enterica enterica serovar Typhi Ty2
uccguugugaacagcg

SEQ ID NO: 3710374 - RNA, 23 nt, Salmonella enterica enterica serovar Typhi Ty2
uccguuuucgacaugguuggcca

SEQ ID NO: 3710375 - RNA, 16 nt, Salmonella enterica enterica serovar Typhi Ty2
uccucaacucguuccc

SEQ ID NO: 3710376 - RNA, 15 nt, Salmonella enterica enterica serovar Typhi Ty2
uccucaauguuaacu

SEQ ID NO: 3710377 - RNA, 12 nt, Salmonella enterica enterica serovar Typhi Ty2
uccucacgcccu

SEQ ID NO: 3710378 - RNA, 17 nt, Salmonella enterica enterica serovar Typhi Ty2
uccucagaauccgucag

SEQ ID NO: 3710379 - RNA, 20 nt, Salmonella enterica enterica serovar Typhi Ty2
uccucagcgaauaucucuau

SEQ ID NO: 3710380 - RNA, 13 nt, Salmonella enterica enterica serovar Typhi Ty2
uccucauacagcc

SEQ ID NO: 3710381 - RNA, 14 nt, Salmonella enterica enterica serovar Typhi Ty2
uccucauucagcgg

SEQ ID NO: 3710382 - RNA, 19 nt, Salmonella enterica enterica serovar Typhi Ty2
uccucauuuuguugcucca

SEQ ID NO: 3710383 - RNA, 21 nt, Salmonella enterica enterica serovar Typhi Ty2
uccucauuuuguugcuccagc

SEQ ID NO: 3710384 - RNA, 16 nt, Salmonella enterica enterica serovar Typhi Ty2
uccuccaacgugcaga

SEQ ID NO: 3710385 - RNA, 14 nt, Salmonella enterica enterica serovar Typhi Ty2
uccuccaucgccag

SEQ ID NO: 3710386 - RNA, 14 nt, Salmonella enterica enterica serovar Typhi Ty2
uccucccaucgagc

SEQ ID NO: 3710387 - RNA, 23 nt, Salmonella enterica enterica serovar Typhi Ty2
uccuccggcauagccggagguuu

SEQ ID NO: 3710388 - RNA, 22 nt, Salmonella enterica enterica serovar Typhi Ty2
uccuccggcgacugaaugccuu

SEQ ID NO: 3710389 - RNA, 20 nt, Salmonella enterica enterica serovar Typhi Ty2
uccuccggcgagcgaugcug

SEQ ID NO: 3710390 - RNA, 16 nt, Salmonella enterica enterica serovar Typhi Ty2
uccuccgguuucaacu

SEQ ID NO: 3710391 - RNA, 15 nt, Salmonella enterica enterica serovar Typhi Ty2
uccuccucauucagc

SEQ ID NO: 3710392 - RNA, 14 nt, Salmonella enterica enterica serovar Typhi Ty2
uccucgcauccucc

SEQ ID NO: 3710393 - RNA, 19 nt, Salmonella enterica enterica serovar Typhi Ty2
uccucgcgaaucucaaugc

SEQ ID NO: 3710394 - RNA, 20 nt, Salmonella enterica enterica serovar Typhi Ty2
uccucgcggguggccugcag

SEQ ID NO: 3710395 - RNA, 13 nt, Salmonella enterica enterica serovar Typhi Ty2
uccucuucucuga

SEQ ID NO: 3710396 - RNA, 16 nt, Salmonella enterica enterica serovar Typhi Ty2
uccucuugucaggcag

SEQ ID NO: 3710397 - RNA, 15 nt, Salmonella enterica enterica serovar Typhi Ty2
uccucuuucccuuuu

SEQ ID NO: 3710398 - RNA, 17 nt, Salmonella enterica enterica serovar Typhi Ty2
uccucuuuucgaacgcc

SEQ ID NO: 3710399 - RNA, 11 nt, Salmonella enterica enterica serovar Typhi Ty2
uccugaaaaaa

SEQ ID NO: 3710400 - RNA, 21 nt, Salmonella enterica enterica serovar Typhi Ty2
uccugaaacccauaauaauga

SEQ ID NO: 3710401 - RNA, 14 nt, Salmonella enterica enterica serovar Typhi Ty2
uccugaaccagcgg

SEQ ID NO: 3710402 - RNA, 21 nt, Salmonella enterica enterica serovar Typhi Ty2
uccugaaccagcggcaccagc

SEQ ID NO: 3710403 - RNA, 22 nt, Salmonella enterica enterica serovar Typhi Ty2
uccugaagaugggucagugcau

SEQ ID NO: 3710404 - RNA, 19 nt, Salmonella enterica enterica serovar Typhi Ty2
uccugaaggacaagcugcg

SEQ ID NO: 3710405 - RNA, 18 nt, Salmonella enterica enterica serovar Typhi Ty2
uccugaauugcaaggcga

SEQ ID NO: 3710406 - RNA, 23 nt, Salmonella enterica enterica serovar Typhi Ty2
uccugaccgggcucacgcuggug

SEQ ID NO: 3710407 - RNA, 12 nt, Salmonella enterica enterica serovar Typhi Ty2
uccugacgcuga

SEQ ID NO: 3710408 - RNA, 20 nt, Salmonella enterica enterica serovar Typhi Ty2
uccugacggugcgcgacgcc

SEQ ID NO: 3710409 - RNA, 12 nt, Salmonella enterica enterica serovar Typhi Ty2
uccugauaaccu

SEQ ID NO: 3710410 - RNA, 17 nt, Salmonella enterica enterica serovar Typhi Ty2
uccugauauucccguuc

SEQ ID NO: 3710411 - RNA, 22 nt, Salmonella enterica enterica serovar Typhi Ty2
uccugauauucccguuccagcu

SEQ ID NO: 3710412 - RNA, 19 nt, Salmonella enterica enterica serovar Typhi Ty2
uccugaucaaggcgcaaaa

SEQ ID NO: 3710413 - RNA, 15 nt, Salmonella enterica enterica serovar Typhi Ty2
uccugauccggcugu

SEQ ID NO: 3710414 - RNA, 20 nt, Salmonella enterica enterica serovar Typhi Ty2
uccugauuaaguuuuuuuaa

SEQ ID NO: 3710415 - RNA, 15 nt, Salmonella enterica enterica serovar Typhi Ty2
uccugcaaaauaccg

SEQ ID NO: 3710416 - RNA, 14 nt, Salmonella enterica enterica serovar Typhi Ty2
uccugcaacagaag

SEQ ID NO: 3710417 - RNA, 16 nt, Salmonella enterica enterica serovar Typhi Ty2
uccugcaacagaagag

SEQ ID NO: 3710418 - RNA, 17 nt, Salmonella enterica enterica serovar Typhi Ty2
uccugcaccgccugcgg

SEQ ID NO: 3710419 - RNA, 18 nt, Salmonella enterica enterica serovar Typhi Ty2
uccugcagcgccagaaag

SEQ ID NO: 3710420 - RNA, 20 nt, Salmonella enterica enterica serovar Typhi Ty2
uccugcaggcgagugcuacc

SEQ ID NO: 3710421 - RNA, 23 nt, Salmonella enterica enterica serovar Typhi Ty2
uccugcaggguaauuagccccug

SEQ ID NO: 3710422 - RNA, 24 nt, Salmonella enterica enterica serovar Typhi Ty2
uccugcauaauccaacgaaacgca

SEQ ID NO: 3710423 - RNA, 15 nt, Salmonella enterica enterica serovar Typhi Ty2
uccugccagacccca

SEQ ID NO: 3710424 - RNA, 21 nt, Salmonella enterica enterica serovar Typhi Ty2
uccugccagauuuucuuuaau

SEQ ID NO: 3710425 - RNA, 20 nt, Salmonella enterica enterica serovar Typhi Ty2
uccugcccuggugagcucca

SEQ ID NO: 3710426 - RNA, 16 nt, Salmonella enterica enterica serovar Typhi Ty2
uccugccgacaggcag

SEQ ID NO: 3710427 - RNA, 22 nt, Salmonella enterica enterica serovar Typhi Ty2
uccugccgacaggcagguugcc

SEQ ID NO: 3710428 - RNA, 21 nt, Salmonella enterica enterica serovar Typhi Ty2
uccugccgaugccgccgcaac

SEQ ID NO: 3710429 - RNA, 13 nt, Salmonella enterica enterica serovar Typhi Ty2
uccugccgccgca

SEQ ID NO: 3710430 - RNA, 16 nt, Salmonella enterica enterica serovar Typhi Ty2
uccugccugacaauga

SEQ ID NO: 3710431 - RNA, 14 nt, Salmonella enterica enterica serovar Typhi Ty2
uccugcgccagccg

SEQ ID NO: 3710432 - RNA, 14 nt, Salmonella enterica enterica serovar Typhi Ty2
uccugcgccggacg

SEQ ID NO: 3710433 - RNA, 18 nt, Salmonella enterica enterica serovar Typhi Ty2
uccugcgcugucaccagc

SEQ ID NO: 3710434 - RNA, 21 nt, Salmonella enterica enterica serovar Typhi Ty2
uccugcggccuugccgccagc

SEQ ID NO: 3710435 - RNA, 19 nt, Salmonella enterica enterica serovar Typhi Ty2
uccugcgguacggccagcg

SEQ ID NO: 3710436 - RNA, 14 nt, Salmonella enterica enterica serovar Typhi Ty2
uccugcuccugcgg

SEQ ID NO: 3710437 - RNA, 17 nt, Salmonella enterica enterica serovar Typhi Ty2
uccugcugcgccagcgc

SEQ ID NO: 3710438 - RNA, 21 nt, Salmonella enterica enterica serovar Typhi Ty2
uccugcuggcaaaacgcaucc

SEQ ID NO: 3710439 - RNA, 12 nt, Salmonella enterica enterica serovar Typhi Ty2
uccugcuguggu

SEQ ID NO: 3710440 - RNA, 13 nt, Salmonella enterica enterica serovar Typhi Ty2
uccuggaacugac

SEQ ID NO: 3710441 - RNA, 13 nt, Salmonella enterica enterica serovar Typhi Ty2
uccuggauuuuac

SEQ ID NO: 3710442 - RNA, 15 nt, Salmonella enterica enterica serovar Typhi Ty2
uccuggccaggcuuc

SEQ ID NO: 3710443 - RNA, 19 nt, Salmonella enterica enterica serovar Typhi Ty2
uccuggcgccacccaacau

SEQ ID NO: 3710444 - RNA, 20 nt, Salmonella enterica enterica serovar Typhi Ty2
uccuggcguaugcuuucagc

SEQ ID NO: 3710445 - RNA, 20 nt, Salmonella enterica enterica serovar Typhi Ty2
uccuggcguuaucaucguaa

SEQ ID NO: 3710446 - RNA, 22 nt, Salmonella enterica enterica serovar Typhi Ty2
uccuggcugucggcagaaccug

SEQ ID NO: 3710447 - RNA, 16 nt, Salmonella enterica enterica serovar Typhi Ty2
uccuggcuuaccugcu

SEQ ID NO: 3710448 - RNA, 12 nt, Salmonella enterica enterica serovar Typhi Ty2
uccuggcuucaa

SEQ ID NO: 3710449 - RNA, 16 nt, Salmonella enterica enterica serovar Typhi Ty2
uccuggcuugccagau

SEQ ID NO: 3710450 - RNA, 23 nt, Salmonella enterica enterica serovar Typhi Ty2
uccuggguauuuuuuagcgccaa

SEQ ID NO: 3710451 - RNA, 18 nt, Salmonella enterica enterica serovar Typhi Ty2
uccugguccggcagguag

SEQ ID NO: 3710452 - RNA, 17 nt, Salmonella enterica enterica serovar Typhi Ty2
ucgacguuguccggcga

SEQ ID NO: 3710453 - RNA, 19 nt, Salmonella enterica enterica serovar Typhi Ty2
ucgacuaauuuuaggaaga

SEQ ID NO: 3710454 - RNA, 14 nt, Salmonella enterica enterica serovar Typhi Ty2
ucgacucauccagc

SEQ ID NO: 3710455 - RNA, 18 nt, Salmonella enterica enterica serovar Typhi Ty2
ucgacuguuguucuucau

SEQ ID NO: 3710456 - RNA, 12 nt, Salmonella enterica enterica serovar Typhi Ty2
ucgacuuucauu

SEQ ID NO: 3710457 - RNA, 19 nt, Salmonella enterica enterica serovar Typhi Ty2
ucgagauuuuucugcgcca

SEQ ID NO: 3710458 - RNA, 19 nt, Salmonella enterica enterica serovar Typhi Ty2
ucgagcaucuccagcgcau

SEQ ID NO: 3710459 - RNA, 18 nt, Salmonella enterica enterica serovar Typhi Ty2
ucgagcguaauuccggcc

SEQ ID NO: 3710460 - RNA, 18 nt, Salmonella enterica enterica serovar Typhi Ty2
ucgagcgugucagugcca

SEQ ID NO: 3710461 - RNA, 19 nt, Salmonella enterica enterica serovar Typhi Ty2
ucgagcuuuugcugcgcca

SEQ ID NO: 3710462 - RNA, 15 nt, Salmonella enterica enterica serovar Typhi Ty2
ucgaggacggccuga

SEQ ID NO: 3710463 - RNA, 18 nt, Salmonella enterica enterica serovar Typhi Ty2
ucgaggauaaucacggcg

SEQ ID NO: 3710464 - RNA, 22 nt, Salmonella enterica enterica serovar Typhi Ty2
ucgagggugggcgcacaggccu

SEQ ID NO: 3710465 - RNA, 22 nt, Salmonella enterica enterica serovar Typhi Ty2
ucgaggucagcauuucauccau

SEQ ID NO: 3710466 - RNA, 22 nt, Salmonella enterica enterica serovar Typhi Ty2
ucgaguucuugcgacaucgcau

SEQ ID NO: 3710467 - RNA, 20 nt, Salmonella enterica enterica serovar Typhi Ty2
ucgauaaccuguaaauaaua

SEQ ID NO: 3710468 - RNA, 16 nt, Salmonella enterica enterica serovar Typhi Ty2
ucgauaaucgcgcgcu

SEQ ID NO: 3710469 - RNA, 18 nt, Salmonella enterica enterica serovar Typhi Ty2
ucgauaauugcucaccca

SEQ ID NO: 3710470 - RNA, 22 nt, Salmonella enterica enterica serovar Typhi Ty2
ucgauacgauugcgcguguuac

SEQ ID NO: 3710471 - RNA, 16 nt, Salmonella enterica enterica serovar Typhi Ty2
ucgauacuauaacgcu

SEQ ID NO: 3710472 - RNA, 17 nt, Salmonella enterica enterica serovar Typhi Ty2
ucgauacuauaacgcuu

SEQ ID NO: 3710473 - RNA, 19 nt, Salmonella enterica enterica serovar Typhi Ty2
ucgauagcgccgcaucgau

SEQ ID NO: 3710474 - RNA, 16 nt, Salmonella enterica enterica serovar Typhi Ty2
ucgauauaauuuuauu

SEQ ID NO: 3710475 - RNA, 19 nt, Salmonella enterica enterica serovar Typhi Ty2
ucgauaucgauaaucaaca

SEQ ID NO: 3710476 - RNA, 22 nt, Salmonella enterica enterica serovar Typhi Ty2
ucgauaucugccugcagaccca

SEQ ID NO: 3710477 - RNA, 21 nt, Salmonella enterica enterica serovar Typhi Ty2
ucgauaugaccaguacaggcg

SEQ ID NO: 3710478 - RNA, 13 nt, Salmonella enterica enterica serovar Typhi Ty2
ucgaucagcauau

SEQ ID NO: 3710479 - RNA, 14 nt, Salmonella enterica enterica serovar Typhi Ty2
ucgaucccggcaaa

SEQ ID NO: 3710480 - RNA, 22 nt, Salmonella enterica enterica serovar Typhi Ty2
ucgaucucgauauucacacgcu

SEQ ID NO: 3710481 - RNA, 21 nt, Salmonella enterica enterica serovar Typhi Ty2
ucgaucucggccacguccguu

SEQ ID NO: 3710482 - RNA, 15 nt, Salmonella enterica enterica serovar Typhi Ty2
ucgaucuucuccaga

SEQ ID NO: 3710483 - RNA, 14 nt, Salmonella enterica enterica serovar Typhi Ty2
ucgaugaaaaagag

SEQ ID NO: 3710484 - RNA, 17 nt, Salmonella enterica enterica serovar Typhi Ty2
ucgaugauauccagcac

SEQ ID NO: 3710485 - RNA, 12 nt, Salmonella enterica enterica serovar Typhi Ty2
ucgaugauggcg

SEQ ID NO: 3710486 - RNA, 19 nt, Salmonella enterica enterica serovar Typhi Ty2
ucgaugccacagcgcauuc

SEQ ID NO: 3710487 - RNA, 21 nt, Salmonella enterica enterica serovar Typhi Ty2
ucgaugcccguugucacaggc

SEQ ID NO: 3710488 - RNA, 12 nt, Salmonella enterica enterica serovar Typhi Ty2
ucgauuaaacgc

SEQ ID NO: 3710489 - RNA, 21 nt, Salmonella enterica enterica serovar Typhi Ty2
ucgauuuuguuaugcgcauag

SEQ ID NO: 3710490 - RNA, 13 nt, Salmonella enterica enterica serovar Typhi Ty2
ucgauuuuuucga

SEQ ID NO: 3710491 - RNA, 13 nt, Salmonella enterica enterica serovar Typhi Ty2
ucgcaaaauuccg

SEQ ID NO: 3710492 - RNA, 20 nt, Salmonella enterica enterica serovar Typhi Ty2
ucgcaaacccacccgguaau

SEQ ID NO: 3710493 - RNA, 14 nt, Salmonella enterica enterica serovar Typhi Ty2
ucgcaaacgccagc

SEQ ID NO: 3710494 - RNA, 21 nt, Salmonella enterica enterica serovar Typhi Ty2
ucgcaacgccgccgacaugac

SEQ ID NO: 3710495 - RNA, 21 nt, Salmonella enterica enterica serovar Typhi Ty2
ucgcaauauaaauaucauucg

SEQ ID NO: 3710496 - RNA, 20 nt, Salmonella enterica enterica serovar Typhi Ty2
ucgcaauauacugauauugc

SEQ ID NO: 3710497 - RNA, 15 nt, Salmonella enterica enterica serovar Typhi Ty2
ucgcaaucuccgccg

SEQ ID NO: 3710498 - RNA, 23 nt, Salmonella enterica enterica serovar Typhi Ty2
ucgcacaucaugaugaucuucag

SEQ ID NO: 3710499 - RNA, 15 nt, Salmonella enterica enterica serovar Typhi Ty2
ucgcaccaccggacu

SEQ ID NO: 3710500 - RNA, 13 nt, Salmonella enterica enterica serovar Typhi Ty2
ucgcaccauagca

SEQ ID NO: 3710501 - RNA, 15 nt, Salmonella enterica enterica serovar Typhi Ty2
ucgcagacauggcaa

SEQ ID NO: 3710502 - RNA, 24 nt, Salmonella enterica enterica serovar Typhi Ty2
ucgcagcgcuuugccgcugcugcc

SEQ ID NO: 3710503 - RNA, 12 nt, Salmonella enterica enterica serovar Typhi Ty2
ucgcagcggcug

SEQ ID NO: 3710504 - RNA, 21 nt, Salmonella enterica enterica serovar Typhi Ty2
ucgcaguuaugcgcaucaccg

SEQ ID NO: 3710505 - RNA, 13 nt, Salmonella enterica enterica serovar Typhi Ty2
ucgcauagacgcc

SEQ ID NO: 3710506 - RNA, 13 nt, Salmonella enterica enterica serovar Typhi Ty2
ucgcaucagggcg

SEQ ID NO: 3710507 - RNA, 12 nt, Salmonella enterica enterica serovar Typhi Ty2
ucgcauccucgc

SEQ ID NO: 3710508 - RNA, 20 nt, Salmonella enterica enterica serovar Typhi Ty2
ucgcauguugacugcgcucc

SEQ ID NO: 3710509 - RNA, 21 nt, Salmonella enterica enterica serovar Typhi Ty2
ucgcauucauaucgccugcgg

SEQ ID NO: 3710510 - RNA, 23 nt, Salmonella enterica enterica serovar Typhi Ty2
ucgcauucauaucgccugcggca

SEQ ID NO: 3710511 - RNA, 22 nt, Salmonella enterica enterica serovar Typhi Ty2
ucgccaaagcagcggaaaauau

SEQ ID NO: 3710512 - RNA, 18 nt, Salmonella enterica enterica serovar Typhi Ty2
ucgccaaagcagcugcug

SEQ ID NO: 3710513 - RNA, 17 nt, Salmonella enterica enterica serovar Typhi Ty2
ucgccaaagcagugaau

SEQ ID NO: 3710514 - RNA, 21 nt, Salmonella enterica enterica serovar Typhi Ty2
ucgccaaauuuagugcucagc

SEQ ID NO: 3710515 - RNA, 17 nt, Salmonella enterica enterica serovar Typhi Ty2
ucgccaagaucgccaag

SEQ ID NO: 3710516 - RNA, 15 nt, Salmonella enterica enterica serovar Typhi Ty2
ucgccaaugccgcag

SEQ ID NO: 3710517 - RNA, 16 nt, Salmonella enterica enterica serovar Typhi Ty2
ucgccaauuaaauauc

SEQ ID NO: 3710518 - RNA, 16 nt, Salmonella enterica enterica serovar Typhi Ty2
ucgccaccacauucag

SEQ ID NO: 3710519 - RNA, 15 nt, Salmonella enterica enterica serovar Typhi Ty2
ucgccaccaccagcg

SEQ ID NO: 3710520 - RNA, 13 nt, Salmonella enterica enterica serovar Typhi Ty2
ucgccaccaggcu

SEQ ID NO: 3710521 - RNA, 18 nt, Salmonella enterica enterica serovar Typhi Ty2
ucgccaccgcauuuucag

SEQ ID NO: 3710522 - RNA, 21 nt, Salmonella enterica enterica serovar Typhi Ty2
ucgccaccgcauuuucagcuu

SEQ ID NO: 3710523 - RNA, 18 nt, Salmonella enterica enterica serovar Typhi Ty2
ucgccaccgcgcgcuuaa

SEQ ID NO: 3710524 - RNA, 19 nt, Salmonella enterica enterica serovar Typhi Ty2
ucgccaccgcuacaaucca

SEQ ID NO: 3710525 - RNA, 14 nt, Salmonella enterica enterica serovar Typhi Ty2
ucgccagaccgaaa

SEQ ID NO: 3710526 - RNA, 18 nt, Salmonella enterica enterica serovar Typhi Ty2
ucgccagaccgaaaagcc

SEQ ID NO: 3710527 - RNA, 15 nt, Salmonella enterica enterica serovar Typhi Ty2
ucgccagcagcgcga

SEQ ID NO: 3710528 - RNA, 22 nt, Salmonella enterica enterica serovar Typhi Ty2
ucgccagcauacgucugcgcug

SEQ ID NO: 3710529 - RNA, 14 nt, Salmonella enterica enterica serovar Typhi Ty2
ucgccagccccagc

SEQ ID NO: 3710530 - RNA, 16 nt, Salmonella enterica enterica serovar Typhi Ty2
ucgccagccccagccc

SEQ ID NO: 3710531 - RNA, 20 nt, Salmonella enterica enterica serovar Typhi Ty2
ucgccagcggaucgcgucca

SEQ ID NO: 3710532 - RNA, 21 nt, Salmonella enterica enterica serovar Typhi Ty2
ucgccagcgucucagcaggcg

SEQ ID NO: 3710533 - RNA, 10 nt, Salmonella enterica enterica serovar Typhi Ty2
ucgccaggcc

SEQ ID NO: 3710534 - RNA, 21 nt, Salmonella enterica enterica serovar Typhi Ty2
ucgcgacggaccggcagcguc

SEQ ID NO: 3710535 - RNA, 17 nt, Salmonella enterica enterica serovar Typhi Ty2
ucgcgacguccgccaac

SEQ ID NO: 3710536 - RNA, 18 nt, Salmonella enterica enterica serovar Typhi Ty2
ucgcgagcacuuuuuccu

SEQ ID NO: 3710537 - RNA, 22 nt, Salmonella enterica enterica serovar Typhi Ty2
ucgcgagcacuuuuuccuccug

SEQ ID NO: 3710538 - RNA, 20 nt, Salmonella enterica enterica serovar Typhi Ty2
ucgcgauaaucaacucuccu

SEQ ID NO: 3710539 - RNA, 17 nt, Salmonella enterica enterica serovar Typhi Ty2
ucgcgaucacagacaga

SEQ ID NO: 3710540 - RNA, 18 nt, Salmonella enterica enterica serovar Typhi Ty2
ucgcgauccucauacagc

SEQ ID NO: 3710541 - RNA, 12 nt, Salmonella enterica enterica serovar Typhi Ty2
ucgcgaugaugu

SEQ ID NO: 3710542 - RNA, 19 nt, Salmonella enterica enterica serovar Typhi Ty2
ucgcgauuaaucucauccg

SEQ ID NO: 3710543 - RNA, 13 nt, Salmonella enterica enterica serovar Typhi Ty2
ucgcgauuuagcg

SEQ ID NO: 3710544 - RNA, 23 nt, Salmonella enterica enterica serovar Typhi Ty2
ucgcgauuuucaucaagccauug

SEQ ID NO: 3710545 - RNA, 22 nt, Salmonella enterica enterica serovar Typhi Ty2
ucgcgcacgcgccgaaugcguu

SEQ ID NO: 3710546 - RNA, 22 nt, Salmonella enterica enterica serovar Typhi Ty2
ucgcgcagacaguggccaucuu

SEQ ID NO: 3710547 - RNA, 13 nt, Salmonella enterica enterica serovar Typhi Ty2
ucgcgcagccagc

SEQ ID NO: 3710548 - RNA, 14 nt, Salmonella enterica enterica serovar Typhi Ty2
ucgcgcaggcggaa

SEQ ID NO: 3710549 - RNA, 16 nt, Salmonella enterica enterica serovar Typhi Ty2
ucgcgcauccgggccg

SEQ ID NO: 3710550 - RNA, 20 nt, Salmonella enterica enterica serovar Typhi Ty2
ucgcgcauccgggccgcuag

SEQ ID NO: 3710551 - RNA, 17 nt, Salmonella enterica enterica serovar Typhi Ty2
ucgcgcauggcagggcg

SEQ ID NO: 3710552 - RNA, 18 nt, Salmonella enterica enterica serovar Typhi Ty2
ucgcgccaaaagaggcag

SEQ ID NO: 3710553 - RNA, 19 nt, Salmonella enterica enterica serovar Typhi Ty2
ucgcgccaaaagaggcagc

SEQ ID NO: 3710554 - RNA, 20 nt, Salmonella enterica enterica serovar Typhi Ty2
ucgcgccaaaagaggcagca

SEQ ID NO: 3710555 - RNA, 21 nt, Salmonella enterica enterica serovar Typhi Ty2
ucgcgccagcgacaucccaga

SEQ ID NO: 3710556 - RNA, 15 nt, Salmonella enterica enterica serovar Typhi Ty2
ucgcgccauuuagcg

SEQ ID NO: 3710557 - RNA, 24 nt, Salmonella enterica enterica serovar Typhi Ty2
ucgcgcccaaugcuuagucagccu

SEQ ID NO: 3710558 - RNA, 12 nt, Salmonella enterica enterica serovar Typhi Ty2
ucgcgccgccaa

SEQ ID NO: 3710559 - RNA, 21 nt, Salmonella enterica enterica serovar Typhi Ty2
ucgcgccggucgccagcauau

SEQ ID NO: 3710560 - RNA, 19 nt, Salmonella enterica enterica serovar Typhi Ty2
ucgcgccgugcccagcauc

SEQ ID NO: 3710561 - RNA, 20 nt, Salmonella enterica enterica serovar Typhi Ty2
ucgcgcgcaaaugcaauuca

SEQ ID NO: 3710562 - RNA, 22 nt, Salmonella enterica enterica serovar Typhi Ty2
ucgcgcggcgguucauccugcg

SEQ ID NO: 3710563 - RNA, 17 nt, Salmonella enterica enterica serovar Typhi Ty2
ucgcgcucaagcgaaaa

SEQ ID NO: 3710564 - RNA, 17 nt, Salmonella enterica enterica serovar Typhi Ty2
ucgcgcucuuccgccag

SEQ ID NO: 3710565 - RNA, 13 nt, Salmonella enterica enterica serovar Typhi Ty2
ucgcgcuggcagu

SEQ ID NO: 3710566 - RNA, 19 nt, Salmonella enterica enterica serovar Typhi Ty2
ucgcgcuguauaaucccgc

SEQ ID NO: 3710567 - RNA, 13 nt, Salmonella enterica enterica serovar Typhi Ty2
ucgcgcuuauccg

SEQ ID NO: 3710568 - RNA, 21 nt, Salmonella enterica enterica serovar Typhi Ty2
ucgcgcuuucaaucgucagac

SEQ ID NO: 3710569 - RNA, 20 nt, Salmonella enterica enterica serovar Typhi Ty2
ucgcggaagcgaccggcguc

SEQ ID NO: 3710570 - RNA, 19 nt, Salmonella enterica enterica serovar Typhi Ty2
ucgcggauaugcagcagcc

SEQ ID NO: 3710571 - RNA, 19 nt, Salmonella enterica enterica serovar Typhi Ty2
ucgcggcauuaaaugcgcc

SEQ ID NO: 3710572 - RNA, 15 nt, Salmonella enterica enterica serovar Typhi Ty2
ucgcgguaaaaagcu

SEQ ID NO: 3710573 - RNA, 18 nt, Salmonella enterica enterica serovar Typhi Ty2
ucgcgguaacggccuggc

SEQ ID NO: 3710574 - RNA, 16 nt, Salmonella enterica enterica serovar Typhi Ty2
ucgcgguacuucugac

SEQ ID NO: 3710575 - RNA, 16 nt, Salmonella enterica enterica serovar Typhi Ty2
ucgcggugaucccagg

SEQ ID NO: 3710576 - RNA, 13 nt, Salmonella enterica enterica serovar Typhi Ty2
ucgcgguuagaaa

SEQ ID NO: 3710577 - RNA, 18 nt, Salmonella enterica enterica serovar Typhi Ty2
ucgcgguugccgucaaac

SEQ ID NO: 3710578 - RNA, 19 nt, Salmonella enterica enterica serovar Typhi Ty2
ucgcgguuuacuucuucag

SEQ ID NO: 3710579 - RNA, 24 nt, Salmonella enterica enterica serovar Typhi Ty2
ucgcguacaggauguccaggcgac

SEQ ID NO: 3710580 - RNA, 20 nt, Salmonella enterica enterica serovar Typhi Ty2
ucgcgucaauauuaaugcug

SEQ ID NO: 3710581 - RNA, 16 nt, Salmonella enterica enterica serovar Typhi Ty2
ucgcgucgccaucagg

SEQ ID NO: 3710582 - RNA, 17 nt, Salmonella enterica enterica serovar Typhi Ty2
ucgcgucuacgucagga

SEQ ID NO: 3710583 - RNA, 18 nt, Salmonella enterica enterica serovar Typhi Ty2
ucgcguuauagccgccaa

SEQ ID NO: 3710584 - RNA, 15 nt, Salmonella enterica enterica serovar Typhi Ty2
ucgcguuguaaucgc

SEQ ID NO: 3710585 - RNA, 18 nt, Salmonella enterica enterica serovar Typhi Ty2
ucgcguuuuucgaaaauu

SEQ ID NO: 3710586 - RNA, 23 nt, Salmonella enterica enterica serovar Typhi Ty2
ucgcuaagagugacgguuuucac

SEQ ID NO: 3710587 - RNA, 22 nt, Salmonella enterica enterica serovar Typhi Ty2
ucgcuaagcgucagacacaaua

SEQ ID NO: 3710588 - RNA, 14 nt, Salmonella enterica enterica serovar Typhi Ty2
ucgcuaauuuuuaa

SEQ ID NO: 3710589 - RNA, 21 nt, Salmonella enterica enterica serovar Typhi Ty2
ucgcuacacgcguaaacuucc

SEQ ID NO: 3710590 - RNA, 12 nt, Salmonella enterica enterica serovar Typhi Ty2
ucgcuaccuucu

SEQ ID NO: 3710591 - RNA, 20 nt, Salmonella enterica enterica serovar Typhi Ty2
ucgcuaccuucuucccauau

SEQ ID NO: 3710592 - RNA, 16 nt, Salmonella enterica enterica serovar Typhi Ty2
ucgcuaccuuuuuuca

SEQ ID NO: 3710593 - RNA, 17 nt, Salmonella enterica enterica serovar Typhi Ty2
ucgcuaccuuuuuucag

SEQ ID NO: 3710594 - RNA, 14 nt, Salmonella enterica enterica serovar Typhi Ty2
ucgcuauccagcag

SEQ ID NO: 3710595 - RNA, 15 nt, Salmonella enterica enterica serovar Typhi Ty2
ucgcuauccaucgcc

SEQ ID NO: 3710596 - RNA, 23 nt, Salmonella enterica enterica serovar Typhi Ty2
ucgcuaucugacagccaaacugc

SEQ ID NO: 3710597 - RNA, 16 nt, Salmonella enterica enterica serovar Typhi Ty2
ucgcucaacuccugca

SEQ ID NO: 3710598 - RNA, 18 nt, Salmonella enterica enterica serovar Typhi Ty2
ucgcucaggacagguucc

SEQ ID NO: 3710599 - RNA, 18 nt, Salmonella enterica enterica serovar Typhi Ty2
ucgcucaggagcgccuga

SEQ ID NO: 3710600 - RNA, 21 nt, Salmonella enterica enterica serovar Typhi Ty2
ucgcucgacauagguucugcg

SEQ ID NO: 3710601 - RNA, 16 nt, Salmonella enterica enterica serovar Typhi Ty2
ucgcucgcgccacgca

SEQ ID NO: 3710602 - RNA, 14 nt, Salmonella enterica enterica serovar Typhi Ty2
ucgcucgcggcaga

SEQ ID NO: 3710603 - RNA, 22 nt, Salmonella enterica enterica serovar Typhi Ty2
ucgcucuaucgccuggagcuga

SEQ ID NO: 3710604 - RNA, 15 nt, Salmonella enterica enterica serovar Typhi Ty2
ucgcucuuccaguug

SEQ ID NO: 3710605 - RNA, 19 nt, Salmonella enterica enterica serovar Typhi Ty2
ucgcucuuuuuuuugcuua

SEQ ID NO: 3710606 - RNA, 22 nt, Salmonella enterica enterica serovar Typhi Ty2
ucgcugacgccgaccaccgccc

SEQ ID NO: 3710607 - RNA, 20 nt, Salmonella enterica enterica serovar Typhi Ty2
ucgcugcugaugauaugggu

SEQ ID NO: 3710608 - RNA, 15 nt, Salmonella enterica enterica serovar Typhi Ty2
ucgcuggacauuaag

SEQ ID NO: 3710609 - RNA, 23 nt, Salmonella enterica enterica serovar Typhi Ty2
ucgcuggccauauuuuuucagga

SEQ ID NO: 3710610 - RNA, 17 nt, Salmonella enterica enterica serovar Typhi Ty2
ucgcuggccguuaugca

SEQ ID NO: 3710611 - RNA, 18 nt, Salmonella enterica enterica serovar Typhi Ty2
ucgcuggcguagauauuc

SEQ ID NO: 3710612 - RNA, 15 nt, Salmonella enterica enterica serovar Typhi Ty2
ucgcuguagcgccaa

SEQ ID NO: 3710613 - RNA, 12 nt, Salmonella enterica enterica serovar Typhi Ty2
ucgcuguuaacc

SEQ ID NO: 3710614 - RNA, 19 nt, Salmonella enterica enterica serovar Typhi Ty2
ucgcuuaucuggccuacgg

SEQ ID NO: 3710615 - RNA, 18 nt, Salmonella enterica enterica serovar Typhi Ty2
ucgcuuauuccuccgccg

SEQ ID NO: 3710616 - RNA, 18 nt, Salmonella enterica enterica serovar Typhi Ty2
ucgcuuccuuuauugguu

SEQ ID NO: 3710617 - RNA, 23 nt, Salmonella enterica enterica serovar Typhi Ty2
ucgcuucugccgccaguugcuca

SEQ ID NO: 3710618 - RNA, 12 nt, Salmonella enterica enterica serovar Typhi Ty2
ucgcuuguuuca

SEQ ID NO: 3710619 - RNA, 15 nt, Salmonella enterica enterica serovar Typhi Ty2
ucgcuuuuacucuuc

SEQ ID NO: 3710620 - RNA, 19 nt, Salmonella enterica enterica serovar Typhi Ty2
ucgcuuuuauguuacccag

SEQ ID NO: 3710621 - RNA, 13 nt, Salmonella enterica enterica serovar Typhi Ty2
ucggaaccggcaa

SEQ ID NO: 3710622 - RNA, 18 nt, Salmonella enterica enterica serovar Typhi Ty2
ucggaacgcgacucccag

SEQ ID NO: 3710623 - RNA, 21 nt, Salmonella enterica enterica serovar Typhi Ty2
ucggaauauugguaccgagga

SEQ ID NO: 3710624 - RNA, 13 nt, Salmonella enterica enterica serovar Typhi Ty2
ucggacucaucgg

SEQ ID NO: 3710625 - RNA, 15 nt, Salmonella enterica enterica serovar Typhi Ty2
ucggagaaauagacg

SEQ ID NO: 3710626 - RNA, 20 nt, Salmonella enterica enterica serovar Typhi Ty2
ucggagauuucauccucuug

SEQ ID NO: 3710627 - RNA, 20 nt, Salmonella enterica enterica serovar Typhi Ty2
ucggagguuuucucauccag

SEQ ID NO: 3710628 - RNA, 15 nt, Salmonella enterica enterica serovar Typhi Ty2
ucggaucaaacgugc

SEQ ID NO: 3710629 - RNA, 21 nt, Salmonella enterica enterica serovar Typhi Ty2
ucggauggcgacguaacuguc

SEQ ID NO: 3710630 - RNA, 18 nt, Salmonella enterica enterica serovar Typhi Ty2
ucggcaaaccaugaucgu

SEQ ID NO: 3710631 - RNA, 16 nt, Salmonella enterica enterica serovar Typhi Ty2
ucggcaaauucuuuuc

SEQ ID NO: 3710632 - RNA, 19 nt, Salmonella enterica enterica serovar Typhi Ty2
ucggcaauaaacucccgca

SEQ ID NO: 3710633 - RNA, 17 nt, Salmonella enterica enterica serovar Typhi Ty2
ucggcaauaugcuguuu

SEQ ID NO: 3710634 - RNA, 17 nt, Salmonella enterica enterica serovar Typhi Ty2
ucggcaauauugccgca

SEQ ID NO: 3710635 - RNA, 18 nt, Salmonella enterica enterica serovar Typhi Ty2
ucggcaauuuccggcgac

SEQ ID NO: 3710636 - RNA, 19 nt, Salmonella enterica enterica serovar Typhi Ty2
ucggcacagccaguaagaa

SEQ ID NO: 3710637 - RNA, 15 nt, Salmonella enterica enterica serovar Typhi Ty2
ucggcaccauuccca

SEQ ID NO: 3710638 - RNA, 19 nt, Salmonella enterica enterica serovar Typhi Ty2
ucggcaccauucccacgca

SEQ ID NO: 3710639 - RNA, 21 nt, Salmonella enterica enterica serovar Typhi Ty2
ucggcacugacucuuccgggc

SEQ ID NO: 3710640 - RNA, 17 nt, Salmonella enterica enterica serovar Typhi Ty2
ucggcagcuuccagcaa

SEQ ID NO: 3710641 - RNA, 11 nt, Salmonella enterica enterica serovar Typhi Ty2
ucggcaggccg

SEQ ID NO: 3710642 - RNA, 20 nt, Salmonella enterica enterica serovar Typhi Ty2
ucggcaggcggucaucgccc

SEQ ID NO: 3710643 - RNA, 16 nt, Salmonella enterica enterica serovar Typhi Ty2
ucggcagucacuuuca

SEQ ID NO: 3710644 - RNA, 23 nt, Salmonella enterica enterica serovar Typhi Ty2
ucggcauacaccgccagcgucug

SEQ ID NO: 3710645 - RNA, 18 nt, Salmonella enterica enterica serovar Typhi Ty2
ucggcaucuguagcggcg

SEQ ID NO: 3710646 - RNA, 22 nt, Salmonella enterica enterica serovar Typhi Ty2
ucggcaugauggcgaacagccc

SEQ ID NO: 3710647 - RNA, 15 nt, Salmonella enterica enterica serovar Typhi Ty2
ucggccaaccgccac

SEQ ID NO: 3710648 - RNA, 12 nt, Salmonella enterica enterica serovar Typhi Ty2
ucggccaccauu

SEQ ID NO: 3710649 - RNA, 20 nt, Salmonella enterica enterica serovar Typhi Ty2
ucggccacguccguuacccc

SEQ ID NO: 3710650 - RNA, 17 nt, Salmonella enterica enterica serovar Typhi Ty2
ucggccagcaagcggcg

SEQ ID NO: 3710651 - RNA, 14 nt, Salmonella enterica enterica serovar Typhi Ty2
ucggccauuuuuuu

SEQ ID NO: 3710652 - RNA, 18 nt, Salmonella enterica enterica serovar Typhi Ty2
ucggccggauagggcgua

SEQ ID NO: 3710653 - RNA, 17 nt, Salmonella enterica enterica serovar Typhi Ty2
ucggcgacgucccggca

SEQ ID NO: 3710654 - RNA, 17 nt, Salmonella enterica enterica serovar Typhi Ty2
ucggcgaggggcaggcg

SEQ ID NO: 3710655 - RNA, 17 nt, Salmonella enterica enterica serovar Typhi Ty2
ucggcgccagccacaag

SEQ ID NO: 3710656 - RNA, 15 nt, Salmonella enterica enterica serovar Typhi Ty2
ucggcgccaucaugc

SEQ ID NO: 3710657 - RNA, 23 nt, Salmonella enterica enterica serovar Typhi Ty2
ucggcgcccggacgaaccuggcg

SEQ ID NO: 3710658 - RNA, 14 nt, Salmonella enterica enterica serovar Typhi Ty2
ucggcgccggcguc

SEQ ID NO: 3710659 - RNA, 12 nt, Salmonella enterica enterica serovar Typhi Ty2
ucggcgcgcugg

SEQ ID NO: 3710660 - RNA, 13 nt, Salmonella enterica enterica serovar Typhi Ty2
ucggcgcgcuggc

SEQ ID NO: 3710661 - RNA, 22 nt, Salmonella enterica enterica serovar Typhi Ty2
ucggcggcccacucauccagca

SEQ ID NO: 3710662 - RNA, 20 nt, Salmonella enterica enterica serovar Typhi Ty2
ucggcgggcaggucgucuuc

SEQ ID NO: 3710663 - RNA, 16 nt, Salmonella enterica enterica serovar Typhi Ty2
ucggcgggcaucauau

SEQ ID NO: 3710664 - RNA, 23 nt, Salmonella enterica enterica serovar Typhi Ty2
ucggcgggcguaucucauugaug

SEQ ID NO: 3710665 - RNA, 18 nt, Salmonella enterica enterica serovar Typhi Ty2
ucggcguaacccagugca

SEQ ID NO: 3710666 - RNA, 19 nt, Salmonella enterica enterica serovar Typhi Ty2
ucggcguaacccagugcaa

SEQ ID NO: 3710667 - RNA, 16 nt, Salmonella enterica enterica serovar Typhi Ty2
ucggcgucgcggcaau

SEQ ID NO: 3710668 - RNA, 17 nt, Salmonella enterica enterica serovar Typhi Ty2
ucggcgugaauaaaaua

SEQ ID NO: 3710669 - RNA, 17 nt, Salmonella enterica enterica serovar Typhi Ty2
ucggcuaguaauaccag

SEQ ID NO: 3710670 - RNA, 14 nt, Salmonella enterica enterica serovar Typhi Ty2
ucggcuccugguga

SEQ ID NO: 3710671 - RNA, 13 nt, Salmonella enterica enterica serovar Typhi Ty2
ucggcuuacccaa

SEQ ID NO: 3710672 - RNA, 16 nt, Salmonella enterica enterica serovar Typhi Ty2
ucggcuucucccaaca

SEQ ID NO: 3710673 - RNA, 20 nt, Salmonella enterica enterica serovar Typhi Ty2
ucggcuugcuucaucugguu

SEQ ID NO: 3710674 - RNA, 14 nt, Salmonella enterica enterica serovar Typhi Ty2
ucggcuuuaucgcc

SEQ ID NO: 3710675 - RNA, 14 nt, Salmonella enterica enterica serovar Typhi Ty2
ucggcuuucaccuu

SEQ ID NO: 3710676 - RNA, 23 nt, Salmonella enterica enterica serovar Typhi Ty2
ucggcuuuguaucagcauuuaca

SEQ ID NO: 3710677 - RNA, 18 nt, Salmonella enterica enterica serovar Typhi Ty2
ucggcuuuuguucccgca

SEQ ID NO: 3710678 - RNA, 21 nt, Salmonella enterica enterica serovar Typhi Ty2
ucggcuuuuuuuuaugccucu

SEQ ID NO: 3710679 - RNA, 23 nt, Salmonella enterica enterica serovar Typhi Ty2
ucggcuuuuuuuuaugccucuua

SEQ ID NO: 3710680 - RNA, 14 nt, Salmonella enterica enterica serovar Typhi Ty2
ucgggaacgcuguc

SEQ ID NO: 3710681 - RNA, 21 nt, Salmonella enterica enterica serovar Typhi Ty2
ucgggaaucaucgaggccacc

SEQ ID NO: 3710682 - RNA, 21 nt, Salmonella enterica enterica serovar Typhi Ty2
ucgggacaaucaccaucccau

SEQ ID NO: 3710683 - RNA, 18 nt, Salmonella enterica enterica serovar Typhi Ty2
ucgggauauaugcaaaac

SEQ ID NO: 3710684 - RNA, 17 nt, Salmonella enterica enterica serovar Typhi Ty2
ucgggaucaauuuugcu

SEQ ID NO: 3710685 - RNA, 20 nt, Salmonella enterica enterica serovar Typhi Ty2
ucgggaugcauaaaaaaacg

SEQ ID NO: 3710686 - RNA, 20 nt, Salmonella enterica enterica serovar Typhi Ty2
ucgggaugguuaaauucaua

SEQ ID NO: 3710687 - RNA, 20 nt, Salmonella enterica enterica serovar Typhi Ty2
ucgggauguggugcggcuua

SEQ ID NO: 3710688 - RNA, 18 nt, Salmonella enterica enterica serovar Typhi Ty2
ucgggcaaaaugcgucgg

SEQ ID NO: 3710689 - RNA, 20 nt, Salmonella enterica enterica serovar Typhi Ty2
ucgggcaacugauaugacgu

SEQ ID NO: 3710690 - RNA, 15 nt, Salmonella enterica enterica serovar Typhi Ty2
ucgggcagaaagugg

SEQ ID NO: 3710691 - RNA, 21 nt, Salmonella enterica enterica serovar Typhi Ty2
ucgggcagcgcuucucuuucc

SEQ ID NO: 3710692 - RNA, 19 nt, Salmonella enterica enterica serovar Typhi Ty2
ucgggcaggcuuccacgca

SEQ ID NO: 3710693 - RNA, 23 nt, Salmonella enterica enterica serovar Typhi Ty2
ucgggcaggcuuccacgcacgcc

SEQ ID NO: 3710694 - RNA, 13 nt, Salmonella enterica enterica serovar Typhi Ty2
ucgggccaaucgg

SEQ ID NO: 3710695 - RNA, 18 nt, Salmonella enterica enterica serovar Typhi Ty2
ucggggauucgccagcgu

SEQ ID NO: 3710696 - RNA, 17 nt, Salmonella enterica enterica serovar Typhi Ty2
ucggguaaagguuugcu

SEQ ID NO: 3710697 - RNA, 22 nt, Salmonella enterica enterica serovar Typhi Ty2
ucggguaaggcguagccgccac

SEQ ID NO: 3710698 - RNA, 19 nt, Salmonella enterica enterica serovar Typhi Ty2
ucguguuauuuucaaaaac

SEQ ID NO: 3710699 - RNA, 23 nt, Salmonella enterica enterica serovar Typhi Ty2
ucguuaaaaucggggucuuccag

SEQ ID NO: 3710700 - RNA, 16 nt, Salmonella enterica enterica serovar Typhi Ty2
ucguuaaccagcggcg

SEQ ID NO: 3710701 - RNA, 14 nt, Salmonella enterica enterica serovar Typhi Ty2
ucguuacccgugcg

SEQ ID NO: 3710702 - RNA, 16 nt, Salmonella enterica enterica serovar Typhi Ty2
ucguuacccuccugca

SEQ ID NO: 3710703 - RNA, 21 nt, Salmonella enterica enterica serovar Typhi Ty2
ucguuaccggugauauugccg

SEQ ID NO: 3710704 - RNA, 16 nt, Salmonella enterica enterica serovar Typhi Ty2
ucguuagcaaauugcu

SEQ ID NO: 3710705 - RNA, 11 nt, Salmonella enterica enterica serovar Typhi Ty2
ucguuaucauu

SEQ ID NO: 3710706 - RNA, 20 nt, Salmonella enterica enterica serovar Typhi Ty2
ucguuauuuccgagaucgcc

SEQ ID NO: 3710707 - RNA, 14 nt, Salmonella enterica enterica serovar Typhi Ty2
ucguucacgccaaa

SEQ ID NO: 3710708 - RNA, 16 nt, Salmonella enterica enterica serovar Typhi Ty2
ucguucauugcuuucu

SEQ ID NO: 3710709 - RNA, 15 nt, Salmonella enterica enterica serovar Typhi Ty2
ucguucccgccugcu

SEQ ID NO: 3710710 - RNA, 16 nt, Salmonella enterica enterica serovar Typhi Ty2
ucguucccgccugcug

SEQ ID NO: 3710711 - RNA, 17 nt, Salmonella enterica enterica serovar Typhi Ty2
ucguucccguuuauguu

SEQ ID NO: 3710712 - RNA, 17 nt, Salmonella enterica enterica serovar Typhi Ty2
ucguuccgguucuuccc

SEQ ID NO: 3710713 - RNA, 14 nt, Salmonella enterica enterica serovar Typhi Ty2
ucguucgcccuuca

SEQ ID NO: 3710714 - RNA, 19 nt, Salmonella enterica enterica serovar Typhi Ty2
ucguucggucaggauacua

SEQ ID NO: 3710715 - RNA, 17 nt, Salmonella enterica enterica serovar Typhi Ty2
ucguucugcgucgcgca

SEQ ID NO: 3710716 - RNA, 17 nt, Salmonella enterica enterica serovar Typhi Ty2
ucguugacuucaaucac

SEQ ID NO: 3710717 - RNA, 17 nt, Salmonella enterica enterica serovar Typhi Ty2
ucguugauaucgcugug

SEQ ID NO: 3710718 - RNA, 14 nt, Salmonella enterica enterica serovar Typhi Ty2
ucguugccagcggc

SEQ ID NO: 3710719 - RNA, 21 nt, Salmonella enterica enterica serovar Typhi Ty2
ucguuggcgccaaaaccgcuc

SEQ ID NO: 3710720 - RNA, 20 nt, Salmonella enterica enterica serovar Typhi Ty2
ucguuuaaguaagguaaagc

SEQ ID NO: 3710721 - RNA, 18 nt, Salmonella enterica enterica serovar Typhi Ty2
ucguuucccucauauuug

SEQ ID NO: 3710722 - RNA, 13 nt, Salmonella enterica enterica serovar Typhi Ty2
ucguuuuccgcaa

SEQ ID NO: 3710723 - RNA, 23 nt, Salmonella enterica enterica serovar Typhi Ty2
ucuaaaaaggaaagggacgauga

SEQ ID NO: 3710724 - RNA, 23 nt, Salmonella enterica enterica serovar Typhi Ty2
ucuaaaauuauuuuuacuuaaaa

SEQ ID NO: 3710725 - RNA, 17 nt, Salmonella enterica enterica serovar Typhi Ty2
ucuaaaucauaccagcg

SEQ ID NO: 3710726 - RNA, 20 nt, Salmonella enterica enterica serovar Typhi Ty2
ucuaaaugggcaggagauga

SEQ ID NO: 3710727 - RNA, 15 nt, Salmonella enterica enterica serovar Typhi Ty2
ucuaacauaaugaau

SEQ ID NO: 3710728 - RNA, 23 nt, Salmonella enterica enterica serovar Typhi Ty2
ucuaacgcaacggaaggaaauaa

SEQ ID NO: 3710729 - RNA, 15 nt, Salmonella enterica enterica serovar Typhi Ty2
ucuaaucgggagcag

SEQ ID NO: 3710730 - RNA, 23 nt, Salmonella enterica enterica serovar Typhi Ty2
ucuaauucccaguaaccuauuuu

SEQ ID NO: 3710731 - RNA, 21 nt, Salmonella enterica enterica serovar Typhi Ty2
ucuacauuuucguaaaauaua

SEQ ID NO: 3710732 - RNA, 19 nt, Salmonella enterica enterica serovar Typhi Ty2
ucuaccauugauaccaaua

SEQ ID NO: 3710733 - RNA, 19 nt, Salmonella enterica enterica serovar Typhi Ty2
ucuaccgcuucgcgcgcca

SEQ ID NO: 3710734 - RNA, 22 nt, Salmonella enterica enterica serovar Typhi Ty2
ucuaccguaggccggauaagcg

SEQ ID NO: 3710735 - RNA, 18 nt, Salmonella enterica enterica serovar Typhi Ty2
ucuaccuggaaccaggcg

SEQ ID NO: 3710736 - RNA, 19 nt, Salmonella enterica enterica serovar Typhi Ty2
ucuacgcugccauccucau

SEQ ID NO: 3710737 - RNA, 14 nt, Salmonella enterica enterica serovar Typhi Ty2
ucuacggaucccuu

SEQ ID NO: 3710738 - RNA, 14 nt, Salmonella enterica enterica serovar Typhi Ty2
ucuacgguaucugc

SEQ ID NO: 3710739 - RNA, 16 nt, Salmonella enterica enterica serovar Typhi Ty2
ucuacuaacuggcaau

SEQ ID NO: 3710740 - RNA, 22 nt, Salmonella enterica enterica serovar Typhi Ty2
ucuacuaacuggcaaucaugcg

SEQ ID NO: 3710741 - RNA, 14 nt, Salmonella enterica enterica serovar Typhi Ty2
ucuacuacaacugu

SEQ ID NO: 3710742 - RNA, 14 nt, Salmonella enterica enterica serovar Typhi Ty2
ucuacuuuccugaa

SEQ ID NO: 3710743 - RNA, 15 nt, Salmonella enterica enterica serovar Typhi Ty2
ucuacuuuccugaag

SEQ ID NO: 3710744 - RNA, 22 nt, Salmonella enterica enterica serovar Typhi Ty2
ucuacuuuucggguguccacuc

SEQ ID NO: 3710745 - RNA, 19 nt, Salmonella enterica enterica serovar Typhi Ty2
ucuagaugaugauuuauga

SEQ ID NO: 3710746 - RNA, 18 nt, Salmonella enterica enterica serovar Typhi Ty2
ucuaggcgcugcuggcag

SEQ ID NO: 3710747 - RNA, 13 nt, Salmonella enterica enterica serovar Typhi Ty2
ucuagucgccggu

SEQ ID NO: 3710748 - RNA, 15 nt, Salmonella enterica enterica serovar Typhi Ty2
ucuauacggcgcgca

SEQ ID NO: 3710749 - RNA, 14 nt, Salmonella enterica enterica serovar Typhi Ty2
ucuauagauuucgc

SEQ ID NO: 3710750 - RNA, 13 nt, Salmonella enterica enterica serovar Typhi Ty2
ucuauauauucuu

SEQ ID NO: 3710751 - RNA, 13 nt, Salmonella enterica enterica serovar Typhi Ty2
ucuauauccugcc

SEQ ID NO: 3710752 - RNA, 13 nt, Salmonella enterica enterica serovar Typhi Ty2
ucuaucaccgccu

SEQ ID NO: 3710753 - RNA, 14 nt, Salmonella enterica enterica serovar Typhi Ty2
ucuaucaccgccuc

SEQ ID NO: 3710754 - RNA, 19 nt, Salmonella enterica enterica serovar Typhi Ty2
ucuaucagguaucccgcca

SEQ ID NO: 3710755 - RNA, 16 nt, Salmonella enterica enterica serovar Typhi Ty2
ucuaucgccuggagcu

SEQ ID NO: 3710756 - RNA, 15 nt, Salmonella enterica enterica serovar Typhi Ty2
ucuaucgcuccuccc

SEQ ID NO: 3710757 - RNA, 18 nt, Salmonella enterica enterica serovar Typhi Ty2
ucuauucguucucugaau

SEQ ID NO: 3710758 - RNA, 16 nt, Salmonella enterica enterica serovar Typhi Ty2
ucuauugccuaaauaa

SEQ ID NO: 3710759 - RNA, 18 nt, Salmonella enterica enterica serovar Typhi Ty2
ucuauugccuaaauaacu

SEQ ID NO: 3710760 - RNA, 15 nt, Salmonella enterica enterica serovar Typhi Ty2
ucuauuucauaauaa

SEQ ID NO: 3710761 - RNA, 24 nt, Salmonella enterica enterica serovar Typhi Ty2
ucuauuuuucccggaucgcuaauu

SEQ ID NO: 3710762 - RNA, 15 nt, Salmonella enterica enterica serovar Typhi Ty2
ucucaaacacuucua

SEQ ID NO: 3710763 - RNA, 17 nt, Salmonella enterica enterica serovar Typhi Ty2
ucucaaacacuucuaaa

SEQ ID NO: 3710764 - RNA, 19 nt, Salmonella enterica enterica serovar Typhi Ty2
ucucaaggucugucaggac

SEQ ID NO: 3710765 - RNA, 17 nt, Salmonella enterica enterica serovar Typhi Ty2
ucucacagaaucaucag

SEQ ID NO: 3710766 - RNA, 18 nt, Salmonella enterica enterica serovar Typhi Ty2
ucucacccguuuucuccu

SEQ ID NO: 3710767 - RNA, 16 nt, Salmonella enterica enterica serovar Typhi Ty2
ucucaccgaccugccu

SEQ ID NO: 3710768 - RNA, 13 nt, Salmonella enterica enterica serovar Typhi Ty2
ucucaccguggca

SEQ ID NO: 3710769 - RNA, 18 nt, Salmonella enterica enterica serovar Typhi Ty2
ucucagauggaaaaaaag

SEQ ID NO: 3710770 - RNA, 20 nt, Salmonella enterica enterica serovar Typhi Ty2
ucucagauggaaaaaaagaa

SEQ ID NO: 3710771 - RNA, 21 nt, Salmonella enterica enterica serovar Typhi Ty2
ucucagauggaaaaaaagaau

SEQ ID NO: 3710772 - RNA, 16 nt, Salmonella enterica enterica serovar Typhi Ty2
ucucagcgucggugaa

SEQ ID NO: 3710773 - RNA, 14 nt, Salmonella enterica enterica serovar Typhi Ty2
ucucaggagugaac

SEQ ID NO: 3710774 - RNA, 16 nt, Salmonella enterica enterica serovar Typhi Ty2
ucucagguucgaaucc

SEQ ID NO: 3710775 - RNA, 22 nt, Salmonella enterica enterica serovar Typhi Ty2
ucucauaaaacauuccugacau

SEQ ID NO: 3710776 - RNA, 22 nt, Salmonella enterica enterica serovar Typhi Ty2
ucucauaaaccgccgcuuugau

SEQ ID NO: 3710777 - RNA, 20 nt, Salmonella enterica enterica serovar Typhi Ty2
ucucauaccaggugccgagg

SEQ ID NO: 3710778 - RNA, 12 nt, Salmonella enterica enterica serovar Typhi Ty2
ucucaucaaaaa

SEQ ID NO: 3710779 - RNA, 17 nt, Salmonella enterica enterica serovar Typhi Ty2
ucucaucagaccgugaa

SEQ ID NO: 3710780 - RNA, 24 nt, Salmonella enterica enterica serovar Typhi Ty2
ucugauaacgcaggcgauagcccc

SEQ ID NO: 3710781 - RNA, 19 nt, Salmonella enterica enterica serovar Typhi Ty2
ucugauacugcuccggcgc

SEQ ID NO: 3710782 - RNA, 12 nt, Salmonella enterica enterica serovar Typhi Ty2
ucugauccagcg

SEQ ID NO: 3710783 - RNA, 19 nt, Salmonella enterica enterica serovar Typhi Ty2
ucugaugccugaaggcgcu

SEQ ID NO: 3710784 - RNA, 15 nt, Salmonella enterica enterica serovar Typhi Ty2
ucugauggcgcugcg

SEQ ID NO: 3710785 - RNA, 16 nt, Salmonella enterica enterica serovar Typhi Ty2
ucugauggcuuugcug

SEQ ID NO: 3710786 - RNA, 16 nt, Salmonella enterica enterica serovar Typhi Ty2
ucugauucaauagugc

SEQ ID NO: 3710787 - RNA, 15 nt, Salmonella enterica enterica serovar Typhi Ty2
ucugauucaguaaga

SEQ ID NO: 3710788 - RNA, 20 nt, Salmonella enterica enterica serovar Typhi Ty2
ucugauuucgacgauaaaaa

SEQ ID NO: 3710789 - RNA, 16 nt, Salmonella enterica enterica serovar Typhi Ty2
ucugcaagagaaauaa

SEQ ID NO: 3710790 - RNA, 22 nt, Salmonella enterica enterica serovar Typhi Ty2
ucugcaaugguaaaacgcuggc

SEQ ID NO: 3710791 - RNA, 20 nt, Salmonella enterica enterica serovar Typhi Ty2
ucugcacaacauuccgcuuc

SEQ ID NO: 3710792 - RNA, 16 nt, Salmonella enterica enterica serovar Typhi Ty2
ucugcaccagaacucc

SEQ ID NO: 3710793 - RNA, 14 nt, Salmonella enterica enterica serovar Typhi Ty2
ucugcaggucacga

SEQ ID NO: 3710794 - RNA, 17 nt, Salmonella enterica enterica serovar Typhi Ty2
ucugcaguauuaccgaa

SEQ ID NO: 3710795 - RNA, 17 nt, Salmonella enterica enterica serovar Typhi Ty2
ucugcauguaguaagcc

SEQ ID NO: 3710796 - RNA, 22 nt, Salmonella enterica enterica serovar Typhi Ty2
ucugccagcgcccuauccagcg

SEQ ID NO: 3710797 - RNA, 12 nt, Salmonella enterica enterica serovar Typhi Ty2
ucugccagguuc

SEQ ID NO: 3710798 - RNA, 17 nt, Salmonella enterica enterica serovar Typhi Ty2
ucugccaguagcugcuc

SEQ ID NO: 3710799 - RNA, 19 nt, Salmonella enterica enterica serovar Typhi Ty2
ucugccaguuaucgguaau

SEQ ID NO: 3710800 - RNA, 22 nt, Salmonella enterica enterica serovar Typhi Ty2
ucugccgcgcccgccaucgccc

SEQ ID NO: 3710801 - RNA, 14 nt, Salmonella enterica enterica serovar Typhi Ty2
ucugccucaacaag

SEQ ID NO: 3710802 - RNA, 22 nt, Salmonella enterica enterica serovar Typhi Ty2
ucugccucagcaagaaguuccg

SEQ ID NO: 3710803 - RNA, 14 nt, Salmonella enterica enterica serovar Typhi Ty2
ucugccugcagacc

SEQ ID NO: 3710804 - RNA, 15 nt, Salmonella enterica enterica serovar Typhi Ty2
ucugccugcagaccc

SEQ ID NO: 3710805 - RNA, 22 nt, Salmonella enterica enterica serovar Typhi Ty2
ucugccuuuacugaaucucaga

SEQ ID NO: 3710806 - RNA, 20 nt, Salmonella enterica enterica serovar Typhi Ty2
ucugccuuuuuuaauccagg

SEQ ID NO: 3710807 - RNA, 13 nt, Salmonella enterica enterica serovar Typhi Ty2
ucugcgacgccag

SEQ ID NO: 3710808 - RNA, 19 nt, Salmonella enterica enterica serovar Typhi Ty2
ucugcgcaacgcuuccacc

SEQ ID NO: 3710809 - RNA, 21 nt, Salmonella enterica enterica serovar Typhi Ty2
ucugcgcaggaggcuuccgcg

SEQ ID NO: 3710810 - RNA, 13 nt, Salmonella enterica enterica serovar Typhi Ty2
ucugcgccaccag

SEQ ID NO: 3710811 - RNA, 14 nt, Salmonella enterica enterica serovar Typhi Ty2
ucugcgccaccagc

SEQ ID NO: 3710812 - RNA, 14 nt, Salmonella enterica enterica serovar Typhi Ty2
ucugcgcuaagcgu

SEQ ID NO: 3710813 - RNA, 23 nt, Salmonella enterica enterica serovar Typhi Ty2
ucugcgcuaagcguuacggaaaa

SEQ ID NO: 3710814 - RNA, 22 nt, Salmonella enterica enterica serovar Typhi Ty2
ucugcgcuggguuuuuccgcuu

SEQ ID NO: 3710815 - RNA, 18 nt, Salmonella enterica enterica serovar Typhi Ty2
ucugcgggacgcaucauc

SEQ ID NO: 3710816 - RNA, 19 nt, Salmonella enterica enterica serovar Typhi Ty2
ucugcgucaguaccugaug

SEQ ID NO: 3710817 - RNA, 21 nt, Salmonella enterica enterica serovar Typhi Ty2
ucugcguccugcuuaugaaac

SEQ ID NO: 3710818 - RNA, 19 nt, Salmonella enterica enterica serovar Typhi Ty2
ucugcgugaugcaucagaa

SEQ ID NO: 3710819 - RNA, 13 nt, Salmonella enterica enterica serovar Typhi Ty2
ucugcuccgccag

SEQ ID NO: 3710820 - RNA, 15 nt, Salmonella enterica enterica serovar Typhi Ty2
ucugcuccgccagca

SEQ ID NO: 3710821 - RNA, 17 nt, Salmonella enterica enterica serovar Typhi Ty2
ucugcuccgccagcaau

SEQ ID NO: 3710822 - RNA, 14 nt, Salmonella enterica enterica serovar Typhi Ty2
ucugcuccggcgua

SEQ ID NO: 3710823 - RNA, 16 nt, Salmonella enterica enterica serovar Typhi Ty2
ucugcugauaauacug

SEQ ID NO: 3710824 - RNA, 18 nt, Salmonella enterica enterica serovar Typhi Ty2
ucugcuuguucuuuucaa

SEQ ID NO: 3710825 - RNA, 14 nt, Salmonella enterica enterica serovar Typhi Ty2
ucugcuuucggugc

SEQ ID NO: 3710826 - RNA, 14 nt, Salmonella enterica enterica serovar Typhi Ty2
ucugcuuuucucac

SEQ ID NO: 3710827 - RNA, 16 nt, Salmonella enterica enterica serovar Typhi Ty2
ucuggaaucaauuucc

SEQ ID NO: 3710828 - RNA, 19 nt, Salmonella enterica enterica serovar Typhi Ty2
ucuggaaucaauuucccuu

SEQ ID NO: 3710829 - RNA, 15 nt, Salmonella enterica enterica serovar Typhi Ty2
ucuggaguacgggca

SEQ ID NO: 3710830 - RNA, 18 nt, Salmonella enterica enterica serovar Typhi Ty2
ucuggauagcgguuugca

SEQ ID NO: 3710831 - RNA, 15 nt, Salmonella enterica enterica serovar Typhi Ty2
ucuggaucaguuccg

SEQ ID NO: 3710832 - RNA, 22 nt, Salmonella enterica enterica serovar Typhi Ty2
ucuggaugcguucaaagaucuc

SEQ ID NO: 3710833 - RNA, 13 nt, Salmonella enterica enterica serovar Typhi Ty2
ucuggcaauaagg

SEQ ID NO: 3710834 - RNA, 17 nt, Salmonella enterica enterica serovar Typhi Ty2
ucuggccaauuuuucac

SEQ ID NO: 3710835 - RNA, 15 nt, Salmonella enterica enterica serovar Typhi Ty2
ucuggccaguuucaa

SEQ ID NO: 3710836 - RNA, 14 nt, Salmonella enterica enterica serovar Typhi Ty2
ucuggccauuucau

SEQ ID NO: 3710837 - RNA, 17 nt, Salmonella enterica enterica serovar Typhi Ty2
ucuggccgucuggcgug

SEQ ID NO: 3710838 - RNA, 20 nt, Salmonella enterica enterica serovar Typhi Ty2
ucuggcgaacgacucacgcg

SEQ ID NO: 3710839 - RNA, 18 nt, Salmonella enterica enterica serovar Typhi Ty2
ucuggcgacgccaaucgg

SEQ ID NO: 3710840 - RNA, 14 nt, Salmonella enterica enterica serovar Typhi Ty2
ucuggcgcauaaug

SEQ ID NO: 3710841 - RNA, 19 nt, Salmonella enterica enterica serovar Typhi Ty2
ucuggcgcauuccagaccc

SEQ ID NO: 3710842 - RNA, 18 nt, Salmonella enterica enterica serovar Typhi Ty2
ucuggcgcuuuuccagca

SEQ ID NO: 3710843 - RNA, 22 nt, Salmonella enterica enterica serovar Typhi Ty2
ucuggcguaaugcgaugccgca

SEQ ID NO: 3710844 - RNA, 18 nt, Salmonella enterica enterica serovar Typhi Ty2
ucuggcucccgcagccac

SEQ ID NO: 3710845 - RNA, 13 nt, Salmonella enterica enterica serovar Typhi Ty2
ucuggcugcugau

SEQ ID NO: 3710846 - RNA, 14 nt, Salmonella enterica enterica serovar Typhi Ty2
ucuggcugcugaug

SEQ ID NO: 3710847 - RNA, 17 nt, Salmonella enterica enterica serovar Typhi Ty2
ucuggguuugcagcaga

SEQ ID NO: 3710848 - RNA, 22 nt, Salmonella enterica enterica serovar Typhi Ty2
ucugguaagacgggugcgccca

SEQ ID NO: 3710849 - RNA, 16 nt, Salmonella enterica enterica serovar Typhi Ty2
ucugguacauacuguu

SEQ ID NO: 3710850 - RNA, 20 nt, Salmonella enterica enterica serovar Typhi Ty2
ucugguacggccaccaggcc

SEQ ID NO: 3710851 - RNA, 14 nt, Salmonella enterica enterica serovar Typhi Ty2
ucuggucaaguauu

SEQ ID NO: 3710852 - RNA, 12 nt, Salmonella enterica enterica serovar Typhi Ty2
ucuggugcagca

SEQ ID NO: 3710853 - RNA, 21 nt, Salmonella enterica enterica serovar Typhi Ty2
ucuggugcuguuuagccgucu

SEQ ID NO: 3710854 - RNA, 14 nt, Salmonella enterica enterica serovar Typhi Ty2
ucugguuauccacc

SEQ ID NO: 3710855 - RNA, 22 nt, Salmonella enterica enterica serovar Typhi Ty2
ucugguuguuucgguuuccguu

SEQ ID NO: 3710856 - RNA, 21 nt, Salmonella enterica enterica serovar Typhi Ty2
ucuguaggccggauaaggcgu

SEQ ID NO: 3710857 - RNA, 21 nt, Salmonella enterica enterica serovar Typhi Ty2
ucuguaggucggauaaggcgu

SEQ ID NO: 3710858 - RNA, 17 nt, Salmonella enterica enterica serovar Typhi Ty2
ucuguaugacaacauaa

SEQ ID NO: 3710859 - RNA, 17 nt, Salmonella enterica enterica serovar Typhi Ty2
ucugucagaaaucugaa

SEQ ID NO: 3710860 - RNA, 21 nt, Salmonella enterica enterica serovar Typhi Ty2
ucuguccuuucugcugccgca

SEQ ID NO: 3710861 - RNA, 14 nt, Salmonella enterica enterica serovar Typhi Ty2
ucugucugacgacc

SEQ ID NO: 3710862 - RNA, 18 nt, Salmonella enterica enterica serovar Typhi Ty2
ucuucggucgagcuuuug

SEQ ID NO: 3710863 - RNA, 14 nt, Salmonella enterica enterica serovar Typhi Ty2
ucuucgucgucauc

SEQ ID NO: 3710864 - RNA, 14 nt, Salmonella enterica enterica serovar Typhi Ty2
ucuucuacaaugcg

SEQ ID NO: 3710865 - RNA, 13 nt, Salmonella enterica enterica serovar Typhi Ty2
ucuucuaccaccu

SEQ ID NO: 3710866 - RNA, 19 nt, Salmonella enterica enterica serovar Typhi Ty2
ucuucuccagaucgcauaa

SEQ ID NO: 3710867 - RNA, 14 nt, Salmonella enterica enterica serovar Typhi Ty2
ucuucuccgccugc

SEQ ID NO: 3710868 - RNA, 20 nt, Salmonella enterica enterica serovar Typhi Ty2
ucuucuccgccugcgguuua

SEQ ID NO: 3710869 - RNA, 21 nt, Salmonella enterica enterica serovar Typhi Ty2
ucuucugauggcuuugcuguc

SEQ ID NO: 3710870 - RNA, 16 nt, Salmonella enterica enterica serovar Typhi Ty2
ucuucugugauuaucc

SEQ ID NO: 3710871 - RNA, 19 nt, Salmonella enterica enterica serovar Typhi Ty2
ucuucuuuagauaauuucg

SEQ ID NO: 3710872 - RNA, 21 nt, Salmonella enterica enterica serovar Typhi Ty2
ucuucuuuauccugaagaugg

SEQ ID NO: 3710873 - RNA, 23 nt, Salmonella enterica enterica serovar Typhi Ty2
ucuucuuugacccacgccagcag

SEQ ID NO: 3710874 - RNA, 19 nt, Salmonella enterica enterica serovar Typhi Ty2
ucuugcacaauacuuuuug

SEQ ID NO: 3710875 - RNA, 13 nt, Salmonella enterica enterica serovar Typhi Ty2
ucuugccacuggc

SEQ ID NO: 3710876 - RNA, 14 nt, Salmonella enterica enterica serovar Typhi Ty2
ucuugccacuggcc

SEQ ID NO: 3710877 - RNA, 14 nt, Salmonella enterica enterica serovar Typhi Ty2
ucuugccgccaucu

SEQ ID NO: 3710878 - RNA, 11 nt, Salmonella enterica enterica serovar Typhi Ty2
ucuugcuauca

SEQ ID NO: 3710879 - RNA, 19 nt, Salmonella enterica enterica serovar Typhi Ty2
ucuuggagagcaucaucug

SEQ ID NO: 3710880 - RNA, 18 nt, Salmonella enterica enterica serovar Typhi Ty2
ucuugguaccaaacagca

SEQ ID NO: 3710881 - RNA, 22 nt, Salmonella enterica enterica serovar Typhi Ty2
ucuuguagugugauccaucccu

SEQ ID NO: 3710882 - RNA, 19 nt, Salmonella enterica enterica serovar Typhi Ty2
ucuuguuucaucgucagcu

SEQ ID NO: 3710883 - RNA, 20 nt, Salmonella enterica enterica serovar Typhi Ty2
ucuuuaaaaucgcgcauggc

SEQ ID NO: 3710884 - RNA, 20 nt, Salmonella enterica enterica serovar Typhi Ty2
ucuuuaaaaugacucaggac

SEQ ID NO: 3710885 - RNA, 22 nt, Salmonella enterica enterica serovar Typhi Ty2
ucuuuaaacaacgccauaauac

SEQ ID NO: 3710886 - RNA, 16 nt, Salmonella enterica enterica serovar Typhi Ty2
ucuuuaaauuucaggg

SEQ ID NO: 3710887 - RNA, 23 nt, Salmonella enterica enterica serovar Typhi Ty2
ucuuuaaugcccgguauuuuuuc

SEQ ID NO: 3710888 - RNA, 22 nt, Salmonella enterica enterica serovar Typhi Ty2
ucuuuaauuuacguccgccgug

SEQ ID NO: 3710889 - RNA, 20 nt, Salmonella enterica enterica serovar Typhi Ty2
ucuuuaauuugugccagcgu

SEQ ID NO: 3710890 - RNA, 14 nt, Salmonella enterica enterica serovar Typhi Ty2
ucuuuacacucgcg

SEQ ID NO: 3710891 - RNA, 22 nt, Salmonella enterica enterica serovar Typhi Ty2
ucuuuacacucgcggauaaugu

SEQ ID NO: 3710892 - RNA, 16 nt, Salmonella enterica enterica serovar Typhi Ty2
ucuuuacgcagcaaga

SEQ ID NO: 3710893 - RNA, 22 nt, Salmonella enterica enterica serovar Typhi Ty2
ucuuuacgcagcaagaacagag

SEQ ID NO: 3710894 - RNA, 16 nt, Salmonella enterica enterica serovar Typhi Ty2
ucuuuagauaauuucg

SEQ ID NO: 3710895 - RNA, 12 nt, Salmonella enterica enterica serovar Typhi Ty2
ucuuuaucaaac

SEQ ID NO: 3710896 - RNA, 12 nt, Salmonella enterica enterica serovar Typhi Ty2
ucuuuaucuucu

SEQ ID NO: 3710897 - RNA, 23 nt, Salmonella enterica enterica serovar Typhi Ty2
ucuuuaugcgagaguuuuucagc

SEQ ID NO: 3710898 - RNA, 23 nt, Salmonella enterica enterica serovar Typhi Ty2
ucuuuaugcggcgcuuccagacu

SEQ ID NO: 3710899 - RNA, 13 nt, Salmonella enterica enterica serovar Typhi Ty2
ucuuuaugcguca

SEQ ID NO: 3710900 - RNA, 12 nt, Salmonella enterica enterica serovar Typhi Ty2
ucuuuauucgcg

SEQ ID NO: 3710901 - RNA, 14 nt, Salmonella enterica enterica serovar Typhi Ty2
ucuuucaacuuccg

SEQ ID NO: 3710902 - RNA, 17 nt, Salmonella enterica enterica serovar Typhi Ty2
ucuuucaauaauggcgc

SEQ ID NO: 3710903 - RNA, 12 nt, Salmonella enterica enterica serovar Typhi Ty2
ucuuucaauccu

SEQ ID NO: 3710904 - RNA, 19 nt, Salmonella enterica enterica serovar Typhi Ty2
ucuuucaauccuucuucug

SEQ ID NO: 3710905 - RNA, 22 nt, Salmonella enterica enterica serovar Typhi Ty2
ucuuucagcaaacguucaauga

SEQ ID NO: 3710906 - RNA, 23 nt, Salmonella enterica enterica serovar Typhi Ty2
ucuuucagccgacuaucuucuuc

SEQ ID NO: 3710907 - RNA, 13 nt, Salmonella enterica enterica serovar Typhi Ty2
ucuuucaucaaac

SEQ ID NO: 3710908 - RNA, 13 nt, Salmonella enterica enterica serovar Typhi Ty2
ucuuucauuucug

SEQ ID NO: 3710909 - RNA, 14 nt, Salmonella enterica enterica serovar Typhi Ty2
ucuuucccaggccc

SEQ ID NO: 3710910 - RNA, 22 nt, Salmonella enterica enterica serovar Typhi Ty2
ucuuucccggcaauuaccgcca

SEQ ID NO: 3710911 - RNA, 12 nt, Salmonella enterica enterica serovar Typhi Ty2
ucuuuccuuuuu

SEQ ID NO: 3710912 - RNA, 15 nt, Salmonella enterica enterica serovar Typhi Ty2
ucuuuccuuuuucag

SEQ ID NO: 3710913 - RNA, 20 nt, Salmonella enterica enterica serovar Typhi Ty2
ucuuugacccacgccagcag

SEQ ID NO: 3710914 - RNA, 19 nt, Salmonella enterica enterica serovar Typhi Ty2
ucuuugcaccgcuaaaaaa

SEQ ID NO: 3710915 - RNA, 14 nt, Salmonella enterica enterica serovar Typhi Ty2
ucuuugcugccguc

SEQ ID NO: 3710916 - RNA, 17 nt, Salmonella enterica enterica serovar Typhi Ty2
ucuuuggacggcaucag

SEQ ID NO: 3710917 - RNA, 17 nt, Salmonella enterica enterica serovar Typhi Ty2
ucuuuggcuuaaucauu

SEQ ID NO: 3710918 - RNA, 13 nt, Salmonella enterica enterica serovar Typhi Ty2
ucuuuuaacauaa

SEQ ID NO: 3710919 - RNA, 22 nt, Salmonella enterica enterica serovar Typhi Ty2
ucuuuuaaggcggcaaagauaa

SEQ ID NO: 3710920 - RNA, 18 nt, Salmonella enterica enterica serovar Typhi Ty2
ucuuuuacgaucgccacc

SEQ ID NO: 3710921 - RNA, 16 nt, Salmonella enterica enterica serovar Typhi Ty2
ucuuuuaucacccgga

SEQ ID NO: 3710922 - RNA, 22 nt, Salmonella enterica enterica serovar Typhi Ty2
ucuuuucguuucuugauguguc

SEQ ID NO: 3710923 - RNA, 23 nt, Salmonella enterica enterica serovar Typhi Ty2
ucuuuucugucguguccuugcca

SEQ ID NO: 3710924 - RNA, 12 nt, Salmonella enterica enterica serovar Typhi Ty2
ucuuuugcaaua

SEQ ID NO: 3710925 - RNA, 16 nt, Salmonella enterica enterica serovar Typhi Ty2
ucuuuugcgccuucca

SEQ ID NO: 3710926 - RNA, 18 nt, Salmonella enterica enterica serovar Typhi Ty2
ucuuuuucggcuggcagc

SEQ ID NO: 3710927 - RNA, 12 nt, Salmonella enterica enterica serovar Typhi Ty2
ugaaaaaauuuc

SEQ ID NO: 3710928 - RNA, 22 nt, Salmonella enterica enterica serovar Typhi Ty2
ugaaaaacgguauuuccauuuu

SEQ ID NO: 3710929 - RNA, 16 nt, Salmonella enterica enterica serovar Typhi Ty2
ugaaaaagauagacca

SEQ ID NO: 3710930 - RNA, 12 nt, Salmonella enterica enterica serovar Typhi Ty2
ugaaaaaucauu

SEQ ID NO: 3710931 - RNA, 15 nt, Salmonella enterica enterica serovar Typhi Ty2
ugaaaagcagccaga

SEQ ID NO: 3710932 - RNA, 12 nt, Salmonella enterica enterica serovar Typhi Ty2
ugaaaagcuuag

SEQ ID NO: 3710933 - RNA, 19 nt, Salmonella enterica enterica serovar Typhi Ty2
ugaaaagcuuagaacucac

SEQ ID NO: 3710934 - RNA, 23 nt, Salmonella enterica enterica serovar Typhi Ty2
ugaaaaggggaucguguaacaau

SEQ ID NO: 3710935 - RNA, 13 nt, Salmonella enterica enterica serovar Typhi Ty2
ugaaaauaauuga

SEQ ID NO: 3710936 - RNA, 14 nt, Salmonella enterica enterica serovar Typhi Ty2
ugaaaauaauuuuu

SEQ ID NO: 3710937 - RNA, 18 nt, Salmonella enterica enterica serovar Typhi Ty2
ugaaaauaauuuuuauca

SEQ ID NO: 3710938 - RNA, 18 nt, Salmonella enterica enterica serovar Typhi Ty2
ugaaaauguaucagacgu

SEQ ID NO: 3710939 - RNA, 15 nt, Salmonella enterica enterica serovar Typhi Ty2
ugaaaauuuguacuu

SEQ ID NO: 3710940 - RNA, 19 nt, Salmonella enterica enterica serovar Typhi Ty2
ugaaaauuuguacuucaga

SEQ ID NO: 3710941 - RNA, 15 nt, Salmonella enterica enterica serovar Typhi Ty2
ugaaacagaauaaac

SEQ ID NO: 3710942 - RNA, 22 nt, Salmonella enterica enterica serovar Typhi Ty2
ugaaacaguccggcgaaaaaag

SEQ ID NO: 3710943 - RNA, 20 nt, Salmonella enterica enterica serovar Typhi Ty2
ugaaacauauauauccgcua

SEQ ID NO: 3710944 - RNA, 15 nt, Salmonella enterica enterica serovar Typhi Ty2
ugaauaacagcacca

SEQ ID NO: 3710945 - RNA, 16 nt, Salmonella enterica enterica serovar Typhi Ty2
ugaauaaccauacuga

SEQ ID NO: 3710946 - RNA, 15 nt, Salmonella enterica enterica serovar Typhi Ty2
ugaauaauaauacac

SEQ ID NO: 3710947 - RNA, 21 nt, Salmonella enterica enterica serovar Typhi Ty2
ugaauaaucgucgugguuuaa

SEQ ID NO: 3710948 - RNA, 14 nt, Salmonella enterica enterica serovar Typhi Ty2
ugaauaaugaccag

SEQ ID NO: 3710949 - RNA, 17 nt, Salmonella enterica enterica serovar Typhi Ty2
ugaauaaugguaaauuu

SEQ ID NO: 3710950 - RNA, 15 nt, Salmonella enterica enterica serovar Typhi Ty2
ugaauaccaaagccc

SEQ ID NO: 3710951 - RNA, 16 nt, Salmonella enterica enterica serovar Typhi Ty2
ugaauaccaaagcccg

SEQ ID NO: 3710952 - RNA, 18 nt, Salmonella enterica enterica serovar Typhi Ty2
ugaauaccaagucucagg

SEQ ID NO: 3710953 - RNA, 17 nt, Salmonella enterica enterica serovar Typhi Ty2
ugaauaccacaaauuuu

SEQ ID NO: 3710954 - RNA, 12 nt, Salmonella enterica enterica serovar Typhi Ty2
ugaauaccagcg

SEQ ID NO: 3710955 - RNA, 14 nt, Salmonella enterica enterica serovar Typhi Ty2
ugaauagcgcugcg

SEQ ID NO: 3710956 - RNA, 16 nt, Salmonella enterica enterica serovar Typhi Ty2
ugaauauccgccgccc

SEQ ID NO: 3710957 - RNA, 22 nt, Salmonella enterica enterica serovar Typhi Ty2
ugaauaucgagcggcaguagca

SEQ ID NO: 3710958 - RNA, 18 nt, Salmonella enterica enterica serovar Typhi Ty2
ugaauauggccagucccc

SEQ ID NO: 3710959 - RNA, 17 nt, Salmonella enterica enterica serovar Typhi Ty2
ugaauauucaauggguu

SEQ ID NO: 3710960 - RNA, 15 nt, Salmonella enterica enterica serovar Typhi Ty2
ugaaucaagcuuugc

SEQ ID NO: 3710961 - RNA, 22 nt, Salmonella enterica enterica serovar Typhi Ty2
ugaaucaucgguaaaugcuuau

SEQ ID NO: 3710962 - RNA, 15 nt, Salmonella enterica enterica serovar Typhi Ty2
ugaauccaggccaga

SEQ ID NO: 3710963 - RNA, 16 nt, Salmonella enterica enterica serovar Typhi Ty2
ugaauccaggccagau

SEQ ID NO: 3710964 - RNA, 17 nt, Salmonella enterica enterica serovar Typhi Ty2
ugaaucccccugccaca

SEQ ID NO: 3710965 - RNA, 15 nt, Salmonella enterica enterica serovar Typhi Ty2
ugaaucccgccaucg

SEQ ID NO: 3710966 - RNA, 21 nt, Salmonella enterica enterica serovar Typhi Ty2
ugaaucccgccaucguccagc

SEQ ID NO: 3710967 - RNA, 15 nt, Salmonella enterica enterica serovar Typhi Ty2
ugaaucccuguucaa

SEQ ID NO: 3710968 - RNA, 22 nt, Salmonella enterica enterica serovar Typhi Ty2
ugaaucccuguucaaaagccug

SEQ ID NO: 3710969 - RNA, 15 nt, Salmonella enterica enterica serovar Typhi Ty2
ugaaucgccgucagu

SEQ ID NO: 3710970 - RNA, 18 nt, Salmonella enterica enterica serovar Typhi Ty2
ugaaucggcaccuggagc

SEQ ID NO: 3710971 - RNA, 21 nt, Salmonella enterica enterica serovar Typhi Ty2
ugaaucguagcgugcgcaaua

SEQ ID NO: 3710972 - RNA, 21 nt, Salmonella enterica enterica serovar Typhi Ty2
ugaaucucagauaauagcugc

SEQ ID NO: 3710973 - RNA, 17 nt, Salmonella enterica enterica serovar Typhi Ty2
ugaaucucuucccagcg

SEQ ID NO: 3710974 - RNA, 22 nt, Salmonella enterica enterica serovar Typhi Ty2
ugaaucuggucggugauauauu

SEQ ID NO: 3710975 - RNA, 18 nt, Salmonella enterica enterica serovar Typhi Ty2
ugaaugagucggaccauc

SEQ ID NO: 3710976 - RNA, 13 nt, Salmonella enterica enterica serovar Typhi Ty2
ugaaugcaaagaa

SEQ ID NO: 3710977 - RNA, 19 nt, Salmonella enterica enterica serovar Typhi Ty2
ugaaugccccagcgcugcu

SEQ ID NO: 3710978 - RNA, 11 nt, Salmonella enterica enterica serovar Typhi Ty2
ugaauguuuug

SEQ ID NO: 3710979 - RNA, 22 nt, Salmonella enterica enterica serovar Typhi Ty2
ugaauuacagcucauaaacgcg

SEQ ID NO: 3710980 - RNA, 17 nt, Salmonella enterica enterica serovar Typhi Ty2
ugaauuauaauaaaggg

SEQ ID NO: 3710981 - RNA, 17 nt, Salmonella enterica enterica serovar Typhi Ty2
ugaauuauuuuuucaug

SEQ ID NO: 3710982 - RNA, 14 nt, Salmonella enterica enterica serovar Typhi Ty2
ugaauucaacgucc

SEQ ID NO: 3710983 - RNA, 15 nt, Salmonella enterica enterica serovar Typhi Ty2
ugaauucaccgcaug

SEQ ID NO: 3710984 - RNA, 14 nt, Salmonella enterica enterica serovar Typhi Ty2
ugaauucguuaccu

SEQ ID NO: 3710985 - RNA, 18 nt, Salmonella enterica enterica serovar Typhi Ty2
ugaauugauuagcuuuaa

SEQ ID NO: 3710986 - RNA, 16 nt, Salmonella enterica enterica serovar Typhi Ty2
ugaauugcaaggcgac

SEQ ID NO: 3710987 - RNA, 22 nt, Salmonella enterica enterica serovar Typhi Ty2
ugaauugcgguuuauccccgcu

SEQ ID NO: 3710988 - RNA, 15 nt, Salmonella enterica enterica serovar Typhi Ty2
ugaauuuaaauacuu

SEQ ID NO: 3710989 - RNA, 20 nt, Salmonella enterica enterica serovar Typhi Ty2
ugaauuuaucccgugguggg

SEQ ID NO: 3710990 - RNA, 14 nt, Salmonella enterica enterica serovar Typhi Ty2
ugaauuucugcugc

SEQ ID NO: 3710991 - RNA, 20 nt, Salmonella enterica enterica serovar Typhi Ty2
ugaauuugcugcauuucuug

SEQ ID NO: 3710992 - RNA, 14 nt, Salmonella enterica enterica serovar Typhi Ty2
ugacaacaaaaaga

SEQ ID NO: 3710993 - RNA, 17 nt, Salmonella enterica enterica serovar Typhi Ty2
ugacaacacucacaaaa

SEQ ID NO: 3710994 - RNA, 23 nt, Salmonella enterica enterica serovar Typhi Ty2
ugacaacacucacaaaacuauuu

SEQ ID NO: 3710995 - RNA, 17 nt, Salmonella enterica enterica serovar Typhi Ty2
ugacaacuauugcugcc

SEQ ID NO: 3710996 - RNA, 15 nt, Salmonella enterica enterica serovar Typhi Ty2
ugacaagcagcggaa

SEQ ID NO: 3710997 - RNA, 20 nt, Salmonella enterica enterica serovar Typhi Ty2
ugacaauaagauuugcggca

SEQ ID NO: 3710998 - RNA, 11 nt, Salmonella enterica enterica serovar Typhi Ty2
ugacaauaagu

SEQ ID NO: 3710999 - RNA, 16 nt, Salmonella enterica enterica serovar Typhi Ty2
ugacaauauugccaua

SEQ ID NO: 3711000 - RNA, 20 nt, Salmonella enterica enterica serovar Typhi Ty2
ugacaauauugccauaaaua

SEQ ID NO: 3711001 - RNA, 23 nt, Salmonella enterica enterica serovar Typhi Ty2
ugacaauauugccauaaauacaa

SEQ ID NO: 3711002 - RNA, 14 nt, Salmonella enterica enterica serovar Typhi Ty2
ugacaaucacucuc

SEQ ID NO: 3711003 - RNA, 17 nt, Salmonella enterica enterica serovar Typhi Ty2
ugacaaucagcacacua

SEQ ID NO: 3711004 - RNA, 12 nt, Salmonella enterica enterica serovar Typhi Ty2
ugacaaucugcu

SEQ ID NO: 3711005 - RNA, 14 nt, Salmonella enterica enterica serovar Typhi Ty2
ugacaaugacgcaa

SEQ ID NO: 3711006 - RNA, 14 nt, Salmonella enterica enterica serovar Typhi Ty2
ugacacccucugcg

SEQ ID NO: 3711007 - RNA, 22 nt, Salmonella enterica enterica serovar Typhi Ty2
ugacacccucuuucgccauuga

SEQ ID NO: 3711008 - RNA, 14 nt, Salmonella enterica enterica serovar Typhi Ty2
ugacacggaacaac

SEQ ID NO: 3711009 - RNA, 15 nt, Salmonella enterica enterica serovar Typhi Ty2
ugacacggucagcgg

SEQ ID NO: 3711010 - RNA, 14 nt, Salmonella enterica enterica serovar Typhi Ty2
ugacacucauccag

SEQ ID NO: 3711011 - RNA, 21 nt, Salmonella enterica enterica serovar Typhi Ty2
ugacagagcucgucaaaaauc

SEQ ID NO: 3711012 - RNA, 22 nt, Salmonella enterica enterica serovar Typhi Ty2
ugacaucaagcccacacaucac

SEQ ID NO: 3711013 - RNA, 18 nt, Salmonella enterica enterica serovar Typhi Ty2
ugacaucgcaaugccacc

SEQ ID NO: 3711014 - RNA, 20 nt, Salmonella enterica enterica serovar Typhi Ty2
ugacaucucuuuuaauuuuc

SEQ ID NO: 3711015 - RNA, 15 nt, Salmonella enterica enterica serovar Typhi Ty2
ugacauuauucaccu

SEQ ID NO: 3711016 - RNA, 17 nt, Salmonella enterica enterica serovar Typhi Ty2
ugacauuuaucuuccgg

SEQ ID NO: 3711017 - RNA, 20 nt, Salmonella enterica enterica serovar Typhi Ty2
ugaccaacaucauuauuccc

SEQ ID NO: 3711018 - RNA, 21 nt, Salmonella enterica enterica serovar Typhi Ty2
ugaccaacaucauuauucccc

SEQ ID NO: 3711019 - RNA, 18 nt, Salmonella enterica enterica serovar Typhi Ty2
ugaccaacgucagcaucu

SEQ ID NO: 3711020 - RNA, 18 nt, Salmonella enterica enterica serovar Typhi Ty2
ugaccaccagcgcgaccg

SEQ ID NO: 3711021 - RNA, 17 nt, Salmonella enterica enterica serovar Typhi Ty2
ugaccaccauauucgcc

SEQ ID NO: 3711022 - RNA, 14 nt, Salmonella enterica enterica serovar Typhi Ty2
ugaccacgccgccg

SEQ ID NO: 3711023 - RNA, 16 nt, Salmonella enterica enterica serovar Typhi Ty2
ugaccagcaucgccgg

SEQ ID NO: 3711024 - RNA, 18 nt, Salmonella enterica enterica serovar Typhi Ty2
ugaccagccuaccugccg

SEQ ID NO: 3711025 - RNA, 13 nt, Salmonella enterica enterica serovar Typhi Ty2
ugaccagcgacgg

SEQ ID NO: 3711026 - RNA, 17 nt, Salmonella enterica enterica serovar Typhi Ty2
ugacugaucgauccacu

SEQ ID NO: 3711027 - RNA, 19 nt, Salmonella enterica enterica serovar Typhi Ty2
ugacugcaaaucugccguc

SEQ ID NO: 3711028 - RNA, 16 nt, Salmonella enterica enterica serovar Typhi Ty2
ugacugccagguaauc

SEQ ID NO: 3711029 - RNA, 21 nt, Salmonella enterica enterica serovar Typhi Ty2
ugacugccguauaauccagcu

SEQ ID NO: 3711030 - RNA, 13 nt, Salmonella enterica enterica serovar Typhi Ty2
ugacugcugucau

SEQ ID NO: 3711031 - RNA, 19 nt, Salmonella enterica enterica serovar Typhi Ty2
ugacuguaauaauacuaac

SEQ ID NO: 3711032 - RNA, 14 nt, Salmonella enterica enterica serovar Typhi Ty2
ugacuuacaggcug

SEQ ID NO: 3711033 - RNA, 17 nt, Salmonella enterica enterica serovar Typhi Ty2
ugacuucaacgcaggcg

SEQ ID NO: 3711034 - RNA, 17 nt, Salmonella enterica enterica serovar Typhi Ty2
ugacuuguuccagucca

SEQ ID NO: 3711035 - RNA, 16 nt, Salmonella enterica enterica serovar Typhi Ty2
ugacuuugcucuccuu

SEQ ID NO: 3711036 - RNA, 13 nt, Salmonella enterica enterica serovar Typhi Ty2
ugagaaaaauacg

SEQ ID NO: 3711037 - RNA, 17 nt, Salmonella enterica enterica serovar Typhi Ty2
ugagaaaaccauauaaa

SEQ ID NO: 3711038 - RNA, 12 nt, Salmonella enterica enterica serovar Typhi Ty2
ugagaaaaggaa

SEQ ID NO: 3711039 - RNA, 15 nt, Salmonella enterica enterica serovar Typhi Ty2
ugagaaaaggaagaa

SEQ ID NO: 3711040 - RNA, 20 nt, Salmonella enterica enterica serovar Typhi Ty2
ugagaaaaggaagaauaaau

SEQ ID NO: 3711041 - RNA, 23 nt, Salmonella enterica enterica serovar Typhi Ty2
ugagaaaaggaagaauaaauaac

SEQ ID NO: 3711042 - RNA, 15 nt, Salmonella enterica enterica serovar Typhi Ty2
ugagaaaauuacgcc

SEQ ID NO: 3711043 - RNA, 18 nt, Salmonella enterica enterica serovar Typhi Ty2
ugagaaacgcgccacgcg

SEQ ID NO: 3711044 - RNA, 14 nt, Salmonella enterica enterica serovar Typhi Ty2
ugagaagggcagau

SEQ ID NO: 3711045 - RNA, 20 nt, Salmonella enterica enterica serovar Typhi Ty2
ugagaaggucaguccaccug

SEQ ID NO: 3711046 - RNA, 14 nt, Salmonella enterica enterica serovar Typhi Ty2
ugagaauggcggga

SEQ ID NO: 3711047 - RNA, 15 nt, Salmonella enterica enterica serovar Typhi Ty2
ugagaauucugcgcg

SEQ ID NO: 3711048 - RNA, 19 nt, Salmonella enterica enterica serovar Typhi Ty2
ugagaauuuccaguucaau

SEQ ID NO: 3711049 - RNA, 12 nt, Salmonella enterica enterica serovar Typhi Ty2
ugagacucagca

SEQ ID NO: 3711050 - RNA, 17 nt, Salmonella enterica enterica serovar Typhi Ty2
ugagacuguuugucuca

SEQ ID NO: 3711051 - RNA, 22 nt, Salmonella enterica enterica serovar Typhi Ty2
ugagagucgauacucacgacuu

SEQ ID NO: 3711052 - RNA, 20 nt, Salmonella enterica enterica serovar Typhi Ty2
ugagauaauuuaugauuuua

SEQ ID NO: 3711053 - RNA, 12 nt, Salmonella enterica enterica serovar Typhi Ty2
ugagaucguuau

SEQ ID NO: 3711054 - RNA, 21 nt, Salmonella enterica enterica serovar Typhi Ty2
ugagaugcaggccaagcagcg

SEQ ID NO: 3711055 - RNA, 16 nt, Salmonella enterica enterica serovar Typhi Ty2
ugagcagaucagcacg

SEQ ID NO: 3711056 - RNA, 20 nt, Salmonella enterica enterica serovar Typhi Ty2
ugagcagaucagcacgcgcc

SEQ ID NO: 3711057 - RNA, 20 nt, Salmonella enterica enterica serovar Typhi Ty2
ugagcaucaaacuuuuaaau

SEQ ID NO: 3711058 - RNA, 13 nt, Salmonella enterica enterica serovar Typhi Ty2
ugagcccacagcg

SEQ ID NO: 3711059 - RNA, 16 nt, Salmonella enterica enterica serovar Typhi Ty2
ugagcgaaacuccagc

SEQ ID NO: 3711060 - RNA, 12 nt, Salmonella enterica enterica serovar Typhi Ty2
ugagcgaacagg

SEQ ID NO: 3711061 - RNA, 21 nt, Salmonella enterica enterica serovar Typhi Ty2
ugagcgaauccccgggaacau

SEQ ID NO: 3711062 - RNA, 13 nt, Salmonella enterica enterica serovar Typhi Ty2
ugagcgcaaugcu

SEQ ID NO: 3711063 - RNA, 20 nt, Salmonella enterica enterica serovar Typhi Ty2
ugagcgccgcgccuaccagc

SEQ ID NO: 3711064 - RNA, 17 nt, Salmonella enterica enterica serovar Typhi Ty2
ugagcgcgaacgcucca

SEQ ID NO: 3711065 - RNA, 23 nt, Salmonella enterica enterica serovar Typhi Ty2
ugagcgcgccaugagacgcguaa

SEQ ID NO: 3711066 - RNA, 20 nt, Salmonella enterica enterica serovar Typhi Ty2
ugagcgcuugauccagcucg

SEQ ID NO: 3711067 - RNA, 21 nt, Salmonella enterica enterica serovar Typhi Ty2
ugagcgguagcccgacaauaa

SEQ ID NO: 3711068 - RNA, 22 nt, Salmonella enterica enterica serovar Typhi Ty2
ugagcguccagucgggcgugcc

SEQ ID NO: 3711069 - RNA, 18 nt, Salmonella enterica enterica serovar Typhi Ty2
ugagcguuacgggaacag

SEQ ID NO: 3711070 - RNA, 22 nt, Salmonella enterica enterica serovar Typhi Ty2
ugagcguuagcgccauccggca

SEQ ID NO: 3711071 - RNA, 13 nt, Salmonella enterica enterica serovar Typhi Ty2
ugagcucauccag

SEQ ID NO: 3711072 - RNA, 14 nt, Salmonella enterica enterica serovar Typhi Ty2
ugagcucauccagc

SEQ ID NO: 3711073 - RNA, 20 nt, Salmonella enterica enterica serovar Typhi Ty2
ugagcucguuauaagcuuua

SEQ ID NO: 3711074 - RNA, 17 nt, Salmonella enterica enterica serovar Typhi Ty2
ugagcucuuucugcgca

SEQ ID NO: 3711075 - RNA, 12 nt, Salmonella enterica enterica serovar Typhi Ty2
ugagcugaaagc

SEQ ID NO: 3711076 - RNA, 17 nt, Salmonella enterica enterica serovar Typhi Ty2
ugagcugacugacguga

SEQ ID NO: 3711077 - RNA, 15 nt, Salmonella enterica enterica serovar Typhi Ty2
ugagcuugagccagc

SEQ ID NO: 3711078 - RNA, 16 nt, Salmonella enterica enterica serovar Typhi Ty2
ugaggccgcucgccau

SEQ ID NO: 3711079 - RNA, 17 nt, Salmonella enterica enterica serovar Typhi Ty2
ugaggcgacaaucucac

SEQ ID NO: 3711080 - RNA, 12 nt, Salmonella enterica enterica serovar Typhi Ty2
ugaggcgcagcc

SEQ ID NO: 3711081 - RNA, 18 nt, Salmonella enterica enterica serovar Typhi Ty2
ugaggcgcugcgacgcgg

SEQ ID NO: 3711082 - RNA, 17 nt, Salmonella enterica enterica serovar Typhi Ty2
ugaggcguugcuccagc

SEQ ID NO: 3711083 - RNA, 18 nt, Salmonella enterica enterica serovar Typhi Ty2
ugaggcuauugucauuga

SEQ ID NO: 3711084 - RNA, 18 nt, Salmonella enterica enterica serovar Typhi Ty2
ugaguaaacgcucaagca

SEQ ID NO: 3711085 - RNA, 19 nt, Salmonella enterica enterica serovar Typhi Ty2
ugaguaaagagaucaauuu

SEQ ID NO: 3711086 - RNA, 13 nt, Salmonella enterica enterica serovar Typhi Ty2
ugaguaacguuaa

SEQ ID NO: 3711087 - RNA, 21 nt, Salmonella enterica enterica serovar Typhi Ty2
ugaguauaaaacucgccgcga

SEQ ID NO: 3711088 - RNA, 16 nt, Salmonella enterica enterica serovar Typhi Ty2
ugaguauuggcaagaa

SEQ ID NO: 3711089 - RNA, 15 nt, Salmonella enterica enterica serovar Typhi Ty2
ugagucauccuuccc

SEQ ID NO: 3711090 - RNA, 16 nt, Salmonella enterica enterica serovar Typhi Ty2
ugagucauccuucccc

SEQ ID NO: 3711091 - RNA, 16 nt, Salmonella enterica enterica serovar Typhi Ty2
ugaguccccgggagca

SEQ ID NO: 3711092 - RNA, 17 nt, Salmonella enterica enterica serovar Typhi Ty2
ugaguuugacugccaga

SEQ ID NO: 3711093 - RNA, 16 nt, Salmonella enterica enterica serovar Typhi Ty2
ugaguuugucauccag

SEQ ID NO: 3711094 - RNA, 18 nt, Salmonella enterica enterica serovar Typhi Ty2
ugaguuugucauccagac

SEQ ID NO: 3711095 - RNA, 16 nt, Salmonella enterica enterica serovar Typhi Ty2
ugaguuuuccgccauu

SEQ ID NO: 3711096 - RNA, 18 nt, Salmonella enterica enterica serovar Typhi Ty2
ugauaaaaaacaguacgg

SEQ ID NO: 3711097 - RNA, 22 nt, Salmonella enterica enterica serovar Typhi Ty2
ugauaaaacauuccaucgccau

SEQ ID NO: 3711098 - RNA, 14 nt, Salmonella enterica enterica serovar Typhi Ty2
ugauaaaacgcagg

SEQ ID NO: 3711099 - RNA, 17 nt, Salmonella enterica enterica serovar Typhi Ty2
ugauaaaauaaacacua

SEQ ID NO: 3711100 - RNA, 18 nt, Salmonella enterica enterica serovar Typhi Ty2
ugauaaaauaaacacuaa

SEQ ID NO: 3711101 - RNA, 20 nt, Salmonella enterica enterica serovar Typhi Ty2
ugauaaaauaaacacuaaau

SEQ ID NO: 3711102 - RNA, 22 nt, Salmonella enterica enterica serovar Typhi Ty2
ugauaaacgcaaugucaucagg

SEQ ID NO: 3711103 - RNA, 16 nt, Salmonella enterica enterica serovar Typhi Ty2
ugauaaagcuuucauc

SEQ ID NO: 3711104 - RNA, 15 nt, Salmonella enterica enterica serovar Typhi Ty2
ugauaaauacgcugc

SEQ ID NO: 3711105 - RNA, 11 nt, Salmonella enterica enterica serovar Typhi Ty2
ugauaaauauc

SEQ ID NO: 3711106 - RNA, 18 nt, Salmonella enterica enterica serovar Typhi Ty2
ugauaaaucgucggcagg

SEQ ID NO: 3711107 - RNA, 19 nt, Salmonella enterica enterica serovar Typhi Ty2
ugauaaccuauuuugcaaa

SEQ ID NO: 3711108 - RNA, 20 nt, Salmonella enterica enterica serovar Typhi Ty2
ugaugauacccccagagauu

SEQ ID NO: 3711109 - RNA, 15 nt, Salmonella enterica enterica serovar Typhi Ty2
ugaugauagcgccau

SEQ ID NO: 3711110 - RNA, 13 nt, Salmonella enterica enterica serovar Typhi Ty2
ugaugaucuucag

SEQ ID NO: 3711111 - RNA, 17 nt, Salmonella enterica enterica serovar Typhi Ty2
ugaugaugaagcugcag

SEQ ID NO: 3711112 - RNA, 13 nt, Salmonella enterica enterica serovar Typhi Ty2
ugaugaugccagg

SEQ ID NO: 3711113 - RNA, 16 nt, Salmonella enterica enterica serovar Typhi Ty2
ugaugauggaacagac

SEQ ID NO: 3711114 - RNA, 16 nt, Salmonella enterica enterica serovar Typhi Ty2
ugaugauuuaugaaua

SEQ ID NO: 3711115 - RNA, 21 nt, Salmonella enterica enterica serovar Typhi Ty2
ugaugcccucuuccagcgcca

SEQ ID NO: 3711116 - RNA, 18 nt, Salmonella enterica enterica serovar Typhi Ty2
ugaugcgccccgcuuccc

SEQ ID NO: 3711117 - RNA, 15 nt, Salmonella enterica enterica serovar Typhi Ty2
ugaugcugcgcaucc

SEQ ID NO: 3711118 - RNA, 23 nt, Salmonella enterica enterica serovar Typhi Ty2
ugaugcugguuuuagcuuauccc

SEQ ID NO: 3711119 - RNA, 19 nt, Salmonella enterica enterica serovar Typhi Ty2
ugauggagguuguuuuauu

SEQ ID NO: 3711120 - RNA, 20 nt, Salmonella enterica enterica serovar Typhi Ty2
ugauggcagaccguggccgu

SEQ ID NO: 3711121 - RNA, 13 nt, Salmonella enterica enterica serovar Typhi Ty2
ugauggccuuugu

SEQ ID NO: 3711122 - RNA, 15 nt, Salmonella enterica enterica serovar Typhi Ty2
ugauggcgaacagcc

SEQ ID NO: 3711123 - RNA, 13 nt, Salmonella enterica enterica serovar Typhi Ty2
ugauggcgcgcca

SEQ ID NO: 3711124 - RNA, 20 nt, Salmonella enterica enterica serovar Typhi Ty2
ugauggcgcugcgcuuauca

SEQ ID NO: 3711125 - RNA, 17 nt, Salmonella enterica enterica serovar Typhi Ty2
ugauggcguaauccgga

SEQ ID NO: 3711126 - RNA, 19 nt, Salmonella enterica enterica serovar Typhi Ty2
ugauggcguagcgccauca

SEQ ID NO: 3711127 - RNA, 10 nt, Salmonella enterica enterica serovar Typhi Ty2
ugauggcuuu

SEQ ID NO: 3711128 - RNA, 14 nt, Salmonella enterica enterica serovar Typhi Ty2
ugaugggcaaugcc

SEQ ID NO: 3711129 - RNA, 18 nt, Salmonella enterica enterica serovar Typhi Ty2
ugaugggcgcacagcgcc

SEQ ID NO: 3711130 - RNA, 20 nt, Salmonella enterica enterica serovar Typhi Ty2
ugaugggcgcacagcgccau

SEQ ID NO: 3711131 - RNA, 13 nt, Salmonella enterica enterica serovar Typhi Ty2
ugauggucuccag

SEQ ID NO: 3711132 - RNA, 15 nt, Salmonella enterica enterica serovar Typhi Ty2
ugaugguuauuuuca

SEQ ID NO: 3711133 - RNA, 21 nt, Salmonella enterica enterica serovar Typhi Ty2
ugaugguuucggcaugccacu

SEQ ID NO: 3711134 - RNA, 21 nt, Salmonella enterica enterica serovar Typhi Ty2
ugauguagcuugaaagcgcaa

SEQ ID NO: 3711135 - RNA, 14 nt, Salmonella enterica enterica serovar Typhi Ty2
ugauguccagcgcg

SEQ ID NO: 3711136 - RNA, 17 nt, Salmonella enterica enterica serovar Typhi Ty2
ugaugugucuauuuauu

SEQ ID NO: 3711137 - RNA, 17 nt, Salmonella enterica enterica serovar Typhi Ty2
ugauguguuucagcagc

SEQ ID NO: 3711138 - RNA, 18 nt, Salmonella enterica enterica serovar Typhi Ty2
ugauguguuucagcagcc

SEQ ID NO: 3711139 - RNA, 18 nt, Salmonella enterica enterica serovar Typhi Ty2
ugauguuuuuaaaagaag

SEQ ID NO: 3711140 - RNA, 17 nt, Salmonella enterica enterica serovar Typhi Ty2
ugauuaaaagucaacug

SEQ ID NO: 3711141 - RNA, 16 nt, Salmonella enterica enterica serovar Typhi Ty2
ugauuaaaauaaauga

SEQ ID NO: 3711142 - RNA, 13 nt, Salmonella enterica enterica serovar Typhi Ty2
ugauuaaagccac

SEQ ID NO: 3711143 - RNA, 16 nt, Salmonella enterica enterica serovar Typhi Ty2
ugauuaacagcgccau

SEQ ID NO: 3711144 - RNA, 19 nt, Salmonella enterica enterica serovar Typhi Ty2
ugauuaaguuuuuuuaaaa

SEQ ID NO: 3711145 - RNA, 18 nt, Salmonella enterica enterica serovar Typhi Ty2
ugauuaaugauuugcuuu

SEQ ID NO: 3711146 - RNA, 15 nt, Salmonella enterica enterica serovar Typhi Ty2
ugauuacaaaaugug

SEQ ID NO: 3711147 - RNA, 15 nt, Salmonella enterica enterica serovar Typhi Ty2
ugauuacaaagggca

SEQ ID NO: 3711148 - RNA, 14 nt, Salmonella enterica enterica serovar Typhi Ty2
ugauuacagccggu

SEQ ID NO: 3711149 - RNA, 14 nt, Salmonella enterica enterica serovar Typhi Ty2
ugauuacggaacaa

SEQ ID NO: 3711150 - RNA, 21 nt, Salmonella enterica enterica serovar Typhi Ty2
ugauuacggaacaaaacggaa

SEQ ID NO: 3711151 - RNA, 22 nt, Salmonella enterica enterica serovar Typhi Ty2
ugauuacguuuucccugagcgc

SEQ ID NO: 3711152 - RNA, 20 nt, Salmonella enterica enterica serovar Typhi Ty2
ugauuagaaacccauauucc

SEQ ID NO: 3711153 - RNA, 15 nt, Salmonella enterica enterica serovar Typhi Ty2
ugauuauuacaauaa

SEQ ID NO: 3711154 - RNA, 14 nt, Salmonella enterica enterica serovar Typhi Ty2
ugauuccuggcuug

SEQ ID NO: 3711155 - RNA, 15 nt, Salmonella enterica enterica serovar Typhi Ty2
ugauucgcuggccuc

SEQ ID NO: 3711156 - RNA, 21 nt, Salmonella enterica enterica serovar Typhi Ty2
ugauucguuuaaguaagguaa

SEQ ID NO: 3711157 - RNA, 23 nt, Salmonella enterica enterica serovar Typhi Ty2
ugauugccgccaucuuuacccug

SEQ ID NO: 3711158 - RNA, 21 nt, Salmonella enterica enterica serovar Typhi Ty2
ugauugccggagauuuaucuu

SEQ ID NO: 3711159 - RNA, 15 nt, Salmonella enterica enterica serovar Typhi Ty2
ugauugcgacaggcu

SEQ ID NO: 3711160 - RNA, 12 nt, Salmonella enterica enterica serovar Typhi Ty2
ugauuuaaaaaa

SEQ ID NO: 3711161 - RNA, 11 nt, Salmonella enterica enterica serovar Typhi Ty2
ugauuuauuca

SEQ ID NO: 3711162 - RNA, 20 nt, Salmonella enterica enterica serovar Typhi Ty2
ugauuucaggugcuuaucug

SEQ ID NO: 3711163 - RNA, 17 nt, Salmonella enterica enterica serovar Typhi Ty2
ugauuuguuuuuuauau

SEQ ID NO: 3711164 - RNA, 22 nt, Salmonella enterica enterica serovar Typhi Ty2
ugauuuguuuuuuauauuuuua

SEQ ID NO: 3711165 - RNA, 16 nt, Salmonella enterica enterica serovar Typhi Ty2
ugauuuuacuaaugaa

SEQ ID NO: 3711166 - RNA, 11 nt, Salmonella enterica enterica serovar Typhi Ty2
ugauuuuauga

SEQ ID NO: 3711167 - RNA, 13 nt, Salmonella enterica enterica serovar Typhi Ty2
ugauuuucuuauu

SEQ ID NO: 3711168 - RNA, 13 nt, Salmonella enterica enterica serovar Typhi Ty2
ugauuuuuuugcu

SEQ ID NO: 3711169 - RNA, 13 nt, Salmonella enterica enterica serovar Typhi Ty2
ugcaaaagaaaaa

SEQ ID NO: 3711170 - RNA, 18 nt, Salmonella enterica enterica serovar Typhi Ty2
ugcaaaaugcuucuucaa

SEQ ID NO: 3711171 - RNA, 16 nt, Salmonella enterica enterica serovar Typhi Ty2
ugcaaaauuuguggug

SEQ ID NO: 3711172 - RNA, 20 nt, Salmonella enterica enterica serovar Typhi Ty2
ugcaaaccggguaacaacau

SEQ ID NO: 3711173 - RNA, 22 nt, Salmonella enterica enterica serovar Typhi Ty2
ugcaaaccucucccccgccauu

SEQ ID NO: 3711174 - RNA, 16 nt, Salmonella enterica enterica serovar Typhi Ty2
ugcaaacgcggcgcca

SEQ ID NO: 3711175 - RNA, 17 nt, Salmonella enterica enterica serovar Typhi Ty2
ugcaaagaagggcaggg

SEQ ID NO: 3711176 - RNA, 13 nt, Salmonella enterica enterica serovar Typhi Ty2
ugcaaagcaaaaa

SEQ ID NO: 3711177 - RNA, 16 nt, Salmonella enterica enterica serovar Typhi Ty2
ugcaaaguuauuacau

SEQ ID NO: 3711178 - RNA, 15 nt, Salmonella enterica enterica serovar Typhi Ty2
ugcaaauacugcuuu

SEQ ID NO: 3711179 - RNA, 14 nt, Salmonella enterica enterica serovar Typhi Ty2
ugcaaauauucgcc

SEQ ID NO: 3711180 - RNA, 14 nt, Salmonella enterica enterica serovar Typhi Ty2
ugcaaaucaccaca

SEQ ID NO: 3711181 - RNA, 14 nt, Salmonella enterica enterica serovar Typhi Ty2
ugcaaauccaucuc

SEQ ID NO: 3711182 - RNA, 16 nt, Salmonella enterica enterica serovar Typhi Ty2
ugcaaaucugccguca

SEQ ID NO: 3711183 - RNA, 20 nt, Salmonella enterica enterica serovar Typhi Ty2
ugcaaaucugccgucaucga

SEQ ID NO: 3711184 - RNA, 13 nt, Salmonella enterica enterica serovar Typhi Ty2
ugcaacagcacca

SEQ ID NO: 3711185 - RNA, 14 nt, Salmonella enterica enterica serovar Typhi Ty2
ugcaacagcaccag

SEQ ID NO: 3711186 - RNA, 15 nt, Salmonella enterica enterica serovar Typhi Ty2
ugcaacagcaccagc

SEQ ID NO: 3711187 - RNA, 24 nt, Salmonella enterica enterica serovar Typhi Ty2
ugcaacaucuuaccggugcgauuc

SEQ ID NO: 3711188 - RNA, 22 nt, Salmonella enterica enterica serovar Typhi Ty2
ugcaacauuacugaccgagauc

SEQ ID NO: 3711189 - RNA, 15 nt, Salmonella enterica enterica serovar Typhi Ty2
ugcaacauuccuugc

SEQ ID NO: 3711190 - RNA, 20 nt, Salmonella enterica enterica serovar Typhi Ty2
ugcaacauugcaggucugga

SEQ ID NO: 3711191 - RNA, 18 nt, Salmonella enterica enterica serovar Typhi Ty2
ugcaggccaagcagcgcc

SEQ ID NO: 3711192 - RNA, 23 nt, Salmonella enterica enterica serovar Typhi Ty2
ugcaggccgauuuuuuaucucgc

SEQ ID NO: 3711193 - RNA, 14 nt, Salmonella enterica enterica serovar Typhi Ty2
ugcaggccggauaa

SEQ ID NO: 3711194 - RNA, 15 nt, Salmonella enterica enterica serovar Typhi Ty2
ugcaggcgccugggu

SEQ ID NO: 3711195 - RNA, 19 nt, Salmonella enterica enterica serovar Typhi Ty2
ugcaggcgggugcgcagcc

SEQ ID NO: 3711196 - RNA, 22 nt, Salmonella enterica enterica serovar Typhi Ty2
ugcaggcugagcguagaccgcc

SEQ ID NO: 3711197 - RNA, 22 nt, Salmonella enterica enterica serovar Typhi Ty2
ugcagggauaugcugaucuggc

SEQ ID NO: 3711198 - RNA, 15 nt, Salmonella enterica enterica serovar Typhi Ty2
ugcagggugcagcaa

SEQ ID NO: 3711199 - RNA, 15 nt, Salmonella enterica enterica serovar Typhi Ty2
ugcagguaacgacua

SEQ ID NO: 3711200 - RNA, 14 nt, Salmonella enterica enterica serovar Typhi Ty2
ugcagguucccgcc

SEQ ID NO: 3711201 - RNA, 14 nt, Salmonella enterica enterica serovar Typhi Ty2
ugcaguauuucaga

SEQ ID NO: 3711202 - RNA, 17 nt, Salmonella enterica enterica serovar Typhi Ty2
ugcagucgguagcuuuu

SEQ ID NO: 3711203 - RNA, 18 nt, Salmonella enterica enterica serovar Typhi Ty2
ugcagucugguaacgcaa

SEQ ID NO: 3711204 - RNA, 17 nt, Salmonella enterica enterica serovar Typhi Ty2
ugcagugacagaggaau

SEQ ID NO: 3711205 - RNA, 14 nt, Salmonella enterica enterica serovar Typhi Ty2
ugcaguuccgcaau

SEQ ID NO: 3711206 - RNA, 23 nt, Salmonella enterica enterica serovar Typhi Ty2
ugcaguuccgcaauccuggcuuc

SEQ ID NO: 3711207 - RNA, 19 nt, Salmonella enterica enterica serovar Typhi Ty2
ugcaguuccguugcaauau

SEQ ID NO: 3711208 - RNA, 23 nt, Salmonella enterica enterica serovar Typhi Ty2
ugcaguuuuaccguaaaaugcug

SEQ ID NO: 3711209 - RNA, 13 nt, Salmonella enterica enterica serovar Typhi Ty2
ugcauaaaaaaac

SEQ ID NO: 3711210 - RNA, 19 nt, Salmonella enterica enterica serovar Typhi Ty2
ugcauaaagauuggcaucu

SEQ ID NO: 3711211 - RNA, 20 nt, Salmonella enterica enterica serovar Typhi Ty2
ugcauaaagauuggcaucug

SEQ ID NO: 3711212 - RNA, 23 nt, Salmonella enterica enterica serovar Typhi Ty2
ugcauaaucgccgacuaauuauu

SEQ ID NO: 3711213 - RNA, 12 nt, Salmonella enterica enterica serovar Typhi Ty2
ugcauaauggug

SEQ ID NO: 3711214 - RNA, 22 nt, Salmonella enterica enterica serovar Typhi Ty2
ugcauaaugguggaaugcccca

SEQ ID NO: 3711215 - RNA, 15 nt, Salmonella enterica enterica serovar Typhi Ty2
ugcauacggaugaaa

SEQ ID NO: 3711216 - RNA, 23 nt, Salmonella enterica enterica serovar Typhi Ty2
ugcauacggaugaaauacucuuc

SEQ ID NO: 3711217 - RNA, 20 nt, Salmonella enterica enterica serovar Typhi Ty2
ugcauacguuucaccagcac

SEQ ID NO: 3711218 - RNA, 15 nt, Salmonella enterica enterica serovar Typhi Ty2
ugcauagccccagcg

SEQ ID NO: 3711219 - RNA, 16 nt, Salmonella enterica enterica serovar Typhi Ty2
ugcauagccccagcgc

SEQ ID NO: 3711220 - RNA, 19 nt, Salmonella enterica enterica serovar Typhi Ty2
ugcauaucgcuaaaccaaa

SEQ ID NO: 3711221 - RNA, 13 nt, Salmonella enterica enterica serovar Typhi Ty2
ugcauauuguauu

SEQ ID NO: 3711222 - RNA, 16 nt, Salmonella enterica enterica serovar Typhi Ty2
ugcauauuguauuggu

SEQ ID NO: 3711223 - RNA, 14 nt, Salmonella enterica enterica serovar Typhi Ty2
ugcaucaaacuucg

SEQ ID NO: 3711224 - RNA, 21 nt, Salmonella enterica enterica serovar Typhi Ty2
ugcaucaaacuucguuacuua

SEQ ID NO: 3711225 - RNA, 17 nt, Salmonella enterica enterica serovar Typhi Ty2
ugcaucgcggucagcgg

SEQ ID NO: 3711226 - RNA, 22 nt, Salmonella enterica enterica serovar Typhi Ty2
ugcaucguuugcaguuccgcaa

SEQ ID NO: 3711227 - RNA, 22 nt, Salmonella enterica enterica serovar Typhi Ty2
ugcaucuccagcguggcaguga

SEQ ID NO: 3711228 - RNA, 19 nt, Salmonella enterica enterica serovar Typhi Ty2
ugcaucugggggaagauaa

SEQ ID NO: 3711229 - RNA, 18 nt, Salmonella enterica enterica serovar Typhi Ty2
ugcaucuggucaggugau

SEQ ID NO: 3711230 - RNA, 21 nt, Salmonella enterica enterica serovar Typhi Ty2
ugcaucuuaucaggccgacaa

SEQ ID NO: 3711231 - RNA, 14 nt, Salmonella enterica enterica serovar Typhi Ty2
ugcaugaauaucaa

SEQ ID NO: 3711232 - RNA, 15 nt, Salmonella enterica enterica serovar Typhi Ty2
ugcaugagcacgcgg

SEQ ID NO: 3711233 - RNA, 22 nt, Salmonella enterica enterica serovar Typhi Ty2
ugcaugggauacgccagcagac

SEQ ID NO: 3711234 - RNA, 15 nt, Salmonella enterica enterica serovar Typhi Ty2
ugcaugggcagcuug

SEQ ID NO: 3711235 - RNA, 23 nt, Salmonella enterica enterica serovar Typhi Ty2
ugcaugguagucguuauaauccu

SEQ ID NO: 3711236 - RNA, 17 nt, Salmonella enterica enterica serovar Typhi Ty2
ugcauguaguaagccau

SEQ ID NO: 3711237 - RNA, 15 nt, Salmonella enterica enterica serovar Typhi Ty2
ugcauuaaugggcga

SEQ ID NO: 3711238 - RNA, 17 nt, Salmonella enterica enterica serovar Typhi Ty2
ugcauuccgcgcaaaua

SEQ ID NO: 3711239 - RNA, 16 nt, Salmonella enterica enterica serovar Typhi Ty2
ugcauugccgggcuga

SEQ ID NO: 3711240 - RNA, 16 nt, Salmonella enterica enterica serovar Typhi Ty2
ugcauuuaucaaucug

SEQ ID NO: 3711241 - RNA, 20 nt, Salmonella enterica enterica serovar Typhi Ty2
ugcauuugauuuguuuuuua

SEQ ID NO: 3711242 - RNA, 15 nt, Salmonella enterica enterica serovar Typhi Ty2
ugcauuugcgcauau

SEQ ID NO: 3711243 - RNA, 22 nt, Salmonella enterica enterica serovar Typhi Ty2
ugccaaaaaaacuaauccucuu

SEQ ID NO: 3711244 - RNA, 23 nt, Salmonella enterica enterica serovar Typhi Ty2
ugccaaaagguuagguuaaauag

SEQ ID NO: 3711245 - RNA, 21 nt, Salmonella enterica enterica serovar Typhi Ty2
ugccaaacaucgcucgcgcca

SEQ ID NO: 3711246 - RNA, 14 nt, Salmonella enterica enterica serovar Typhi Ty2
ugccaaccaccgcg

SEQ ID NO: 3711247 - RNA, 17 nt, Salmonella enterica enterica serovar Typhi Ty2
ugccaagcaacacggcg

SEQ ID NO: 3711248 - RNA, 16 nt, Salmonella enterica enterica serovar Typhi Ty2
ugccaaguaauaaaga

SEQ ID NO: 3711249 - RNA, 18 nt, Salmonella enterica enterica serovar Typhi Ty2
ugccaaguaauaaagaga

SEQ ID NO: 3711250 - RNA, 13 nt, Salmonella enterica enterica serovar Typhi Ty2
ugccaaucuccag

SEQ ID NO: 3711251 - RNA, 15 nt, Salmonella enterica enterica serovar Typhi Ty2
ugccaaugaaauaau

SEQ ID NO: 3711252 - RNA, 16 nt, Salmonella enterica enterica serovar Typhi Ty2
ugccacaauaucaucg

SEQ ID NO: 3711253 - RNA, 14 nt, Salmonella enterica enterica serovar Typhi Ty2
ugccacacccugag

SEQ ID NO: 3711254 - RNA, 18 nt, Salmonella enterica enterica serovar Typhi Ty2
ugccacagccucagcacg

SEQ ID NO: 3711255 - RNA, 13 nt, Salmonella enterica enterica serovar Typhi Ty2
ugccacaggccaa

SEQ ID NO: 3711256 - RNA, 18 nt, Salmonella enterica enterica serovar Typhi Ty2
ugccacgaacgauauaaa

SEQ ID NO: 3711257 - RNA, 22 nt, Salmonella enterica enterica serovar Typhi Ty2
ugccacgucacgcaacaggccg

SEQ ID NO: 3711258 - RNA, 16 nt, Salmonella enterica enterica serovar Typhi Ty2
ugccacuauagaugau

SEQ ID NO: 3711259 - RNA, 13 nt, Salmonella enterica enterica serovar Typhi Ty2
ugccacuccgcca

SEQ ID NO: 3711260 - RNA, 12 nt, Salmonella enterica enterica serovar Typhi Ty2
ugccacuggccu

SEQ ID NO: 3711261 - RNA, 13 nt, Salmonella enterica enterica serovar Typhi Ty2
ugccacuggccuc

SEQ ID NO: 3711262 - RNA, 21 nt, Salmonella enterica enterica serovar Typhi Ty2
ugccacuguucagaaaucggc

SEQ ID NO: 3711263 - RNA, 12 nt, Salmonella enterica enterica serovar Typhi Ty2
ugccacuguucg

SEQ ID NO: 3711264 - RNA, 22 nt, Salmonella enterica enterica serovar Typhi Ty2
ugccagaaacaacgcgggccau

SEQ ID NO: 3711265 - RNA, 18 nt, Salmonella enterica enterica serovar Typhi Ty2
ugccagagauaauuuucc

SEQ ID NO: 3711266 - RNA, 17 nt, Salmonella enterica enterica serovar Typhi Ty2
ugccagauuuuccaggc

SEQ ID NO: 3711267 - RNA, 16 nt, Salmonella enterica enterica serovar Typhi Ty2
ugccagcaccagcagu

SEQ ID NO: 3711268 - RNA, 14 nt, Salmonella enterica enterica serovar Typhi Ty2
ugccagcauuaacc

SEQ ID NO: 3711269 - RNA, 13 nt, Salmonella enterica enterica serovar Typhi Ty2
ugccagccauagc

SEQ ID NO: 3711270 - RNA, 15 nt, Salmonella enterica enterica serovar Typhi Ty2
ugccagccgccgccg

SEQ ID NO: 3711271 - RNA, 14 nt, Salmonella enterica enterica serovar Typhi Ty2
ugccagcgccgccg

SEQ ID NO: 3711272 - RNA, 14 nt, Salmonella enterica enterica serovar Typhi Ty2
ugccagcgccguca

SEQ ID NO: 3711273 - RNA, 21 nt, Salmonella enterica enterica serovar Typhi Ty2
ugcccgguuaaggggcaggcg

SEQ ID NO: 3711274 - RNA, 17 nt, Salmonella enterica enterica serovar Typhi Ty2
ugcccgucggacucauc

SEQ ID NO: 3711275 - RNA, 13 nt, Salmonella enterica enterica serovar Typhi Ty2
ugcccguuccagg

SEQ ID NO: 3711276 - RNA, 16 nt, Salmonella enterica enterica serovar Typhi Ty2
ugcccguugucacagg

SEQ ID NO: 3711277 - RNA, 17 nt, Salmonella enterica enterica serovar Typhi Ty2
ugcccugacucgcaccg

SEQ ID NO: 3711278 - RNA, 19 nt, Salmonella enterica enterica serovar Typhi Ty2
ugcccugcuggcgcaugau

SEQ ID NO: 3711279 - RNA, 23 nt, Salmonella enterica enterica serovar Typhi Ty2
ugcccugcuugucgaucaucaga

SEQ ID NO: 3711280 - RNA, 17 nt, Salmonella enterica enterica serovar Typhi Ty2
ugcccuggaauuuuucc

SEQ ID NO: 3711281 - RNA, 18 nt, Salmonella enterica enterica serovar Typhi Ty2
ugcccuuaaauccggccu

SEQ ID NO: 3711282 - RNA, 16 nt, Salmonella enterica enterica serovar Typhi Ty2
ugcccuuaucuggaug

SEQ ID NO: 3711283 - RNA, 20 nt, Salmonella enterica enterica serovar Typhi Ty2
ugcccuuaucuggaugagga

SEQ ID NO: 3711284 - RNA, 21 nt, Salmonella enterica enterica serovar Typhi Ty2
ugcccuuaucuggaugaggac

SEQ ID NO: 3711285 - RNA, 22 nt, Salmonella enterica enterica serovar Typhi Ty2
ugcccuucgacaaucagcacca

SEQ ID NO: 3711286 - RNA, 19 nt, Salmonella enterica enterica serovar Typhi Ty2
ugcccuucgaccgucagca

SEQ ID NO: 3711287 - RNA, 20 nt, Salmonella enterica enterica serovar Typhi Ty2
ugcccuucuuuaauacgcgu

SEQ ID NO: 3711288 - RNA, 13 nt, Salmonella enterica enterica serovar Typhi Ty2
ugcccuuucuuau

SEQ ID NO: 3711289 - RNA, 14 nt, Salmonella enterica enterica serovar Typhi Ty2
ugcccuuucuuaug

SEQ ID NO: 3711290 - RNA, 23 nt, Salmonella enterica enterica serovar Typhi Ty2
ugccgaagucaaaggccaguaag

SEQ ID NO: 3711291 - RNA, 20 nt, Salmonella enterica enterica serovar Typhi Ty2
ugccgacaaagagcucccca

SEQ ID NO: 3711292 - RNA, 17 nt, Salmonella enterica enterica serovar Typhi Ty2
ugccgaccaaugacgcu

SEQ ID NO: 3711293 - RNA, 22 nt, Salmonella enterica enterica serovar Typhi Ty2
ugccgaccagcgguugcauaaa

SEQ ID NO: 3711294 - RNA, 18 nt, Salmonella enterica enterica serovar Typhi Ty2
ugccgaccgccagcagag

SEQ ID NO: 3711295 - RNA, 13 nt, Salmonella enterica enterica serovar Typhi Ty2
ugccgacggcgcu

SEQ ID NO: 3711296 - RNA, 21 nt, Salmonella enterica enterica serovar Typhi Ty2
ugccgagcaacagaaaccaua

SEQ ID NO: 3711297 - RNA, 21 nt, Salmonella enterica enterica serovar Typhi Ty2
ugccgauaauaaacgcgccaa

SEQ ID NO: 3711298 - RNA, 18 nt, Salmonella enterica enterica serovar Typhi Ty2
ugccgaucaccagcgcau

SEQ ID NO: 3711299 - RNA, 17 nt, Salmonella enterica enterica serovar Typhi Ty2
ugccgaugaaagagcgc

SEQ ID NO: 3711300 - RNA, 16 nt, Salmonella enterica enterica serovar Typhi Ty2
ugccgaugacucccag

SEQ ID NO: 3711301 - RNA, 16 nt, Salmonella enterica enterica serovar Typhi Ty2
ugccgaugccgccgca

SEQ ID NO: 3711302 - RNA, 13 nt, Salmonella enterica enterica serovar Typhi Ty2
ugccgcaaaaaug

SEQ ID NO: 3711303 - RNA, 19 nt, Salmonella enterica enterica serovar Typhi Ty2
ugccgcagccacauuguau

SEQ ID NO: 3711304 - RNA, 21 nt, Salmonella enterica enterica serovar Typhi Ty2
ugccgcagccgcucaggguaa

SEQ ID NO: 3711305 - RNA, 14 nt, Salmonella enterica enterica serovar Typhi Ty2
ugccgcagcgcagu

SEQ ID NO: 3711306 - RNA, 19 nt, Salmonella enterica enterica serovar Typhi Ty2
ugccgcaucuucgcccggc

SEQ ID NO: 3711307 - RNA, 14 nt, Salmonella enterica enterica serovar Typhi Ty2
ugccgccacgccgc

SEQ ID NO: 3711308 - RNA, 22 nt, Salmonella enterica enterica serovar Typhi Ty2
ugccgccacgccgcuccacagc

SEQ ID NO: 3711309 - RNA, 21 nt, Salmonella enterica enterica serovar Typhi Ty2
ugccgccaguuguucaacaua

SEQ ID NO: 3711310 - RNA, 23 nt, Salmonella enterica enterica serovar Typhi Ty2
ugccgccaucagcgucagcagag

SEQ ID NO: 3711311 - RNA, 20 nt, Salmonella enterica enterica serovar Typhi Ty2
ugccgccaucucacgcaugg

SEQ ID NO: 3711312 - RNA, 20 nt, Salmonella enterica enterica serovar Typhi Ty2
ugccgccauuauucugaauu

SEQ ID NO: 3711313 - RNA, 15 nt, Salmonella enterica enterica serovar Typhi Ty2
ugccgcccaggccug

SEQ ID NO: 3711314 - RNA, 20 nt, Salmonella enterica enterica serovar Typhi Ty2
ugccgcccagggaaagauca

SEQ ID NO: 3711315 - RNA, 19 nt, Salmonella enterica enterica serovar Typhi Ty2
ugccgcccaucgccacagc

SEQ ID NO: 3711316 - RNA, 21 nt, Salmonella enterica enterica serovar Typhi Ty2
ugccgcccguuuuuuccagcg

SEQ ID NO: 3711317 - RNA, 21 nt, Salmonella enterica enterica serovar Typhi Ty2
ugccgcccugaaagccgaccc

SEQ ID NO: 3711318 - RNA, 18 nt, Salmonella enterica enterica serovar Typhi Ty2
ugccgccgacaaccagcg

SEQ ID NO: 3711319 - RNA, 21 nt, Salmonella enterica enterica serovar Typhi Ty2
ugccgccgacaaccagcgaaa

SEQ ID NO: 3711320 - RNA, 14 nt, Salmonella enterica enterica serovar Typhi Ty2
ugccgccgcaccac

SEQ ID NO: 3711321 - RNA, 19 nt, Salmonella enterica enterica serovar Typhi Ty2
ugccgccggaccaucuucc

SEQ ID NO: 3711322 - RNA, 20 nt, Salmonella enterica enterica serovar Typhi Ty2
ugccgccgguugggcagaaa

SEQ ID NO: 3711323 - RNA, 20 nt, Salmonella enterica enterica serovar Typhi Ty2
ugccgccguucucauugcug

SEQ ID NO: 3711324 - RNA, 23 nt, Salmonella enterica enterica serovar Typhi Ty2
ugccgcgaccacgcauaccagcc

SEQ ID NO: 3711325 - RNA, 18 nt, Salmonella enterica enterica serovar Typhi Ty2
ugccgcgccugccauagc

SEQ ID NO: 3711326 - RNA, 23 nt, Salmonella enterica enterica serovar Typhi Ty2
ugccgcgcuggugggacuguuca

SEQ ID NO: 3711327 - RNA, 17 nt, Salmonella enterica enterica serovar Typhi Ty2
ugccgcuggcguauucg

SEQ ID NO: 3711328 - RNA, 19 nt, Salmonella enterica enterica serovar Typhi Ty2
ugccgcuuaaauuaccgcc

SEQ ID NO: 3711329 - RNA, 23 nt, Salmonella enterica enterica serovar Typhi Ty2
ugccggaaagacggcagcgccau

SEQ ID NO: 3711330 - RNA, 23 nt, Salmonella enterica enterica serovar Typhi Ty2
ugccggaaaucgcggcgauggaa

SEQ ID NO: 3711331 - RNA, 19 nt, Salmonella enterica enterica serovar Typhi Ty2
ugccggaagcggacgggcg

SEQ ID NO: 3711332 - RNA, 14 nt, Salmonella enterica enterica serovar Typhi Ty2
ugccggacgccacc

SEQ ID NO: 3711333 - RNA, 15 nt, Salmonella enterica enterica serovar Typhi Ty2
ugccggacugauacc

SEQ ID NO: 3711334 - RNA, 20 nt, Salmonella enterica enterica serovar Typhi Ty2
ugccggaucaggcguugugc

SEQ ID NO: 3711335 - RNA, 16 nt, Salmonella enterica enterica serovar Typhi Ty2
ugccggauggcggcuu

SEQ ID NO: 3711336 - RNA, 23 nt, Salmonella enterica enterica serovar Typhi Ty2
ugccggauggcgguauaacugcc

SEQ ID NO: 3711337 - RNA, 13 nt, Salmonella enterica enterica serovar Typhi Ty2
ugccggauggcgu

SEQ ID NO: 3711338 - RNA, 24 nt, Salmonella enterica enterica serovar Typhi Ty2
ugccggauucacuuucgacgacaa

SEQ ID NO: 3711339 - RNA, 15 nt, Salmonella enterica enterica serovar Typhi Ty2
ugccggcgaccaugc

SEQ ID NO: 3711340 - RNA, 22 nt, Salmonella enterica enterica serovar Typhi Ty2
ugccggcuaauaguuagccuga

SEQ ID NO: 3711341 - RNA, 13 nt, Salmonella enterica enterica serovar Typhi Ty2
ugccgggaaaacg

SEQ ID NO: 3711342 - RNA, 16 nt, Salmonella enterica enterica serovar Typhi Ty2
ugccgggaaaacggcc

SEQ ID NO: 3711343 - RNA, 13 nt, Salmonella enterica enterica serovar Typhi Ty2
ugccgggcaaaaa

SEQ ID NO: 3711344 - RNA, 15 nt, Salmonella enterica enterica serovar Typhi Ty2
ugccgggcaaaaaac

SEQ ID NO: 3711345 - RNA, 15 nt, Salmonella enterica enterica serovar Typhi Ty2
ugccgggccuggcau

SEQ ID NO: 3711346 - RNA, 16 nt, Salmonella enterica enterica serovar Typhi Ty2
ugccgggugcggcgcu

SEQ ID NO: 3711347 - RNA, 23 nt, Salmonella enterica enterica serovar Typhi Ty2
ugccggguucguuaacccggcau

SEQ ID NO: 3711348 - RNA, 13 nt, Salmonella enterica enterica serovar Typhi Ty2
ugccggucggcgu

SEQ ID NO: 3711349 - RNA, 15 nt, Salmonella enterica enterica serovar Typhi Ty2
ugccggugcgagaaa

SEQ ID NO: 3711350 - RNA, 17 nt, Salmonella enterica enterica serovar Typhi Ty2
ugccggugcgagaaaaa

SEQ ID NO: 3711351 - RNA, 18 nt, Salmonella enterica enterica serovar Typhi Ty2
ugccggugcgagaaaaag

SEQ ID NO: 3711352 - RNA, 14 nt, Salmonella enterica enterica serovar Typhi Ty2
ugccggugguggug

SEQ ID NO: 3711353 - RNA, 14 nt, Salmonella enterica enterica serovar Typhi Ty2
ugccguaggcaacg

SEQ ID NO: 3711354 - RNA, 16 nt, Salmonella enterica enterica serovar Typhi Ty2
ugcgaggggccaaaac

SEQ ID NO: 3711355 - RNA, 17 nt, Salmonella enterica enterica serovar Typhi Ty2
ugcgaggucaccgggcg

SEQ ID NO: 3711356 - RNA, 18 nt, Salmonella enterica enterica serovar Typhi Ty2
ugcgaggucaccgggcga

SEQ ID NO: 3711357 - RNA, 17 nt, Salmonella enterica enterica serovar Typhi Ty2
ugcgaguagcaaauccc

SEQ ID NO: 3711358 - RNA, 18 nt, Salmonella enterica enterica serovar Typhi Ty2
ugcgagucgucaguucca

SEQ ID NO: 3711359 - RNA, 22 nt, Salmonella enterica enterica serovar Typhi Ty2
ugcgauaaugaagcauaaaaag

SEQ ID NO: 3711360 - RNA, 23 nt, Salmonella enterica enterica serovar Typhi Ty2
ugcgaucguaaucacccgcuucc

SEQ ID NO: 3711361 - RNA, 19 nt, Salmonella enterica enterica serovar Typhi Ty2
ugcgaucuccuuuaaugaa

SEQ ID NO: 3711362 - RNA, 19 nt, Salmonella enterica enterica serovar Typhi Ty2
ugcgaucugugucguccag

SEQ ID NO: 3711363 - RNA, 19 nt, Salmonella enterica enterica serovar Typhi Ty2
ugcgaugagauccgggcug

SEQ ID NO: 3711364 - RNA, 21 nt, Salmonella enterica enterica serovar Typhi Ty2
ugcgcaacaugccugauggcg

SEQ ID NO: 3711365 - RNA, 20 nt, Salmonella enterica enterica serovar Typhi Ty2
ugcgcaacguuucuuucauc

SEQ ID NO: 3711366 - RNA, 22 nt, Salmonella enterica enterica serovar Typhi Ty2
ugcgcaacguuucuuucaucag

SEQ ID NO: 3711367 - RNA, 12 nt, Salmonella enterica enterica serovar Typhi Ty2
ugcgcacucaga

SEQ ID NO: 3711368 - RNA, 20 nt, Salmonella enterica enterica serovar Typhi Ty2
ugcgcagcaugaucggcugg

SEQ ID NO: 3711369 - RNA, 18 nt, Salmonella enterica enterica serovar Typhi Ty2
ugcgcagcguuuccagac

SEQ ID NO: 3711370 - RNA, 18 nt, Salmonella enterica enterica serovar Typhi Ty2
ugcgcaggccgcgccgcu

SEQ ID NO: 3711371 - RNA, 21 nt, Salmonella enterica enterica serovar Typhi Ty2
ugcgcagguaaaaccagauac

SEQ ID NO: 3711372 - RNA, 20 nt, Salmonella enterica enterica serovar Typhi Ty2
ugcgcaguuuaaaucacagg

SEQ ID NO: 3711373 - RNA, 21 nt, Salmonella enterica enterica serovar Typhi Ty2
ugcgcauccgcggcgcuuugc

SEQ ID NO: 3711374 - RNA, 19 nt, Salmonella enterica enterica serovar Typhi Ty2
ugcgcaugugagcaucggc

SEQ ID NO: 3711375 - RNA, 16 nt, Salmonella enterica enterica serovar Typhi Ty2
ugcgcauuaacgccau

SEQ ID NO: 3711376 - RNA, 20 nt, Salmonella enterica enterica serovar Typhi Ty2
ugcgccaacgaagagaccug

SEQ ID NO: 3711377 - RNA, 13 nt, Salmonella enterica enterica serovar Typhi Ty2
ugcgccaacguca

SEQ ID NO: 3711378 - RNA, 19 nt, Salmonella enterica enterica serovar Typhi Ty2
ugcgccaacugcauuucau

SEQ ID NO: 3711379 - RNA, 23 nt, Salmonella enterica enterica serovar Typhi Ty2
ugcgccaagaccgccuaacagcg

SEQ ID NO: 3711380 - RNA, 17 nt, Salmonella enterica enterica serovar Typhi Ty2
ugcgccaccagcgcagu

SEQ ID NO: 3711381 - RNA, 11 nt, Salmonella enterica enterica serovar Typhi Ty2
ugcgccacgac

SEQ ID NO: 3711382 - RNA, 19 nt, Salmonella enterica enterica serovar Typhi Ty2
ugcgccagaauugccugau

SEQ ID NO: 3711383 - RNA, 20 nt, Salmonella enterica enterica serovar Typhi Ty2
ugcgccagccagcucaccag

SEQ ID NO: 3711384 - RNA, 23 nt, Salmonella enterica enterica serovar Typhi Ty2
ugcgccagccagucgccaggcaa

SEQ ID NO: 3711385 - RNA, 22 nt, Salmonella enterica enterica serovar Typhi Ty2
ugcgccagccggauacugcgcu

SEQ ID NO: 3711386 - RNA, 17 nt, Salmonella enterica enterica serovar Typhi Ty2
ugcgccagccuuauccc

SEQ ID NO: 3711387 - RNA, 18 nt, Salmonella enterica enterica serovar Typhi Ty2
ugcgccagcgugcuaagc

SEQ ID NO: 3711388 - RNA, 17 nt, Salmonella enterica enterica serovar Typhi Ty2
ugcgccaggcagcaccu

SEQ ID NO: 3711389 - RNA, 19 nt, Salmonella enterica enterica serovar Typhi Ty2
ugcgccaucauccggcaac

SEQ ID NO: 3711390 - RNA, 18 nt, Salmonella enterica enterica serovar Typhi Ty2
ugcgccauccaccaggca

SEQ ID NO: 3711391 - RNA, 21 nt, Salmonella enterica enterica serovar Typhi Ty2
ugcgccaucgcgaccggauca

SEQ ID NO: 3711392 - RNA, 21 nt, Salmonella enterica enterica serovar Typhi Ty2
ugcgccaucggcgcugauugc

SEQ ID NO: 3711393 - RNA, 20 nt, Salmonella enterica enterica serovar Typhi Ty2
ugcgccauucuuucgcguaa

SEQ ID NO: 3711394 - RNA, 23 nt, Salmonella enterica enterica serovar Typhi Ty2
ugcgccauugccguaucagcaag

SEQ ID NO: 3711395 - RNA, 19 nt, Salmonella enterica enterica serovar Typhi Ty2
ugcgccauuucaauaauau

SEQ ID NO: 3711396 - RNA, 14 nt, Salmonella enterica enterica serovar Typhi Ty2
ugcgccauuuccag

SEQ ID NO: 3711397 - RNA, 20 nt, Salmonella enterica enterica serovar Typhi Ty2
ugcgccauuuccagccccga

SEQ ID NO: 3711398 - RNA, 15 nt, Salmonella enterica enterica serovar Typhi Ty2
ugcgcccaucaucau

SEQ ID NO: 3711399 - RNA, 21 nt, Salmonella enterica enterica serovar Typhi Ty2
ugcgccccagcaugagccagc

SEQ ID NO: 3711400 - RNA, 22 nt, Salmonella enterica enterica serovar Typhi Ty2
ugcgccccgcaacgccgauaag

SEQ ID NO: 3711401 - RNA, 21 nt, Salmonella enterica enterica serovar Typhi Ty2
ugcgccccggcggcguacagc

SEQ ID NO: 3711402 - RNA, 23 nt, Salmonella enterica enterica serovar Typhi Ty2
ugcgccgacaucgccaccgcaug

SEQ ID NO: 3711403 - RNA, 19 nt, Salmonella enterica enterica serovar Typhi Ty2
ugcgccgcacuucacgcuc

SEQ ID NO: 3711404 - RNA, 16 nt, Salmonella enterica enterica serovar Typhi Ty2
ugcgccgccagcgaca

SEQ ID NO: 3711405 - RNA, 18 nt, Salmonella enterica enterica serovar Typhi Ty2
ugcgccgccauccggcga

SEQ ID NO: 3711406 - RNA, 21 nt, Salmonella enterica enterica serovar Typhi Ty2
ugcgccggcugcgcugccagc

SEQ ID NO: 3711407 - RNA, 22 nt, Salmonella enterica enterica serovar Typhi Ty2
ugcgccggcugcgcugccagcu

SEQ ID NO: 3711408 - RNA, 19 nt, Salmonella enterica enterica serovar Typhi Ty2
ugcgccgucaggcuugccg

SEQ ID NO: 3711409 - RNA, 21 nt, Salmonella enterica enterica serovar Typhi Ty2
ugcgccgucaggcuugccgcg

SEQ ID NO: 3711410 - RNA, 19 nt, Salmonella enterica enterica serovar Typhi Ty2
ugcgccguccugcaaggca

SEQ ID NO: 3711411 - RNA, 14 nt, Salmonella enterica enterica serovar Typhi Ty2
ugcgccgugccugg

SEQ ID NO: 3711412 - RNA, 15 nt, Salmonella enterica enterica serovar Typhi Ty2
ugcgccgugccuggc

SEQ ID NO: 3711413 - RNA, 18 nt, Salmonella enterica enterica serovar Typhi Ty2
ugcgccgugccuggcgcu

SEQ ID NO: 3711414 - RNA, 16 nt, Salmonella enterica enterica serovar Typhi Ty2
ugcgccuaccgacaaa

SEQ ID NO: 3711415 - RNA, 16 nt, Salmonella enterica enterica serovar Typhi Ty2
ugcgccuaccgccaua

SEQ ID NO: 3711416 - RNA, 20 nt, Salmonella enterica enterica serovar Typhi Ty2
ugcgccugaagauacgccag

SEQ ID NO: 3711417 - RNA, 12 nt, Salmonella enterica enterica serovar Typhi Ty2
ugcgccugcuca

SEQ ID NO: 3711418 - RNA, 14 nt, Salmonella enterica enterica serovar Typhi Ty2
ugcgccuggcggua

SEQ ID NO: 3711419 - RNA, 23 nt, Salmonella enterica enterica serovar Typhi Ty2
ugcgccugggugggcggaaaacu

SEQ ID NO: 3711420 - RNA, 20 nt, Salmonella enterica enterica serovar Typhi Ty2
ugcgccugucuccagcgccg

SEQ ID NO: 3711421 - RNA, 18 nt, Salmonella enterica enterica serovar Typhi Ty2
ugcgccugugguuuaaaa

SEQ ID NO: 3711422 - RNA, 22 nt, Salmonella enterica enterica serovar Typhi Ty2
ugcgccuguuagggcgcggcug

SEQ ID NO: 3711423 - RNA, 23 nt, Salmonella enterica enterica serovar Typhi Ty2
ugcgccuguuagggcgcggcugg

SEQ ID NO: 3711424 - RNA, 15 nt, Salmonella enterica enterica serovar Typhi Ty2
ugcgccuuaucaagc

SEQ ID NO: 3711425 - RNA, 23 nt, Salmonella enterica enterica serovar Typhi Ty2
ugcgccuuaucaagccuacaccu

SEQ ID NO: 3711426 - RNA, 18 nt, Salmonella enterica enterica serovar Typhi Ty2
ugcgccuuauccggcgug

SEQ ID NO: 3711427 - RNA, 17 nt, Salmonella enterica enterica serovar Typhi Ty2
ugcgcgacgacgccagc

SEQ ID NO: 3711428 - RNA, 18 nt, Salmonella enterica enterica serovar Typhi Ty2
ugcgcgacgacgccagcc

SEQ ID NO: 3711429 - RNA, 22 nt, Salmonella enterica enterica serovar Typhi Ty2
ugcgcgacgacgccagccagcc

SEQ ID NO: 3711430 - RNA, 14 nt, Salmonella enterica enterica serovar Typhi Ty2
ugcgcgauaucugc

SEQ ID NO: 3711431 - RNA, 23 nt, Salmonella enterica enterica serovar Typhi Ty2
ugcgcgccauacuuacugcuguc

SEQ ID NO: 3711432 - RNA, 22 nt, Salmonella enterica enterica serovar Typhi Ty2
ugcgcgccgcccugcaucaugc

SEQ ID NO: 3711433 - RNA, 22 nt, Salmonella enterica enterica serovar Typhi Ty2
ugcgcgccgggcuucauaccgu

SEQ ID NO: 3711434 - RNA, 17 nt, Salmonella enterica enterica serovar Typhi Ty2
ugcgcgcgaugcugcuc

SEQ ID NO: 3711435 - RNA, 17 nt, Salmonella enterica enterica serovar Typhi Ty2
ugcggucaaaagcugca

SEQ ID NO: 3711436 - RNA, 15 nt, Salmonella enterica enterica serovar Typhi Ty2
ugcggucuccugaac

SEQ ID NO: 3711437 - RNA, 17 nt, Salmonella enterica enterica serovar Typhi Ty2
ugcgguuaaaccaggcg

SEQ ID NO: 3711438 - RNA, 15 nt, Salmonella enterica enterica serovar Typhi Ty2
ugcgguucucccggc

SEQ ID NO: 3711439 - RNA, 17 nt, Salmonella enterica enterica serovar Typhi Ty2
ugcgguucucccggcau

SEQ ID NO: 3711440 - RNA, 22 nt, Salmonella enterica enterica serovar Typhi Ty2
ugcgguuuuccugaugauauuu

SEQ ID NO: 3711441 - RNA, 15 nt, Salmonella enterica enterica serovar Typhi Ty2
ugcguaaucuuuuca

SEQ ID NO: 3711442 - RNA, 21 nt, Salmonella enterica enterica serovar Typhi Ty2
ugcguaaucuuuucauauuau

SEQ ID NO: 3711443 - RNA, 19 nt, Salmonella enterica enterica serovar Typhi Ty2
ugcguaaugagcgucgcca

SEQ ID NO: 3711444 - RNA, 22 nt, Salmonella enterica enterica serovar Typhi Ty2
ugcguaccgcuaucgccaaacu

SEQ ID NO: 3711445 - RNA, 19 nt, Salmonella enterica enterica serovar Typhi Ty2
ugcguagacgaugcaggcc

SEQ ID NO: 3711446 - RNA, 20 nt, Salmonella enterica enterica serovar Typhi Ty2
ugcguaggggcgaccgggcg

SEQ ID NO: 3711447 - RNA, 15 nt, Salmonella enterica enterica serovar Typhi Ty2
ugcguaucgcccacc

SEQ ID NO: 3711448 - RNA, 15 nt, Salmonella enterica enterica serovar Typhi Ty2
ugcgucaccgggcug

SEQ ID NO: 3711449 - RNA, 16 nt, Salmonella enterica enterica serovar Typhi Ty2
ugcgucagcgcccgau

SEQ ID NO: 3711450 - RNA, 17 nt, Salmonella enterica enterica serovar Typhi Ty2
ugcgucaggcgauagcc

SEQ ID NO: 3711451 - RNA, 13 nt, Salmonella enterica enterica serovar Typhi Ty2
ugcgucaguaccu

SEQ ID NO: 3711452 - RNA, 17 nt, Salmonella enterica enterica serovar Typhi Ty2
ugcgucgccccaaucgc

SEQ ID NO: 3711453 - RNA, 19 nt, Salmonella enterica enterica serovar Typhi Ty2
ugcgucgcgcuuucaaucg

SEQ ID NO: 3711454 - RNA, 17 nt, Salmonella enterica enterica serovar Typhi Ty2
ugcgucgcguaccagcg

SEQ ID NO: 3711455 - RNA, 18 nt, Salmonella enterica enterica serovar Typhi Ty2
ugcgucggcaccauuccc

SEQ ID NO: 3711456 - RNA, 15 nt, Salmonella enterica enterica serovar Typhi Ty2
ugcgucuuaauggug

SEQ ID NO: 3711457 - RNA, 14 nt, Salmonella enterica enterica serovar Typhi Ty2
ugcgugaugcugca

SEQ ID NO: 3711458 - RNA, 23 nt, Salmonella enterica enterica serovar Typhi Ty2
ugcguuaaacgcugugaccagua

SEQ ID NO: 3711459 - RNA, 23 nt, Salmonella enterica enterica serovar Typhi Ty2
ugcguuaacccgcuuacaauuua

SEQ ID NO: 3711460 - RNA, 23 nt, Salmonella enterica enterica serovar Typhi Ty2
ugcguuaacggcuucguuucaga

SEQ ID NO: 3711461 - RNA, 22 nt, Salmonella enterica enterica serovar Typhi Ty2
ugcguucuauugucaccgggcg

SEQ ID NO: 3711462 - RNA, 14 nt, Salmonella enterica enterica serovar Typhi Ty2
ugcguugaccagcg

SEQ ID NO: 3711463 - RNA, 15 nt, Salmonella enterica enterica serovar Typhi Ty2
ugcguugcuauggca

SEQ ID NO: 3711464 - RNA, 23 nt, Salmonella enterica enterica serovar Typhi Ty2
ugcguuggaagugcguuaacccg

SEQ ID NO: 3711465 - RNA, 13 nt, Salmonella enterica enterica serovar Typhi Ty2
ugcuaaaagaagc

SEQ ID NO: 3711466 - RNA, 16 nt, Salmonella enterica enterica serovar Typhi Ty2
ugcuaaaagaagcugu

SEQ ID NO: 3711467 - RNA, 14 nt, Salmonella enterica enterica serovar Typhi Ty2
ugcuaacagugaaa

SEQ ID NO: 3711468 - RNA, 22 nt, Salmonella enterica enterica serovar Typhi Ty2
ugcuaccguuuucgccuuugcg

SEQ ID NO: 3711469 - RNA, 23 nt, Salmonella enterica enterica serovar Typhi Ty2
ugcuacgaaccugauuguuuuac

SEQ ID NO: 3711470 - RNA, 20 nt, Salmonella enterica enterica serovar Typhi Ty2
ugcuacgggcgcugucgccg

SEQ ID NO: 3711471 - RNA, 18 nt, Salmonella enterica enterica serovar Typhi Ty2
ugcuaggaacagugacaa

SEQ ID NO: 3711472 - RNA, 21 nt, Salmonella enterica enterica serovar Typhi Ty2
ugcuauaugcaggcauaaaaa

SEQ ID NO: 3711473 - RNA, 23 nt, Salmonella enterica enterica serovar Typhi Ty2
ugcuauaugcaggcauaaaaaag

SEQ ID NO: 3711474 - RNA, 14 nt, Salmonella enterica enterica serovar Typhi Ty2
ugcuaucccaggcg

SEQ ID NO: 3711475 - RNA, 15 nt, Salmonella enterica enterica serovar Typhi Ty2
ugcuauccgccgcca

SEQ ID NO: 3711476 - RNA, 18 nt, Salmonella enterica enterica serovar Typhi Ty2
ugcuaugauaagccugac

SEQ ID NO: 3711477 - RNA, 14 nt, Salmonella enterica enterica serovar Typhi Ty2
ugcuauucagcagu

SEQ ID NO: 3711478 - RNA, 17 nt, Salmonella enterica enterica serovar Typhi Ty2
ugcucaaccaugauaac

SEQ ID NO: 3711479 - RNA, 16 nt, Salmonella enterica enterica serovar Typhi Ty2
ugcucaacuuccagag

SEQ ID NO: 3711480 - RNA, 17 nt, Salmonella enterica enterica serovar Typhi Ty2
ugcucaacuuccagagc

SEQ ID NO: 3711481 - RNA, 17 nt, Salmonella enterica enterica serovar Typhi Ty2
ugcucaauaagccaugu

SEQ ID NO: 3711482 - RNA, 13 nt, Salmonella enterica enterica serovar Typhi Ty2
ugcucaauauuau

SEQ ID NO: 3711483 - RNA, 17 nt, Salmonella enterica enterica serovar Typhi Ty2
ugcucaaucacuuuugc

SEQ ID NO: 3711484 - RNA, 23 nt, Salmonella enterica enterica serovar Typhi Ty2
ugcucaauuauacgcuggugcag

SEQ ID NO: 3711485 - RNA, 18 nt, Salmonella enterica enterica serovar Typhi Ty2
ugcucagccaaacuccuc

SEQ ID NO: 3711486 - RNA, 13 nt, Salmonella enterica enterica serovar Typhi Ty2
ugcucaggcaaca

SEQ ID NO: 3711487 - RNA, 21 nt, Salmonella enterica enterica serovar Typhi Ty2
ugcucagggcauccgccgccg

SEQ ID NO: 3711488 - RNA, 23 nt, Salmonella enterica enterica serovar Typhi Ty2
ugcucaucgucuuucuccaugcu

SEQ ID NO: 3711489 - RNA, 18 nt, Salmonella enterica enterica serovar Typhi Ty2
ugcucaugcgagguauac

SEQ ID NO: 3711490 - RNA, 17 nt, Salmonella enterica enterica serovar Typhi Ty2
ugcuccaugacguucaa

SEQ ID NO: 3711491 - RNA, 12 nt, Salmonella enterica enterica serovar Typhi Ty2
ugcuccaugauc

SEQ ID NO: 3711492 - RNA, 13 nt, Salmonella enterica enterica serovar Typhi Ty2
ugcucccacagcu

SEQ ID NO: 3711493 - RNA, 20 nt, Salmonella enterica enterica serovar Typhi Ty2
ugcuccccaaccgccagcca

SEQ ID NO: 3711494 - RNA, 14 nt, Salmonella enterica enterica serovar Typhi Ty2
ugcucccccaguug

SEQ ID NO: 3711495 - RNA, 13 nt, Salmonella enterica enterica serovar Typhi Ty2
ugcuccggcuuaa

SEQ ID NO: 3711496 - RNA, 23 nt, Salmonella enterica enterica serovar Typhi Ty2
ugcuccggcuuaaugcccggccc

SEQ ID NO: 3711497 - RNA, 12 nt, Salmonella enterica enterica serovar Typhi Ty2
ugcuccgggcca

SEQ ID NO: 3711498 - RNA, 19 nt, Salmonella enterica enterica serovar Typhi Ty2
ugcucgaaauccucacggu

SEQ ID NO: 3711499 - RNA, 18 nt, Salmonella enterica enterica serovar Typhi Ty2
ugcucgauauauuuuccg

SEQ ID NO: 3711500 - RNA, 17 nt, Salmonella enterica enterica serovar Typhi Ty2
ugcucuaccaacugagc

SEQ ID NO: 3711501 - RNA, 19 nt, Salmonella enterica enterica serovar Typhi Ty2
ugcucuaccaacugagcua

SEQ ID NO: 3711502 - RNA, 16 nt, Salmonella enterica enterica serovar Typhi Ty2
ugcucuccacgccgca

SEQ ID NO: 3711503 - RNA, 20 nt, Salmonella enterica enterica serovar Typhi Ty2
ugcucuccacgccgcaagga

SEQ ID NO: 3711504 - RNA, 17 nt, Salmonella enterica enterica serovar Typhi Ty2
ugcucucccagcugagc

SEQ ID NO: 3711505 - RNA, 19 nt, Salmonella enterica enterica serovar Typhi Ty2
ugcucucccagcugagcua

SEQ ID NO: 3711506 - RNA, 19 nt, Salmonella enterica enterica serovar Typhi Ty2
ugcucuccuggcauggcuc

SEQ ID NO: 3711507 - RNA, 15 nt, Salmonella enterica enterica serovar Typhi Ty2
ugcucugccagcgcc

SEQ ID NO: 3711508 - RNA, 22 nt, Salmonella enterica enterica serovar Typhi Ty2
ugcugaaaaagaacaauaauca

SEQ ID NO: 3711509 - RNA, 21 nt, Salmonella enterica enterica serovar Typhi Ty2
ugcugaaaaucgucucucauc

SEQ ID NO: 3711510 - RNA, 20 nt, Salmonella enterica enterica serovar Typhi Ty2
ugcugacaucucuuuuaauu

SEQ ID NO: 3711511 - RNA, 15 nt, Salmonella enterica enterica serovar Typhi Ty2
ugcugaccuuaaucc

SEQ ID NO: 3711512 - RNA, 17 nt, Salmonella enterica enterica serovar Typhi Ty2
ugcugaccuuaauccag

SEQ ID NO: 3711513 - RNA, 20 nt, Salmonella enterica enterica serovar Typhi Ty2
ugcugaccuuaauccagcag

SEQ ID NO: 3711514 - RNA, 18 nt, Salmonella enterica enterica serovar Typhi Ty2
ugcugacggagcuggcac

SEQ ID NO: 3711515 - RNA, 19 nt, Salmonella enterica enterica serovar Typhi Ty2
ugcugacguagauucugau

SEQ ID NO: 3711516 - RNA, 15 nt, Salmonella enterica enterica serovar Typhi Ty2
ugcugauaauacugc

SEQ ID NO: 3711517 - RNA, 21 nt, Salmonella enterica enterica serovar Typhi Ty2
uggcauaaccgcagcgcggcc

SEQ ID NO: 3711518 - RNA, 15 nt, Salmonella enterica enterica serovar Typhi Ty2
uggcauagccaaaga

SEQ ID NO: 3711519 - RNA, 20 nt, Salmonella enterica enterica serovar Typhi Ty2
uggcauauugcgaucuguac

SEQ ID NO: 3711520 - RNA, 22 nt, Salmonella enterica enterica serovar Typhi Ty2
uggcauauuugccccuuccgcc

SEQ ID NO: 3711521 - RNA, 15 nt, Salmonella enterica enterica serovar Typhi Ty2
uggcauggugcagcc

SEQ ID NO: 3711522 - RNA, 16 nt, Salmonella enterica enterica serovar Typhi Ty2
uggcauucuuacgaua

SEQ ID NO: 3711523 - RNA, 14 nt, Salmonella enterica enterica serovar Typhi Ty2
uggcauuggcaucu

SEQ ID NO: 3711524 - RNA, 16 nt, Salmonella enterica enterica serovar Typhi Ty2
uggcauuggcaucugu

SEQ ID NO: 3711525 - RNA, 17 nt, Salmonella enterica enterica serovar Typhi Ty2
uggcauuggcaucuguc

SEQ ID NO: 3711526 - RNA, 15 nt, Salmonella enterica enterica serovar Typhi Ty2
uggccaagaugcuga

SEQ ID NO: 3711527 - RNA, 21 nt, Salmonella enterica enterica serovar Typhi Ty2
uggccaaucagcggguauugc

SEQ ID NO: 3711528 - RNA, 13 nt, Salmonella enterica enterica serovar Typhi Ty2
uggccacaucguu

SEQ ID NO: 3711529 - RNA, 12 nt, Salmonella enterica enterica serovar Typhi Ty2
uggccaccagcu

SEQ ID NO: 3711530 - RNA, 20 nt, Salmonella enterica enterica serovar Typhi Ty2
uggccacggagugcgcggcg

SEQ ID NO: 3711531 - RNA, 15 nt, Salmonella enterica enterica serovar Typhi Ty2
uggccaggaauaaag

SEQ ID NO: 3711532 - RNA, 16 nt, Salmonella enterica enterica serovar Typhi Ty2
uggccaggcauugaua

SEQ ID NO: 3711533 - RNA, 21 nt, Salmonella enterica enterica serovar Typhi Ty2
uggccagggcaggcagugaac

SEQ ID NO: 3711534 - RNA, 14 nt, Salmonella enterica enterica serovar Typhi Ty2
uggccaucuuccag

SEQ ID NO: 3711535 - RNA, 19 nt, Salmonella enterica enterica serovar Typhi Ty2
uggccaucuuccagcauca

SEQ ID NO: 3711536 - RNA, 17 nt, Salmonella enterica enterica serovar Typhi Ty2
uggcccagcgcgguggc

SEQ ID NO: 3711537 - RNA, 19 nt, Salmonella enterica enterica serovar Typhi Ty2
uggcccaguuaacagaaug

SEQ ID NO: 3711538 - RNA, 16 nt, Salmonella enterica enterica serovar Typhi Ty2
uggcccgcacugccga

SEQ ID NO: 3711539 - RNA, 12 nt, Salmonella enterica enterica serovar Typhi Ty2
uggccgaacacg

SEQ ID NO: 3711540 - RNA, 16 nt, Salmonella enterica enterica serovar Typhi Ty2
uggccgacggcauaac

SEQ ID NO: 3711541 - RNA, 15 nt, Salmonella enterica enterica serovar Typhi Ty2
uggccgacuggcacc

SEQ ID NO: 3711542 - RNA, 23 nt, Salmonella enterica enterica serovar Typhi Ty2
uggccgauauugccuucacccag

SEQ ID NO: 3711543 - RNA, 22 nt, Salmonella enterica enterica serovar Typhi Ty2
uggccgaugucaauuacgcacc

SEQ ID NO: 3711544 - RNA, 20 nt, Salmonella enterica enterica serovar Typhi Ty2
uggccgcaaauuccaacaua

SEQ ID NO: 3711545 - RNA, 15 nt, Salmonella enterica enterica serovar Typhi Ty2
uggccgcagcgccau

SEQ ID NO: 3711546 - RNA, 15 nt, Salmonella enterica enterica serovar Typhi Ty2
uggccgcgugcucgc

SEQ ID NO: 3711547 - RNA, 19 nt, Salmonella enterica enterica serovar Typhi Ty2
uggccgcgugcucgcggcg

SEQ ID NO: 3711548 - RNA, 16 nt, Salmonella enterica enterica serovar Typhi Ty2
uggccggucuuaugcu

SEQ ID NO: 3711549 - RNA, 21 nt, Salmonella enterica enterica serovar Typhi Ty2
uggccgugacuuguuccaguc

SEQ ID NO: 3711550 - RNA, 17 nt, Salmonella enterica enterica serovar Typhi Ty2
uggccguuuucccggca

SEQ ID NO: 3711551 - RNA, 12 nt, Salmonella enterica enterica serovar Typhi Ty2
uggccucauccg

SEQ ID NO: 3711552 - RNA, 14 nt, Salmonella enterica enterica serovar Typhi Ty2
uggccucuuaucag

SEQ ID NO: 3711553 - RNA, 21 nt, Salmonella enterica enterica serovar Typhi Ty2
uggccugcagaccuauauggc

SEQ ID NO: 3711554 - RNA, 19 nt, Salmonella enterica enterica serovar Typhi Ty2
uggccugcucaauacuuuc

SEQ ID NO: 3711555 - RNA, 17 nt, Salmonella enterica enterica serovar Typhi Ty2
uggccugcucaucaggu

SEQ ID NO: 3711556 - RNA, 15 nt, Salmonella enterica enterica serovar Typhi Ty2
uggccugcugcggua

SEQ ID NO: 3711557 - RNA, 16 nt, Salmonella enterica enterica serovar Typhi Ty2
uggccuggagaucagc

SEQ ID NO: 3711558 - RNA, 15 nt, Salmonella enterica enterica serovar Typhi Ty2
uggccuucauaccgu

SEQ ID NO: 3711559 - RNA, 13 nt, Salmonella enterica enterica serovar Typhi Ty2
uggccuucuccac

SEQ ID NO: 3711560 - RNA, 14 nt, Salmonella enterica enterica serovar Typhi Ty2
uggcgaaacgccug

SEQ ID NO: 3711561 - RNA, 18 nt, Salmonella enterica enterica serovar Typhi Ty2
uggcgaacgacucacgcg

SEQ ID NO: 3711562 - RNA, 13 nt, Salmonella enterica enterica serovar Typhi Ty2
uggcgaauacugu

SEQ ID NO: 3711563 - RNA, 20 nt, Salmonella enterica enterica serovar Typhi Ty2
uggcgaauacuguuccaggc

SEQ ID NO: 3711564 - RNA, 23 nt, Salmonella enterica enterica serovar Typhi Ty2
uggcgaauccgggaaauggcaau

SEQ ID NO: 3711565 - RNA, 17 nt, Salmonella enterica enterica serovar Typhi Ty2
uggcgaauucggcagac

SEQ ID NO: 3711566 - RNA, 15 nt, Salmonella enterica enterica serovar Typhi Ty2
uggcgaccgcugcaa

SEQ ID NO: 3711567 - RNA, 14 nt, Salmonella enterica enterica serovar Typhi Ty2
uggcgaccgggucg

SEQ ID NO: 3711568 - RNA, 21 nt, Salmonella enterica enterica serovar Typhi Ty2
uggcgaccugauugaccagca

SEQ ID NO: 3711569 - RNA, 19 nt, Salmonella enterica enterica serovar Typhi Ty2
uggcgacgaucagcgccac

SEQ ID NO: 3711570 - RNA, 23 nt, Salmonella enterica enterica serovar Typhi Ty2
uggcgacguaacugucuuauccg

SEQ ID NO: 3711571 - RNA, 19 nt, Salmonella enterica enterica serovar Typhi Ty2
uggcgacuaaccagcgcaa

SEQ ID NO: 3711572 - RNA, 16 nt, Salmonella enterica enterica serovar Typhi Ty2
uggcgagcaacuuuuu

SEQ ID NO: 3711573 - RNA, 18 nt, Salmonella enterica enterica serovar Typhi Ty2
uggcgaggaacaucagcc

SEQ ID NO: 3711574 - RNA, 22 nt, Salmonella enterica enterica serovar Typhi Ty2
uggcgaggcuuuguccuuugcu

SEQ ID NO: 3711575 - RNA, 16 nt, Salmonella enterica enterica serovar Typhi Ty2
uggcgaucacaauuac

SEQ ID NO: 3711576 - RNA, 14 nt, Salmonella enterica enterica serovar Typhi Ty2
uggcgauuuccagc

SEQ ID NO: 3711577 - RNA, 20 nt, Salmonella enterica enterica serovar Typhi Ty2
uggcgauuuccagcgaauaa

SEQ ID NO: 3711578 - RNA, 18 nt, Salmonella enterica enterica serovar Typhi Ty2
uggcgauuuucaccggcg

SEQ ID NO: 3711579 - RNA, 20 nt, Salmonella enterica enterica serovar Typhi Ty2
uggcgcacaguacgcgaccg

SEQ ID NO: 3711580 - RNA, 20 nt, Salmonella enterica enterica serovar Typhi Ty2
uggcgcacauuuacgccagc

SEQ ID NO: 3711581 - RNA, 16 nt, Salmonella enterica enterica serovar Typhi Ty2
uggcgcagcaaaccau

SEQ ID NO: 3711582 - RNA, 18 nt, Salmonella enterica enterica serovar Typhi Ty2
uggcgcaguggcgggugc

SEQ ID NO: 3711583 - RNA, 22 nt, Salmonella enterica enterica serovar Typhi Ty2
uggcgccaaaaccgcucacggu

SEQ ID NO: 3711584 - RNA, 16 nt, Salmonella enterica enterica serovar Typhi Ty2
uggcgccaugagccug

SEQ ID NO: 3711585 - RNA, 18 nt, Salmonella enterica enterica serovar Typhi Ty2
uggcgccuuuuggcagca

SEQ ID NO: 3711586 - RNA, 14 nt, Salmonella enterica enterica serovar Typhi Ty2
uggcgcgaaaacag

SEQ ID NO: 3711587 - RNA, 15 nt, Salmonella enterica enterica serovar Typhi Ty2
uggcgcgccacuucu

SEQ ID NO: 3711588 - RNA, 14 nt, Salmonella enterica enterica serovar Typhi Ty2
uggcgcgugcccag

SEQ ID NO: 3711589 - RNA, 21 nt, Salmonella enterica enterica serovar Typhi Ty2
uggcgcuacgcuuaucaggcc

SEQ ID NO: 3711590 - RNA, 14 nt, Salmonella enterica enterica serovar Typhi Ty2
uggcgcuccugaau

SEQ ID NO: 3711591 - RNA, 21 nt, Salmonella enterica enterica serovar Typhi Ty2
uggcgcucggaugugcauuga

SEQ ID NO: 3711592 - RNA, 16 nt, Salmonella enterica enterica serovar Typhi Ty2
uggcgcugccggaaag

SEQ ID NO: 3711593 - RNA, 18 nt, Salmonella enterica enterica serovar Typhi Ty2
uggcgcugcgcuuauccg

SEQ ID NO: 3711594 - RNA, 20 nt, Salmonella enterica enterica serovar Typhi Ty2
uggcgcugcguuuaucaggc

SEQ ID NO: 3711595 - RNA, 21 nt, Salmonella enterica enterica serovar Typhi Ty2
uggcgcuggccgaauagcuga

SEQ ID NO: 3711596 - RNA, 17 nt, Salmonella enterica enterica serovar Typhi Ty2
uggcgcugucgcuuacc

SEQ ID NO: 3711597 - RNA, 19 nt, Salmonella enterica enterica serovar Typhi Ty2
uggcgcuuaauacgcgaug

SEQ ID NO: 3711598 - RNA, 20 nt, Salmonella enterica enterica serovar Typhi Ty2
uggcggaauccaucccccug

SEQ ID NO: 3711599 - RNA, 14 nt, Salmonella enterica enterica serovar Typhi Ty2
uggggaaguuaugu

SEQ ID NO: 3711600 - RNA, 18 nt, Salmonella enterica enterica serovar Typhi Ty2
uggggaucgggcagacuu

SEQ ID NO: 3711601 - RNA, 16 nt, Salmonella enterica enterica serovar Typhi Ty2
uggggauuaagcgagc

SEQ ID NO: 3711602 - RNA, 15 nt, Salmonella enterica enterica serovar Typhi Ty2
uggggcaagcucagc

SEQ ID NO: 3711603 - RNA, 19 nt, Salmonella enterica enterica serovar Typhi Ty2
uggggcaagcucagcggca

SEQ ID NO: 3711604 - RNA, 15 nt, Salmonella enterica enterica serovar Typhi Ty2
uggggcaagcucuuc

SEQ ID NO: 3711605 - RNA, 20 nt, Salmonella enterica enterica serovar Typhi Ty2
uggggccuaaugagccagau

SEQ ID NO: 3711606 - RNA, 22 nt, Salmonella enterica enterica serovar Typhi Ty2
ugggguugcuucuguccuuucu

SEQ ID NO: 3711607 - RNA, 16 nt, Salmonella enterica enterica serovar Typhi Ty2
uggguaaauaccaggc

SEQ ID NO: 3711608 - RNA, 19 nt, Salmonella enterica enterica serovar Typhi Ty2
uggguaaauaccaggcacu

SEQ ID NO: 3711609 - RNA, 22 nt, Salmonella enterica enterica serovar Typhi Ty2
uggguaacgcucuuaccgcuaa

SEQ ID NO: 3711610 - RNA, 19 nt, Salmonella enterica enterica serovar Typhi Ty2
uggguacguucggacuggg

SEQ ID NO: 3711611 - RNA, 15 nt, Salmonella enterica enterica serovar Typhi Ty2
uggguagaguaaccc

SEQ ID NO: 3711612 - RNA, 14 nt, Salmonella enterica enterica serovar Typhi Ty2
uggguaucuucauc

SEQ ID NO: 3711613 - RNA, 19 nt, Salmonella enterica enterica serovar Typhi Ty2
ugggucacgauaaccaggu

SEQ ID NO: 3711614 - RNA, 20 nt, Salmonella enterica enterica serovar Typhi Ty2
uggguuauggguguuuucac

SEQ ID NO: 3711615 - RNA, 19 nt, Salmonella enterica enterica serovar Typhi Ty2
uggguuuauguaggguggc

SEQ ID NO: 3711616 - RNA, 13 nt, Salmonella enterica enterica serovar Typhi Ty2
ugguaaaauccuu

SEQ ID NO: 3711617 - RNA, 23 nt, Salmonella enterica enterica serovar Typhi Ty2
ugguaaaauuauugugagaaaag

SEQ ID NO: 3711618 - RNA, 19 nt, Salmonella enterica enterica serovar Typhi Ty2
ugguaacgccgugacggcg

SEQ ID NO: 3711619 - RNA, 21 nt, Salmonella enterica enterica serovar Typhi Ty2
ugguaaggcaaauaugcuguc

SEQ ID NO: 3711620 - RNA, 18 nt, Salmonella enterica enterica serovar Typhi Ty2
ugguaauggcgaagcccg

SEQ ID NO: 3711621 - RNA, 18 nt, Salmonella enterica enterica serovar Typhi Ty2
ugguaauuaaaggcagcg

SEQ ID NO: 3711622 - RNA, 18 nt, Salmonella enterica enterica serovar Typhi Ty2
ugguaccaaacagcagaa

SEQ ID NO: 3711623 - RNA, 12 nt, Salmonella enterica enterica serovar Typhi Ty2
ugguaccagauc

SEQ ID NO: 3711624 - RNA, 22 nt, Salmonella enterica enterica serovar Typhi Ty2
ugguaccgccaucggcgccggg

SEQ ID NO: 3711625 - RNA, 21 nt, Salmonella enterica enterica serovar Typhi Ty2
ugguacgauuucauuacgccu

SEQ ID NO: 3711626 - RNA, 16 nt, Salmonella enterica enterica serovar Typhi Ty2
ugguacguccauccgc

SEQ ID NO: 3711627 - RNA, 19 nt, Salmonella enterica enterica serovar Typhi Ty2
ugguagacaaacagcgcgc

SEQ ID NO: 3711628 - RNA, 16 nt, Salmonella enterica enterica serovar Typhi Ty2
ugguagacgcaccaga

SEQ ID NO: 3711629 - RNA, 22 nt, Salmonella enterica enterica serovar Typhi Ty2
ugguagagaucgacaaaccacu

SEQ ID NO: 3711630 - RNA, 16 nt, Salmonella enterica enterica serovar Typhi Ty2
ugguagagcaucgcgg

SEQ ID NO: 3711631 - RNA, 22 nt, Salmonella enterica enterica serovar Typhi Ty2
ugguagcgcugaugcaggcaau

SEQ ID NO: 3711632 - RNA, 19 nt, Salmonella enterica enterica serovar Typhi Ty2
ugguaggccugauaagcga

SEQ ID NO: 3711633 - RNA, 14 nt, Salmonella enterica enterica serovar Typhi Ty2
ugguauaaaucccg

SEQ ID NO: 3711634 - RNA, 17 nt, Salmonella enterica enterica serovar Typhi Ty2
ugguauaggccaggcua

SEQ ID NO: 3711635 - RNA, 15 nt, Salmonella enterica enterica serovar Typhi Ty2
ugguauucauuacag

SEQ ID NO: 3711636 - RNA, 20 nt, Salmonella enterica enterica serovar Typhi Ty2
uggucaaaaucgacagcgac

SEQ ID NO: 3711637 - RNA, 12 nt, Salmonella enterica enterica serovar Typhi Ty2
uggucagcagcc

SEQ ID NO: 3711638 - RNA, 14 nt, Salmonella enterica enterica serovar Typhi Ty2
uggucagcauaaua

SEQ ID NO: 3711639 - RNA, 22 nt, Salmonella enterica enterica serovar Typhi Ty2
uggucagcucacgcgccagcac

SEQ ID NO: 3711640 - RNA, 14 nt, Salmonella enterica enterica serovar Typhi Ty2
uggucaggcgacca

SEQ ID NO: 3711641 - RNA, 12 nt, Salmonella enterica enterica serovar Typhi Ty2
uggucaucgcgg

SEQ ID NO: 3711642 - RNA, 16 nt, Salmonella enterica enterica serovar Typhi Ty2
uggucauucccgucuc

SEQ ID NO: 3711643 - RNA, 14 nt, Salmonella enterica enterica serovar Typhi Ty2
uggucgaaaauauc

SEQ ID NO: 3711644 - RNA, 13 nt, Salmonella enterica enterica serovar Typhi Ty2
uggucgcggcuca

SEQ ID NO: 3711645 - RNA, 22 nt, Salmonella enterica enterica serovar Typhi Ty2
uggucgcgguuuacuucuucag

SEQ ID NO: 3711646 - RNA, 21 nt, Salmonella enterica enterica serovar Typhi Ty2
uggucggacgggcccuggccg

SEQ ID NO: 3711647 - RNA, 21 nt, Salmonella enterica enterica serovar Typhi Ty2
uggucggcaaucaccugcauc

SEQ ID NO: 3711648 - RNA, 23 nt, Salmonella enterica enterica serovar Typhi Ty2
uggucggcgaccagcagcgcggc

SEQ ID NO: 3711649 - RNA, 19 nt, Salmonella enterica enterica serovar Typhi Ty2
uggucggcguaacccagug

SEQ ID NO: 3711650 - RNA, 14 nt, Salmonella enterica enterica serovar Typhi Ty2
uggucgguauuauc

SEQ ID NO: 3711651 - RNA, 16 nt, Salmonella enterica enterica serovar Typhi Ty2
uggucgucagccguga

SEQ ID NO: 3711652 - RNA, 21 nt, Salmonella enterica enterica serovar Typhi Ty2
uggucguuagccagauggcug

SEQ ID NO: 3711653 - RNA, 18 nt, Salmonella enterica enterica serovar Typhi Ty2
uggucuccgccuggaacc

SEQ ID NO: 3711654 - RNA, 16 nt, Salmonella enterica enterica serovar Typhi Ty2
uggucugaaucugcuc

SEQ ID NO: 3711655 - RNA, 18 nt, Salmonella enterica enterica serovar Typhi Ty2
uggucugaaucugcuccg

SEQ ID NO: 3711656 - RNA, 16 nt, Salmonella enterica enterica serovar Typhi Ty2
uggucugacccgcgaa

SEQ ID NO: 3711657 - RNA, 21 nt, Salmonella enterica enterica serovar Typhi Ty2
uggucuguagauagcuaucca

SEQ ID NO: 3711658 - RNA, 23 nt, Salmonella enterica enterica serovar Typhi Ty2
uggucuuaaugcugcgguugagc

SEQ ID NO: 3711659 - RNA, 14 nt, Salmonella enterica enterica serovar Typhi Ty2
uggugacaucgccg

SEQ ID NO: 3711660 - RNA, 20 nt, Salmonella enterica enterica serovar Typhi Ty2
uggugacguuuuuuggcaga

SEQ ID NO: 3711661 - RNA, 21 nt, Salmonella enterica enterica serovar Typhi Ty2
uggugagagcacguaggccug

SEQ ID NO: 3711662 - RNA, 18 nt, Salmonella enterica enterica serovar Typhi Ty2
uggugagcuccagcccgc

SEQ ID NO: 3711663 - RNA, 16 nt, Salmonella enterica enterica serovar Typhi Ty2
uggugauauaaacggg

SEQ ID NO: 3711664 - RNA, 17 nt, Salmonella enterica enterica serovar Typhi Ty2
uggugauccagcguagc

SEQ ID NO: 3711665 - RNA, 23 nt, Salmonella enterica enterica serovar Typhi Ty2
uggugaucuggccaauuuuucac

SEQ ID NO: 3711666 - RNA, 21 nt, Salmonella enterica enterica serovar Typhi Ty2
uggugaugaacaugcccggau

SEQ ID NO: 3711667 - RNA, 20 nt, Salmonella enterica enterica serovar Typhi Ty2
uggugcaagcaccuuauccg

SEQ ID NO: 3711668 - RNA, 12 nt, Salmonella enterica enterica serovar Typhi Ty2
uggugcauuuuu

SEQ ID NO: 3711669 - RNA, 16 nt, Salmonella enterica enterica serovar Typhi Ty2
uggugccaaucuccag

SEQ ID NO: 3711670 - RNA, 17 nt, Salmonella enterica enterica serovar Typhi Ty2
uggugccguuacuguuu

SEQ ID NO: 3711671 - RNA, 22 nt, Salmonella enterica enterica serovar Typhi Ty2
uggugcucaggaucaauucuga

SEQ ID NO: 3711672 - RNA, 16 nt, Salmonella enterica enterica serovar Typhi Ty2
ugguggauauccagca

SEQ ID NO: 3711673 - RNA, 23 nt, Salmonella enterica enterica serovar Typhi Ty2
ugguggauauccagcauaauaug

SEQ ID NO: 3711674 - RNA, 23 nt, Salmonella enterica enterica serovar Typhi Ty2
ugguggcagaguccagcggcagc

SEQ ID NO: 3711675 - RNA, 20 nt, Salmonella enterica enterica serovar Typhi Ty2
ugguggcggucauugucgga

SEQ ID NO: 3711676 - RNA, 17 nt, Salmonella enterica enterica serovar Typhi Ty2
ugguggcuauagcucag

SEQ ID NO: 3711677 - RNA, 19 nt, Salmonella enterica enterica serovar Typhi Ty2
ugguggggccuaaugagcc

SEQ ID NO: 3711678 - RNA, 19 nt, Salmonella enterica enterica serovar Typhi Ty2
ugguggucauccgcccggc

SEQ ID NO: 3711679 - RNA, 18 nt, Salmonella enterica enterica serovar Typhi Ty2
ugguguaauugcgccagg

SEQ ID NO: 3711680 - RNA, 20 nt, Salmonella enterica enterica serovar Typhi Ty2
uguaggccugauaagcgcag

SEQ ID NO: 3711681 - RNA, 21 nt, Salmonella enterica enterica serovar Typhi Ty2
uguaggccugauagcacagcg

SEQ ID NO: 3711682 - RNA, 20 nt, Salmonella enterica enterica serovar Typhi Ty2
uguaggccugguaagcguag

SEQ ID NO: 3711683 - RNA, 17 nt, Salmonella enterica enterica serovar Typhi Ty2
uguaggguacagcgcga

SEQ ID NO: 3711684 - RNA, 17 nt, Salmonella enterica enterica serovar Typhi Ty2
uguaguuauaaauuuau

SEQ ID NO: 3711685 - RNA, 12 nt, Salmonella enterica enterica serovar Typhi Ty2
uguaguuuuuug

SEQ ID NO: 3711686 - RNA, 15 nt, Salmonella enterica enterica serovar Typhi Ty2
uguauaaacucagca

SEQ ID NO: 3711687 - RNA, 20 nt, Salmonella enterica enterica serovar Typhi Ty2
uguauaauccaacauuauca

SEQ ID NO: 3711688 - RNA, 12 nt, Salmonella enterica enterica serovar Typhi Ty2
uguauaauuauu

SEQ ID NO: 3711689 - RNA, 18 nt, Salmonella enterica enterica serovar Typhi Ty2
uguauaccaaaaauaauu

SEQ ID NO: 3711690 - RNA, 20 nt, Salmonella enterica enterica serovar Typhi Ty2
uguauagcaacuuaauaaua

SEQ ID NO: 3711691 - RNA, 13 nt, Salmonella enterica enterica serovar Typhi Ty2
uguauccacccgg

SEQ ID NO: 3711692 - RNA, 19 nt, Salmonella enterica enterica serovar Typhi Ty2
uguaucgcccugccagcuc

SEQ ID NO: 3711693 - RNA, 21 nt, Salmonella enterica enterica serovar Typhi Ty2
uguaucuucgccguauucuua

SEQ ID NO: 3711694 - RNA, 22 nt, Salmonella enterica enterica serovar Typhi Ty2
uguauuaaaggaucgauuaagg

SEQ ID NO: 3711695 - RNA, 20 nt, Salmonella enterica enterica serovar Typhi Ty2
uguauuaucgaugcgccagu

SEQ ID NO: 3711696 - RNA, 14 nt, Salmonella enterica enterica serovar Typhi Ty2
uguauugacgccga

SEQ ID NO: 3711697 - RNA, 16 nt, Salmonella enterica enterica serovar Typhi Ty2
uguauuuguucucgag

SEQ ID NO: 3711698 - RNA, 17 nt, Salmonella enterica enterica serovar Typhi Ty2
ugucaacgugugccagg

SEQ ID NO: 3711699 - RNA, 16 nt, Salmonella enterica enterica serovar Typhi Ty2
ugucaaucgccugcug

SEQ ID NO: 3711700 - RNA, 16 nt, Salmonella enterica enterica serovar Typhi Ty2
ugucacccgcuuuucc

SEQ ID NO: 3711701 - RNA, 14 nt, Salmonella enterica enterica serovar Typhi Ty2
ugucacgcaggggg

SEQ ID NO: 3711702 - RNA, 22 nt, Salmonella enterica enterica serovar Typhi Ty2
ugucacgccguguucgucgcca

SEQ ID NO: 3711703 - RNA, 19 nt, Salmonella enterica enterica serovar Typhi Ty2
ugucagaucgcccggauca

SEQ ID NO: 3711704 - RNA, 21 nt, Salmonella enterica enterica serovar Typhi Ty2
ugucagaucguaugcgccugu

SEQ ID NO: 3711705 - RNA, 15 nt, Salmonella enterica enterica serovar Typhi Ty2
ugucaggaugcugau

SEQ ID NO: 3711706 - RNA, 15 nt, Salmonella enterica enterica serovar Typhi Ty2
ugucagggcggaaca

SEQ ID NO: 3711707 - RNA, 16 nt, Salmonella enterica enterica serovar Typhi Ty2
ugucaguggacgauaa

SEQ ID NO: 3711708 - RNA, 21 nt, Salmonella enterica enterica serovar Typhi Ty2
ugucauagucggcgccaaagu

SEQ ID NO: 3711709 - RNA, 16 nt, Salmonella enterica enterica serovar Typhi Ty2
ugucauauuugugagc

SEQ ID NO: 3711710 - RNA, 22 nt, Salmonella enterica enterica serovar Typhi Ty2
ugucauccaccagaauaaaggc

SEQ ID NO: 3711711 - RNA, 12 nt, Salmonella enterica enterica serovar Typhi Ty2
ugucauccugcu

SEQ ID NO: 3711712 - RNA, 17 nt, Salmonella enterica enterica serovar Typhi Ty2
ugucaucgccauccugc

SEQ ID NO: 3711713 - RNA, 15 nt, Salmonella enterica enterica serovar Typhi Ty2
ugucaucgccgcuaa

SEQ ID NO: 3711714 - RNA, 19 nt, Salmonella enterica enterica serovar Typhi Ty2
ugucauucgccucaaaacc

SEQ ID NO: 3711715 - RNA, 12 nt, Salmonella enterica enterica serovar Typhi Ty2
uguccagcagug

SEQ ID NO: 3711716 - RNA, 16 nt, Salmonella enterica enterica serovar Typhi Ty2
uguccagcagugucug

SEQ ID NO: 3711717 - RNA, 14 nt, Salmonella enterica enterica serovar Typhi Ty2
uguccagcggccau

SEQ ID NO: 3711718 - RNA, 20 nt, Salmonella enterica enterica serovar Typhi Ty2
uguccaguuuuugcauuaua

SEQ ID NO: 3711719 - RNA, 20 nt, Salmonella enterica enterica serovar Typhi Ty2
uguccaucagauucaacagg

SEQ ID NO: 3711720 - RNA, 12 nt, Salmonella enterica enterica serovar Typhi Ty2
uguccaucaggc

SEQ ID NO: 3711721 - RNA, 17 nt, Salmonella enterica enterica serovar Typhi Ty2
uguccauguaaacucca

SEQ ID NO: 3711722 - RNA, 18 nt, Salmonella enterica enterica serovar Typhi Ty2
uguccauugcgagaaaaa

SEQ ID NO: 3711723 - RNA, 19 nt, Salmonella enterica enterica serovar Typhi Ty2
uguccauugcgagaaaaaa

SEQ ID NO: 3711724 - RNA, 13 nt, Salmonella enterica enterica serovar Typhi Ty2
ugucccagccuuc

SEQ ID NO: 3711725 - RNA, 20 nt, Salmonella enterica enterica serovar Typhi Ty2
ugucccagugucaacugcgc

SEQ ID NO: 3711726 - RNA, 20 nt, Salmonella enterica enterica serovar Typhi Ty2
ugucccaucguaacgccguc

SEQ ID NO: 3711727 - RNA, 17 nt, Salmonella enterica enterica serovar Typhi Ty2
ugucccugccagcguaa

SEQ ID NO: 3711728 - RNA, 15 nt, Salmonella enterica enterica serovar Typhi Ty2
uguccgaugcagaca

SEQ ID NO: 3711729 - RNA, 23 nt, Salmonella enterica enterica serovar Typhi Ty2
uguccggcgcaaucuuugccgca

SEQ ID NO: 3711730 - RNA, 19 nt, Salmonella enterica enterica serovar Typhi Ty2
uguccggguucagcgacag

SEQ ID NO: 3711731 - RNA, 16 nt, Salmonella enterica enterica serovar Typhi Ty2
uguccgguguccauca

SEQ ID NO: 3711732 - RNA, 18 nt, Salmonella enterica enterica serovar Typhi Ty2
uguccgucuuuucugucg

SEQ ID NO: 3711733 - RNA, 15 nt, Salmonella enterica enterica serovar Typhi Ty2
uguccguuccugccg

SEQ ID NO: 3711734 - RNA, 16 nt, Salmonella enterica enterica serovar Typhi Ty2
uguccuauugcaacgc

SEQ ID NO: 3711735 - RNA, 15 nt, Salmonella enterica enterica serovar Typhi Ty2
uguccugaaggacaa

SEQ ID NO: 3711736 - RNA, 18 nt, Salmonella enterica enterica serovar Typhi Ty2
uguccuuucugcugccgc

SEQ ID NO: 3711737 - RNA, 19 nt, Salmonella enterica enterica serovar Typhi Ty2
ugucgaaauugccgcccgu

SEQ ID NO: 3711738 - RNA, 17 nt, Salmonella enterica enterica serovar Typhi Ty2
ugucgacaauaaauugc

SEQ ID NO: 3711739 - RNA, 17 nt, Salmonella enterica enterica serovar Typhi Ty2
ugucgaccgcuccacuc

SEQ ID NO: 3711740 - RNA, 21 nt, Salmonella enterica enterica serovar Typhi Ty2
ugucgagcaucuccagcgcau

SEQ ID NO: 3711741 - RNA, 23 nt, Salmonella enterica enterica serovar Typhi Ty2
ugucgcaaccgacacauucaggc

SEQ ID NO: 3711742 - RNA, 12 nt, Salmonella enterica enterica serovar Typhi Ty2
ugucgccaauaa

SEQ ID NO: 3711743 - RNA, 22 nt, Salmonella enterica enterica serovar Typhi Ty2
ugucgccaccgcuauucuucau

SEQ ID NO: 3711744 - RNA, 15 nt, Salmonella enterica enterica serovar Typhi Ty2
ugucgccggaaaaaa

SEQ ID NO: 3711745 - RNA, 14 nt, Salmonella enterica enterica serovar Typhi Ty2
ugucgccguggaac

SEQ ID NO: 3711746 - RNA, 17 nt, Salmonella enterica enterica serovar Typhi Ty2
ugucgcgagcuuccagu

SEQ ID NO: 3711747 - RNA, 18 nt, Salmonella enterica enterica serovar Typhi Ty2
ugucgcgcaauaccugua

SEQ ID NO: 3711748 - RNA, 16 nt, Salmonella enterica enterica serovar Typhi Ty2
ugucgcggauaugcag

SEQ ID NO: 3711749 - RNA, 22 nt, Salmonella enterica enterica serovar Typhi Ty2
ugucgcugaguacgcaccagcc

SEQ ID NO: 3711750 - RNA, 23 nt, Salmonella enterica enterica serovar Typhi Ty2
ugucggauggcggcguaaacgcc

SEQ ID NO: 3711751 - RNA, 23 nt, Salmonella enterica enterica serovar Typhi Ty2
ugucggccaggugccgagguuaa

SEQ ID NO: 3711752 - RNA, 17 nt, Salmonella enterica enterica serovar Typhi Ty2
ugucgggcaaaaugcgu

SEQ ID NO: 3711753 - RNA, 19 nt, Salmonella enterica enterica serovar Typhi Ty2
ugucgggccuacagaugaa

SEQ ID NO: 3711754 - RNA, 17 nt, Salmonella enterica enterica serovar Typhi Ty2
ugucggucaggcugcgg

SEQ ID NO: 3711755 - RNA, 21 nt, Salmonella enterica enterica serovar Typhi Ty2
  misc_feature (11)..(11): n is a, c, g or u
ugucggucggnuaagcgcuag

SEQ ID NO: 3711756 - RNA, 13 nt, Salmonella enterica enterica serovar Typhi Ty2
ugucguauuuauu

SEQ ID NO: 3711757 - RNA, 15 nt, Salmonella enterica enterica serovar Typhi Ty2
ugucgucguauggug

SEQ ID NO: 3711758 - RNA, 18 nt, Salmonella enterica enterica serovar Typhi Ty2
ugucguucacguaaucgc

SEQ ID NO: 3711759 - RNA, 20 nt, Salmonella enterica enterica serovar Typhi Ty2
ugucguuguaguuaucgccg

SEQ ID NO: 3711760 - RNA, 11 nt, Salmonella enterica enterica serovar Typhi Ty2
ugucuaccgcg

SEQ ID NO: 3711761 - RNA, 23 nt, Salmonella enterica enterica serovar Typhi Ty2
ugucuauaggccugauaaacgua

SEQ ID NO: 3711762 - RNA, 20 nt, Salmonella enterica enterica serovar Typhi Ty2
uguucacguaccaggcagcg

SEQ ID NO: 3711763 - RNA, 12 nt, Salmonella enterica enterica serovar Typhi Ty2
uguucagccagc

SEQ ID NO: 3711764 - RNA, 14 nt, Salmonella enterica enterica serovar Typhi Ty2
uguucagccagcaa

SEQ ID NO: 3711765 - RNA, 20 nt, Salmonella enterica enterica serovar Typhi Ty2
uguucagguacagguaauga

SEQ ID NO: 3711766 - RNA, 14 nt, Salmonella enterica enterica serovar Typhi Ty2
uguucauaaagugc

SEQ ID NO: 3711767 - RNA, 19 nt, Salmonella enterica enterica serovar Typhi Ty2
uguucauaccggauauggc

SEQ ID NO: 3711768 - RNA, 23 nt, Salmonella enterica enterica serovar Typhi Ty2
uguucauaucgaagaccuggccg

SEQ ID NO: 3711769 - RNA, 21 nt, Salmonella enterica enterica serovar Typhi Ty2
uguuccagauaauccagcguc

SEQ ID NO: 3711770 - RNA, 16 nt, Salmonella enterica enterica serovar Typhi Ty2
uguuccagggcuucca

SEQ ID NO: 3711771 - RNA, 12 nt, Salmonella enterica enterica serovar Typhi Ty2
uguuccagguuu

SEQ ID NO: 3711772 - RNA, 18 nt, Salmonella enterica enterica serovar Typhi Ty2
uguuccggaugcgggccg

SEQ ID NO: 3711773 - RNA, 22 nt, Salmonella enterica enterica serovar Typhi Ty2
uguuccggcgaggacuguacaa

SEQ ID NO: 3711774 - RNA, 14 nt, Salmonella enterica enterica serovar Typhi Ty2
uguuccugcaauau

SEQ ID NO: 3711775 - RNA, 16 nt, Salmonella enterica enterica serovar Typhi Ty2
uguuccugcgggaaca

SEQ ID NO: 3711776 - RNA, 17 nt, Salmonella enterica enterica serovar Typhi Ty2
uguuccugcuggcaaaa

SEQ ID NO: 3711777 - RNA, 20 nt, Salmonella enterica enterica serovar Typhi Ty2
uguucgcuuauuccuccgcc

SEQ ID NO: 3711778 - RNA, 15 nt, Salmonella enterica enterica serovar Typhi Ty2
uguucgcuucuucua

SEQ ID NO: 3711779 - RNA, 23 nt, Salmonella enterica enterica serovar Typhi Ty2
uguucuaaaaaguucauguaagu

SEQ ID NO: 3711780 - RNA, 13 nt, Salmonella enterica enterica serovar Typhi Ty2
uguucuaaacguu

SEQ ID NO: 3711781 - RNA, 17 nt, Salmonella enterica enterica serovar Typhi Ty2
uguucuacuacagaaag

SEQ ID NO: 3711782 - RNA, 13 nt, Salmonella enterica enterica serovar Typhi Ty2
uguucucccugcu

SEQ ID NO: 3711783 - RNA, 19 nt, Salmonella enterica enterica serovar Typhi Ty2
uguucucgaggacagugaa

SEQ ID NO: 3711784 - RNA, 20 nt, Salmonella enterica enterica serovar Typhi Ty2
uguucucgaggacagugaaa

SEQ ID NO: 3711785 - RNA, 19 nt, Salmonella enterica enterica serovar Typhi Ty2
uguucuguccauguuuuau

SEQ ID NO: 3711786 - RNA, 23 nt, Salmonella enterica enterica serovar Typhi Ty2
uguucuugcugcugcugauggcc

SEQ ID NO: 3711787 - RNA, 14 nt, Salmonella enterica enterica serovar Typhi Ty2
uguucuuuucuuuc

SEQ ID NO: 3711788 - RNA, 17 nt, Salmonella enterica enterica serovar Typhi Ty2
uguugaaagccccggcu

SEQ ID NO: 3711789 - RNA, 14 nt, Salmonella enterica enterica serovar Typhi Ty2
uguugacugcgcuc

SEQ ID NO: 3711790 - RNA, 14 nt, Salmonella enterica enterica serovar Typhi Ty2
uguugagacgguga

SEQ ID NO: 3711791 - RNA, 15 nt, Salmonella enterica enterica serovar Typhi Ty2
uguugauuaagcacg

SEQ ID NO: 3711792 - RNA, 14 nt, Salmonella enterica enterica serovar Typhi Ty2
uguugcaaauauuc

SEQ ID NO: 3711793 - RNA, 13 nt, Salmonella enterica enterica serovar Typhi Ty2
uguugccaugauc

SEQ ID NO: 3711794 - RNA, 20 nt, Salmonella enterica enterica serovar Typhi Ty2
uguugcgccauggcuucucc

SEQ ID NO: 3711795 - RNA, 15 nt, Salmonella enterica enterica serovar Typhi Ty2
uguugcgggccagca

SEQ ID NO: 3711796 - RNA, 21 nt, Salmonella enterica enterica serovar Typhi Ty2
uguugcgggccagcagccagg

SEQ ID NO: 3711797 - RNA, 14 nt, Salmonella enterica enterica serovar Typhi Ty2
uguugcuaaaucca

SEQ ID NO: 3711798 - RNA, 13 nt, Salmonella enterica enterica serovar Typhi Ty2
uguugcuccagca

SEQ ID NO: 3711799 - RNA, 18 nt, Salmonella enterica enterica serovar Typhi Ty2
uguuggucacgauccgca

SEQ ID NO: 3711800 - RNA, 22 nt, Salmonella enterica enterica serovar Typhi Ty2
uguuggugaguggccugucugg

SEQ ID NO: 3711801 - RNA, 22 nt, Salmonella enterica enterica serovar Typhi Ty2
uguuguaagggcuggaaaauca

SEQ ID NO: 3711802 - RNA, 21 nt, Salmonella enterica enterica serovar Typhi Ty2
uguugugugccgcgcuggugg

SEQ ID NO: 3711803 - RNA, 20 nt, Salmonella enterica enterica serovar Typhi Ty2
uguuguguuuagcccucugg

SEQ ID NO: 3711804 - RNA, 23 nt, Salmonella enterica enterica serovar Typhi Ty2
uguuguguuuagcccucuggcaa

SEQ ID NO: 3711805 - RNA, 21 nt, Salmonella enterica enterica serovar Typhi Ty2
uguuguucgucuuuugaauag

SEQ ID NO: 3711806 - RNA, 20 nt, Salmonella enterica enterica serovar Typhi Ty2
uguuguucuuuucuuucagc

SEQ ID NO: 3711807 - RNA, 19 nt, Salmonella enterica enterica serovar Typhi Ty2
uguuuaagcgccuccacaa

SEQ ID NO: 3711808 - RNA, 16 nt, Salmonella enterica enterica serovar Typhi Ty2
uguuuaauacgcuguc

SEQ ID NO: 3711809 - RNA, 17 nt, Salmonella enterica enterica serovar Typhi Ty2
uguuuaaugcuuucaau

SEQ ID NO: 3711810 - RNA, 19 nt, Salmonella enterica enterica serovar Typhi Ty2
uguuuaccaagcaccgcca

SEQ ID NO: 3711811 - RNA, 14 nt, Salmonella enterica enterica serovar Typhi Ty2
uguuuaccuuuacg

SEQ ID NO: 3711812 - RNA, 16 nt, Salmonella enterica enterica serovar Typhi Ty2
uguuuacgccgccauc

SEQ ID NO: 3711813 - RNA, 16 nt, Salmonella enterica enterica serovar Typhi Ty2
uguuuagacacauuga

SEQ ID NO: 3711814 - RNA, 23 nt, Salmonella enterica enterica serovar Typhi Ty2
uguuuagccuuauagagguguua

SEQ ID NO: 3711815 - RNA, 19 nt, Salmonella enterica enterica serovar Typhi Ty2
uguuuaguacgcaaggaaa

SEQ ID NO: 3711816 - RNA, 23 nt, Salmonella enterica enterica serovar Typhi Ty2
uguuuaguacgcaaggaaauauu

SEQ ID NO: 3711817 - RNA, 22 nt, Salmonella enterica enterica serovar Typhi Ty2
uguuuaucagaccuguaaaaaa

SEQ ID NO: 3711818 - RNA, 13 nt, Salmonella enterica enterica serovar Typhi Ty2
uguuuaucgggcu

SEQ ID NO: 3711819 - RNA, 20 nt, Salmonella enterica enterica serovar Typhi Ty2
uguuuauucuucgucagaug

SEQ ID NO: 3711820 - RNA, 18 nt, Salmonella enterica enterica serovar Typhi Ty2
uguuucagcaccucuuug

SEQ ID NO: 3711821 - RNA, 12 nt, Salmonella enterica enterica serovar Typhi Ty2
uguuucagcagc

SEQ ID NO: 3711822 - RNA, 15 nt, Salmonella enterica enterica serovar Typhi Ty2
uguuucaguucggag

SEQ ID NO: 3711823 - RNA, 16 nt, Salmonella enterica enterica serovar Typhi Ty2
uguuucaucucaucaa

SEQ ID NO: 3711824 - RNA, 15 nt, Salmonella enterica enterica serovar Typhi Ty2
uguuucauggagauc

SEQ ID NO: 3711825 - RNA, 14 nt, Salmonella enterica enterica serovar Typhi Ty2
uguuucccaacaau

SEQ ID NO: 3711826 - RNA, 21 nt, Salmonella enterica enterica serovar Typhi Ty2
uguuucgaccgccugcaucac

SEQ ID NO: 3711827 - RNA, 12 nt, Salmonella enterica enterica serovar Typhi Ty2
uguuucgaugua

SEQ ID NO: 3711828 - RNA, 17 nt, Salmonella enterica enterica serovar Typhi Ty2
uguuucggauaauucug

SEQ ID NO: 3711829 - RNA, 17 nt, Salmonella enterica enterica serovar Typhi Ty2
uguuucucuuccgccag

SEQ ID NO: 3711830 - RNA, 15 nt, Salmonella enterica enterica serovar Typhi Ty2
uguuucugcuggccu

SEQ ID NO: 3711831 - RNA, 23 nt, Salmonella enterica enterica serovar Typhi Ty2
uguuucuuuuaaggcggcaaaga

SEQ ID NO: 3711832 - RNA, 17 nt, Salmonella enterica enterica serovar Typhi Ty2
uguuugagaaaaacauc

SEQ ID NO: 3711833 - RNA, 21 nt, Salmonella enterica enterica serovar Typhi Ty2
uguuugcccaccguaauaguu

SEQ ID NO: 3711834 - RNA, 22 nt, Salmonella enterica enterica serovar Typhi Ty2
uguuugcccaccguaauaguuu

SEQ ID NO: 3711835 - RNA, 20 nt, Salmonella enterica enterica serovar Typhi Ty2
uguuugcgcaguugccagua

SEQ ID NO: 3711836 - RNA, 20 nt, Salmonella enterica enterica serovar Typhi Ty2
uguuugcugagaauuuccag

SEQ ID NO: 3711837 - RNA, 14 nt, Salmonella enterica enterica serovar Typhi Ty2
uguuuggguaacac

SEQ ID NO: 3711838 - RNA, 13 nt, Salmonella enterica enterica serovar Typhi Ty2
uguuuggugcuga

SEQ ID NO: 3711839 - RNA, 19 nt, Salmonella enterica enterica serovar Typhi Ty2
uguuuuaccaaaucaauag

SEQ ID NO: 3711840 - RNA, 21 nt, Salmonella enterica enterica serovar Typhi Ty2
uguuuuacuuuuuuaaauguu

SEQ ID NO: 3711841 - RNA, 20 nt, Salmonella enterica enterica serovar Typhi Ty2
uguuuuagcagaguaugcug

SEQ ID NO: 3711842 - RNA, 21 nt, Salmonella enterica enterica serovar Typhi Ty2
uguuuuauugcuucagccaga

SEQ ID NO: 3711843 - RNA, 20 nt, Salmonella enterica enterica serovar Typhi Ty2
uguuuucccagaauccgcgc

SEQ ID NO: 3711844 - RNA, 15 nt, Salmonella enterica enterica serovar Typhi Ty2
uuaaggcaucaauac

SEQ ID NO: 3711845 - RNA, 17 nt, Salmonella enterica enterica serovar Typhi Ty2
uuaaggcggcaaagaua

SEQ ID NO: 3711846 - RNA, 14 nt, Salmonella enterica enterica serovar Typhi Ty2
uuaagucauaccug

SEQ ID NO: 3711847 - RNA, 13 nt, Salmonella enterica enterica serovar Typhi Ty2
uuaauaaaaucua

SEQ ID NO: 3711848 - RNA, 15 nt, Salmonella enterica enterica serovar Typhi Ty2
uuaauacaucagaaa

SEQ ID NO: 3711849 - RNA, 18 nt, Salmonella enterica enterica serovar Typhi Ty2
uuaauacaucagaaaaca

SEQ ID NO: 3711850 - RNA, 21 nt, Salmonella enterica enterica serovar Typhi Ty2
uuaauacaucaugcuugcuuu

SEQ ID NO: 3711851 - RNA, 21 nt, Salmonella enterica enterica serovar Typhi Ty2
uuaauaccagcgccaaucacu

SEQ ID NO: 3711852 - RNA, 22 nt, Salmonella enterica enterica serovar Typhi Ty2
uuaauaccaucuccaucgggcu

SEQ ID NO: 3711853 - RNA, 14 nt, Salmonella enterica enterica serovar Typhi Ty2
uuaauacccauagu

SEQ ID NO: 3711854 - RNA, 24 nt, Salmonella enterica enterica serovar Typhi Ty2
uuaauaccgugcaggacagacaga

SEQ ID NO: 3711855 - RNA, 14 nt, Salmonella enterica enterica serovar Typhi Ty2
uuaauacgcugucg

SEQ ID NO: 3711856 - RNA, 19 nt, Salmonella enterica enterica serovar Typhi Ty2
uuaauacguacugaaauaa

SEQ ID NO: 3711857 - RNA, 21 nt, Salmonella enterica enterica serovar Typhi Ty2
uuaauauaugaaccaagauaa

SEQ ID NO: 3711858 - RNA, 17 nt, Salmonella enterica enterica serovar Typhi Ty2
uuaauauauucaucuuu

SEQ ID NO: 3711859 - RNA, 17 nt, Salmonella enterica enterica serovar Typhi Ty2
uuaauaucaauauaauu

SEQ ID NO: 3711860 - RNA, 18 nt, Salmonella enterica enterica serovar Typhi Ty2
uuaaucaagcccagcuca

SEQ ID NO: 3711861 - RNA, 13 nt, Salmonella enterica enterica serovar Typhi Ty2
uuaaucacccgcg

SEQ ID NO: 3711862 - RNA, 15 nt, Salmonella enterica enterica serovar Typhi Ty2
uuaaucaggcauuca

SEQ ID NO: 3711863 - RNA, 12 nt, Salmonella enterica enterica serovar Typhi Ty2
uuaauccagcag

SEQ ID NO: 3711864 - RNA, 22 nt, Salmonella enterica enterica serovar Typhi Ty2
uuaaucccuugcuggcgacggc

SEQ ID NO: 3711865 - RNA, 20 nt, Salmonella enterica enterica serovar Typhi Ty2
uuaauccgcggauagacgau

SEQ ID NO: 3711866 - RNA, 15 nt, Salmonella enterica enterica serovar Typhi Ty2
uuaaucgcuucaauc

SEQ ID NO: 3711867 - RNA, 15 nt, Salmonella enterica enterica serovar Typhi Ty2
uuaaucgucaucccg

SEQ ID NO: 3711868 - RNA, 21 nt, Salmonella enterica enterica serovar Typhi Ty2
uuaaucucuucaucuguggca

SEQ ID NO: 3711869 - RNA, 15 nt, Salmonella enterica enterica serovar Typhi Ty2
uuaaugaccugccgc

SEQ ID NO: 3711870 - RNA, 16 nt, Salmonella enterica enterica serovar Typhi Ty2
uuaaugacuuuuuaua

SEQ ID NO: 3711871 - RNA, 22 nt, Salmonella enterica enterica serovar Typhi Ty2
uuaaugaguagaacguauuauu

SEQ ID NO: 3711872 - RNA, 23 nt, Salmonella enterica enterica serovar Typhi Ty2
uuaaugaguagaacguauuauua

SEQ ID NO: 3711873 - RNA, 17 nt, Salmonella enterica enterica serovar Typhi Ty2
uuaaugauguccagaau

SEQ ID NO: 3711874 - RNA, 21 nt, Salmonella enterica enterica serovar Typhi Ty2
uuaaugauuugcuuuauuugu

SEQ ID NO: 3711875 - RNA, 22 nt, Salmonella enterica enterica serovar Typhi Ty2
uuaaugccgccguacaaacccu

SEQ ID NO: 3711876 - RNA, 19 nt, Salmonella enterica enterica serovar Typhi Ty2
uuaaugccuucgccgccgc

SEQ ID NO: 3711877 - RNA, 18 nt, Salmonella enterica enterica serovar Typhi Ty2
uuaaugcgcacgccagcg

SEQ ID NO: 3711878 - RNA, 12 nt, Salmonella enterica enterica serovar Typhi Ty2
uuaaugcgcgcu

SEQ ID NO: 3711879 - RNA, 17 nt, Salmonella enterica enterica serovar Typhi Ty2
uuaaugcuaucccaggc

SEQ ID NO: 3711880 - RNA, 16 nt, Salmonella enterica enterica serovar Typhi Ty2
uuaaugcuguccugca

SEQ ID NO: 3711881 - RNA, 22 nt, Salmonella enterica enterica serovar Typhi Ty2
uuaaugcuguccugcaaaauac

SEQ ID NO: 3711882 - RNA, 18 nt, Salmonella enterica enterica serovar Typhi Ty2
uuaauggcagaauaaaac

SEQ ID NO: 3711883 - RNA, 19 nt, Salmonella enterica enterica serovar Typhi Ty2
uuaauggcgcaaugucccu

SEQ ID NO: 3711884 - RNA, 15 nt, Salmonella enterica enterica serovar Typhi Ty2
uuaaugguaccaaua

SEQ ID NO: 3711885 - RNA, 23 nt, Salmonella enterica enterica serovar Typhi Ty2
uuaauggucuuaaaugccgccgg

SEQ ID NO: 3711886 - RNA, 14 nt, Salmonella enterica enterica serovar Typhi Ty2
uuaauguccagcag

SEQ ID NO: 3711887 - RNA, 20 nt, Salmonella enterica enterica serovar Typhi Ty2
uuaauguuaggaguaaauaa

SEQ ID NO: 3711888 - RNA, 21 nt, Salmonella enterica enterica serovar Typhi Ty2
uuaauguuuagucuuuuagua

SEQ ID NO: 3711889 - RNA, 19 nt, Salmonella enterica enterica serovar Typhi Ty2
uuaauuacgcacuacggca

SEQ ID NO: 3711890 - RNA, 21 nt, Salmonella enterica enterica serovar Typhi Ty2
uuaauuccucagaauccguca

SEQ ID NO: 3711891 - RNA, 20 nt, Salmonella enterica enterica serovar Typhi Ty2
uuaauuccuggcguaugcuu

SEQ ID NO: 3711892 - RNA, 18 nt, Salmonella enterica enterica serovar Typhi Ty2
uuaauucuuuuaacauaa

SEQ ID NO: 3711893 - RNA, 21 nt, Salmonella enterica enterica serovar Typhi Ty2
uuaauugcugaagauaaaauu

SEQ ID NO: 3711894 - RNA, 15 nt, Salmonella enterica enterica serovar Typhi Ty2
uuaauuugugccagc

SEQ ID NO: 3711895 - RNA, 18 nt, Salmonella enterica enterica serovar Typhi Ty2
uuaauuugugccagcgug

SEQ ID NO: 3711896 - RNA, 20 nt, Salmonella enterica enterica serovar Typhi Ty2
uuacaaauuuaaacauguca

SEQ ID NO: 3711897 - RNA, 19 nt, Salmonella enterica enterica serovar Typhi Ty2
uuacaagaauaugcagugc

SEQ ID NO: 3711898 - RNA, 18 nt, Salmonella enterica enterica serovar Typhi Ty2
uuacaaguaauaaaauaa

SEQ ID NO: 3711899 - RNA, 16 nt, Salmonella enterica enterica serovar Typhi Ty2
uuacaauguacagaau

SEQ ID NO: 3711900 - RNA, 18 nt, Salmonella enterica enterica serovar Typhi Ty2
uuacaauuuaucugcgug

SEQ ID NO: 3711901 - RNA, 19 nt, Salmonella enterica enterica serovar Typhi Ty2
uuacaauuuaucugcguga

SEQ ID NO: 3711902 - RNA, 17 nt, Salmonella enterica enterica serovar Typhi Ty2
uuacaccccacuauuca

SEQ ID NO: 3711903 - RNA, 15 nt, Salmonella enterica enterica serovar Typhi Ty2
uuacacguuccaugg

SEQ ID NO: 3711904 - RNA, 12 nt, Salmonella enterica enterica serovar Typhi Ty2
uuacacugaagc

SEQ ID NO: 3711905 - RNA, 19 nt, Salmonella enterica enterica serovar Typhi Ty2
uuacacuuagcacaaagaa

SEQ ID NO: 3711906 - RNA, 16 nt, Salmonella enterica enterica serovar Typhi Ty2
uuacagauauccaccg

SEQ ID NO: 3711907 - RNA, 14 nt, Salmonella enterica enterica serovar Typhi Ty2
uuacagcucauaaa

SEQ ID NO: 3711908 - RNA, 14 nt, Salmonella enterica enterica serovar Typhi Ty2
uuacaggacagaug

SEQ ID NO: 3711909 - RNA, 19 nt, Salmonella enterica enterica serovar Typhi Ty2
uuacaggcaucuuccagcg

SEQ ID NO: 3711910 - RNA, 15 nt, Salmonella enterica enterica serovar Typhi Ty2
uuacaggcgcaucag

SEQ ID NO: 3711911 - RNA, 21 nt, Salmonella enterica enterica serovar Typhi Ty2
uuacaggcgcaucagaaaaac

SEQ ID NO: 3711912 - RNA, 22 nt, Salmonella enterica enterica serovar Typhi Ty2
uuacaggcgcaucagaaaaacc

SEQ ID NO: 3711913 - RNA, 13 nt, Salmonella enterica enterica serovar Typhi Ty2
uuacaggugccug

SEQ ID NO: 3711914 - RNA, 17 nt, Salmonella enterica enterica serovar Typhi Ty2
uuacauagaaaauauau

SEQ ID NO: 3711915 - RNA, 13 nt, Salmonella enterica enterica serovar Typhi Ty2
uuacaucagauaa

SEQ ID NO: 3711916 - RNA, 14 nt, Salmonella enterica enterica serovar Typhi Ty2
uuacaucagauaaa

SEQ ID NO: 3711917 - RNA, 12 nt, Salmonella enterica enterica serovar Typhi Ty2
uuacauuuucca

SEQ ID NO: 3711918 - RNA, 12 nt, Salmonella enterica enterica serovar Typhi Ty2
uuaccaaaucaa

SEQ ID NO: 3711919 - RNA, 11 nt, Salmonella enterica enterica serovar Typhi Ty2
uuaccaacccc

SEQ ID NO: 3711920 - RNA, 13 nt, Salmonella enterica enterica serovar Typhi Ty2
uuaccaaucgcgg

SEQ ID NO: 3711921 - RNA, 18 nt, Salmonella enterica enterica serovar Typhi Ty2
uuaccaaugccaaaaaaa

SEQ ID NO: 3711922 - RNA, 23 nt, Salmonella enterica enterica serovar Typhi Ty2
uuaccaaugccaaaaaaacuaau

SEQ ID NO: 3711923 - RNA, 13 nt, Salmonella enterica enterica serovar Typhi Ty2
uuaccacuuugcg

SEQ ID NO: 3711924 - RNA, 19 nt, Salmonella enterica enterica serovar Typhi Ty2
uuaccacuuugcgcuccug

SEQ ID NO: 3711925 - RNA, 14 nt, Salmonella enterica enterica serovar Typhi Ty2
uuaccagaaccacu

SEQ ID NO: 3711926 - RNA, 21 nt, Salmonella enterica enterica serovar Typhi Ty2
uuagccaaacucugaaaaaau

SEQ ID NO: 3711927 - RNA, 14 nt, Salmonella enterica enterica serovar Typhi Ty2
uuagccacgccguc

SEQ ID NO: 3711928 - RNA, 22 nt, Salmonella enterica enterica serovar Typhi Ty2
uuagccacuuaccaaucgcggc

SEQ ID NO: 3711929 - RNA, 15 nt, Salmonella enterica enterica serovar Typhi Ty2
uuagccagauggcug

SEQ ID NO: 3711930 - RNA, 19 nt, Salmonella enterica enterica serovar Typhi Ty2
uuagccaggugacuuugcc

SEQ ID NO: 3711931 - RNA, 17 nt, Salmonella enterica enterica serovar Typhi Ty2
uuagccccugacgcugc

SEQ ID NO: 3711932 - RNA, 17 nt, Salmonella enterica enterica serovar Typhi Ty2
uuagcccucuggcaaau

SEQ ID NO: 3711933 - RNA, 20 nt, Salmonella enterica enterica serovar Typhi Ty2
uuagcgacauacauaacgcg

SEQ ID NO: 3711934 - RNA, 14 nt, Salmonella enterica enterica serovar Typhi Ty2
uuagcgcacaaaaa

SEQ ID NO: 3711935 - RNA, 23 nt, Salmonella enterica enterica serovar Typhi Ty2
uuagcgcuaauuccuguccauug

SEQ ID NO: 3711936 - RNA, 16 nt, Salmonella enterica enterica serovar Typhi Ty2
uuagcguuucaaccgc

SEQ ID NO: 3711937 - RNA, 22 nt, Salmonella enterica enterica serovar Typhi Ty2
uuagcucuuucauuucugccug

SEQ ID NO: 3711938 - RNA, 23 nt, Salmonella enterica enterica serovar Typhi Ty2
uuagcugcgcaagaaacaucauc

SEQ ID NO: 3711939 - RNA, 18 nt, Salmonella enterica enterica serovar Typhi Ty2
uuagcuggccaaucagcg

SEQ ID NO: 3711940 - RNA, 14 nt, Salmonella enterica enterica serovar Typhi Ty2
uuaggaaacauaag

SEQ ID NO: 3711941 - RNA, 19 nt, Salmonella enterica enterica serovar Typhi Ty2
uuaggccaaacuuacgcag

SEQ ID NO: 3711942 - RNA, 11 nt, Salmonella enterica enterica serovar Typhi Ty2
uuaggcguggu

SEQ ID NO: 3711943 - RNA, 13 nt, Salmonella enterica enterica serovar Typhi Ty2
uuagggcgcggcu

SEQ ID NO: 3711944 - RNA, 22 nt, Salmonella enterica enterica serovar Typhi Ty2
uuagggcuauuuuacuugccau

SEQ ID NO: 3711945 - RNA, 18 nt, Salmonella enterica enterica serovar Typhi Ty2
uuaggguagaaaaaggua

SEQ ID NO: 3711946 - RNA, 16 nt, Salmonella enterica enterica serovar Typhi Ty2
uuagguucuucaaugc

SEQ ID NO: 3711947 - RNA, 11 nt, Salmonella enterica enterica serovar Typhi Ty2
uuaguaacccc

SEQ ID NO: 3711948 - RNA, 17 nt, Salmonella enterica enterica serovar Typhi Ty2
uuaguaauaaagcguag

SEQ ID NO: 3711949 - RNA, 16 nt, Salmonella enterica enterica serovar Typhi Ty2
uuaguaccgucuggcu

SEQ ID NO: 3711950 - RNA, 20 nt, Salmonella enterica enterica serovar Typhi Ty2
uuagugacguuaucugucag

SEQ ID NO: 3711951 - RNA, 14 nt, Salmonella enterica enterica serovar Typhi Ty2
uuaguguuauauaa

SEQ ID NO: 3711952 - RNA, 21 nt, Salmonella enterica enterica serovar Typhi Ty2
uuaguuacgcacgccagauaa

SEQ ID NO: 3711953 - RNA, 21 nt, Salmonella enterica enterica serovar Typhi Ty2
uuaguugauucgcuaauaauu

SEQ ID NO: 3711954 - RNA, 23 nt, Salmonella enterica enterica serovar Typhi Ty2
uuaguuucuauuaaaucagauaa

SEQ ID NO: 3711955 - RNA, 21 nt, Salmonella enterica enterica serovar Typhi Ty2
uuauaaauauuaaugaauaaa

SEQ ID NO: 3711956 - RNA, 19 nt, Salmonella enterica enterica serovar Typhi Ty2
uuauaaaucaggaaaaagg

SEQ ID NO: 3711957 - RNA, 13 nt, Salmonella enterica enterica serovar Typhi Ty2
uuauaacauaaau

SEQ ID NO: 3711958 - RNA, 15 nt, Salmonella enterica enterica serovar Typhi Ty2
uuauaacguaucguu

SEQ ID NO: 3711959 - RNA, 15 nt, Salmonella enterica enterica serovar Typhi Ty2
uuauaagaaccaucu

SEQ ID NO: 3711960 - RNA, 21 nt, Salmonella enterica enterica serovar Typhi Ty2
uuauaagaaccaucuaccaua

SEQ ID NO: 3711961 - RNA, 16 nt, Salmonella enterica enterica serovar Typhi Ty2
uuauaagccugagcgc

SEQ ID NO: 3711962 - RNA, 22 nt, Salmonella enterica enterica serovar Typhi Ty2
uuauaaguacgccugaaaacag

SEQ ID NO: 3711963 - RNA, 23 nt, Salmonella enterica enterica serovar Typhi Ty2
uuauaaguacgccugaaaacaga

SEQ ID NO: 3711964 - RNA, 23 nt, Salmonella enterica enterica serovar Typhi Ty2
uuauacauccugugaaguaaaaa

SEQ ID NO: 3711965 - RNA, 17 nt, Salmonella enterica enterica serovar Typhi Ty2
uuauacgccuauuuucu

SEQ ID NO: 3711966 - RNA, 16 nt, Salmonella enterica enterica serovar Typhi Ty2
uuauacuugcugcuau

SEQ ID NO: 3711967 - RNA, 20 nt, Salmonella enterica enterica serovar Typhi Ty2
uuauacuugcugcuauguaa

SEQ ID NO: 3711968 - RNA, 21 nt, Salmonella enterica enterica serovar Typhi Ty2
uuauagacgccggucaugcca

SEQ ID NO: 3711969 - RNA, 18 nt, Salmonella enterica enterica serovar Typhi Ty2
uuauagcucagcgcggca

SEQ ID NO: 3711970 - RNA, 17 nt, Salmonella enterica enterica serovar Typhi Ty2
uuauagcuggcuuuaua

SEQ ID NO: 3711971 - RNA, 14 nt, Salmonella enterica enterica serovar Typhi Ty2
uuauaggucagguu

SEQ ID NO: 3711972 - RNA, 19 nt, Salmonella enterica enterica serovar Typhi Ty2
uuauaggugucagauccuu

SEQ ID NO: 3711973 - RNA, 21 nt, Salmonella enterica enterica serovar Typhi Ty2
uuauaggugucagauccuuca

SEQ ID NO: 3711974 - RNA, 22 nt, Salmonella enterica enterica serovar Typhi Ty2
uuauauaaaaaaugguuuuauu

SEQ ID NO: 3711975 - RNA, 12 nt, Salmonella enterica enterica serovar Typhi Ty2
uuauauaaaaau

SEQ ID NO: 3711976 - RNA, 13 nt, Salmonella enterica enterica serovar Typhi Ty2
uuauauaagcaua

SEQ ID NO: 3711977 - RNA, 21 nt, Salmonella enterica enterica serovar Typhi Ty2
uuauaugcguguagcagauag

SEQ ID NO: 3711978 - RNA, 15 nt, Salmonella enterica enterica serovar Typhi Ty2
uuauauuuaaaauuc

SEQ ID NO: 3711979 - RNA, 19 nt, Salmonella enterica enterica serovar Typhi Ty2
uuauauuuaaaauuccaau

SEQ ID NO: 3711980 - RNA, 11 nt, Salmonella enterica enterica serovar Typhi Ty2
uuauauuuauu

SEQ ID NO: 3711981 - RNA, 19 nt, Salmonella enterica enterica serovar Typhi Ty2
uuaucaauaaccgccagca

SEQ ID NO: 3711982 - RNA, 16 nt, Salmonella enterica enterica serovar Typhi Ty2
uuaucaaucugcuuuu

SEQ ID NO: 3711983 - RNA, 19 nt, Salmonella enterica enterica serovar Typhi Ty2
uuaucaauuucauauuauu

SEQ ID NO: 3711984 - RNA, 21 nt, Salmonella enterica enterica serovar Typhi Ty2
uuaucacccacaggagccagu

SEQ ID NO: 3711985 - RNA, 24 nt, Salmonella enterica enterica serovar Typhi Ty2
uuaucacccugaauuucaauaauc

SEQ ID NO: 3711986 - RNA, 19 nt, Salmonella enterica enterica serovar Typhi Ty2
uuaucacugguuauaugaa

SEQ ID NO: 3711987 - RNA, 21 nt, Salmonella enterica enterica serovar Typhi Ty2
uuaucauaaugucccugccac

SEQ ID NO: 3711988 - RNA, 16 nt, Salmonella enterica enterica serovar Typhi Ty2
uuaucaucguaaaauc

SEQ ID NO: 3711989 - RNA, 17 nt, Salmonella enterica enterica serovar Typhi Ty2
uuaucaucguaaaauca

SEQ ID NO: 3711990 - RNA, 14 nt, Salmonella enterica enterica serovar Typhi Ty2
uuaucaugcugacu

SEQ ID NO: 3711991 - RNA, 17 nt, Salmonella enterica enterica serovar Typhi Ty2
uuauccacaaacuccag

SEQ ID NO: 3711992 - RNA, 13 nt, Salmonella enterica enterica serovar Typhi Ty2
uuauccaguaacg

SEQ ID NO: 3711993 - RNA, 17 nt, Salmonella enterica enterica serovar Typhi Ty2
uuauccagucagaggaa

SEQ ID NO: 3711994 - RNA, 18 nt, Salmonella enterica enterica serovar Typhi Ty2
uuauccagucccaccggg

SEQ ID NO: 3711995 - RNA, 11 nt, Salmonella enterica enterica serovar Typhi Ty2
uuauccccuuc

SEQ ID NO: 3711996 - RNA, 17 nt, Salmonella enterica enterica serovar Typhi Ty2
uuaucccgcccgaucuc

SEQ ID NO: 3711997 - RNA, 14 nt, Salmonella enterica enterica serovar Typhi Ty2
uuaucccguggugg

SEQ ID NO: 3711998 - RNA, 15 nt, Salmonella enterica enterica serovar Typhi Ty2
uuauccggcaaaaga

SEQ ID NO: 3711999 - RNA, 18 nt, Salmonella enterica enterica serovar Typhi Ty2
uuauccggccuacgcguc

SEQ ID NO: 3712000 - RNA, 15 nt, Salmonella enterica enterica serovar Typhi Ty2
uuauccggccugcac

SEQ ID NO: 3712001 - RNA, 16 nt, Salmonella enterica enterica serovar Typhi Ty2
uuauccggcguguaaa

SEQ ID NO: 3712002 - RNA, 16 nt, Salmonella enterica enterica serovar Typhi Ty2
uuauccggugcgcagg

SEQ ID NO: 3712003 - RNA, 16 nt, Salmonella enterica enterica serovar Typhi Ty2
uuauccugcaaauagc

SEQ ID NO: 3712004 - RNA, 18 nt, Salmonella enterica enterica serovar Typhi Ty2
uuauccugcaaauagcgc

SEQ ID NO: 3712005 - RNA, 17 nt, Salmonella enterica enterica serovar Typhi Ty2
uuauccuguguuuggcc

SEQ ID NO: 3712006 - RNA, 20 nt, Salmonella enterica enterica serovar Typhi Ty2
uuauccuguguuuggccgcc

SEQ ID NO: 3712007 - RNA, 13 nt, Salmonella enterica enterica serovar Typhi Ty2
uuaucgccaaaga

SEQ ID NO: 3712008 - RNA, 18 nt, Salmonella enterica enterica serovar Typhi Ty2
uucaacauauuuuucaca

SEQ ID NO: 3712009 - RNA, 23 nt, Salmonella enterica enterica serovar Typhi Ty2
uucaaccacaaguuuauccagca

SEQ ID NO: 3712010 - RNA, 21 nt, Salmonella enterica enterica serovar Typhi Ty2
uucaaccacggauaagccagc

SEQ ID NO: 3712011 - RNA, 17 nt, Salmonella enterica enterica serovar Typhi Ty2
uucaaccggcaguuuuu

SEQ ID NO: 3712012 - RNA, 12 nt, Salmonella enterica enterica serovar Typhi Ty2
uucaaccucacu

SEQ ID NO: 3712013 - RNA, 14 nt, Salmonella enterica enterica serovar Typhi Ty2
uucaacgcgaccgg

SEQ ID NO: 3712014 - RNA, 19 nt, Salmonella enterica enterica serovar Typhi Ty2
uucaacgcguugccugaaa

SEQ ID NO: 3712015 - RNA, 14 nt, Salmonella enterica enterica serovar Typhi Ty2
uucaacggcaucaa

SEQ ID NO: 3712016 - RNA, 13 nt, Salmonella enterica enterica serovar Typhi Ty2
uucaacgucagcu

SEQ ID NO: 3712017 - RNA, 18 nt, Salmonella enterica enterica serovar Typhi Ty2
uucaacuuccaccaccuc

SEQ ID NO: 3712018 - RNA, 12 nt, Salmonella enterica enterica serovar Typhi Ty2
uucaagcaauac

SEQ ID NO: 3712019 - RNA, 14 nt, Salmonella enterica enterica serovar Typhi Ty2
uucaagcaguucca

SEQ ID NO: 3712020 - RNA, 17 nt, Salmonella enterica enterica serovar Typhi Ty2
uucaagcaguuccagca

SEQ ID NO: 3712021 - RNA, 23 nt, Salmonella enterica enterica serovar Typhi Ty2
uucaagccguuuuggcagcgccc

SEQ ID NO: 3712022 - RNA, 22 nt, Salmonella enterica enterica serovar Typhi Ty2
uucaagcguuuccagaguacau

SEQ ID NO: 3712023 - RNA, 22 nt, Salmonella enterica enterica serovar Typhi Ty2
uucaauaaauugaaauucuaug

SEQ ID NO: 3712024 - RNA, 17 nt, Salmonella enterica enterica serovar Typhi Ty2
uucaauaaguuagcuuu

SEQ ID NO: 3712025 - RNA, 21 nt, Salmonella enterica enterica serovar Typhi Ty2
uucaauaaguuagcuuuuuua

SEQ ID NO: 3712026 - RNA, 17 nt, Salmonella enterica enterica serovar Typhi Ty2
uucaauaauauuaucau

SEQ ID NO: 3712027 - RNA, 18 nt, Salmonella enterica enterica serovar Typhi Ty2
uucaauaauauuaucaua

SEQ ID NO: 3712028 - RNA, 23 nt, Salmonella enterica enterica serovar Typhi Ty2
uucaauacccuuuucuuuaaaca

SEQ ID NO: 3712029 - RNA, 15 nt, Salmonella enterica enterica serovar Typhi Ty2
uucaauacgaaaacc

SEQ ID NO: 3712030 - RNA, 17 nt, Salmonella enterica enterica serovar Typhi Ty2
uucaauacgaaaaccga

SEQ ID NO: 3712031 - RNA, 17 nt, Salmonella enterica enterica serovar Typhi Ty2
uucaauaugccaggcau

SEQ ID NO: 3712032 - RNA, 14 nt, Salmonella enterica enterica serovar Typhi Ty2
uucaauaugugcau

SEQ ID NO: 3712033 - RNA, 22 nt, Salmonella enterica enterica serovar Typhi Ty2
uucaauauuccuggcgccaccc

SEQ ID NO: 3712034 - RNA, 13 nt, Salmonella enterica enterica serovar Typhi Ty2
uucaaucaucaua

SEQ ID NO: 3712035 - RNA, 17 nt, Salmonella enterica enterica serovar Typhi Ty2
uucaaucgccaguuuuu

SEQ ID NO: 3712036 - RNA, 14 nt, Salmonella enterica enterica serovar Typhi Ty2
uucaaugcacgcca

SEQ ID NO: 3712037 - RNA, 18 nt, Salmonella enterica enterica serovar Typhi Ty2
uucaaugcauacugccgg

SEQ ID NO: 3712038 - RNA, 19 nt, Salmonella enterica enterica serovar Typhi Ty2
uucaauuaaugaguagaac

SEQ ID NO: 3712039 - RNA, 21 nt, Salmonella enterica enterica serovar Typhi Ty2
uucaauuugugagauaaaaaa

SEQ ID NO: 3712040 - RNA, 15 nt, Salmonella enterica enterica serovar Typhi Ty2
uucaauuuucgcuuu

SEQ ID NO: 3712041 - RNA, 13 nt, Salmonella enterica enterica serovar Typhi Ty2
uucacaaacuucu

SEQ ID NO: 3712042 - RNA, 17 nt, Salmonella enterica enterica serovar Typhi Ty2
uucacaaccuccacgcc

SEQ ID NO: 3712043 - RNA, 14 nt, Salmonella enterica enterica serovar Typhi Ty2
uucacaaccugaaa

SEQ ID NO: 3712044 - RNA, 14 nt, Salmonella enterica enterica serovar Typhi Ty2
uucacacaauuuuc

SEQ ID NO: 3712045 - RNA, 17 nt, Salmonella enterica enterica serovar Typhi Ty2
uucacacaauuuucuua

SEQ ID NO: 3712046 - RNA, 22 nt, Salmonella enterica enterica serovar Typhi Ty2
uucacaccaaugucauauuugu

SEQ ID NO: 3712047 - RNA, 21 nt, Salmonella enterica enterica serovar Typhi Ty2
uucacaccguuauccggcaaa

SEQ ID NO: 3712048 - RNA, 14 nt, Salmonella enterica enterica serovar Typhi Ty2
uucacagaaggcua

SEQ ID NO: 3712049 - RNA, 24 nt, Salmonella enterica enterica serovar Typhi Ty2
uucaccaaaaggcagacagagaaa

SEQ ID NO: 3712050 - RNA, 16 nt, Salmonella enterica enterica serovar Typhi Ty2
uucaccaaauccucac

SEQ ID NO: 3712051 - RNA, 21 nt, Salmonella enterica enterica serovar Typhi Ty2
uucaccaccacccgaucgccc

SEQ ID NO: 3712052 - RNA, 13 nt, Salmonella enterica enterica serovar Typhi Ty2
uucaccacgcagc

SEQ ID NO: 3712053 - RNA, 12 nt, Salmonella enterica enterica serovar Typhi Ty2
uucaccagcgcg

SEQ ID NO: 3712054 - RNA, 18 nt, Salmonella enterica enterica serovar Typhi Ty2
uucaccauuaagcaaucc

SEQ ID NO: 3712055 - RNA, 16 nt, Salmonella enterica enterica serovar Typhi Ty2
uucacccacugcacau

SEQ ID NO: 3712056 - RNA, 16 nt, Salmonella enterica enterica serovar Typhi Ty2
uucaccccagcgguaa

SEQ ID NO: 3712057 - RNA, 16 nt, Salmonella enterica enterica serovar Typhi Ty2
uucacccccaucgccc

SEQ ID NO: 3712058 - RNA, 16 nt, Salmonella enterica enterica serovar Typhi Ty2
uucacccguuauucau

SEQ ID NO: 3712059 - RNA, 13 nt, Salmonella enterica enterica serovar Typhi Ty2
uucaccgaggguu

SEQ ID NO: 3712060 - RNA, 16 nt, Salmonella enterica enterica serovar Typhi Ty2
uucaccgcgccaaacg

SEQ ID NO: 3712061 - RNA, 23 nt, Salmonella enterica enterica serovar Typhi Ty2
uucaccgcgucguuacgcucguc

SEQ ID NO: 3712062 - RNA, 17 nt, Salmonella enterica enterica serovar Typhi Ty2
uucaccggauacccagc

SEQ ID NO: 3712063 - RNA, 20 nt, Salmonella enterica enterica serovar Typhi Ty2
uucaccggaugcgcagguaa

SEQ ID NO: 3712064 - RNA, 13 nt, Salmonella enterica enterica serovar Typhi Ty2
uucaccggcuggu

SEQ ID NO: 3712065 - RNA, 15 nt, Salmonella enterica enterica serovar Typhi Ty2
uucaccguaucgccc

SEQ ID NO: 3712066 - RNA, 23 nt, Salmonella enterica enterica serovar Typhi Ty2
uucaccuucugugaaaguuucag

SEQ ID NO: 3712067 - RNA, 20 nt, Salmonella enterica enterica serovar Typhi Ty2
uucacgagcggucaggccag

SEQ ID NO: 3712068 - RNA, 21 nt, Salmonella enterica enterica serovar Typhi Ty2
uucacgcagucguuccagacg

SEQ ID NO: 3712069 - RNA, 11 nt, Salmonella enterica enterica serovar Typhi Ty2
uucacgccacc

SEQ ID NO: 3712070 - RNA, 20 nt, Salmonella enterica enterica serovar Typhi Ty2
uucacgccgugaauuucugc

SEQ ID NO: 3712071 - RNA, 20 nt, Salmonella enterica enterica serovar Typhi Ty2
uucacgcuauguuugcugag

SEQ ID NO: 3712072 - RNA, 22 nt, Salmonella enterica enterica serovar Typhi Ty2
uucacgcuauguuugcugagaa

SEQ ID NO: 3712073 - RNA, 15 nt, Salmonella enterica enterica serovar Typhi Ty2
uucacgcucacgcag

SEQ ID NO: 3712074 - RNA, 19 nt, Salmonella enterica enterica serovar Typhi Ty2
uucacgcucacgcagauau

SEQ ID NO: 3712075 - RNA, 20 nt, Salmonella enterica enterica serovar Typhi Ty2
uucacgcucacgcagauauu

SEQ ID NO: 3712076 - RNA, 21 nt, Salmonella enterica enterica serovar Typhi Ty2
uucacgcucgaguucuucacg

SEQ ID NO: 3712077 - RNA, 20 nt, Salmonella enterica enterica serovar Typhi Ty2
uucacggucaaacgcgguaa

SEQ ID NO: 3712078 - RNA, 20 nt, Salmonella enterica enterica serovar Typhi Ty2
uucacguaccaggcagcgcg

SEQ ID NO: 3712079 - RNA, 24 nt, Salmonella enterica enterica serovar Typhi Ty2
uucacguacccaaauaucaaauac

SEQ ID NO: 3712080 - RNA, 23 nt, Salmonella enterica enterica serovar Typhi Ty2
uucacuaauuugaugccuggcag

SEQ ID NO: 3712081 - RNA, 16 nt, Salmonella enterica enterica serovar Typhi Ty2
uucacuggcaugcgcc

SEQ ID NO: 3712082 - RNA, 21 nt, Salmonella enterica enterica serovar Typhi Ty2
uucacuguagcugauaagcua

SEQ ID NO: 3712083 - RNA, 24 nt, Salmonella enterica enterica serovar Typhi Ty2
uucacugucaugguuauuuugucc

SEQ ID NO: 3712084 - RNA, 15 nt, Salmonella enterica enterica serovar Typhi Ty2
uucacuuauaaauaa

SEQ ID NO: 3712085 - RNA, 14 nt, Salmonella enterica enterica serovar Typhi Ty2
uucacuuuuucucu

SEQ ID NO: 3712086 - RNA, 21 nt, Salmonella enterica enterica serovar Typhi Ty2
uucagaaaguuacuuuccaua

SEQ ID NO: 3712087 - RNA, 17 nt, Salmonella enterica enterica serovar Typhi Ty2
uucagaauaugccaggg

SEQ ID NO: 3712088 - RNA, 17 nt, Salmonella enterica enterica serovar Typhi Ty2
uucagaccacuauaguu

SEQ ID NO: 3712089 - RNA, 20 nt, Salmonella enterica enterica serovar Typhi Ty2
uucagagcgucuuuuauccc

SEQ ID NO: 3712090 - RNA, 16 nt, Salmonella enterica enterica serovar Typhi Ty2
uucaugccauacuccu

SEQ ID NO: 3712091 - RNA, 13 nt, Salmonella enterica enterica serovar Typhi Ty2
uucaugcgcggcg

SEQ ID NO: 3712092 - RNA, 16 nt, Salmonella enterica enterica serovar Typhi Ty2
uucaugcuguauaaac

SEQ ID NO: 3712093 - RNA, 15 nt, Salmonella enterica enterica serovar Typhi Ty2
uucauggauaccggg

SEQ ID NO: 3712094 - RNA, 19 nt, Salmonella enterica enterica serovar Typhi Ty2
uucaugguacucaacauca

SEQ ID NO: 3712095 - RNA, 21 nt, Salmonella enterica enterica serovar Typhi Ty2
uucaugguacucaacaucauu

SEQ ID NO: 3712096 - RNA, 21 nt, Salmonella enterica enterica serovar Typhi Ty2
uucauggucaucgcaaauucu

SEQ ID NO: 3712097 - RNA, 15 nt, Salmonella enterica enterica serovar Typhi Ty2
uucauguaaaugacg

SEQ ID NO: 3712098 - RNA, 13 nt, Salmonella enterica enterica serovar Typhi Ty2
uucauuacaggug

SEQ ID NO: 3712099 - RNA, 13 nt, Salmonella enterica enterica serovar Typhi Ty2
uucauuacgcuuc

SEQ ID NO: 3712100 - RNA, 18 nt, Salmonella enterica enterica serovar Typhi Ty2
uucauuauuuuuaaauaa

SEQ ID NO: 3712101 - RNA, 20 nt, Salmonella enterica enterica serovar Typhi Ty2
uucauucacccaauaaauaa

SEQ ID NO: 3712102 - RNA, 12 nt, Salmonella enterica enterica serovar Typhi Ty2
uucauucagacc

SEQ ID NO: 3712103 - RNA, 22 nt, Salmonella enterica enterica serovar Typhi Ty2
uucauucagggaaucagcguaa

SEQ ID NO: 3712104 - RNA, 20 nt, Salmonella enterica enterica serovar Typhi Ty2
uucauucgucaaauucaccc

SEQ ID NO: 3712105 - RNA, 13 nt, Salmonella enterica enterica serovar Typhi Ty2
uucauucugucag

SEQ ID NO: 3712106 - RNA, 20 nt, Salmonella enterica enterica serovar Typhi Ty2
uucauugucuuuuucucaau

SEQ ID NO: 3712107 - RNA, 17 nt, Salmonella enterica enterica serovar Typhi Ty2
uucauuucgaucuguuu

SEQ ID NO: 3712108 - RNA, 17 nt, Salmonella enterica enterica serovar Typhi Ty2
uucauuucuuccagcac

SEQ ID NO: 3712109 - RNA, 23 nt, Salmonella enterica enterica serovar Typhi Ty2
uuccaauauuuauuuaauguuuc

SEQ ID NO: 3712110 - RNA, 23 nt, Salmonella enterica enterica serovar Typhi Ty2
uuccacaaaaggauacagcgccg

SEQ ID NO: 3712111 - RNA, 20 nt, Salmonella enterica enterica serovar Typhi Ty2
uuccacaaucccggcaacug

SEQ ID NO: 3712112 - RNA, 13 nt, Salmonella enterica enterica serovar Typhi Ty2
uuccacagaccca

SEQ ID NO: 3712113 - RNA, 18 nt, Salmonella enterica enterica serovar Typhi Ty2
uuccaccaccuccugcug

SEQ ID NO: 3712114 - RNA, 22 nt, Salmonella enterica enterica serovar Typhi Ty2
uuccaccagccaggccgccagc

SEQ ID NO: 3712115 - RNA, 13 nt, Salmonella enterica enterica serovar Typhi Ty2
uuccaccgccaau

SEQ ID NO: 3712116 - RNA, 18 nt, Salmonella enterica enterica serovar Typhi Ty2
uuccaccucuucugcagu

SEQ ID NO: 3712117 - RNA, 22 nt, Salmonella enterica enterica serovar Typhi Ty2
uuccacgauauuaauucccgcc

SEQ ID NO: 3712118 - RNA, 16 nt, Salmonella enterica enterica serovar Typhi Ty2
uuccacgcacgccggc

SEQ ID NO: 3712119 - RNA, 21 nt, Salmonella enterica enterica serovar Typhi Ty2
uuccacgccgucgaugauggc

SEQ ID NO: 3712120 - RNA, 23 nt, Salmonella enterica enterica serovar Typhi Ty2
uuccacgcgcgcgccgauaaauu

SEQ ID NO: 3712121 - RNA, 21 nt, Salmonella enterica enterica serovar Typhi Ty2
uuccacgcugacugcauaaug

SEQ ID NO: 3712122 - RNA, 21 nt, Salmonella enterica enterica serovar Typhi Ty2
uuccacugagcuucaccgcca

SEQ ID NO: 3712123 - RNA, 16 nt, Salmonella enterica enterica serovar Typhi Ty2
uuccacugcggcauua

SEQ ID NO: 3712124 - RNA, 18 nt, Salmonella enterica enterica serovar Typhi Ty2
uuccagaaauaaaauacg

SEQ ID NO: 3712125 - RNA, 21 nt, Salmonella enterica enterica serovar Typhi Ty2
uuccagaagcgcuuugccaau

SEQ ID NO: 3712126 - RNA, 20 nt, Salmonella enterica enterica serovar Typhi Ty2
uuccagaauucguacguuuu

SEQ ID NO: 3712127 - RNA, 20 nt, Salmonella enterica enterica serovar Typhi Ty2
uuccagauaauccagcgucg

SEQ ID NO: 3712128 - RNA, 22 nt, Salmonella enterica enterica serovar Typhi Ty2
uuccagcagauccauuaaaugc

SEQ ID NO: 3712129 - RNA, 14 nt, Salmonella enterica enterica serovar Typhi Ty2
uuccagcagccagc

SEQ ID NO: 3712130 - RNA, 22 nt, Salmonella enterica enterica serovar Typhi Ty2
uuccagcagccagccguugugc

SEQ ID NO: 3712131 - RNA, 18 nt, Salmonella enterica enterica serovar Typhi Ty2
uuccagcagcgcaucaug

SEQ ID NO: 3712132 - RNA, 17 nt, Salmonella enterica enterica serovar Typhi Ty2
uuccagcagcucaucaa

SEQ ID NO: 3712133 - RNA, 22 nt, Salmonella enterica enterica serovar Typhi Ty2
uuccagcauccugacauuaccc

SEQ ID NO: 3712134 - RNA, 16 nt, Salmonella enterica enterica serovar Typhi Ty2
uuccagcauuucuuca

SEQ ID NO: 3712135 - RNA, 17 nt, Salmonella enterica enterica serovar Typhi Ty2
uuccagcauuucuucaa

SEQ ID NO: 3712136 - RNA, 21 nt, Salmonella enterica enterica serovar Typhi Ty2
uuccagccagugugcgguggc

SEQ ID NO: 3712137 - RNA, 21 nt, Salmonella enterica enterica serovar Typhi Ty2
uuccagcgcgccgucaucgcu

SEQ ID NO: 3712138 - RNA, 24 nt, Salmonella enterica enterica serovar Typhi Ty2
uuccagcgcgccgucaucgcucau

SEQ ID NO: 3712139 - RNA, 12 nt, Salmonella enterica enterica serovar Typhi Ty2
uuccagcggcag

SEQ ID NO: 3712140 - RNA, 21 nt, Salmonella enterica enterica serovar Typhi Ty2
uuccagcgugccgagcaacag

SEQ ID NO: 3712141 - RNA, 22 nt, Salmonella enterica enterica serovar Typhi Ty2
uuccagcucacggauauuaccc

SEQ ID NO: 3712142 - RNA, 19 nt, Salmonella enterica enterica serovar Typhi Ty2
uuccagcuguaccaucacc

SEQ ID NO: 3712143 - RNA, 14 nt, Salmonella enterica enterica serovar Typhi Ty2
uuccaggacggaca

SEQ ID NO: 3712144 - RNA, 18 nt, Salmonella enterica enterica serovar Typhi Ty2
uuccagggcuuccagaau

SEQ ID NO: 3712145 - RNA, 19 nt, Salmonella enterica enterica serovar Typhi Ty2
uuccaggucaugguaaaac

SEQ ID NO: 3712146 - RNA, 21 nt, Salmonella enterica enterica serovar Typhi Ty2
uuccaguucauaagucaucca

SEQ ID NO: 3712147 - RNA, 11 nt, Salmonella enterica enterica serovar Typhi Ty2
uuccauacauu

SEQ ID NO: 3712148 - RNA, 12 nt, Salmonella enterica enterica serovar Typhi Ty2
uuccaucggcau

SEQ ID NO: 3712149 - RNA, 16 nt, Salmonella enterica enterica serovar Typhi Ty2
uuccauuaugaugagu

SEQ ID NO: 3712150 - RNA, 19 nt, Salmonella enterica enterica serovar Typhi Ty2
uuccauucaucgauuuccu

SEQ ID NO: 3712151 - RNA, 13 nt, Salmonella enterica enterica serovar Typhi Ty2
uuccauucccgcc

SEQ ID NO: 3712152 - RNA, 12 nt, Salmonella enterica enterica serovar Typhi Ty2
uuccauugcugc

SEQ ID NO: 3712153 - RNA, 11 nt, Salmonella enterica enterica serovar Typhi Ty2
uuccauuuuuc

SEQ ID NO: 3712154 - RNA, 18 nt, Salmonella enterica enterica serovar Typhi Ty2
uucccaagucacgcccgc

SEQ ID NO: 3712155 - RNA, 21 nt, Salmonella enterica enterica serovar Typhi Ty2
uucccacagcuucaggcucau

SEQ ID NO: 3712156 - RNA, 23 nt, Salmonella enterica enterica serovar Typhi Ty2
uucccacaguuaacgccaacgcc

SEQ ID NO: 3712157 - RNA, 23 nt, Salmonella enterica enterica serovar Typhi Ty2
uucccacgggcgcaccauaccua

SEQ ID NO: 3712158 - RNA, 14 nt, Salmonella enterica enterica serovar Typhi Ty2
uucccacuccgccc

SEQ ID NO: 3712159 - RNA, 17 nt, Salmonella enterica enterica serovar Typhi Ty2
uucccagcgggaacauc

SEQ ID NO: 3712160 - RNA, 22 nt, Salmonella enterica enterica serovar Typhi Ty2
uucccagguuuuggucagcuca

SEQ ID NO: 3712161 - RNA, 23 nt, Salmonella enterica enterica serovar Typhi Ty2
uucccagguuuuggucagcucac

SEQ ID NO: 3712162 - RNA, 24 nt, Salmonella enterica enterica serovar Typhi Ty2
uucccaguauugcaccugggaauc

SEQ ID NO: 3712163 - RNA, 15 nt, Salmonella enterica enterica serovar Typhi Ty2
uucccagucauccgg

SEQ ID NO: 3712164 - RNA, 22 nt, Salmonella enterica enterica serovar Typhi Ty2
uucccagugcgcggucauaucu

SEQ ID NO: 3712165 - RNA, 19 nt, Salmonella enterica enterica serovar Typhi Ty2
uucccauugggccagcagc

SEQ ID NO: 3712166 - RNA, 16 nt, Salmonella enterica enterica serovar Typhi Ty2
uuccccaccaggaaug

SEQ ID NO: 3712167 - RNA, 13 nt, Salmonella enterica enterica serovar Typhi Ty2
uuccccacgccau

SEQ ID NO: 3712168 - RNA, 19 nt, Salmonella enterica enterica serovar Typhi Ty2
uuccccacgccaucgcggc

SEQ ID NO: 3712169 - RNA, 13 nt, Salmonella enterica enterica serovar Typhi Ty2
uuccccagcaccg

SEQ ID NO: 3712170 - RNA, 12 nt, Salmonella enterica enterica serovar Typhi Ty2
uuccccauaauc

SEQ ID NO: 3712171 - RNA, 15 nt, Salmonella enterica enterica serovar Typhi Ty2
uucgacgauaaaaaa

SEQ ID NO: 3712172 - RNA, 20 nt, Salmonella enterica enterica serovar Typhi Ty2
uucgagauuuuucugcgcca

SEQ ID NO: 3712173 - RNA, 14 nt, Salmonella enterica enterica serovar Typhi Ty2
uucgauaaacucaa

SEQ ID NO: 3712174 - RNA, 18 nt, Salmonella enterica enterica serovar Typhi Ty2
uucgauaaccaccagcgg

SEQ ID NO: 3712175 - RNA, 17 nt, Salmonella enterica enterica serovar Typhi Ty2
uucgauaugaccaguac

SEQ ID NO: 3712176 - RNA, 14 nt, Salmonella enterica enterica serovar Typhi Ty2
uucgaugaaaaaga

SEQ ID NO: 3712177 - RNA, 23 nt, Salmonella enterica enterica serovar Typhi Ty2
uucgaugaugagaugcaggccaa

SEQ ID NO: 3712178 - RNA, 19 nt, Salmonella enterica enterica serovar Typhi Ty2
uucgaugcggccauggaga

SEQ ID NO: 3712179 - RNA, 14 nt, Salmonella enterica enterica serovar Typhi Ty2
uucgauggccucau

SEQ ID NO: 3712180 - RNA, 17 nt, Salmonella enterica enterica serovar Typhi Ty2
uucgauggccucaucau

SEQ ID NO: 3712181 - RNA, 13 nt, Salmonella enterica enterica serovar Typhi Ty2
uucgcaacgccgc

SEQ ID NO: 3712182 - RNA, 23 nt, Salmonella enterica enterica serovar Typhi Ty2
uucgcacgccucuggcguacgca

SEQ ID NO: 3712183 - RNA, 12 nt, Salmonella enterica enterica serovar Typhi Ty2
uucgcagcgcag

SEQ ID NO: 3712184 - RNA, 16 nt, Salmonella enterica enterica serovar Typhi Ty2
uucgcauauucugcga

SEQ ID NO: 3712185 - RNA, 18 nt, Salmonella enterica enterica serovar Typhi Ty2
uucgcauauucugcgaaa

SEQ ID NO: 3712186 - RNA, 15 nt, Salmonella enterica enterica serovar Typhi Ty2
uucgccagugacaaa

SEQ ID NO: 3712187 - RNA, 13 nt, Salmonella enterica enterica serovar Typhi Ty2
uucgcccauaucc

SEQ ID NO: 3712188 - RNA, 17 nt, Salmonella enterica enterica serovar Typhi Ty2
uucgccccacuggcccc

SEQ ID NO: 3712189 - RNA, 18 nt, Salmonella enterica enterica serovar Typhi Ty2
uucgcccggcgccagcuc

SEQ ID NO: 3712190 - RNA, 18 nt, Salmonella enterica enterica serovar Typhi Ty2
uucgcccguucugaccag

SEQ ID NO: 3712191 - RNA, 19 nt, Salmonella enterica enterica serovar Typhi Ty2
uucgccgcccaaccagccc

SEQ ID NO: 3712192 - RNA, 21 nt, Salmonella enterica enterica serovar Typhi Ty2
uucgccggaaagaaacgccgc

SEQ ID NO: 3712193 - RNA, 23 nt, Salmonella enterica enterica serovar Typhi Ty2
uucgccguguucuuacccacugu

SEQ ID NO: 3712194 - RNA, 23 nt, Salmonella enterica enterica serovar Typhi Ty2
uucgcgaacugcacucggaugua

SEQ ID NO: 3712195 - RNA, 19 nt, Salmonella enterica enterica serovar Typhi Ty2
uucgcgaauuucacgcagc

SEQ ID NO: 3712196 - RNA, 22 nt, Salmonella enterica enterica serovar Typhi Ty2
uucgcgucaaaacuuauuuuau

SEQ ID NO: 3712197 - RNA, 16 nt, Salmonella enterica enterica serovar Typhi Ty2
uucgcgucacaaucgc

SEQ ID NO: 3712198 - RNA, 13 nt, Salmonella enterica enterica serovar Typhi Ty2
uucgcuaaaucag

SEQ ID NO: 3712199 - RNA, 21 nt, Salmonella enterica enterica serovar Typhi Ty2
uucgcuaauccccccuuuuuu

SEQ ID NO: 3712200 - RNA, 17 nt, Salmonella enterica enterica serovar Typhi Ty2
uucgcuacguucaaauu

SEQ ID NO: 3712201 - RNA, 15 nt, Salmonella enterica enterica serovar Typhi Ty2
uucgcuucgaggaua

SEQ ID NO: 3712202 - RNA, 20 nt, Salmonella enterica enterica serovar Typhi Ty2
uucgcuucuucuaccaccuu

SEQ ID NO: 3712203 - RNA, 13 nt, Salmonella enterica enterica serovar Typhi Ty2
uucggacuuccug

SEQ ID NO: 3712204 - RNA, 21 nt, Salmonella enterica enterica serovar Typhi Ty2
uucggagcgcuuuuuuuaugc

SEQ ID NO: 3712205 - RNA, 19 nt, Salmonella enterica enterica serovar Typhi Ty2
uucggauuauuggucagua

SEQ ID NO: 3712206 - RNA, 14 nt, Salmonella enterica enterica serovar Typhi Ty2
uucggcagaaaaag

SEQ ID NO: 3712207 - RNA, 11 nt, Salmonella enterica enterica serovar Typhi Ty2
uucggcagacu

SEQ ID NO: 3712208 - RNA, 15 nt, Salmonella enterica enterica serovar Typhi Ty2
uucggcgaaagaagc

SEQ ID NO: 3712209 - RNA, 20 nt, Salmonella enterica enterica serovar Typhi Ty2
uucggcgauuuccagcgccg

SEQ ID NO: 3712210 - RNA, 19 nt, Salmonella enterica enterica serovar Typhi Ty2
uucggcuccaauauuucag

SEQ ID NO: 3712211 - RNA, 13 nt, Salmonella enterica enterica serovar Typhi Ty2
uucggcuucaauu

SEQ ID NO: 3712212 - RNA, 20 nt, Salmonella enterica enterica serovar Typhi Ty2
uucgguauuuaucaaaaaga

SEQ ID NO: 3712213 - RNA, 19 nt, Salmonella enterica enterica serovar Typhi Ty2
uucguacccgcaggccugg

SEQ ID NO: 3712214 - RNA, 13 nt, Salmonella enterica enterica serovar Typhi Ty2
uucguagacucag

SEQ ID NO: 3712215 - RNA, 16 nt, Salmonella enterica enterica serovar Typhi Ty2
uucguagacucaggcg

SEQ ID NO: 3712216 - RNA, 17 nt, Salmonella enterica enterica serovar Typhi Ty2
uucgucaggaggccuga

SEQ ID NO: 3712217 - RNA, 15 nt, Salmonella enterica enterica serovar Typhi Ty2
uucgucuucaucuuc

SEQ ID NO: 3712218 - RNA, 18 nt, Salmonella enterica enterica serovar Typhi Ty2
uucgucuuuauucaucau

SEQ ID NO: 3712219 - RNA, 13 nt, Salmonella enterica enterica serovar Typhi Ty2
uucguggacgagc

SEQ ID NO: 3712220 - RNA, 17 nt, Salmonella enterica enterica serovar Typhi Ty2
uucguggcgcuguucuu

SEQ ID NO: 3712221 - RNA, 15 nt, Salmonella enterica enterica serovar Typhi Ty2
uucguuaccggugau

SEQ ID NO: 3712222 - RNA, 15 nt, Salmonella enterica enterica serovar Typhi Ty2
uucguucagggugaa

SEQ ID NO: 3712223 - RNA, 21 nt, Salmonella enterica enterica serovar Typhi Ty2
uucguuccgcgauuuccugug

SEQ ID NO: 3712224 - RNA, 15 nt, Salmonella enterica enterica serovar Typhi Ty2
uucguucucugaaua

SEQ ID NO: 3712225 - RNA, 11 nt, Salmonella enterica enterica serovar Typhi Ty2
uucguuuuccg

SEQ ID NO: 3712226 - RNA, 21 nt, Salmonella enterica enterica serovar Typhi Ty2
uucuaaaaguaagcuauguuu

SEQ ID NO: 3712227 - RNA, 20 nt, Salmonella enterica enterica serovar Typhi Ty2
uucuaaacguucaucuuccc

SEQ ID NO: 3712228 - RNA, 15 nt, Salmonella enterica enterica serovar Typhi Ty2
uucuaacgaaacaga

SEQ ID NO: 3712229 - RNA, 16 nt, Salmonella enterica enterica serovar Typhi Ty2
uucuacaaguucagua

SEQ ID NO: 3712230 - RNA, 19 nt, Salmonella enterica enterica serovar Typhi Ty2
uucuaccacccagccagac

SEQ ID NO: 3712231 - RNA, 20 nt, Salmonella enterica enterica serovar Typhi Ty2
uucuaccacgcugccgccgc

SEQ ID NO: 3712232 - RNA, 14 nt, Salmonella enterica enterica serovar Typhi Ty2
uucuacgcgccagc

SEQ ID NO: 3712233 - RNA, 14 nt, Salmonella enterica enterica serovar Typhi Ty2
uucuacuacagaaa

SEQ ID NO: 3712234 - RNA, 19 nt, Salmonella enterica enterica serovar Typhi Ty2
uucuacuacagaaagccau

SEQ ID NO: 3712235 - RNA, 19 nt, Salmonella enterica enterica serovar Typhi Ty2
uucuacucuucacccuucu

SEQ ID NO: 3712236 - RNA, 23 nt, Salmonella enterica enterica serovar Typhi Ty2
uucuacuucaauuuuccagauag

SEQ ID NO: 3712237 - RNA, 16 nt, Salmonella enterica enterica serovar Typhi Ty2
uucuaugccaggcgca

SEQ ID NO: 3712238 - RNA, 13 nt, Salmonella enterica enterica serovar Typhi Ty2
uucuauuaaauca

SEQ ID NO: 3712239 - RNA, 18 nt, Salmonella enterica enterica serovar Typhi Ty2
uucuauuaaaucagauaa

SEQ ID NO: 3712240 - RNA, 14 nt, Salmonella enterica enterica serovar Typhi Ty2
uucucaaugaacag

SEQ ID NO: 3712241 - RNA, 16 nt, Salmonella enterica enterica serovar Typhi Ty2
uucucaggacgccagu

SEQ ID NO: 3712242 - RNA, 16 nt, Salmonella enterica enterica serovar Typhi Ty2
uucucauccagcuugc

SEQ ID NO: 3712243 - RNA, 19 nt, Salmonella enterica enterica serovar Typhi Ty2
uucuccacgcgaugagcug

SEQ ID NO: 3712244 - RNA, 14 nt, Salmonella enterica enterica serovar Typhi Ty2
uucuccagcagacg

SEQ ID NO: 3712245 - RNA, 20 nt, Salmonella enterica enterica serovar Typhi Ty2
uucuccaggcgaauccccau

SEQ ID NO: 3712246 - RNA, 22 nt, Salmonella enterica enterica serovar Typhi Ty2
uucuccccuucaucaguaacug

SEQ ID NO: 3712247 - RNA, 15 nt, Salmonella enterica enterica serovar Typhi Ty2
uucuccggcagucca

SEQ ID NO: 3712248 - RNA, 22 nt, Salmonella enterica enterica serovar Typhi Ty2
uucuccgggauagcaaucucgc

SEQ ID NO: 3712249 - RNA, 14 nt, Salmonella enterica enterica serovar Typhi Ty2
uucuccugccagcg

SEQ ID NO: 3712250 - RNA, 22 nt, Salmonella enterica enterica serovar Typhi Ty2
uucuccugcgccagccggauac

SEQ ID NO: 3712251 - RNA, 21 nt, Salmonella enterica enterica serovar Typhi Ty2
uucuccugcggccuugccgcc

SEQ ID NO: 3712252 - RNA, 13 nt, Salmonella enterica enterica serovar Typhi Ty2
uucucgauaucuu

SEQ ID NO: 3712253 - RNA, 16 nt, Salmonella enterica enterica serovar Typhi Ty2
uugacuuacaaaaaau

SEQ ID NO: 3712254 - RNA, 17 nt, Salmonella enterica enterica serovar Typhi Ty2
uugacuuuuacgccacg

SEQ ID NO: 3712255 - RNA, 15 nt, Salmonella enterica enterica serovar Typhi Ty2
uugagacaugccgcc

SEQ ID NO: 3712256 - RNA, 13 nt, Salmonella enterica enterica serovar Typhi Ty2
uugagccauucca

SEQ ID NO: 3712257 - RNA, 23 nt, Salmonella enterica enterica serovar Typhi Ty2
uugagcgagucagacaccagccc

SEQ ID NO: 3712258 - RNA, 17 nt, Salmonella enterica enterica serovar Typhi Ty2
uugagcuucuuggcgau

SEQ ID NO: 3712259 - RNA, 16 nt, Salmonella enterica enterica serovar Typhi Ty2
uugaggaaauucugac

SEQ ID NO: 3712260 - RNA, 16 nt, Salmonella enterica enterica serovar Typhi Ty2
uugagucgcauccagu

SEQ ID NO: 3712261 - RNA, 16 nt, Salmonella enterica enterica serovar Typhi Ty2
uugaguuuuccgccau

SEQ ID NO: 3712262 - RNA, 21 nt, Salmonella enterica enterica serovar Typhi Ty2
uugauaauguuggauuauaca

SEQ ID NO: 3712263 - RNA, 14 nt, Salmonella enterica enterica serovar Typhi Ty2
uugauacauuuuuu

SEQ ID NO: 3712264 - RNA, 17 nt, Salmonella enterica enterica serovar Typhi Ty2
uugauaccaucaauguu

SEQ ID NO: 3712265 - RNA, 23 nt, Salmonella enterica enterica serovar Typhi Ty2
uugauagcgacgcccauuagcau

SEQ ID NO: 3712266 - RNA, 19 nt, Salmonella enterica enterica serovar Typhi Ty2
uugauauugugcauacuga

SEQ ID NO: 3712267 - RNA, 13 nt, Salmonella enterica enterica serovar Typhi Ty2
uugaucacaaaau

SEQ ID NO: 3712268 - RNA, 12 nt, Salmonella enterica enterica serovar Typhi Ty2
uugaucacggua

SEQ ID NO: 3712269 - RNA, 23 nt, Salmonella enterica enterica serovar Typhi Ty2
uugaucacgguacgcaucaccag

SEQ ID NO: 3712270 - RNA, 20 nt, Salmonella enterica enterica serovar Typhi Ty2
uugaucaggaaaucuuccag

SEQ ID NO: 3712271 - RNA, 13 nt, Salmonella enterica enterica serovar Typhi Ty2
uugaucauccuua

SEQ ID NO: 3712272 - RNA, 18 nt, Salmonella enterica enterica serovar Typhi Ty2
uugaucgcgcagcaaauc

SEQ ID NO: 3712273 - RNA, 17 nt, Salmonella enterica enterica serovar Typhi Ty2
uugaucguaaaaugaaa

SEQ ID NO: 3712274 - RNA, 13 nt, Salmonella enterica enterica serovar Typhi Ty2
uugaucguccauc

SEQ ID NO: 3712275 - RNA, 18 nt, Salmonella enterica enterica serovar Typhi Ty2
uugaugaugccaggacca

SEQ ID NO: 3712276 - RNA, 11 nt, Salmonella enterica enterica serovar Typhi Ty2
uugaugcccaa

SEQ ID NO: 3712277 - RNA, 17 nt, Salmonella enterica enterica serovar Typhi Ty2
uugaugcuaaccucuau

SEQ ID NO: 3712278 - RNA, 21 nt, Salmonella enterica enterica serovar Typhi Ty2
uugaugucauccgguucaccc

SEQ ID NO: 3712279 - RNA, 13 nt, Salmonella enterica enterica serovar Typhi Ty2
uugauucaccgac

SEQ ID NO: 3712280 - RNA, 17 nt, Salmonella enterica enterica serovar Typhi Ty2
uugauuucauugcugca

SEQ ID NO: 3712281 - RNA, 19 nt, Salmonella enterica enterica serovar Typhi Ty2
uugauuuuucugguaaacc

SEQ ID NO: 3712282 - RNA, 19 nt, Salmonella enterica enterica serovar Typhi Ty2
uugcaaaucuuguaggccg

SEQ ID NO: 3712283 - RNA, 12 nt, Salmonella enterica enterica serovar Typhi Ty2
uugcaacuauua

SEQ ID NO: 3712284 - RNA, 20 nt, Salmonella enterica enterica serovar Typhi Ty2
uugcaagaaauguccauaaa

SEQ ID NO: 3712285 - RNA, 19 nt, Salmonella enterica enterica serovar Typhi Ty2
uugcaagucaccaucagua

SEQ ID NO: 3712286 - RNA, 15 nt, Salmonella enterica enterica serovar Typhi Ty2
uugcacggcaucuuu

SEQ ID NO: 3712287 - RNA, 20 nt, Salmonella enterica enterica serovar Typhi Ty2
uugcagccacguugcgcgcg

SEQ ID NO: 3712288 - RNA, 14 nt, Salmonella enterica enterica serovar Typhi Ty2
uugcagccagaacu

SEQ ID NO: 3712289 - RNA, 16 nt, Salmonella enterica enterica serovar Typhi Ty2
uugcagcgugaaaagc

SEQ ID NO: 3712290 - RNA, 17 nt, Salmonella enterica enterica serovar Typhi Ty2
uugcaggaagggcagca

SEQ ID NO: 3712291 - RNA, 20 nt, Salmonella enterica enterica serovar Typhi Ty2
uugcagguuacucacugccg

SEQ ID NO: 3712292 - RNA, 15 nt, Salmonella enterica enterica serovar Typhi Ty2
uugcaguacaggcau

SEQ ID NO: 3712293 - RNA, 23 nt, Salmonella enterica enterica serovar Typhi Ty2
uugcaguuuuaccguaaaaugcu

SEQ ID NO: 3712294 - RNA, 13 nt, Salmonella enterica enterica serovar Typhi Ty2
uugcauacauaaa

SEQ ID NO: 3712295 - RNA, 22 nt, Salmonella enterica enterica serovar Typhi Ty2
uugcaugguagucguuauaauc

SEQ ID NO: 3712296 - RNA, 16 nt, Salmonella enterica enterica serovar Typhi Ty2
uugcauuucgaccgca

SEQ ID NO: 3712297 - RNA, 21 nt, Salmonella enterica enterica serovar Typhi Ty2
uugccacaauaucaucgucau

SEQ ID NO: 3712298 - RNA, 14 nt, Salmonella enterica enterica serovar Typhi Ty2
uugccacagccuca

SEQ ID NO: 3712299 - RNA, 14 nt, Salmonella enterica enterica serovar Typhi Ty2
uugccacuacgcag

SEQ ID NO: 3712300 - RNA, 23 nt, Salmonella enterica enterica serovar Typhi Ty2
uugccacuggcuuuccugaucaa

SEQ ID NO: 3712301 - RNA, 18 nt, Salmonella enterica enterica serovar Typhi Ty2
uugccagaggcagcacau

SEQ ID NO: 3712302 - RNA, 15 nt, Salmonella enterica enterica serovar Typhi Ty2
uugccagugaaaaaa

SEQ ID NO: 3712303 - RNA, 12 nt, Salmonella enterica enterica serovar Typhi Ty2
uugccauacgcc

SEQ ID NO: 3712304 - RNA, 19 nt, Salmonella enterica enterica serovar Typhi Ty2
uugccauacgcccacgcgg

SEQ ID NO: 3712305 - RNA, 19 nt, Salmonella enterica enterica serovar Typhi Ty2
uugccaugaugagcgccau

SEQ ID NO: 3712306 - RNA, 15 nt, Salmonella enterica enterica serovar Typhi Ty2
uugccaugguucaca

SEQ ID NO: 3712307 - RNA, 17 nt, Salmonella enterica enterica serovar Typhi Ty2
uugccaugugccgcgaa

SEQ ID NO: 3712308 - RNA, 20 nt, Salmonella enterica enterica serovar Typhi Ty2
uugccauucgccagcccgau

SEQ ID NO: 3712309 - RNA, 18 nt, Salmonella enterica enterica serovar Typhi Ty2
uugccauugcgacgauau

SEQ ID NO: 3712310 - RNA, 12 nt, Salmonella enterica enterica serovar Typhi Ty2
uugccccuuccg

SEQ ID NO: 3712311 - RNA, 15 nt, Salmonella enterica enterica serovar Typhi Ty2
uugcccgaugcgccc

SEQ ID NO: 3712312 - RNA, 13 nt, Salmonella enterica enterica serovar Typhi Ty2
uugcccuccagcc

SEQ ID NO: 3712313 - RNA, 16 nt, Salmonella enterica enterica serovar Typhi Ty2
uugcccuggaauuuuu

SEQ ID NO: 3712314 - RNA, 14 nt, Salmonella enterica enterica serovar Typhi Ty2
uugcccuuuuguuu

SEQ ID NO: 3712315 - RNA, 19 nt, Salmonella enterica enterica serovar Typhi Ty2
uugccgaguggaaucagcc

SEQ ID NO: 3712316 - RNA, 20 nt, Salmonella enterica enterica serovar Typhi Ty2
uugccgauuccaugcccagu

SEQ ID NO: 3712317 - RNA, 23 nt, Salmonella enterica enterica serovar Typhi Ty2
uugccgcacgguacuauuaccgc

SEQ ID NO: 3712318 - RNA, 16 nt, Salmonella enterica enterica serovar Typhi Ty2
uugccgcccugaaagc

SEQ ID NO: 3712319 - RNA, 15 nt, Salmonella enterica enterica serovar Typhi Ty2
uugccgccgagcaga

SEQ ID NO: 3712320 - RNA, 13 nt, Salmonella enterica enterica serovar Typhi Ty2
uugccggauggcg

SEQ ID NO: 3712321 - RNA, 14 nt, Salmonella enterica enterica serovar Typhi Ty2
uugccggcaucauu

SEQ ID NO: 3712322 - RNA, 16 nt, Salmonella enterica enterica serovar Typhi Ty2
uugccgggcugaccgc

SEQ ID NO: 3712323 - RNA, 20 nt, Salmonella enterica enterica serovar Typhi Ty2
uugccgucaacacgcagacc

SEQ ID NO: 3712324 - RNA, 15 nt, Salmonella enterica enterica serovar Typhi Ty2
uugccgugaaaacga

SEQ ID NO: 3712325 - RNA, 15 nt, Salmonella enterica enterica serovar Typhi Ty2
uugccguuaacugcu

SEQ ID NO: 3712326 - RNA, 20 nt, Salmonella enterica enterica serovar Typhi Ty2
uugccugauggcgcugcgcu

SEQ ID NO: 3712327 - RNA, 20 nt, Salmonella enterica enterica serovar Typhi Ty2
uugccugcggauuugcugcu

SEQ ID NO: 3712328 - RNA, 17 nt, Salmonella enterica enterica serovar Typhi Ty2
uugccuucgauuaacgc

SEQ ID NO: 3712329 - RNA, 17 nt, Salmonella enterica enterica serovar Typhi Ty2
uugccuucgccgcccaa

SEQ ID NO: 3712330 - RNA, 15 nt, Salmonella enterica enterica serovar Typhi Ty2
uugccuucuguuuuu

SEQ ID NO: 3712331 - RNA, 16 nt, Salmonella enterica enterica serovar Typhi Ty2
uugccuuuuuccggga

SEQ ID NO: 3712332 - RNA, 22 nt, Salmonella enterica enterica serovar Typhi Ty2
uugcgaauggccuccagcagca

SEQ ID NO: 3712333 - RNA, 13 nt, Salmonella enterica enterica serovar Typhi Ty2
uugcgacuaucgg

SEQ ID NO: 3712334 - RNA, 13 nt, Salmonella enterica enterica serovar Typhi Ty2
uugcgagaaaaaa

SEQ ID NO: 3712335 - RNA, 13 nt, Salmonella enterica enterica serovar Typhi Ty2
uuggcuuccggca

SEQ ID NO: 3712336 - RNA, 18 nt, Salmonella enterica enterica serovar Typhi Ty2
uugggcagugcucgccaa

SEQ ID NO: 3712337 - RNA, 19 nt, Salmonella enterica enterica serovar Typhi Ty2
uugggcgcgacgccugggc

SEQ ID NO: 3712338 - RNA, 18 nt, Salmonella enterica enterica serovar Typhi Ty2
uugguaaguuuuucucuu

SEQ ID NO: 3712339 - RNA, 19 nt, Salmonella enterica enterica serovar Typhi Ty2
uugguauucaacgccaucu

SEQ ID NO: 3712340 - RNA, 19 nt, Salmonella enterica enterica serovar Typhi Ty2
uuggucaggcuaaauggca

SEQ ID NO: 3712341 - RNA, 23 nt, Salmonella enterica enterica serovar Typhi Ty2
uuggucagguaagcuauuacaaa

SEQ ID NO: 3712342 - RNA, 12 nt, Salmonella enterica enterica serovar Typhi Ty2
uuggugaguggc

SEQ ID NO: 3712343 - RNA, 21 nt, Salmonella enterica enterica serovar Typhi Ty2
uuggugauuaacagcgccauc

SEQ ID NO: 3712344 - RNA, 16 nt, Salmonella enterica enterica serovar Typhi Ty2
uuggugcgacgccaga

SEQ ID NO: 3712345 - RNA, 19 nt, Salmonella enterica enterica serovar Typhi Ty2
uugguuagggaucaucuuc

SEQ ID NO: 3712346 - RNA, 16 nt, Salmonella enterica enterica serovar Typhi Ty2
uugguuucggcguaag

SEQ ID NO: 3712347 - RNA, 12 nt, Salmonella enterica enterica serovar Typhi Ty2
uuguaacagcag

SEQ ID NO: 3712348 - RNA, 19 nt, Salmonella enterica enterica serovar Typhi Ty2
uuguacaaaaaaugugagc

SEQ ID NO: 3712349 - RNA, 17 nt, Salmonella enterica enterica serovar Typhi Ty2
uuguacagcaauaaaag

SEQ ID NO: 3712350 - RNA, 13 nt, Salmonella enterica enterica serovar Typhi Ty2
uuguacaggauau

SEQ ID NO: 3712351 - RNA, 18 nt, Salmonella enterica enterica serovar Typhi Ty2
uuguagcggcaacagcac

SEQ ID NO: 3712352 - RNA, 18 nt, Salmonella enterica enterica serovar Typhi Ty2
uuguagcugcgccagcgu

SEQ ID NO: 3712353 - RNA, 21 nt, Salmonella enterica enterica serovar Typhi Ty2
uuguagcugcgccagcgugcu

SEQ ID NO: 3712354 - RNA, 18 nt, Salmonella enterica enterica serovar Typhi Ty2
uuguagcugcgccugaaa

SEQ ID NO: 3712355 - RNA, 15 nt, Salmonella enterica enterica serovar Typhi Ty2
uuguaggcaggaauu

SEQ ID NO: 3712356 - RNA, 19 nt, Salmonella enterica enterica serovar Typhi Ty2
uuguaggccugauaagcgc

SEQ ID NO: 3712357 - RNA, 16 nt, Salmonella enterica enterica serovar Typhi Ty2
uuguaggccugauagc

SEQ ID NO: 3712358 - RNA, 18 nt, Salmonella enterica enterica serovar Typhi Ty2
uuguaggccugauagcac

SEQ ID NO: 3712359 - RNA, 18 nt, Salmonella enterica enterica serovar Typhi Ty2
uuguaucauguuccggca

SEQ ID NO: 3712360 - RNA, 13 nt, Salmonella enterica enterica serovar Typhi Ty2
uugucaaaaauag

SEQ ID NO: 3712361 - RNA, 15 nt, Salmonella enterica enterica serovar Typhi Ty2
uugucagacaugaua

SEQ ID NO: 3712362 - RNA, 15 nt, Salmonella enterica enterica serovar Typhi Ty2
uugucagcauaaagc

SEQ ID NO: 3712363 - RNA, 19 nt, Salmonella enterica enterica serovar Typhi Ty2
uugucaucaguaugagcga

SEQ ID NO: 3712364 - RNA, 15 nt, Salmonella enterica enterica serovar Typhi Ty2
uugucaucagucuca

SEQ ID NO: 3712365 - RNA, 19 nt, Salmonella enterica enterica serovar Typhi Ty2
uugucauccugcucaucga

SEQ ID NO: 3712366 - RNA, 13 nt, Salmonella enterica enterica serovar Typhi Ty2
uugucccgccuug

SEQ ID NO: 3712367 - RNA, 20 nt, Salmonella enterica enterica serovar Typhi Ty2
uuguccgaugcagacaaaau

SEQ ID NO: 3712368 - RNA, 18 nt, Salmonella enterica enterica serovar Typhi Ty2
uuguccggaucucgccag

SEQ ID NO: 3712369 - RNA, 22 nt, Salmonella enterica enterica serovar Typhi Ty2
uuguccggcguuuuagcgccau

SEQ ID NO: 3712370 - RNA, 22 nt, Salmonella enterica enterica serovar Typhi Ty2
uuguccucaucauucgguuagg

SEQ ID NO: 3712371 - RNA, 13 nt, Salmonella enterica enterica serovar Typhi Ty2
uuguccugguaca

SEQ ID NO: 3712372 - RNA, 18 nt, Salmonella enterica enterica serovar Typhi Ty2
uuguccuuuaucugcccu

SEQ ID NO: 3712373 - RNA, 17 nt, Salmonella enterica enterica serovar Typhi Ty2
uugucgaucaucagacc

SEQ ID NO: 3712374 - RNA, 14 nt, Salmonella enterica enterica serovar Typhi Ty2
uugucgccaauaau

SEQ ID NO: 3712375 - RNA, 15 nt, Salmonella enterica enterica serovar Typhi Ty2
uugucgccaauaauu

SEQ ID NO: 3712376 - RNA, 13 nt, Salmonella enterica enterica serovar Typhi Ty2
uugucgggcagaa

SEQ ID NO: 3712377 - RNA, 14 nt, Salmonella enterica enterica serovar Typhi Ty2
uugucuaacuuacc

SEQ ID NO: 3712378 - RNA, 14 nt, Salmonella enterica enterica serovar Typhi Ty2
uugucugaccgggc

SEQ ID NO: 3712379 - RNA, 22 nt, Salmonella enterica enterica serovar Typhi Ty2
uugucugaugacucucggccua

SEQ ID NO: 3712380 - RNA, 13 nt, Salmonella enterica enterica serovar Typhi Ty2
uugucuucgaugc

SEQ ID NO: 3712381 - RNA, 15 nt, Salmonella enterica enterica serovar Typhi Ty2
uugucuuuuccagua

SEQ ID NO: 3712382 - RNA, 22 nt, Salmonella enterica enterica serovar Typhi Ty2
uugugagcuauacgguaaauca

SEQ ID NO: 3712383 - RNA, 14 nt, Salmonella enterica enterica serovar Typhi Ty2
uugugaguaauaau

SEQ ID NO: 3712384 - RNA, 22 nt, Salmonella enterica enterica serovar Typhi Ty2
uugugaguaauaaucacauuau

SEQ ID NO: 3712385 - RNA, 23 nt, Salmonella enterica enterica serovar Typhi Ty2
uugugauacgcgucaaauagaga

SEQ ID NO: 3712386 - RNA, 13 nt, Salmonella enterica enterica serovar Typhi Ty2
uugugauuccagu

SEQ ID NO: 3712387 - RNA, 15 nt, Salmonella enterica enterica serovar Typhi Ty2
uugugcagaaucauu

SEQ ID NO: 3712388 - RNA, 22 nt, Salmonella enterica enterica serovar Typhi Ty2
uugugccugcugcggauaacgu

SEQ ID NO: 3712389 - RNA, 20 nt, Salmonella enterica enterica serovar Typhi Ty2
uugugcugguggugccgacg

SEQ ID NO: 3712390 - RNA, 22 nt, Salmonella enterica enterica serovar Typhi Ty2
uugugcuuauggguuuccucca

SEQ ID NO: 3712391 - RNA, 17 nt, Salmonella enterica enterica serovar Typhi Ty2
uugugucaaaaaguugu

SEQ ID NO: 3712392 - RNA, 16 nt, Salmonella enterica enterica serovar Typhi Ty2
uuguuacucaauaaaa

SEQ ID NO: 3712393 - RNA, 21 nt, Salmonella enterica enterica serovar Typhi Ty2
uuguucaaucggauaauccgc

SEQ ID NO: 3712394 - RNA, 21 nt, Salmonella enterica enterica serovar Typhi Ty2
uuguucaguuucaaagaacga

SEQ ID NO: 3712395 - RNA, 15 nt, Salmonella enterica enterica serovar Typhi Ty2
uuguucaugcaauuc

SEQ ID NO: 3712396 - RNA, 14 nt, Salmonella enterica enterica serovar Typhi Ty2
uuguuccagcagcu

SEQ ID NO: 3712397 - RNA, 19 nt, Salmonella enterica enterica serovar Typhi Ty2
uuguuccugcuggcaaaac

SEQ ID NO: 3712398 - RNA, 16 nt, Salmonella enterica enterica serovar Typhi Ty2
uuguucgucuuuugaa

SEQ ID NO: 3712399 - RNA, 14 nt, Salmonella enterica enterica serovar Typhi Ty2
uuguucuaaacguu

SEQ ID NO: 3712400 - RNA, 13 nt, Salmonella enterica enterica serovar Typhi Ty2
uuguuuaaaaacc

SEQ ID NO: 3712401 - RNA, 19 nt, Salmonella enterica enterica serovar Typhi Ty2
uuguuuacgcccucaucgg

SEQ ID NO: 3712402 - RNA, 17 nt, Salmonella enterica enterica serovar Typhi Ty2
uuguuuauuaugcguuu

SEQ ID NO: 3712403 - RNA, 17 nt, Salmonella enterica enterica serovar Typhi Ty2
uuguuuauuccauucau

SEQ ID NO: 3712404 - RNA, 19 nt, Salmonella enterica enterica serovar Typhi Ty2
uuguuucggauaauucuga

SEQ ID NO: 3712405 - RNA, 15 nt, Salmonella enterica enterica serovar Typhi Ty2
uuguuucuuaacccc

SEQ ID NO: 3712406 - RNA, 18 nt, Salmonella enterica enterica serovar Typhi Ty2
uuguuuguggcaaaguac

SEQ ID NO: 3712407 - RNA, 20 nt, Salmonella enterica enterica serovar Typhi Ty2
uuguuuuaaauucaaccagu

SEQ ID NO: 3712408 - RNA, 12 nt, Salmonella enterica enterica serovar Typhi Ty2
uuuaaaaugacc

SEQ ID NO: 3712409 - RNA, 18 nt, Salmonella enterica enterica serovar Typhi Ty2
uuuaaaauguuuuuguug

SEQ ID NO: 3712410 - RNA, 16 nt, Salmonella enterica enterica serovar Typhi Ty2
uuuaaaauuccaauau

SEQ ID NO: 3712411 - RNA, 22 nt, Salmonella enterica enterica serovar Typhi Ty2
uuuaaaauuccaauauuuauuu

SEQ ID NO: 3712412 - RNA, 15 nt, Salmonella enterica enterica serovar Typhi Ty2
uuuaaaccacaccug

SEQ ID NO: 3712413 - RNA, 20 nt, Salmonella enterica enterica serovar Typhi Ty2
uuuaacaaaucgacagccag

SEQ ID NO: 3712414 - RNA, 14 nt, Salmonella enterica enterica serovar Typhi Ty2
uuuaacagauaauu

SEQ ID NO: 3712415 - RNA, 20 nt, Salmonella enterica enterica serovar Typhi Ty2
uuuaacagauaauuaauaau

SEQ ID NO: 3712416 - RNA, 16 nt, Salmonella enterica enterica serovar Typhi Ty2
uuuaaccucuuuuuca

SEQ ID NO: 3712417 - RNA, 12 nt, Salmonella enterica enterica serovar Typhi Ty2
uuuauuuuucaa

SEQ ID NO: 3712418 - RNA, 21 nt, Salmonella enterica enterica serovar Typhi Ty2
uuuauuuuuuuacauuauucc

SEQ ID NO: 3712419 - RNA, 20 nt, Salmonella enterica enterica serovar Typhi Ty2
uuucaacagcacccaggcac

SEQ ID NO: 3712420 - RNA, 20 nt, Salmonella enterica enterica serovar Typhi Ty2
uuucaacauauuuuucacac

SEQ ID NO: 3712421 - RNA, 23 nt, Salmonella enterica enterica serovar Typhi Ty2
uuucaacauauuuuucacacaua

SEQ ID NO: 3712422 - RNA, 18 nt, Salmonella enterica enterica serovar Typhi Ty2
uuucaacccccucagcaa

SEQ ID NO: 3712423 - RNA, 23 nt, Salmonella enterica enterica serovar Typhi Ty2
uuucaacccccucagcaaugauu

SEQ ID NO: 3712424 - RNA, 21 nt, Salmonella enterica enterica serovar Typhi Ty2
uuucaaccgcgccaaagauaa

SEQ ID NO: 3712425 - RNA, 22 nt, Salmonella enterica enterica serovar Typhi Ty2
uuucaaccgcgccaaagauaag

SEQ ID NO: 3712426 - RNA, 21 nt, Salmonella enterica enterica serovar Typhi Ty2
uuucaacgcguugccugaaaa

SEQ ID NO: 3712427 - RNA, 12 nt, Salmonella enterica enterica serovar Typhi Ty2
uuucaacggauu

SEQ ID NO: 3712428 - RNA, 21 nt, Salmonella enterica enterica serovar Typhi Ty2
uuucaagcaauaccggguuaa

SEQ ID NO: 3712429 - RNA, 22 nt, Salmonella enterica enterica serovar Typhi Ty2
uuucaagcaggcgaucggcgug

SEQ ID NO: 3712430 - RNA, 11 nt, Salmonella enterica enterica serovar Typhi Ty2
uuucaauaaua

SEQ ID NO: 3712431 - RNA, 19 nt, Salmonella enterica enterica serovar Typhi Ty2
uuucaauauagccguggcu

SEQ ID NO: 3712432 - RNA, 13 nt, Salmonella enterica enterica serovar Typhi Ty2
uuucaaucaucau

SEQ ID NO: 3712433 - RNA, 18 nt, Salmonella enterica enterica serovar Typhi Ty2
uuucaauccuucuucuga

SEQ ID NO: 3712434 - RNA, 20 nt, Salmonella enterica enterica serovar Typhi Ty2
uuucaaucgcgcccgccauc

SEQ ID NO: 3712435 - RNA, 17 nt, Salmonella enterica enterica serovar Typhi Ty2
uuucaauuccacaggcg

SEQ ID NO: 3712436 - RNA, 13 nt, Salmonella enterica enterica serovar Typhi Ty2
uuucacaucgcca

SEQ ID NO: 3712437 - RNA, 24 nt, Salmonella enterica enterica serovar Typhi Ty2
uuucaccgcgucguuacgcucguc

SEQ ID NO: 3712438 - RNA, 20 nt, Salmonella enterica enterica serovar Typhi Ty2
uuucaccucacuccagaccu

SEQ ID NO: 3712439 - RNA, 12 nt, Salmonella enterica enterica serovar Typhi Ty2
uuucaccuucug

SEQ ID NO: 3712440 - RNA, 23 nt, Salmonella enterica enterica serovar Typhi Ty2
uuucacgccauugccaggacuga

SEQ ID NO: 3712441 - RNA, 21 nt, Salmonella enterica enterica serovar Typhi Ty2
uuucacuaauccccauuuuuu

SEQ ID NO: 3712442 - RNA, 12 nt, Salmonella enterica enterica serovar Typhi Ty2
uuucacuauaaa

SEQ ID NO: 3712443 - RNA, 19 nt, Salmonella enterica enterica serovar Typhi Ty2
uuucacucgcauucuucag

SEQ ID NO: 3712444 - RNA, 14 nt, Salmonella enterica enterica serovar Typhi Ty2
uuucacuuccaugc

SEQ ID NO: 3712445 - RNA, 18 nt, Salmonella enterica enterica serovar Typhi Ty2
uuucagauaacgaaccau

SEQ ID NO: 3712446 - RNA, 13 nt, Salmonella enterica enterica serovar Typhi Ty2
uuucagaucgccg

SEQ ID NO: 3712447 - RNA, 13 nt, Salmonella enterica enterica serovar Typhi Ty2
uuucagaucggca

SEQ ID NO: 3712448 - RNA, 12 nt, Salmonella enterica enterica serovar Typhi Ty2
uuucagccccuu

SEQ ID NO: 3712449 - RNA, 18 nt, Salmonella enterica enterica serovar Typhi Ty2
uuucagccgcgcauagcu

SEQ ID NO: 3712450 - RNA, 19 nt, Salmonella enterica enterica serovar Typhi Ty2
uuucagccgcgcauagcug

SEQ ID NO: 3712451 - RNA, 23 nt, Salmonella enterica enterica serovar Typhi Ty2
uuucagcgcagaauuuauuucug

SEQ ID NO: 3712452 - RNA, 18 nt, Salmonella enterica enterica serovar Typhi Ty2
uuucagcggcagcucugc

SEQ ID NO: 3712453 - RNA, 21 nt, Salmonella enterica enterica serovar Typhi Ty2
uuucagcguaccgaagaacau

SEQ ID NO: 3712454 - RNA, 20 nt, Salmonella enterica enterica serovar Typhi Ty2
uuucaggcaaaaaaaaaccg

SEQ ID NO: 3712455 - RNA, 16 nt, Salmonella enterica enterica serovar Typhi Ty2
uuucagggaaaagaag

SEQ ID NO: 3712456 - RNA, 21 nt, Salmonella enterica enterica serovar Typhi Ty2
uuucagugacgcguuaauauc

SEQ ID NO: 3712457 - RNA, 14 nt, Salmonella enterica enterica serovar Typhi Ty2
uuucagugauaaag

SEQ ID NO: 3712458 - RNA, 16 nt, Salmonella enterica enterica serovar Typhi Ty2
uuucagugauaaagcc

SEQ ID NO: 3712459 - RNA, 15 nt, Salmonella enterica enterica serovar Typhi Ty2
uuucaguugcccauu

SEQ ID NO: 3712460 - RNA, 22 nt, Salmonella enterica enterica serovar Typhi Ty2
uuucaguuucggccccccccau

SEQ ID NO: 3712461 - RNA, 18 nt, Salmonella enterica enterica serovar Typhi Ty2
uuucauaauaagcgcuca

SEQ ID NO: 3712462 - RNA, 12 nt, Salmonella enterica enterica serovar Typhi Ty2
uuucauaauguu

SEQ ID NO: 3712463 - RNA, 23 nt, Salmonella enterica enterica serovar Typhi Ty2
uuucauauuauuauauagacucc

SEQ ID NO: 3712464 - RNA, 14 nt, Salmonella enterica enterica serovar Typhi Ty2
uuucauauuuuccu

SEQ ID NO: 3712465 - RNA, 11 nt, Salmonella enterica enterica serovar Typhi Ty2
uuucauccucu

SEQ ID NO: 3712466 - RNA, 12 nt, Salmonella enterica enterica serovar Typhi Ty2
uuucauccucuu

SEQ ID NO: 3712467 - RNA, 19 nt, Salmonella enterica enterica serovar Typhi Ty2
uuucaucgccgauuccugc

SEQ ID NO: 3712468 - RNA, 15 nt, Salmonella enterica enterica serovar Typhi Ty2
uuucaucuucaguaa

SEQ ID NO: 3712469 - RNA, 16 nt, Salmonella enterica enterica serovar Typhi Ty2
uuucaugauauucugu

SEQ ID NO: 3712470 - RNA, 14 nt, Salmonella enterica enterica serovar Typhi Ty2
uuucaugccauacu

SEQ ID NO: 3712471 - RNA, 17 nt, Salmonella enterica enterica serovar Typhi Ty2
uuucauuggucaguaag

SEQ ID NO: 3712472 - RNA, 16 nt, Salmonella enterica enterica serovar Typhi Ty2
uuucauuucgaucugu

SEQ ID NO: 3712473 - RNA, 13 nt, Salmonella enterica enterica serovar Typhi Ty2
uuucauuucugcc

SEQ ID NO: 3712474 - RNA, 22 nt, Salmonella enterica enterica serovar Typhi Ty2
uuuccacaaucccggcaacugc

SEQ ID NO: 3712475 - RNA, 20 nt, Salmonella enterica enterica serovar Typhi Ty2
uuuccagaguacauucucuu

SEQ ID NO: 3712476 - RNA, 15 nt, Salmonella enterica enterica serovar Typhi Ty2
uuuccagcacgccca

SEQ ID NO: 3712477 - RNA, 23 nt, Salmonella enterica enterica serovar Typhi Ty2
uuuccagcacggcauaagccuca

SEQ ID NO: 3712478 - RNA, 14 nt, Salmonella enterica enterica serovar Typhi Ty2
uuuccagcagccag

SEQ ID NO: 3712479 - RNA, 18 nt, Salmonella enterica enterica serovar Typhi Ty2
uuuccagcauuagcgcca

SEQ ID NO: 3712480 - RNA, 20 nt, Salmonella enterica enterica serovar Typhi Ty2
uuuccagccccuucgcuguc

SEQ ID NO: 3712481 - RNA, 21 nt, Salmonella enterica enterica serovar Typhi Ty2
uuuccagccguaccacccggg

SEQ ID NO: 3712482 - RNA, 17 nt, Salmonella enterica enterica serovar Typhi Ty2
uuuccagcucagaaaua

SEQ ID NO: 3712483 - RNA, 22 nt, Salmonella enterica enterica serovar Typhi Ty2
uuuccagcuccagccgcugccu

SEQ ID NO: 3712484 - RNA, 17 nt, Salmonella enterica enterica serovar Typhi Ty2
uuuccaggugcugccac

SEQ ID NO: 3712485 - RNA, 19 nt, Salmonella enterica enterica serovar Typhi Ty2
uuuccaguagucgcgccau

SEQ ID NO: 3712486 - RNA, 12 nt, Salmonella enterica enterica serovar Typhi Ty2
uuuccagucaac

SEQ ID NO: 3712487 - RNA, 22 nt, Salmonella enterica enterica serovar Typhi Ty2
uuuccauucacacaauuuucuu

SEQ ID NO: 3712488 - RNA, 20 nt, Salmonella enterica enterica serovar Typhi Ty2
uuucccaacuguauuuugaa

SEQ ID NO: 3712489 - RNA, 13 nt, Salmonella enterica enterica serovar Typhi Ty2
uuucccacuguuc

SEQ ID NO: 3712490 - RNA, 19 nt, Salmonella enterica enterica serovar Typhi Ty2
uuucccagaauccgcgcau

SEQ ID NO: 3712491 - RNA, 22 nt, Salmonella enterica enterica serovar Typhi Ty2
uuuccccaaagguguuauuucu

SEQ ID NO: 3712492 - RNA, 15 nt, Salmonella enterica enterica serovar Typhi Ty2
uuucccccacuucug

SEQ ID NO: 3712493 - RNA, 19 nt, Salmonella enterica enterica serovar Typhi Ty2
uuucccccuccauacccua

SEQ ID NO: 3712494 - RNA, 18 nt, Salmonella enterica enterica serovar Typhi Ty2
uuucccgcgugaacacca

SEQ ID NO: 3712495 - RNA, 14 nt, Salmonella enterica enterica serovar Typhi Ty2
uuucccggcgugaa

SEQ ID NO: 3712496 - RNA, 15 nt, Salmonella enterica enterica serovar Typhi Ty2
uuucccuucugaaau

SEQ ID NO: 3712497 - RNA, 18 nt, Salmonella enterica enterica serovar Typhi Ty2
uuuccgcagccagaauca

SEQ ID NO: 3712498 - RNA, 18 nt, Salmonella enterica enterica serovar Typhi Ty2
uuuccgccugaucuuucu

SEQ ID NO: 3712499 - RNA, 16 nt, Salmonella enterica enterica serovar Typhi Ty2
uuuccgcugucuaucc

SEQ ID NO: 3712500 - RNA, 15 nt, Salmonella enterica enterica serovar Typhi Ty2
uuuccggcgggagcu

SEQ ID NO: 3712501 - RNA, 18 nt, Salmonella enterica enterica serovar Typhi Ty2
uuuccggcgggagcucua

SEQ ID NO: 3712502 - RNA, 17 nt, Salmonella enterica enterica serovar Typhi Ty2
uuuccguugugaacagc

SEQ ID NO: 3712503 - RNA, 22 nt, Salmonella enterica enterica serovar Typhi Ty2
uuuccguuuguaacauauuuuu

SEQ ID NO: 3712504 - RNA, 13 nt, Salmonella enterica enterica serovar Typhi Ty2
uuuccguuuuuau

SEQ ID NO: 3712505 - RNA, 16 nt, Salmonella enterica enterica serovar Typhi Ty2
uuuccucaaccucuuu

SEQ ID NO: 3712506 - RNA, 18 nt, Salmonella enterica enterica serovar Typhi Ty2
uuuccugaugauauuucu

SEQ ID NO: 3712507 - RNA, 21 nt, Salmonella enterica enterica serovar Typhi Ty2
uuuccugccuucugaaaguuu

SEQ ID NO: 3712508 - RNA, 21 nt, Salmonella enterica enterica serovar Typhi Ty2
uuuccugcuguugucgauauu

SEQ ID NO: 3712509 - RNA, 22 nt, Salmonella enterica enterica serovar Typhi Ty2
uuuccugguaaucgauacggga

SEQ ID NO: 3712510 - RNA, 20 nt, Salmonella enterica enterica serovar Typhi Ty2
uuucgaaacaggaaaaacau

SEQ ID NO: 3712511 - RNA, 21 nt, Salmonella enterica enterica serovar Typhi Ty2
uuucgacgauaaaaaaaguau

SEQ ID NO: 3712512 - RNA, 17 nt, Salmonella enterica enterica serovar Typhi Ty2
uuucgacggcaaccuuc

SEQ ID NO: 3712513 - RNA, 16 nt, Salmonella enterica enterica serovar Typhi Ty2
uuucgacuuucauuuc

SEQ ID NO: 3712514 - RNA, 18 nt, Salmonella enterica enterica serovar Typhi Ty2
uuucgagcagaacuggcg

SEQ ID NO: 3712515 - RNA, 17 nt, Salmonella enterica enterica serovar Typhi Ty2
uuucgcaaacacccgac

SEQ ID NO: 3712516 - RNA, 21 nt, Salmonella enterica enterica serovar Typhi Ty2
uuucgcaaacugaucgaggac

SEQ ID NO: 3712517 - RNA, 20 nt, Salmonella enterica enterica serovar Typhi Ty2
uuucgccacgcucacuuuuc

SEQ ID NO: 3712518 - RNA, 13 nt, Salmonella enterica enterica serovar Typhi Ty2
uuucgccagcaac

SEQ ID NO: 3712519 - RNA, 21 nt, Salmonella enterica enterica serovar Typhi Ty2
uuucgccagcgcaucgauaua

SEQ ID NO: 3712520 - RNA, 13 nt, Salmonella enterica enterica serovar Typhi Ty2
uuucgcccacauc

SEQ ID NO: 3712521 - RNA, 16 nt, Salmonella enterica enterica serovar Typhi Ty2
uuucgccccacuggcc

SEQ ID NO: 3712522 - RNA, 18 nt, Salmonella enterica enterica serovar Typhi Ty2
uuucgccccacuggcccc

SEQ ID NO: 3712523 - RNA, 17 nt, Salmonella enterica enterica serovar Typhi Ty2
uuucgcccgcucgcgau

SEQ ID NO: 3712524 - RNA, 18 nt, Salmonella enterica enterica serovar Typhi Ty2
uuucgccgccauccggca

SEQ ID NO: 3712525 - RNA, 14 nt, Salmonella enterica enterica serovar Typhi Ty2
uuucgccguccaga

SEQ ID NO: 3712526 - RNA, 17 nt, Salmonella enterica enterica serovar Typhi Ty2
uuucgcgaauaaucugu

SEQ ID NO: 3712527 - RNA, 23 nt, Salmonella enterica enterica serovar Typhi Ty2
uuucgcgauaauagaacccaaag

SEQ ID NO: 3712528 - RNA, 15 nt, Salmonella enterica enterica serovar Typhi Ty2
uuucgcuguaauagu

SEQ ID NO: 3712529 - RNA, 15 nt, Salmonella enterica enterica serovar Typhi Ty2
uuucggacuuccugu

SEQ ID NO: 3712530 - RNA, 23 nt, Salmonella enterica enterica serovar Typhi Ty2
uuucggcguguaacugcaaacgc

SEQ ID NO: 3712531 - RNA, 15 nt, Salmonella enterica enterica serovar Typhi Ty2
uuucgggcacuggcg

SEQ ID NO: 3712532 - RNA, 19 nt, Salmonella enterica enterica serovar Typhi Ty2
uuucguacauguccagauc

SEQ ID NO: 3712533 - RNA, 18 nt, Salmonella enterica enterica serovar Typhi Ty2
uuucguagggccgcguau

SEQ ID NO: 3712534 - RNA, 18 nt, Salmonella enterica enterica serovar Typhi Ty2
uuucguccggcugccacu

SEQ ID NO: 3712535 - RNA, 17 nt, Salmonella enterica enterica serovar Typhi Ty2
uuucuacuacaacuguc

SEQ ID NO: 3712536 - RNA, 13 nt, Salmonella enterica enterica serovar Typhi Ty2
uuucucaauacga

SEQ ID NO: 3712537 - RNA, 12 nt, Salmonella enterica enterica serovar Typhi Ty2
uuucucaucaag

SEQ ID NO: 3712538 - RNA, 13 nt, Salmonella enterica enterica serovar Typhi Ty2
uuucucauuaaaa

SEQ ID NO: 3712539 - RNA, 18 nt, Salmonella enterica enterica serovar Typhi Ty2
uuucucauuaaaaaaccg

SEQ ID NO: 3712540 - RNA, 18 nt, Salmonella enterica enterica serovar Typhi Ty2
uuucucccgccagaugca

SEQ ID NO: 3712541 - RNA, 19 nt, Salmonella enterica enterica serovar Typhi Ty2
uuucucccgccagaugcag

SEQ ID NO: 3712542 - RNA, 23 nt, Salmonella enterica enterica serovar Typhi Ty2
uuucuccugcgccagccggauac

SEQ ID NO: 3712543 - RNA, 11 nt, Salmonella enterica enterica serovar Typhi Ty2
uuucucgccau

SEQ ID NO: 3712544 - RNA, 17 nt, Salmonella enterica enterica serovar Typhi Ty2
uuucucggcuuuccagc

SEQ ID NO: 3712545 - RNA, 19 nt, Salmonella enterica enterica serovar Typhi Ty2
uuucucggcuuuccagcuc

SEQ ID NO: 3712546 - RNA, 22 nt, Salmonella enterica enterica serovar Typhi Ty2
uuucucugguuucccugccuca

SEQ ID NO: 3712547 - RNA, 14 nt, Salmonella enterica enterica serovar Typhi Ty2
uuucugaugcgccu

SEQ ID NO: 3712548 - RNA, 18 nt, Salmonella enterica enterica serovar Typhi Ty2
uuucugccuuuaacaaau

SEQ ID NO: 3712549 - RNA, 15 nt, Salmonella enterica enterica serovar Typhi Ty2
uuucugcuggccuuu

SEQ ID NO: 3712550 - RNA, 21 nt, Salmonella enterica enterica serovar Typhi Ty2
uuucuggcuucagccugugca

SEQ ID NO: 3712551 - RNA, 19 nt, Salmonella enterica enterica serovar Typhi Ty2
uuucuguacagcgucgaca

SEQ ID NO: 3712552 - RNA, 14 nt, Salmonella enterica enterica serovar Typhi Ty2
uuucuguuaucagg

SEQ ID NO: 3712553 - RNA, 14 nt, Salmonella enterica enterica serovar Typhi Ty2
uuucuguuccgaaa

SEQ ID NO: 3712554 - RNA, 15 nt, Salmonella enterica enterica serovar Typhi Ty2
uuucuguuccgaaau

SEQ ID NO: 3712555 - RNA, 12 nt, Salmonella enterica enterica serovar Typhi Ty2
uuucuuaacccc

SEQ ID NO: 3712556 - RNA, 13 nt, Salmonella enterica enterica serovar Typhi Ty2
uuucuuauuuauu

SEQ ID NO: 3712557 - RNA, 13 nt, Salmonella enterica enterica serovar Typhi Ty2
uuucuucaucaaa

SEQ ID NO: 3712558 - RNA, 13 nt, Salmonella enterica enterica serovar Typhi Ty2
uuucuuccagguu

SEQ ID NO: 3712559 - RNA, 19 nt, Salmonella enterica enterica serovar Typhi Ty2
uuucuuccauuagcuguug

SEQ ID NO: 3712560 - RNA, 21 nt, Salmonella enterica enterica serovar Typhi Ty2
uuucuucccuccccugcgccu

SEQ ID NO: 3712561 - RNA, 15 nt, Salmonella enterica enterica serovar Typhi Ty2
uuucuucuuaacacu

SEQ ID NO: 3712562 - RNA, 22 nt, Salmonella enterica enterica serovar Typhi Ty2
uuucuugaugugucuauuuauu

SEQ ID NO: 3712563 - RNA, 23 nt, Salmonella enterica enterica serovar Typhi Ty2
uuucuugccacuggccucccagu

SEQ ID NO: 3712564 - RNA, 13 nt, Salmonella enterica enterica serovar Typhi Ty2
uuucuuucaucaa

SEQ ID NO: 3712565 - RNA, 13 nt, Salmonella enterica enterica serovar Typhi Ty2
uuucuuuuccaga

SEQ ID NO: 3712566 - RNA, 13 nt, Salmonella enterica enterica serovar Typhi Ty2
uuugaaaaucaca

SEQ ID NO: 3712567 - RNA, 15 nt, Salmonella enterica enterica serovar Typhi Ty2
uuugaacucuuucag

SEQ ID NO: 3712568 - RNA, 14 nt, Salmonella enterica enterica serovar Typhi Ty2
uuugacauugucau

SEQ ID NO: 3712569 - RNA, 23 nt, Salmonella enterica enterica serovar Typhi Ty2
uuugacccacgccagcagcucgc

SEQ ID NO: 3712570 - RNA, 21 nt, Salmonella enterica enterica serovar Typhi Ty2
uuugacgacaaacuccagcuc

SEQ ID NO: 3712571 - RNA, 22 nt, Salmonella enterica enterica serovar Typhi Ty2
uuugacgccgggaaauuuuucg

SEQ ID NO: 3712572 - RNA, 22 nt, Salmonella enterica enterica serovar Typhi Ty2
uuugacucgcuacgcucgcccu

SEQ ID NO: 3712573 - RNA, 15 nt, Salmonella enterica enterica serovar Typhi Ty2
uuugagaaaaacauc

SEQ ID NO: 3712574 - RNA, 15 nt, Salmonella enterica enterica serovar Typhi Ty2
uuugagcaacuucag

SEQ ID NO: 3712575 - RNA, 17 nt, Salmonella enterica enterica serovar Typhi Ty2
uuugauauuuaaucgcu

SEQ ID NO: 3712576 - RNA, 21 nt, Salmonella enterica enterica serovar Typhi Ty2
uuugaucccguccgcgcucau

SEQ ID NO: 3712577 - RNA, 18 nt, Salmonella enterica enterica serovar Typhi Ty2
uuugauccguuucagaaa

SEQ ID NO: 3712578 - RNA, 20 nt, Salmonella enterica enterica serovar Typhi Ty2
uuugauccguuucagaaaga

SEQ ID NO: 3712579 - RNA, 14 nt, Salmonella enterica enterica serovar Typhi Ty2
uuugaucugcuuga

SEQ ID NO: 3712580 - RNA, 21 nt, Salmonella enterica enterica serovar Typhi Ty2
uuugaugcaaaugucagaucg

SEQ ID NO: 3712581 - RNA, 12 nt, Salmonella enterica enterica serovar Typhi Ty2
uuuuaaaaguua

SEQ ID NO: 3712582 - RNA, 13 nt, Salmonella enterica enterica serovar Typhi Ty2
uuuuaaaaguuag

SEQ ID NO: 3712583 - RNA, 14 nt, Salmonella enterica enterica serovar Typhi Ty2
uuuuaaaauguuuu

SEQ ID NO: 3712584 - RNA, 15 nt, Salmonella enterica enterica serovar Typhi Ty2
uuuuaaacgccugau

SEQ ID NO: 3712585 - RNA, 19 nt, Salmonella enterica enterica serovar Typhi Ty2
uuuuaaauaacuuuuaauu

SEQ ID NO: 3712586 - RNA, 22 nt, Salmonella enterica enterica serovar Typhi Ty2
uuuuaaauaacuuuuaauuuuu

SEQ ID NO: 3712587 - RNA, 13 nt, Salmonella enterica enterica serovar Typhi Ty2
uuuuaaauguuuu

SEQ ID NO: 3712588 - RNA, 17 nt, Salmonella enterica enterica serovar Typhi Ty2
uuuuaaauguuuuuuca

SEQ ID NO: 3712589 - RNA, 12 nt, Salmonella enterica enterica serovar Typhi Ty2
uuuuaaauuccu

SEQ ID NO: 3712590 - RNA, 13 nt, Salmonella enterica enterica serovar Typhi Ty2
uuuuaaauugaag

SEQ ID NO: 3712591 - RNA, 12 nt, Salmonella enterica enterica serovar Typhi Ty2
uuuuaaccauca

SEQ ID NO: 3712592 - RNA, 20 nt, Salmonella enterica enterica serovar Typhi Ty2
uuuuaaggcggcaaagauaa

SEQ ID NO: 3712593 - RNA, 12 nt, Salmonella enterica enterica serovar Typhi Ty2
uuuuaauaacgg

SEQ ID NO: 3712594 - RNA, 17 nt, Salmonella enterica enterica serovar Typhi Ty2
uuuuaauguccagcagu

SEQ ID NO: 3712595 - RNA, 17 nt, Salmonella enterica enterica serovar Typhi Ty2
uuuuaauuuucuguaau

SEQ ID NO: 3712596 - RNA, 12 nt, Salmonella enterica enterica serovar Typhi Ty2
uuuuaauuuuua

SEQ ID NO: 3712597 - RNA, 13 nt, Salmonella enterica enterica serovar Typhi Ty2
uuuuacaucagau

SEQ ID NO: 3712598 - RNA, 23 nt, Salmonella enterica enterica serovar Typhi Ty2
uuuuaccccccaugaauuacagc

SEQ ID NO: 3712599 - RNA, 19 nt, Salmonella enterica enterica serovar Typhi Ty2
uuuuaccgcccgcgccagu

SEQ ID NO: 3712600 - RNA, 23 nt, Salmonella enterica enterica serovar Typhi Ty2
uuuuacgagaaccaacugccaaa

SEQ ID NO: 3712601 - RNA, 20 nt, Salmonella enterica enterica serovar Typhi Ty2
uuuuacgccacggcaauuua

SEQ ID NO: 3712602 - RNA, 21 nt, Salmonella enterica enterica serovar Typhi Ty2
uuuuacgccauaacacaaacu

SEQ ID NO: 3712603 - RNA, 19 nt, Salmonella enterica enterica serovar Typhi Ty2
uuuuacuuucaaaauacug

SEQ ID NO: 3712604 - RNA, 15 nt, Salmonella enterica enterica serovar Typhi Ty2
uuuuacuuucauucc

SEQ ID NO: 3712605 - RNA, 13 nt, Salmonella enterica enterica serovar Typhi Ty2
uuuuagaaaauaa

SEQ ID NO: 3712606 - RNA, 14 nt, Salmonella enterica enterica serovar Typhi Ty2
uuuuagaauuaucu

SEQ ID NO: 3712607 - RNA, 19 nt, Salmonella enterica enterica serovar Typhi Ty2
uuuuagaauuaucugaaag

SEQ ID NO: 3712608 - RNA, 20 nt, Salmonella enterica enterica serovar Typhi Ty2
uuuuagauccccaaacugcu

SEQ ID NO: 3712609 - RNA, 21 nt, Salmonella enterica enterica serovar Typhi Ty2
uuuuagcaaugaugaugaagg

SEQ ID NO: 3712610 - RNA, 20 nt, Salmonella enterica enterica serovar Typhi Ty2
uuuuagccuguuauucaauu

SEQ ID NO: 3712611 - RNA, 17 nt, Salmonella enterica enterica serovar Typhi Ty2
uuuuagcguuucaucgg

SEQ ID NO: 3712612 - RNA, 14 nt, Salmonella enterica enterica serovar Typhi Ty2
uuuuagcuuaaaaa

SEQ ID NO: 3712613 - RNA, 15 nt, Salmonella enterica enterica serovar Typhi Ty2
uuuuaggcuauaaaa

SEQ ID NO: 3712614 - RNA, 14 nt, Salmonella enterica enterica serovar Typhi Ty2
uuuuauaaauauag

SEQ ID NO: 3712615 - RNA, 15 nt, Salmonella enterica enterica serovar Typhi Ty2
uuuuauagcagucag

SEQ ID NO: 3712616 - RNA, 23 nt, Salmonella enterica enterica serovar Typhi Ty2
uuuuauccguuuccgcaauaagu

SEQ ID NO: 3712617 - RNA, 21 nt, Salmonella enterica enterica serovar Typhi Ty2
uuuuauccuguguuuggccgc

SEQ ID NO: 3712618 - RNA, 23 nt, Salmonella enterica enterica serovar Typhi Ty2
uuuuaucucuuuugcuucaauaa

SEQ ID NO: 3712619 - RNA, 19 nt, Salmonella enterica enterica serovar Typhi Ty2
uuuuaugaugcauuugauu

SEQ ID NO: 3712620 - RNA, 20 nt, Salmonella enterica enterica serovar Typhi Ty2
uuuuaugcacgcuauaacgu

SEQ ID NO: 3712621 - RNA, 15 nt, Salmonella enterica enterica serovar Typhi Ty2
uuuuaugcagccgau

SEQ ID NO: 3712622 - RNA, 12 nt, Salmonella enterica enterica serovar Typhi Ty2
uuuuaugcguuu

SEQ ID NO: 3712623 - RNA, 16 nt, Salmonella enterica enterica serovar Typhi Ty2
uuuuaugcguuuaauu

SEQ ID NO: 3712624 - RNA, 20 nt, Salmonella enterica enterica serovar Typhi Ty2
uuuuaugcguuuaauugaau

SEQ ID NO: 3712625 - RNA, 23 nt, Salmonella enterica enterica serovar Typhi Ty2
uuuuauggaaucggcuaguaaua

SEQ ID NO: 3712626 - RNA, 21 nt, Salmonella enterica enterica serovar Typhi Ty2
uuuuauuauuuugauacucau

SEQ ID NO: 3712627 - RNA, 14 nt, Salmonella enterica enterica serovar Typhi Ty2
uuuuauuuuucaau

SEQ ID NO: 3712628 - RNA, 13 nt, Salmonella enterica enterica serovar Typhi Ty2
uuuucaaaaacaa

SEQ ID NO: 3712629 - RNA, 17 nt, Salmonella enterica enterica serovar Typhi Ty2
uuuucaaccacggauaa

SEQ ID NO: 3712630 - RNA, 21 nt, Salmonella enterica enterica serovar Typhi Ty2
uuuucaacggcaucaauaauu

SEQ ID NO: 3712631 - RNA, 20 nt, Salmonella enterica enterica serovar Typhi Ty2
uuuucaaugucgcaaucggc

SEQ ID NO: 3712632 - RNA, 19 nt, Salmonella enterica enterica serovar Typhi Ty2
uuuucacgaccaaccaaca

SEQ ID NO: 3712633 - RNA, 23 nt, Salmonella enterica enterica serovar Typhi Ty2
uuuucacuaauccccauuuuuuu

SEQ ID NO: 3712634 - RNA, 16 nt, Salmonella enterica enterica serovar Typhi Ty2
uuuucagcagugcaaa

SEQ ID NO: 3712635 - RNA, 18 nt, Salmonella enterica enterica serovar Typhi Ty2
uuuucagcggcagcucug

SEQ ID NO: 3712636 - RNA, 17 nt, Salmonella enterica enterica serovar Typhi Ty2
uuuucaggaaguuuaac

SEQ ID NO: 3712637 - RNA, 15 nt, Salmonella enterica enterica serovar Typhi Ty2
uuuucaggcacagaa

SEQ ID NO: 3712638 - RNA, 11 nt, Salmonella enterica enterica serovar Typhi Ty2
uuuucaggccg

SEQ ID NO: 3712639 - RNA, 15 nt, Salmonella enterica enterica serovar Typhi Ty2
uuuucauauguuuga

SEQ ID NO: 3712640 - RNA, 13 nt, Salmonella enterica enterica serovar Typhi Ty2
uuuucaucaucau

SEQ ID NO: 3712641 - RNA, 15 nt, Salmonella enterica enterica serovar Typhi Ty2
uuuucaugcaauaau

SEQ ID NO: 3712642 - RNA, 20 nt, Salmonella enterica enterica serovar Typhi Ty2
uuuucauucgaucuguguac

SEQ ID NO: 3712643 - RNA, 18 nt, Salmonella enterica enterica serovar Typhi Ty2
uuuuccacagacccagua

SEQ ID NO: 3712644 - RNA, 19 nt, Salmonella enterica enterica serovar Typhi Ty2
uuuuccagcauuucuucaa

SEQ ID NO: 3712645 - RNA, 22 nt, Salmonella enterica enterica serovar Typhi Ty2
uuuuccagccgcuuuucgcuua

SEQ ID NO: 3712646 - RNA, 22 nt, Salmonella enterica enterica serovar Typhi Ty2
uuuuccagcgccgccagaauca

SEQ ID NO: 3712647 - RNA, 18 nt, Salmonella enterica enterica serovar Typhi Ty2
uuuuccaggugcugccac

SEQ ID NO: 3712648 - RNA, 13 nt, Salmonella enterica enterica serovar Typhi Ty2
uuuuccaucacgu

SEQ ID NO: 3712649 - RNA, 23 nt, Salmonella enterica enterica serovar Typhi Ty2
uuuucccacucgcuuccuuuauu

SEQ ID NO: 3712650 - RNA, 14 nt, Salmonella enterica enterica serovar Typhi Ty2
uuuucccauaaaag

SEQ ID NO: 3712651 - RNA, 21 nt, Salmonella enterica enterica serovar Typhi Ty2
uuuucccgccagcugcgcgcu

SEQ ID NO: 3712652 - RNA, 15 nt, Salmonella enterica enterica serovar Typhi Ty2
uuuuccgcuuuuccu

SEQ ID NO: 3712653 - RNA, 19 nt, Salmonella enterica enterica serovar Typhi Ty2
uuuuccugaaaaaauuccc

SEQ ID NO: 3712654 - RNA, 20 nt, Salmonella enterica enterica serovar Typhi Ty2
uuuuccugcugguagagcau

SEQ ID NO: 3712655 - RNA, 15 nt, Salmonella enterica enterica serovar Typhi Ty2
uuuucgacagcggcg

SEQ ID NO: 3712656 - RNA, 16 nt, Salmonella enterica enterica serovar Typhi Ty2
uuuucgauaaucgcgc

SEQ ID NO: 3712657 - RNA, 15 nt, Salmonella enterica enterica serovar Typhi Ty2
uuuucgaucuucucc

SEQ ID NO: 3712658 - RNA, 21 nt, Salmonella enterica enterica serovar Typhi Ty2
uuuucgccagguacaucgcgc

SEQ ID NO: 3712659 - RNA, 21 nt, Salmonella enterica enterica serovar Typhi Ty2
uuuucggcacaucaauaaauc

SEQ ID NO: 3712660 - RNA, 12 nt, Salmonella enterica enterica serovar Typhi Ty2
uuuucggcucac

SEQ ID NO: 3712661 - RNA, 13 nt, Salmonella enterica enterica serovar Typhi Ty2
uuuucuauuuucu

SEQ ID NO: 3712662 - RNA, 18 nt, Salmonella enterica enterica serovar Typhi Ty2
uuuucucaauacgauauu

SEQ ID NO: 3712663 - RNA, 16 nt, Salmonella enterica enterica serovar Typhi Ty2
aaaaaccaaaaaauau

SEQ ID NO: 3712664 - RNA, 15 nt, Salmonella enterica enterica serovar Typhi Ty2
aaaaaccagaauuuc

SEQ ID NO: 3712665 - RNA, 15 nt, Salmonella enterica enterica serovar Typhi Ty2
aaaaacccaccaacu

SEQ ID NO: 3712666 - RNA, 14 nt, Salmonella enterica enterica serovar Typhi Ty2
aaaaacccaccagc

SEQ ID NO: 3712667 - RNA, 21 nt, Salmonella enterica enterica serovar Typhi Ty2
aaaaaccgcccccagucugcu

SEQ ID NO: 3712668 - RNA, 14 nt, Salmonella enterica enterica serovar Typhi Ty2
aaaaaccgggaaau

SEQ ID NO: 3712669 - RNA, 16 nt, Salmonella enterica enterica serovar Typhi Ty2
aaaaaccuccggcuau

SEQ ID NO: 3712670 - RNA, 21 nt, Salmonella enterica enterica serovar Typhi Ty2
aaaaaccucuaccuacacauu

SEQ ID NO: 3712671 - RNA, 18 nt, Salmonella enterica enterica serovar Typhi Ty2
aaaaacguugcuggcgcg

SEQ ID NO: 3712672 - RNA, 16 nt, Salmonella enterica enterica serovar Typhi Ty2
aaaaacucaaagcguu

SEQ ID NO: 3712673 - RNA, 15 nt, Salmonella enterica enterica serovar Typhi Ty2
aaaaacucaggaaau

SEQ ID NO: 3712674 - RNA, 20 nt, Salmonella enterica enterica serovar Typhi Ty2
aaaaagaacggcaaauugag

SEQ ID NO: 3712675 - RNA, 15 nt, Salmonella enterica enterica serovar Typhi Ty2
aaaaagcaaagaggu

SEQ ID NO: 3712676 - RNA, 18 nt, Salmonella enterica enterica serovar Typhi Ty2
aaaaagccaaaaggcgcc

SEQ ID NO: 3712677 - RNA, 19 nt, Salmonella enterica enterica serovar Typhi Ty2
aaaaagccaagcacaaaaa

SEQ ID NO: 3712678 - RNA, 19 nt, Salmonella enterica enterica serovar Typhi Ty2
aaaaagccacgcaagcagc

SEQ ID NO: 3712679 - RNA, 20 nt, Salmonella enterica enterica serovar Typhi Ty2
aaaaagccacgcaagcagca

SEQ ID NO: 3712680 - RNA, 22 nt, Salmonella enterica enterica serovar Typhi Ty2
aaaaagcccgacccgcugcgug

SEQ ID NO: 3712681 - RNA, 19 nt, Salmonella enterica enterica serovar Typhi Ty2
aaaaagccggcggaaaaaa

SEQ ID NO: 3712682 - RNA, 21 nt, Salmonella enterica enterica serovar Typhi Ty2
aaaaagccggcggaaaaaagc

SEQ ID NO: 3712683 - RNA, 16 nt, Salmonella enterica enterica serovar Typhi Ty2
aaaaagccucugauuu

SEQ ID NO: 3712684 - RNA, 17 nt, Salmonella enterica enterica serovar Typhi Ty2
aaaaagccucugauuuc

SEQ ID NO: 3712685 - RNA, 17 nt, Salmonella enterica enterica serovar Typhi Ty2
aaaaagcguacaaaaaa

SEQ ID NO: 3712686 - RNA, 23 nt, Salmonella enterica enterica serovar Typhi Ty2
aaaaagcuccggacgcaccagcc

SEQ ID NO: 3712687 - RNA, 15 nt, Salmonella enterica enterica serovar Typhi Ty2
aaaaaggcagaagaa

SEQ ID NO: 3712688 - RNA, 22 nt, Salmonella enterica enterica serovar Typhi Ty2
aaaaaggguaacgggacacugc

SEQ ID NO: 3712689 - RNA, 13 nt, Salmonella enterica enterica serovar Typhi Ty2
aaaaauaaaaaaa

SEQ ID NO: 3712690 - RNA, 13 nt, Salmonella enterica enterica serovar Typhi Ty2
aaaaauaaaaacc

SEQ ID NO: 3712691 - RNA, 11 nt, Salmonella enterica enterica serovar Typhi Ty2
aaaaauacuga

SEQ ID NO: 3712692 - RNA, 20 nt, Salmonella enterica enterica serovar Typhi Ty2
aaaaauacugauaaaaaaca

SEQ ID NO: 3712693 - RNA, 14 nt, Salmonella enterica enterica serovar Typhi Ty2
aaaaauagcauuaa

SEQ ID NO: 3712694 - RNA, 20 nt, Salmonella enterica enterica serovar Typhi Ty2
aaaaauagcauuaagcugau

SEQ ID NO: 3712695 - RNA, 13 nt, Salmonella enterica enterica serovar Typhi Ty2
aaaaauaggcuuu

SEQ ID NO: 3712696 - RNA, 20 nt, Salmonella enterica enterica serovar Typhi Ty2
aaaaauaggcuuuugauuca

SEQ ID NO: 3712697 - RNA, 13 nt, Salmonella enterica enterica serovar Typhi Ty2
aaaaauauaaaaa

SEQ ID NO: 3712698 - RNA, 18 nt, Salmonella enterica enterica serovar Typhi Ty2
aaaaauaucauuaaauca

SEQ ID NO: 3712699 - RNA, 23 nt, Salmonella enterica enterica serovar Typhi Ty2
aaaaaucagcccggacaucaucc

SEQ ID NO: 3712700 - RNA, 15 nt, Salmonella enterica enterica serovar Typhi Ty2
aaaaauccccccucc

SEQ ID NO: 3712701 - RNA, 22 nt, Salmonella enterica enterica serovar Typhi Ty2
aaaaaugauguguuucagcagc

SEQ ID NO: 3712702 - RNA, 16 nt, Salmonella enterica enterica serovar Typhi Ty2
aaaaauggaccagcca

SEQ ID NO: 3712703 - RNA, 12 nt, Salmonella enterica enterica serovar Typhi Ty2
aaaaauuaaaaa

SEQ ID NO: 3712704 - RNA, 14 nt, Salmonella enterica enterica serovar Typhi Ty2
aaaaauuaaaaaua

SEQ ID NO: 3712705 - RNA, 12 nt, Salmonella enterica enterica serovar Typhi Ty2
aaaaauuucgaa

SEQ ID NO: 3712706 - RNA, 12 nt, Salmonella enterica enterica serovar Typhi Ty2
aaaacaagcagu

SEQ ID NO: 3712707 - RNA, 14 nt, Salmonella enterica enterica serovar Typhi Ty2
aaaacaagcaguau

SEQ ID NO: 3712708 - RNA, 20 nt, Salmonella enterica enterica serovar Typhi Ty2
aaaacaccuaacccaccaua

SEQ ID NO: 3712709 - RNA, 17 nt, Salmonella enterica enterica serovar Typhi Ty2
aaaacacgucuggaaac

SEQ ID NO: 3712710 - RNA, 22 nt, Salmonella enterica enterica serovar Typhi Ty2
aaaacagaaccccaucgccuga

SEQ ID NO: 3712711 - RNA, 18 nt, Salmonella enterica enterica serovar Typhi Ty2
aaaacagcauaauaaagc

SEQ ID NO: 3712712 - RNA, 19 nt, Salmonella enterica enterica serovar Typhi Ty2
aaaacagcaugguguuagu

SEQ ID NO: 3712713 - RNA, 11 nt, Salmonella enterica enterica serovar Typhi Ty2
aaaacagccag

SEQ ID NO: 3712714 - RNA, 18 nt, Salmonella enterica enterica serovar Typhi Ty2
aaaacagccgccauggcg

SEQ ID NO: 3712715 - RNA, 20 nt, Salmonella enterica enterica serovar Typhi Ty2
aaaacaucgcugauauuguu

SEQ ID NO: 3712716 - RNA, 17 nt, Salmonella enterica enterica serovar Typhi Ty2
aaaacauuccugacauu

SEQ ID NO: 3712717 - RNA, 21 nt, Salmonella enterica enterica serovar Typhi Ty2
aaaaccagcgcggauaaaaaa

SEQ ID NO: 3712718 - RNA, 12 nt, Salmonella enterica enterica serovar Typhi Ty2
aaaaccauauaa

SEQ ID NO: 3712719 - RNA, 16 nt, Salmonella enterica enterica serovar Typhi Ty2
aaaaccgacagcaaua

SEQ ID NO: 3712720 - RNA, 21 nt, Salmonella enterica enterica serovar Typhi Ty2
aaaaccgacgaaagauaaaaa

SEQ ID NO: 3712721 - RNA, 16 nt, Salmonella enterica enterica serovar Typhi Ty2
aaaaccgagcaacaga

SEQ ID NO: 3712722 - RNA, 14 nt, Salmonella enterica enterica serovar Typhi Ty2
aaaaccggcccagc

SEQ ID NO: 3712723 - RNA, 18 nt, Salmonella enterica enterica serovar Typhi Ty2
aaaaccgucggcaauaca

SEQ ID NO: 3712724 - RNA, 14 nt, Salmonella enterica enterica serovar Typhi Ty2
aaaaccguucugag

SEQ ID NO: 3712725 - RNA, 20 nt, Salmonella enterica enterica serovar Typhi Ty2
aaaacgcccccugccagcgc

SEQ ID NO: 3712726 - RNA, 23 nt, Salmonella enterica enterica serovar Typhi Ty2
aaaacgcccccugccagcgcuga

SEQ ID NO: 3712727 - RNA, 21 nt, Salmonella enterica enterica serovar Typhi Ty2
aaaacgccgccuugcggcggc

SEQ ID NO: 3712728 - RNA, 12 nt, Salmonella enterica enterica serovar Typhi Ty2
aaaacgccugcc

SEQ ID NO: 3712729 - RNA, 13 nt, Salmonella enterica enterica serovar Typhi Ty2
aaaacgccuguaa

SEQ ID NO: 3712730 - RNA, 15 nt, Salmonella enterica enterica serovar Typhi Ty2
aaaacgcgcaaaacu

SEQ ID NO: 3712731 - RNA, 18 nt, Salmonella enterica enterica serovar Typhi Ty2
aaaacgcgcucgccagcg

SEQ ID NO: 3712732 - RNA, 19 nt, Salmonella enterica enterica serovar Typhi Ty2
aaaacgcgcucgccagcgc

SEQ ID NO: 3712733 - RNA, 22 nt, Salmonella enterica enterica serovar Typhi Ty2
aaaacgcgcucgccagcgcugu

SEQ ID NO: 3712734 - RNA, 21 nt, Salmonella enterica enterica serovar Typhi Ty2
aaaacgcguuagcguuuugaa

SEQ ID NO: 3712735 - RNA, 14 nt, Salmonella enterica enterica serovar Typhi Ty2
aaaacggccaguga

SEQ ID NO: 3712736 - RNA, 13 nt, Salmonella enterica enterica serovar Typhi Ty2
aaaacgguuuuca

SEQ ID NO: 3712737 - RNA, 22 nt, Salmonella enterica enterica serovar Typhi Ty2
aaaacguaacguacgggugucc

SEQ ID NO: 3712738 - RNA, 22 nt, Salmonella enterica enterica serovar Typhi Ty2
aaaacguuauuggcaggaugua

SEQ ID NO: 3712739 - RNA, 21 nt, Salmonella enterica enterica serovar Typhi Ty2
aaaacguuugcaaauagguuu

SEQ ID NO: 3712740 - RNA, 15 nt, Salmonella enterica enterica serovar Typhi Ty2
aaaacuaauccucuu

SEQ ID NO: 3712741 - RNA, 13 nt, Salmonella enterica enterica serovar Typhi Ty2
aaaacuauuucaa

SEQ ID NO: 3712742 - RNA, 13 nt, Salmonella enterica enterica serovar Typhi Ty2
aaaacucaggaaa

SEQ ID NO: 3712743 - RNA, 17 nt, Salmonella enterica enterica serovar Typhi Ty2
aaaacugacuaaaaauc

SEQ ID NO: 3712744 - RNA, 18 nt, Salmonella enterica enterica serovar Typhi Ty2
aaaacuggugcaggcggu

SEQ ID NO: 3712745 - RNA, 20 nt, Salmonella enterica enterica serovar Typhi Ty2
aaaauuauuggcuuuguaaa

SEQ ID NO: 3712746 - RNA, 18 nt, Salmonella enterica enterica serovar Typhi Ty2
aaaauucccggcggaaau

SEQ ID NO: 3712747 - RNA, 18 nt, Salmonella enterica enterica serovar Typhi Ty2
aaaauuuugcauaaauaa

SEQ ID NO: 3712748 - RNA, 15 nt, Salmonella enterica enterica serovar Typhi Ty2
aaacaaaccaaacug

SEQ ID NO: 3712749 - RNA, 19 nt, Salmonella enterica enterica serovar Typhi Ty2
aaacaacaaaguauaaagc

SEQ ID NO: 3712750 - RNA, 13 nt, Salmonella enterica enterica serovar Typhi Ty2
aaacaacauaucg

SEQ ID NO: 3712751 - RNA, 14 nt, Salmonella enterica enterica serovar Typhi Ty2
aaacaagccgccaa

SEQ ID NO: 3712752 - RNA, 24 nt, Salmonella enterica enterica serovar Typhi Ty2
aaacaagccgccaacgccagcagc

SEQ ID NO: 3712753 - RNA, 12 nt, Salmonella enterica enterica serovar Typhi Ty2
aaacacagccau

SEQ ID NO: 3712754 - RNA, 22 nt, Salmonella enterica enterica serovar Typhi Ty2
aaacacauccggcggcgucgcg

SEQ ID NO: 3712755 - RNA, 22 nt, Salmonella enterica enterica serovar Typhi Ty2
aaacaccaccgguuugucgcuu

SEQ ID NO: 3712756 - RNA, 11 nt, Salmonella enterica enterica serovar Typhi Ty2
aaacaccagaa

SEQ ID NO: 3712757 - RNA, 13 nt, Salmonella enterica enterica serovar Typhi Ty2
aaacaccagaaug

SEQ ID NO: 3712758 - RNA, 14 nt, Salmonella enterica enterica serovar Typhi Ty2
aaacaccagaaugc

SEQ ID NO: 3712759 - RNA, 21 nt, Salmonella enterica enterica serovar Typhi Ty2
aaacaccggaauucuguucag

SEQ ID NO: 3712760 - RNA, 17 nt, Salmonella enterica enterica serovar Typhi Ty2
aaacaccggggcauuuc

SEQ ID NO: 3712761 - RNA, 19 nt, Salmonella enterica enterica serovar Typhi Ty2
aaacaccggggcauuucca

SEQ ID NO: 3712762 - RNA, 16 nt, Salmonella enterica enterica serovar Typhi Ty2
aaacacgccgcgcugg

SEQ ID NO: 3712763 - RNA, 13 nt, Salmonella enterica enterica serovar Typhi Ty2
aaacacucaggca

SEQ ID NO: 3712764 - RNA, 18 nt, Salmonella enterica enterica serovar Typhi Ty2
aaacacucuccaccaaau

SEQ ID NO: 3712765 - RNA, 18 nt, Salmonella enterica enterica serovar Typhi Ty2
aaacacuuccccugccag

SEQ ID NO: 3712766 - RNA, 12 nt, Salmonella enterica enterica serovar Typhi Ty2
aaacagaauaaa

SEQ ID NO: 3712767 - RNA, 22 nt, Salmonella enterica enterica serovar Typhi Ty2
aaacagaccggagcgugcuuca

SEQ ID NO: 3712768 - RNA, 20 nt, Salmonella enterica enterica serovar Typhi Ty2
aaacagauaagcgucugcaa

SEQ ID NO: 3712769 - RNA, 11 nt, Salmonella enterica enterica serovar Typhi Ty2
aaacagaugcu

SEQ ID NO: 3712770 - RNA, 17 nt, Salmonella enterica enterica serovar Typhi Ty2
aaacagccaaucauaaa

SEQ ID NO: 3712771 - RNA, 14 nt, Salmonella enterica enterica serovar Typhi Ty2
aaacagccagcagc

SEQ ID NO: 3712772 - RNA, 15 nt, Salmonella enterica enterica serovar Typhi Ty2
aaacagccgccaugg

SEQ ID NO: 3712773 - RNA, 18 nt, Salmonella enterica enterica serovar Typhi Ty2
aaacagcgccaguuuuuc

SEQ ID NO: 3712774 - RNA, 23 nt, Salmonella enterica enterica serovar Typhi Ty2
aaacagcgccaguuuuuccuguu

SEQ ID NO: 3712775 - RNA, 14 nt, Salmonella enterica enterica serovar Typhi Ty2
aaacagcuguaaau

SEQ ID NO: 3712776 - RNA, 16 nt, Salmonella enterica enterica serovar Typhi Ty2
aaacaguacuggucgg

SEQ ID NO: 3712777 - RNA, 17 nt, Salmonella enterica enterica serovar Typhi Ty2
aaacagugaaaaaacgg

SEQ ID NO: 3712778 - RNA, 16 nt, Salmonella enterica enterica serovar Typhi Ty2
aaacauauaauuaaca

SEQ ID NO: 3712779 - RNA, 15 nt, Salmonella enterica enterica serovar Typhi Ty2
aaacauauaucucua

SEQ ID NO: 3712780 - RNA, 18 nt, Salmonella enterica enterica serovar Typhi Ty2
aaacaucagcgcaugccc

SEQ ID NO: 3712781 - RNA, 16 nt, Salmonella enterica enterica serovar Typhi Ty2
aaacaucauaauaauu

SEQ ID NO: 3712782 - RNA, 17 nt, Salmonella enterica enterica serovar Typhi Ty2
aaacaucgcccuccagc

SEQ ID NO: 3712783 - RNA, 17 nt, Salmonella enterica enterica serovar Typhi Ty2
aaacaugucaaaauccu

SEQ ID NO: 3712784 - RNA, 14 nt, Salmonella enterica enterica serovar Typhi Ty2
aaaccaaacaccag

SEQ ID NO: 3712785 - RNA, 14 nt, Salmonella enterica enterica serovar Typhi Ty2
aaaccaaacagcga

SEQ ID NO: 3712786 - RNA, 23 nt, Salmonella enterica enterica serovar Typhi Ty2
aaaccaaacagcgacacauccug

SEQ ID NO: 3712787 - RNA, 13 nt, Salmonella enterica enterica serovar Typhi Ty2
aaaccaacagccg

SEQ ID NO: 3712788 - RNA, 20 nt, Salmonella enterica enterica serovar Typhi Ty2
aaaccaaccacggggcaugc

SEQ ID NO: 3712789 - RNA, 14 nt, Salmonella enterica enterica serovar Typhi Ty2
aaaccacaaucaca

SEQ ID NO: 3712790 - RNA, 19 nt, Salmonella enterica enterica serovar Typhi Ty2
aaaccacaaucacagcgca

SEQ ID NO: 3712791 - RNA, 16 nt, Salmonella enterica enterica serovar Typhi Ty2
aaaccacgcugaggcg

SEQ ID NO: 3712792 - RNA, 12 nt, Salmonella enterica enterica serovar Typhi Ty2
aaaccagauacg

SEQ ID NO: 3712793 - RNA, 14 nt, Salmonella enterica enterica serovar Typhi Ty2
aaaccagcauaaua

SEQ ID NO: 3712794 - RNA, 16 nt, Salmonella enterica enterica serovar Typhi Ty2
aaaccagcauaauauu

SEQ ID NO: 3712795 - RNA, 17 nt, Salmonella enterica enterica serovar Typhi Ty2
aaaccagcauaaugagc

SEQ ID NO: 3712796 - RNA, 20 nt, Salmonella enterica enterica serovar Typhi Ty2
aaaccagcgcggauaaaaaa

SEQ ID NO: 3712797 - RNA, 12 nt, Salmonella enterica enterica serovar Typhi Ty2
aaaccaguucac

SEQ ID NO: 3712798 - RNA, 17 nt, Salmonella enterica enterica serovar Typhi Ty2
aaaccaguugccagggu

SEQ ID NO: 3712799 - RNA, 18 nt, Salmonella enterica enterica serovar Typhi Ty2
aaaccauaaacaaaacaa

SEQ ID NO: 3712800 - RNA, 20 nt, Salmonella enterica enterica serovar Typhi Ty2
aaaccauguugaucguaaaa

SEQ ID NO: 3712801 - RNA, 21 nt, Salmonella enterica enterica serovar Typhi Ty2
aaaccauucaaauucaauaaa

SEQ ID NO: 3712802 - RNA, 15 nt, Salmonella enterica enterica serovar Typhi Ty2
aaacccauauuccug

SEQ ID NO: 3712803 - RNA, 16 nt, Salmonella enterica enterica serovar Typhi Ty2
aaaccgacccaaaaau

SEQ ID NO: 3712804 - RNA, 13 nt, Salmonella enterica enterica serovar Typhi Ty2
aaaccgauaauca

SEQ ID NO: 3712805 - RNA, 15 nt, Salmonella enterica enterica serovar Typhi Ty2
aaaccgcagaaaaag

SEQ ID NO: 3712806 - RNA, 19 nt, Salmonella enterica enterica serovar Typhi Ty2
aaaccgcagaaggucacgc

SEQ ID NO: 3712807 - RNA, 19 nt, Salmonella enterica enterica serovar Typhi Ty2
aaaccgccgcuuugauuug

SEQ ID NO: 3712808 - RNA, 22 nt, Salmonella enterica enterica serovar Typhi Ty2
aaaccgcucgccgccucccccu

SEQ ID NO: 3712809 - RNA, 17 nt, Salmonella enterica enterica serovar Typhi Ty2
aaaccggaauuuguugg

SEQ ID NO: 3712810 - RNA, 23 nt, Salmonella enterica enterica serovar Typhi Ty2
aaaccggcgcgccuuccagcaau

SEQ ID NO: 3712811 - RNA, 15 nt, Salmonella enterica enterica serovar Typhi Ty2
aaaccggggagcuau

SEQ ID NO: 3712812 - RNA, 20 nt, Salmonella enterica enterica serovar Typhi Ty2
aaaccgguaaugauaccaau

SEQ ID NO: 3712813 - RNA, 15 nt, Salmonella enterica enterica serovar Typhi Ty2
aaaccguagauuuuc

SEQ ID NO: 3712814 - RNA, 17 nt, Salmonella enterica enterica serovar Typhi Ty2
aaaccgucauuuaccag

SEQ ID NO: 3712815 - RNA, 15 nt, Salmonella enterica enterica serovar Typhi Ty2
aaaccguuaugaauc

SEQ ID NO: 3712816 - RNA, 15 nt, Salmonella enterica enterica serovar Typhi Ty2
aaaccuaccggcaua

SEQ ID NO: 3712817 - RNA, 19 nt, Salmonella enterica enterica serovar Typhi Ty2
aaaccugguauuacaacgu

SEQ ID NO: 3712818 - RNA, 17 nt, Salmonella enterica enterica serovar Typhi Ty2
aaaccuuaccgucagcc

SEQ ID NO: 3712819 - RNA, 23 nt, Salmonella enterica enterica serovar Typhi Ty2
aaaccuucgcuuuuaaaacuucc

SEQ ID NO: 3712820 - RNA, 15 nt, Salmonella enterica enterica serovar Typhi Ty2
aaaccuuucuucucu

SEQ ID NO: 3712821 - RNA, 16 nt, Salmonella enterica enterica serovar Typhi Ty2
aaacgaaucucaucag

SEQ ID NO: 3712822 - RNA, 15 nt, Salmonella enterica enterica serovar Typhi Ty2
aaacgaauuuaaaua

SEQ ID NO: 3712823 - RNA, 14 nt, Salmonella enterica enterica serovar Typhi Ty2
aaacgacauaaccg

SEQ ID NO: 3712824 - RNA, 21 nt, Salmonella enterica enterica serovar Typhi Ty2
aaacgaccaggaucagaccga

SEQ ID NO: 3712825 - RNA, 22 nt, Salmonella enterica enterica serovar Typhi Ty2
aaacgagcgcaauaacaauaaa

SEQ ID NO: 3712826 - RNA, 19 nt, Salmonella enterica enterica serovar Typhi Ty2
aaacgauuaauaaccaaua

SEQ ID NO: 3712827 - RNA, 19 nt, Salmonella enterica enterica serovar Typhi Ty2
aaacguagcguucauuccc

SEQ ID NO: 3712828 - RNA, 18 nt, Salmonella enterica enterica serovar Typhi Ty2
aaacgucacaauacuucc

SEQ ID NO: 3712829 - RNA, 14 nt, Salmonella enterica enterica serovar Typhi Ty2
aaacgucgaacaua

SEQ ID NO: 3712830 - RNA, 16 nt, Salmonella enterica enterica serovar Typhi Ty2
aaacgucguaaaaccu

SEQ ID NO: 3712831 - RNA, 16 nt, Salmonella enterica enterica serovar Typhi Ty2
aaacguucauccgacc

SEQ ID NO: 3712832 - RNA, 15 nt, Salmonella enterica enterica serovar Typhi Ty2
aaacguuccugccag

SEQ ID NO: 3712833 - RNA, 22 nt, Salmonella enterica enterica serovar Typhi Ty2
aaacguugcuggacauauucca

SEQ ID NO: 3712834 - RNA, 18 nt, Salmonella enterica enterica serovar Typhi Ty2
aaacuaaguaaggaggaa

SEQ ID NO: 3712835 - RNA, 15 nt, Salmonella enterica enterica serovar Typhi Ty2
aaacuauccuggccu

SEQ ID NO: 3712836 - RNA, 14 nt, Salmonella enterica enterica serovar Typhi Ty2
aaacucaaucaggc

SEQ ID NO: 3712837 - RNA, 15 nt, Salmonella enterica enterica serovar Typhi Ty2
aaacucacccaggcg

SEQ ID NO: 3712838 - RNA, 19 nt, Salmonella enterica enterica serovar Typhi Ty2
aaacucacguuccccagca

SEQ ID NO: 3712839 - RNA, 23 nt, Salmonella enterica enterica serovar Typhi Ty2
aaacucacguuccccagcaccga

SEQ ID NO: 3712840 - RNA, 13 nt, Salmonella enterica enterica serovar Typhi Ty2
aaacucagcaaua

SEQ ID NO: 3712841 - RNA, 13 nt, Salmonella enterica enterica serovar Typhi Ty2
aaacucaucuuua

SEQ ID NO: 3712842 - RNA, 15 nt, Salmonella enterica enterica serovar Typhi Ty2
aaacuccgcgcuggc

SEQ ID NO: 3712843 - RNA, 19 nt, Salmonella enterica enterica serovar Typhi Ty2
aaacuccuccgggaaaaca

SEQ ID NO: 3712844 - RNA, 19 nt, Salmonella enterica enterica serovar Typhi Ty2
aaacucgacacacucaucu

SEQ ID NO: 3712845 - RNA, 16 nt, Salmonella enterica enterica serovar Typhi Ty2
aaacugaaacguagcg

SEQ ID NO: 3712846 - RNA, 15 nt, Salmonella enterica enterica serovar Typhi Ty2
aaacugacugaugcu

SEQ ID NO: 3712847 - RNA, 11 nt, Salmonella enterica enterica serovar Typhi Ty2
aaacugccuuc

SEQ ID NO: 3712848 - RNA, 14 nt, Salmonella enterica enterica serovar Typhi Ty2
aaacuggaagaaga

SEQ ID NO: 3712849 - RNA, 15 nt, Salmonella enterica enterica serovar Typhi Ty2
aaacuggccacagca

SEQ ID NO: 3712850 - RNA, 12 nt, Salmonella enterica enterica serovar Typhi Ty2
aaacuggugcag

SEQ ID NO: 3712851 - RNA, 15 nt, Salmonella enterica enterica serovar Typhi Ty2
aaacuguucagcggu

SEQ ID NO: 3712852 - RNA, 13 nt, Salmonella enterica enterica serovar Typhi Ty2
aaacuuaucucuu

SEQ ID NO: 3712853 - RNA, 17 nt, Salmonella enterica enterica serovar Typhi Ty2
aaacuucaucguuacgc

SEQ ID NO: 3712854 - RNA, 22 nt, Salmonella enterica enterica serovar Typhi Ty2
aaacuuccacacggcauucacg

SEQ ID NO: 3712855 - RNA, 20 nt, Salmonella enterica enterica serovar Typhi Ty2
aaacuucccgcgcagugcag

SEQ ID NO: 3712856 - RNA, 23 nt, Salmonella enterica enterica serovar Typhi Ty2
aaacuuucauuucacuuguucuu

SEQ ID NO: 3712857 - RNA, 12 nt, Salmonella enterica enterica serovar Typhi Ty2
aaacuuuuaaau

SEQ ID NO: 3712858 - RNA, 13 nt, Salmonella enterica enterica serovar Typhi Ty2
aaacuuuuaaauu

SEQ ID NO: 3712859 - RNA, 10 nt, Salmonella enterica enterica serovar Typhi Ty2
aaagaaaaac

SEQ ID NO: 3712860 - RNA, 14 nt, Salmonella enterica enterica serovar Typhi Ty2
aaagaaaacaucag

SEQ ID NO: 3712861 - RNA, 19 nt, Salmonella enterica enterica serovar Typhi Ty2
aaagaaaacuuucauuuca

SEQ ID NO: 3712862 - RNA, 12 nt, Salmonella enterica enterica serovar Typhi Ty2
aaagaaaucacc

SEQ ID NO: 3712863 - RNA, 16 nt, Salmonella enterica enterica serovar Typhi Ty2
aaagaacaauaaucau

SEQ ID NO: 3712864 - RNA, 21 nt, Salmonella enterica enterica serovar Typhi Ty2
aaagaaccgacugucgaaacc

SEQ ID NO: 3712865 - RNA, 22 nt, Salmonella enterica enterica serovar Typhi Ty2
aaagaacgacgaauaagcugaa

SEQ ID NO: 3712866 - RNA, 18 nt, Salmonella enterica enterica serovar Typhi Ty2
aaagaacguguuuuucca

SEQ ID NO: 3712867 - RNA, 23 nt, Salmonella enterica enterica serovar Typhi Ty2
aaagaacguguuuuuccagcaac

SEQ ID NO: 3712868 - RNA, 13 nt, Salmonella enterica enterica serovar Typhi Ty2
aaagaagggcagg

SEQ ID NO: 3712869 - RNA, 19 nt, Salmonella enterica enterica serovar Typhi Ty2
aaagaaguggacuuccauu

SEQ ID NO: 3712870 - RNA, 19 nt, Salmonella enterica enterica serovar Typhi Ty2
aaagaaguuagauauuaau

SEQ ID NO: 3712871 - RNA, 16 nt, Salmonella enterica enterica serovar Typhi Ty2
aaagaaucgccagucg

SEQ ID NO: 3712872 - RNA, 18 nt, Salmonella enterica enterica serovar Typhi Ty2
aaagaaugaaaaaaaaau

SEQ ID NO: 3712873 - RNA, 16 nt, Salmonella enterica enterica serovar Typhi Ty2
aaagacagcaggcuuu

SEQ ID NO: 3712874 - RNA, 18 nt, Salmonella enterica enterica serovar Typhi Ty2
aaagacaugaucuuaccu

SEQ ID NO: 3712875 - RNA, 16 nt, Salmonella enterica enterica serovar Typhi Ty2
aaagaccuccgcccgg

SEQ ID NO: 3712876 - RNA, 20 nt, Salmonella enterica enterica serovar Typhi Ty2
aaagagacagaaucaggcca

SEQ ID NO: 3712877 - RNA, 17 nt, Salmonella enterica enterica serovar Typhi Ty2
aaagagagcgccaaaaa

SEQ ID NO: 3712878 - RNA, 16 nt, Salmonella enterica enterica serovar Typhi Ty2
aaagagccgcgcagcg

SEQ ID NO: 3712879 - RNA, 19 nt, Salmonella enterica enterica serovar Typhi Ty2
aaagagcguaucgccggcg

SEQ ID NO: 3712880 - RNA, 13 nt, Salmonella enterica enterica serovar Typhi Ty2
aaagauaaucuga

SEQ ID NO: 3712881 - RNA, 15 nt, Salmonella enterica enterica serovar Typhi Ty2
aaagaucgcugcaau

SEQ ID NO: 3712882 - RNA, 19 nt, Salmonella enterica enterica serovar Typhi Ty2
aaagaucuggccgucuggc

SEQ ID NO: 3712883 - RNA, 18 nt, Salmonella enterica enterica serovar Typhi Ty2
aaagauuagccccagcgc

SEQ ID NO: 3712884 - RNA, 22 nt, Salmonella enterica enterica serovar Typhi Ty2
aaagauuauuuuaucaucagca

SEQ ID NO: 3712885 - RNA, 22 nt, Salmonella enterica enterica serovar Typhi Ty2
aaagauuuaucaauuuuuaaaa

SEQ ID NO: 3712886 - RNA, 16 nt, Salmonella enterica enterica serovar Typhi Ty2
aaagcaauaauccgcu

SEQ ID NO: 3712887 - RNA, 12 nt, Salmonella enterica enterica serovar Typhi Ty2
aaauaaaauacg

SEQ ID NO: 3712888 - RNA, 22 nt, Salmonella enterica enterica serovar Typhi Ty2
aaauaaaauacgcucaauauac

SEQ ID NO: 3712889 - RNA, 13 nt, Salmonella enterica enterica serovar Typhi Ty2
aaauaaaauuaua

SEQ ID NO: 3712890 - RNA, 13 nt, Salmonella enterica enterica serovar Typhi Ty2
aaauaaacaccau

SEQ ID NO: 3712891 - RNA, 22 nt, Salmonella enterica enterica serovar Typhi Ty2
aaauaaacacuaaaucauaauu

SEQ ID NO: 3712892 - RNA, 13 nt, Salmonella enterica enterica serovar Typhi Ty2
aaauaaacagcgc

SEQ ID NO: 3712893 - RNA, 21 nt, Salmonella enterica enterica serovar Typhi Ty2
aaauaaagugcugaacaauaa

SEQ ID NO: 3712894 - RNA, 22 nt, Salmonella enterica enterica serovar Typhi Ty2
aaauaaauaguaaauagaaaau

SEQ ID NO: 3712895 - RNA, 20 nt, Salmonella enterica enterica serovar Typhi Ty2
aaauaaauauguuauuuaca

SEQ ID NO: 3712896 - RNA, 21 nt, Salmonella enterica enterica serovar Typhi Ty2
aaauaaauauguuauuuacaa

SEQ ID NO: 3712897 - RNA, 18 nt, Salmonella enterica enterica serovar Typhi Ty2
aaauaaaugauauuuaaa

SEQ ID NO: 3712898 - RNA, 19 nt, Salmonella enterica enterica serovar Typhi Ty2
aaauaaaugauauuuaaaa

SEQ ID NO: 3712899 - RNA, 21 nt, Salmonella enterica enterica serovar Typhi Ty2
aaauaacaauauuaaauaaau

SEQ ID NO: 3712900 - RNA, 14 nt, Salmonella enterica enterica serovar Typhi Ty2
aaauaacagacgaa

SEQ ID NO: 3712901 - RNA, 21 nt, Salmonella enterica enterica serovar Typhi Ty2
aaauaacaggaaucauucuau

SEQ ID NO: 3712902 - RNA, 17 nt, Salmonella enterica enterica serovar Typhi Ty2
aaauaacccgccuggcg

SEQ ID NO: 3712903 - RNA, 13 nt, Salmonella enterica enterica serovar Typhi Ty2
aaauaacuuuuaa

SEQ ID NO: 3712904 - RNA, 16 nt, Salmonella enterica enterica serovar Typhi Ty2
aaauaacuuuuaauuu

SEQ ID NO: 3712905 - RNA, 19 nt, Salmonella enterica enterica serovar Typhi Ty2
aaauaacuuuuaauuuuua

SEQ ID NO: 3712906 - RNA, 19 nt, Salmonella enterica enterica serovar Typhi Ty2
aaauaagccguacagccua

SEQ ID NO: 3712907 - RNA, 17 nt, Salmonella enterica enterica serovar Typhi Ty2
aaauaaggcugcgcguu

SEQ ID NO: 3712908 - RNA, 21 nt, Salmonella enterica enterica serovar Typhi Ty2
aaauaaggcugcgcguuuuca

SEQ ID NO: 3712909 - RNA, 22 nt, Salmonella enterica enterica serovar Typhi Ty2
aaauaaggcugcgcguuuucau

SEQ ID NO: 3712910 - RNA, 12 nt, Salmonella enterica enterica serovar Typhi Ty2
aaauaauaccac

SEQ ID NO: 3712911 - RNA, 13 nt, Salmonella enterica enterica serovar Typhi Ty2
aaauaauauuauu

SEQ ID NO: 3712912 - RNA, 22 nt, Salmonella enterica enterica serovar Typhi Ty2
aaauaauccgcugcaacucccg

SEQ ID NO: 3712913 - RNA, 13 nt, Salmonella enterica enterica serovar Typhi Ty2
aaauaauugauaa

SEQ ID NO: 3712914 - RNA, 14 nt, Salmonella enterica enterica serovar Typhi Ty2
aaauaauuguguaa

SEQ ID NO: 3712915 - RNA, 12 nt, Salmonella enterica enterica serovar Typhi Ty2
aaauaauuuuua

SEQ ID NO: 3712916 - RNA, 22 nt, Salmonella enterica enterica serovar Typhi Ty2
aaauacaccaaacgaauuuaaa

SEQ ID NO: 3712917 - RNA, 23 nt, Salmonella enterica enterica serovar Typhi Ty2
aaauacagagucgcuuaucugcu

SEQ ID NO: 3712918 - RNA, 13 nt, Salmonella enterica enterica serovar Typhi Ty2
aaauacaucgcca

SEQ ID NO: 3712919 - RNA, 13 nt, Salmonella enterica enterica serovar Typhi Ty2
aaauaccacauca

SEQ ID NO: 3712920 - RNA, 19 nt, Salmonella enterica enterica serovar Typhi Ty2
aaauacccgaccccgccgu

SEQ ID NO: 3712921 - RNA, 15 nt, Salmonella enterica enterica serovar Typhi Ty2
aaauacgccagauaa

SEQ ID NO: 3712922 - RNA, 19 nt, Salmonella enterica enterica serovar Typhi Ty2
aaauacgccgccagcaaua

SEQ ID NO: 3712923 - RNA, 20 nt, Salmonella enterica enterica serovar Typhi Ty2
aaauacgcgauaaaaaccca

SEQ ID NO: 3712924 - RNA, 20 nt, Salmonella enterica enterica serovar Typhi Ty2
aaauacgcucaauauacuua

SEQ ID NO: 3712925 - RNA, 17 nt, Salmonella enterica enterica serovar Typhi Ty2
aaauacggaccuggcgu

SEQ ID NO: 3712926 - RNA, 22 nt, Salmonella enterica enterica serovar Typhi Ty2
aaauacuggccgguuuuaaaaa

SEQ ID NO: 3712927 - RNA, 13 nt, Salmonella enterica enterica serovar Typhi Ty2
aaauagaaaauaa

SEQ ID NO: 3712928 - RNA, 22 nt, Salmonella enterica enterica serovar Typhi Ty2
aaauagaacagcuggugcggca

SEQ ID NO: 3712929 - RNA, 21 nt, Salmonella enterica enterica serovar Typhi Ty2
aaauagacgagcgaaaaacug

SEQ ID NO: 3712930 - RNA, 14 nt, Salmonella enterica enterica serovar Typhi Ty2
aaauagagaaaaua

SEQ ID NO: 3712931 - RNA, 15 nt, Salmonella enterica enterica serovar Typhi Ty2
aaauagagaaaauaa

SEQ ID NO: 3712932 - RNA, 23 nt, Salmonella enterica enterica serovar Typhi Ty2
aaauagaucaucuauaauaccuc

SEQ ID NO: 3712933 - RNA, 18 nt, Salmonella enterica enterica serovar Typhi Ty2
aaauagcaagagaugagc

SEQ ID NO: 3712934 - RNA, 15 nt, Salmonella enterica enterica serovar Typhi Ty2
aaauagcaauuauau

SEQ ID NO: 3712935 - RNA, 16 nt, Salmonella enterica enterica serovar Typhi Ty2
aaauagccagcaucau

SEQ ID NO: 3712936 - RNA, 19 nt, Salmonella enterica enterica serovar Typhi Ty2
aaauagcgccagacagaua

SEQ ID NO: 3712937 - RNA, 17 nt, Salmonella enterica enterica serovar Typhi Ty2
aaauagcgguucaauca

SEQ ID NO: 3712938 - RNA, 14 nt, Salmonella enterica enterica serovar Typhi Ty2
aaauagcguccagc

SEQ ID NO: 3712939 - RNA, 14 nt, Salmonella enterica enterica serovar Typhi Ty2
aaauaggagaugca

SEQ ID NO: 3712940 - RNA, 20 nt, Salmonella enterica enterica serovar Typhi Ty2
aaauaggcgaggaaaacauu

SEQ ID NO: 3712941 - RNA, 19 nt, Salmonella enterica enterica serovar Typhi Ty2
aaauaguaaauagaaaaua

SEQ ID NO: 3712942 - RNA, 21 nt, Salmonella enterica enterica serovar Typhi Ty2
aaauaguauaacgaugauuau

SEQ ID NO: 3712943 - RNA, 16 nt, Salmonella enterica enterica serovar Typhi Ty2
aaauauagcuuuucau

SEQ ID NO: 3712944 - RNA, 16 nt, Salmonella enterica enterica serovar Typhi Ty2
aaauauauaauuuaua

SEQ ID NO: 3712945 - RNA, 21 nt, Salmonella enterica enterica serovar Typhi Ty2
aaauaucauucgcgucauacu

SEQ ID NO: 3712946 - RNA, 19 nt, Salmonella enterica enterica serovar Typhi Ty2
aaauauccuccgccgauaa

SEQ ID NO: 3712947 - RNA, 17 nt, Salmonella enterica enterica serovar Typhi Ty2
aaauaucucucccuccc

SEQ ID NO: 3712948 - RNA, 16 nt, Salmonella enterica enterica serovar Typhi Ty2
aaauaugaaagagaaa

SEQ ID NO: 3712949 - RNA, 17 nt, Salmonella enterica enterica serovar Typhi Ty2
aaauaugcggagccucu

SEQ ID NO: 3712950 - RNA, 20 nt, Salmonella enterica enterica serovar Typhi Ty2
aaauauuaaugaauaaauga

SEQ ID NO: 3712951 - RNA, 19 nt, Salmonella enterica enterica serovar Typhi Ty2
aaauauuacaacauguccu

SEQ ID NO: 3712952 - RNA, 20 nt, Salmonella enterica enterica serovar Typhi Ty2
aaauauugauuaaucgucau

SEQ ID NO: 3712953 - RNA, 21 nt, Salmonella enterica enterica serovar Typhi Ty2
aaauauuggcggcaaagaaaa

SEQ ID NO: 3712954 - RNA, 19 nt, Salmonella enterica enterica serovar Typhi Ty2
aaauauuucuuugucgcca

SEQ ID NO: 3712955 - RNA, 12 nt, Salmonella enterica enterica serovar Typhi Ty2
aaaucaaaaagu

SEQ ID NO: 3712956 - RNA, 15 nt, Salmonella enterica enterica serovar Typhi Ty2
aaaucaaacagaaua

SEQ ID NO: 3712957 - RNA, 16 nt, Salmonella enterica enterica serovar Typhi Ty2
aaaucaaacagaauau

SEQ ID NO: 3712958 - RNA, 16 nt, Salmonella enterica enterica serovar Typhi Ty2
aaaucaaagaccuccg

SEQ ID NO: 3712959 - RNA, 18 nt, Salmonella enterica enterica serovar Typhi Ty2
aaaucaaagaccuccgcc

SEQ ID NO: 3712960 - RNA, 16 nt, Salmonella enterica enterica serovar Typhi Ty2
aaaucaacauacugau

SEQ ID NO: 3712961 - RNA, 19 nt, Salmonella enterica enterica serovar Typhi Ty2
aaaucaacauuauuaaaau

SEQ ID NO: 3712962 - RNA, 22 nt, Salmonella enterica enterica serovar Typhi Ty2
aaaucaacgcucagaccgaucu

SEQ ID NO: 3712963 - RNA, 21 nt, Salmonella enterica enterica serovar Typhi Ty2
aaaucacagggggaacauuua

SEQ ID NO: 3712964 - RNA, 16 nt, Salmonella enterica enterica serovar Typhi Ty2
aaaucacaucgccgga

SEQ ID NO: 3712965 - RNA, 18 nt, Salmonella enterica enterica serovar Typhi Ty2
aaaucacuaagaccagca

SEQ ID NO: 3712966 - RNA, 12 nt, Salmonella enterica enterica serovar Typhi Ty2
aaaucagacuaa

SEQ ID NO: 3712967 - RNA, 20 nt, Salmonella enterica enterica serovar Typhi Ty2
aaaucaggccaagcaacauu

SEQ ID NO: 3712968 - RNA, 13 nt, Salmonella enterica enterica serovar Typhi Ty2
aaaucauaccagc

SEQ ID NO: 3712969 - RNA, 24 nt, Salmonella enterica enterica serovar Typhi Ty2
aaaucaucaaucgcuaucugacag

SEQ ID NO: 3712970 - RNA, 13 nt, Salmonella enterica enterica serovar Typhi Ty2
aaaucaucaaugg

SEQ ID NO: 3712971 - RNA, 19 nt, Salmonella enterica enterica serovar Typhi Ty2
aaaucaucaauggcgauuu

SEQ ID NO: 3712972 - RNA, 16 nt, Salmonella enterica enterica serovar Typhi Ty2
aaaucaucgccacgau

SEQ ID NO: 3712973 - RNA, 21 nt, Salmonella enterica enterica serovar Typhi Ty2
aaaucaucgcgcugauauuuu

SEQ ID NO: 3712974 - RNA, 15 nt, Salmonella enterica enterica serovar Typhi Ty2
aaaucaugccagaau

SEQ ID NO: 3712975 - RNA, 16 nt, Salmonella enterica enterica serovar Typhi Ty2
aaaucauuacuuauau

SEQ ID NO: 3712976 - RNA, 22 nt, Salmonella enterica enterica serovar Typhi Ty2
aaaucauuacuuauauuuauuu

SEQ ID NO: 3712977 - RNA, 20 nt, Salmonella enterica enterica serovar Typhi Ty2
aaaucauuuguacaaaaaau

SEQ ID NO: 3712978 - RNA, 12 nt, Salmonella enterica enterica serovar Typhi Ty2
aaauccaauaga

SEQ ID NO: 3712979 - RNA, 20 nt, Salmonella enterica enterica serovar Typhi Ty2
aaauccagcagaauaacauc

SEQ ID NO: 3712980 - RNA, 15 nt, Salmonella enterica enterica serovar Typhi Ty2
aaauccagcucaguu

SEQ ID NO: 3712981 - RNA, 22 nt, Salmonella enterica enterica serovar Typhi Ty2
aaauccagggaaaccauguuga

SEQ ID NO: 3712982 - RNA, 19 nt, Salmonella enterica enterica serovar Typhi Ty2
aaauccaugagaagaaaaa

SEQ ID NO: 3712983 - RNA, 19 nt, Salmonella enterica enterica serovar Typhi Ty2
aaaucccggcgauuaauaa

SEQ ID NO: 3712984 - RNA, 14 nt, Salmonella enterica enterica serovar Typhi Ty2
aaaucccggcuggg

SEQ ID NO: 3712985 - RNA, 16 nt, Salmonella enterica enterica serovar Typhi Ty2
aaaucccgguuuuuuu

SEQ ID NO: 3712986 - RNA, 18 nt, Salmonella enterica enterica serovar Typhi Ty2
aaauccgccggaaacugg

SEQ ID NO: 3712987 - RNA, 17 nt, Salmonella enterica enterica serovar Typhi Ty2
aaauccggaucaucuuu

SEQ ID NO: 3712988 - RNA, 21 nt, Salmonella enterica enterica serovar Typhi Ty2
aaauccggcaggcagccggau

SEQ ID NO: 3712989 - RNA, 14 nt, Salmonella enterica enterica serovar Typhi Ty2
aaauccggccucca

SEQ ID NO: 3712990 - RNA, 19 nt, Salmonella enterica enterica serovar Typhi Ty2
aaauccggcugccugccgg

SEQ ID NO: 3712991 - RNA, 17 nt, Salmonella enterica enterica serovar Typhi Ty2
aaauccucauuaguuca

SEQ ID NO: 3712992 - RNA, 14 nt, Salmonella enterica enterica serovar Typhi Ty2
aaaucgacagccag

SEQ ID NO: 3712993 - RNA, 23 nt, Salmonella enterica enterica serovar Typhi Ty2
aaaucgacagccagcauuuccag

SEQ ID NO: 3712994 - RNA, 16 nt, Salmonella enterica enterica serovar Typhi Ty2
aaaucgcccaggccug

SEQ ID NO: 3712995 - RNA, 19 nt, Salmonella enterica enterica serovar Typhi Ty2
aaaucgccucauucgggca

SEQ ID NO: 3712996 - RNA, 13 nt, Salmonella enterica enterica serovar Typhi Ty2
aaaucgcgagccu

SEQ ID NO: 3712997 - RNA, 17 nt, Salmonella enterica enterica serovar Typhi Ty2
aaaucgcgagccuucaa

SEQ ID NO: 3712998 - RNA, 19 nt, Salmonella enterica enterica serovar Typhi Ty2
aaaucgcgcaaauauuaca

SEQ ID NO: 3712999 - RNA, 16 nt, Salmonella enterica enterica serovar Typhi Ty2
aaaucggaccuccgcg

SEQ ID NO: 3713000 - RNA, 21 nt, Salmonella enterica enterica serovar Typhi Ty2
aaaucggggucuuccagcaga

SEQ ID NO: 3713001 - RNA, 20 nt, Salmonella enterica enterica serovar Typhi Ty2
aaaucgguaacaucaaguac

SEQ ID NO: 3713002 - RNA, 22 nt, Salmonella enterica enterica serovar Typhi Ty2
aaaucgguaaucaugucguaga

SEQ ID NO: 3713003 - RNA, 22 nt, Salmonella enterica enterica serovar Typhi Ty2
aaaucggucauuaauccccggc

SEQ ID NO: 3713004 - RNA, 13 nt, Salmonella enterica enterica serovar Typhi Ty2
aaaucgucaucag

SEQ ID NO: 3713005 - RNA, 21 nt, Salmonella enterica enterica serovar Typhi Ty2
aaaucuggugauaaagcagac

SEQ ID NO: 3713006 - RNA, 13 nt, Salmonella enterica enterica serovar Typhi Ty2
aaaucuucauuuc

SEQ ID NO: 3713007 - RNA, 23 nt, Salmonella enterica enterica serovar Typhi Ty2
aaaucuucuacuucaauuuucca

SEQ ID NO: 3713008 - RNA, 17 nt, Salmonella enterica enterica serovar Typhi Ty2
aaaucuuuuucgcugua

SEQ ID NO: 3713009 - RNA, 21 nt, Salmonella enterica enterica serovar Typhi Ty2
aaaugaaaaacgguauuucca

SEQ ID NO: 3713010 - RNA, 22 nt, Salmonella enterica enterica serovar Typhi Ty2
aaaugaaaugcccauaaagaaa

SEQ ID NO: 3713011 - RNA, 13 nt, Salmonella enterica enterica serovar Typhi Ty2
aaaugaauaccaa

SEQ ID NO: 3713012 - RNA, 18 nt, Salmonella enterica enterica serovar Typhi Ty2
aaaugacgcccugcgcca

SEQ ID NO: 3713013 - RNA, 14 nt, Salmonella enterica enterica serovar Typhi Ty2
aaaugacgucagca

SEQ ID NO: 3713014 - RNA, 21 nt, Salmonella enterica enterica serovar Typhi Ty2
aaaugagaaaaggaagaauaa

SEQ ID NO: 3713015 - RNA, 12 nt, Salmonella enterica enterica serovar Typhi Ty2
aaaugagaacac

SEQ ID NO: 3713016 - RNA, 21 nt, Salmonella enterica enterica serovar Typhi Ty2
aaaugaggacacaguaaugag

SEQ ID NO: 3713017 - RNA, 10 nt, Salmonella enterica enterica serovar Typhi Ty2
aaaugauaag

SEQ ID NO: 3713018 - RNA, 13 nt, Salmonella enterica enterica serovar Typhi Ty2
aaaugaucacuuc

SEQ ID NO: 3713019 - RNA, 15 nt, Salmonella enterica enterica serovar Typhi Ty2
aaaugaucacuuccg

SEQ ID NO: 3713020 - RNA, 23 nt, Salmonella enterica enterica serovar Typhi Ty2
aaaugaugacucauuaaaaaaac

SEQ ID NO: 3713021 - RNA, 13 nt, Salmonella enterica enterica serovar Typhi Ty2
aaaugauguguuu

SEQ ID NO: 3713022 - RNA, 21 nt, Salmonella enterica enterica serovar Typhi Ty2
aaaugcacugcaauuucugcu

SEQ ID NO: 3713023 - RNA, 19 nt, Salmonella enterica enterica serovar Typhi Ty2
aaaugcauugauaggcugc

SEQ ID NO: 3713024 - RNA, 19 nt, Salmonella enterica enterica serovar Typhi Ty2
aaaugcccauaaagaaaua

SEQ ID NO: 3713025 - RNA, 20 nt, Salmonella enterica enterica serovar Typhi Ty2
aaaugcccauaaagaaauau

SEQ ID NO: 3713026 - RNA, 16 nt, Salmonella enterica enterica serovar Typhi Ty2
aaaugcccgucucauu

SEQ ID NO: 3713027 - RNA, 14 nt, Salmonella enterica enterica serovar Typhi Ty2
aaaugccugugcca

SEQ ID NO: 3713028 - RNA, 15 nt, Salmonella enterica enterica serovar Typhi Ty2
aaaugcgaaaaaaag

SEQ ID NO: 3713029 - RNA, 16 nt, Salmonella enterica enterica serovar Typhi Ty2
aaaugcgcaaagcaua

SEQ ID NO: 3713030 - RNA, 17 nt, Salmonella enterica enterica serovar Typhi Ty2
aaaugcgcaaagcauaa

SEQ ID NO: 3713031 - RNA, 17 nt, Salmonella enterica enterica serovar Typhi Ty2
aaaugcggguccugauc

SEQ ID NO: 3713032 - RNA, 15 nt, Salmonella enterica enterica serovar Typhi Ty2
aaaugcgguuuucuu

SEQ ID NO: 3713033 - RNA, 19 nt, Salmonella enterica enterica serovar Typhi Ty2
aaaugcguggcauuaacaa

SEQ ID NO: 3713034 - RNA, 20 nt, Salmonella enterica enterica serovar Typhi Ty2
aaaugcguggcauuaacaaa

SEQ ID NO: 3713035 - RNA, 15 nt, Salmonella enterica enterica serovar Typhi Ty2
aaaugcuuaucugau

SEQ ID NO: 3713036 - RNA, 18 nt, Salmonella enterica enterica serovar Typhi Ty2
aaaugcuugcuuuagcuu

SEQ ID NO: 3713037 - RNA, 14 nt, Salmonella enterica enterica serovar Typhi Ty2
aaauggauacuggu

SEQ ID NO: 3713038 - RNA, 13 nt, Salmonella enterica enterica serovar Typhi Ty2
aaauggaucgaca

SEQ ID NO: 3713039 - RNA, 11 nt, Salmonella enterica enterica serovar Typhi Ty2
aaauggcgcug

SEQ ID NO: 3713040 - RNA, 12 nt, Salmonella enterica enterica serovar Typhi Ty2
aaauggcgcugu

SEQ ID NO: 3713041 - RNA, 17 nt, Salmonella enterica enterica serovar Typhi Ty2
aaaugggcuggaaauau

SEQ ID NO: 3713042 - RNA, 15 nt, Salmonella enterica enterica serovar Typhi Ty2
aaauggguaucuuca

SEQ ID NO: 3713043 - RNA, 23 nt, Salmonella enterica enterica serovar Typhi Ty2
aaauggucagccauaaccuccuu

SEQ ID NO: 3713044 - RNA, 19 nt, Salmonella enterica enterica serovar Typhi Ty2
aaauggucccugauauaca

SEQ ID NO: 3713045 - RNA, 16 nt, Salmonella enterica enterica serovar Typhi Ty2
aaauggucggucacgc

SEQ ID NO: 3713046 - RNA, 16 nt, Salmonella enterica enterica serovar Typhi Ty2
aaaugguuuugcccau

SEQ ID NO: 3713047 - RNA, 17 nt, Salmonella enterica enterica serovar Typhi Ty2
aaauguauacuccccuu

SEQ ID NO: 3713048 - RNA, 18 nt, Salmonella enterica enterica serovar Typhi Ty2
aaaugucccgauauuggu

SEQ ID NO: 3713049 - RNA, 16 nt, Salmonella enterica enterica serovar Typhi Ty2
aaaugucuguuuguuc

SEQ ID NO: 3713050 - RNA, 9 nt, Salmonella enterica enterica serovar Typhi Ty2
aaauguuuu

SEQ ID NO: 3713051 - RNA, 13 nt, Salmonella enterica enterica serovar Typhi Ty2
aaauguuuuuguu

SEQ ID NO: 3713052 - RNA, 13 nt, Salmonella enterica enterica serovar Typhi Ty2
aaauuaaaaauac

SEQ ID NO: 3713053 - RNA, 14 nt, Salmonella enterica enterica serovar Typhi Ty2
aaauuaaaaauacc

SEQ ID NO: 3713054 - RNA, 18 nt, Salmonella enterica enterica serovar Typhi Ty2
aaauuaaagauuagcguu

SEQ ID NO: 3713055 - RNA, 19 nt, Salmonella enterica enterica serovar Typhi Ty2
aaauuaaauaacaaaugaa

SEQ ID NO: 3713056 - RNA, 13 nt, Salmonella enterica enterica serovar Typhi Ty2
aaauuaaucaggc

SEQ ID NO: 3713057 - RNA, 18 nt, Salmonella enterica enterica serovar Typhi Ty2
aaauuaaugauuaaaaua

SEQ ID NO: 3713058 - RNA, 19 nt, Salmonella enterica enterica serovar Typhi Ty2
aaauuaaugauuaaaauaa

SEQ ID NO: 3713059 - RNA, 18 nt, Salmonella enterica enterica serovar Typhi Ty2
aaauuacgccauaaaaag

SEQ ID NO: 3713060 - RNA, 17 nt, Salmonella enterica enterica serovar Typhi Ty2
aaauuacuuaugauaua

SEQ ID NO: 3713061 - RNA, 22 nt, Salmonella enterica enterica serovar Typhi Ty2
aaauuagcucccgcgauagguu

SEQ ID NO: 3713062 - RNA, 21 nt, Salmonella enterica enterica serovar Typhi Ty2
aaauuauuuuuacuuaaaauu

SEQ ID NO: 3713063 - RNA, 18 nt, Salmonella enterica enterica serovar Typhi Ty2
aaauucaaaaaagcagua

SEQ ID NO: 3713064 - RNA, 19 nt, Salmonella enterica enterica serovar Typhi Ty2
aaauucacgcuucucuggc

SEQ ID NO: 3713065 - RNA, 21 nt, Salmonella enterica enterica serovar Typhi Ty2
aaauucacuuccgucauguag

SEQ ID NO: 3713066 - RNA, 16 nt, Salmonella enterica enterica serovar Typhi Ty2
aaauuccaauauuuau

SEQ ID NO: 3713067 - RNA, 21 nt, Salmonella enterica enterica serovar Typhi Ty2
aaauuccuuccggcgcaauaa

SEQ ID NO: 3713068 - RNA, 19 nt, Salmonella enterica enterica serovar Typhi Ty2
aaauucggcguuacccguc

SEQ ID NO: 3713069 - RNA, 17 nt, Salmonella enterica enterica serovar Typhi Ty2
aaauucuaugccaggcg

SEQ ID NO: 3713070 - RNA, 22 nt, Salmonella enterica enterica serovar Typhi Ty2
aaauucugucucaauaaaaugu

SEQ ID NO: 3713071 - RNA, 22 nt, Salmonella enterica enterica serovar Typhi Ty2
aaauugaauuaagcaauccauu

SEQ ID NO: 3713072 - RNA, 23 nt, Salmonella enterica enterica serovar Typhi Ty2
aaauugaauuaagcaauccauuu

SEQ ID NO: 3713073 - RNA, 14 nt, Salmonella enterica enterica serovar Typhi Ty2
aaauugaauuauaa

SEQ ID NO: 3713074 - RNA, 19 nt, Salmonella enterica enterica serovar Typhi Ty2
aaauugaauuauaauaaag

SEQ ID NO: 3713075 - RNA, 22 nt, Salmonella enterica enterica serovar Typhi Ty2
aaauugaccucacgcuuaucgc

SEQ ID NO: 3713076 - RNA, 12 nt, Salmonella enterica enterica serovar Typhi Ty2
aaauugcagggu

SEQ ID NO: 3713077 - RNA, 24 nt, Salmonella enterica enterica serovar Typhi Ty2
aaauugccacgaacgauauaaaaa

SEQ ID NO: 3713078 - RNA, 20 nt, Salmonella enterica enterica serovar Typhi Ty2
aaauugccgcgcccugcgga

SEQ ID NO: 3713079 - RNA, 16 nt, Salmonella enterica enterica serovar Typhi Ty2
aaauugccugauggcg

SEQ ID NO: 3713080 - RNA, 18 nt, Salmonella enterica enterica serovar Typhi Ty2
aaauugccugauggcgcu

SEQ ID NO: 3713081 - RNA, 13 nt, Salmonella enterica enterica serovar Typhi Ty2
aaauugcugaugu

SEQ ID NO: 3713082 - RNA, 17 nt, Salmonella enterica enterica serovar Typhi Ty2
aaauuggcucagaauuu

SEQ ID NO: 3713083 - RNA, 19 nt, Salmonella enterica enterica serovar Typhi Ty2
aaauuggugauauaaacgg

SEQ ID NO: 3713084 - RNA, 18 nt, Salmonella enterica enterica serovar Typhi Ty2
aaauugguuauauuacug

SEQ ID NO: 3713085 - RNA, 22 nt, Salmonella enterica enterica serovar Typhi Ty2
aaauuuagcuauuccaaaauaa

SEQ ID NO: 3713086 - RNA, 20 nt, Salmonella enterica enterica serovar Typhi Ty2
aaauuuauuuuuugcuggga

SEQ ID NO: 3713087 - RNA, 20 nt, Salmonella enterica enterica serovar Typhi Ty2
aaauuucaucguagucguag

SEQ ID NO: 3713088 - RNA, 12 nt, Salmonella enterica enterica serovar Typhi Ty2
aaauuuccucuu

SEQ ID NO: 3713089 - RNA, 14 nt, Salmonella enterica enterica serovar Typhi Ty2
aaauuucuuuucca

SEQ ID NO: 3713090 - RNA, 16 nt, Salmonella enterica enterica serovar Typhi Ty2
aaauuugcagcgcugu

SEQ ID NO: 3713091 - RNA, 22 nt, Salmonella enterica enterica serovar Typhi Ty2
aaauuuucaauacgucauauca

SEQ ID NO: 3713092 - RNA, 19 nt, Salmonella enterica enterica serovar Typhi Ty2
aaauuuucagacacugcac

SEQ ID NO: 3713093 - RNA, 13 nt, Salmonella enterica enterica serovar Typhi Ty2
aacaaaaccagca

SEQ ID NO: 3713094 - RNA, 15 nt, Salmonella enterica enterica serovar Typhi Ty2
aacaaaaccagcauc

SEQ ID NO: 3713095 - RNA, 14 nt, Salmonella enterica enterica serovar Typhi Ty2
aacaaaagaaagca

SEQ ID NO: 3713096 - RNA, 14 nt, Salmonella enterica enterica serovar Typhi Ty2
aacaaacacagcca

SEQ ID NO: 3713097 - RNA, 17 nt, Salmonella enterica enterica serovar Typhi Ty2
aacaaacauaagcaaau

SEQ ID NO: 3713098 - RNA, 14 nt, Salmonella enterica enterica serovar Typhi Ty2
aacaaaccaaacug

SEQ ID NO: 3713099 - RNA, 19 nt, Salmonella enterica enterica serovar Typhi Ty2
aacaaagccccgggcgcug

SEQ ID NO: 3713100 - RNA, 20 nt, Salmonella enterica enterica serovar Typhi Ty2
aacaaagggcaccugggcaa

SEQ ID NO: 3713101 - RNA, 23 nt, Salmonella enterica enterica serovar Typhi Ty2
aacaaagguuuguuuaauuuugu

SEQ ID NO: 3713102 - RNA, 17 nt, Salmonella enterica enterica serovar Typhi Ty2
aacaaauaaauccauga

SEQ ID NO: 3713103 - RNA, 18 nt, Salmonella enterica enterica serovar Typhi Ty2
aacaaauaaauccaugag

SEQ ID NO: 3713104 - RNA, 16 nt, Salmonella enterica enterica serovar Typhi Ty2
aacaaaucgacagcca

SEQ ID NO: 3713105 - RNA, 14 nt, Salmonella enterica enterica serovar Typhi Ty2
aacaacaggccgcc

SEQ ID NO: 3713106 - RNA, 21 nt, Salmonella enterica enterica serovar Typhi Ty2
aacaaccagaauaauggggau

SEQ ID NO: 3713107 - RNA, 15 nt, Salmonella enterica enterica serovar Typhi Ty2
aacaagcaaaccuau

SEQ ID NO: 3713108 - RNA, 14 nt, Salmonella enterica enterica serovar Typhi Ty2
aacaagcagauacc

SEQ ID NO: 3713109 - RNA, 14 nt, Salmonella enterica enterica serovar Typhi Ty2
aacaagccgccaac

SEQ ID NO: 3713110 - RNA, 18 nt, Salmonella enterica enterica serovar Typhi Ty2
aacaagggcauaaugauu

SEQ ID NO: 3713111 - RNA, 23 nt, Salmonella enterica enterica serovar Typhi Ty2
aacaauaucgauagcauuuuuac

SEQ ID NO: 3713112 - RNA, 17 nt, Salmonella enterica enterica serovar Typhi Ty2
aacaaugggauaaaaug

SEQ ID NO: 3713113 - RNA, 17 nt, Salmonella enterica enterica serovar Typhi Ty2
aacaauuugcccagcgc

SEQ ID NO: 3713114 - RNA, 21 nt, Salmonella enterica enterica serovar Typhi Ty2
aacacaaacaauuuacgcagc

SEQ ID NO: 3713115 - RNA, 16 nt, Salmonella enterica enterica serovar Typhi Ty2
aacacaaucaggcgca

SEQ ID NO: 3713116 - RNA, 19 nt, Salmonella enterica enterica serovar Typhi Ty2
aacacacgcuuagcuugcc

SEQ ID NO: 3713117 - RNA, 23 nt, Salmonella enterica enterica serovar Typhi Ty2
aacacacguaacaaccagaauaa

SEQ ID NO: 3713118 - RNA, 14 nt, Salmonella enterica enterica serovar Typhi Ty2
aacacagccagcac

SEQ ID NO: 3713119 - RNA, 21 nt, Salmonella enterica enterica serovar Typhi Ty2
aacaccagccgcaucuuauau

SEQ ID NO: 3713120 - RNA, 19 nt, Salmonella enterica enterica serovar Typhi Ty2
aacaccagggauuuugcuu

SEQ ID NO: 3713121 - RNA, 21 nt, Salmonella enterica enterica serovar Typhi Ty2
aacacccaauauagaguccug

SEQ ID NO: 3713122 - RNA, 16 nt, Salmonella enterica enterica serovar Typhi Ty2
aacacccacaccaucg

SEQ ID NO: 3713123 - RNA, 20 nt, Salmonella enterica enterica serovar Typhi Ty2
aacacccgcaaacuaauggc

SEQ ID NO: 3713124 - RNA, 18 nt, Salmonella enterica enterica serovar Typhi Ty2
aacacgaccagcgacagu

SEQ ID NO: 3713125 - RNA, 16 nt, Salmonella enterica enterica serovar Typhi Ty2
aacacgacgcugccac

SEQ ID NO: 3713126 - RNA, 22 nt, Salmonella enterica enterica serovar Typhi Ty2
aacacgauggcaaauaauacca

SEQ ID NO: 3713127 - RNA, 21 nt, Salmonella enterica enterica serovar Typhi Ty2
aacacgccgccuaucgccagc

SEQ ID NO: 3713128 - RNA, 16 nt, Salmonella enterica enterica serovar Typhi Ty2
aacacgccgcgcugga

SEQ ID NO: 3713129 - RNA, 13 nt, Salmonella enterica enterica serovar Typhi Ty2
aacacggcgcuca

SEQ ID NO: 3713130 - RNA, 16 nt, Salmonella enterica enterica serovar Typhi Ty2
aacacuaaaucauaau

SEQ ID NO: 3713131 - RNA, 18 nt, Salmonella enterica enterica serovar Typhi Ty2
aacacuauauguccuuua

SEQ ID NO: 3713132 - RNA, 23 nt, Salmonella enterica enterica serovar Typhi Ty2
aacacucccccaccuuuugcagc

SEQ ID NO: 3713133 - RNA, 13 nt, Salmonella enterica enterica serovar Typhi Ty2
aacacucuccacc

SEQ ID NO: 3713134 - RNA, 14 nt, Salmonella enterica enterica serovar Typhi Ty2
aacacucuccacca

SEQ ID NO: 3713135 - RNA, 14 nt, Salmonella enterica enterica serovar Typhi Ty2
aacacuggcgcuca

SEQ ID NO: 3713136 - RNA, 14 nt, Salmonella enterica enterica serovar Typhi Ty2
aacagaaaccauaa

SEQ ID NO: 3713137 - RNA, 18 nt, Salmonella enterica enterica serovar Typhi Ty2
aacagaagccugcguuau

SEQ ID NO: 3713138 - RNA, 19 nt, Salmonella enterica enterica serovar Typhi Ty2
aacagaaucgcgcugaggg

SEQ ID NO: 3713139 - RNA, 17 nt, Salmonella enterica enterica serovar Typhi Ty2
aacagacaauaccaggg

SEQ ID NO: 3713140 - RNA, 22 nt, Salmonella enterica enterica serovar Typhi Ty2
aacagacaauuagcgacgcaua

SEQ ID NO: 3713141 - RNA, 18 nt, Salmonella enterica enterica serovar Typhi Ty2
aacagagagggaaaaaaa

SEQ ID NO: 3713142 - RNA, 12 nt, Salmonella enterica enterica serovar Typhi Ty2
aacagagcaauu

SEQ ID NO: 3713143 - RNA, 22 nt, Salmonella enterica enterica serovar Typhi Ty2
aacagagcgccggcaaagccau

SEQ ID NO: 3713144 - RNA, 16 nt, Salmonella enterica enterica serovar Typhi Ty2
aacagcaaacgccuuc

SEQ ID NO: 3713145 - RNA, 16 nt, Salmonella enterica enterica serovar Typhi Ty2
aacagcaaugcccaaa

SEQ ID NO: 3713146 - RNA, 14 nt, Salmonella enterica enterica serovar Typhi Ty2
aacagcaauguuuc

SEQ ID NO: 3713147 - RNA, 12 nt, Salmonella enterica enterica serovar Typhi Ty2
aacagcaccagc

SEQ ID NO: 3713148 - RNA, 16 nt, Salmonella enterica enterica serovar Typhi Ty2
aacagcacgcccugcc

SEQ ID NO: 3713149 - RNA, 12 nt, Salmonella enterica enterica serovar Typhi Ty2
aacagcagcagc

SEQ ID NO: 3713150 - RNA, 18 nt, Salmonella enterica enterica serovar Typhi Ty2
aacagcauaauaaagcag

SEQ ID NO: 3713151 - RNA, 23 nt, Salmonella enterica enterica serovar Typhi Ty2
aacagccaaucauaaacgccuga

SEQ ID NO: 3713152 - RNA, 15 nt, Salmonella enterica enterica serovar Typhi Ty2
aacagccagaagccu

SEQ ID NO: 3713153 - RNA, 13 nt, Salmonella enterica enterica serovar Typhi Ty2
aacagccagcagc

SEQ ID NO: 3713154 - RNA, 14 nt, Salmonella enterica enterica serovar Typhi Ty2
aacagccagcagcg

SEQ ID NO: 3713155 - RNA, 12 nt, Salmonella enterica enterica serovar Typhi Ty2
aacagccaggcu

SEQ ID NO: 3713156 - RNA, 15 nt, Salmonella enterica enterica serovar Typhi Ty2
agcaggcacuguggu

SEQ ID NO: 3713157 - RNA, 17 nt, Salmonella enterica enterica serovar Typhi Ty2
agcaggcacuguggugu

SEQ ID NO: 3713158 - RNA, 21 nt, Salmonella enterica enterica serovar Typhi Ty2
agcaggcacuguggugugccu

SEQ ID NO: 3713159 - RNA, 10 nt, Salmonella enterica enterica serovar Typhi Ty2
agcaggcggg

SEQ ID NO: 3713160 - RNA, 24 nt, Salmonella enterica enterica serovar Typhi Ty2
agcaggcgggacgccauagcguuu

SEQ ID NO: 3713161 - RNA, 13 nt, Salmonella enterica enterica serovar Typhi Ty2
agcaggcgggcuu

SEQ ID NO: 3713162 - RNA, 14 nt, Salmonella enterica enterica serovar Typhi Ty2
agcaggcuuugcug

SEQ ID NO: 3713163 - RNA, 14 nt, Salmonella enterica enterica serovar Typhi Ty2
agcagggucaggaa

SEQ ID NO: 3713164 - RNA, 15 nt, Salmonella enterica enterica serovar Typhi Ty2
agcagggucaggaac

SEQ ID NO: 3713165 - RNA, 22 nt, Salmonella enterica enterica serovar Typhi Ty2
agcagggucaggaacugcggcc

SEQ ID NO: 3713166 - RNA, 18 nt, Salmonella enterica enterica serovar Typhi Ty2
agcaggucaaagacgaaa

SEQ ID NO: 3713167 - RNA, 13 nt, Salmonella enterica enterica serovar Typhi Ty2
agcaggugcggcu

SEQ ID NO: 3713168 - RNA, 17 nt, Salmonella enterica enterica serovar Typhi Ty2
agcagguuaaacagaca

SEQ ID NO: 3713169 - RNA, 15 nt, Salmonella enterica enterica serovar Typhi Ty2
agcaguaacgcacuu

SEQ ID NO: 3713170 - RNA, 19 nt, Salmonella enterica enterica serovar Typhi Ty2
agcaguaucguguuauuuu

SEQ ID NO: 3713171 - RNA, 18 nt, Salmonella enterica enterica serovar Typhi Ty2
agcaguccugcgggaaca

SEQ ID NO: 3713172 - RNA, 16 nt, Salmonella enterica enterica serovar Typhi Ty2
agcagugauuaugcuc

SEQ ID NO: 3713173 - RNA, 14 nt, Salmonella enterica enterica serovar Typhi Ty2
agcagugggaaaau

SEQ ID NO: 3713174 - RNA, 14 nt, Salmonella enterica enterica serovar Typhi Ty2
agcaguucagcagc

SEQ ID NO: 3713175 - RNA, 16 nt, Salmonella enterica enterica serovar Typhi Ty2
agcaguucagcagcac

SEQ ID NO: 3713176 - RNA, 20 nt, Salmonella enterica enterica serovar Typhi Ty2
agcaguuccccgccgcggcg

SEQ ID NO: 3713177 - RNA, 21 nt, Salmonella enterica enterica serovar Typhi Ty2
agcaguuuuaucuaugugugg

SEQ ID NO: 3713178 - RNA, 21 nt, Salmonella enterica enterica serovar Typhi Ty2
agcauaaaaccgccgcccauu

SEQ ID NO: 3713179 - RNA, 13 nt, Salmonella enterica enterica serovar Typhi Ty2
agcauaccgccca

SEQ ID NO: 3713180 - RNA, 17 nt, Salmonella enterica enterica serovar Typhi Ty2
agcauacgacaucgcca

SEQ ID NO: 3713181 - RNA, 14 nt, Salmonella enterica enterica serovar Typhi Ty2
agcauacgcugcac

SEQ ID NO: 3713182 - RNA, 18 nt, Salmonella enterica enterica serovar Typhi Ty2
agcauagcgccuucaggc

SEQ ID NO: 3713183 - RNA, 15 nt, Salmonella enterica enterica serovar Typhi Ty2
agcauagcguuaucu

SEQ ID NO: 3713184 - RNA, 14 nt, Salmonella enterica enterica serovar Typhi Ty2
agcauauccagcgc

SEQ ID NO: 3713185 - RNA, 12 nt, Salmonella enterica enterica serovar Typhi Ty2
agcauaucgccg

SEQ ID NO: 3713186 - RNA, 21 nt, Salmonella enterica enterica serovar Typhi Ty2
agcauauucaccagagcauca

SEQ ID NO: 3713187 - RNA, 16 nt, Salmonella enterica enterica serovar Typhi Ty2
agcaucaauagcagcu

SEQ ID NO: 3713188 - RNA, 15 nt, Salmonella enterica enterica serovar Typhi Ty2
agcaucaauaucugc

SEQ ID NO: 3713189 - RNA, 13 nt, Salmonella enterica enterica serovar Typhi Ty2
agcaucagcgccg

SEQ ID NO: 3713190 - RNA, 13 nt, Salmonella enterica enterica serovar Typhi Ty2
agcaucaggugga

SEQ ID NO: 3713191 - RNA, 16 nt, Salmonella enterica enterica serovar Typhi Ty2
agcaucaucugccauu

SEQ ID NO: 3713192 - RNA, 13 nt, Salmonella enterica enterica serovar Typhi Ty2
agcaucauguccc

SEQ ID NO: 3713193 - RNA, 15 nt, Salmonella enterica enterica serovar Typhi Ty2
agcauccagcucaug

SEQ ID NO: 3713194 - RNA, 18 nt, Salmonella enterica enterica serovar Typhi Ty2
agcaucccgcuggcgcca

SEQ ID NO: 3713195 - RNA, 21 nt, Salmonella enterica enterica serovar Typhi Ty2
agcauccgggauauaaaauua

SEQ ID NO: 3713196 - RNA, 13 nt, Salmonella enterica enterica serovar Typhi Ty2
agcaucgccauca

SEQ ID NO: 3713197 - RNA, 18 nt, Salmonella enterica enterica serovar Typhi Ty2
agcaucgccgguagcuuc

SEQ ID NO: 3713198 - RNA, 20 nt, Salmonella enterica enterica serovar Typhi Ty2
agcaucgccgguagcuucag

SEQ ID NO: 3713199 - RNA, 22 nt, Salmonella enterica enterica serovar Typhi Ty2
agcaucgcuuuuaggcugaaag

SEQ ID NO: 3713200 - RNA, 15 nt, Salmonella enterica enterica serovar Typhi Ty2
agcaucgggaaucau

SEQ ID NO: 3713201 - RNA, 23 nt, Salmonella enterica enterica serovar Typhi Ty2
agcaucguaagccgcauuacaaa

SEQ ID NO: 3713202 - RNA, 12 nt, Salmonella enterica enterica serovar Typhi Ty2
agcaucucaucc

SEQ ID NO: 3713203 - RNA, 15 nt, Salmonella enterica enterica serovar Typhi Ty2
agcaucuccuggcgc

SEQ ID NO: 3713204 - RNA, 18 nt, Salmonella enterica enterica serovar Typhi Ty2
agcaucugauagcccauc

SEQ ID NO: 3713205 - RNA, 15 nt, Salmonella enterica enterica serovar Typhi Ty2
agcaucugcauaaug

SEQ ID NO: 3713206 - RNA, 18 nt, Salmonella enterica enterica serovar Typhi Ty2
agcaucugcggcuuucau

SEQ ID NO: 3713207 - RNA, 16 nt, Salmonella enterica enterica serovar Typhi Ty2
agcaucuuaugcgcaa

SEQ ID NO: 3713208 - RNA, 15 nt, Salmonella enterica enterica serovar Typhi Ty2
agcaugacaauaacg

SEQ ID NO: 3713209 - RNA, 14 nt, Salmonella enterica enterica serovar Typhi Ty2
agcguuucacgcgc

SEQ ID NO: 3713210 - RNA, 15 nt, Salmonella enterica enterica serovar Typhi Ty2
agcguuucgccguaa

SEQ ID NO: 3713211 - RNA, 19 nt, Salmonella enterica enterica serovar Typhi Ty2
agcguuugacggauuuuuu

SEQ ID NO: 3713212 - RNA, 22 nt, Salmonella enterica enterica serovar Typhi Ty2
agcguuuugauguccagaugcu

SEQ ID NO: 3713213 - RNA, 13 nt, Salmonella enterica enterica serovar Typhi Ty2
agcuaaaaacagc

SEQ ID NO: 3713214 - RNA, 19 nt, Salmonella enterica enterica serovar Typhi Ty2
agcuaaauaaaaauaauca

SEQ ID NO: 3713215 - RNA, 17 nt, Salmonella enterica enterica serovar Typhi Ty2
agcuaaucacccacuuc

SEQ ID NO: 3713216 - RNA, 18 nt, Salmonella enterica enterica serovar Typhi Ty2
agcuaauccccagcgcuc

SEQ ID NO: 3713217 - RNA, 18 nt, Salmonella enterica enterica serovar Typhi Ty2
agcuaaugcaauaaacua

SEQ ID NO: 3713218 - RNA, 21 nt, Salmonella enterica enterica serovar Typhi Ty2
agcuacuugaucggcuggcgc

SEQ ID NO: 3713219 - RNA, 22 nt, Salmonella enterica enterica serovar Typhi Ty2
agcuacuugaucggcuggcgca

SEQ ID NO: 3713220 - RNA, 19 nt, Salmonella enterica enterica serovar Typhi Ty2
agcuauccacgcagacgcc

SEQ ID NO: 3713221 - RNA, 18 nt, Salmonella enterica enterica serovar Typhi Ty2
agcuauccaguuucugac

SEQ ID NO: 3713222 - RNA, 19 nt, Salmonella enterica enterica serovar Typhi Ty2
agcuauccaguuucugacg

SEQ ID NO: 3713223 - RNA, 16 nt, Salmonella enterica enterica serovar Typhi Ty2
agcuauuccaaaauaa

SEQ ID NO: 3713224 - RNA, 22 nt, Salmonella enterica enterica serovar Typhi Ty2
agcuauuccuguauaauuauuu

SEQ ID NO: 3713225 - RNA, 19 nt, Salmonella enterica enterica serovar Typhi Ty2
agcucaacuauuaaagcac

SEQ ID NO: 3713226 - RNA, 18 nt, Salmonella enterica enterica serovar Typhi Ty2
agcucaagcccgcgucgu

SEQ ID NO: 3713227 - RNA, 19 nt, Salmonella enterica enterica serovar Typhi Ty2
agcucaagcccgcgucguu

SEQ ID NO: 3713228 - RNA, 17 nt, Salmonella enterica enterica serovar Typhi Ty2
agcucacgcgccagcac

SEQ ID NO: 3713229 - RNA, 18 nt, Salmonella enterica enterica serovar Typhi Ty2
agcucagaaauaaaacca

SEQ ID NO: 3713230 - RNA, 23 nt, Salmonella enterica enterica serovar Typhi Ty2
agcucagaaauaaaaccagggaa

SEQ ID NO: 3713231 - RNA, 19 nt, Salmonella enterica enterica serovar Typhi Ty2
agcucaguccagccgccgc

SEQ ID NO: 3713232 - RNA, 17 nt, Salmonella enterica enterica serovar Typhi Ty2
agcucaguugguagagc

SEQ ID NO: 3713233 - RNA, 21 nt, Salmonella enterica enterica serovar Typhi Ty2
agcucauguagucauauugcg

SEQ ID NO: 3713234 - RNA, 22 nt, Salmonella enterica enterica serovar Typhi Ty2
agcucauguagucauauugcgc

SEQ ID NO: 3713235 - RNA, 17 nt, Salmonella enterica enterica serovar Typhi Ty2
agcuccagccgcugccu

SEQ ID NO: 3713236 - RNA, 16 nt, Salmonella enterica enterica serovar Typhi Ty2
agcuccgcaaagccca

SEQ ID NO: 3713237 - RNA, 24 nt, Salmonella enterica enterica serovar Typhi Ty2
agcuccgcaaagcccaucagcgcc

SEQ ID NO: 3713238 - RNA, 22 nt, Salmonella enterica enterica serovar Typhi Ty2
agcuccgcguauucucaaccag

SEQ ID NO: 3713239 - RNA, 14 nt, Salmonella enterica enterica serovar Typhi Ty2
agcucgauccggca

SEQ ID NO: 3713240 - RNA, 21 nt, Salmonella enterica enterica serovar Typhi Ty2
agcucgcaugcauagccgcug

SEQ ID NO: 3713241 - RNA, 14 nt, Salmonella enterica enterica serovar Typhi Ty2
agcucgcccagcac

SEQ ID NO: 3713242 - RNA, 20 nt, Salmonella enterica enterica serovar Typhi Ty2
agcucgguucuucggcauaa

SEQ ID NO: 3713243 - RNA, 15 nt, Salmonella enterica enterica serovar Typhi Ty2
agcucguuauuuccg

SEQ ID NO: 3713244 - RNA, 23 nt, Salmonella enterica enterica serovar Typhi Ty2
agcucuguggggggaacggcaga

SEQ ID NO: 3713245 - RNA, 20 nt, Salmonella enterica enterica serovar Typhi Ty2
agcucuucaggcguauauuc

SEQ ID NO: 3713246 - RNA, 22 nt, Salmonella enterica enterica serovar Typhi Ty2
agcucuucuucgcucucgccgc

SEQ ID NO: 3713247 - RNA, 10 nt, Salmonella enterica enterica serovar Typhi Ty2
agcucuuuca

SEQ ID NO: 3713248 - RNA, 19 nt, Salmonella enterica enterica serovar Typhi Ty2
agcugacgacgccagcccu

SEQ ID NO: 3713249 - RNA, 14 nt, Salmonella enterica enterica serovar Typhi Ty2
agcugagcgucagg

SEQ ID NO: 3713250 - RNA, 17 nt, Salmonella enterica enterica serovar Typhi Ty2
agcugagcuaaucaccc

SEQ ID NO: 3713251 - RNA, 14 nt, Salmonella enterica enterica serovar Typhi Ty2
agcugaguaaggac

SEQ ID NO: 3713252 - RNA, 17 nt, Salmonella enterica enterica serovar Typhi Ty2
agcugaguaaggacaga

SEQ ID NO: 3713253 - RNA, 16 nt, Salmonella enterica enterica serovar Typhi Ty2
agcugauaagcuagua

SEQ ID NO: 3713254 - RNA, 16 nt, Salmonella enterica enterica serovar Typhi Ty2
agcugauauuuuacuu

SEQ ID NO: 3713255 - RNA, 20 nt, Salmonella enterica enterica serovar Typhi Ty2
agcugauauuuuacuuuuug

SEQ ID NO: 3713256 - RNA, 18 nt, Salmonella enterica enterica serovar Typhi Ty2
agcugauugauuuuguaa

SEQ ID NO: 3713257 - RNA, 13 nt, Salmonella enterica enterica serovar Typhi Ty2
agcugauuuuucg

SEQ ID NO: 3713258 - RNA, 15 nt, Salmonella enterica enterica serovar Typhi Ty2
agcugcaccaggagc

SEQ ID NO: 3713259 - RNA, 17 nt, Salmonella enterica enterica serovar Typhi Ty2
agcugcaguuauuuuuu

SEQ ID NO: 3713260 - RNA, 22 nt, Salmonella enterica enterica serovar Typhi Ty2
agcugcauccgggguucgaauc

SEQ ID NO: 3713261 - RNA, 15 nt, Salmonella enterica enterica serovar Typhi Ty2
agcugccaaaaggcg

SEQ ID NO: 3713262 - RNA, 16 nt, Salmonella enterica enterica serovar Typhi Ty2
agcugcgaucaaguuu

SEQ ID NO: 3713263 - RNA, 17 nt, Salmonella enterica enterica serovar Typhi Ty2
agcugcgaucaaguuuu

SEQ ID NO: 3713264 - RNA, 17 nt, Salmonella enterica enterica serovar Typhi Ty2
agcugcgccauaccccg

SEQ ID NO: 3713265 - RNA, 19 nt, Salmonella enterica enterica serovar Typhi Ty2
agcugcgccauaccccgau

SEQ ID NO: 3713266 - RNA, 23 nt, Salmonella enterica enterica serovar Typhi Ty2
agcugcgggugcuugagacuguu

SEQ ID NO: 3713267 - RNA, 12 nt, Salmonella enterica enterica serovar Typhi Ty2
agcugcgucagc

SEQ ID NO: 3713268 - RNA, 20 nt, Salmonella enterica enterica serovar Typhi Ty2
agcugcgucagcgcuugccg

SEQ ID NO: 3713269 - RNA, 17 nt, Salmonella enterica enterica serovar Typhi Ty2
agcugcuggcgagcagg

SEQ ID NO: 3713270 - RNA, 18 nt, Salmonella enterica enterica serovar Typhi Ty2
agcuggaccgcagcuuau

SEQ ID NO: 3713271 - RNA, 13 nt, Salmonella enterica enterica serovar Typhi Ty2
agcuggauaagcu

SEQ ID NO: 3713272 - RNA, 19 nt, Salmonella enterica enterica serovar Typhi Ty2
agcuggccggaucggcggu

SEQ ID NO: 3713273 - RNA, 21 nt, Salmonella enterica enterica serovar Typhi Ty2
agcuggcuugccagcagauuu

SEQ ID NO: 3713274 - RNA, 19 nt, Salmonella enterica enterica serovar Typhi Ty2
agcugggcgucaacgugaa

SEQ ID NO: 3713275 - RNA, 18 nt, Salmonella enterica enterica serovar Typhi Ty2
agcugguauaggccaggc

SEQ ID NO: 3713276 - RNA, 19 nt, Salmonella enterica enterica serovar Typhi Ty2
agcugguauaggccaggcu

SEQ ID NO: 3713277 - RNA, 13 nt, Salmonella enterica enterica serovar Typhi Ty2
agcugguauugaa

SEQ ID NO: 3713278 - RNA, 21 nt, Salmonella enterica enterica serovar Typhi Ty2
agcuggucgccagcgccggac

SEQ ID NO: 3713279 - RNA, 20 nt, Salmonella enterica enterica serovar Typhi Ty2
agcugguguaauugcgccag

SEQ ID NO: 3713280 - RNA, 22 nt, Salmonella enterica enterica serovar Typhi Ty2
agcugguugagauccauaagau

SEQ ID NO: 3713281 - RNA, 21 nt, Salmonella enterica enterica serovar Typhi Ty2
agcugguugauauugugcaua

SEQ ID NO: 3713282 - RNA, 13 nt, Salmonella enterica enterica serovar Typhi Ty2
agcuguaacacug

SEQ ID NO: 3713283 - RNA, 23 nt, Salmonella enterica enterica serovar Typhi Ty2
agcuguaccaucaccugaugucc

SEQ ID NO: 3713284 - RNA, 22 nt, Salmonella enterica enterica serovar Typhi Ty2
agcuguacuuugccggggaggg

SEQ ID NO: 3713285 - RNA, 13 nt, Salmonella enterica enterica serovar Typhi Ty2
agcuguagcauaa

SEQ ID NO: 3713286 - RNA, 16 nt, Salmonella enterica enterica serovar Typhi Ty2
agcuguuaauuugcau

SEQ ID NO: 3713287 - RNA, 14 nt, Salmonella enterica enterica serovar Typhi Ty2
agcuuaaucaccag

SEQ ID NO: 3713288 - RNA, 18 nt, Salmonella enterica enterica serovar Typhi Ty2
agcuuaaucaccagcgca

SEQ ID NO: 3713289 - RNA, 16 nt, Salmonella enterica enterica serovar Typhi Ty2
agcuuaauuuuauagc

SEQ ID NO: 3713290 - RNA, 15 nt, Salmonella enterica enterica serovar Typhi Ty2
aggagcauagauaac

SEQ ID NO: 3713291 - RNA, 19 nt, Salmonella enterica enterica serovar Typhi Ty2
aggagcgcgacgacggcgc

SEQ ID NO: 3713292 - RNA, 13 nt, Salmonella enterica enterica serovar Typhi Ty2
aggagcggaagag

SEQ ID NO: 3713293 - RNA, 17 nt, Salmonella enterica enterica serovar Typhi Ty2
aggagcucggccaucug

SEQ ID NO: 3713294 - RNA, 20 nt, Salmonella enterica enterica serovar Typhi Ty2
aggaguaacagauagucgua

SEQ ID NO: 3713295 - RNA, 14 nt, Salmonella enterica enterica serovar Typhi Ty2
aggaguaguuaaaa

SEQ ID NO: 3713296 - RNA, 21 nt, Salmonella enterica enterica serovar Typhi Ty2
aggaguccaaaacgaacaggc

SEQ ID NO: 3713297 - RNA, 11 nt, Salmonella enterica enterica serovar Typhi Ty2
aggagugaaca

SEQ ID NO: 3713298 - RNA, 16 nt, Salmonella enterica enterica serovar Typhi Ty2
aggauaaaauccugca

SEQ ID NO: 3713299 - RNA, 17 nt, Salmonella enterica enterica serovar Typhi Ty2
aggauaaaauccugcac

SEQ ID NO: 3713300 - RNA, 15 nt, Salmonella enterica enterica serovar Typhi Ty2
aggauaaaaucgcca

SEQ ID NO: 3713301 - RNA, 18 nt, Salmonella enterica enterica serovar Typhi Ty2
aggauaaccuuccggcac

SEQ ID NO: 3713302 - RNA, 23 nt, Salmonella enterica enterica serovar Typhi Ty2
aggauaauaguguuagcgucagu

SEQ ID NO: 3713303 - RNA, 19 nt, Salmonella enterica enterica serovar Typhi Ty2
aggauaauucccccaguag

SEQ ID NO: 3713304 - RNA, 15 nt, Salmonella enterica enterica serovar Typhi Ty2
aggauacagccgacu

SEQ ID NO: 3713305 - RNA, 16 nt, Salmonella enterica enterica serovar Typhi Ty2
aggauacagccgacua

SEQ ID NO: 3713306 - RNA, 19 nt, Salmonella enterica enterica serovar Typhi Ty2
aggauagcgaccagcguca

SEQ ID NO: 3713307 - RNA, 21 nt, Salmonella enterica enterica serovar Typhi Ty2
aggauagcgaccagcgucagc

SEQ ID NO: 3713308 - RNA, 21 nt, Salmonella enterica enterica serovar Typhi Ty2
aggauagcuuuguauauguuu

SEQ ID NO: 3713309 - RNA, 19 nt, Salmonella enterica enterica serovar Typhi Ty2
aggauagugauauagcgcc

SEQ ID NO: 3713310 - RNA, 13 nt, Salmonella enterica enterica serovar Typhi Ty2
aggauauaaaaaa

SEQ ID NO: 3713311 - RNA, 21 nt, Salmonella enterica enterica serovar Typhi Ty2
aggauauuuauuugguuucua

SEQ ID NO: 3713312 - RNA, 20 nt, Salmonella enterica enterica serovar Typhi Ty2
aggaucaaaaucgcgcccca

SEQ ID NO: 3713313 - RNA, 14 nt, Salmonella enterica enterica serovar Typhi Ty2
aggaucguaaugau

SEQ ID NO: 3713314 - RNA, 14 nt, Salmonella enterica enterica serovar Typhi Ty2
aggaugaacucuau

SEQ ID NO: 3713315 - RNA, 21 nt, Salmonella enterica enterica serovar Typhi Ty2
aggauggccagcaccagcauu

SEQ ID NO: 3713316 - RNA, 16 nt, Salmonella enterica enterica serovar Typhi Ty2
aggauguccaggcgac

SEQ ID NO: 3713317 - RNA, 18 nt, Salmonella enterica enterica serovar Typhi Ty2
aggauuugucucaucuga

SEQ ID NO: 3713318 - RNA, 19 nt, Salmonella enterica enterica serovar Typhi Ty2
aggauuugucucaucugau

SEQ ID NO: 3713319 - RNA, 18 nt, Salmonella enterica enterica serovar Typhi Ty2
aggcaaaaauaggcuuuu

SEQ ID NO: 3713320 - RNA, 20 nt, Salmonella enterica enterica serovar Typhi Ty2
aggcaaaaaucgucaucaga

SEQ ID NO: 3713321 - RNA, 21 nt, Salmonella enterica enterica serovar Typhi Ty2
aggcaaaaaucgucaucagau

SEQ ID NO: 3713322 - RNA, 13 nt, Salmonella enterica enterica serovar Typhi Ty2
aggcaaaacgggc

SEQ ID NO: 3713323 - RNA, 15 nt, Salmonella enterica enterica serovar Typhi Ty2
aggcaaaaugccagc

SEQ ID NO: 3713324 - RNA, 12 nt, Salmonella enterica enterica serovar Typhi Ty2
aggcaaaccagc

SEQ ID NO: 3713325 - RNA, 20 nt, Salmonella enterica enterica serovar Typhi Ty2
aggcaaacgcggugaaggca

SEQ ID NO: 3713326 - RNA, 17 nt, Salmonella enterica enterica serovar Typhi Ty2
aggcaaagcauaggcca

SEQ ID NO: 3713327 - RNA, 20 nt, Salmonella enterica enterica serovar Typhi Ty2
aggcaaagcauaggccacga

SEQ ID NO: 3713328 - RNA, 14 nt, Salmonella enterica enterica serovar Typhi Ty2
aggcaaaggaaugc

SEQ ID NO: 3713329 - RNA, 17 nt, Salmonella enterica enterica serovar Typhi Ty2
aggcaaaucaacauuau

SEQ ID NO: 3713330 - RNA, 16 nt, Salmonella enterica enterica serovar Typhi Ty2
aggcaaccugucagua

SEQ ID NO: 3713331 - RNA, 19 nt, Salmonella enterica enterica serovar Typhi Ty2
aggcaauaaaaaaggcaga

SEQ ID NO: 3713332 - RNA, 16 nt, Salmonella enterica enterica serovar Typhi Ty2
aggcaauaaacaucag

SEQ ID NO: 3713333 - RNA, 14 nt, Salmonella enterica enterica serovar Typhi Ty2
aggcaauauccucc

SEQ ID NO: 3713334 - RNA, 16 nt, Salmonella enterica enterica serovar Typhi Ty2
aggcaaucgcuuccag

SEQ ID NO: 3713335 - RNA, 13 nt, Salmonella enterica enterica serovar Typhi Ty2
aggcacaacaaua

SEQ ID NO: 3713336 - RNA, 22 nt, Salmonella enterica enterica serovar Typhi Ty2
aggcaccguuucuuugcugccg

SEQ ID NO: 3713337 - RNA, 15 nt, Salmonella enterica enterica serovar Typhi Ty2
aggcagauucuucug

SEQ ID NO: 3713338 - RNA, 16 nt, Salmonella enterica enterica serovar Typhi Ty2
aggcagcaaugugcgc

SEQ ID NO: 3713339 - RNA, 14 nt, Salmonella enterica enterica serovar Typhi Ty2
aggcagcacaauca

SEQ ID NO: 3713340 - RNA, 17 nt, Salmonella enterica enterica serovar Typhi Ty2
aggcagcacaucaauau

SEQ ID NO: 3713341 - RNA, 19 nt, Salmonella enterica enterica serovar Typhi Ty2
aggcagcaccucaauauga

SEQ ID NO: 3713342 - RNA, 23 nt, Salmonella enterica enterica serovar Typhi Ty2
aggcagccacaaugggggcauaa

SEQ ID NO: 3713343 - RNA, 18 nt, Salmonella enterica enterica serovar Typhi Ty2
aggcagccggauuuuaaa

SEQ ID NO: 3713344 - RNA, 21 nt, Salmonella enterica enterica serovar Typhi Ty2
aggcagccggauuuuaaauug

SEQ ID NO: 3713345 - RNA, 22 nt, Salmonella enterica enterica serovar Typhi Ty2
aggcagccggauuuuaaauugg

SEQ ID NO: 3713346 - RNA, 14 nt, Salmonella enterica enterica serovar Typhi Ty2
aggcaggaaaucca

SEQ ID NO: 3713347 - RNA, 15 nt, Salmonella enterica enterica serovar Typhi Ty2
aggcaggaaauccag

SEQ ID NO: 3713348 - RNA, 17 nt, Salmonella enterica enterica serovar Typhi Ty2
aggcaggaaauccagca

SEQ ID NO: 3713349 - RNA, 13 nt, Salmonella enterica enterica serovar Typhi Ty2
aggcauaaaaaaa

SEQ ID NO: 3713350 - RNA, 16 nt, Salmonella enterica enterica serovar Typhi Ty2
aggcauaaaaaagagg

SEQ ID NO: 3713351 - RNA, 19 nt, Salmonella enterica enterica serovar Typhi Ty2
aggcauaauggaacugccu

SEQ ID NO: 3713352 - RNA, 14 nt, Salmonella enterica enterica serovar Typhi Ty2
aggcauagaaaaag

SEQ ID NO: 3713353 - RNA, 19 nt, Salmonella enterica enterica serovar Typhi Ty2
aggcauccgugaccugcug

SEQ ID NO: 3713354 - RNA, 23 nt, Salmonella enterica enterica serovar Typhi Ty2
aggcauccgugaccugcugacua

SEQ ID NO: 3713355 - RNA, 22 nt, Salmonella enterica enterica serovar Typhi Ty2
aggcaucgacgccagcggguga

SEQ ID NO: 3713356 - RNA, 14 nt, Salmonella enterica enterica serovar Typhi Ty2
aggcaucugaaaug

SEQ ID NO: 3713357 - RNA, 16 nt, Salmonella enterica enterica serovar Typhi Ty2
aggcaucuuccagcgu

SEQ ID NO: 3713358 - RNA, 20 nt, Salmonella enterica enterica serovar Typhi Ty2
aggcaugccaaaccagacuc

SEQ ID NO: 3713359 - RNA, 16 nt, Salmonella enterica enterica serovar Typhi Ty2
aggcauguuaugaaua

SEQ ID NO: 3713360 - RNA, 14 nt, Salmonella enterica enterica serovar Typhi Ty2
aggcauuaaaaaaa

SEQ ID NO: 3713361 - RNA, 15 nt, Salmonella enterica enterica serovar Typhi Ty2
aggcauuaaaaaaac

SEQ ID NO: 3713362 - RNA, 16 nt, Salmonella enterica enterica serovar Typhi Ty2
aggcauuaaaaaaacg

SEQ ID NO: 3713363 - RNA, 14 nt, Salmonella enterica enterica serovar Typhi Ty2
aggcauuggacgga

SEQ ID NO: 3713364 - RNA, 19 nt, Salmonella enterica enterica serovar Typhi Ty2
aggcauuuaugccgccauc

SEQ ID NO: 3713365 - RNA, 18 nt, Salmonella enterica enterica serovar Typhi Ty2
aggcauuucaaucgccac

SEQ ID NO: 3713366 - RNA, 20 nt, Salmonella enterica enterica serovar Typhi Ty2
aggccaaacccugcgccgca

SEQ ID NO: 3713367 - RNA, 18 nt, Salmonella enterica enterica serovar Typhi Ty2
aggccaaauagaacgcuc

SEQ ID NO: 3713368 - RNA, 19 nt, Salmonella enterica enterica serovar Typhi Ty2
aggccaaguuuagaaaaua

SEQ ID NO: 3713369 - RNA, 23 nt, Salmonella enterica enterica serovar Typhi Ty2
aggccacgauauagucgcccauc

SEQ ID NO: 3713370 - RNA, 13 nt, Salmonella enterica enterica serovar Typhi Ty2
aggccacuucaca

SEQ ID NO: 3713371 - RNA, 20 nt, Salmonella enterica enterica serovar Typhi Ty2
aggccagaaggcgaacauaa

SEQ ID NO: 3713372 - RNA, 19 nt, Salmonella enterica enterica serovar Typhi Ty2
aggcguuuaugagaucggg

SEQ ID NO: 3713373 - RNA, 16 nt, Salmonella enterica enterica serovar Typhi Ty2
aggcguuuuauuggua

SEQ ID NO: 3713374 - RNA, 14 nt, Salmonella enterica enterica serovar Typhi Ty2
aggcuaaagugcgu

SEQ ID NO: 3713375 - RNA, 13 nt, Salmonella enterica enterica serovar Typhi Ty2
aggcuacccagac

SEQ ID NO: 3713376 - RNA, 15 nt, Salmonella enterica enterica serovar Typhi Ty2
aggcuacccagacaa

SEQ ID NO: 3713377 - RNA, 17 nt, Salmonella enterica enterica serovar Typhi Ty2
aggcuacccagacaagc

SEQ ID NO: 3713378 - RNA, 15 nt, Salmonella enterica enterica serovar Typhi Ty2
aggcuaccguucaga

SEQ ID NO: 3713379 - RNA, 16 nt, Salmonella enterica enterica serovar Typhi Ty2
aggcucaucagcgcca

SEQ ID NO: 3713380 - RNA, 22 nt, Salmonella enterica enterica serovar Typhi Ty2
aggcucaucagcgccauugcua

SEQ ID NO: 3713381 - RNA, 21 nt, Salmonella enterica enterica serovar Typhi Ty2
aggcuccaaguauugauaccu

SEQ ID NO: 3713382 - RNA, 22 nt, Salmonella enterica enterica serovar Typhi Ty2
aggcuccaaguauugauaccuu

SEQ ID NO: 3713383 - RNA, 21 nt, Salmonella enterica enterica serovar Typhi Ty2
aggcucccuuauacaggcgca

SEQ ID NO: 3713384 - RNA, 20 nt, Salmonella enterica enterica serovar Typhi Ty2
aggcuccgagacucaaagaa

SEQ ID NO: 3713385 - RNA, 21 nt, Salmonella enterica enterica serovar Typhi Ty2
aggcuccggcaccaaaccaua

SEQ ID NO: 3713386 - RNA, 21 nt, Salmonella enterica enterica serovar Typhi Ty2
aggcucgcauucgcgagccuu

SEQ ID NO: 3713387 - RNA, 19 nt, Salmonella enterica enterica serovar Typhi Ty2
aggcucuccgguugcugau

SEQ ID NO: 3713388 - RNA, 20 nt, Salmonella enterica enterica serovar Typhi Ty2
aggcucuuauucaaucaauu

SEQ ID NO: 3713389 - RNA, 22 nt, Salmonella enterica enterica serovar Typhi Ty2
aggcugacaaagguugcgccaa

SEQ ID NO: 3713390 - RNA, 18 nt, Salmonella enterica enterica serovar Typhi Ty2
aggcugagcguagaccgc

SEQ ID NO: 3713391 - RNA, 23 nt, Salmonella enterica enterica serovar Typhi Ty2
aggcugccgacaacgccuccugc

SEQ ID NO: 3713392 - RNA, 21 nt, Salmonella enterica enterica serovar Typhi Ty2
aggcugcggcacgcuaaacca

SEQ ID NO: 3713393 - RNA, 17 nt, Salmonella enterica enterica serovar Typhi Ty2
aggcuggagagcaacgc

SEQ ID NO: 3713394 - RNA, 20 nt, Salmonella enterica enterica serovar Typhi Ty2
aggcuggcgguaacaggcac

SEQ ID NO: 3713395 - RNA, 14 nt, Salmonella enterica enterica serovar Typhi Ty2
aggcugucugccau

SEQ ID NO: 3713396 - RNA, 17 nt, Salmonella enterica enterica serovar Typhi Ty2
aggcuguggcugucguu

SEQ ID NO: 3713397 - RNA, 23 nt, Salmonella enterica enterica serovar Typhi Ty2
aggcuguugaggaaauucugacg

SEQ ID NO: 3713398 - RNA, 14 nt, Salmonella enterica enterica serovar Typhi Ty2
aggcuuccacgcac

SEQ ID NO: 3713399 - RNA, 13 nt, Salmonella enterica enterica serovar Typhi Ty2
aggcuuccagaag

SEQ ID NO: 3713400 - RNA, 14 nt, Salmonella enterica enterica serovar Typhi Ty2
aggcuuccagauac

SEQ ID NO: 3713401 - RNA, 14 nt, Salmonella enterica enterica serovar Typhi Ty2
aggcuuccggcagc

SEQ ID NO: 3713402 - RNA, 23 nt, Salmonella enterica enterica serovar Typhi Ty2
aggcuucgacaaacagcuaucca

SEQ ID NO: 3713403 - RNA, 22 nt, Salmonella enterica enterica serovar Typhi Ty2
aggcuucgcgcagccagcgccc

SEQ ID NO: 3713404 - RNA, 17 nt, Salmonella enterica enterica serovar Typhi Ty2
aggcuuuaugcugacaa

SEQ ID NO: 3713405 - RNA, 14 nt, Salmonella enterica enterica serovar Typhi Ty2
aggcuuugcugcug

SEQ ID NO: 3713406 - RNA, 14 nt, Salmonella enterica enterica serovar Typhi Ty2
aggcuuuugauuca

SEQ ID NO: 3713407 - RNA, 16 nt, Salmonella enterica enterica serovar Typhi Ty2
agggaaaacaucgcuc

SEQ ID NO: 3713408 - RNA, 13 nt, Salmonella enterica enterica serovar Typhi Ty2
agggaaaagaagu

SEQ ID NO: 3713409 - RNA, 23 nt, Salmonella enterica enterica serovar Typhi Ty2
agggaaaccauguugaucguaaa

SEQ ID NO: 3713410 - RNA, 18 nt, Salmonella enterica enterica serovar Typhi Ty2
agggaagacuauuaccac

SEQ ID NO: 3713411 - RNA, 13 nt, Salmonella enterica enterica serovar Typhi Ty2
agggaauaugauu

SEQ ID NO: 3713412 - RNA, 20 nt, Salmonella enterica enterica serovar Typhi Ty2
agggacacauuucuuuugau

SEQ ID NO: 3713413 - RNA, 16 nt, Salmonella enterica enterica serovar Typhi Ty2
agggagaacucaucuc

SEQ ID NO: 3713414 - RNA, 17 nt, Salmonella enterica enterica serovar Typhi Ty2
agggagcugacugcaaa

SEQ ID NO: 3713415 - RNA, 12 nt, Salmonella enterica enterica serovar Typhi Ty2
agggagggccaa

SEQ ID NO: 3713416 - RNA, 21 nt, Salmonella enterica enterica serovar Typhi Ty2
agggaggugcucucccagcug

SEQ ID NO: 3713417 - RNA, 20 nt, Salmonella enterica enterica serovar Typhi Ty2
agggauaagaaagauaaaau

SEQ ID NO: 3713418 - RNA, 21 nt, Salmonella enterica enterica serovar Typhi Ty2
agggauaagaaagauaaaaua

SEQ ID NO: 3713419 - RNA, 18 nt, Salmonella enterica enterica serovar Typhi Ty2
agggauaagguugucaaa

SEQ ID NO: 3713420 - RNA, 22 nt, Salmonella enterica enterica serovar Typhi Ty2
agggauaagguugucaaaaaau

SEQ ID NO: 3713421 - RNA, 22 nt, Salmonella enterica enterica serovar Typhi Ty2
agggaucgauaauugcucaccc

SEQ ID NO: 3713422 - RNA, 16 nt, Salmonella enterica enterica serovar Typhi Ty2
agggaugacagaaagc

SEQ ID NO: 3713423 - RNA, 21 nt, Salmonella enterica enterica serovar Typhi Ty2
agggauuaucagaaggcuuga

SEQ ID NO: 3713424 - RNA, 13 nt, Salmonella enterica enterica serovar Typhi Ty2
agggauuuugcuu

SEQ ID NO: 3713425 - RNA, 21 nt, Salmonella enterica enterica serovar Typhi Ty2
agggauuuugcuuuuucggca

SEQ ID NO: 3713426 - RNA, 20 nt, Salmonella enterica enterica serovar Typhi Ty2
agggcaaaguuaucccugcu

SEQ ID NO: 3713427 - RNA, 21 nt, Salmonella enterica enterica serovar Typhi Ty2
agggcaagaauuaaauaacgg

SEQ ID NO: 3713428 - RNA, 20 nt, Salmonella enterica enterica serovar Typhi Ty2
agggcaccugggcaauaacg

SEQ ID NO: 3713429 - RNA, 13 nt, Salmonella enterica enterica serovar Typhi Ty2
agggcaggcagug

SEQ ID NO: 3713430 - RNA, 13 nt, Salmonella enterica enterica serovar Typhi Ty2
agggcaggggaaa

SEQ ID NO: 3713431 - RNA, 22 nt, Salmonella enterica enterica serovar Typhi Ty2
agggcauaaugauugcuggcag

SEQ ID NO: 3713432 - RNA, 17 nt, Salmonella enterica enterica serovar Typhi Ty2
agggccgauaccggcaa

SEQ ID NO: 3713433 - RNA, 21 nt, Salmonella enterica enterica serovar Typhi Ty2
agggccgcaaacgguucgcgg

SEQ ID NO: 3713434 - RNA, 15 nt, Salmonella enterica enterica serovar Typhi Ty2
agggcgaacuggcgg

SEQ ID NO: 3713435 - RNA, 16 nt, Salmonella enterica enterica serovar Typhi Ty2
agggcgagcguagcga

SEQ ID NO: 3713436 - RNA, 19 nt, Salmonella enterica enterica serovar Typhi Ty2
agggcgaggcccaugaaug

SEQ ID NO: 3713437 - RNA, 21 nt, Salmonella enterica enterica serovar Typhi Ty2
agggcgauaauccgcuccaca

SEQ ID NO: 3713438 - RNA, 18 nt, Salmonella enterica enterica serovar Typhi Ty2
agggcgaugccucacccc

SEQ ID NO: 3713439 - RNA, 19 nt, Salmonella enterica enterica serovar Typhi Ty2
agggcgcggcgcaacuuuu

SEQ ID NO: 3713440 - RNA, 14 nt, Salmonella enterica enterica serovar Typhi Ty2
agggcgcggcuggu

SEQ ID NO: 3713441 - RNA, 21 nt, Salmonella enterica enterica serovar Typhi Ty2
agggcggcgcgcugccgcccu

SEQ ID NO: 3713442 - RNA, 17 nt, Salmonella enterica enterica serovar Typhi Ty2
agggcgggcgauagaga

SEQ ID NO: 3713443 - RNA, 22 nt, Salmonella enterica enterica serovar Typhi Ty2
agggcgucuuauccggccuacc

SEQ ID NO: 3713444 - RNA, 16 nt, Salmonella enterica enterica serovar Typhi Ty2
agggcgugacgcgcca

SEQ ID NO: 3713445 - RNA, 16 nt, Salmonella enterica enterica serovar Typhi Ty2
agggcguuuuauaagc

SEQ ID NO: 3713446 - RNA, 17 nt, Salmonella enterica enterica serovar Typhi Ty2
agggcuggaaaaucacg

SEQ ID NO: 3713447 - RNA, 18 nt, Salmonella enterica enterica serovar Typhi Ty2
aggggccacaggcggcau

SEQ ID NO: 3713448 - RNA, 15 nt, Salmonella enterica enterica serovar Typhi Ty2
agggguuccggcaau

SEQ ID NO: 3713449 - RNA, 17 nt, Salmonella enterica enterica serovar Typhi Ty2
agggguugaugccgacc

SEQ ID NO: 3713450 - RNA, 13 nt, Salmonella enterica enterica serovar Typhi Ty2
aggguaauaacgg

SEQ ID NO: 3713451 - RNA, 16 nt, Salmonella enterica enterica serovar Typhi Ty2
aggguagggauagcau

SEQ ID NO: 3713452 - RNA, 21 nt, Salmonella enterica enterica serovar Typhi Ty2
aggguauaugagcgcaggcga

SEQ ID NO: 3713453 - RNA, 15 nt, Salmonella enterica enterica serovar Typhi Ty2
agggucaacaggcug

SEQ ID NO: 3713454 - RNA, 15 nt, Salmonella enterica enterica serovar Typhi Ty2
aguaaauagaaaaua

SEQ ID NO: 3713455 - RNA, 17 nt, Salmonella enterica enterica serovar Typhi Ty2
aguaaauuauuccuuga

SEQ ID NO: 3713456 - RNA, 22 nt, Salmonella enterica enterica serovar Typhi Ty2
aguaaauugacgcuugacucug

SEQ ID NO: 3713457 - RNA, 15 nt, Salmonella enterica enterica serovar Typhi Ty2
aguaaauuuacucag

SEQ ID NO: 3713458 - RNA, 16 nt, Salmonella enterica enterica serovar Typhi Ty2
aguaacaccgcggcgc

SEQ ID NO: 3713459 - RNA, 14 nt, Salmonella enterica enterica serovar Typhi Ty2
aguaacauaaugcc

SEQ ID NO: 3713460 - RNA, 15 nt, Salmonella enterica enterica serovar Typhi Ty2
aguaaccccagggag

SEQ ID NO: 3713461 - RNA, 22 nt, Salmonella enterica enterica serovar Typhi Ty2
aguaacgcguccaacuggcuuu

SEQ ID NO: 3713462 - RNA, 21 nt, Salmonella enterica enterica serovar Typhi Ty2
aguaacggcaguguuucccaa

SEQ ID NO: 3713463 - RNA, 22 nt, Salmonella enterica enterica serovar Typhi Ty2
aguaacgggcaucgccgcaacu

SEQ ID NO: 3713464 - RNA, 18 nt, Salmonella enterica enterica serovar Typhi Ty2
aguaacugcaaaucuucg

SEQ ID NO: 3713465 - RNA, 16 nt, Salmonella enterica enterica serovar Typhi Ty2
aguaagcuauuccugu

SEQ ID NO: 3713466 - RNA, 15 nt, Salmonella enterica enterica serovar Typhi Ty2
aguaauaaaauaaua

SEQ ID NO: 3713467 - RNA, 18 nt, Salmonella enterica enterica serovar Typhi Ty2
aguaauaaaauaauaggu

SEQ ID NO: 3713468 - RNA, 20 nt, Salmonella enterica enterica serovar Typhi Ty2
aguaauaacaaaaaacauau

SEQ ID NO: 3713469 - RNA, 14 nt, Salmonella enterica enterica serovar Typhi Ty2
aguaauaaucacau

SEQ ID NO: 3713470 - RNA, 12 nt, Salmonella enterica enterica serovar Typhi Ty2
aguaauauuaaa

SEQ ID NO: 3713471 - RNA, 17 nt, Salmonella enterica enterica serovar Typhi Ty2
aguaaugccuucugaaa

SEQ ID NO: 3713472 - RNA, 16 nt, Salmonella enterica enterica serovar Typhi Ty2
aguaauguccagauua

SEQ ID NO: 3713473 - RNA, 20 nt, Salmonella enterica enterica serovar Typhi Ty2
aguaauuugaacauauccgc

SEQ ID NO: 3713474 - RNA, 21 nt, Salmonella enterica enterica serovar Typhi Ty2
aguaauuuuucucccagcaga

SEQ ID NO: 3713475 - RNA, 21 nt, Salmonella enterica enterica serovar Typhi Ty2
aguacaaacaaauaaauccau

SEQ ID NO: 3713476 - RNA, 16 nt, Salmonella enterica enterica serovar Typhi Ty2
aguacagacuggaugg

SEQ ID NO: 3713477 - RNA, 23 nt, Salmonella enterica enterica serovar Typhi Ty2
aguacagcuuaaucaccagcgca

SEQ ID NO: 3713478 - RNA, 18 nt, Salmonella enterica enterica serovar Typhi Ty2
aguacagggcgauuuccg

SEQ ID NO: 3713479 - RNA, 19 nt, Salmonella enterica enterica serovar Typhi Ty2
aguacauaguucuggcuuu

SEQ ID NO: 3713480 - RNA, 12 nt, Salmonella enterica enterica serovar Typhi Ty2
aguaccagcacu

SEQ ID NO: 3713481 - RNA, 22 nt, Salmonella enterica enterica serovar Typhi Ty2
aguaccauugagcuuucuucca

SEQ ID NO: 3713482 - RNA, 13 nt, Salmonella enterica enterica serovar Typhi Ty2
aguacccucugca

SEQ ID NO: 3713483 - RNA, 15 nt, Salmonella enterica enterica serovar Typhi Ty2
aguaccgaacagcca

SEQ ID NO: 3713484 - RNA, 18 nt, Salmonella enterica enterica serovar Typhi Ty2
aguaccgaacagccaggc

SEQ ID NO: 3713485 - RNA, 20 nt, Salmonella enterica enterica serovar Typhi Ty2
aguaccgaacagccaggcuu

SEQ ID NO: 3713486 - RNA, 21 nt, Salmonella enterica enterica serovar Typhi Ty2
aguaccgggcaggaaaagacu

SEQ ID NO: 3713487 - RNA, 11 nt, Salmonella enterica enterica serovar Typhi Ty2
aguaccugaug

SEQ ID NO: 3713488 - RNA, 18 nt, Salmonella enterica enterica serovar Typhi Ty2
aguacgagcauccagauc

SEQ ID NO: 3713489 - RNA, 22 nt, Salmonella enterica enterica serovar Typhi Ty2
aguacgauagcaauuaauaaac

SEQ ID NO: 3713490 - RNA, 22 nt, Salmonella enterica enterica serovar Typhi Ty2
aguacgcaccagcccagguuac

SEQ ID NO: 3713491 - RNA, 11 nt, Salmonella enterica enterica serovar Typhi Ty2
aguacgcccgg

SEQ ID NO: 3713492 - RNA, 17 nt, Salmonella enterica enterica serovar Typhi Ty2
aguacgcgacugaucag

SEQ ID NO: 3713493 - RNA, 19 nt, Salmonella enterica enterica serovar Typhi Ty2
aguacggcgcgccaauaaa

SEQ ID NO: 3713494 - RNA, 15 nt, Salmonella enterica enterica serovar Typhi Ty2
aguacugaccagaca

SEQ ID NO: 3713495 - RNA, 16 nt, Salmonella enterica enterica serovar Typhi Ty2
aguacuggaauaucua

SEQ ID NO: 3713496 - RNA, 16 nt, Salmonella enterica enterica serovar Typhi Ty2
aguacuucacaaucag

SEQ ID NO: 3713497 - RNA, 16 nt, Salmonella enterica enterica serovar Typhi Ty2
aguacuuucuuuugau

SEQ ID NO: 3713498 - RNA, 16 nt, Salmonella enterica enterica serovar Typhi Ty2
aguagaccaacaauca

SEQ ID NO: 3713499 - RNA, 19 nt, Salmonella enterica enterica serovar Typhi Ty2
aguagacgguaacggcugg

SEQ ID NO: 3713500 - RNA, 14 nt, Salmonella enterica enterica serovar Typhi Ty2
aguagaucaccagc

SEQ ID NO: 3713501 - RNA, 11 nt, Salmonella enterica enterica serovar Typhi Ty2
aguagauggcg

SEQ ID NO: 3713502 - RNA, 15 nt, Salmonella enterica enterica serovar Typhi Ty2
aguagcagacagccg

SEQ ID NO: 3713503 - RNA, 14 nt, Salmonella enterica enterica serovar Typhi Ty2
aguagcagagaaaa

SEQ ID NO: 3713504 - RNA, 16 nt, Salmonella enterica enterica serovar Typhi Ty2
aguagccugccagcaa

SEQ ID NO: 3713505 - RNA, 15 nt, Salmonella enterica enterica serovar Typhi Ty2
aguagcguucuuucc

SEQ ID NO: 3713506 - RNA, 14 nt, Salmonella enterica enterica serovar Typhi Ty2
aguagcuaaugauu

SEQ ID NO: 3713507 - RNA, 17 nt, Salmonella enterica enterica serovar Typhi Ty2
aguagcuaaugauuauc

SEQ ID NO: 3713508 - RNA, 17 nt, Salmonella enterica enterica serovar Typhi Ty2
aguagcugagcgucagg

SEQ ID NO: 3713509 - RNA, 22 nt, Salmonella enterica enterica serovar Typhi Ty2
aguaguauccccggcaaccuua

SEQ ID NO: 3713510 - RNA, 13 nt, Salmonella enterica enterica serovar Typhi Ty2
aguaguuaaaaaa

SEQ ID NO: 3713511 - RNA, 18 nt, Salmonella enterica enterica serovar Typhi Ty2
aguaguugaauaaccuca

SEQ ID NO: 3713512 - RNA, 12 nt, Salmonella enterica enterica serovar Typhi Ty2
aguaguuggugg

SEQ ID NO: 3713513 - RNA, 16 nt, Salmonella enterica enterica serovar Typhi Ty2
aguaguugguggguga

SEQ ID NO: 3713514 - RNA, 21 nt, Salmonella enterica enterica serovar Typhi Ty2
aguaguuguuauagcgcgccc

SEQ ID NO: 3713515 - RNA, 21 nt, Salmonella enterica enterica serovar Typhi Ty2
aguauaaauaccuuauucagc

SEQ ID NO: 3713516 - RNA, 15 nt, Salmonella enterica enterica serovar Typhi Ty2
aguauaagcgccgcu

SEQ ID NO: 3713517 - RNA, 21 nt, Salmonella enterica enterica serovar Typhi Ty2
aguaucccuuucaaaaaagag

SEQ ID NO: 3713518 - RNA, 23 nt, Salmonella enterica enterica serovar Typhi Ty2
aguaucgcucuauauccugcccu

SEQ ID NO: 3713519 - RNA, 18 nt, Salmonella enterica enterica serovar Typhi Ty2
aguaugaccccuccggcc

SEQ ID NO: 3713520 - RNA, 15 nt, Salmonella enterica enterica serovar Typhi Ty2
aguaugaccguugau

SEQ ID NO: 3713521 - RNA, 23 nt, Salmonella enterica enterica serovar Typhi Ty2
aguaugccucgcgcaccauaaua

SEQ ID NO: 3713522 - RNA, 18 nt, Salmonella enterica enterica serovar Typhi Ty2
aguaugcuuauugucgcc

SEQ ID NO: 3713523 - RNA, 11 nt, Salmonella enterica enterica serovar Typhi Ty2
aguauggcgac

SEQ ID NO: 3713524 - RNA, 19 nt, Salmonella enterica enterica serovar Typhi Ty2
aguauggcgaccaggaauu

SEQ ID NO: 3713525 - RNA, 16 nt, Salmonella enterica enterica serovar Typhi Ty2
aguauguuaacgccga

SEQ ID NO: 3713526 - RNA, 16 nt, Salmonella enterica enterica serovar Typhi Ty2
aguauguuaggguaga

SEQ ID NO: 3713527 - RNA, 14 nt, Salmonella enterica enterica serovar Typhi Ty2
aguauuauccauug

SEQ ID NO: 3713528 - RNA, 14 nt, Salmonella enterica enterica serovar Typhi Ty2
aguauugcaccagg

SEQ ID NO: 3713529 - RNA, 14 nt, Salmonella enterica enterica serovar Typhi Ty2
aguauuggcaagaa

SEQ ID NO: 3713530 - RNA, 15 nt, Salmonella enterica enterica serovar Typhi Ty2
aguauuuacaaaaaa

SEQ ID NO: 3713531 - RNA, 19 nt, Salmonella enterica enterica serovar Typhi Ty2
aguauuuaccuacuguggu

SEQ ID NO: 3713532 - RNA, 11 nt, Salmonella enterica enterica serovar Typhi Ty2
aguauuucaga

SEQ ID NO: 3713533 - RNA, 20 nt, Salmonella enterica enterica serovar Typhi Ty2
aguauuucgacuuucuucgg

SEQ ID NO: 3713534 - RNA, 22 nt, Salmonella enterica enterica serovar Typhi Ty2
agucaaaagauugauuuauuca

SEQ ID NO: 3713535 - RNA, 22 nt, Salmonella enterica enterica serovar Typhi Ty2
agucaaaauaaaauuauauucu

SEQ ID NO: 3713536 - RNA, 21 nt, Salmonella enterica enterica serovar Typhi Ty2
agucguaauucagcucgcugc

SEQ ID NO: 3713537 - RNA, 16 nt, Salmonella enterica enterica serovar Typhi Ty2
agucguagaacaccac

SEQ ID NO: 3713538 - RNA, 19 nt, Salmonella enterica enterica serovar Typhi Ty2
agucguagaacaccacgcg

SEQ ID NO: 3713539 - RNA, 20 nt, Salmonella enterica enterica serovar Typhi Ty2
agucgucauggcguaaaucg

SEQ ID NO: 3713540 - RNA, 17 nt, Salmonella enterica enterica serovar Typhi Ty2
agucgugaugcauacgg

SEQ ID NO: 3713541 - RNA, 23 nt, Salmonella enterica enterica serovar Typhi Ty2
agucguggcggauucuacugguu

SEQ ID NO: 3713542 - RNA, 22 nt, Salmonella enterica enterica serovar Typhi Ty2
agucgugucauagucggcgcca

SEQ ID NO: 3713543 - RNA, 15 nt, Salmonella enterica enterica serovar Typhi Ty2
agucucaggagugaa

SEQ ID NO: 3713544 - RNA, 15 nt, Salmonella enterica enterica serovar Typhi Ty2
agucucccuccugcu

SEQ ID NO: 3713545 - RNA, 20 nt, Salmonella enterica enterica serovar Typhi Ty2
agucucccuccugcuccaug

SEQ ID NO: 3713546 - RNA, 20 nt, Salmonella enterica enterica serovar Typhi Ty2
agucuccgccaccugaauaa

SEQ ID NO: 3713547 - RNA, 20 nt, Salmonella enterica enterica serovar Typhi Ty2
agucuccugccaaugaaaua

SEQ ID NO: 3713548 - RNA, 19 nt, Salmonella enterica enterica serovar Typhi Ty2
agucucgaaacgaaucuca

SEQ ID NO: 3713549 - RNA, 13 nt, Salmonella enterica enterica serovar Typhi Ty2
agucugaaaauaa

SEQ ID NO: 3713550 - RNA, 15 nt, Salmonella enterica enterica serovar Typhi Ty2
agucuggauauaaac

SEQ ID NO: 3713551 - RNA, 18 nt, Salmonella enterica enterica serovar Typhi Ty2
agucuggauauaaaccgg

SEQ ID NO: 3713552 - RNA, 19 nt, Salmonella enterica enterica serovar Typhi Ty2
agucuggauauaaaccgga

SEQ ID NO: 3713553 - RNA, 20 nt, Salmonella enterica enterica serovar Typhi Ty2
agucuggccaccgauaaaaa

SEQ ID NO: 3713554 - RNA, 18 nt, Salmonella enterica enterica serovar Typhi Ty2
agucuguucguagcccau

SEQ ID NO: 3713555 - RNA, 16 nt, Salmonella enterica enterica serovar Typhi Ty2
agucuucauggucgga

SEQ ID NO: 3713556 - RNA, 11 nt, Salmonella enterica enterica serovar Typhi Ty2
agucuuccugc

SEQ ID NO: 3713557 - RNA, 16 nt, Salmonella enterica enterica serovar Typhi Ty2
agucuuuuguuuuucu

SEQ ID NO: 3713558 - RNA, 19 nt, Salmonella enterica enterica serovar Typhi Ty2
agucuuuuguuuuucucuu

SEQ ID NO: 3713559 - RNA, 14 nt, Salmonella enterica enterica serovar Typhi Ty2
agugaaaagcugga

SEQ ID NO: 3713560 - RNA, 15 nt, Salmonella enterica enterica serovar Typhi Ty2
agugaaagaccugcc

SEQ ID NO: 3713561 - RNA, 22 nt, Salmonella enterica enterica serovar Typhi Ty2
agugaaaguugguguuucucaa

SEQ ID NO: 3713562 - RNA, 17 nt, Salmonella enterica enterica serovar Typhi Ty2
agugaaaguuuucgcca

SEQ ID NO: 3713563 - RNA, 12 nt, Salmonella enterica enterica serovar Typhi Ty2
agugaaauaaau

SEQ ID NO: 3713564 - RNA, 20 nt, Salmonella enterica enterica serovar Typhi Ty2
agugaaauuugucgauaaaa

SEQ ID NO: 3713565 - RNA, 18 nt, Salmonella enterica enterica serovar Typhi Ty2
agugaacgguugagcuuu

SEQ ID NO: 3713566 - RNA, 19 nt, Salmonella enterica enterica serovar Typhi Ty2
agugaaggccaaguuuaga

SEQ ID NO: 3713567 - RNA, 22 nt, Salmonella enterica enterica serovar Typhi Ty2
agugaaggccaaguuuagaaaa

SEQ ID NO: 3713568 - RNA, 14 nt, Salmonella enterica enterica serovar Typhi Ty2
agugaauaacaacc

SEQ ID NO: 3713569 - RNA, 23 nt, Salmonella enterica enterica serovar Typhi Ty2
agugaaucgacggcaauauuaaa

SEQ ID NO: 3713570 - RNA, 19 nt, Salmonella enterica enterica serovar Typhi Ty2
agugaauuaugaccaaugu

SEQ ID NO: 3713571 - RNA, 16 nt, Salmonella enterica enterica serovar Typhi Ty2
agugacagaggaauga

SEQ ID NO: 3713572 - RNA, 22 nt, Salmonella enterica enterica serovar Typhi Ty2
agugacagaggaaugaaaacga

SEQ ID NO: 3713573 - RNA, 22 nt, Salmonella enterica enterica serovar Typhi Ty2
agugacauuauucaccuggauu

SEQ ID NO: 3713574 - RNA, 20 nt, Salmonella enterica enterica serovar Typhi Ty2
agugacccgccgccagcacc

SEQ ID NO: 3713575 - RNA, 20 nt, Salmonella enterica enterica serovar Typhi Ty2
agugacgguuuucacuggca

SEQ ID NO: 3713576 - RNA, 18 nt, Salmonella enterica enterica serovar Typhi Ty2
agugacguggcuucgccg

SEQ ID NO: 3713577 - RNA, 19 nt, Salmonella enterica enterica serovar Typhi Ty2
agugacguuaucugucagc

SEQ ID NO: 3713578 - RNA, 23 nt, Salmonella enterica enterica serovar Typhi Ty2
agugacguuaucugucagccgca

SEQ ID NO: 3713579 - RNA, 22 nt, Salmonella enterica enterica serovar Typhi Ty2
agugacuucugcucgguaaaaa

SEQ ID NO: 3713580 - RNA, 20 nt, Salmonella enterica enterica serovar Typhi Ty2
agugaguaacguuaauacau

SEQ ID NO: 3713581 - RNA, 17 nt, Salmonella enterica enterica serovar Typhi Ty2
agugaguacgcaggagg

SEQ ID NO: 3713582 - RNA, 15 nt, Salmonella enterica enterica serovar Typhi Ty2
agugaguuaagacgc

SEQ ID NO: 3713583 - RNA, 18 nt, Salmonella enterica enterica serovar Typhi Ty2
agugauaaagcacagccc

SEQ ID NO: 3713584 - RNA, 20 nt, Salmonella enterica enterica serovar Typhi Ty2
agugauaaagcacagcccca

SEQ ID NO: 3713585 - RNA, 22 nt, Salmonella enterica enterica serovar Typhi Ty2
agugauagcgccauggagaaac

SEQ ID NO: 3713586 - RNA, 21 nt, Salmonella enterica enterica serovar Typhi Ty2
agugaucccgacauaggccag

SEQ ID NO: 3713587 - RNA, 19 nt, Salmonella enterica enterica serovar Typhi Ty2
agugauuuacuccaaaaau

SEQ ID NO: 3713588 - RNA, 15 nt, Salmonella enterica enterica serovar Typhi Ty2
agugcaaaggccucu

SEQ ID NO: 3713589 - RNA, 21 nt, Salmonella enterica enterica serovar Typhi Ty2
agugcagcggaugcucuuuac

SEQ ID NO: 3713590 - RNA, 18 nt, Salmonella enterica enterica serovar Typhi Ty2
agugcauguacaacuuca

SEQ ID NO: 3713591 - RNA, 22 nt, Salmonella enterica enterica serovar Typhi Ty2
agugcauguacaacuucaugag

SEQ ID NO: 3713592 - RNA, 20 nt, Salmonella enterica enterica serovar Typhi Ty2
agugccaagcaacacggcga

SEQ ID NO: 3713593 - RNA, 21 nt, Salmonella enterica enterica serovar Typhi Ty2
agugcccguuugcgagacggc

SEQ ID NO: 3713594 - RNA, 15 nt, Salmonella enterica enterica serovar Typhi Ty2
agugccgccaggcaa

SEQ ID NO: 3713595 - RNA, 20 nt, Salmonella enterica enterica serovar Typhi Ty2
agugccugcuggagccggaa

SEQ ID NO: 3713596 - RNA, 19 nt, Salmonella enterica enterica serovar Typhi Ty2
agugcgaugggcuucagau

SEQ ID NO: 3713597 - RNA, 14 nt, Salmonella enterica enterica serovar Typhi Ty2
agugcgauuugaca

SEQ ID NO: 3713598 - RNA, 21 nt, Salmonella enterica enterica serovar Typhi Ty2
agugcgcauacuaccgcugcg

SEQ ID NO: 3713599 - RNA, 12 nt, Salmonella enterica enterica serovar Typhi Ty2
agugcgcggcga

SEQ ID NO: 3713600 - RNA, 20 nt, Salmonella enterica enterica serovar Typhi Ty2
agugcgcggcgaaaaagccg

SEQ ID NO: 3713601 - RNA, 14 nt, Salmonella enterica enterica serovar Typhi Ty2
agugcguuaacccg

SEQ ID NO: 3713602 - RNA, 14 nt, Salmonella enterica enterica serovar Typhi Ty2
agugcugaacaaua

SEQ ID NO: 3713603 - RNA, 17 nt, Salmonella enterica enterica serovar Typhi Ty2
agugcugcgcaaauacg

SEQ ID NO: 3713604 - RNA, 16 nt, Salmonella enterica enterica serovar Typhi Ty2
agugcuucugcaaaau

SEQ ID NO: 3713605 - RNA, 14 nt, Salmonella enterica enterica serovar Typhi Ty2
aguggaaucagcca

SEQ ID NO: 3713606 - RNA, 14 nt, Salmonella enterica enterica serovar Typhi Ty2
aguggacgcgucgc

SEQ ID NO: 3713607 - RNA, 15 nt, Salmonella enterica enterica serovar Typhi Ty2
aguggacgcgucgcu

SEQ ID NO: 3713608 - RNA, 20 nt, Salmonella enterica enterica serovar Typhi Ty2
aguggccaucuuccagcauc

SEQ ID NO: 3713609 - RNA, 21 nt, Salmonella enterica enterica serovar Typhi Ty2
aguggcgaaacuccuccggga

SEQ ID NO: 3713610 - RNA, 20 nt, Salmonella enterica enterica serovar Typhi Ty2
aguggcgcaauaacugacuc

SEQ ID NO: 3713611 - RNA, 21 nt, Salmonella enterica enterica serovar Typhi Ty2
aguggcgccgcaaugccgccu

SEQ ID NO: 3713612 - RNA, 15 nt, Salmonella enterica enterica serovar Typhi Ty2
aguggcuaauuucaa

SEQ ID NO: 3713613 - RNA, 20 nt, Salmonella enterica enterica serovar Typhi Ty2
aguggcuaauuucaauuuug

SEQ ID NO: 3713614 - RNA, 15 nt, Salmonella enterica enterica serovar Typhi Ty2
agugggcuaugaaga

SEQ ID NO: 3713615 - RNA, 16 nt, Salmonella enterica enterica serovar Typhi Ty2
agugggucacaucgcc

SEQ ID NO: 3713616 - RNA, 17 nt, Salmonella enterica enterica serovar Typhi Ty2
aguggugggugaugacg

SEQ ID NO: 3713617 - RNA, 20 nt, Salmonella enterica enterica serovar Typhi Ty2
aguuuagcgagcguucugca

SEQ ID NO: 3713618 - RNA, 17 nt, Salmonella enterica enterica serovar Typhi Ty2
aguuuauucaucuccuc

SEQ ID NO: 3713619 - RNA, 15 nt, Salmonella enterica enterica serovar Typhi Ty2
aguuuauugagauaa

SEQ ID NO: 3713620 - RNA, 16 nt, Salmonella enterica enterica serovar Typhi Ty2
aguuuauugagauaau

SEQ ID NO: 3713621 - RNA, 14 nt, Salmonella enterica enterica serovar Typhi Ty2
aguuucaccuucug

SEQ ID NO: 3713622 - RNA, 14 nt, Salmonella enterica enterica serovar Typhi Ty2
aguuucaguaucau

SEQ ID NO: 3713623 - RNA, 14 nt, Salmonella enterica enterica serovar Typhi Ty2
aguuucaugccaua

SEQ ID NO: 3713624 - RNA, 16 nt, Salmonella enterica enterica serovar Typhi Ty2
aguuucaugccauacu

SEQ ID NO: 3713625 - RNA, 14 nt, Salmonella enterica enterica serovar Typhi Ty2
aguuuccgguaaau

SEQ ID NO: 3713626 - RNA, 16 nt, Salmonella enterica enterica serovar Typhi Ty2
aguuucgacuuucauu

SEQ ID NO: 3713627 - RNA, 19 nt, Salmonella enterica enterica serovar Typhi Ty2
aguuucucccgccagaugc

SEQ ID NO: 3713628 - RNA, 16 nt, Salmonella enterica enterica serovar Typhi Ty2
aguuucucuucguuau

SEQ ID NO: 3713629 - RNA, 19 nt, Salmonella enterica enterica serovar Typhi Ty2
aguuucugcucgaccguca

SEQ ID NO: 3713630 - RNA, 14 nt, Salmonella enterica enterica serovar Typhi Ty2
aguuucuuaccuac

SEQ ID NO: 3713631 - RNA, 18 nt, Salmonella enterica enterica serovar Typhi Ty2
aguuugaugcaaauguca

SEQ ID NO: 3713632 - RNA, 22 nt, Salmonella enterica enterica serovar Typhi Ty2
aguuugaugcaaaugucagauc

SEQ ID NO: 3713633 - RNA, 19 nt, Salmonella enterica enterica serovar Typhi Ty2
aguuugcgauaagcgcguu

SEQ ID NO: 3713634 - RNA, 22 nt, Salmonella enterica enterica serovar Typhi Ty2
aguuugucaacgugugccagga

SEQ ID NO: 3713635 - RNA, 13 nt, Salmonella enterica enterica serovar Typhi Ty2
aguuugucaucca

SEQ ID NO: 3713636 - RNA, 22 nt, Salmonella enterica enterica serovar Typhi Ty2
aguuugucuucgaugcgcucau

SEQ ID NO: 3713637 - RNA, 20 nt, Salmonella enterica enterica serovar Typhi Ty2
aguuuuaccguaaaaugcug

SEQ ID NO: 3713638 - RNA, 15 nt, Salmonella enterica enterica serovar Typhi Ty2
aguuuuccgccugaa

SEQ ID NO: 3713639 - RNA, 19 nt, Salmonella enterica enterica serovar Typhi Ty2
aguuuugcuucaugcacaa

SEQ ID NO: 3713640 - RNA, 20 nt, Salmonella enterica enterica serovar Typhi Ty2
aguuuugcuucaugcacaaa

SEQ ID NO: 3713641 - RNA, 12 nt, Salmonella enterica enterica serovar Typhi Ty2
aguuuuuaaaca

SEQ ID NO: 3713642 - RNA, 14 nt, Salmonella enterica enterica serovar Typhi Ty2
aguuuuucaaucuu

SEQ ID NO: 3713643 - RNA, 22 nt, Salmonella enterica enterica serovar Typhi Ty2
aguuuuucuacuaacuggcaau

SEQ ID NO: 3713644 - RNA, 19 nt, Salmonella enterica enterica serovar Typhi Ty2
aguuuuugcgccagcgcaa

SEQ ID NO: 3713645 - RNA, 20 nt, Salmonella enterica enterica serovar Typhi Ty2
aguuuuuuuaagaaggucag

SEQ ID NO: 3713646 - RNA, 14 nt, Salmonella enterica enterica serovar Typhi Ty2
aguuuuuuucugcc

SEQ ID NO: 3713647 - RNA, 14 nt, Salmonella enterica enterica serovar Typhi Ty2
auaaaaaacaucau

SEQ ID NO: 3713648 - RNA, 18 nt, Salmonella enterica enterica serovar Typhi Ty2
auaaaaaagccguauuuu

SEQ ID NO: 3713649 - RNA, 17 nt, Salmonella enterica enterica serovar Typhi Ty2
auaaaaaagcugcgauc

SEQ ID NO: 3713650 - RNA, 15 nt, Salmonella enterica enterica serovar Typhi Ty2
auaaaaaaggccgcu

SEQ ID NO: 3713651 - RNA, 22 nt, Salmonella enterica enterica serovar Typhi Ty2
auaaaaacugcuaaaagaagcu

SEQ ID NO: 3713652 - RNA, 22 nt, Salmonella enterica enterica serovar Typhi Ty2
auaaaaagccaucccgcugauc

SEQ ID NO: 3713653 - RNA, 17 nt, Salmonella enterica enterica serovar Typhi Ty2
auaaaaauagcuggcug

SEQ ID NO: 3713654 - RNA, 18 nt, Salmonella enterica enterica serovar Typhi Ty2
auaaaaauagcuggcugu

SEQ ID NO: 3713655 - RNA, 14 nt, Salmonella enterica enterica serovar Typhi Ty2
auaaaaaucgggua

SEQ ID NO: 3713656 - RNA, 12 nt, Salmonella enterica enterica serovar Typhi Ty2
auaaaaauuccc

SEQ ID NO: 3713657 - RNA, 20 nt, Salmonella enterica enterica serovar Typhi Ty2
auaaaacauuccugacauuu

SEQ ID NO: 3713658 - RNA, 14 nt, Salmonella enterica enterica serovar Typhi Ty2
auaaaaccauucaa

SEQ ID NO: 3713659 - RNA, 18 nt, Salmonella enterica enterica serovar Typhi Ty2
auaaaacgcccccugcca

SEQ ID NO: 3713660 - RNA, 16 nt, Salmonella enterica enterica serovar Typhi Ty2
auaaaacgcucucuuu

SEQ ID NO: 3713661 - RNA, 18 nt, Salmonella enterica enterica serovar Typhi Ty2
auaaaacugccgucaauu

SEQ ID NO: 3713662 - RNA, 21 nt, Salmonella enterica enterica serovar Typhi Ty2
auaaaagccgccguguuuuuu

SEQ ID NO: 3713663 - RNA, 23 nt, Salmonella enterica enterica serovar Typhi Ty2
auaaaagcucuggaaaaauuguu

SEQ ID NO: 3713664 - RNA, 22 nt, Salmonella enterica enterica serovar Typhi Ty2
auaaaaguugcucggcaauuuc

SEQ ID NO: 3713665 - RNA, 13 nt, Salmonella enterica enterica serovar Typhi Ty2
auaaaauaaacac

SEQ ID NO: 3713666 - RNA, 14 nt, Salmonella enterica enterica serovar Typhi Ty2
auaaaauaaacacu

SEQ ID NO: 3713667 - RNA, 12 nt, Salmonella enterica enterica serovar Typhi Ty2
auaaaauaacua

SEQ ID NO: 3713668 - RNA, 13 nt, Salmonella enterica enterica serovar Typhi Ty2
auaaaauggaugc

SEQ ID NO: 3713669 - RNA, 21 nt, Salmonella enterica enterica serovar Typhi Ty2
auaaacaaaaaccugcucucg

SEQ ID NO: 3713670 - RNA, 14 nt, Salmonella enterica enterica serovar Typhi Ty2
auaaacacagcaaa

SEQ ID NO: 3713671 - RNA, 15 nt, Salmonella enterica enterica serovar Typhi Ty2
auaaacacagcaaac

SEQ ID NO: 3713672 - RNA, 18 nt, Salmonella enterica enterica serovar Typhi Ty2
auaaacacgauggcaaau

SEQ ID NO: 3713673 - RNA, 17 nt, Salmonella enterica enterica serovar Typhi Ty2
auaaacagcguuuucau

SEQ ID NO: 3713674 - RNA, 16 nt, Salmonella enterica enterica serovar Typhi Ty2
auaaacagguaaaaca

SEQ ID NO: 3713675 - RNA, 14 nt, Salmonella enterica enterica serovar Typhi Ty2
auaaaccaacagcc

SEQ ID NO: 3713676 - RNA, 21 nt, Salmonella enterica enterica serovar Typhi Ty2
auaaaccgccgcuuugauuug

SEQ ID NO: 3713677 - RNA, 22 nt, Salmonella enterica enterica serovar Typhi Ty2
auaaaccggcggccuaccaguu

SEQ ID NO: 3713678 - RNA, 16 nt, Salmonella enterica enterica serovar Typhi Ty2
auaaaccuaucaggcg

SEQ ID NO: 3713679 - RNA, 17 nt, Salmonella enterica enterica serovar Typhi Ty2
auaaaccuucguaauag

SEQ ID NO: 3713680 - RNA, 16 nt, Salmonella enterica enterica serovar Typhi Ty2
auaaacgccucauccg

SEQ ID NO: 3713681 - RNA, 15 nt, Salmonella enterica enterica serovar Typhi Ty2
auaaacgccugacga

SEQ ID NO: 3713682 - RNA, 19 nt, Salmonella enterica enterica serovar Typhi Ty2
auaaacgcgccaaguaaau

SEQ ID NO: 3713683 - RNA, 16 nt, Salmonella enterica enterica serovar Typhi Ty2
auaaacgcugcgcaac

SEQ ID NO: 3713684 - RNA, 19 nt, Salmonella enterica enterica serovar Typhi Ty2
auaaacuucaauucagaaa

SEQ ID NO: 3713685 - RNA, 21 nt, Salmonella enterica enterica serovar Typhi Ty2
auaaacuucaauucagaaagu

SEQ ID NO: 3713686 - RNA, 19 nt, Salmonella enterica enterica serovar Typhi Ty2
auaaagaacggccucccaa

SEQ ID NO: 3713687 - RNA, 20 nt, Salmonella enterica enterica serovar Typhi Ty2
auaaagaccggcacaaccgu

SEQ ID NO: 3713688 - RNA, 22 nt, Salmonella enterica enterica serovar Typhi Ty2
auaaagauauugucgcccugca

SEQ ID NO: 3713689 - RNA, 12 nt, Salmonella enterica enterica serovar Typhi Ty2
auaaagauggca

SEQ ID NO: 3713690 - RNA, 21 nt, Salmonella enterica enterica serovar Typhi Ty2
auaaagauuggcaucugcaau

SEQ ID NO: 3713691 - RNA, 22 nt, Salmonella enterica enterica serovar Typhi Ty2
auaaagauuggcaucugcaauu

SEQ ID NO: 3713692 - RNA, 17 nt, Salmonella enterica enterica serovar Typhi Ty2
auaaagcacagccccag

SEQ ID NO: 3713693 - RNA, 14 nt, Salmonella enterica enterica serovar Typhi Ty2
auaaagcauaaaua

SEQ ID NO: 3713694 - RNA, 16 nt, Salmonella enterica enterica serovar Typhi Ty2
auaaagcauaaauaca

SEQ ID NO: 3713695 - RNA, 16 nt, Salmonella enterica enterica serovar Typhi Ty2
auaaagcgaauaacau

SEQ ID NO: 3713696 - RNA, 17 nt, Salmonella enterica enterica serovar Typhi Ty2
auaaagcgaauaauuaa

SEQ ID NO: 3713697 - RNA, 15 nt, Salmonella enterica enterica serovar Typhi Ty2
auaaagcuuucaucu

SEQ ID NO: 3713698 - RNA, 14 nt, Salmonella enterica enterica serovar Typhi Ty2
auaaaggggugcuu

SEQ ID NO: 3713699 - RNA, 12 nt, Salmonella enterica enterica serovar Typhi Ty2
auaagcuuuaac

SEQ ID NO: 3713700 - RNA, 20 nt, Salmonella enterica enterica serovar Typhi Ty2
auaaggccugccguccugau

SEQ ID NO: 3713701 - RNA, 23 nt, Salmonella enterica enterica serovar Typhi Ty2
auaaggcggacaacgcauauuau

SEQ ID NO: 3713702 - RNA, 13 nt, Salmonella enterica enterica serovar Typhi Ty2
auaaggcguucac

SEQ ID NO: 3713703 - RNA, 14 nt, Salmonella enterica enterica serovar Typhi Ty2
auaagggcucagca

SEQ ID NO: 3713704 - RNA, 15 nt, Salmonella enterica enterica serovar Typhi Ty2
auaagggcucagcau

SEQ ID NO: 3713705 - RNA, 18 nt, Salmonella enterica enterica serovar Typhi Ty2
auaaggguaagcaauaug

SEQ ID NO: 3713706 - RNA, 22 nt, Salmonella enterica enterica serovar Typhi Ty2
auaagguaacgcgaaaaaagau

SEQ ID NO: 3713707 - RNA, 16 nt, Salmonella enterica enterica serovar Typhi Ty2
auaagguucuggcauu

SEQ ID NO: 3713708 - RNA, 13 nt, Salmonella enterica enterica serovar Typhi Ty2
auaagucauauca

SEQ ID NO: 3713709 - RNA, 18 nt, Salmonella enterica enterica serovar Typhi Ty2
auaagugcauguaaauaa

SEQ ID NO: 3713710 - RNA, 23 nt, Salmonella enterica enterica serovar Typhi Ty2
auaauaaaugccgucgcuuucau

SEQ ID NO: 3713711 - RNA, 16 nt, Salmonella enterica enterica serovar Typhi Ty2
auaauaagaucaaagc

SEQ ID NO: 3713712 - RNA, 15 nt, Salmonella enterica enterica serovar Typhi Ty2
auaauaaugaucgcu

SEQ ID NO: 3713713 - RNA, 20 nt, Salmonella enterica enterica serovar Typhi Ty2
auaauaauuaccacgcagcc

SEQ ID NO: 3713714 - RNA, 21 nt, Salmonella enterica enterica serovar Typhi Ty2
auaauacaccgccauauauuu

SEQ ID NO: 3713715 - RNA, 20 nt, Salmonella enterica enterica serovar Typhi Ty2
auaauacacgguaaauucuu

SEQ ID NO: 3713716 - RNA, 12 nt, Salmonella enterica enterica serovar Typhi Ty2
auaauaccucaa

SEQ ID NO: 3713717 - RNA, 23 nt, Salmonella enterica enterica serovar Typhi Ty2
auaauacgaaauugagaauuauu

SEQ ID NO: 3713718 - RNA, 21 nt, Salmonella enterica enterica serovar Typhi Ty2
auaauacgcgcgauuacgcga

SEQ ID NO: 3713719 - RNA, 11 nt, Salmonella enterica enterica serovar Typhi Ty2
auaauacuuaa

SEQ ID NO: 3713720 - RNA, 16 nt, Salmonella enterica enterica serovar Typhi Ty2
auaauagcugaaaaga

SEQ ID NO: 3713721 - RNA, 17 nt, Salmonella enterica enterica serovar Typhi Ty2
auaauagcugaaaagau

SEQ ID NO: 3713722 - RNA, 21 nt, Salmonella enterica enterica serovar Typhi Ty2
auaauagcugaaaagauaaag

SEQ ID NO: 3713723 - RNA, 22 nt, Salmonella enterica enterica serovar Typhi Ty2
auaauaucgaauggggaaauaa

SEQ ID NO: 3713724 - RNA, 13 nt, Salmonella enterica enterica serovar Typhi Ty2
auaauaugcucaa

SEQ ID NO: 3713725 - RNA, 20 nt, Salmonella enterica enterica serovar Typhi Ty2
auaauauguuccacaaucaa

SEQ ID NO: 3713726 - RNA, 17 nt, Salmonella enterica enterica serovar Typhi Ty2
auaauauguuuauuugc

SEQ ID NO: 3713727 - RNA, 17 nt, Salmonella enterica enterica serovar Typhi Ty2
auaauauuauugacgcu

SEQ ID NO: 3713728 - RNA, 14 nt, Salmonella enterica enterica serovar Typhi Ty2
auaaucaaacccuu

SEQ ID NO: 3713729 - RNA, 20 nt, Salmonella enterica enterica serovar Typhi Ty2
auaaucaauggccuugccag

SEQ ID NO: 3713730 - RNA, 22 nt, Salmonella enterica enterica serovar Typhi Ty2
auaaucacaggggucaucggca

SEQ ID NO: 3713731 - RNA, 19 nt, Salmonella enterica enterica serovar Typhi Ty2
auaaucacauuaugcuggg

SEQ ID NO: 3713732 - RNA, 14 nt, Salmonella enterica enterica serovar Typhi Ty2
auaaucaccacgua

SEQ ID NO: 3713733 - RNA, 13 nt, Salmonella enterica enterica serovar Typhi Ty2
auaaucagcgcuc

SEQ ID NO: 3713734 - RNA, 23 nt, Salmonella enterica enterica serovar Typhi Ty2
auaaucauccgggcauaaaaaaa

SEQ ID NO: 3713735 - RNA, 15 nt, Salmonella enterica enterica serovar Typhi Ty2
auaauccagacaaau

SEQ ID NO: 3713736 - RNA, 19 nt, Salmonella enterica enterica serovar Typhi Ty2
auaaucccggcgccaauca

SEQ ID NO: 3713737 - RNA, 12 nt, Salmonella enterica enterica serovar Typhi Ty2
auaauccuuccc

SEQ ID NO: 3713738 - RNA, 15 nt, Salmonella enterica enterica serovar Typhi Ty2
auaauccuucccgcu

SEQ ID NO: 3713739 - RNA, 12 nt, Salmonella enterica enterica serovar Typhi Ty2
auaauccuuccu

SEQ ID NO: 3713740 - RNA, 18 nt, Salmonella enterica enterica serovar Typhi Ty2
auaaucgacaguggcuuu

SEQ ID NO: 3713741 - RNA, 17 nt, Salmonella enterica enterica serovar Typhi Ty2
auaaucgauuccuauuu

SEQ ID NO: 3713742 - RNA, 21 nt, Salmonella enterica enterica serovar Typhi Ty2
auaaucgccgacuaauuauuu

SEQ ID NO: 3713743 - RNA, 14 nt, Salmonella enterica enterica serovar Typhi Ty2
auaaucgccgccgg

SEQ ID NO: 3713744 - RNA, 16 nt, Salmonella enterica enterica serovar Typhi Ty2
auaaucgcgagaaaau

SEQ ID NO: 3713745 - RNA, 21 nt, Salmonella enterica enterica serovar Typhi Ty2
auaaucgcgauacugccgccc

SEQ ID NO: 3713746 - RNA, 16 nt, Salmonella enterica enterica serovar Typhi Ty2
auaaucggccaggaug

SEQ ID NO: 3713747 - RNA, 18 nt, Salmonella enterica enterica serovar Typhi Ty2
auaaucggcgucauuuuc

SEQ ID NO: 3713748 - RNA, 17 nt, Salmonella enterica enterica serovar Typhi Ty2
auaaucgguagcacuuu

SEQ ID NO: 3713749 - RNA, 20 nt, Salmonella enterica enterica serovar Typhi Ty2
auaaucgguagcacuuuaaa

SEQ ID NO: 3713750 - RNA, 23 nt, Salmonella enterica enterica serovar Typhi Ty2
auaaucuaccauugauaccaaua

SEQ ID NO: 3713751 - RNA, 20 nt, Salmonella enterica enterica serovar Typhi Ty2
auaaucugugauugaauuca

SEQ ID NO: 3713752 - RNA, 19 nt, Salmonella enterica enterica serovar Typhi Ty2
auaaugaagcauaaaaaga

SEQ ID NO: 3713753 - RNA, 16 nt, Salmonella enterica enterica serovar Typhi Ty2
auaaugcaaugccuaa

SEQ ID NO: 3713754 - RNA, 13 nt, Salmonella enterica enterica serovar Typhi Ty2
auaaugccgccgu

SEQ ID NO: 3713755 - RNA, 14 nt, Salmonella enterica enterica serovar Typhi Ty2
auaaugcgccacca

SEQ ID NO: 3713756 - RNA, 16 nt, Salmonella enterica enterica serovar Typhi Ty2
auaaugcgccaccacu

SEQ ID NO: 3713757 - RNA, 23 nt, Salmonella enterica enterica serovar Typhi Ty2
auaaugcgccccgcaacgccgau

SEQ ID NO: 3713758 - RNA, 15 nt, Salmonella enterica enterica serovar Typhi Ty2
auaaugcuuacggca

SEQ ID NO: 3713759 - RNA, 15 nt, Salmonella enterica enterica serovar Typhi Ty2
auaauggaacugccu

SEQ ID NO: 3713760 - RNA, 16 nt, Salmonella enterica enterica serovar Typhi Ty2
auaauggagaacccag

SEQ ID NO: 3713761 - RNA, 19 nt, Salmonella enterica enterica serovar Typhi Ty2
auaauggcgacggccacgc

SEQ ID NO: 3713762 - RNA, 19 nt, Salmonella enterica enterica serovar Typhi Ty2
auaauggcgccgauaacac

SEQ ID NO: 3713763 - RNA, 20 nt, Salmonella enterica enterica serovar Typhi Ty2
auaauggggauuaucaggau

SEQ ID NO: 3713764 - RNA, 19 nt, Salmonella enterica enterica serovar Typhi Ty2
auaaugguggaaugcccca

SEQ ID NO: 3713765 - RNA, 19 nt, Salmonella enterica enterica serovar Typhi Ty2
auaauguaaaaaaauaaaa

SEQ ID NO: 3713766 - RNA, 13 nt, Salmonella enterica enterica serovar Typhi Ty2
auaaugugcgcga

SEQ ID NO: 3713767 - RNA, 18 nt, Salmonella enterica enterica serovar Typhi Ty2
auaauguugguaaauuua

SEQ ID NO: 3713768 - RNA, 23 nt, Salmonella enterica enterica serovar Typhi Ty2
auaauuaacauuuaagaaacaau

SEQ ID NO: 3713769 - RNA, 16 nt, Salmonella enterica enterica serovar Typhi Ty2
auaauuaagaccauac

SEQ ID NO: 3713770 - RNA, 15 nt, Salmonella enterica enterica serovar Typhi Ty2
auaauuaauaauggu

SEQ ID NO: 3713771 - RNA, 22 nt, Salmonella enterica enterica serovar Typhi Ty2
auaauuaucguuuacguuauca

SEQ ID NO: 3713772 - RNA, 13 nt, Salmonella enterica enterica serovar Typhi Ty2
auaauucauaaca

SEQ ID NO: 3713773 - RNA, 12 nt, Salmonella enterica enterica serovar Typhi Ty2
auaauuccccca

SEQ ID NO: 3713774 - RNA, 22 nt, Salmonella enterica enterica serovar Typhi Ty2
auaauucgaguugcuuaaaagc

SEQ ID NO: 3713775 - RNA, 19 nt, Salmonella enterica enterica serovar Typhi Ty2
auaauucuguaacucauag

SEQ ID NO: 3713776 - RNA, 16 nt, Salmonella enterica enterica serovar Typhi Ty2
auaauugcucugccag

SEQ ID NO: 3713777 - RNA, 16 nt, Salmonella enterica enterica serovar Typhi Ty2
auaauuugcgccguca

SEQ ID NO: 3713778 - RNA, 19 nt, Salmonella enterica enterica serovar Typhi Ty2
auaauuugucgauaagcgu

SEQ ID NO: 3713779 - RNA, 13 nt, Salmonella enterica enterica serovar Typhi Ty2
auaauuuuagaaa

SEQ ID NO: 3713780 - RNA, 18 nt, Salmonella enterica enterica serovar Typhi Ty2
auaauuuuauuauauuua

SEQ ID NO: 3713781 - RNA, 18 nt, Salmonella enterica enterica serovar Typhi Ty2
auacgucuugcggucgcc

SEQ ID NO: 3713782 - RNA, 14 nt, Salmonella enterica enterica serovar Typhi Ty2
auacguuccagcag

SEQ ID NO: 3713783 - RNA, 13 nt, Salmonella enterica enterica serovar Typhi Ty2
auacguucgcggg

SEQ ID NO: 3713784 - RNA, 15 nt, Salmonella enterica enterica serovar Typhi Ty2
auacuaaaacuuuaa

SEQ ID NO: 3713785 - RNA, 17 nt, Salmonella enterica enterica serovar Typhi Ty2
auacuaaaacuuuaaca

SEQ ID NO: 3713786 - RNA, 17 nt, Salmonella enterica enterica serovar Typhi Ty2
auacuaaagggaucuuc

SEQ ID NO: 3713787 - RNA, 16 nt, Salmonella enterica enterica serovar Typhi Ty2
auacucaauauccugc

SEQ ID NO: 3713788 - RNA, 19 nt, Salmonella enterica enterica serovar Typhi Ty2
auacucagcgacguaaucu

SEQ ID NO: 3713789 - RNA, 23 nt, Salmonella enterica enterica serovar Typhi Ty2
auacucagcgacguaaucuauuc

SEQ ID NO: 3713790 - RNA, 13 nt, Salmonella enterica enterica serovar Typhi Ty2
auacuccagcaga

SEQ ID NO: 3713791 - RNA, 14 nt, Salmonella enterica enterica serovar Typhi Ty2
auacuccagcagac

SEQ ID NO: 3713792 - RNA, 19 nt, Salmonella enterica enterica serovar Typhi Ty2
auacucuuugaacagccag

SEQ ID NO: 3713793 - RNA, 21 nt, Salmonella enterica enterica serovar Typhi Ty2
auacugaaccacggagagaca

SEQ ID NO: 3713794 - RNA, 17 nt, Salmonella enterica enterica serovar Typhi Ty2
auacugaccaacaacag

SEQ ID NO: 3713795 - RNA, 20 nt, Salmonella enterica enterica serovar Typhi Ty2
auacugaccaagcgucagca

SEQ ID NO: 3713796 - RNA, 11 nt, Salmonella enterica enterica serovar Typhi Ty2
auacugcaacg

SEQ ID NO: 3713797 - RNA, 16 nt, Salmonella enterica enterica serovar Typhi Ty2
auacugccgcccaucg

SEQ ID NO: 3713798 - RNA, 21 nt, Salmonella enterica enterica serovar Typhi Ty2
auacugccgcccaucgccaca

SEQ ID NO: 3713799 - RNA, 20 nt, Salmonella enterica enterica serovar Typhi Ty2
auacugcuuuuccggcagcg

SEQ ID NO: 3713800 - RNA, 14 nt, Salmonella enterica enterica serovar Typhi Ty2
auacuggaaaaaac

SEQ ID NO: 3713801 - RNA, 22 nt, Salmonella enterica enterica serovar Typhi Ty2
auacugggcgcaugaggccugu

SEQ ID NO: 3713802 - RNA, 20 nt, Salmonella enterica enterica serovar Typhi Ty2
auacuggucgcgucaauauu

SEQ ID NO: 3713803 - RNA, 17 nt, Salmonella enterica enterica serovar Typhi Ty2
auacuguacgcccagcc

SEQ ID NO: 3713804 - RNA, 17 nt, Salmonella enterica enterica serovar Typhi Ty2
auacugucgcgcggcgu

SEQ ID NO: 3713805 - RNA, 16 nt, Salmonella enterica enterica serovar Typhi Ty2
auacugugggauuuuu

SEQ ID NO: 3713806 - RNA, 17 nt, Salmonella enterica enterica serovar Typhi Ty2
auacuguuccaggcgaa

SEQ ID NO: 3713807 - RNA, 15 nt, Salmonella enterica enterica serovar Typhi Ty2
auacuguuuuugcuu

SEQ ID NO: 3713808 - RNA, 22 nt, Salmonella enterica enterica serovar Typhi Ty2
auacuguuuuugcuuuaauauu

SEQ ID NO: 3713809 - RNA, 12 nt, Salmonella enterica enterica serovar Typhi Ty2
auacuuaacccu

SEQ ID NO: 3713810 - RNA, 21 nt, Salmonella enterica enterica serovar Typhi Ty2
auacuuaacccugaaccggga

SEQ ID NO: 3713811 - RNA, 23 nt, Salmonella enterica enterica serovar Typhi Ty2
auacuuaauucauaacgaccuuu

SEQ ID NO: 3713812 - RNA, 12 nt, Salmonella enterica enterica serovar Typhi Ty2
auacuuccgcug

SEQ ID NO: 3713813 - RNA, 23 nt, Salmonella enterica enterica serovar Typhi Ty2
auacuucgcucucuuuuggcgac

SEQ ID NO: 3713814 - RNA, 17 nt, Salmonella enterica enterica serovar Typhi Ty2
auagaaaauauaugaca

SEQ ID NO: 3713815 - RNA, 17 nt, Salmonella enterica enterica serovar Typhi Ty2
auagaaagucuuuuguu

SEQ ID NO: 3713816 - RNA, 14 nt, Salmonella enterica enterica serovar Typhi Ty2
auagaaauagccuu

SEQ ID NO: 3713817 - RNA, 22 nt, Salmonella enterica enterica serovar Typhi Ty2
auagaacgcucgcgcaugaccu

SEQ ID NO: 3713818 - RNA, 16 nt, Salmonella enterica enterica serovar Typhi Ty2
auagaacgcuugucuu

SEQ ID NO: 3713819 - RNA, 23 nt, Salmonella enterica enterica serovar Typhi Ty2
auagaacgguuuugcgcugguac

SEQ ID NO: 3713820 - RNA, 18 nt, Salmonella enterica enterica serovar Typhi Ty2
auagaacuuccgguaggu

SEQ ID NO: 3713821 - RNA, 16 nt, Salmonella enterica enterica serovar Typhi Ty2
auagaaguuaugcauc

SEQ ID NO: 3713822 - RNA, 21 nt, Salmonella enterica enterica serovar Typhi Ty2
auagaauaggaaauaauuaau

SEQ ID NO: 3713823 - RNA, 16 nt, Salmonella enterica enterica serovar Typhi Ty2
auagacauacaggaau

SEQ ID NO: 3713824 - RNA, 19 nt, Salmonella enterica enterica serovar Typhi Ty2
auagaccaggcgacuauuc

SEQ ID NO: 3713825 - RNA, 15 nt, Salmonella enterica enterica serovar Typhi Ty2
auagacgacaucuuu

SEQ ID NO: 3713826 - RNA, 18 nt, Salmonella enterica enterica serovar Typhi Ty2
auagacgacaucuuuucc

SEQ ID NO: 3713827 - RNA, 13 nt, Salmonella enterica enterica serovar Typhi Ty2
auagacgauauag

SEQ ID NO: 3713828 - RNA, 15 nt, Salmonella enterica enterica serovar Typhi Ty2
auagacgccgaaccu

SEQ ID NO: 3713829 - RNA, 18 nt, Salmonella enterica enterica serovar Typhi Ty2
auagacgccggucaugcc

SEQ ID NO: 3713830 - RNA, 15 nt, Salmonella enterica enterica serovar Typhi Ty2
auagacgcuacugug

SEQ ID NO: 3713831 - RNA, 15 nt, Salmonella enterica enterica serovar Typhi Ty2
auagacggccugcaa

SEQ ID NO: 3713832 - RNA, 12 nt, Salmonella enterica enterica serovar Typhi Ty2
auagacuccguc

SEQ ID NO: 3713833 - RNA, 23 nt, Salmonella enterica enterica serovar Typhi Ty2
auagacuccgucaaagaaaacuu

SEQ ID NO: 3713834 - RNA, 17 nt, Salmonella enterica enterica serovar Typhi Ty2
auagacuucacuuuccc

SEQ ID NO: 3713835 - RNA, 17 nt, Salmonella enterica enterica serovar Typhi Ty2
auagagacugccgccgu

SEQ ID NO: 3713836 - RNA, 15 nt, Salmonella enterica enterica serovar Typhi Ty2
auagaugauaaucau

SEQ ID NO: 3713837 - RNA, 17 nt, Salmonella enterica enterica serovar Typhi Ty2
auagcaacguccgcagc

SEQ ID NO: 3713838 - RNA, 17 nt, Salmonella enterica enterica serovar Typhi Ty2
auagcaacuuaauaaua

SEQ ID NO: 3713839 - RNA, 15 nt, Salmonella enterica enterica serovar Typhi Ty2
auagcaaucauccug

SEQ ID NO: 3713840 - RNA, 20 nt, Salmonella enterica enterica serovar Typhi Ty2
auagcaauuaauaaacaaug

SEQ ID NO: 3713841 - RNA, 14 nt, Salmonella enterica enterica serovar Typhi Ty2
auagcacacaaacg

SEQ ID NO: 3713842 - RNA, 17 nt, Salmonella enterica enterica serovar Typhi Ty2
auagcaccucgcaauau

SEQ ID NO: 3713843 - RNA, 13 nt, Salmonella enterica enterica serovar Typhi Ty2
auagcagcaaauu

SEQ ID NO: 3713844 - RNA, 16 nt, Salmonella enterica enterica serovar Typhi Ty2
auagcaggagauauag

SEQ ID NO: 3713845 - RNA, 16 nt, Salmonella enterica enterica serovar Typhi Ty2
auagcaucuuccucug

SEQ ID NO: 3713846 - RNA, 15 nt, Salmonella enterica enterica serovar Typhi Ty2
auagcauuaagcuga

SEQ ID NO: 3713847 - RNA, 20 nt, Salmonella enterica enterica serovar Typhi Ty2
auagccaacacauaagccac

SEQ ID NO: 3713848 - RNA, 14 nt, Salmonella enterica enterica serovar Typhi Ty2
auagccagaaugcc

SEQ ID NO: 3713849 - RNA, 17 nt, Salmonella enterica enterica serovar Typhi Ty2
auagccagcccccugcc

SEQ ID NO: 3713850 - RNA, 18 nt, Salmonella enterica enterica serovar Typhi Ty2
auagccagcccccugcca

SEQ ID NO: 3713851 - RNA, 19 nt, Salmonella enterica enterica serovar Typhi Ty2
auagccaguaauauaacca

SEQ ID NO: 3713852 - RNA, 14 nt, Salmonella enterica enterica serovar Typhi Ty2
auagccccaguaaa

SEQ ID NO: 3713853 - RNA, 21 nt, Salmonella enterica enterica serovar Typhi Ty2
auagccccggucaacgcgccg

SEQ ID NO: 3713854 - RNA, 12 nt, Salmonella enterica enterica serovar Typhi Ty2
auagcccggcuu

SEQ ID NO: 3713855 - RNA, 15 nt, Salmonella enterica enterica serovar Typhi Ty2
auagcccguuaugcc

SEQ ID NO: 3713856 - RNA, 15 nt, Salmonella enterica enterica serovar Typhi Ty2
auagccgaaacuuau

SEQ ID NO: 3713857 - RNA, 13 nt, Salmonella enterica enterica serovar Typhi Ty2
auagccugggcaa

SEQ ID NO: 3713858 - RNA, 21 nt, Salmonella enterica enterica serovar Typhi Ty2
auagccuugauccuguaacgc

SEQ ID NO: 3713859 - RNA, 20 nt, Salmonella enterica enterica serovar Typhi Ty2
auagccuuuauugaugacau

SEQ ID NO: 3713860 - RNA, 22 nt, Salmonella enterica enterica serovar Typhi Ty2
auagccuuugucgaaauugccg

SEQ ID NO: 3713861 - RNA, 14 nt, Salmonella enterica enterica serovar Typhi Ty2
auagcgaccagcgu

SEQ ID NO: 3713862 - RNA, 15 nt, Salmonella enterica enterica serovar Typhi Ty2
auagcgcagcauugg

SEQ ID NO: 3713863 - RNA, 19 nt, Salmonella enterica enterica serovar Typhi Ty2
auauaucgcgucaucaaac

SEQ ID NO: 3713864 - RNA, 11 nt, Salmonella enterica enterica serovar Typhi Ty2
auauaucucua

SEQ ID NO: 3713865 - RNA, 21 nt, Salmonella enterica enterica serovar Typhi Ty2
auauaugacaacacucacaaa

SEQ ID NO: 3713866 - RNA, 15 nt, Salmonella enterica enterica serovar Typhi Ty2
auauaugcaaaacug

SEQ ID NO: 3713867 - RNA, 18 nt, Salmonella enterica enterica serovar Typhi Ty2
auauauuacgacugcacc

SEQ ID NO: 3713868 - RNA, 16 nt, Salmonella enterica enterica serovar Typhi Ty2
auauauucagcaaaug

SEQ ID NO: 3713869 - RNA, 18 nt, Salmonella enterica enterica serovar Typhi Ty2
auauauuucacuucauca

SEQ ID NO: 3713870 - RNA, 12 nt, Salmonella enterica enterica serovar Typhi Ty2
auauauuuuccg

SEQ ID NO: 3713871 - RNA, 20 nt, Salmonella enterica enterica serovar Typhi Ty2
auaucaaacacaaauuucga

SEQ ID NO: 3713872 - RNA, 22 nt, Salmonella enterica enterica serovar Typhi Ty2
auaucaacccaguuuuuauccu

SEQ ID NO: 3713873 - RNA, 12 nt, Salmonella enterica enterica serovar Typhi Ty2
auaucaacgacc

SEQ ID NO: 3713874 - RNA, 19 nt, Salmonella enterica enterica serovar Typhi Ty2
auaucaagagaaccaacgc

SEQ ID NO: 3713875 - RNA, 13 nt, Salmonella enterica enterica serovar Typhi Ty2
auaucaaucaccu

SEQ ID NO: 3713876 - RNA, 18 nt, Salmonella enterica enterica serovar Typhi Ty2
auaucaccaucuuuuugc

SEQ ID NO: 3713877 - RNA, 21 nt, Salmonella enterica enterica serovar Typhi Ty2
auaucagccccacggcaaauu

SEQ ID NO: 3713878 - RNA, 19 nt, Salmonella enterica enterica serovar Typhi Ty2
auaucaggcaaaaaucguc

SEQ ID NO: 3713879 - RNA, 22 nt, Salmonella enterica enterica serovar Typhi Ty2
auaucagggcuuuuuucucgcg

SEQ ID NO: 3713880 - RNA, 14 nt, Salmonella enterica enterica serovar Typhi Ty2
auaucagucugcaa

SEQ ID NO: 3713881 - RNA, 13 nt, Salmonella enterica enterica serovar Typhi Ty2
auaucaucaucuc

SEQ ID NO: 3713882 - RNA, 13 nt, Salmonella enterica enterica serovar Typhi Ty2
auaucaucgucau

SEQ ID NO: 3713883 - RNA, 22 nt, Salmonella enterica enterica serovar Typhi Ty2
auaucaucgucauuaaugccua

SEQ ID NO: 3713884 - RNA, 22 nt, Salmonella enterica enterica serovar Typhi Ty2
auaucauucgcgucauacuuaa

SEQ ID NO: 3713885 - RNA, 13 nt, Salmonella enterica enterica serovar Typhi Ty2
auaucauuuuacc

SEQ ID NO: 3713886 - RNA, 17 nt, Salmonella enterica enterica serovar Typhi Ty2
auauccagccaguccuc

SEQ ID NO: 3713887 - RNA, 13 nt, Salmonella enterica enterica serovar Typhi Ty2
auauccaggagca

SEQ ID NO: 3713888 - RNA, 13 nt, Salmonella enterica enterica serovar Typhi Ty2
auauccaguugcg

SEQ ID NO: 3713889 - RNA, 20 nt, Salmonella enterica enterica serovar Typhi Ty2
auauccaguugcgccagcgu

SEQ ID NO: 3713890 - RNA, 23 nt, Salmonella enterica enterica serovar Typhi Ty2
auauccauugggggguuagugcu

SEQ ID NO: 3713891 - RNA, 14 nt, Salmonella enterica enterica serovar Typhi Ty2
auaucccgcaagaa

SEQ ID NO: 3713892 - RNA, 19 nt, Salmonella enterica enterica serovar Typhi Ty2
auaucccggcugacauaau

SEQ ID NO: 3713893 - RNA, 15 nt, Salmonella enterica enterica serovar Typhi Ty2
auauccguagcggau

SEQ ID NO: 3713894 - RNA, 14 nt, Salmonella enterica enterica serovar Typhi Ty2
auauccuaacuuau

SEQ ID NO: 3713895 - RNA, 22 nt, Salmonella enterica enterica serovar Typhi Ty2
auauccugcaccgccugcggca

SEQ ID NO: 3713896 - RNA, 15 nt, Salmonella enterica enterica serovar Typhi Ty2
auauccuguaacuca

SEQ ID NO: 3713897 - RNA, 17 nt, Salmonella enterica enterica serovar Typhi Ty2
auauccuguaacucauc

SEQ ID NO: 3713898 - RNA, 20 nt, Salmonella enterica enterica serovar Typhi Ty2
auaucgacauaaguaaauaa

SEQ ID NO: 3713899 - RNA, 18 nt, Salmonella enterica enterica serovar Typhi Ty2
auaucgacggucaggcug

SEQ ID NO: 3713900 - RNA, 13 nt, Salmonella enterica enterica serovar Typhi Ty2
auaucgauaaaga

SEQ ID NO: 3713901 - RNA, 23 nt, Salmonella enterica enterica serovar Typhi Ty2
auaucgauaaucaacaaugucgc

SEQ ID NO: 3713902 - RNA, 13 nt, Salmonella enterica enterica serovar Typhi Ty2
auaucgaugccag

SEQ ID NO: 3713903 - RNA, 13 nt, Salmonella enterica enterica serovar Typhi Ty2
auaucgccauaca

SEQ ID NO: 3713904 - RNA, 13 nt, Salmonella enterica enterica serovar Typhi Ty2
auaucgccgccac

SEQ ID NO: 3713905 - RNA, 15 nt, Salmonella enterica enterica serovar Typhi Ty2
auaucgccugcggca

SEQ ID NO: 3713906 - RNA, 17 nt, Salmonella enterica enterica serovar Typhi Ty2
auaucgccuggugugaa

SEQ ID NO: 3713907 - RNA, 13 nt, Salmonella enterica enterica serovar Typhi Ty2
auaucgcgcggca

SEQ ID NO: 3713908 - RNA, 16 nt, Salmonella enterica enterica serovar Typhi Ty2
auaucgcggaaauuca

SEQ ID NO: 3713909 - RNA, 14 nt, Salmonella enterica enterica serovar Typhi Ty2
auaucgcuaaccaa

SEQ ID NO: 3713910 - RNA, 20 nt, Salmonella enterica enterica serovar Typhi Ty2
auaucggcaauauugccgca

SEQ ID NO: 3713911 - RNA, 12 nt, Salmonella enterica enterica serovar Typhi Ty2
auaucggcugcu

SEQ ID NO: 3713912 - RNA, 20 nt, Salmonella enterica enterica serovar Typhi Ty2
auaucgguucaauacccuuu

SEQ ID NO: 3713913 - RNA, 18 nt, Salmonella enterica enterica serovar Typhi Ty2
auaucucuacccuauugu

SEQ ID NO: 3713914 - RNA, 11 nt, Salmonella enterica enterica serovar Typhi Ty2
auaucucuauu

SEQ ID NO: 3713915 - RNA, 15 nt, Salmonella enterica enterica serovar Typhi Ty2
auaucugcgccgcca

SEQ ID NO: 3713916 - RNA, 15 nt, Salmonella enterica enterica serovar Typhi Ty2
auaucuuuauucgcu

SEQ ID NO: 3713917 - RNA, 19 nt, Salmonella enterica enterica serovar Typhi Ty2
auaucuuucaguucgccgg

SEQ ID NO: 3713918 - RNA, 14 nt, Salmonella enterica enterica serovar Typhi Ty2
auaugaaagagaaa

SEQ ID NO: 3713919 - RNA, 15 nt, Salmonella enterica enterica serovar Typhi Ty2
auaugaaagagaaau

SEQ ID NO: 3713920 - RNA, 13 nt, Salmonella enterica enterica serovar Typhi Ty2
auaugaaccaaga

SEQ ID NO: 3713921 - RNA, 15 nt, Salmonella enterica enterica serovar Typhi Ty2
auaugaauaaacugu

SEQ ID NO: 3713922 - RNA, 14 nt, Salmonella enterica enterica serovar Typhi Ty2
auaugaauauacga

SEQ ID NO: 3713923 - RNA, 18 nt, Salmonella enterica enterica serovar Typhi Ty2
auaugaaucaucagaauc

SEQ ID NO: 3713924 - RNA, 20 nt, Salmonella enterica enterica serovar Typhi Ty2
auaugaauuauuuucuaaaa

SEQ ID NO: 3713925 - RNA, 18 nt, Salmonella enterica enterica serovar Typhi Ty2
auaugacaacacucacaa

SEQ ID NO: 3713926 - RNA, 18 nt, Salmonella enterica enterica serovar Typhi Ty2
auaugaguacuacugaua

SEQ ID NO: 3713927 - RNA, 19 nt, Salmonella enterica enterica serovar Typhi Ty2
auaugauagaaguuaugca

SEQ ID NO: 3713928 - RNA, 19 nt, Salmonella enterica enterica serovar Typhi Ty2
auaugaucugcacaacauu

SEQ ID NO: 3713929 - RNA, 12 nt, Salmonella enterica enterica serovar Typhi Ty2
auaugaugcagg

SEQ ID NO: 3713930 - RNA, 15 nt, Salmonella enterica enterica serovar Typhi Ty2
auaugauuuaaaaaa

SEQ ID NO: 3713931 - RNA, 14 nt, Salmonella enterica enterica serovar Typhi Ty2
auaugcaggcauaa

SEQ ID NO: 3713932 - RNA, 17 nt, Salmonella enterica enterica serovar Typhi Ty2
auaugcaggcauaaaaa

SEQ ID NO: 3713933 - RNA, 18 nt, Salmonella enterica enterica serovar Typhi Ty2
auaugcaggcauaaaaaa

SEQ ID NO: 3713934 - RNA, 19 nt, Salmonella enterica enterica serovar Typhi Ty2
auaugcaggcauaaaaaag

SEQ ID NO: 3713935 - RNA, 21 nt, Salmonella enterica enterica serovar Typhi Ty2
auaugcagugcugcugccauu

SEQ ID NO: 3713936 - RNA, 19 nt, Salmonella enterica enterica serovar Typhi Ty2
auaugccaaguaauaaaga

SEQ ID NO: 3713937 - RNA, 22 nt, Salmonella enterica enterica serovar Typhi Ty2
auaugccaaguaauaaagagaa

SEQ ID NO: 3713938 - RNA, 17 nt, Salmonella enterica enterica serovar Typhi Ty2
auaugccggauaguuac

SEQ ID NO: 3713939 - RNA, 22 nt, Salmonella enterica enterica serovar Typhi Ty2
auaugccugcacuaaaccagau

SEQ ID NO: 3713940 - RNA, 15 nt, Salmonella enterica enterica serovar Typhi Ty2
auaugcgccaacugc

SEQ ID NO: 3713941 - RNA, 17 nt, Salmonella enterica enterica serovar Typhi Ty2
auaugcgcggcgaucag

SEQ ID NO: 3713942 - RNA, 22 nt, Salmonella enterica enterica serovar Typhi Ty2
auaugcgcugcgaagugaauau

SEQ ID NO: 3713943 - RNA, 19 nt, Salmonella enterica enterica serovar Typhi Ty2
auaugcggagccucuuccu

SEQ ID NO: 3713944 - RNA, 16 nt, Salmonella enterica enterica serovar Typhi Ty2
auaugcggcgccauca

SEQ ID NO: 3713945 - RNA, 22 nt, Salmonella enterica enterica serovar Typhi Ty2
aucaaaggcgucgccgaauaaa

SEQ ID NO: 3713946 - RNA, 17 nt, Salmonella enterica enterica serovar Typhi Ty2
aucaaauaccuuuucau

SEQ ID NO: 3713947 - RNA, 20 nt, Salmonella enterica enterica serovar Typhi Ty2
aucaaauacgcuauuuaaaa

SEQ ID NO: 3713948 - RNA, 21 nt, Salmonella enterica enterica serovar Typhi Ty2
aucaaaugagaauagacuggc

SEQ ID NO: 3713949 - RNA, 20 nt, Salmonella enterica enterica serovar Typhi Ty2
aucaacagaccgacgaugac

SEQ ID NO: 3713950 - RNA, 23 nt, Salmonella enterica enterica serovar Typhi Ty2
aucaacaggcgauucggacucau

SEQ ID NO: 3713951 - RNA, 15 nt, Salmonella enterica enterica serovar Typhi Ty2
aucaacauuauuaaa

SEQ ID NO: 3713952 - RNA, 19 nt, Salmonella enterica enterica serovar Typhi Ty2
aucaacauuauuaaaaugu

SEQ ID NO: 3713953 - RNA, 14 nt, Salmonella enterica enterica serovar Typhi Ty2
aucaaccaccuuca

SEQ ID NO: 3713954 - RNA, 17 nt, Salmonella enterica enterica serovar Typhi Ty2
aucaacccgcuaccgca

SEQ ID NO: 3713955 - RNA, 23 nt, Salmonella enterica enterica serovar Typhi Ty2
aucaacgaccaugguucccgcca

SEQ ID NO: 3713956 - RNA, 18 nt, Salmonella enterica enterica serovar Typhi Ty2
aucaacgccgcgccauca

SEQ ID NO: 3713957 - RNA, 20 nt, Salmonella enterica enterica serovar Typhi Ty2
aucaacgccgcgccaucagg

SEQ ID NO: 3713958 - RNA, 17 nt, Salmonella enterica enterica serovar Typhi Ty2
aucaacgccuccaggcu

SEQ ID NO: 3713959 - RNA, 22 nt, Salmonella enterica enterica serovar Typhi Ty2
aucaacguaaauagagaaauca

SEQ ID NO: 3713960 - RNA, 20 nt, Salmonella enterica enterica serovar Typhi Ty2
aucaacgucgucgucuucaa

SEQ ID NO: 3713961 - RNA, 16 nt, Salmonella enterica enterica serovar Typhi Ty2
aucaacucuuuaccca

SEQ ID NO: 3713962 - RNA, 13 nt, Salmonella enterica enterica serovar Typhi Ty2
aucaagaugcuac

SEQ ID NO: 3713963 - RNA, 17 nt, Salmonella enterica enterica serovar Typhi Ty2
aucaagauugaguccau

SEQ ID NO: 3713964 - RNA, 21 nt, Salmonella enterica enterica serovar Typhi Ty2
aucaagcagugacguggcuuc

SEQ ID NO: 3713965 - RNA, 17 nt, Salmonella enterica enterica serovar Typhi Ty2
aucaagcccacacauca

SEQ ID NO: 3713966 - RNA, 13 nt, Salmonella enterica enterica serovar Typhi Ty2
aucaagcccagcu

SEQ ID NO: 3713967 - RNA, 22 nt, Salmonella enterica enterica serovar Typhi Ty2
aucaagcgguagcguuauccag

SEQ ID NO: 3713968 - RNA, 17 nt, Salmonella enterica enterica serovar Typhi Ty2
aucaauaaaauuaucca

SEQ ID NO: 3713969 - RNA, 21 nt, Salmonella enterica enterica serovar Typhi Ty2
aucaauacagagauauuaaaa

SEQ ID NO: 3713970 - RNA, 14 nt, Salmonella enterica enterica serovar Typhi Ty2
aucaauagauuauu

SEQ ID NO: 3713971 - RNA, 20 nt, Salmonella enterica enterica serovar Typhi Ty2
aucaauauaucaggcugagc

SEQ ID NO: 3713972 - RNA, 18 nt, Salmonella enterica enterica serovar Typhi Ty2
aucaaucaccucuucccc

SEQ ID NO: 3713973 - RNA, 21 nt, Salmonella enterica enterica serovar Typhi Ty2
aucaaucacuacggguuuuug

SEQ ID NO: 3713974 - RNA, 16 nt, Salmonella enterica enterica serovar Typhi Ty2
aucaaucuacuguuau

SEQ ID NO: 3713975 - RNA, 15 nt, Salmonella enterica enterica serovar Typhi Ty2
aucaaucugcuuuuu

SEQ ID NO: 3713976 - RNA, 12 nt, Salmonella enterica enterica serovar Typhi Ty2
aucaaugcccag

SEQ ID NO: 3713977 - RNA, 21 nt, Salmonella enterica enterica serovar Typhi Ty2
aucaaugcccagcgcaaucac

SEQ ID NO: 3713978 - RNA, 22 nt, Salmonella enterica enterica serovar Typhi Ty2
aucaaugcccagcgcaaucacg

SEQ ID NO: 3713979 - RNA, 20 nt, Salmonella enterica enterica serovar Typhi Ty2
aucaaugcgcguaauuugcg

SEQ ID NO: 3713980 - RNA, 21 nt, Salmonella enterica enterica serovar Typhi Ty2
aucaaugggauagugccugcc

SEQ ID NO: 3713981 - RNA, 18 nt, Salmonella enterica enterica serovar Typhi Ty2
aucaauguaaaacgguau

SEQ ID NO: 3713982 - RNA, 20 nt, Salmonella enterica enterica serovar Typhi Ty2
aucaauguauuguucaugca

SEQ ID NO: 3713983 - RNA, 20 nt, Salmonella enterica enterica serovar Typhi Ty2
aucaauuccuuuuaauuuaa

SEQ ID NO: 3713984 - RNA, 18 nt, Salmonella enterica enterica serovar Typhi Ty2
aucaauucuuuaauuugu

SEQ ID NO: 3713985 - RNA, 19 nt, Salmonella enterica enterica serovar Typhi Ty2
aucaauugugugcacugca

SEQ ID NO: 3713986 - RNA, 18 nt, Salmonella enterica enterica serovar Typhi Ty2
aucaauuucauauuauua

SEQ ID NO: 3713987 - RNA, 19 nt, Salmonella enterica enterica serovar Typhi Ty2
aucaauuucauauuauuau

SEQ ID NO: 3713988 - RNA, 23 nt, Salmonella enterica enterica serovar Typhi Ty2
aucaauuucucuuuuauuauuuu

SEQ ID NO: 3713989 - RNA, 12 nt, Salmonella enterica enterica serovar Typhi Ty2
aucaauuuuucg

SEQ ID NO: 3713990 - RNA, 22 nt, Salmonella enterica enterica serovar Typhi Ty2
aucaauuuuucgcccggcucau

SEQ ID NO: 3713991 - RNA, 19 nt, Salmonella enterica enterica serovar Typhi Ty2
aucacaaaauggcugauaa

SEQ ID NO: 3713992 - RNA, 14 nt, Salmonella enterica enterica serovar Typhi Ty2
aucacaaauaacag

SEQ ID NO: 3713993 - RNA, 18 nt, Salmonella enterica enterica serovar Typhi Ty2
aucacaaauaacagacga

SEQ ID NO: 3713994 - RNA, 23 nt, Salmonella enterica enterica serovar Typhi Ty2
aucacaauuacgcaagagagcaa

SEQ ID NO: 3713995 - RNA, 13 nt, Salmonella enterica enterica serovar Typhi Ty2
aucacacauaucg

SEQ ID NO: 3713996 - RNA, 19 nt, Salmonella enterica enterica serovar Typhi Ty2
aucacacauaucgccagcc

SEQ ID NO: 3713997 - RNA, 20 nt, Salmonella enterica enterica serovar Typhi Ty2
aucacacauaucgccagcca

SEQ ID NO: 3713998 - RNA, 17 nt, Salmonella enterica enterica serovar Typhi Ty2
aucacacccgcacgccu

SEQ ID NO: 3713999 - RNA, 15 nt, Salmonella enterica enterica serovar Typhi Ty2
aucacagacagaugc

SEQ ID NO: 3714000 - RNA, 21 nt, Salmonella enterica enterica serovar Typhi Ty2
aucacagggggaacauuuaag

SEQ ID NO: 3714001 - RNA, 22 nt, Salmonella enterica enterica serovar Typhi Ty2
aucacaggggucaucggcacgu

SEQ ID NO: 3714002 - RNA, 21 nt, Salmonella enterica enterica serovar Typhi Ty2
aucacaugcgggagcaaaaua

SEQ ID NO: 3714003 - RNA, 17 nt, Salmonella enterica enterica serovar Typhi Ty2
aucacauuaugcugggu

SEQ ID NO: 3714004 - RNA, 13 nt, Salmonella enterica enterica serovar Typhi Ty2
aucaccaccucaa

SEQ ID NO: 3714005 - RNA, 18 nt, Salmonella enterica enterica serovar Typhi Ty2
aucaccagaucggcaucu

SEQ ID NO: 3714006 - RNA, 12 nt, Salmonella enterica enterica serovar Typhi Ty2
aucaccagcgca

SEQ ID NO: 3714007 - RNA, 22 nt, Salmonella enterica enterica serovar Typhi Ty2
aucaccagcgcaucucccugcc

SEQ ID NO: 3714008 - RNA, 14 nt, Salmonella enterica enterica serovar Typhi Ty2
aucaccaggcaaug

SEQ ID NO: 3714009 - RNA, 14 nt, Salmonella enterica enterica serovar Typhi Ty2
aucaccaucacgau

SEQ ID NO: 3714010 - RNA, 21 nt, Salmonella enterica enterica serovar Typhi Ty2
aucaccaucguugccagcggc

SEQ ID NO: 3714011 - RNA, 15 nt, Salmonella enterica enterica serovar Typhi Ty2
aucaccaucuucaca

SEQ ID NO: 3714012 - RNA, 19 nt, Salmonella enterica enterica serovar Typhi Ty2
aucaccauucccagcgccc

SEQ ID NO: 3714013 - RNA, 17 nt, Salmonella enterica enterica serovar Typhi Ty2
aucacccaacguucaug

SEQ ID NO: 3714014 - RNA, 15 nt, Salmonella enterica enterica serovar Typhi Ty2
aucacccugaauuuc

SEQ ID NO: 3714015 - RNA, 19 nt, Salmonella enterica enterica serovar Typhi Ty2
aucacccugaauuucaaua

SEQ ID NO: 3714016 - RNA, 23 nt, Salmonella enterica enterica serovar Typhi Ty2
aucaccgcccuggcgggaaacag

SEQ ID NO: 3714017 - RNA, 17 nt, Salmonella enterica enterica serovar Typhi Ty2
aucaccggcauuucacc

SEQ ID NO: 3714018 - RNA, 19 nt, Salmonella enterica enterica serovar Typhi Ty2
aucaccucgcuucccugac

SEQ ID NO: 3714019 - RNA, 16 nt, Salmonella enterica enterica serovar Typhi Ty2
aucaccucuuucucca

SEQ ID NO: 3714020 - RNA, 17 nt, Salmonella enterica enterica serovar Typhi Ty2
aucaccucuuucuccac

SEQ ID NO: 3714021 - RNA, 18 nt, Salmonella enterica enterica serovar Typhi Ty2
aucaccugaaugcaaaga

SEQ ID NO: 3714022 - RNA, 21 nt, Salmonella enterica enterica serovar Typhi Ty2
aucaccugaccgauauagcca

SEQ ID NO: 3714023 - RNA, 15 nt, Salmonella enterica enterica serovar Typhi Ty2
aucaccugcaucacg

SEQ ID NO: 3714024 - RNA, 15 nt, Salmonella enterica enterica serovar Typhi Ty2
aucaccuggugcauu

SEQ ID NO: 3714025 - RNA, 18 nt, Salmonella enterica enterica serovar Typhi Ty2
aucaccuucuuuggcuua

SEQ ID NO: 3714026 - RNA, 22 nt, Salmonella enterica enterica serovar Typhi Ty2
aucagcuauuagcguuuuuacc

SEQ ID NO: 3714027 - RNA, 22 nt, Salmonella enterica enterica serovar Typhi Ty2
aucagcuuugcggccagcauau

SEQ ID NO: 3714028 - RNA, 21 nt, Salmonella enterica enterica serovar Typhi Ty2
aucaggaaaaagggaauaaua

SEQ ID NO: 3714029 - RNA, 15 nt, Salmonella enterica enterica serovar Typhi Ty2
aucaggaaaucuucc

SEQ ID NO: 3714030 - RNA, 18 nt, Salmonella enterica enterica serovar Typhi Ty2
aucaggaaaucuuccagu

SEQ ID NO: 3714031 - RNA, 22 nt, Salmonella enterica enterica serovar Typhi Ty2
aucaggaaauucucagaaacaa

SEQ ID NO: 3714032 - RNA, 13 nt, Salmonella enterica enterica serovar Typhi Ty2
aucaggacaucaa

SEQ ID NO: 3714033 - RNA, 14 nt, Salmonella enterica enterica serovar Typhi Ty2
aucaggaucaaaau

SEQ ID NO: 3714034 - RNA, 14 nt, Salmonella enterica enterica serovar Typhi Ty2
aucaggaucuucau

SEQ ID NO: 3714035 - RNA, 15 nt, Salmonella enterica enterica serovar Typhi Ty2
aucaggauuauuaca

SEQ ID NO: 3714036 - RNA, 22 nt, Salmonella enterica enterica serovar Typhi Ty2
aucaggauucgacggccagcgc

SEQ ID NO: 3714037 - RNA, 21 nt, Salmonella enterica enterica serovar Typhi Ty2
aucaggcaaaaaucgucauca

SEQ ID NO: 3714038 - RNA, 23 nt, Salmonella enterica enterica serovar Typhi Ty2
aucaggcaagacccgaaccugcg

SEQ ID NO: 3714039 - RNA, 17 nt, Salmonella enterica enterica serovar Typhi Ty2
aucaggcacaacccaaa

SEQ ID NO: 3714040 - RNA, 15 nt, Salmonella enterica enterica serovar Typhi Ty2
aucaggcauaaaccu

SEQ ID NO: 3714041 - RNA, 16 nt, Salmonella enterica enterica serovar Typhi Ty2
aucaggcauaaaccua

SEQ ID NO: 3714042 - RNA, 18 nt, Salmonella enterica enterica serovar Typhi Ty2
aucaggcaugccaaacca

SEQ ID NO: 3714043 - RNA, 17 nt, Salmonella enterica enterica serovar Typhi Ty2
aucaggcauguugcgca

SEQ ID NO: 3714044 - RNA, 20 nt, Salmonella enterica enterica serovar Typhi Ty2
aucaggccgacaaaugacgu

SEQ ID NO: 3714045 - RNA, 16 nt, Salmonella enterica enterica serovar Typhi Ty2
aucaggccuacaaggc

SEQ ID NO: 3714046 - RNA, 20 nt, Salmonella enterica enterica serovar Typhi Ty2
aucaggccuacauccggcuc

SEQ ID NO: 3714047 - RNA, 15 nt, Salmonella enterica enterica serovar Typhi Ty2
aucaggccuaccagc

SEQ ID NO: 3714048 - RNA, 13 nt, Salmonella enterica enterica serovar Typhi Ty2
aucaggccugcaa

SEQ ID NO: 3714049 - RNA, 19 nt, Salmonella enterica enterica serovar Typhi Ty2
aucaggccugcaaaccucu

SEQ ID NO: 3714050 - RNA, 14 nt, Salmonella enterica enterica serovar Typhi Ty2
aucaggccugccug

SEQ ID NO: 3714051 - RNA, 16 nt, Salmonella enterica enterica serovar Typhi Ty2
aucaggccugccugau

SEQ ID NO: 3714052 - RNA, 21 nt, Salmonella enterica enterica serovar Typhi Ty2
aucaggccugugguaugugcc

SEQ ID NO: 3714053 - RNA, 20 nt, Salmonella enterica enterica serovar Typhi Ty2
aucaggcgucagcauggugu

SEQ ID NO: 3714054 - RNA, 21 nt, Salmonella enterica enterica serovar Typhi Ty2
aucaggcguugaccgcuucgc

SEQ ID NO: 3714055 - RNA, 19 nt, Salmonella enterica enterica serovar Typhi Ty2
aucaggcuuugcgccaucg

SEQ ID NO: 3714056 - RNA, 14 nt, Salmonella enterica enterica serovar Typhi Ty2
aucagggaaaaaug

SEQ ID NO: 3714057 - RNA, 21 nt, Salmonella enterica enterica serovar Typhi Ty2
aucaggggcgaacccaucagg

SEQ ID NO: 3714058 - RNA, 14 nt, Salmonella enterica enterica serovar Typhi Ty2
aucagguuguccug

SEQ ID NO: 3714059 - RNA, 18 nt, Salmonella enterica enterica serovar Typhi Ty2
aucaguccccacauuacg

SEQ ID NO: 3714060 - RNA, 18 nt, Salmonella enterica enterica serovar Typhi Ty2
aucagucucaaaggccug

SEQ ID NO: 3714061 - RNA, 18 nt, Salmonella enterica enterica serovar Typhi Ty2
aucagugaacacccugcc

SEQ ID NO: 3714062 - RNA, 20 nt, Salmonella enterica enterica serovar Typhi Ty2
aucaguggcgccgcaaugcc

SEQ ID NO: 3714063 - RNA, 19 nt, Salmonella enterica enterica serovar Typhi Ty2
aucaguggcggcaaaaaau

SEQ ID NO: 3714064 - RNA, 19 nt, Salmonella enterica enterica serovar Typhi Ty2
aucaguuccaaucucuuuu

SEQ ID NO: 3714065 - RNA, 20 nt, Salmonella enterica enterica serovar Typhi Ty2
aucaguuccaaucucuuuug

SEQ ID NO: 3714066 - RNA, 15 nt, Salmonella enterica enterica serovar Typhi Ty2
aucaguugcaggaag

SEQ ID NO: 3714067 - RNA, 16 nt, Salmonella enterica enterica serovar Typhi Ty2
aucaguuuaaccguuc

SEQ ID NO: 3714068 - RNA, 20 nt, Salmonella enterica enterica serovar Typhi Ty2
aucaguuuaaccguuccaac

SEQ ID NO: 3714069 - RNA, 14 nt, Salmonella enterica enterica serovar Typhi Ty2
aucauaaaaggcau

SEQ ID NO: 3714070 - RNA, 21 nt, Salmonella enterica enterica serovar Typhi Ty2
aucauaaaaggcugagaaggu

SEQ ID NO: 3714071 - RNA, 18 nt, Salmonella enterica enterica serovar Typhi Ty2
aucauaaagcgcccggug

SEQ ID NO: 3714072 - RNA, 22 nt, Salmonella enterica enterica serovar Typhi Ty2
aucauaagggagcugacugcaa

SEQ ID NO: 3714073 - RNA, 14 nt, Salmonella enterica enterica serovar Typhi Ty2
aucauaaucacuau

SEQ ID NO: 3714074 - RNA, 14 nt, Salmonella enterica enterica serovar Typhi Ty2
aucauacugaacuc

SEQ ID NO: 3714075 - RNA, 19 nt, Salmonella enterica enterica serovar Typhi Ty2
aucauaguuuuuccccauc

SEQ ID NO: 3714076 - RNA, 11 nt, Salmonella enterica enterica serovar Typhi Ty2
aucauauccuc

SEQ ID NO: 3714077 - RNA, 18 nt, Salmonella enterica enterica serovar Typhi Ty2
aucaucaaguaccgugaa

SEQ ID NO: 3714078 - RNA, 14 nt, Salmonella enterica enterica serovar Typhi Ty2
aucaucacaauuag

SEQ ID NO: 3714079 - RNA, 15 nt, Salmonella enterica enterica serovar Typhi Ty2
aucaucacgaucgag

SEQ ID NO: 3714080 - RNA, 17 nt, Salmonella enterica enterica serovar Typhi Ty2
aucaucaggguuauccu

SEQ ID NO: 3714081 - RNA, 12 nt, Salmonella enterica enterica serovar Typhi Ty2
aucauccagccc

SEQ ID NO: 3714082 - RNA, 19 nt, Salmonella enterica enterica serovar Typhi Ty2
aucauccccaccgcugaug

SEQ ID NO: 3714083 - RNA, 21 nt, Salmonella enterica enterica serovar Typhi Ty2
aucauccccguuuucgccgga

SEQ ID NO: 3714084 - RNA, 16 nt, Salmonella enterica enterica serovar Typhi Ty2
aucauccugauuuuac

SEQ ID NO: 3714085 - RNA, 23 nt, Salmonella enterica enterica serovar Typhi Ty2
aucauccuucgggcgauuuuugc

SEQ ID NO: 3714086 - RNA, 22 nt, Salmonella enterica enterica serovar Typhi Ty2
aucaucgaggccaccaaaaauu

SEQ ID NO: 3714087 - RNA, 22 nt, Salmonella enterica enterica serovar Typhi Ty2
aucaucgcauugagcaggggcu

SEQ ID NO: 3714088 - RNA, 13 nt, Salmonella enterica enterica serovar Typhi Ty2
aucaucgcuauca

SEQ ID NO: 3714089 - RNA, 16 nt, Salmonella enterica enterica serovar Typhi Ty2
aucaucggcacagcca

SEQ ID NO: 3714090 - RNA, 21 nt, Salmonella enterica enterica serovar Typhi Ty2
aucaucgguuacuccuuauuu

SEQ ID NO: 3714091 - RNA, 20 nt, Salmonella enterica enterica serovar Typhi Ty2
aucaucgucauuaaugccua

SEQ ID NO: 3714092 - RNA, 12 nt, Salmonella enterica enterica serovar Typhi Ty2
aucaucuauaga

SEQ ID NO: 3714093 - RNA, 19 nt, Salmonella enterica enterica serovar Typhi Ty2
aucaucucccaggccgcca

SEQ ID NO: 3714094 - RNA, 12 nt, Salmonella enterica enterica serovar Typhi Ty2
aucaucuucacu

SEQ ID NO: 3714095 - RNA, 16 nt, Salmonella enterica enterica serovar Typhi Ty2
aucaucuucacuucac

SEQ ID NO: 3714096 - RNA, 14 nt, Salmonella enterica enterica serovar Typhi Ty2
aucaugaaaaauau

SEQ ID NO: 3714097 - RNA, 20 nt, Salmonella enterica enterica serovar Typhi Ty2
aucaugaaaaauauaaaaag

SEQ ID NO: 3714098 - RNA, 20 nt, Salmonella enterica enterica serovar Typhi Ty2
aucaugaacguuaucggcau

SEQ ID NO: 3714099 - RNA, 15 nt, Salmonella enterica enterica serovar Typhi Ty2
aucaugaauaaucgu

SEQ ID NO: 3714100 - RNA, 17 nt, Salmonella enterica enterica serovar Typhi Ty2
aucaugacagauuuaau

SEQ ID NO: 3714101 - RNA, 11 nt, Salmonella enterica enterica serovar Typhi Ty2
aucaugcccac

SEQ ID NO: 3714102 - RNA, 16 nt, Salmonella enterica enterica serovar Typhi Ty2
aucaugccgcccaggc

SEQ ID NO: 3714103 - RNA, 15 nt, Salmonella enterica enterica serovar Typhi Ty2
aucaugcugaugacu

SEQ ID NO: 3714104 - RNA, 14 nt, Salmonella enterica enterica serovar Typhi Ty2
aucaugcugcaccg

SEQ ID NO: 3714105 - RNA, 19 nt, Salmonella enterica enterica serovar Typhi Ty2
aucaugcugcaccgcauca

SEQ ID NO: 3714106 - RNA, 16 nt, Salmonella enterica enterica serovar Typhi Ty2
aucaugcuugcuuugc

SEQ ID NO: 3714107 - RNA, 14 nt, Salmonella enterica enterica serovar Typhi Ty2
aucauggcucagau

SEQ ID NO: 3714108 - RNA, 14 nt, Salmonella enterica enterica serovar Typhi Ty2
auccaguuucuucg

SEQ ID NO: 3714109 - RNA, 17 nt, Salmonella enterica enterica serovar Typhi Ty2
auccauaauuuucccca

SEQ ID NO: 3714110 - RNA, 18 nt, Salmonella enterica enterica serovar Typhi Ty2
auccauaauuuuccccag

SEQ ID NO: 3714111 - RNA, 23 nt, Salmonella enterica enterica serovar Typhi Ty2
auccauaccgcuuuguaaaacau

SEQ ID NO: 3714112 - RNA, 17 nt, Salmonella enterica enterica serovar Typhi Ty2
auccaucagccaggguu

SEQ ID NO: 3714113 - RNA, 13 nt, Salmonella enterica enterica serovar Typhi Ty2
auccaucaucuau

SEQ ID NO: 3714114 - RNA, 19 nt, Salmonella enterica enterica serovar Typhi Ty2
auccaugauggcguaaucc

SEQ ID NO: 3714115 - RNA, 20 nt, Salmonella enterica enterica serovar Typhi Ty2
auccaugccggcuuuccgca

SEQ ID NO: 3714116 - RNA, 16 nt, Salmonella enterica enterica serovar Typhi Ty2
auccaugcuuucaaua

SEQ ID NO: 3714117 - RNA, 19 nt, Salmonella enterica enterica serovar Typhi Ty2
auccaugcuuucaauaaau

SEQ ID NO: 3714118 - RNA, 16 nt, Salmonella enterica enterica serovar Typhi Ty2
auccauguacgcaggc

SEQ ID NO: 3714119 - RNA, 14 nt, Salmonella enterica enterica serovar Typhi Ty2
auccauguugccau

SEQ ID NO: 3714120 - RNA, 18 nt, Salmonella enterica enterica serovar Typhi Ty2
auccauucucaucagacc

SEQ ID NO: 3714121 - RNA, 19 nt, Salmonella enterica enterica serovar Typhi Ty2
auccauugcgccacggaug

SEQ ID NO: 3714122 - RNA, 16 nt, Salmonella enterica enterica serovar Typhi Ty2
auccauuuuaaauaca

SEQ ID NO: 3714123 - RNA, 14 nt, Salmonella enterica enterica serovar Typhi Ty2
aucccaauaccggc

SEQ ID NO: 3714124 - RNA, 12 nt, Salmonella enterica enterica serovar Typhi Ty2
aucccaaucagg

SEQ ID NO: 3714125 - RNA, 17 nt, Salmonella enterica enterica serovar Typhi Ty2
aucccacaacuguucuu

SEQ ID NO: 3714126 - RNA, 20 nt, Salmonella enterica enterica serovar Typhi Ty2
aucccaccaauugccacaua

SEQ ID NO: 3714127 - RNA, 13 nt, Salmonella enterica enterica serovar Typhi Ty2
aucccaccagcag

SEQ ID NO: 3714128 - RNA, 18 nt, Salmonella enterica enterica serovar Typhi Ty2
aucccaccauaaagcgaa

SEQ ID NO: 3714129 - RNA, 15 nt, Salmonella enterica enterica serovar Typhi Ty2
aucccacggagaaaa

SEQ ID NO: 3714130 - RNA, 20 nt, Salmonella enterica enterica serovar Typhi Ty2
aucccacuccaucgccugau

SEQ ID NO: 3714131 - RNA, 14 nt, Salmonella enterica enterica serovar Typhi Ty2
aucccacugcacgc

SEQ ID NO: 3714132 - RNA, 16 nt, Salmonella enterica enterica serovar Typhi Ty2
aucccacuuaggcagc

SEQ ID NO: 3714133 - RNA, 18 nt, Salmonella enterica enterica serovar Typhi Ty2
aucccacuuaggcagcca

SEQ ID NO: 3714134 - RNA, 20 nt, Salmonella enterica enterica serovar Typhi Ty2
aucccagggcggcgucgcca

SEQ ID NO: 3714135 - RNA, 21 nt, Salmonella enterica enterica serovar Typhi Ty2
aucccauccgggccacucucc

SEQ ID NO: 3714136 - RNA, 19 nt, Salmonella enterica enterica serovar Typhi Ty2
aucccaugcaccaguccca

SEQ ID NO: 3714137 - RNA, 17 nt, Salmonella enterica enterica serovar Typhi Ty2
auccccaaacugcucgu

SEQ ID NO: 3714138 - RNA, 18 nt, Salmonella enterica enterica serovar Typhi Ty2
auccccagcaucaugucc

SEQ ID NO: 3714139 - RNA, 12 nt, Salmonella enterica enterica serovar Typhi Ty2
auccccagcgcu

SEQ ID NO: 3714140 - RNA, 12 nt, Salmonella enterica enterica serovar Typhi Ty2
auccccauccca

SEQ ID NO: 3714141 - RNA, 19 nt, Salmonella enterica enterica serovar Typhi Ty2
auccccccuuuuuugcugg

SEQ ID NO: 3714142 - RNA, 20 nt, Salmonella enterica enterica serovar Typhi Ty2
auccccccuuuuuugcuggc

SEQ ID NO: 3714143 - RNA, 15 nt, Salmonella enterica enterica serovar Typhi Ty2
aucccccugccacaa

SEQ ID NO: 3714144 - RNA, 18 nt, Salmonella enterica enterica serovar Typhi Ty2
auccccgccgagaaaaua

SEQ ID NO: 3714145 - RNA, 22 nt, Salmonella enterica enterica serovar Typhi Ty2
auccccgccgagaaaauaccgc

SEQ ID NO: 3714146 - RNA, 16 nt, Salmonella enterica enterica serovar Typhi Ty2
auccccgccucaccgc

SEQ ID NO: 3714147 - RNA, 13 nt, Salmonella enterica enterica serovar Typhi Ty2
auccccggcaacc

SEQ ID NO: 3714148 - RNA, 17 nt, Salmonella enterica enterica serovar Typhi Ty2
auccccggcaaccuuaa

SEQ ID NO: 3714149 - RNA, 20 nt, Salmonella enterica enterica serovar Typhi Ty2
aucccgacucugacgccggu

SEQ ID NO: 3714150 - RNA, 15 nt, Salmonella enterica enterica serovar Typhi Ty2
aucccgccaaaccgg

SEQ ID NO: 3714151 - RNA, 19 nt, Salmonella enterica enterica serovar Typhi Ty2
aucccgccagcggcgccau

SEQ ID NO: 3714152 - RNA, 21 nt, Salmonella enterica enterica serovar Typhi Ty2
aucccgccaucguccagccau

SEQ ID NO: 3714153 - RNA, 18 nt, Salmonella enterica enterica serovar Typhi Ty2
aucccgccgcauccuuau

SEQ ID NO: 3714154 - RNA, 14 nt, Salmonella enterica enterica serovar Typhi Ty2
aucccgccgcuggc

SEQ ID NO: 3714155 - RNA, 23 nt, Salmonella enterica enterica serovar Typhi Ty2
aucccgccuugcggcgccaggac

SEQ ID NO: 3714156 - RNA, 16 nt, Salmonella enterica enterica serovar Typhi Ty2
aucccgcgcgccucgc

SEQ ID NO: 3714157 - RNA, 20 nt, Salmonella enterica enterica serovar Typhi Ty2
aucccgcgcgccucgcauaa

SEQ ID NO: 3714158 - RNA, 23 nt, Salmonella enterica enterica serovar Typhi Ty2
aucccgcugugauccauguugcc

SEQ ID NO: 3714159 - RNA, 23 nt, Salmonella enterica enterica serovar Typhi Ty2
aucccggcgacagcgaccacgac

SEQ ID NO: 3714160 - RNA, 17 nt, Salmonella enterica enterica serovar Typhi Ty2
aucccggcgcgcguggc

SEQ ID NO: 3714161 - RNA, 15 nt, Salmonella enterica enterica serovar Typhi Ty2
aucccggcguagcgc

SEQ ID NO: 3714162 - RNA, 19 nt, Salmonella enterica enterica serovar Typhi Ty2
aucccgggcgauaaaccag

SEQ ID NO: 3714163 - RNA, 21 nt, Salmonella enterica enterica serovar Typhi Ty2
aucccgguauuccguuccuuc

SEQ ID NO: 3714164 - RNA, 15 nt, Salmonella enterica enterica serovar Typhi Ty2
aucccguagccgcuu

SEQ ID NO: 3714165 - RNA, 12 nt, Salmonella enterica enterica serovar Typhi Ty2
aucccguagcgu

SEQ ID NO: 3714166 - RNA, 15 nt, Salmonella enterica enterica serovar Typhi Ty2
aucccgucccaccac

SEQ ID NO: 3714167 - RNA, 13 nt, Salmonella enterica enterica serovar Typhi Ty2
aucccgugguggg

SEQ ID NO: 3714168 - RNA, 21 nt, Salmonella enterica enterica serovar Typhi Ty2
aucccguuuucgucccagcgc

SEQ ID NO: 3714169 - RNA, 17 nt, Salmonella enterica enterica serovar Typhi Ty2
aucccuaauaagguauu

SEQ ID NO: 3714170 - RNA, 13 nt, Salmonella enterica enterica serovar Typhi Ty2
aucccucaccucc

SEQ ID NO: 3714171 - RNA, 18 nt, Salmonella enterica enterica serovar Typhi Ty2
aucccucaccucccccgc

SEQ ID NO: 3714172 - RNA, 18 nt, Salmonella enterica enterica serovar Typhi Ty2
aucccuguucaaaagccu

SEQ ID NO: 3714173 - RNA, 20 nt, Salmonella enterica enterica serovar Typhi Ty2
aucccuguucaaaagccugu

SEQ ID NO: 3714174 - RNA, 21 nt, Salmonella enterica enterica serovar Typhi Ty2
aucccuuucaaaaaagagaag

SEQ ID NO: 3714175 - RNA, 15 nt, Salmonella enterica enterica serovar Typhi Ty2
auccgacaacaugaa

SEQ ID NO: 3714176 - RNA, 16 nt, Salmonella enterica enterica serovar Typhi Ty2
auccgacagauagugg

SEQ ID NO: 3714177 - RNA, 12 nt, Salmonella enterica enterica serovar Typhi Ty2
auccgacaugau

SEQ ID NO: 3714178 - RNA, 17 nt, Salmonella enterica enterica serovar Typhi Ty2
auccgacgccuguucga

SEQ ID NO: 3714179 - RNA, 13 nt, Salmonella enterica enterica serovar Typhi Ty2
auccgcacggcgg

SEQ ID NO: 3714180 - RNA, 16 nt, Salmonella enterica enterica serovar Typhi Ty2
auccgcagauccagca

SEQ ID NO: 3714181 - RNA, 15 nt, Salmonella enterica enterica serovar Typhi Ty2
auccgcauacaccuu

SEQ ID NO: 3714182 - RNA, 14 nt, Salmonella enterica enterica serovar Typhi Ty2
auccgcauccguca

SEQ ID NO: 3714183 - RNA, 16 nt, Salmonella enterica enterica serovar Typhi Ty2
auccgccagccgccau

SEQ ID NO: 3714184 - RNA, 14 nt, Salmonella enterica enterica serovar Typhi Ty2
auccgccagcgccu

SEQ ID NO: 3714185 - RNA, 20 nt, Salmonella enterica enterica serovar Typhi Ty2
auccgccaguuuguaaccaa

SEQ ID NO: 3714186 - RNA, 11 nt, Salmonella enterica enterica serovar Typhi Ty2
auccgccaucg

SEQ ID NO: 3714187 - RNA, 16 nt, Salmonella enterica enterica serovar Typhi Ty2
auccgccgagggcauu

SEQ ID NO: 3714188 - RNA, 12 nt, Salmonella enterica enterica serovar Typhi Ty2
auccgccgccca

SEQ ID NO: 3714189 - RNA, 15 nt, Salmonella enterica enterica serovar Typhi Ty2
auccgcgaauaccuu

SEQ ID NO: 3714190 - RNA, 16 nt, Salmonella enterica enterica serovar Typhi Ty2
aucgaacugugagccu

SEQ ID NO: 3714191 - RNA, 17 nt, Salmonella enterica enterica serovar Typhi Ty2
aucgaaggcaucuucag

SEQ ID NO: 3714192 - RNA, 15 nt, Salmonella enterica enterica serovar Typhi Ty2
aucgaauccagcagg

SEQ ID NO: 3714193 - RNA, 22 nt, Salmonella enterica enterica serovar Typhi Ty2
aucgacaaaagauuuaucaauu

SEQ ID NO: 3714194 - RNA, 15 nt, Salmonella enterica enterica serovar Typhi Ty2
aucgacaaaccacug

SEQ ID NO: 3714195 - RNA, 20 nt, Salmonella enterica enterica serovar Typhi Ty2
aucgacaaaggcaagauccg

SEQ ID NO: 3714196 - RNA, 12 nt, Salmonella enterica enterica serovar Typhi Ty2
aucgacaacgcg

SEQ ID NO: 3714197 - RNA, 13 nt, Salmonella enterica enterica serovar Typhi Ty2
aucgacaauccgc

SEQ ID NO: 3714198 - RNA, 14 nt, Salmonella enterica enterica serovar Typhi Ty2
aucgacaauccgcc

SEQ ID NO: 3714199 - RNA, 16 nt, Salmonella enterica enterica serovar Typhi Ty2
aucgacaucuucauca

SEQ ID NO: 3714200 - RNA, 22 nt, Salmonella enterica enterica serovar Typhi Ty2
aucgacauuaacaaugccuuau

SEQ ID NO: 3714201 - RNA, 17 nt, Salmonella enterica enterica serovar Typhi Ty2
aucgaccguauccgcca

SEQ ID NO: 3714202 - RNA, 20 nt, Salmonella enterica enterica serovar Typhi Ty2
aucgacguugaucgccaucg

SEQ ID NO: 3714203 - RNA, 23 nt, Salmonella enterica enterica serovar Typhi Ty2
aucgacuggcggaauggcgggcg

SEQ ID NO: 3714204 - RNA, 15 nt, Salmonella enterica enterica serovar Typhi Ty2
aucgagaucagacuu

SEQ ID NO: 3714205 - RNA, 18 nt, Salmonella enterica enterica serovar Typhi Ty2
aucgagcggcaguagcag

SEQ ID NO: 3714206 - RNA, 17 nt, Salmonella enterica enterica serovar Typhi Ty2
aucgaggccauauuuaa

SEQ ID NO: 3714207 - RNA, 16 nt, Salmonella enterica enterica serovar Typhi Ty2
aucgagucaggcgcca

SEQ ID NO: 3714208 - RNA, 21 nt, Salmonella enterica enterica serovar Typhi Ty2
aucgagugucaauaagccaga

SEQ ID NO: 3714209 - RNA, 14 nt, Salmonella enterica enterica serovar Typhi Ty2
aucgauaagccagc

SEQ ID NO: 3714210 - RNA, 14 nt, Salmonella enterica enterica serovar Typhi Ty2
aucgauaauugcuc

SEQ ID NO: 3714211 - RNA, 20 nt, Salmonella enterica enterica serovar Typhi Ty2
aucgauacagacgccaacgc

SEQ ID NO: 3714212 - RNA, 16 nt, Salmonella enterica enterica serovar Typhi Ty2
aucgauaguggcgauc

SEQ ID NO: 3714213 - RNA, 14 nt, Salmonella enterica enterica serovar Typhi Ty2
aucgauauaucgcg

SEQ ID NO: 3714214 - RNA, 19 nt, Salmonella enterica enterica serovar Typhi Ty2
aucgauauaucgcgucauc

SEQ ID NO: 3714215 - RNA, 22 nt, Salmonella enterica enterica serovar Typhi Ty2
aucgauccgcaucagcaacgcg

SEQ ID NO: 3714216 - RNA, 21 nt, Salmonella enterica enterica serovar Typhi Ty2
aucgauggcagucgcaucaug

SEQ ID NO: 3714217 - RNA, 14 nt, Salmonella enterica enterica serovar Typhi Ty2
aucgaugugauaaa

SEQ ID NO: 3714218 - RNA, 14 nt, Salmonella enterica enterica serovar Typhi Ty2
aucgcaaacgccag

SEQ ID NO: 3714219 - RNA, 15 nt, Salmonella enterica enterica serovar Typhi Ty2
aucgcaaauucugua

SEQ ID NO: 3714220 - RNA, 21 nt, Salmonella enterica enterica serovar Typhi Ty2
aucgcaacgccggugccugcc

SEQ ID NO: 3714221 - RNA, 21 nt, Salmonella enterica enterica serovar Typhi Ty2
aucgcacagagaucgugcauc

SEQ ID NO: 3714222 - RNA, 21 nt, Salmonella enterica enterica serovar Typhi Ty2
aucgcacuggcgccugcgccu

SEQ ID NO: 3714223 - RNA, 22 nt, Salmonella enterica enterica serovar Typhi Ty2
aucgcagaaauauuuugccugc

SEQ ID NO: 3714224 - RNA, 20 nt, Salmonella enterica enterica serovar Typhi Ty2
aucgcagagcguaauuccgc

SEQ ID NO: 3714225 - RNA, 21 nt, Salmonella enterica enterica serovar Typhi Ty2
aucgcagagcguaauuccgca

SEQ ID NO: 3714226 - RNA, 16 nt, Salmonella enterica enterica serovar Typhi Ty2
aucgcaggaugcgcug

SEQ ID NO: 3714227 - RNA, 18 nt, Salmonella enterica enterica serovar Typhi Ty2
aucgcauaaauauccggg

SEQ ID NO: 3714228 - RNA, 23 nt, Salmonella enterica enterica serovar Typhi Ty2
aucgcauagacgcccugcaaagc

SEQ ID NO: 3714229 - RNA, 22 nt, Salmonella enterica enterica serovar Typhi Ty2
aucgcauuaacguccauaccgg

SEQ ID NO: 3714230 - RNA, 22 nt, Salmonella enterica enterica serovar Typhi Ty2
aucgcauugagcaggggcuccu

SEQ ID NO: 3714231 - RNA, 12 nt, Salmonella enterica enterica serovar Typhi Ty2
aucgccaaacca

SEQ ID NO: 3714232 - RNA, 19 nt, Salmonella enterica enterica serovar Typhi Ty2
aucgccaaagcguaaacag

SEQ ID NO: 3714233 - RNA, 17 nt, Salmonella enterica enterica serovar Typhi Ty2
aucgccaacgaccggcg

SEQ ID NO: 3714234 - RNA, 23 nt, Salmonella enterica enterica serovar Typhi Ty2
aucgccacgauagacagcaccau

SEQ ID NO: 3714235 - RNA, 14 nt, Salmonella enterica enterica serovar Typhi Ty2
aucgccagauaaau

SEQ ID NO: 3714236 - RNA, 15 nt, Salmonella enterica enterica serovar Typhi Ty2
aucgccagcacguuu

SEQ ID NO: 3714237 - RNA, 12 nt, Salmonella enterica enterica serovar Typhi Ty2
aucgccagcgcg

SEQ ID NO: 3714238 - RNA, 12 nt, Salmonella enterica enterica serovar Typhi Ty2
aucgccagcuuc

SEQ ID NO: 3714239 - RNA, 17 nt, Salmonella enterica enterica serovar Typhi Ty2
aucgccauauacgccac

SEQ ID NO: 3714240 - RNA, 14 nt, Salmonella enterica enterica serovar Typhi Ty2
aucgccauccugca

SEQ ID NO: 3714241 - RNA, 19 nt, Salmonella enterica enterica serovar Typhi Ty2
aucgccauccugcaccgua

SEQ ID NO: 3714242 - RNA, 21 nt, Salmonella enterica enterica serovar Typhi Ty2
aucgccaucgauagcagcgcu

SEQ ID NO: 3714243 - RNA, 13 nt, Salmonella enterica enterica serovar Typhi Ty2
aucgccauuacgc

SEQ ID NO: 3714244 - RNA, 16 nt, Salmonella enterica enterica serovar Typhi Ty2
aucgcccggccuccgg

SEQ ID NO: 3714245 - RNA, 24 nt, Salmonella enterica enterica serovar Typhi Ty2
aucgcccgguugcaauuccgccau

SEQ ID NO: 3714246 - RNA, 17 nt, Salmonella enterica enterica serovar Typhi Ty2
aucgccgaaagcgauca

SEQ ID NO: 3714247 - RNA, 16 nt, Salmonella enterica enterica serovar Typhi Ty2
aucgccgaagcggcag

SEQ ID NO: 3714248 - RNA, 18 nt, Salmonella enterica enterica serovar Typhi Ty2
aucgccgacuaauuauuu

SEQ ID NO: 3714249 - RNA, 19 nt, Salmonella enterica enterica serovar Typhi Ty2
aucgccgaucacaaaguca

SEQ ID NO: 3714250 - RNA, 15 nt, Salmonella enterica enterica serovar Typhi Ty2
aucgccgccagcuca

SEQ ID NO: 3714251 - RNA, 13 nt, Salmonella enterica enterica serovar Typhi Ty2
aucgccgccaucg

SEQ ID NO: 3714252 - RNA, 21 nt, Salmonella enterica enterica serovar Typhi Ty2
aucgccgcccaguggcaaaau

SEQ ID NO: 3714253 - RNA, 16 nt, Salmonella enterica enterica serovar Typhi Ty2
aucgccgcgacagucg

SEQ ID NO: 3714254 - RNA, 19 nt, Salmonella enterica enterica serovar Typhi Ty2
aucgccgcgacagucgcag

SEQ ID NO: 3714255 - RNA, 14 nt, Salmonella enterica enterica serovar Typhi Ty2
aucgccggagaucu

SEQ ID NO: 3714256 - RNA, 23 nt, Salmonella enterica enterica serovar Typhi Ty2
aucgccggcgucaucggcgccag

SEQ ID NO: 3714257 - RNA, 22 nt, Salmonella enterica enterica serovar Typhi Ty2
aucgccgguagcuucagcggcg

SEQ ID NO: 3714258 - RNA, 21 nt, Salmonella enterica enterica serovar Typhi Ty2
aucgccgguuuugguaucuuc

SEQ ID NO: 3714259 - RNA, 13 nt, Salmonella enterica enterica serovar Typhi Ty2
aucgccgugaucc

SEQ ID NO: 3714260 - RNA, 20 nt, Salmonella enterica enterica serovar Typhi Ty2
aucgccgugcucuucgugga

SEQ ID NO: 3714261 - RNA, 22 nt, Salmonella enterica enterica serovar Typhi Ty2
aucgccucccugccuaaagaaa

SEQ ID NO: 3714262 - RNA, 23 nt, Salmonella enterica enterica serovar Typhi Ty2
aucgccucccugccuaaagaaaa

SEQ ID NO: 3714263 - RNA, 16 nt, Salmonella enterica enterica serovar Typhi Ty2
aucgccugauggcgac

SEQ ID NO: 3714264 - RNA, 16 nt, Salmonella enterica enterica serovar Typhi Ty2
aucgccugccagcgcu

SEQ ID NO: 3714265 - RNA, 18 nt, Salmonella enterica enterica serovar Typhi Ty2
aucgccugcgcgccugac

SEQ ID NO: 3714266 - RNA, 14 nt, Salmonella enterica enterica serovar Typhi Ty2
aucgccuggagcug

SEQ ID NO: 3714267 - RNA, 19 nt, Salmonella enterica enterica serovar Typhi Ty2
aucgcgagcacuuuuuccu

SEQ ID NO: 3714268 - RNA, 20 nt, Salmonella enterica enterica serovar Typhi Ty2
aucgcgauuccggacaacgc

SEQ ID NO: 3714269 - RNA, 16 nt, Salmonella enterica enterica serovar Typhi Ty2
aucgcgcacaugcugu

SEQ ID NO: 3714270 - RNA, 16 nt, Salmonella enterica enterica serovar Typhi Ty2
aucgcgcagacagugg

SEQ ID NO: 3714271 - RNA, 12 nt, Salmonella enterica enterica serovar Typhi Ty2
aucgcgccaucg

SEQ ID NO: 3714272 - RNA, 23 nt, Salmonella enterica enterica serovar Typhi Ty2
aucgugcaagcccaacuauuuua

SEQ ID NO: 3714273 - RNA, 16 nt, Salmonella enterica enterica serovar Typhi Ty2
aucgugccaugaccau

SEQ ID NO: 3714274 - RNA, 19 nt, Salmonella enterica enterica serovar Typhi Ty2
aucgugccguccggcauca

SEQ ID NO: 3714275 - RNA, 17 nt, Salmonella enterica enterica serovar Typhi Ty2
aucgugguacgcggcga

SEQ ID NO: 3714276 - RNA, 22 nt, Salmonella enterica enterica serovar Typhi Ty2
aucguguuauuuucaaaaacaa

SEQ ID NO: 3714277 - RNA, 13 nt, Salmonella enterica enterica serovar Typhi Ty2
aucguuauauaua

SEQ ID NO: 3714278 - RNA, 16 nt, Salmonella enterica enterica serovar Typhi Ty2
aucguuauccagcagc

SEQ ID NO: 3714279 - RNA, 18 nt, Salmonella enterica enterica serovar Typhi Ty2
aucguuauccagcagcca

SEQ ID NO: 3714280 - RNA, 19 nt, Salmonella enterica enterica serovar Typhi Ty2
aucguuauuaaacagacaa

SEQ ID NO: 3714281 - RNA, 18 nt, Salmonella enterica enterica serovar Typhi Ty2
aucguucgccagugacaa

SEQ ID NO: 3714282 - RNA, 22 nt, Salmonella enterica enterica serovar Typhi Ty2
aucguucgcccuucaucuucca

SEQ ID NO: 3714283 - RNA, 14 nt, Salmonella enterica enterica serovar Typhi Ty2
aucguugccgccgu

SEQ ID NO: 3714284 - RNA, 22 nt, Salmonella enterica enterica serovar Typhi Ty2
aucguugccgccgucgccgaau

SEQ ID NO: 3714285 - RNA, 17 nt, Salmonella enterica enterica serovar Typhi Ty2
aucguugcgcgcaauca

SEQ ID NO: 3714286 - RNA, 21 nt, Salmonella enterica enterica serovar Typhi Ty2
aucguuuuaucucuuuugcuu

SEQ ID NO: 3714287 - RNA, 17 nt, Salmonella enterica enterica serovar Typhi Ty2
aucguuuucuaacgagg

SEQ ID NO: 3714288 - RNA, 13 nt, Salmonella enterica enterica serovar Typhi Ty2
aucguuuuucuuc

SEQ ID NO: 3714289 - RNA, 17 nt, Salmonella enterica enterica serovar Typhi Ty2
aucuaaaauuauuuuua

SEQ ID NO: 3714290 - RNA, 18 nt, Salmonella enterica enterica serovar Typhi Ty2
aucuacaaacgcggacau

SEQ ID NO: 3714291 - RNA, 17 nt, Salmonella enterica enterica serovar Typhi Ty2
aucuauauauucuucuu

SEQ ID NO: 3714292 - RNA, 20 nt, Salmonella enterica enterica serovar Typhi Ty2
aucuauuuagcguauaguac

SEQ ID NO: 3714293 - RNA, 15 nt, Salmonella enterica enterica serovar Typhi Ty2
aucucaagccccaug

SEQ ID NO: 3714294 - RNA, 17 nt, Salmonella enterica enterica serovar Typhi Ty2
aucucaauaccacgccg

SEQ ID NO: 3714295 - RNA, 18 nt, Salmonella enterica enterica serovar Typhi Ty2
aucucagauaauagcugc

SEQ ID NO: 3714296 - RNA, 13 nt, Salmonella enterica enterica serovar Typhi Ty2
aucucauaaaccg

SEQ ID NO: 3714297 - RNA, 18 nt, Salmonella enterica enterica serovar Typhi Ty2
aucucauaaacgccugga

SEQ ID NO: 3714298 - RNA, 18 nt, Salmonella enterica enterica serovar Typhi Ty2
aucucauaaaugcugucg

SEQ ID NO: 3714299 - RNA, 19 nt, Salmonella enterica enterica serovar Typhi Ty2
aucucaucagacuguaugu

SEQ ID NO: 3714300 - RNA, 19 nt, Salmonella enterica enterica serovar Typhi Ty2
aucucaucugcaaaauaua

SEQ ID NO: 3714301 - RNA, 11 nt, Salmonella enterica enterica serovar Typhi Ty2
aucuccagcau

SEQ ID NO: 3714302 - RNA, 21 nt, Salmonella enterica enterica serovar Typhi Ty2
aucuccagcgcauugccuuuc

SEQ ID NO: 3714303 - RNA, 16 nt, Salmonella enterica enterica serovar Typhi Ty2
aucuccaguuguucac

SEQ ID NO: 3714304 - RNA, 13 nt, Salmonella enterica enterica serovar Typhi Ty2
aucuccaucucca

SEQ ID NO: 3714305 - RNA, 23 nt, Salmonella enterica enterica serovar Typhi Ty2
aucucccaggccgccaccgccuc

SEQ ID NO: 3714306 - RNA, 19 nt, Salmonella enterica enterica serovar Typhi Ty2
aucuccgccgcuuuaucgu

SEQ ID NO: 3714307 - RNA, 16 nt, Salmonella enterica enterica serovar Typhi Ty2
aucuccggcaucucaa

SEQ ID NO: 3714308 - RNA, 22 nt, Salmonella enterica enterica serovar Typhi Ty2
aucuccgggaaaaacgugucca

SEQ ID NO: 3714309 - RNA, 22 nt, Salmonella enterica enterica serovar Typhi Ty2
aucuccuccucauucagcggcu

SEQ ID NO: 3714310 - RNA, 18 nt, Salmonella enterica enterica serovar Typhi Ty2
aucuccucgcacuggcga

SEQ ID NO: 3714311 - RNA, 12 nt, Salmonella enterica enterica serovar Typhi Ty2
aucuccugacau

SEQ ID NO: 3714312 - RNA, 19 nt, Salmonella enterica enterica serovar Typhi Ty2
aucuccugacauagcucac

SEQ ID NO: 3714313 - RNA, 17 nt, Salmonella enterica enterica serovar Typhi Ty2
aucuccuguaaugaggc

SEQ ID NO: 3714314 - RNA, 18 nt, Salmonella enterica enterica serovar Typhi Ty2
aucuccuguaaugaggca

SEQ ID NO: 3714315 - RNA, 16 nt, Salmonella enterica enterica serovar Typhi Ty2
aucuccuuuaaugaag

SEQ ID NO: 3714316 - RNA, 12 nt, Salmonella enterica enterica serovar Typhi Ty2
aucucgccuggc

SEQ ID NO: 3714317 - RNA, 22 nt, Salmonella enterica enterica serovar Typhi Ty2
aucucguuuuacgccuucggcg

SEQ ID NO: 3714318 - RNA, 14 nt, Salmonella enterica enterica serovar Typhi Ty2
aucucuacgccggc

SEQ ID NO: 3714319 - RNA, 18 nt, Salmonella enterica enterica serovar Typhi Ty2
aucucuacuuuccugaag

SEQ ID NO: 3714320 - RNA, 14 nt, Salmonella enterica enterica serovar Typhi Ty2
aucucuccccccuc

SEQ ID NO: 3714321 - RNA, 15 nt, Salmonella enterica enterica serovar Typhi Ty2
aucucuggcggcgua

SEQ ID NO: 3714322 - RNA, 16 nt, Salmonella enterica enterica serovar Typhi Ty2
aucucugucgaccauc

SEQ ID NO: 3714323 - RNA, 14 nt, Salmonella enterica enterica serovar Typhi Ty2
aucucuuaauguaa

SEQ ID NO: 3714324 - RNA, 17 nt, Salmonella enterica enterica serovar Typhi Ty2
aucucuugcauaauauc

SEQ ID NO: 3714325 - RNA, 19 nt, Salmonella enterica enterica serovar Typhi Ty2
aucucuugcauaauaucca

SEQ ID NO: 3714326 - RNA, 17 nt, Salmonella enterica enterica serovar Typhi Ty2
aucucuuuuaauuuucu

SEQ ID NO: 3714327 - RNA, 15 nt, Salmonella enterica enterica serovar Typhi Ty2
aucucuuuugcggcg

SEQ ID NO: 3714328 - RNA, 13 nt, Salmonella enterica enterica serovar Typhi Ty2
aucucuuuuucuc

SEQ ID NO: 3714329 - RNA, 21 nt, Salmonella enterica enterica serovar Typhi Ty2
aucugaacucuuccagauacg

SEQ ID NO: 3714330 - RNA, 13 nt, Salmonella enterica enterica serovar Typhi Ty2
aucugaauaccuu

SEQ ID NO: 3714331 - RNA, 15 nt, Salmonella enterica enterica serovar Typhi Ty2
aucugacagauaucu

SEQ ID NO: 3714332 - RNA, 18 nt, Salmonella enterica enterica serovar Typhi Ty2
aucugacaucagaaaaua

SEQ ID NO: 3714333 - RNA, 16 nt, Salmonella enterica enterica serovar Typhi Ty2
aucugacgcggcgccg

SEQ ID NO: 3714334 - RNA, 18 nt, Salmonella enterica enterica serovar Typhi Ty2
aucugacugcgugagugu

SEQ ID NO: 3714335 - RNA, 19 nt, Salmonella enterica enterica serovar Typhi Ty2
aucugagcugguuucuccg

SEQ ID NO: 3714336 - RNA, 14 nt, Salmonella enterica enterica serovar Typhi Ty2
aucugaugauuaau

SEQ ID NO: 3714337 - RNA, 14 nt, Salmonella enterica enterica serovar Typhi Ty2
aucugaugccugaa

SEQ ID NO: 3714338 - RNA, 20 nt, Salmonella enterica enterica serovar Typhi Ty2
aucugaugccugaaggcgcu

SEQ ID NO: 3714339 - RNA, 17 nt, Salmonella enterica enterica serovar Typhi Ty2
aucugauucaauuaaug

SEQ ID NO: 3714340 - RNA, 13 nt, Salmonella enterica enterica serovar Typhi Ty2
aucugcaaaauau

SEQ ID NO: 3714341 - RNA, 21 nt, Salmonella enterica enterica serovar Typhi Ty2
aucugcacaacauuccgcuuc

SEQ ID NO: 3714342 - RNA, 20 nt, Salmonella enterica enterica serovar Typhi Ty2
aucugcacguaccugcucca

SEQ ID NO: 3714343 - RNA, 16 nt, Salmonella enterica enterica serovar Typhi Ty2
aucugcaugcgcugga

SEQ ID NO: 3714344 - RNA, 20 nt, Salmonella enterica enterica serovar Typhi Ty2
aucugcauguaguaagccau

SEQ ID NO: 3714345 - RNA, 20 nt, Salmonella enterica enterica serovar Typhi Ty2
aucugccagccgauuuuucg

SEQ ID NO: 3714346 - RNA, 16 nt, Salmonella enterica enterica serovar Typhi Ty2
aucugccauuucugcu

SEQ ID NO: 3714347 - RNA, 14 nt, Salmonella enterica enterica serovar Typhi Ty2
aucugcccuuucuu

SEQ ID NO: 3714348 - RNA, 17 nt, Salmonella enterica enterica serovar Typhi Ty2
aucugcccuuucuuaug

SEQ ID NO: 3714349 - RNA, 20 nt, Salmonella enterica enterica serovar Typhi Ty2
aucugccgcgcccgccaucg

SEQ ID NO: 3714350 - RNA, 24 nt, Salmonella enterica enterica serovar Typhi Ty2
aucugccucaacaaguccuucuuc

SEQ ID NO: 3714351 - RNA, 16 nt, Salmonella enterica enterica serovar Typhi Ty2
aucugcgcauuaacgc

SEQ ID NO: 3714352 - RNA, 19 nt, Salmonella enterica enterica serovar Typhi Ty2
aucugcgccggcugcgcug

SEQ ID NO: 3714353 - RNA, 22 nt, Salmonella enterica enterica serovar Typhi Ty2
aucugcgccggcugcgcugcca

SEQ ID NO: 3714354 - RNA, 21 nt, Salmonella enterica enterica serovar Typhi Ty2
augaagccuuagcgggaggug

SEQ ID NO: 3714355 - RNA, 16 nt, Salmonella enterica enterica serovar Typhi Ty2
augaagcggaaaggac

SEQ ID NO: 3714356 - RNA, 14 nt, Salmonella enterica enterica serovar Typhi Ty2
augaagcgucauca

SEQ ID NO: 3714357 - RNA, 23 nt, Salmonella enterica enterica serovar Typhi Ty2
augaagcugcagggauaugcuga

SEQ ID NO: 3714358 - RNA, 23 nt, Salmonella enterica enterica serovar Typhi Ty2
augaaggauacggaauggauaac

SEQ ID NO: 3714359 - RNA, 16 nt, Salmonella enterica enterica serovar Typhi Ty2
augaaggguaaaacgu

SEQ ID NO: 3714360 - RNA, 21 nt, Salmonella enterica enterica serovar Typhi Ty2
augaaggguauauaaaucaaa

SEQ ID NO: 3714361 - RNA, 18 nt, Salmonella enterica enterica serovar Typhi Ty2
augaauaaaugaauuauu

SEQ ID NO: 3714362 - RNA, 13 nt, Salmonella enterica enterica serovar Typhi Ty2
augaauaauaaua

SEQ ID NO: 3714363 - RNA, 20 nt, Salmonella enterica enterica serovar Typhi Ty2
augaauacgcaagccgaacu

SEQ ID NO: 3714364 - RNA, 22 nt, Salmonella enterica enterica serovar Typhi Ty2
augaauauccgccgcccagcgg

SEQ ID NO: 3714365 - RNA, 16 nt, Salmonella enterica enterica serovar Typhi Ty2
augaaucaucgguaaa

SEQ ID NO: 3714366 - RNA, 23 nt, Salmonella enterica enterica serovar Typhi Ty2
augaaucgcgugcgcugcggcca

SEQ ID NO: 3714367 - RNA, 19 nt, Salmonella enterica enterica serovar Typhi Ty2
augaaugccggauggcggc

SEQ ID NO: 3714368 - RNA, 12 nt, Salmonella enterica enterica serovar Typhi Ty2
augaauuauuuu

SEQ ID NO: 3714369 - RNA, 23 nt, Salmonella enterica enterica serovar Typhi Ty2
augaauuuauggagucaugaaug

SEQ ID NO: 3714370 - RNA, 21 nt, Salmonella enterica enterica serovar Typhi Ty2
augacaaagccggauaucgcu

SEQ ID NO: 3714371 - RNA, 13 nt, Salmonella enterica enterica serovar Typhi Ty2
augacagaaagcg

SEQ ID NO: 3714372 - RNA, 16 nt, Salmonella enterica enterica serovar Typhi Ty2
augacaucgcaaugcc

SEQ ID NO: 3714373 - RNA, 19 nt, Salmonella enterica enterica serovar Typhi Ty2
augaccaccgcaucggcau

SEQ ID NO: 3714374 - RNA, 16 nt, Salmonella enterica enterica serovar Typhi Ty2
augaccagcgcccaca

SEQ ID NO: 3714375 - RNA, 20 nt, Salmonella enterica enterica serovar Typhi Ty2
augaccaucaaauaauacgc

SEQ ID NO: 3714376 - RNA, 22 nt, Salmonella enterica enterica serovar Typhi Ty2
augaccauuaacgccagcgauc

SEQ ID NO: 3714377 - RNA, 13 nt, Salmonella enterica enterica serovar Typhi Ty2
augaccauucaca

SEQ ID NO: 3714378 - RNA, 17 nt, Salmonella enterica enterica serovar Typhi Ty2
augaccccuccggccag

SEQ ID NO: 3714379 - RNA, 19 nt, Salmonella enterica enterica serovar Typhi Ty2
augaccgaacuuacgcaca

SEQ ID NO: 3714380 - RNA, 16 nt, Salmonella enterica enterica serovar Typhi Ty2
augaccgcacagcaga

SEQ ID NO: 3714381 - RNA, 15 nt, Salmonella enterica enterica serovar Typhi Ty2
augaccgccuuuuuu

SEQ ID NO: 3714382 - RNA, 21 nt, Salmonella enterica enterica serovar Typhi Ty2
augaccugggcgccagagagc

SEQ ID NO: 3714383 - RNA, 18 nt, Salmonella enterica enterica serovar Typhi Ty2
augaccuggugcaucaua

SEQ ID NO: 3714384 - RNA, 13 nt, Salmonella enterica enterica serovar Typhi Ty2
augacgaacagga

SEQ ID NO: 3714385 - RNA, 23 nt, Salmonella enterica enterica serovar Typhi Ty2
augacgaacaggauauuaccgcc

SEQ ID NO: 3714386 - RNA, 14 nt, Salmonella enterica enterica serovar Typhi Ty2
augacgaccucauc

SEQ ID NO: 3714387 - RNA, 19 nt, Salmonella enterica enterica serovar Typhi Ty2
augacgcccugcgccagca

SEQ ID NO: 3714388 - RNA, 20 nt, Salmonella enterica enterica serovar Typhi Ty2
augacggacgcagaccaaag

SEQ ID NO: 3714389 - RNA, 13 nt, Salmonella enterica enterica serovar Typhi Ty2
augacggcagggg

SEQ ID NO: 3714390 - RNA, 19 nt, Salmonella enterica enterica serovar Typhi Ty2
augacgguauugcuuucaa

SEQ ID NO: 3714391 - RNA, 14 nt, Salmonella enterica enterica serovar Typhi Ty2
augacgucagcaag

SEQ ID NO: 3714392 - RNA, 14 nt, Salmonella enterica enterica serovar Typhi Ty2
augacguccaggcc

SEQ ID NO: 3714393 - RNA, 15 nt, Salmonella enterica enterica serovar Typhi Ty2
augacuaauggcauu

SEQ ID NO: 3714394 - RNA, 14 nt, Salmonella enterica enterica serovar Typhi Ty2
augacucaaacaga

SEQ ID NO: 3714395 - RNA, 18 nt, Salmonella enterica enterica serovar Typhi Ty2
augacucauuaaaaaaac

SEQ ID NO: 3714396 - RNA, 19 nt, Salmonella enterica enterica serovar Typhi Ty2
augacucauuaaaaaaaca

SEQ ID NO: 3714397 - RNA, 18 nt, Salmonella enterica enterica serovar Typhi Ty2
augagaaaaggaagaaua

SEQ ID NO: 3714398 - RNA, 13 nt, Salmonella enterica enterica serovar Typhi Ty2
augagaagaaaaa

SEQ ID NO: 3714399 - RNA, 16 nt, Salmonella enterica enterica serovar Typhi Ty2
augagaagggcaauau

SEQ ID NO: 3714400 - RNA, 22 nt, Salmonella enterica enterica serovar Typhi Ty2
augagauacgucaucaugcugc

SEQ ID NO: 3714401 - RNA, 18 nt, Salmonella enterica enterica serovar Typhi Ty2
augagcaaacugcucauu

SEQ ID NO: 3714402 - RNA, 21 nt, Salmonella enterica enterica serovar Typhi Ty2
augagcacgcggaagaaauag

SEQ ID NO: 3714403 - RNA, 12 nt, Salmonella enterica enterica serovar Typhi Ty2
augagcaggcca

SEQ ID NO: 3714404 - RNA, 15 nt, Salmonella enterica enterica serovar Typhi Ty2
augagcgcaggcgag

SEQ ID NO: 3714405 - RNA, 17 nt, Salmonella enterica enterica serovar Typhi Ty2
augagcucaaauaugau

SEQ ID NO: 3714406 - RNA, 20 nt, Salmonella enterica enterica serovar Typhi Ty2
augaggacggcccgcugucu

SEQ ID NO: 3714407 - RNA, 20 nt, Salmonella enterica enterica serovar Typhi Ty2
augaggauauugguaucaaa

SEQ ID NO: 3714408 - RNA, 18 nt, Salmonella enterica enterica serovar Typhi Ty2
augaggcaaaucccugau

SEQ ID NO: 3714409 - RNA, 23 nt, Salmonella enterica enterica serovar Typhi Ty2
augaggccagaaggcgaacauaa

SEQ ID NO: 3714410 - RNA, 20 nt, Salmonella enterica enterica serovar Typhi Ty2
augaggcgcagccgccaucc

SEQ ID NO: 3714411 - RNA, 23 nt, Salmonella enterica enterica serovar Typhi Ty2
augaguauauagcgcuccuuuaa

SEQ ID NO: 3714412 - RNA, 17 nt, Salmonella enterica enterica serovar Typhi Ty2
augagucgcgcgcgcca

SEQ ID NO: 3714413 - RNA, 15 nt, Salmonella enterica enterica serovar Typhi Ty2
augaguuaacgacug

SEQ ID NO: 3714414 - RNA, 17 nt, Salmonella enterica enterica serovar Typhi Ty2
augauaagccugacuac

SEQ ID NO: 3714415 - RNA, 19 nt, Salmonella enterica enterica serovar Typhi Ty2
augauaauuguuaauuauu

SEQ ID NO: 3714416 - RNA, 20 nt, Salmonella enterica enterica serovar Typhi Ty2
augauacguggcucaaggau

SEQ ID NO: 3714417 - RNA, 19 nt, Salmonella enterica enterica serovar Typhi Ty2
augauagcgccauauaaau

SEQ ID NO: 3714418 - RNA, 22 nt, Salmonella enterica enterica serovar Typhi Ty2
augauaucgccaauggcgucgu

SEQ ID NO: 3714419 - RNA, 21 nt, Salmonella enterica enterica serovar Typhi Ty2
augauaucggccggaugccag

SEQ ID NO: 3714420 - RNA, 15 nt, Salmonella enterica enterica serovar Typhi Ty2
augaucaccaucuuc

SEQ ID NO: 3714421 - RNA, 21 nt, Salmonella enterica enterica serovar Typhi Ty2
augaucaccaucuucacauau

SEQ ID NO: 3714422 - RNA, 22 nt, Salmonella enterica enterica serovar Typhi Ty2
augaucaccaucuucacauauc

SEQ ID NO: 3714423 - RNA, 20 nt, Salmonella enterica enterica serovar Typhi Ty2
augaucacuuccgccaccac

SEQ ID NO: 3714424 - RNA, 23 nt, Salmonella enterica enterica serovar Typhi Ty2
augaucagcgacgguccuggcca

SEQ ID NO: 3714425 - RNA, 15 nt, Salmonella enterica enterica serovar Typhi Ty2
augaucauacugccg

SEQ ID NO: 3714426 - RNA, 13 nt, Salmonella enterica enterica serovar Typhi Ty2
augaucgacaaug

SEQ ID NO: 3714427 - RNA, 16 nt, Salmonella enterica enterica serovar Typhi Ty2
augaucgcccagccac

SEQ ID NO: 3714428 - RNA, 17 nt, Salmonella enterica enterica serovar Typhi Ty2
augaucguuuccagcau

SEQ ID NO: 3714429 - RNA, 18 nt, Salmonella enterica enterica serovar Typhi Ty2
augaucguuuccagcauc

SEQ ID NO: 3714430 - RNA, 19 nt, Salmonella enterica enterica serovar Typhi Ty2
augaucguuuuuuguugau

SEQ ID NO: 3714431 - RNA, 19 nt, Salmonella enterica enterica serovar Typhi Ty2
augaucuuaccucuccuga

SEQ ID NO: 3714432 - RNA, 15 nt, Salmonella enterica enterica serovar Typhi Ty2
augaucuuuccuuuu

SEQ ID NO: 3714433 - RNA, 14 nt, Salmonella enterica enterica serovar Typhi Ty2
augaugaaaaagaa

SEQ ID NO: 3714434 - RNA, 14 nt, Salmonella enterica enterica serovar Typhi Ty2
augaugaauauuuu

SEQ ID NO: 3714435 - RNA, 13 nt, Salmonella enterica enterica serovar Typhi Ty2
augaugagcgcca

SEQ ID NO: 3714436 - RNA, 21 nt, Salmonella enterica enterica serovar Typhi Ty2
augccgcacuccccagaauga

SEQ ID NO: 3714437 - RNA, 20 nt, Salmonella enterica enterica serovar Typhi Ty2
augccgccauccgacacagc

SEQ ID NO: 3714438 - RNA, 22 nt, Salmonella enterica enterica serovar Typhi Ty2
augccgcccaggccaugcgccg

SEQ ID NO: 3714439 - RNA, 15 nt, Salmonella enterica enterica serovar Typhi Ty2
augccgccgcaacgc

SEQ ID NO: 3714440 - RNA, 13 nt, Salmonella enterica enterica serovar Typhi Ty2
augccgccgccag

SEQ ID NO: 3714441 - RNA, 18 nt, Salmonella enterica enterica serovar Typhi Ty2
augccgccuuuaucgaca

SEQ ID NO: 3714442 - RNA, 17 nt, Salmonella enterica enterica serovar Typhi Ty2
augccgcgucaggagcg

SEQ ID NO: 3714443 - RNA, 21 nt, Salmonella enterica enterica serovar Typhi Ty2
augccgcuggccgaugucaau

SEQ ID NO: 3714444 - RNA, 20 nt, Salmonella enterica enterica serovar Typhi Ty2
augccgcuggcguauucgcc

SEQ ID NO: 3714445 - RNA, 22 nt, Salmonella enterica enterica serovar Typhi Ty2
augccggauaguuacccggcaa

SEQ ID NO: 3714446 - RNA, 15 nt, Salmonella enterica enterica serovar Typhi Ty2
augccgggcaaaaaa

SEQ ID NO: 3714447 - RNA, 23 nt, Salmonella enterica enterica serovar Typhi Ty2
augccggugcgagaaaaagcaau

SEQ ID NO: 3714448 - RNA, 19 nt, Salmonella enterica enterica serovar Typhi Ty2
augccgguuuuagcaauga

SEQ ID NO: 3714449 - RNA, 16 nt, Salmonella enterica enterica serovar Typhi Ty2
augccguagcggccau

SEQ ID NO: 3714450 - RNA, 19 nt, Salmonella enterica enterica serovar Typhi Ty2
augccguccauccggcgua

SEQ ID NO: 3714451 - RNA, 14 nt, Salmonella enterica enterica serovar Typhi Ty2
augccgugaguaau

SEQ ID NO: 3714452 - RNA, 21 nt, Salmonella enterica enterica serovar Typhi Ty2
augccguucuuuaaucagauu

SEQ ID NO: 3714453 - RNA, 18 nt, Salmonella enterica enterica serovar Typhi Ty2
augccguuggcuuuggcu

SEQ ID NO: 3714454 - RNA, 24 nt, Salmonella enterica enterica serovar Typhi Ty2
augccuaaaccgacaauauucgcc

SEQ ID NO: 3714455 - RNA, 20 nt, Salmonella enterica enterica serovar Typhi Ty2
augccuaacguguuaucgcu

SEQ ID NO: 3714456 - RNA, 20 nt, Salmonella enterica enterica serovar Typhi Ty2
augccugcgcauccucuuuc

SEQ ID NO: 3714457 - RNA, 13 nt, Salmonella enterica enterica serovar Typhi Ty2
augccugcgcuuu

SEQ ID NO: 3714458 - RNA, 19 nt, Salmonella enterica enterica serovar Typhi Ty2
augccuggggucgucagcg

SEQ ID NO: 3714459 - RNA, 23 nt, Salmonella enterica enterica serovar Typhi Ty2
augccuguguaucgcccugccag

SEQ ID NO: 3714460 - RNA, 22 nt, Salmonella enterica enterica serovar Typhi Ty2
augccuuauccggccugcaggc

SEQ ID NO: 3714461 - RNA, 13 nt, Salmonella enterica enterica serovar Typhi Ty2
augccuucgccgc

SEQ ID NO: 3714462 - RNA, 16 nt, Salmonella enterica enterica serovar Typhi Ty2
augcgaauaacaucau

SEQ ID NO: 3714463 - RNA, 15 nt, Salmonella enterica enterica serovar Typhi Ty2
augcgaauaaucgcc

SEQ ID NO: 3714464 - RNA, 16 nt, Salmonella enterica enterica serovar Typhi Ty2
augcgaaugcuggcug

SEQ ID NO: 3714465 - RNA, 16 nt, Salmonella enterica enterica serovar Typhi Ty2
augcgacuaaccugau

SEQ ID NO: 3714466 - RNA, 19 nt, Salmonella enterica enterica serovar Typhi Ty2
augcgaucguaaucacccg

SEQ ID NO: 3714467 - RNA, 17 nt, Salmonella enterica enterica serovar Typhi Ty2
augcgcagaaacugauc

SEQ ID NO: 3714468 - RNA, 20 nt, Salmonella enterica enterica serovar Typhi Ty2
augcgcagaaacugaucgaa

SEQ ID NO: 3714469 - RNA, 15 nt, Salmonella enterica enterica serovar Typhi Ty2
augcgcaugggcaua

SEQ ID NO: 3714470 - RNA, 21 nt, Salmonella enterica enterica serovar Typhi Ty2
augcgccacgacuaucgucac

SEQ ID NO: 3714471 - RNA, 19 nt, Salmonella enterica enterica serovar Typhi Ty2
augcgccagccagucgcca

SEQ ID NO: 3714472 - RNA, 23 nt, Salmonella enterica enterica serovar Typhi Ty2
augcgccagccagucgccaggca

SEQ ID NO: 3714473 - RNA, 13 nt, Salmonella enterica enterica serovar Typhi Ty2
augcgccagcggc

SEQ ID NO: 3714474 - RNA, 12 nt, Salmonella enterica enterica serovar Typhi Ty2
augcgccaggca

SEQ ID NO: 3714475 - RNA, 15 nt, Salmonella enterica enterica serovar Typhi Ty2
augcgccaggugacg

SEQ ID NO: 3714476 - RNA, 19 nt, Salmonella enterica enterica serovar Typhi Ty2
augcgccaucccaugcacc

SEQ ID NO: 3714477 - RNA, 12 nt, Salmonella enterica enterica serovar Typhi Ty2
augcgcccagcc

SEQ ID NO: 3714478 - RNA, 22 nt, Salmonella enterica enterica serovar Typhi Ty2
augcgccccgcuucccgaaagg

SEQ ID NO: 3714479 - RNA, 18 nt, Salmonella enterica enterica serovar Typhi Ty2
augcgccccggcggcgua

SEQ ID NO: 3714480 - RNA, 21 nt, Salmonella enterica enterica serovar Typhi Ty2
augcgccgcccaccgccaacc

SEQ ID NO: 3714481 - RNA, 19 nt, Salmonella enterica enterica serovar Typhi Ty2
augcgccgcgucagcacau

SEQ ID NO: 3714482 - RNA, 13 nt, Salmonella enterica enterica serovar Typhi Ty2
augcgccugcaau

SEQ ID NO: 3714483 - RNA, 14 nt, Salmonella enterica enterica serovar Typhi Ty2
augcgccugucucc

SEQ ID NO: 3714484 - RNA, 17 nt, Salmonella enterica enterica serovar Typhi Ty2
augcgccuguuagggcg

SEQ ID NO: 3714485 - RNA, 16 nt, Salmonella enterica enterica serovar Typhi Ty2
augcgcguagcccaca

SEQ ID NO: 3714486 - RNA, 18 nt, Salmonella enterica enterica serovar Typhi Ty2
augcgcguagcccacagg

SEQ ID NO: 3714487 - RNA, 21 nt, Salmonella enterica enterica serovar Typhi Ty2
augcgcgucccggcagugcau

SEQ ID NO: 3714488 - RNA, 22 nt, Salmonella enterica enterica serovar Typhi Ty2
augcgcgugcgguuuuccugau

SEQ ID NO: 3714489 - RNA, 16 nt, Salmonella enterica enterica serovar Typhi Ty2
augcgcguugccgcca

SEQ ID NO: 3714490 - RNA, 16 nt, Salmonella enterica enterica serovar Typhi Ty2
augcgcuagcuggcag

SEQ ID NO: 3714491 - RNA, 15 nt, Salmonella enterica enterica serovar Typhi Ty2
augcgcugaauagcg

SEQ ID NO: 3714492 - RNA, 17 nt, Salmonella enterica enterica serovar Typhi Ty2
augcgcuuccagcauga

SEQ ID NO: 3714493 - RNA, 13 nt, Salmonella enterica enterica serovar Typhi Ty2
augcgcuuuccgc

SEQ ID NO: 3714494 - RNA, 21 nt, Salmonella enterica enterica serovar Typhi Ty2
augcggaaaccaguucacgcg

SEQ ID NO: 3714495 - RNA, 21 nt, Salmonella enterica enterica serovar Typhi Ty2
augcggauaaagcgaucggcc

SEQ ID NO: 3714496 - RNA, 13 nt, Salmonella enterica enterica serovar Typhi Ty2
augcggcuagcgc

SEQ ID NO: 3714497 - RNA, 19 nt, Salmonella enterica enterica serovar Typhi Ty2
augcggcuuugcgccggca

SEQ ID NO: 3714498 - RNA, 18 nt, Salmonella enterica enterica serovar Typhi Ty2
augcgggcgaucggcugu

SEQ ID NO: 3714499 - RNA, 18 nt, Salmonella enterica enterica serovar Typhi Ty2
augcgggggcaguaaauu

SEQ ID NO: 3714500 - RNA, 22 nt, Salmonella enterica enterica serovar Typhi Ty2
augcguaccugcgcgcaggucu

SEQ ID NO: 3714501 - RNA, 20 nt, Salmonella enterica enterica serovar Typhi Ty2
augcguagggugaugccuuc

SEQ ID NO: 3714502 - RNA, 22 nt, Salmonella enterica enterica serovar Typhi Ty2
augcgucagcgcggcuuccagu

SEQ ID NO: 3714503 - RNA, 16 nt, Salmonella enterica enterica serovar Typhi Ty2
augcguccgcccagaa

SEQ ID NO: 3714504 - RNA, 20 nt, Salmonella enterica enterica serovar Typhi Ty2
augcgucgcauccuuaugca

SEQ ID NO: 3714505 - RNA, 17 nt, Salmonella enterica enterica serovar Typhi Ty2
augcguuguaccguuuu

SEQ ID NO: 3714506 - RNA, 13 nt, Salmonella enterica enterica serovar Typhi Ty2
augcuaaaacaga

SEQ ID NO: 3714507 - RNA, 21 nt, Salmonella enterica enterica serovar Typhi Ty2
augcuauaccgcccgcgcuuu

SEQ ID NO: 3714508 - RNA, 16 nt, Salmonella enterica enterica serovar Typhi Ty2
augcuauaugcaggca

SEQ ID NO: 3714509 - RNA, 13 nt, Salmonella enterica enterica serovar Typhi Ty2
augcuaucccagg

SEQ ID NO: 3714510 - RNA, 13 nt, Salmonella enterica enterica serovar Typhi Ty2
augcuaucgcgga

SEQ ID NO: 3714511 - RNA, 14 nt, Salmonella enterica enterica serovar Typhi Ty2
augcuaucgcggau

SEQ ID NO: 3714512 - RNA, 22 nt, Salmonella enterica enterica serovar Typhi Ty2
augcuaucgguaguguuaucgc

SEQ ID NO: 3714513 - RNA, 19 nt, Salmonella enterica enterica serovar Typhi Ty2
augcucaccgcgaauauac

SEQ ID NO: 3714514 - RNA, 15 nt, Salmonella enterica enterica serovar Typhi Ty2
augcucaggcaacac

SEQ ID NO: 3714515 - RNA, 15 nt, Salmonella enterica enterica serovar Typhi Ty2
augcucauuauuugg

SEQ ID NO: 3714516 - RNA, 21 nt, Salmonella enterica enterica serovar Typhi Ty2
augcuccaguuguuccagcag

SEQ ID NO: 3714517 - RNA, 21 nt, Salmonella enterica enterica serovar Typhi Ty2
augcucuccuggcauggcucg

SEQ ID NO: 3714518 - RNA, 17 nt, Salmonella enterica enterica serovar Typhi Ty2
auggcgguuccggggaa

SEQ ID NO: 3714519 - RNA, 14 nt, Salmonella enterica enterica serovar Typhi Ty2
auggcguagcgcca

SEQ ID NO: 3714520 - RNA, 18 nt, Salmonella enterica enterica serovar Typhi Ty2
auggcgucgcuacgggcg

SEQ ID NO: 3714521 - RNA, 17 nt, Salmonella enterica enterica serovar Typhi Ty2
auggcgucggcgacuuu

SEQ ID NO: 3714522 - RNA, 15 nt, Salmonella enterica enterica serovar Typhi Ty2
auggcgucgugcagc

SEQ ID NO: 3714523 - RNA, 17 nt, Salmonella enterica enterica serovar Typhi Ty2
auggcuaugaagcugga

SEQ ID NO: 3714524 - RNA, 16 nt, Salmonella enterica enterica serovar Typhi Ty2
auggcucagauugaac

SEQ ID NO: 3714525 - RNA, 23 nt, Salmonella enterica enterica serovar Typhi Ty2
auggcugcgauaaugaagcauaa

SEQ ID NO: 3714526 - RNA, 17 nt, Salmonella enterica enterica serovar Typhi Ty2
auggcuugugaauacca

SEQ ID NO: 3714527 - RNA, 20 nt, Salmonella enterica enterica serovar Typhi Ty2
auggcuuucagauuagccag

SEQ ID NO: 3714528 - RNA, 13 nt, Salmonella enterica enterica serovar Typhi Ty2
auggcuuugcugu

SEQ ID NO: 3714529 - RNA, 19 nt, Salmonella enterica enterica serovar Typhi Ty2
augggauaacgcagaagac

SEQ ID NO: 3714530 - RNA, 22 nt, Salmonella enterica enterica serovar Typhi Ty2
augggauaacgcagaagacaga

SEQ ID NO: 3714531 - RNA, 18 nt, Salmonella enterica enterica serovar Typhi Ty2
augggauagugccugccg

SEQ ID NO: 3714532 - RNA, 16 nt, Salmonella enterica enterica serovar Typhi Ty2
augggauugcaaaaaa

SEQ ID NO: 3714533 - RNA, 18 nt, Salmonella enterica enterica serovar Typhi Ty2
augggauuugaugcccaa

SEQ ID NO: 3714534 - RNA, 18 nt, Salmonella enterica enterica serovar Typhi Ty2
augggccaaccugccgau

SEQ ID NO: 3714535 - RNA, 17 nt, Salmonella enterica enterica serovar Typhi Ty2
augggccuacgccugga

SEQ ID NO: 3714536 - RNA, 23 nt, Salmonella enterica enterica serovar Typhi Ty2
augggcgaaaacggcgcaggcaa

SEQ ID NO: 3714537 - RNA, 15 nt, Salmonella enterica enterica serovar Typhi Ty2
augggcuucuucacu

SEQ ID NO: 3714538 - RNA, 14 nt, Salmonella enterica enterica serovar Typhi Ty2
auggggagcagcau

SEQ ID NO: 3714539 - RNA, 17 nt, Salmonella enterica enterica serovar Typhi Ty2
auggggaucgucugcaa

SEQ ID NO: 3714540 - RNA, 19 nt, Salmonella enterica enterica serovar Typhi Ty2
auggggauuaagcgagcgc

SEQ ID NO: 3714541 - RNA, 16 nt, Salmonella enterica enterica serovar Typhi Ty2
auggggcaagcucagc

SEQ ID NO: 3714542 - RNA, 22 nt, Salmonella enterica enterica serovar Typhi Ty2
augggguuuguccugcagcgcc

SEQ ID NO: 3714543 - RNA, 23 nt, Salmonella enterica enterica serovar Typhi Ty2
auggguaaaaauauggcgggccu

SEQ ID NO: 3714544 - RNA, 23 nt, Salmonella enterica enterica serovar Typhi Ty2
auggguaucgccuucgacuuccg

SEQ ID NO: 3714545 - RNA, 20 nt, Salmonella enterica enterica serovar Typhi Ty2
augggucacauccagacagc

SEQ ID NO: 3714546 - RNA, 14 nt, Salmonella enterica enterica serovar Typhi Ty2
augguaaaauccuu

SEQ ID NO: 3714547 - RNA, 23 nt, Salmonella enterica enterica serovar Typhi Ty2
augguaaaauuauugugagaaaa

SEQ ID NO: 3714548 - RNA, 21 nt, Salmonella enterica enterica serovar Typhi Ty2
augguacaccaggaguuaaac

SEQ ID NO: 3714549 - RNA, 20 nt, Salmonella enterica enterica serovar Typhi Ty2
augguacucaacaucauuaa

SEQ ID NO: 3714550 - RNA, 19 nt, Salmonella enterica enterica serovar Typhi Ty2
augguaggccugauaagcg

SEQ ID NO: 3714551 - RNA, 22 nt, Salmonella enterica enterica serovar Typhi Ty2
augguauaaaucccggugggga

SEQ ID NO: 3714552 - RNA, 12 nt, Salmonella enterica enterica serovar Typhi Ty2
augguauuuauu

SEQ ID NO: 3714553 - RNA, 16 nt, Salmonella enterica enterica serovar Typhi Ty2
augguauuucagaccg

SEQ ID NO: 3714554 - RNA, 20 nt, Salmonella enterica enterica serovar Typhi Ty2
augguauuucagaccgugcu

SEQ ID NO: 3714555 - RNA, 17 nt, Salmonella enterica enterica serovar Typhi Ty2
auggucccugauauaca

SEQ ID NO: 3714556 - RNA, 20 nt, Salmonella enterica enterica serovar Typhi Ty2
auggucgaaaauaucggccu

SEQ ID NO: 3714557 - RNA, 22 nt, Salmonella enterica enterica serovar Typhi Ty2
auggucgccuccguaugaccgc

SEQ ID NO: 3714558 - RNA, 18 nt, Salmonella enterica enterica serovar Typhi Ty2
auggucgcgccaaaagag

SEQ ID NO: 3714559 - RNA, 19 nt, Salmonella enterica enterica serovar Typhi Ty2
auggucguauuuuggcgcu

SEQ ID NO: 3714560 - RNA, 17 nt, Salmonella enterica enterica serovar Typhi Ty2
auggucucaaucgcaaa

SEQ ID NO: 3714561 - RNA, 20 nt, Salmonella enterica enterica serovar Typhi Ty2
auggucucguugccauuggu

SEQ ID NO: 3714562 - RNA, 21 nt, Salmonella enterica enterica serovar Typhi Ty2
auggucucguugccauugguu

SEQ ID NO: 3714563 - RNA, 16 nt, Salmonella enterica enterica serovar Typhi Ty2
auggucuguaccacca

SEQ ID NO: 3714564 - RNA, 21 nt, Salmonella enterica enterica serovar Typhi Ty2
auggucuguaccaccagaauc

SEQ ID NO: 3714565 - RNA, 13 nt, Salmonella enterica enterica serovar Typhi Ty2
auggugcucagcc

SEQ ID NO: 3714566 - RNA, 19 nt, Salmonella enterica enterica serovar Typhi Ty2
augguggagggguauuuau

SEQ ID NO: 3714567 - RNA, 22 nt, Salmonella enterica enterica serovar Typhi Ty2
augguuaaauuaaauaacaaau

SEQ ID NO: 3714568 - RNA, 18 nt, Salmonella enterica enterica serovar Typhi Ty2
augguugaacaggcugug

SEQ ID NO: 3714569 - RNA, 23 nt, Salmonella enterica enterica serovar Typhi Ty2
augguugacuuacaaaaaauaca

SEQ ID NO: 3714570 - RNA, 22 nt, Salmonella enterica enterica serovar Typhi Ty2
augguuuugcccauuuccugca

SEQ ID NO: 3714571 - RNA, 16 nt, Salmonella enterica enterica serovar Typhi Ty2
auguaaaaaaauaaaa

SEQ ID NO: 3714572 - RNA, 19 nt, Salmonella enterica enterica serovar Typhi Ty2
auguaaaaaaauaaaaaag

SEQ ID NO: 3714573 - RNA, 13 nt, Salmonella enterica enterica serovar Typhi Ty2
auguaaaacaaga

SEQ ID NO: 3714574 - RNA, 18 nt, Salmonella enterica enterica serovar Typhi Ty2
auguaaacuccauuaaau

SEQ ID NO: 3714575 - RNA, 19 nt, Salmonella enterica enterica serovar Typhi Ty2
auguaaacuccauuaaauu

SEQ ID NO: 3714576 - RNA, 22 nt, Salmonella enterica enterica serovar Typhi Ty2
auguaaagucggccauuuuuuu

SEQ ID NO: 3714577 - RNA, 12 nt, Salmonella enterica enterica serovar Typhi Ty2
auguaaaugacg

SEQ ID NO: 3714578 - RNA, 18 nt, Salmonella enterica enterica serovar Typhi Ty2
auguaauuugcaaaccau

SEQ ID NO: 3714579 - RNA, 19 nt, Salmonella enterica enterica serovar Typhi Ty2
auguacagaaugguauuau

SEQ ID NO: 3714580 - RNA, 18 nt, Salmonella enterica enterica serovar Typhi Ty2
auguaccauugucaaaaa

SEQ ID NO: 3714581 - RNA, 13 nt, Salmonella enterica enterica serovar Typhi Ty2
auguagccagcca

SEQ ID NO: 3714582 - RNA, 20 nt, Salmonella enterica enterica serovar Typhi Ty2
auguaggccgggcaagcgaa

SEQ ID NO: 3714583 - RNA, 20 nt, Salmonella enterica enterica serovar Typhi Ty2
auguaguccgggugcaaauc

SEQ ID NO: 3714584 - RNA, 21 nt, Salmonella enterica enterica serovar Typhi Ty2
auguaguuguucuuuuuaugg

SEQ ID NO: 3714585 - RNA, 20 nt, Salmonella enterica enterica serovar Typhi Ty2
auguaucgcgcuuacacaga

SEQ ID NO: 3714586 - RNA, 22 nt, Salmonella enterica enterica serovar Typhi Ty2
auguauucucccgucagcaaca

SEQ ID NO: 3714587 - RNA, 15 nt, Salmonella enterica enterica serovar Typhi Ty2
auguauuucagacuu

SEQ ID NO: 3714588 - RNA, 16 nt, Salmonella enterica enterica serovar Typhi Ty2
augucaacuuaaacgu

SEQ ID NO: 3714589 - RNA, 16 nt, Salmonella enterica enterica serovar Typhi Ty2
augucaguaauauauu

SEQ ID NO: 3714590 - RNA, 14 nt, Salmonella enterica enterica serovar Typhi Ty2
augucauaauugcc

SEQ ID NO: 3714591 - RNA, 20 nt, Salmonella enterica enterica serovar Typhi Ty2
augucauccgguucacccac

SEQ ID NO: 3714592 - RNA, 14 nt, Salmonella enterica enterica serovar Typhi Ty2
augucaucguuugc

SEQ ID NO: 3714593 - RNA, 17 nt, Salmonella enterica enterica serovar Typhi Ty2
augucaugacuuaacgu

SEQ ID NO: 3714594 - RNA, 19 nt, Salmonella enterica enterica serovar Typhi Ty2
auguccaggcgacaugaca

SEQ ID NO: 3714595 - RNA, 17 nt, Salmonella enterica enterica serovar Typhi Ty2
auguccauaaauagauc

SEQ ID NO: 3714596 - RNA, 18 nt, Salmonella enterica enterica serovar Typhi Ty2
auguccaucagauucaac

SEQ ID NO: 3714597 - RNA, 17 nt, Salmonella enterica enterica serovar Typhi Ty2
auguccaucucuuuacc

SEQ ID NO: 3714598 - RNA, 16 nt, Salmonella enterica enterica serovar Typhi Ty2
augucccaguaauauc

SEQ ID NO: 3714599 - RNA, 17 nt, Salmonella enterica enterica serovar Typhi Ty2
auuaaguuuuuuuaaaa

SEQ ID NO: 3714600 - RNA, 16 nt, Salmonella enterica enterica serovar Typhi Ty2
auuaauaaaauuuuug

SEQ ID NO: 3714601 - RNA, 17 nt, Salmonella enterica enterica serovar Typhi Ty2
auuaauaaacaaugcag

SEQ ID NO: 3714602 - RNA, 13 nt, Salmonella enterica enterica serovar Typhi Ty2
auuaauacccaua

SEQ ID NO: 3714603 - RNA, 14 nt, Salmonella enterica enterica serovar Typhi Ty2
auuaauaucagccc

SEQ ID NO: 3714604 - RNA, 14 nt, Salmonella enterica enterica serovar Typhi Ty2
auuaauaugcgcaa

SEQ ID NO: 3714605 - RNA, 19 nt, Salmonella enterica enterica serovar Typhi Ty2
auuaauaugcgcaaucacc

SEQ ID NO: 3714606 - RNA, 18 nt, Salmonella enterica enterica serovar Typhi Ty2
auuaauauuuaacacauu

SEQ ID NO: 3714607 - RNA, 18 nt, Salmonella enterica enterica serovar Typhi Ty2
auuaaucccaacccgacc

SEQ ID NO: 3714608 - RNA, 21 nt, Salmonella enterica enterica serovar Typhi Ty2
auuaauccccggcgaaagaaa

SEQ ID NO: 3714609 - RNA, 12 nt, Salmonella enterica enterica serovar Typhi Ty2
auuaaucgccag

SEQ ID NO: 3714610 - RNA, 18 nt, Salmonella enterica enterica serovar Typhi Ty2
auuaaucugugagcacag

SEQ ID NO: 3714611 - RNA, 20 nt, Salmonella enterica enterica serovar Typhi Ty2
auuaaugaauaaaugaauua

SEQ ID NO: 3714612 - RNA, 17 nt, Salmonella enterica enterica serovar Typhi Ty2
auuaaugauuaaaauaa

SEQ ID NO: 3714613 - RNA, 18 nt, Salmonella enterica enterica serovar Typhi Ty2
auuaaugauuaaaauaaa

SEQ ID NO: 3714614 - RNA, 15 nt, Salmonella enterica enterica serovar Typhi Ty2
auuaaugauuugcuu

SEQ ID NO: 3714615 - RNA, 12 nt, Salmonella enterica enterica serovar Typhi Ty2
auuaauggcgau

SEQ ID NO: 3714616 - RNA, 21 nt, Salmonella enterica enterica serovar Typhi Ty2
auuaauucuuuuaacauaagu

SEQ ID NO: 3714617 - RNA, 14 nt, Salmonella enterica enterica serovar Typhi Ty2
auuacaaaaaucau

SEQ ID NO: 3714618 - RNA, 20 nt, Salmonella enterica enterica serovar Typhi Ty2
auuacaaaauaagucauauc

SEQ ID NO: 3714619 - RNA, 16 nt, Salmonella enterica enterica serovar Typhi Ty2
auuacaaacaggcuuu

SEQ ID NO: 3714620 - RNA, 17 nt, Salmonella enterica enterica serovar Typhi Ty2
auuacaaagggcaauau

SEQ ID NO: 3714621 - RNA, 21 nt, Salmonella enterica enterica serovar Typhi Ty2
auuacaaagggcaauauauua

SEQ ID NO: 3714622 - RNA, 18 nt, Salmonella enterica enterica serovar Typhi Ty2
auuacaacauguccuaca

SEQ ID NO: 3714623 - RNA, 16 nt, Salmonella enterica enterica serovar Typhi Ty2
auuacaaguaauaaaa

SEQ ID NO: 3714624 - RNA, 18 nt, Salmonella enterica enterica serovar Typhi Ty2
auuacaaguaauaaaaua

SEQ ID NO: 3714625 - RNA, 23 nt, Salmonella enterica enterica serovar Typhi Ty2
auuacagacagucuggauauaaa

SEQ ID NO: 3714626 - RNA, 18 nt, Salmonella enterica enterica serovar Typhi Ty2
auuacagccgcgaugcua

SEQ ID NO: 3714627 - RNA, 19 nt, Salmonella enterica enterica serovar Typhi Ty2
auuacagcguguucaugcg

SEQ ID NO: 3714628 - RNA, 18 nt, Salmonella enterica enterica serovar Typhi Ty2
auuacagguguuaaucau

SEQ ID NO: 3714629 - RNA, 20 nt, Salmonella enterica enterica serovar Typhi Ty2
auuacagguguuaaucauuu

SEQ ID NO: 3714630 - RNA, 18 nt, Salmonella enterica enterica serovar Typhi Ty2
auuacaucaauaaacauu

SEQ ID NO: 3714631 - RNA, 20 nt, Salmonella enterica enterica serovar Typhi Ty2
auuacaugccguuaauaaug

SEQ ID NO: 3714632 - RNA, 16 nt, Salmonella enterica enterica serovar Typhi Ty2
auuaccaguacggaaa

SEQ ID NO: 3714633 - RNA, 15 nt, Salmonella enterica enterica serovar Typhi Ty2
auuaccauuccucac

SEQ ID NO: 3714634 - RNA, 18 nt, Salmonella enterica enterica serovar Typhi Ty2
auuaccccgugguggggu

SEQ ID NO: 3714635 - RNA, 12 nt, Salmonella enterica enterica serovar Typhi Ty2
auuaccgcaucg

SEQ ID NO: 3714636 - RNA, 14 nt, Salmonella enterica enterica serovar Typhi Ty2
auuaccgcuauuca

SEQ ID NO: 3714637 - RNA, 20 nt, Salmonella enterica enterica serovar Typhi Ty2
auuaccgcucguuaauccaa

SEQ ID NO: 3714638 - RNA, 15 nt, Salmonella enterica enterica serovar Typhi Ty2
auuaccggacggucg

SEQ ID NO: 3714639 - RNA, 17 nt, Salmonella enterica enterica serovar Typhi Ty2
auuaccggcugccgaua

SEQ ID NO: 3714640 - RNA, 16 nt, Salmonella enterica enterica serovar Typhi Ty2
auuaccugguauuauu

SEQ ID NO: 3714641 - RNA, 18 nt, Salmonella enterica enterica serovar Typhi Ty2
auuacgaaaaggucuuuc

SEQ ID NO: 3714642 - RNA, 22 nt, Salmonella enterica enterica serovar Typhi Ty2
auuacgacugcacccaucuuua

SEQ ID NO: 3714643 - RNA, 14 nt, Salmonella enterica enterica serovar Typhi Ty2
auuacgcaugguca

SEQ ID NO: 3714644 - RNA, 20 nt, Salmonella enterica enterica serovar Typhi Ty2
auuacgcccauuaugccgca

SEQ ID NO: 3714645 - RNA, 11 nt, Salmonella enterica enterica serovar Typhi Ty2
auuacgcgccu

SEQ ID NO: 3714646 - RNA, 16 nt, Salmonella enterica enterica serovar Typhi Ty2
auuacgcuauaaaguu

SEQ ID NO: 3714647 - RNA, 15 nt, Salmonella enterica enterica serovar Typhi Ty2
auuacggguaaugau

SEQ ID NO: 3714648 - RNA, 22 nt, Salmonella enterica enterica serovar Typhi Ty2
auuacguguaguuauaaauuua

SEQ ID NO: 3714649 - RNA, 21 nt, Salmonella enterica enterica serovar Typhi Ty2
auuacguuggggauaaccaga

SEQ ID NO: 3714650 - RNA, 22 nt, Salmonella enterica enterica serovar Typhi Ty2
auuacguuggggauaaccagaa

SEQ ID NO: 3714651 - RNA, 17 nt, Salmonella enterica enterica serovar Typhi Ty2
auuacguuuucccugag

SEQ ID NO: 3714652 - RNA, 21 nt, Salmonella enterica enterica serovar Typhi Ty2
auuacucguccuucacguuau

SEQ ID NO: 3714653 - RNA, 23 nt, Salmonella enterica enterica serovar Typhi Ty2
auuacugcguaaaccauuucucc

SEQ ID NO: 3714654 - RNA, 13 nt, Salmonella enterica enterica serovar Typhi Ty2
auuacuggaucau

SEQ ID NO: 3714655 - RNA, 15 nt, Salmonella enterica enterica serovar Typhi Ty2
auuacuucaggcugc

SEQ ID NO: 3714656 - RNA, 15 nt, Salmonella enterica enterica serovar Typhi Ty2
auuagacuucuucca

SEQ ID NO: 3714657 - RNA, 18 nt, Salmonella enterica enterica serovar Typhi Ty2
auuagaggcguaaguaaa

SEQ ID NO: 3714658 - RNA, 20 nt, Salmonella enterica enterica serovar Typhi Ty2
auuagaggucagaauaacuc

SEQ ID NO: 3714659 - RNA, 19 nt, Salmonella enterica enterica serovar Typhi Ty2
auuagaugcgaauaagcug

SEQ ID NO: 3714660 - RNA, 21 nt, Salmonella enterica enterica serovar Typhi Ty2
auuagcaauugccauaaaaac

SEQ ID NO: 3714661 - RNA, 12 nt, Salmonella enterica enterica serovar Typhi Ty2
auuagccgccag

SEQ ID NO: 3714662 - RNA, 20 nt, Salmonella enterica enterica serovar Typhi Ty2
auuagcgaggaacgcgcaga

SEQ ID NO: 3714663 - RNA, 13 nt, Salmonella enterica enterica serovar Typhi Ty2
auuagcuuuuuac

SEQ ID NO: 3714664 - RNA, 20 nt, Salmonella enterica enterica serovar Typhi Ty2
auuaggcguaaaauugccgc

SEQ ID NO: 3714665 - RNA, 19 nt, Salmonella enterica enterica serovar Typhi Ty2
auuaggcguaauuauuaca

SEQ ID NO: 3714666 - RNA, 21 nt, Salmonella enterica enterica serovar Typhi Ty2
auuagggggcgggcugaaauc

SEQ ID NO: 3714667 - RNA, 13 nt, Salmonella enterica enterica serovar Typhi Ty2
auuaguaauauca

SEQ ID NO: 3714668 - RNA, 14 nt, Salmonella enterica enterica serovar Typhi Ty2
auuaguaauaucag

SEQ ID NO: 3714669 - RNA, 15 nt, Salmonella enterica enterica serovar Typhi Ty2
auuauaaagcauaaa

SEQ ID NO: 3714670 - RNA, 16 nt, Salmonella enterica enterica serovar Typhi Ty2
auuauauagucuuaau

SEQ ID NO: 3714671 - RNA, 13 nt, Salmonella enterica enterica serovar Typhi Ty2
auuauauuuaaaa

SEQ ID NO: 3714672 - RNA, 17 nt, Salmonella enterica enterica serovar Typhi Ty2
auuauauuuaaaauucc

SEQ ID NO: 3714673 - RNA, 14 nt, Salmonella enterica enterica serovar Typhi Ty2
auuaucaaaaguga

SEQ ID NO: 3714674 - RNA, 15 nt, Salmonella enterica enterica serovar Typhi Ty2
auuaucaaaagugau

SEQ ID NO: 3714675 - RNA, 20 nt, Salmonella enterica enterica serovar Typhi Ty2
auuaucaauuucauauuauu

SEQ ID NO: 3714676 - RNA, 17 nt, Salmonella enterica enterica serovar Typhi Ty2
auuaucagaaggcuuga

SEQ ID NO: 3714677 - RNA, 13 nt, Salmonella enterica enterica serovar Typhi Ty2
auuaucaggauga

SEQ ID NO: 3714678 - RNA, 20 nt, Salmonella enterica enterica serovar Typhi Ty2
auuaucauaaugucccugcc

SEQ ID NO: 3714679 - RNA, 18 nt, Salmonella enterica enterica serovar Typhi Ty2
auuauccacaaacuccag

SEQ ID NO: 3714680 - RNA, 23 nt, Salmonella enterica enterica serovar Typhi Ty2
auuauccagccgaaguucauaaa

SEQ ID NO: 3714681 - RNA, 20 nt, Salmonella enterica enterica serovar Typhi Ty2
auuccauauaacagaauaag

SEQ ID NO: 3714682 - RNA, 22 nt, Salmonella enterica enterica serovar Typhi Ty2
auucccacgcauaguccugccg

SEQ ID NO: 3714683 - RNA, 13 nt, Salmonella enterica enterica serovar Typhi Ty2
auucccagcgccc

SEQ ID NO: 3714684 - RNA, 22 nt, Salmonella enterica enterica serovar Typhi Ty2
auucccaguaaccuauuuuaca

SEQ ID NO: 3714685 - RNA, 16 nt, Salmonella enterica enterica serovar Typhi Ty2
auucccauuccugcaa

SEQ ID NO: 3714686 - RNA, 17 nt, Salmonella enterica enterica serovar Typhi Ty2
auuccccaccaggaaug

SEQ ID NO: 3714687 - RNA, 13 nt, Salmonella enterica enterica serovar Typhi Ty2
auucccccugcgu

SEQ ID NO: 3714688 - RNA, 18 nt, Salmonella enterica enterica serovar Typhi Ty2
auucccggcggaaaugcg

SEQ ID NO: 3714689 - RNA, 15 nt, Salmonella enterica enterica serovar Typhi Ty2
auucccguaaaagaa

SEQ ID NO: 3714690 - RNA, 18 nt, Salmonella enterica enterica serovar Typhi Ty2
auucccguaaaagaagaa

SEQ ID NO: 3714691 - RNA, 21 nt, Salmonella enterica enterica serovar Typhi Ty2
auucccguaucuucauguucu

SEQ ID NO: 3714692 - RNA, 21 nt, Salmonella enterica enterica serovar Typhi Ty2
auuccgcgcuaucgguaucau

SEQ ID NO: 3714693 - RNA, 15 nt, Salmonella enterica enterica serovar Typhi Ty2
auuccgcuuccagaa

SEQ ID NO: 3714694 - RNA, 16 nt, Salmonella enterica enterica serovar Typhi Ty2
auuccgcuucuuccau

SEQ ID NO: 3714695 - RNA, 14 nt, Salmonella enterica enterica serovar Typhi Ty2
auuccggcacaacc

SEQ ID NO: 3714696 - RNA, 14 nt, Salmonella enterica enterica serovar Typhi Ty2
auuccggcgcuggc

SEQ ID NO: 3714697 - RNA, 16 nt, Salmonella enterica enterica serovar Typhi Ty2
auuccgucauggugau

SEQ ID NO: 3714698 - RNA, 17 nt, Salmonella enterica enterica serovar Typhi Ty2
auuccgugucugaauga

SEQ ID NO: 3714699 - RNA, 16 nt, Salmonella enterica enterica serovar Typhi Ty2
auuccucagaauccgu

SEQ ID NO: 3714700 - RNA, 18 nt, Salmonella enterica enterica serovar Typhi Ty2
auuccucgaucgccuggc

SEQ ID NO: 3714701 - RNA, 19 nt, Salmonella enterica enterica serovar Typhi Ty2
auuccugaguaaugaucau

SEQ ID NO: 3714702 - RNA, 14 nt, Salmonella enterica enterica serovar Typhi Ty2
auuccugcauguuu

SEQ ID NO: 3714703 - RNA, 20 nt, Salmonella enterica enterica serovar Typhi Ty2
auuccuggcguaugcuuuca

SEQ ID NO: 3714704 - RNA, 13 nt, Salmonella enterica enterica serovar Typhi Ty2
auuccuuaucaca

SEQ ID NO: 3714705 - RNA, 12 nt, Salmonella enterica enterica serovar Typhi Ty2
auuccuucggug

SEQ ID NO: 3714706 - RNA, 17 nt, Salmonella enterica enterica serovar Typhi Ty2
auuccuuguccgaugca

SEQ ID NO: 3714707 - RNA, 15 nt, Salmonella enterica enterica serovar Typhi Ty2
auuccuuuaaauauc

SEQ ID NO: 3714708 - RNA, 20 nt, Salmonella enterica enterica serovar Typhi Ty2
auuccuuuuuccgccaccug

SEQ ID NO: 3714709 - RNA, 18 nt, Salmonella enterica enterica serovar Typhi Ty2
auucgccccacacggcca

SEQ ID NO: 3714710 - RNA, 15 nt, Salmonella enterica enterica serovar Typhi Ty2
auucgccccagcaua

SEQ ID NO: 3714711 - RNA, 22 nt, Salmonella enterica enterica serovar Typhi Ty2
auucgcgccuagcgcgcgcagu

SEQ ID NO: 3714712 - RNA, 20 nt, Salmonella enterica enterica serovar Typhi Ty2
auucgcgcuaaaugacaaau

SEQ ID NO: 3714713 - RNA, 11 nt, Salmonella enterica enterica serovar Typhi Ty2
auucgcggcaa

SEQ ID NO: 3714714 - RNA, 14 nt, Salmonella enterica enterica serovar Typhi Ty2
auucgcuaauaaau

SEQ ID NO: 3714715 - RNA, 18 nt, Salmonella enterica enterica serovar Typhi Ty2
auucgcugacaucgugua

SEQ ID NO: 3714716 - RNA, 20 nt, Salmonella enterica enterica serovar Typhi Ty2
auucggaaugaugugcuauu

SEQ ID NO: 3714717 - RNA, 14 nt, Salmonella enterica enterica serovar Typhi Ty2
auucggcccugcgc

SEQ ID NO: 3714718 - RNA, 19 nt, Salmonella enterica enterica serovar Typhi Ty2
auucggccuucgguuuuau

SEQ ID NO: 3714719 - RNA, 16 nt, Salmonella enterica enterica serovar Typhi Ty2
auucggcgaaagaagc

SEQ ID NO: 3714720 - RNA, 17 nt, Salmonella enterica enterica serovar Typhi Ty2
auucggcgcuucgcagc

SEQ ID NO: 3714721 - RNA, 22 nt, Salmonella enterica enterica serovar Typhi Ty2
auucgggacaaacccccagcca

SEQ ID NO: 3714722 - RNA, 20 nt, Salmonella enterica enterica serovar Typhi Ty2
auucgguagcuguaccagau

SEQ ID NO: 3714723 - RNA, 21 nt, Salmonella enterica enterica serovar Typhi Ty2
auucgguagcuguaccagauc

SEQ ID NO: 3714724 - RNA, 17 nt, Salmonella enterica enterica serovar Typhi Ty2
auucgguaguuccagaa

SEQ ID NO: 3714725 - RNA, 15 nt, Salmonella enterica enterica serovar Typhi Ty2
auucgguggaaaccg

SEQ ID NO: 3714726 - RNA, 14 nt, Salmonella enterica enterica serovar Typhi Ty2
auucguaacaugcu

SEQ ID NO: 3714727 - RNA, 16 nt, Salmonella enterica enterica serovar Typhi Ty2
auucguuaccagcauc

SEQ ID NO: 3714728 - RNA, 15 nt, Salmonella enterica enterica serovar Typhi Ty2
auucguugacgcuau

SEQ ID NO: 3714729 - RNA, 17 nt, Salmonella enterica enterica serovar Typhi Ty2
auucuaaaaguaagcua

SEQ ID NO: 3714730 - RNA, 19 nt, Salmonella enterica enterica serovar Typhi Ty2
auucuaacauaaugaaucc

SEQ ID NO: 3714731 - RNA, 17 nt, Salmonella enterica enterica serovar Typhi Ty2
auucuacaaguucagua

SEQ ID NO: 3714732 - RNA, 21 nt, Salmonella enterica enterica serovar Typhi Ty2
auucuacaguuugucaucagu

SEQ ID NO: 3714733 - RNA, 17 nt, Salmonella enterica enterica serovar Typhi Ty2
auucucccaaauuuuuu

SEQ ID NO: 3714734 - RNA, 21 nt, Salmonella enterica enterica serovar Typhi Ty2
auucucccuacugcuuagcuc

SEQ ID NO: 3714735 - RNA, 14 nt, Salmonella enterica enterica serovar Typhi Ty2
auucucgcacuuua

SEQ ID NO: 3714736 - RNA, 19 nt, Salmonella enterica enterica serovar Typhi Ty2
auucucugcccccgagcca

SEQ ID NO: 3714737 - RNA, 14 nt, Salmonella enterica enterica serovar Typhi Ty2
auucucuucuacca

SEQ ID NO: 3714738 - RNA, 22 nt, Salmonella enterica enterica serovar Typhi Ty2
auucugaaaaggggauaacaac

SEQ ID NO: 3714739 - RNA, 18 nt, Salmonella enterica enterica serovar Typhi Ty2
auucugacgcagcuucug

SEQ ID NO: 3714740 - RNA, 21 nt, Salmonella enterica enterica serovar Typhi Ty2
auucugauuuuacuaaugaau

SEQ ID NO: 3714741 - RNA, 23 nt, Salmonella enterica enterica serovar Typhi Ty2
auucugcaucccgcuaaggccuu

SEQ ID NO: 3714742 - RNA, 16 nt, Salmonella enterica enterica serovar Typhi Ty2
auucugcgaaagccuc

SEQ ID NO: 3714743 - RNA, 13 nt, Salmonella enterica enterica serovar Typhi Ty2
auucugcgguaau

SEQ ID NO: 3714744 - RNA, 20 nt, Salmonella enterica enterica serovar Typhi Ty2
auucugcugaaaaagaacaa

SEQ ID NO: 3714745 - RNA, 13 nt, Salmonella enterica enterica serovar Typhi Ty2
auucugcugaugc

SEQ ID NO: 3714746 - RNA, 16 nt, Salmonella enterica enterica serovar Typhi Ty2
auucuggaaucaauuu

SEQ ID NO: 3714747 - RNA, 16 nt, Salmonella enterica enterica serovar Typhi Ty2
auucuguaacucauag

SEQ ID NO: 3714748 - RNA, 22 nt, Salmonella enterica enterica serovar Typhi Ty2
auucuguaucgcuuauuuucgu

SEQ ID NO: 3714749 - RNA, 17 nt, Salmonella enterica enterica serovar Typhi Ty2
auucuguguuuuuucgu

SEQ ID NO: 3714750 - RNA, 18 nt, Salmonella enterica enterica serovar Typhi Ty2
auucuguuagcgcccucu

SEQ ID NO: 3714751 - RNA, 17 nt, Salmonella enterica enterica serovar Typhi Ty2
auucuguuugucuuuau

SEQ ID NO: 3714752 - RNA, 18 nt, Salmonella enterica enterica serovar Typhi Ty2
auucuuaguccucagcga

SEQ ID NO: 3714753 - RNA, 18 nt, Salmonella enterica enterica serovar Typhi Ty2
auucuucgaaugucucaa

SEQ ID NO: 3714754 - RNA, 15 nt, Salmonella enterica enterica serovar Typhi Ty2
auucuucgucagaug

SEQ ID NO: 3714755 - RNA, 15 nt, Salmonella enterica enterica serovar Typhi Ty2
auucuucuuagaaua

SEQ ID NO: 3714756 - RNA, 23 nt, Salmonella enterica enterica serovar Typhi Ty2
auucuugcccuauaauaacaagc

SEQ ID NO: 3714757 - RNA, 15 nt, Salmonella enterica enterica serovar Typhi Ty2
auucuugccgcaucu

SEQ ID NO: 3714758 - RNA, 19 nt, Salmonella enterica enterica serovar Typhi Ty2
auucuuuaauuugugccag

SEQ ID NO: 3714759 - RNA, 19 nt, Salmonella enterica enterica serovar Typhi Ty2
auucuuucgcguaaacacu

SEQ ID NO: 3714760 - RNA, 17 nt, Salmonella enterica enterica serovar Typhi Ty2
auucuuuucacgcauug

SEQ ID NO: 3714761 - RNA, 20 nt, Salmonella enterica enterica serovar Typhi Ty2
auugaaaagcagccagaccc

SEQ ID NO: 3714762 - RNA, 15 nt, Salmonella enterica enterica serovar Typhi Ty2
auugaaacgcaucac

SEQ ID NO: 3714763 - RNA, 15 nt, Salmonella enterica enterica serovar Typhi Ty2
auuggggaaccuggc

SEQ ID NO: 3714764 - RNA, 14 nt, Salmonella enterica enterica serovar Typhi Ty2
auugguacaacgcc

SEQ ID NO: 3714765 - RNA, 17 nt, Salmonella enterica enterica serovar Typhi Ty2
auuggugaaaaaucauu

SEQ ID NO: 3714766 - RNA, 15 nt, Salmonella enterica enterica serovar Typhi Ty2
auuggugauauaaac

SEQ ID NO: 3714767 - RNA, 15 nt, Salmonella enterica enterica serovar Typhi Ty2
auuguaaaaccgacu

SEQ ID NO: 3714768 - RNA, 16 nt, Salmonella enterica enterica serovar Typhi Ty2
auuguagcugcgccag

SEQ ID NO: 3714769 - RNA, 13 nt, Salmonella enterica enterica serovar Typhi Ty2
auuguaugcaaga

SEQ ID NO: 3714770 - RNA, 18 nt, Salmonella enterica enterica serovar Typhi Ty2
auugucaccguaauauaa

SEQ ID NO: 3714771 - RNA, 16 nt, Salmonella enterica enterica serovar Typhi Ty2
auugucagaaucacau

SEQ ID NO: 3714772 - RNA, 20 nt, Salmonella enterica enterica serovar Typhi Ty2
auuguccacggggcggcaau

SEQ ID NO: 3714773 - RNA, 15 nt, Salmonella enterica enterica serovar Typhi Ty2
auugucgaauuccgc

SEQ ID NO: 3714774 - RNA, 18 nt, Salmonella enterica enterica serovar Typhi Ty2
auugucugcgcugggccg

SEQ ID NO: 3714775 - RNA, 15 nt, Salmonella enterica enterica serovar Typhi Ty2
auugucuuauuauua

SEQ ID NO: 3714776 - RNA, 15 nt, Salmonella enterica enterica serovar Typhi Ty2
auugugaaccauggc

SEQ ID NO: 3714777 - RNA, 18 nt, Salmonella enterica enterica serovar Typhi Ty2
auugugauuccaguuguc

SEQ ID NO: 3714778 - RNA, 15 nt, Salmonella enterica enterica serovar Typhi Ty2
auuguggaaauaaga

SEQ ID NO: 3714779 - RNA, 21 nt, Salmonella enterica enterica serovar Typhi Ty2
auuguggaucagacgccgcgc

SEQ ID NO: 3714780 - RNA, 17 nt, Salmonella enterica enterica serovar Typhi Ty2
auuguguuuaccucaua

SEQ ID NO: 3714781 - RNA, 18 nt, Salmonella enterica enterica serovar Typhi Ty2
auuguuacugguuuuuuc

SEQ ID NO: 3714782 - RNA, 14 nt, Salmonella enterica enterica serovar Typhi Ty2
auuguuccagguuu

SEQ ID NO: 3714783 - RNA, 18 nt, Salmonella enterica enterica serovar Typhi Ty2
auuguucuaaacguucau

SEQ ID NO: 3714784 - RNA, 18 nt, Salmonella enterica enterica serovar Typhi Ty2
auuguugggguuaucgcu

SEQ ID NO: 3714785 - RNA, 20 nt, Salmonella enterica enterica serovar Typhi Ty2
auuguuuaacguuucaugga

SEQ ID NO: 3714786 - RNA, 15 nt, Salmonella enterica enterica serovar Typhi Ty2
auuguuuggugcuga

SEQ ID NO: 3714787 - RNA, 17 nt, Salmonella enterica enterica serovar Typhi Ty2
auuguuuguagaaagug

SEQ ID NO: 3714788 - RNA, 19 nt, Salmonella enterica enterica serovar Typhi Ty2
auuguuuuacuuuuuuaaa

SEQ ID NO: 3714789 - RNA, 13 nt, Salmonella enterica enterica serovar Typhi Ty2
auuuaaaauucca

SEQ ID NO: 3714790 - RNA, 18 nt, Salmonella enterica enterica serovar Typhi Ty2
auuuaaagauagcugcuu

SEQ ID NO: 3714791 - RNA, 19 nt, Salmonella enterica enterica serovar Typhi Ty2
auuuaaauagcaauuauau

SEQ ID NO: 3714792 - RNA, 20 nt, Salmonella enterica enterica serovar Typhi Ty2
auuuaaauagcaauuauauu

SEQ ID NO: 3714793 - RNA, 17 nt, Salmonella enterica enterica serovar Typhi Ty2
auuuaaauaucgguuca

SEQ ID NO: 3714794 - RNA, 19 nt, Salmonella enterica enterica serovar Typhi Ty2
auuuaacccugguuugcug

SEQ ID NO: 3714795 - RNA, 20 nt, Salmonella enterica enterica serovar Typhi Ty2
auuuaacgaguugaauaacg

SEQ ID NO: 3714796 - RNA, 21 nt, Salmonella enterica enterica serovar Typhi Ty2
auuuaagccagacgcgcagca

SEQ ID NO: 3714797 - RNA, 13 nt, Salmonella enterica enterica serovar Typhi Ty2
auuuaauauauga

SEQ ID NO: 3714798 - RNA, 17 nt, Salmonella enterica enterica serovar Typhi Ty2
auuuaauauaugaacca

SEQ ID NO: 3714799 - RNA, 13 nt, Salmonella enterica enterica serovar Typhi Ty2
auuuaauauuuau

SEQ ID NO: 3714800 - RNA, 17 nt, Salmonella enterica enterica serovar Typhi Ty2
auuuaauggucuuaaau

SEQ ID NO: 3714801 - RNA, 22 nt, Salmonella enterica enterica serovar Typhi Ty2
auuuacaaaaaagauaaccauu

SEQ ID NO: 3714802 - RNA, 21 nt, Salmonella enterica enterica serovar Typhi Ty2
auuuacaaaugaccucaagaa

SEQ ID NO: 3714803 - RNA, 15 nt, Salmonella enterica enterica serovar Typhi Ty2
auuuaccacgguaac

SEQ ID NO: 3714804 - RNA, 11 nt, Salmonella enterica enterica serovar Typhi Ty2
auuuaccagug

SEQ ID NO: 3714805 - RNA, 17 nt, Salmonella enterica enterica serovar Typhi Ty2
auuuaccagugcuaaaa

SEQ ID NO: 3714806 - RNA, 15 nt, Salmonella enterica enterica serovar Typhi Ty2
auuuacgcagcccca

SEQ ID NO: 3714807 - RNA, 21 nt, Salmonella enterica enterica serovar Typhi Ty2
auuuacgccaacgagaauaag

SEQ ID NO: 3714808 - RNA, 14 nt, Salmonella enterica enterica serovar Typhi Ty2
auuuacugaauaaa

SEQ ID NO: 3714809 - RNA, 16 nt, Salmonella enterica enterica serovar Typhi Ty2
auuuacugaauaaaua

SEQ ID NO: 3714810 - RNA, 22 nt, Salmonella enterica enterica serovar Typhi Ty2
auuuagcuauuccaaaauaaua

SEQ ID NO: 3714811 - RNA, 15 nt, Salmonella enterica enterica serovar Typhi Ty2
auuuaggucuuguca

SEQ ID NO: 3714812 - RNA, 13 nt, Salmonella enterica enterica serovar Typhi Ty2
auuuauaacguau

SEQ ID NO: 3714813 - RNA, 16 nt, Salmonella enterica enterica serovar Typhi Ty2
auuuauauugugccuc

SEQ ID NO: 3714814 - RNA, 14 nt, Salmonella enterica enterica serovar Typhi Ty2
auuuaucaauaacc

SEQ ID NO: 3714815 - RNA, 17 nt, Salmonella enterica enterica serovar Typhi Ty2
auuuaucaaucugcuuu

SEQ ID NO: 3714816 - RNA, 14 nt, Salmonella enterica enterica serovar Typhi Ty2
auuuauccacgccg

SEQ ID NO: 3714817 - RNA, 19 nt, Salmonella enterica enterica serovar Typhi Ty2
auuuauccacgccgcuauc

SEQ ID NO: 3714818 - RNA, 14 nt, Salmonella enterica enterica serovar Typhi Ty2
auuuauccagcagg

SEQ ID NO: 3714819 - RNA, 19 nt, Salmonella enterica enterica serovar Typhi Ty2
auuuaucccgugguggggu

SEQ ID NO: 3714820 - RNA, 23 nt, Salmonella enterica enterica serovar Typhi Ty2
auuuaucccguggugggguuccc

SEQ ID NO: 3714821 - RNA, 14 nt, Salmonella enterica enterica serovar Typhi Ty2
auuuauccuccgaa

SEQ ID NO: 3714822 - RNA, 18 nt, Salmonella enterica enterica serovar Typhi Ty2
auuuaucgaucuccaucu

SEQ ID NO: 3714823 - RNA, 14 nt, Salmonella enterica enterica serovar Typhi Ty2
auuuaucugcguga

SEQ ID NO: 3714824 - RNA, 22 nt, Salmonella enterica enterica serovar Typhi Ty2
auuuaucuuccggcaucacauc

SEQ ID NO: 3714825 - RNA, 19 nt, Salmonella enterica enterica serovar Typhi Ty2
auuuaugauuuuaacauca

SEQ ID NO: 3714826 - RNA, 13 nt, Salmonella enterica enterica serovar Typhi Ty2
auuuauuaacccu

SEQ ID NO: 3714827 - RNA, 17 nt, Salmonella enterica enterica serovar Typhi Ty2
auuuauugccugaaacg

SEQ ID NO: 3714828 - RNA, 21 nt, Salmonella enterica enterica serovar Typhi Ty2
auuuauuugcauuguacuuuu

SEQ ID NO: 3714829 - RNA, 23 nt, Salmonella enterica enterica serovar Typhi Ty2
auuuauuugcauuguacuuuuaa

SEQ ID NO: 3714830 - RNA, 22 nt, Salmonella enterica enterica serovar Typhi Ty2
auuucaaacguuucaagaugcc

SEQ ID NO: 3714831 - RNA, 17 nt, Salmonella enterica enterica serovar Typhi Ty2
auuucaauaaucccuuc

SEQ ID NO: 3714832 - RNA, 17 nt, Salmonella enterica enterica serovar Typhi Ty2
auuucaaucaucauauc

SEQ ID NO: 3714833 - RNA, 14 nt, Salmonella enterica enterica serovar Typhi Ty2
auuucaaucgcgcc

SEQ ID NO: 3714834 - RNA, 19 nt, Salmonella enterica enterica serovar Typhi Ty2
auuucaaugcauacugccg

SEQ ID NO: 3714835 - RNA, 21 nt, Salmonella enterica enterica serovar Typhi Ty2
auuucaccgggccaaugccgc

SEQ ID NO: 3714836 - RNA, 18 nt, Salmonella enterica enterica serovar Typhi Ty2
auuucaccgucaauaacg

SEQ ID NO: 3714837 - RNA, 19 nt, Salmonella enterica enterica serovar Typhi Ty2
auuucaccgucaauaacgg

SEQ ID NO: 3714838 - RNA, 17 nt, Salmonella enterica enterica serovar Typhi Ty2
auuucaccuuuggcuuc

SEQ ID NO: 3714839 - RNA, 18 nt, Salmonella enterica enterica serovar Typhi Ty2
auuucacgucacguucau

SEQ ID NO: 3714840 - RNA, 18 nt, Salmonella enterica enterica serovar Typhi Ty2
auuucacguuucaucucu

SEQ ID NO: 3714841 - RNA, 15 nt, Salmonella enterica enterica serovar Typhi Ty2
auuucagaccgugcu

SEQ ID NO: 3714842 - RNA, 18 nt, Salmonella enterica enterica serovar Typhi Ty2
auuucagaccgugcuuuu

SEQ ID NO: 3714843 - RNA, 16 nt, Salmonella enterica enterica serovar Typhi Ty2
auuucagcauccuccg

SEQ ID NO: 3714844 - RNA, 14 nt, Salmonella enterica enterica serovar Typhi Ty2
auuucagcgcagaa

SEQ ID NO: 3714845 - RNA, 15 nt, Salmonella enterica enterica serovar Typhi Ty2
auuuucaaaaacaag

SEQ ID NO: 3714846 - RNA, 19 nt, Salmonella enterica enterica serovar Typhi Ty2
auuuucaacggcaucaaua

SEQ ID NO: 3714847 - RNA, 22 nt, Salmonella enterica enterica serovar Typhi Ty2
auuuucacgcucgaguucuuca

SEQ ID NO: 3714848 - RNA, 17 nt, Salmonella enterica enterica serovar Typhi Ty2
auuuucacuuauaaaua

SEQ ID NO: 3714849 - RNA, 21 nt, Salmonella enterica enterica serovar Typhi Ty2
auuuucagccauuuuuuauug

SEQ ID NO: 3714850 - RNA, 20 nt, Salmonella enterica enterica serovar Typhi Ty2
auuuucagcuucagucauaa

SEQ ID NO: 3714851 - RNA, 18 nt, Salmonella enterica enterica serovar Typhi Ty2
auuuucauacuauuuccu

SEQ ID NO: 3714852 - RNA, 21 nt, Salmonella enterica enterica serovar Typhi Ty2
auuuucaucaagccauugcgc

SEQ ID NO: 3714853 - RNA, 21 nt, Salmonella enterica enterica serovar Typhi Ty2
auuuucaucauaucugauaaa

SEQ ID NO: 3714854 - RNA, 19 nt, Salmonella enterica enterica serovar Typhi Ty2
auuuucaugauauucuguc

SEQ ID NO: 3714855 - RNA, 23 nt, Salmonella enterica enterica serovar Typhi Ty2
auuuucaugguaucccacaugag

SEQ ID NO: 3714856 - RNA, 17 nt, Salmonella enterica enterica serovar Typhi Ty2
auuuucgauaaucgcgc

SEQ ID NO: 3714857 - RNA, 18 nt, Salmonella enterica enterica serovar Typhi Ty2
auuuucggcacaucaaua

SEQ ID NO: 3714858 - RNA, 16 nt, Salmonella enterica enterica serovar Typhi Ty2
auuuucggcaucagca

SEQ ID NO: 3714859 - RNA, 21 nt, Salmonella enterica enterica serovar Typhi Ty2
auuuucgucguuucuacaaua

SEQ ID NO: 3714860 - RNA, 19 nt, Salmonella enterica enterica serovar Typhi Ty2
auuuucuccggaagcauaa

SEQ ID NO: 3714861 - RNA, 18 nt, Salmonella enterica enterica serovar Typhi Ty2
auuuucuuaauaugcugc

SEQ ID NO: 3714862 - RNA, 18 nt, Salmonella enterica enterica serovar Typhi Ty2
auuuucuuauuacaagaa

SEQ ID NO: 3714863 - RNA, 17 nt, Salmonella enterica enterica serovar Typhi Ty2
auuuucuucuggccauu

SEQ ID NO: 3714864 - RNA, 15 nt, Salmonella enterica enterica serovar Typhi Ty2
auuuucuuucaucaa

SEQ ID NO: 3714865 - RNA, 17 nt, Salmonella enterica enterica serovar Typhi Ty2
auuuucuuucaucaaac

SEQ ID NO: 3714866 - RNA, 14 nt, Salmonella enterica enterica serovar Typhi Ty2
auuuugaauuuuua

SEQ ID NO: 3714867 - RNA, 16 nt, Salmonella enterica enterica serovar Typhi Ty2
auuuugauaaaaacac

SEQ ID NO: 3714868 - RNA, 15 nt, Salmonella enterica enterica serovar Typhi Ty2
auuuugauaaaucag

SEQ ID NO: 3714869 - RNA, 21 nt, Salmonella enterica enterica serovar Typhi Ty2
auuuugcacuuuugccaggcg

SEQ ID NO: 3714870 - RNA, 13 nt, Salmonella enterica enterica serovar Typhi Ty2
auuuugccuucaa

SEQ ID NO: 3714871 - RNA, 15 nt, Salmonella enterica enterica serovar Typhi Ty2
auuuugcgguuuuaa

SEQ ID NO: 3714872 - RNA, 22 nt, Salmonella enterica enterica serovar Typhi Ty2
auuuugcucauauuguguuuuu

SEQ ID NO: 3714873 - RNA, 13 nt, Salmonella enterica enterica serovar Typhi Ty2
auuuugcuuggcc

SEQ ID NO: 3714874 - RNA, 23 nt, Salmonella enterica enterica serovar Typhi Ty2
auuuuggacgaggaaaaaugaga

SEQ ID NO: 3714875 - RNA, 16 nt, Salmonella enterica enterica serovar Typhi Ty2
auuuuggggaaaauac

SEQ ID NO: 3714876 - RNA, 17 nt, Salmonella enterica enterica serovar Typhi Ty2
auuuuggggaaaauacc

SEQ ID NO: 3714877 - RNA, 20 nt, Salmonella enterica enterica serovar Typhi Ty2
auuuugguuacuauuuuuca

SEQ ID NO: 3714878 - RNA, 19 nt, Salmonella enterica enterica serovar Typhi Ty2
auuuugucauguccagggc

SEQ ID NO: 3714879 - RNA, 13 nt, Salmonella enterica enterica serovar Typhi Ty2
auuuuuaaauaac

SEQ ID NO: 3714880 - RNA, 20 nt, Salmonella enterica enterica serovar Typhi Ty2
auuuuuaagguauugauuuu

SEQ ID NO: 3714881 - RNA, 21 nt, Salmonella enterica enterica serovar Typhi Ty2
auuuuuaagguauugauuuuu

SEQ ID NO: 3714882 - RNA, 17 nt, Salmonella enterica enterica serovar Typhi Ty2
auuuuuauucccgccgc

SEQ ID NO: 3714883 - RNA, 13 nt, Salmonella enterica enterica serovar Typhi Ty2
auuuuucacaugc

SEQ ID NO: 3714884 - RNA, 12 nt, Salmonella enterica enterica serovar Typhi Ty2
auuuuucagggu

SEQ ID NO: 3714885 - RNA, 13 nt, Salmonella enterica enterica serovar Typhi Ty2
auuuuuccagcau

SEQ ID NO: 3714886 - RNA, 16 nt, Salmonella enterica enterica serovar Typhi Ty2
auuuuucccaucaauc

SEQ ID NO: 3714887 - RNA, 15 nt, Salmonella enterica enterica serovar Typhi Ty2
auuuuucccuggccg

SEQ ID NO: 3714888 - RNA, 18 nt, Salmonella enterica enterica serovar Typhi Ty2
auuuuucccuggccggaa

SEQ ID NO: 3714889 - RNA, 20 nt, Salmonella enterica enterica serovar Typhi Ty2
auuuuuccggcgucaaaaau

SEQ ID NO: 3714890 - RNA, 15 nt, Salmonella enterica enterica serovar Typhi Ty2
auuuuucgaucuucu

SEQ ID NO: 3714891 - RNA, 16 nt, Salmonella enterica enterica serovar Typhi Ty2
auuuuucgaucuucuc

SEQ ID NO: 3714892 - RNA, 17 nt, Salmonella enterica enterica serovar Typhi Ty2
auuuuucgaucuucucc

SEQ ID NO: 3714893 - RNA, 18 nt, Salmonella enterica enterica serovar Typhi Ty2
auuuuucgccagguacau

SEQ ID NO: 3714894 - RNA, 14 nt, Salmonella enterica enterica serovar Typhi Ty2
auuuuucugcgcca

SEQ ID NO: 3714895 - RNA, 17 nt, Salmonella enterica enterica serovar Typhi Ty2
auuuuugaucugcuuga

SEQ ID NO: 3714896 - RNA, 19 nt, Salmonella enterica enterica serovar Typhi Ty2
auuuuuuauauucgcucau

SEQ ID NO: 3714897 - RNA, 15 nt, Salmonella enterica enterica serovar Typhi Ty2
auuuuuuaucuucca

SEQ ID NO: 3714898 - RNA, 12 nt, Salmonella enterica enterica serovar Typhi Ty2
auuuuuucugcu

SEQ ID NO: 3714899 - RNA, 21 nt, Salmonella enterica enterica serovar Typhi Ty2
auuuuuugacaacaaaaagau

SEQ ID NO: 3714900 - RNA, 15 nt, Salmonella enterica enterica serovar Typhi Ty2
auuuuuugucuguau

SEQ ID NO: 3714901 - RNA, 16 nt, Salmonella enterica enterica serovar Typhi Ty2
caaaaaaaaaccggca

SEQ ID NO: 3714902 - RNA, 13 nt, Salmonella enterica enterica serovar Typhi Ty2
caaaaaaaaccag

SEQ ID NO: 3714903 - RNA, 13 nt, Salmonella enterica enterica serovar Typhi Ty2
caaaaaagagaag

SEQ ID NO: 3714904 - RNA, 18 nt, Salmonella enterica enterica serovar Typhi Ty2
caaaaaaggaaaaugacg

SEQ ID NO: 3714905 - RNA, 22 nt, Salmonella enterica enterica serovar Typhi Ty2
caaaaaauauagccauuuaaug

SEQ ID NO: 3714906 - RNA, 10 nt, Salmonella enterica enterica serovar Typhi Ty2
caaaaacaag

SEQ ID NO: 3714907 - RNA, 20 nt, Salmonella enterica enterica serovar Typhi Ty2
caaaaacauccacauaggcg

SEQ ID NO: 3714908 - RNA, 21 nt, Salmonella enterica enterica serovar Typhi Ty2
caaaaaccccgacauucccag

SEQ ID NO: 3714909 - RNA, 13 nt, Salmonella enterica enterica serovar Typhi Ty2
caaaaacgccaga

SEQ ID NO: 3714910 - RNA, 15 nt, Salmonella enterica enterica serovar Typhi Ty2
caaaaacgcccccag

SEQ ID NO: 3714911 - RNA, 23 nt, Salmonella enterica enterica serovar Typhi Ty2
caaaaacguuaggcgcaaaggca

SEQ ID NO: 3714912 - RNA, 20 nt, Salmonella enterica enterica serovar Typhi Ty2
caaaaagaacucacucagug

SEQ ID NO: 3714913 - RNA, 15 nt, Salmonella enterica enterica serovar Typhi Ty2
caaaaagauauuaua

SEQ ID NO: 3714914 - RNA, 20 nt, Salmonella enterica enterica serovar Typhi Ty2
caaaaagauauuauaaaaua

SEQ ID NO: 3714915 - RNA, 11 nt, Salmonella enterica enterica serovar Typhi Ty2
caaaaagccuu

SEQ ID NO: 3714916 - RNA, 18 nt, Salmonella enterica enterica serovar Typhi Ty2
caaaaagccuugcugaau

SEQ ID NO: 3714917 - RNA, 21 nt, Salmonella enterica enterica serovar Typhi Ty2
caaaaagcgcgccgaaaauau

SEQ ID NO: 3714918 - RNA, 18 nt, Salmonella enterica enterica serovar Typhi Ty2
caaaaaguaguuccagca

SEQ ID NO: 3714919 - RNA, 14 nt, Salmonella enterica enterica serovar Typhi Ty2
caaaaauaaaaacc

SEQ ID NO: 3714920 - RNA, 12 nt, Salmonella enterica enterica serovar Typhi Ty2
caaaaauaccac

SEQ ID NO: 3714921 - RNA, 15 nt, Salmonella enterica enterica serovar Typhi Ty2
caaaaauagcauuaa

SEQ ID NO: 3714922 - RNA, 18 nt, Salmonella enterica enterica serovar Typhi Ty2
caaaaauagcauuaagcu

SEQ ID NO: 3714923 - RNA, 18 nt, Salmonella enterica enterica serovar Typhi Ty2
caaaaauaggcuuuugau

SEQ ID NO: 3714924 - RNA, 20 nt, Salmonella enterica enterica serovar Typhi Ty2
caaaaauauggucgaaaaua

SEQ ID NO: 3714925 - RNA, 21 nt, Salmonella enterica enterica serovar Typhi Ty2
caaaaauauggucgaaaauau

SEQ ID NO: 3714926 - RNA, 14 nt, Salmonella enterica enterica serovar Typhi Ty2
caaaaaucaccaca

SEQ ID NO: 3714927 - RNA, 14 nt, Salmonella enterica enterica serovar Typhi Ty2
caaacaucgcgcuc

SEQ ID NO: 3714928 - RNA, 22 nt, Salmonella enterica enterica serovar Typhi Ty2
caaaccaacaucgcugaauuuc

SEQ ID NO: 3714929 - RNA, 20 nt, Salmonella enterica enterica serovar Typhi Ty2
caaaccacaccacgugcgga

SEQ ID NO: 3714930 - RNA, 14 nt, Salmonella enterica enterica serovar Typhi Ty2
caaaccacugcugu

SEQ ID NO: 3714931 - RNA, 21 nt, Salmonella enterica enterica serovar Typhi Ty2
caaaccagacgcguaaccccu

SEQ ID NO: 3714932 - RNA, 16 nt, Salmonella enterica enterica serovar Typhi Ty2
caaaccagcuuuucau

SEQ ID NO: 3714933 - RNA, 17 nt, Salmonella enterica enterica serovar Typhi Ty2
caaaccaugauaauaau

SEQ ID NO: 3714934 - RNA, 12 nt, Salmonella enterica enterica serovar Typhi Ty2
caaaccauguac

SEQ ID NO: 3714935 - RNA, 23 nt, Salmonella enterica enterica serovar Typhi Ty2
caaaccccggacacaugaccuga

SEQ ID NO: 3714936 - RNA, 20 nt, Salmonella enterica enterica serovar Typhi Ty2
caaacccgaccucuucuuug

SEQ ID NO: 3714937 - RNA, 16 nt, Salmonella enterica enterica serovar Typhi Ty2
caaacccuuccgcauc

SEQ ID NO: 3714938 - RNA, 14 nt, Salmonella enterica enterica serovar Typhi Ty2
caaacccuuuggca

SEQ ID NO: 3714939 - RNA, 18 nt, Salmonella enterica enterica serovar Typhi Ty2
caaaccgaauucguccac

SEQ ID NO: 3714940 - RNA, 18 nt, Salmonella enterica enterica serovar Typhi Ty2
caaaccgauaaucaccag

SEQ ID NO: 3714941 - RNA, 22 nt, Salmonella enterica enterica serovar Typhi Ty2
caaaccgauaaucaccagcccg

SEQ ID NO: 3714942 - RNA, 22 nt, Salmonella enterica enterica serovar Typhi Ty2
caaaccgauagcuaucacacau

SEQ ID NO: 3714943 - RNA, 21 nt, Salmonella enterica enterica serovar Typhi Ty2
caaaccgguaaucccuucacg

SEQ ID NO: 3714944 - RNA, 21 nt, Salmonella enterica enterica serovar Typhi Ty2
caaaccugagcauauaaauaa

SEQ ID NO: 3714945 - RNA, 18 nt, Salmonella enterica enterica serovar Typhi Ty2
caaaccugccacaggcca

SEQ ID NO: 3714946 - RNA, 19 nt, Salmonella enterica enterica serovar Typhi Ty2
caaacgaaccguggccucc

SEQ ID NO: 3714947 - RNA, 12 nt, Salmonella enterica enterica serovar Typhi Ty2
caaacgccaccg

SEQ ID NO: 3714948 - RNA, 20 nt, Salmonella enterica enterica serovar Typhi Ty2
caaacgcgauacacuccggc

SEQ ID NO: 3714949 - RNA, 23 nt, Salmonella enterica enterica serovar Typhi Ty2
caaacgcuaucaccgccgcccgu

SEQ ID NO: 3714950 - RNA, 11 nt, Salmonella enterica enterica serovar Typhi Ty2
caaacgcuggc

SEQ ID NO: 3714951 - RNA, 15 nt, Salmonella enterica enterica serovar Typhi Ty2
caaacgcuggugcug

SEQ ID NO: 3714952 - RNA, 13 nt, Salmonella enterica enterica serovar Typhi Ty2
caaacgcuuuuuu

SEQ ID NO: 3714953 - RNA, 16 nt, Salmonella enterica enterica serovar Typhi Ty2
caaacggaauagcgcc

SEQ ID NO: 3714954 - RNA, 15 nt, Salmonella enterica enterica serovar Typhi Ty2
caaacggcgccagcu

SEQ ID NO: 3714955 - RNA, 23 nt, Salmonella enterica enterica serovar Typhi Ty2
caaacuauguacgccaagcugca

SEQ ID NO: 3714956 - RNA, 14 nt, Salmonella enterica enterica serovar Typhi Ty2
caaacuauuuuuag

SEQ ID NO: 3714957 - RNA, 15 nt, Salmonella enterica enterica serovar Typhi Ty2
caaacuauuuuuagc

SEQ ID NO: 3714958 - RNA, 18 nt, Salmonella enterica enterica serovar Typhi Ty2
caaacucacguuccccag

SEQ ID NO: 3714959 - RNA, 12 nt, Salmonella enterica enterica serovar Typhi Ty2
caaacucagcgg

SEQ ID NO: 3714960 - RNA, 22 nt, Salmonella enterica enterica serovar Typhi Ty2
caaacuccgcgcuggcaauaaa

SEQ ID NO: 3714961 - RNA, 21 nt, Salmonella enterica enterica serovar Typhi Ty2
caaacuccucacugcguaaaa

SEQ ID NO: 3714962 - RNA, 17 nt, Salmonella enterica enterica serovar Typhi Ty2
caaacucugaaaaaauu

SEQ ID NO: 3714963 - RNA, 21 nt, Salmonella enterica enterica serovar Typhi Ty2
caaacugaaaacgggugaucu

SEQ ID NO: 3714964 - RNA, 17 nt, Salmonella enterica enterica serovar Typhi Ty2
caaacugauaagggccu

SEQ ID NO: 3714965 - RNA, 14 nt, Salmonella enterica enterica serovar Typhi Ty2
caaacugcgcgccc

SEQ ID NO: 3714966 - RNA, 22 nt, Salmonella enterica enterica serovar Typhi Ty2
caaacugcucguaaagcaucag

SEQ ID NO: 3714967 - RNA, 13 nt, Salmonella enterica enterica serovar Typhi Ty2
caaacuggcgcgu

SEQ ID NO: 3714968 - RNA, 13 nt, Salmonella enterica enterica serovar Typhi Ty2
caaacuuccacac

SEQ ID NO: 3714969 - RNA, 14 nt, Salmonella enterica enterica serovar Typhi Ty2
caaacuuuccguug

SEQ ID NO: 3714970 - RNA, 18 nt, Salmonella enterica enterica serovar Typhi Ty2
caaacuuugcgccauuuc

SEQ ID NO: 3714971 - RNA, 13 nt, Salmonella enterica enterica serovar Typhi Ty2
caaacuuuuaaau

SEQ ID NO: 3714972 - RNA, 15 nt, Salmonella enterica enterica serovar Typhi Ty2
caaagacaccccagc

SEQ ID NO: 3714973 - RNA, 17 nt, Salmonella enterica enterica serovar Typhi Ty2
caaagacaccccagccu

SEQ ID NO: 3714974 - RNA, 23 nt, Salmonella enterica enterica serovar Typhi Ty2
caaagauauaguuuauugaagug

SEQ ID NO: 3714975 - RNA, 16 nt, Salmonella enterica enterica serovar Typhi Ty2
caaagcaaaaaucacc

SEQ ID NO: 3714976 - RNA, 14 nt, Salmonella enterica enterica serovar Typhi Ty2
caaagcaaucgcca

SEQ ID NO: 3714977 - RNA, 16 nt, Salmonella enterica enterica serovar Typhi Ty2
caaagccaggccgcca

SEQ ID NO: 3714978 - RNA, 15 nt, Salmonella enterica enterica serovar Typhi Ty2
caaagcccacgcccu

SEQ ID NO: 3714979 - RNA, 20 nt, Salmonella enterica enterica serovar Typhi Ty2
caaagccgccauccggccug

SEQ ID NO: 3714980 - RNA, 13 nt, Salmonella enterica enterica serovar Typhi Ty2
caaagccugcugg

SEQ ID NO: 3714981 - RNA, 21 nt, Salmonella enterica enterica serovar Typhi Ty2
caaagcgguauaacggccaga

SEQ ID NO: 3714982 - RNA, 16 nt, Salmonella enterica enterica serovar Typhi Ty2
caaagcguaccgucug

SEQ ID NO: 3714983 - RNA, 21 nt, Salmonella enterica enterica serovar Typhi Ty2
caaagcguugcaaccccagac

SEQ ID NO: 3714984 - RNA, 15 nt, Salmonella enterica enterica serovar Typhi Ty2
caaagcucaacgcag

SEQ ID NO: 3714985 - RNA, 20 nt, Salmonella enterica enterica serovar Typhi Ty2
caaagcucaacgcaggcugg

SEQ ID NO: 3714986 - RNA, 16 nt, Salmonella enterica enterica serovar Typhi Ty2
caaaggcguaaaaagg

SEQ ID NO: 3714987 - RNA, 10 nt, Salmonella enterica enterica serovar Typhi Ty2
caaagggagc

SEQ ID NO: 3714988 - RNA, 15 nt, Salmonella enterica enterica serovar Typhi Ty2
caaagggcaccuggg

SEQ ID NO: 3714989 - RNA, 23 nt, Salmonella enterica enterica serovar Typhi Ty2
caaagggcccguggaaaaacuca

SEQ ID NO: 3714990 - RNA, 20 nt, Salmonella enterica enterica serovar Typhi Ty2
caaagguaauaucacacccg

SEQ ID NO: 3714991 - RNA, 15 nt, Salmonella enterica enterica serovar Typhi Ty2
caaagguguuauuuc

SEQ ID NO: 3714992 - RNA, 23 nt, Salmonella enterica enterica serovar Typhi Ty2
caaagguuuguuuaauuuuguug

SEQ ID NO: 3714993 - RNA, 22 nt, Salmonella enterica enterica serovar Typhi Ty2
caaagucagcgcgcgcuuucac

SEQ ID NO: 3714994 - RNA, 21 nt, Salmonella enterica enterica serovar Typhi Ty2
caaagucuggccaccgauaaa

SEQ ID NO: 3714995 - RNA, 18 nt, Salmonella enterica enterica serovar Typhi Ty2
caaagugcgcccuuuuuu

SEQ ID NO: 3714996 - RNA, 18 nt, Salmonella enterica enterica serovar Typhi Ty2
caaaguuaucccugcuga

SEQ ID NO: 3714997 - RNA, 15 nt, Salmonella enterica enterica serovar Typhi Ty2
caaaguugcaucaag

SEQ ID NO: 3714998 - RNA, 16 nt, Salmonella enterica enterica serovar Typhi Ty2
caaaguugcaucaaga

SEQ ID NO: 3714999 - RNA, 18 nt, Salmonella enterica enterica serovar Typhi Ty2
caaaguugguucccagca

SEQ ID NO: 3715000 - RNA, 17 nt, Salmonella enterica enterica serovar Typhi Ty2
caaauaaagccagauac

SEQ ID NO: 3715001 - RNA, 22 nt, Salmonella enterica enterica serovar Typhi Ty2
caaauaaagcggucuuucaaca

SEQ ID NO: 3715002 - RNA, 17 nt, Salmonella enterica enterica serovar Typhi Ty2
caaauaaauccaugaga

SEQ ID NO: 3715003 - RNA, 18 nt, Salmonella enterica enterica serovar Typhi Ty2
caaauaaggacuuuaucu

SEQ ID NO: 3715004 - RNA, 21 nt, Salmonella enterica enterica serovar Typhi Ty2
caaauaagguggcuaacccgc

SEQ ID NO: 3715005 - RNA, 14 nt, Salmonella enterica enterica serovar Typhi Ty2
caaauacauggugc

SEQ ID NO: 3715006 - RNA, 13 nt, Salmonella enterica enterica serovar Typhi Ty2
caaauaccacauc

SEQ ID NO: 3715007 - RNA, 18 nt, Salmonella enterica enterica serovar Typhi Ty2
caaauaccggacagacuu

SEQ ID NO: 3715008 - RNA, 21 nt, Salmonella enterica enterica serovar Typhi Ty2
caaauacgcgauaaaaaccca

SEQ ID NO: 3715009 - RNA, 21 nt, Salmonella enterica enterica serovar Typhi Ty2
caacauuaucaaaagugauca

SEQ ID NO: 3715010 - RNA, 21 nt, Salmonella enterica enterica serovar Typhi Ty2
caacauuggaaaacuccagca

SEQ ID NO: 3715011 - RNA, 15 nt, Salmonella enterica enterica serovar Typhi Ty2
caaccaaaguccaac

SEQ ID NO: 3715012 - RNA, 15 nt, Salmonella enterica enterica serovar Typhi Ty2
caaccaacccaaaaa

SEQ ID NO: 3715013 - RNA, 16 nt, Salmonella enterica enterica serovar Typhi Ty2
caaccaaugcaacgcc

SEQ ID NO: 3715014 - RNA, 18 nt, Salmonella enterica enterica serovar Typhi Ty2
caaccaaugcaacgccuu

SEQ ID NO: 3715015 - RNA, 14 nt, Salmonella enterica enterica serovar Typhi Ty2
caaccacggauaag

SEQ ID NO: 3715016 - RNA, 18 nt, Salmonella enterica enterica serovar Typhi Ty2
caaccacggauaagccag

SEQ ID NO: 3715017 - RNA, 20 nt, Salmonella enterica enterica serovar Typhi Ty2
caaccacggauaagccagcc

SEQ ID NO: 3715018 - RNA, 13 nt, Salmonella enterica enterica serovar Typhi Ty2
caaccagaauaau

SEQ ID NO: 3715019 - RNA, 18 nt, Salmonella enterica enterica serovar Typhi Ty2
caaccagcaaugagacaa

SEQ ID NO: 3715020 - RNA, 21 nt, Salmonella enterica enterica serovar Typhi Ty2
caaccagcgaaaugacggcca

SEQ ID NO: 3715021 - RNA, 22 nt, Salmonella enterica enterica serovar Typhi Ty2
caaccagcgaaaugacggccac

SEQ ID NO: 3715022 - RNA, 12 nt, Salmonella enterica enterica serovar Typhi Ty2
caaccaggcaaa

SEQ ID NO: 3715023 - RNA, 13 nt, Salmonella enterica enterica serovar Typhi Ty2
caaccaggcaaac

SEQ ID NO: 3715024 - RNA, 17 nt, Salmonella enterica enterica serovar Typhi Ty2
caaccaggcaaaccagc

SEQ ID NO: 3715025 - RNA, 19 nt, Salmonella enterica enterica serovar Typhi Ty2
caaccagugcggcaaccac

SEQ ID NO: 3715026 - RNA, 19 nt, Salmonella enterica enterica serovar Typhi Ty2
caaccaguuaauuucuuuc

SEQ ID NO: 3715027 - RNA, 11 nt, Salmonella enterica enterica serovar Typhi Ty2
caaccauacau

SEQ ID NO: 3715028 - RNA, 15 nt, Salmonella enterica enterica serovar Typhi Ty2
caacccacauuggcc

SEQ ID NO: 3715029 - RNA, 22 nt, Salmonella enterica enterica serovar Typhi Ty2
caacccauauucgucuucaucu

SEQ ID NO: 3715030 - RNA, 20 nt, Salmonella enterica enterica serovar Typhi Ty2
caaccccagacggcggcgaa

SEQ ID NO: 3715031 - RNA, 12 nt, Salmonella enterica enterica serovar Typhi Ty2
caaccccugacg

SEQ ID NO: 3715032 - RNA, 20 nt, Salmonella enterica enterica serovar Typhi Ty2
caacccgcaagcauaaaaaa

SEQ ID NO: 3715033 - RNA, 21 nt, Salmonella enterica enterica serovar Typhi Ty2
caacccgcuccagaagcacuu

SEQ ID NO: 3715034 - RNA, 13 nt, Salmonella enterica enterica serovar Typhi Ty2
caaccgacgcauu

SEQ ID NO: 3715035 - RNA, 16 nt, Salmonella enterica enterica serovar Typhi Ty2
caaccgacgcgaauug

SEQ ID NO: 3715036 - RNA, 14 nt, Salmonella enterica enterica serovar Typhi Ty2
caaccgccaauaau

SEQ ID NO: 3715037 - RNA, 22 nt, Salmonella enterica enterica serovar Typhi Ty2
caaccgccagucacccugcccu

SEQ ID NO: 3715038 - RNA, 14 nt, Salmonella enterica enterica serovar Typhi Ty2
caaccgccugcacu

SEQ ID NO: 3715039 - RNA, 18 nt, Salmonella enterica enterica serovar Typhi Ty2
caaccgcgccaaagauaa

SEQ ID NO: 3715040 - RNA, 15 nt, Salmonella enterica enterica serovar Typhi Ty2
caaccgcucuccgca

SEQ ID NO: 3715041 - RNA, 15 nt, Salmonella enterica enterica serovar Typhi Ty2
caaccgucaucucuu

SEQ ID NO: 3715042 - RNA, 16 nt, Salmonella enterica enterica serovar Typhi Ty2
caaccgugagcgcgcc

SEQ ID NO: 3715043 - RNA, 19 nt, Salmonella enterica enterica serovar Typhi Ty2
caaccgugucugcugaucg

SEQ ID NO: 3715044 - RNA, 15 nt, Salmonella enterica enterica serovar Typhi Ty2
caaccguuucuuuuu

SEQ ID NO: 3715045 - RNA, 16 nt, Salmonella enterica enterica serovar Typhi Ty2
caaccguuucuuuuuc

SEQ ID NO: 3715046 - RNA, 17 nt, Salmonella enterica enterica serovar Typhi Ty2
caaccucggcuugcuuc

SEQ ID NO: 3715047 - RNA, 15 nt, Salmonella enterica enterica serovar Typhi Ty2
caaccucuuuuuccg

SEQ ID NO: 3715048 - RNA, 17 nt, Salmonella enterica enterica serovar Typhi Ty2
caaccugaaagaagcgc

SEQ ID NO: 3715049 - RNA, 20 nt, Salmonella enterica enterica serovar Typhi Ty2
caaccugaggaaaaagcgca

SEQ ID NO: 3715050 - RNA, 19 nt, Salmonella enterica enterica serovar Typhi Ty2
caaccugccgaugaaagag

SEQ ID NO: 3715051 - RNA, 22 nt, Salmonella enterica enterica serovar Typhi Ty2
caaccugcgcagaauuuguuua

SEQ ID NO: 3715052 - RNA, 20 nt, Salmonella enterica enterica serovar Typhi Ty2
caaccuguaggccggauaag

SEQ ID NO: 3715053 - RNA, 23 nt, Salmonella enterica enterica serovar Typhi Ty2
caaccuguaggccggauaagcau

SEQ ID NO: 3715054 - RNA, 15 nt, Salmonella enterica enterica serovar Typhi Ty2
caaccuuugggcaga

SEQ ID NO: 3715055 - RNA, 20 nt, Salmonella enterica enterica serovar Typhi Ty2
caaccuuugggcagauaucg

SEQ ID NO: 3715056 - RNA, 17 nt, Salmonella enterica enterica serovar Typhi Ty2
caacgaccagugaacgu

SEQ ID NO: 3715057 - RNA, 23 nt, Salmonella enterica enterica serovar Typhi Ty2
caacgacccgaagggcgaagcgc

SEQ ID NO: 3715058 - RNA, 16 nt, Salmonella enterica enterica serovar Typhi Ty2
caacgagaauaagacc

SEQ ID NO: 3715059 - RNA, 20 nt, Salmonella enterica enterica serovar Typhi Ty2
caacgcacuguaacgcacug

SEQ ID NO: 3715060 - RNA, 20 nt, Salmonella enterica enterica serovar Typhi Ty2
caacgcagacaacguccugc

SEQ ID NO: 3715061 - RNA, 17 nt, Salmonella enterica enterica serovar Typhi Ty2
caacgcaggcuggagag

SEQ ID NO: 3715062 - RNA, 14 nt, Salmonella enterica enterica serovar Typhi Ty2
caacgcaucaaaua

SEQ ID NO: 3715063 - RNA, 13 nt, Salmonella enterica enterica serovar Typhi Ty2
caacgcauccagc

SEQ ID NO: 3715064 - RNA, 18 nt, Salmonella enterica enterica serovar Typhi Ty2
caacgcaucgcugcgcuu

SEQ ID NO: 3715065 - RNA, 14 nt, Salmonella enterica enterica serovar Typhi Ty2
caacgccaacauag

SEQ ID NO: 3715066 - RNA, 17 nt, Salmonella enterica enterica serovar Typhi Ty2
caacgccaagcgcggca

SEQ ID NO: 3715067 - RNA, 19 nt, Salmonella enterica enterica serovar Typhi Ty2
caacgccaagcgcggcagc

SEQ ID NO: 3715068 - RNA, 12 nt, Salmonella enterica enterica serovar Typhi Ty2
caacgccacugc

SEQ ID NO: 3715069 - RNA, 14 nt, Salmonella enterica enterica serovar Typhi Ty2
caacgccagcagcg

SEQ ID NO: 3715070 - RNA, 11 nt, Salmonella enterica enterica serovar Typhi Ty2
caacgccgcac

SEQ ID NO: 3715071 - RNA, 18 nt, Salmonella enterica enterica serovar Typhi Ty2
caacgccgcuuuaccgcc

SEQ ID NO: 3715072 - RNA, 20 nt, Salmonella enterica enterica serovar Typhi Ty2
caacgccgcuuuaccgccuu

SEQ ID NO: 3715073 - RNA, 13 nt, Salmonella enterica enterica serovar Typhi Ty2
caacgccggcaac

SEQ ID NO: 3715074 - RNA, 19 nt, Salmonella enterica enterica serovar Typhi Ty2
caacgccggcaacacccgc

SEQ ID NO: 3715075 - RNA, 18 nt, Salmonella enterica enterica serovar Typhi Ty2
caacgccguacuccagcc

SEQ ID NO: 3715076 - RNA, 17 nt, Salmonella enterica enterica serovar Typhi Ty2
caacgccuucguccgga

SEQ ID NO: 3715077 - RNA, 21 nt, Salmonella enterica enterica serovar Typhi Ty2
caacgcgaguauucgcgcccu

SEQ ID NO: 3715078 - RNA, 14 nt, Salmonella enterica enterica serovar Typhi Ty2
caacgcgcaucaac

SEQ ID NO: 3715079 - RNA, 14 nt, Salmonella enterica enterica serovar Typhi Ty2
caacgcgccgccaa

SEQ ID NO: 3715080 - RNA, 17 nt, Salmonella enterica enterica serovar Typhi Ty2
caacgcgggccauacac

SEQ ID NO: 3715081 - RNA, 17 nt, Salmonella enterica enterica serovar Typhi Ty2
caacgcgugauccacag

SEQ ID NO: 3715082 - RNA, 16 nt, Salmonella enterica enterica serovar Typhi Ty2
caacgcguugccgccg

SEQ ID NO: 3715083 - RNA, 13 nt, Salmonella enterica enterica serovar Typhi Ty2
caacgcucagacc

SEQ ID NO: 3715084 - RNA, 17 nt, Salmonella enterica enterica serovar Typhi Ty2
caacgcucagaccgauc

SEQ ID NO: 3715085 - RNA, 13 nt, Salmonella enterica enterica serovar Typhi Ty2
caacgcuccagca

SEQ ID NO: 3715086 - RNA, 15 nt, Salmonella enterica enterica serovar Typhi Ty2
caacgcuucacaacc

SEQ ID NO: 3715087 - RNA, 19 nt, Salmonella enterica enterica serovar Typhi Ty2
caacgcuuuagugccgcca

SEQ ID NO: 3715088 - RNA, 20 nt, Salmonella enterica enterica serovar Typhi Ty2
caacgcuuuagugccgccau

SEQ ID NO: 3715089 - RNA, 19 nt, Salmonella enterica enterica serovar Typhi Ty2
caacggaagcugaccaggg

SEQ ID NO: 3715090 - RNA, 15 nt, Salmonella enterica enterica serovar Typhi Ty2
caacggcacacaggc

SEQ ID NO: 3715091 - RNA, 18 nt, Salmonella enterica enterica serovar Typhi Ty2
caagcaguucugaagcua

SEQ ID NO: 3715092 - RNA, 21 nt, Salmonella enterica enterica serovar Typhi Ty2
caagcauaaaccggcggccua

SEQ ID NO: 3715093 - RNA, 15 nt, Salmonella enterica enterica serovar Typhi Ty2
caagccauugcgcgc

SEQ ID NO: 3715094 - RNA, 14 nt, Salmonella enterica enterica serovar Typhi Ty2
caagcccaacuauu

SEQ ID NO: 3715095 - RNA, 20 nt, Salmonella enterica enterica serovar Typhi Ty2
caagccgaacucuuccacca

SEQ ID NO: 3715096 - RNA, 14 nt, Salmonella enterica enterica serovar Typhi Ty2
caagccgaucagcg

SEQ ID NO: 3715097 - RNA, 14 nt, Salmonella enterica enterica serovar Typhi Ty2
caagccgccaacgc

SEQ ID NO: 3715098 - RNA, 15 nt, Salmonella enterica enterica serovar Typhi Ty2
caagccgccaacgcc

SEQ ID NO: 3715099 - RNA, 15 nt, Salmonella enterica enterica serovar Typhi Ty2
caagcgccaguaaug

SEQ ID NO: 3715100 - RNA, 17 nt, Salmonella enterica enterica serovar Typhi Ty2
caagcgccuguucaaca

SEQ ID NO: 3715101 - RNA, 17 nt, Salmonella enterica enterica serovar Typhi Ty2
caagcgcggacagcaga

SEQ ID NO: 3715102 - RNA, 17 nt, Salmonella enterica enterica serovar Typhi Ty2
caagcgcggcagcagcu

SEQ ID NO: 3715103 - RNA, 18 nt, Salmonella enterica enterica serovar Typhi Ty2
caagcggcaucucgccaa

SEQ ID NO: 3715104 - RNA, 13 nt, Salmonella enterica enterica serovar Typhi Ty2
caagcggcggcca

SEQ ID NO: 3715105 - RNA, 13 nt, Salmonella enterica enterica serovar Typhi Ty2
caagcgucagcau

SEQ ID NO: 3715106 - RNA, 20 nt, Salmonella enterica enterica serovar Typhi Ty2
caagcucauguaaaggcgug

SEQ ID NO: 3715107 - RNA, 17 nt, Salmonella enterica enterica serovar Typhi Ty2
caagcucauuucccaau

SEQ ID NO: 3715108 - RNA, 18 nt, Salmonella enterica enterica serovar Typhi Ty2
caagcugacggauacgcu

SEQ ID NO: 3715109 - RNA, 14 nt, Salmonella enterica enterica serovar Typhi Ty2
caagcugcuuuuug

SEQ ID NO: 3715110 - RNA, 15 nt, Salmonella enterica enterica serovar Typhi Ty2
caagcugguaaaugc

SEQ ID NO: 3715111 - RNA, 22 nt, Salmonella enterica enterica serovar Typhi Ty2
caagcuguagcguuuccacgac

SEQ ID NO: 3715112 - RNA, 16 nt, Salmonella enterica enterica serovar Typhi Ty2
caaggaaaaccaguaa

SEQ ID NO: 3715113 - RNA, 19 nt, Salmonella enterica enterica serovar Typhi Ty2
caaggcgcaaaaccauacu

SEQ ID NO: 3715114 - RNA, 12 nt, Salmonella enterica enterica serovar Typhi Ty2
caaggcgcgcca

SEQ ID NO: 3715115 - RNA, 14 nt, Salmonella enterica enterica serovar Typhi Ty2
caaggcguucacac

SEQ ID NO: 3715116 - RNA, 16 nt, Salmonella enterica enterica serovar Typhi Ty2
caaggcucaauacgca

SEQ ID NO: 3715117 - RNA, 13 nt, Salmonella enterica enterica serovar Typhi Ty2
caaggucggcucc

SEQ ID NO: 3715118 - RNA, 14 nt, Salmonella enterica enterica serovar Typhi Ty2
caaggucggcuccu

SEQ ID NO: 3715119 - RNA, 18 nt, Salmonella enterica enterica serovar Typhi Ty2
caaguaaaaugcccugcu

SEQ ID NO: 3715120 - RNA, 13 nt, Salmonella enterica enterica serovar Typhi Ty2
caaguaauaaaau

SEQ ID NO: 3715121 - RNA, 16 nt, Salmonella enterica enterica serovar Typhi Ty2
caaguaauaaaauaau

SEQ ID NO: 3715122 - RNA, 17 nt, Salmonella enterica enterica serovar Typhi Ty2
caaguaauaaaauaaua

SEQ ID NO: 3715123 - RNA, 21 nt, Salmonella enterica enterica serovar Typhi Ty2
caaguacagcuuaaucaccag

SEQ ID NO: 3715124 - RNA, 17 nt, Salmonella enterica enterica serovar Typhi Ty2
caaguugcgccacugcc

SEQ ID NO: 3715125 - RNA, 17 nt, Salmonella enterica enterica serovar Typhi Ty2
caaguuuagaaaaaauu

SEQ ID NO: 3715126 - RNA, 20 nt, Salmonella enterica enterica serovar Typhi Ty2
caauaaaaauaucauuaaau

SEQ ID NO: 3715127 - RNA, 16 nt, Salmonella enterica enterica serovar Typhi Ty2
caauaaaauuauccag

SEQ ID NO: 3715128 - RNA, 16 nt, Salmonella enterica enterica serovar Typhi Ty2
caauaaacauuuuuuu

SEQ ID NO: 3715129 - RNA, 20 nt, Salmonella enterica enterica serovar Typhi Ty2
caauaaacuaaguaaggagg

SEQ ID NO: 3715130 - RNA, 12 nt, Salmonella enterica enterica serovar Typhi Ty2
caauaaacuggc

SEQ ID NO: 3715131 - RNA, 14 nt, Salmonella enterica enterica serovar Typhi Ty2
caauaaaucaacau

SEQ ID NO: 3715132 - RNA, 15 nt, Salmonella enterica enterica serovar Typhi Ty2
caauaacaccacaac

SEQ ID NO: 3715133 - RNA, 18 nt, Salmonella enterica enterica serovar Typhi Ty2
caauaacaccacaacaca

SEQ ID NO: 3715134 - RNA, 14 nt, Salmonella enterica enterica serovar Typhi Ty2
caauaacagccagc

SEQ ID NO: 3715135 - RNA, 15 nt, Salmonella enterica enterica serovar Typhi Ty2
caauaacagccagcg

SEQ ID NO: 3715136 - RNA, 16 nt, Salmonella enterica enterica serovar Typhi Ty2
caauaaccaccuguuc

SEQ ID NO: 3715137 - RNA, 14 nt, Salmonella enterica enterica serovar Typhi Ty2
caauaaccgccagc

SEQ ID NO: 3715138 - RNA, 19 nt, Salmonella enterica enterica serovar Typhi Ty2
caauaacgcauucaccuuc

SEQ ID NO: 3715139 - RNA, 23 nt, Salmonella enterica enterica serovar Typhi Ty2
caauaacgccggauauguuugac

SEQ ID NO: 3715140 - RNA, 13 nt, Salmonella enterica enterica serovar Typhi Ty2
caauaagaacuuu

SEQ ID NO: 3715141 - RNA, 17 nt, Salmonella enterica enterica serovar Typhi Ty2
caauaagcgguaauaau

SEQ ID NO: 3715142 - RNA, 20 nt, Salmonella enterica enterica serovar Typhi Ty2
caauaagcuugcuuuccaua

SEQ ID NO: 3715143 - RNA, 19 nt, Salmonella enterica enterica serovar Typhi Ty2
caauaagggcauguuucau

SEQ ID NO: 3715144 - RNA, 19 nt, Salmonella enterica enterica serovar Typhi Ty2
caauaagggucgcgcugua

SEQ ID NO: 3715145 - RNA, 23 nt, Salmonella enterica enterica serovar Typhi Ty2
caauaagggucgcgcuguauaau

SEQ ID NO: 3715146 - RNA, 23 nt, Salmonella enterica enterica serovar Typhi Ty2
caauaaguaaaaacgaaaaaccc

SEQ ID NO: 3715147 - RNA, 21 nt, Salmonella enterica enterica serovar Typhi Ty2
caauaaguuagcuuuuuuaug

SEQ ID NO: 3715148 - RNA, 19 nt, Salmonella enterica enterica serovar Typhi Ty2
caauaaucccuucuuuuac

SEQ ID NO: 3715149 - RNA, 16 nt, Salmonella enterica enterica serovar Typhi Ty2
caauaaucgaaauaaa

SEQ ID NO: 3715150 - RNA, 18 nt, Salmonella enterica enterica serovar Typhi Ty2
caauaaucgcgagaaaau

SEQ ID NO: 3715151 - RNA, 22 nt, Salmonella enterica enterica serovar Typhi Ty2
caauaaugcgcugcacaaucgc

SEQ ID NO: 3715152 - RNA, 14 nt, Salmonella enterica enterica serovar Typhi Ty2
caauaauggcgcga

SEQ ID NO: 3715153 - RNA, 23 nt, Salmonella enterica enterica serovar Typhi Ty2
caauacaggcgaccgggcagaca

SEQ ID NO: 3715154 - RNA, 14 nt, Salmonella enterica enterica serovar Typhi Ty2
caauaccaauuacc

SEQ ID NO: 3715155 - RNA, 15 nt, Salmonella enterica enterica serovar Typhi Ty2
caauaccaauuaccg

SEQ ID NO: 3715156 - RNA, 15 nt, Salmonella enterica enterica serovar Typhi Ty2
caauacccagcgcca

SEQ ID NO: 3715157 - RNA, 23 nt, Salmonella enterica enterica serovar Typhi Ty2
caauaccuguaaacgcuucugcg

SEQ ID NO: 3715158 - RNA, 16 nt, Salmonella enterica enterica serovar Typhi Ty2
caauaccuucugcgcc

SEQ ID NO: 3715159 - RNA, 19 nt, Salmonella enterica enterica serovar Typhi Ty2
caauacgagugacauuauu

SEQ ID NO: 3715160 - RNA, 19 nt, Salmonella enterica enterica serovar Typhi Ty2
caauacgaucggcuggaau

SEQ ID NO: 3715161 - RNA, 22 nt, Salmonella enterica enterica serovar Typhi Ty2
caauacgguaaacagauaagcg

SEQ ID NO: 3715162 - RNA, 20 nt, Salmonella enterica enterica serovar Typhi Ty2
caauacuccacaguucaaug

SEQ ID NO: 3715163 - RNA, 22 nt, Salmonella enterica enterica serovar Typhi Ty2
caauacuuuuugacuccugaca

SEQ ID NO: 3715164 - RNA, 15 nt, Salmonella enterica enterica serovar Typhi Ty2
caauagaccagcggc

SEQ ID NO: 3715165 - RNA, 21 nt, Salmonella enterica enterica serovar Typhi Ty2
caauagaccugaaaucagccu

SEQ ID NO: 3715166 - RNA, 22 nt, Salmonella enterica enterica serovar Typhi Ty2
caauagaccugaaaucagccug

SEQ ID NO: 3715167 - RNA, 16 nt, Salmonella enterica enterica serovar Typhi Ty2
caauagacuucacuuu

SEQ ID NO: 3715168 - RNA, 16 nt, Salmonella enterica enterica serovar Typhi Ty2
caauagcaaucuguaa

SEQ ID NO: 3715169 - RNA, 21 nt, Salmonella enterica enterica serovar Typhi Ty2
caauagcagcuucacgcgcug

SEQ ID NO: 3715170 - RNA, 19 nt, Salmonella enterica enterica serovar Typhi Ty2
caauagccaauaacgucug

SEQ ID NO: 3715171 - RNA, 16 nt, Salmonella enterica enterica serovar Typhi Ty2
caauagcgagaggcaa

SEQ ID NO: 3715172 - RNA, 20 nt, Salmonella enterica enterica serovar Typhi Ty2
caauaggggcggacaugcgc

SEQ ID NO: 3715173 - RNA, 22 nt, Salmonella enterica enterica serovar Typhi Ty2
caaugagcugcuugucacgaag

SEQ ID NO: 3715174 - RNA, 22 nt, Salmonella enterica enterica serovar Typhi Ty2
caaugauaacggcgccacgcgc

SEQ ID NO: 3715175 - RNA, 13 nt, Salmonella enterica enterica serovar Typhi Ty2
caaugaucagacg

SEQ ID NO: 3715176 - RNA, 17 nt, Salmonella enterica enterica serovar Typhi Ty2
caaugaugccuugcgaa

SEQ ID NO: 3715177 - RNA, 14 nt, Salmonella enterica enterica serovar Typhi Ty2
caaugcaacgccuu

SEQ ID NO: 3715178 - RNA, 20 nt, Salmonella enterica enterica serovar Typhi Ty2
caaugcacuacgaaaagagg

SEQ ID NO: 3715179 - RNA, 22 nt, Salmonella enterica enterica serovar Typhi Ty2
caaugcagggguguccagaugc

SEQ ID NO: 3715180 - RNA, 15 nt, Salmonella enterica enterica serovar Typhi Ty2
caaugccaccagcgc

SEQ ID NO: 3715181 - RNA, 15 nt, Salmonella enterica enterica serovar Typhi Ty2
caaugcccacgccgu

SEQ ID NO: 3715182 - RNA, 20 nt, Salmonella enterica enterica serovar Typhi Ty2
caaugcccuuaaauccggcc

SEQ ID NO: 3715183 - RNA, 23 nt, Salmonella enterica enterica serovar Typhi Ty2
caaugcccuuaaauccggccucc

SEQ ID NO: 3715184 - RNA, 17 nt, Salmonella enterica enterica serovar Typhi Ty2
caaugccggacgccacc

SEQ ID NO: 3715185 - RNA, 16 nt, Salmonella enterica enterica serovar Typhi Ty2
caaugccuaacccuuu

SEQ ID NO: 3715186 - RNA, 18 nt, Salmonella enterica enterica serovar Typhi Ty2
caaugccuaacccuuuuc

SEQ ID NO: 3715187 - RNA, 18 nt, Salmonella enterica enterica serovar Typhi Ty2
caaugccuuaugcccggc

SEQ ID NO: 3715188 - RNA, 18 nt, Salmonella enterica enterica serovar Typhi Ty2
caaugcgcguaauuugcg

SEQ ID NO: 3715189 - RNA, 20 nt, Salmonella enterica enterica serovar Typhi Ty2
caaugcgcguaauuugcgac

SEQ ID NO: 3715190 - RNA, 14 nt, Salmonella enterica enterica serovar Typhi Ty2
caaugcggaaacca

SEQ ID NO: 3715191 - RNA, 15 nt, Salmonella enterica enterica serovar Typhi Ty2
caaugcuuucaccag

SEQ ID NO: 3715192 - RNA, 16 nt, Salmonella enterica enterica serovar Typhi Ty2
caauggccgcagcgcc

SEQ ID NO: 3715193 - RNA, 19 nt, Salmonella enterica enterica serovar Typhi Ty2
caauggccgcagcgccaua

SEQ ID NO: 3715194 - RNA, 19 nt, Salmonella enterica enterica serovar Typhi Ty2
caauggcgacgaucagcgc

SEQ ID NO: 3715195 - RNA, 17 nt, Salmonella enterica enterica serovar Typhi Ty2
caauggcgcgucuuaaa

SEQ ID NO: 3715196 - RNA, 22 nt, Salmonella enterica enterica serovar Typhi Ty2
caauggcgcucggaugugcauu

SEQ ID NO: 3715197 - RNA, 18 nt, Salmonella enterica enterica serovar Typhi Ty2
caauggcgucaaacagcu

SEQ ID NO: 3715198 - RNA, 19 nt, Salmonella enterica enterica serovar Typhi Ty2
caaugguguuuuccagcgu

SEQ ID NO: 3715199 - RNA, 17 nt, Salmonella enterica enterica serovar Typhi Ty2
caaugguugccuggugu

SEQ ID NO: 3715200 - RNA, 14 nt, Salmonella enterica enterica serovar Typhi Ty2
caauguaaaacggu

SEQ ID NO: 3715201 - RNA, 23 nt, Salmonella enterica enterica serovar Typhi Ty2
caauguaaaacgguaugaaacau

SEQ ID NO: 3715202 - RNA, 14 nt, Salmonella enterica enterica serovar Typhi Ty2
caauguaaaacuga

SEQ ID NO: 3715203 - RNA, 14 nt, Salmonella enterica enterica serovar Typhi Ty2
caaugucauauuug

SEQ ID NO: 3715204 - RNA, 15 nt, Salmonella enterica enterica serovar Typhi Ty2
caauguccgccagac

SEQ ID NO: 3715205 - RNA, 17 nt, Salmonella enterica enterica serovar Typhi Ty2
caaugucgcaaucggcu

SEQ ID NO: 3715206 - RNA, 18 nt, Salmonella enterica enterica serovar Typhi Ty2
caaugucggccugauuuc

SEQ ID NO: 3715207 - RNA, 21 nt, Salmonella enterica enterica serovar Typhi Ty2
caaugugcagcaggacgcgca

SEQ ID NO: 3715208 - RNA, 19 nt, Salmonella enterica enterica serovar Typhi Ty2
caauguuaacuacuuuaca

SEQ ID NO: 3715209 - RNA, 20 nt, Salmonella enterica enterica serovar Typhi Ty2
caauguucugggaauaggcc

SEQ ID NO: 3715210 - RNA, 13 nt, Salmonella enterica enterica serovar Typhi Ty2
caauguugucgca

SEQ ID NO: 3715211 - RNA, 21 nt, Salmonella enterica enterica serovar Typhi Ty2
caauguuuuaccggcagcucu

SEQ ID NO: 3715212 - RNA, 14 nt, Salmonella enterica enterica serovar Typhi Ty2
caauuaacaaauaa

SEQ ID NO: 3715213 - RNA, 20 nt, Salmonella enterica enterica serovar Typhi Ty2
caauuaauauuuaacacauu

SEQ ID NO: 3715214 - RNA, 15 nt, Salmonella enterica enterica serovar Typhi Ty2
caauuauacgcuggu

SEQ ID NO: 3715215 - RNA, 23 nt, Salmonella enterica enterica serovar Typhi Ty2
caauuauguauuucucgccgccg

SEQ ID NO: 3715216 - RNA, 23 nt, Salmonella enterica enterica serovar Typhi Ty2
caauuccaccaccucggcacgga

SEQ ID NO: 3715217 - RNA, 19 nt, Salmonella enterica enterica serovar Typhi Ty2
caauuccggcccaggccau

SEQ ID NO: 3715218 - RNA, 23 nt, Salmonella enterica enterica serovar Typhi Ty2
caauucgagauuuuucugcgcca

SEQ ID NO: 3715219 - RNA, 20 nt, Salmonella enterica enterica serovar Typhi Ty2
caauucuggaaucaauuucc

SEQ ID NO: 3715220 - RNA, 14 nt, Salmonella enterica enterica serovar Typhi Ty2
caauugcaggcagc

SEQ ID NO: 3715221 - RNA, 18 nt, Salmonella enterica enterica serovar Typhi Ty2
caauugugugcacugcac

SEQ ID NO: 3715222 - RNA, 16 nt, Salmonella enterica enterica serovar Typhi Ty2
caauuuaccuauuucg

SEQ ID NO: 3715223 - RNA, 15 nt, Salmonella enterica enterica serovar Typhi Ty2
caauuuaucugcgug

SEQ ID NO: 3715224 - RNA, 15 nt, Salmonella enterica enterica serovar Typhi Ty2
caauuucaaugaugc

SEQ ID NO: 3715225 - RNA, 18 nt, Salmonella enterica enterica serovar Typhi Ty2
caauuucagcauccuccg

SEQ ID NO: 3715226 - RNA, 15 nt, Salmonella enterica enterica serovar Typhi Ty2
caauuucccccacuu

SEQ ID NO: 3715227 - RNA, 23 nt, Salmonella enterica enterica serovar Typhi Ty2
caauuuccccugcgaacagcgcu

SEQ ID NO: 3715228 - RNA, 14 nt, Salmonella enterica enterica serovar Typhi Ty2
caauuuccgccgcc

SEQ ID NO: 3715229 - RNA, 16 nt, Salmonella enterica enterica serovar Typhi Ty2
caauuuccgcugaaau

SEQ ID NO: 3715230 - RNA, 12 nt, Salmonella enterica enterica serovar Typhi Ty2
caauuuccugau

SEQ ID NO: 3715231 - RNA, 21 nt, Salmonella enterica enterica serovar Typhi Ty2
caauuucucgcucgcccauca

SEQ ID NO: 3715232 - RNA, 13 nt, Salmonella enterica enterica serovar Typhi Ty2
caauuugaaaagg

SEQ ID NO: 3715233 - RNA, 17 nt, Salmonella enterica enterica serovar Typhi Ty2
caauuugcccagcgcug

SEQ ID NO: 3715234 - RNA, 22 nt, Salmonella enterica enterica serovar Typhi Ty2
caauuugguuagggaucaucuu

SEQ ID NO: 3715235 - RNA, 23 nt, Salmonella enterica enterica serovar Typhi Ty2
caauuugugagauaaaaaagcug

SEQ ID NO: 3715236 - RNA, 15 nt, Salmonella enterica enterica serovar Typhi Ty2
caauuuuaagaauau

SEQ ID NO: 3715237 - RNA, 18 nt, Salmonella enterica enterica serovar Typhi Ty2
caauuuuacagccucucu

SEQ ID NO: 3715238 - RNA, 22 nt, Salmonella enterica enterica serovar Typhi Ty2
caauuuucuuaauaugcugccu

SEQ ID NO: 3715239 - RNA, 13 nt, Salmonella enterica enterica serovar Typhi Ty2
caauuuucuucau

SEQ ID NO: 3715240 - RNA, 18 nt, Salmonella enterica enterica serovar Typhi Ty2
caauuuugccgcaucgau

SEQ ID NO: 3715241 - RNA, 11 nt, Salmonella enterica enterica serovar Typhi Ty2
caauuuugcuc

SEQ ID NO: 3715242 - RNA, 22 nt, Salmonella enterica enterica serovar Typhi Ty2
caauuuugcucucgguguggcu

SEQ ID NO: 3715243 - RNA, 20 nt, Salmonella enterica enterica serovar Typhi Ty2
caauuuuuacaaauuuaaac

SEQ ID NO: 3715244 - RNA, 23 nt, Salmonella enterica enterica serovar Typhi Ty2
cacaaaaacacccgcagccgcaa

SEQ ID NO: 3715245 - RNA, 20 nt, Salmonella enterica enterica serovar Typhi Ty2
cacaaaaggauacagcgccg

SEQ ID NO: 3715246 - RNA, 23 nt, Salmonella enterica enterica serovar Typhi Ty2
cacaaaauuuugcauaaauaaug

SEQ ID NO: 3715247 - RNA, 15 nt, Salmonella enterica enterica serovar Typhi Ty2
cacaaacaauuuacg

SEQ ID NO: 3715248 - RNA, 21 nt, Salmonella enterica enterica serovar Typhi Ty2
cacaaacaauuuacgcagccc

SEQ ID NO: 3715249 - RNA, 23 nt, Salmonella enterica enterica serovar Typhi Ty2
cacaaacaauuuacgcagcccca

SEQ ID NO: 3715250 - RNA, 16 nt, Salmonella enterica enterica serovar Typhi Ty2
cacaaacuccagacga

SEQ ID NO: 3715251 - RNA, 14 nt, Salmonella enterica enterica serovar Typhi Ty2
cacaaagaauucuu

SEQ ID NO: 3715252 - RNA, 14 nt, Salmonella enterica enterica serovar Typhi Ty2
cacaaaucgggcgg

SEQ ID NO: 3715253 - RNA, 14 nt, Salmonella enterica enterica serovar Typhi Ty2
cacaaauuucgagc

SEQ ID NO: 3715254 - RNA, 19 nt, Salmonella enterica enterica serovar Typhi Ty2
cacaaauuucgagcagaac

SEQ ID NO: 3715255 - RNA, 16 nt, Salmonella enterica enterica serovar Typhi Ty2
cacaggccuucaugau

SEQ ID NO: 3715256 - RNA, 18 nt, Salmonella enterica enterica serovar Typhi Ty2
cacaggcggaaaacauuc

SEQ ID NO: 3715257 - RNA, 17 nt, Salmonella enterica enterica serovar Typhi Ty2
cacaggcgugguggaua

SEQ ID NO: 3715258 - RNA, 13 nt, Salmonella enterica enterica serovar Typhi Ty2
cacaggcugcggc

SEQ ID NO: 3715259 - RNA, 16 nt, Salmonella enterica enterica serovar Typhi Ty2
cacaggcugcggcacg

SEQ ID NO: 3715260 - RNA, 23 nt, Salmonella enterica enterica serovar Typhi Ty2
cacaggcuucgacaaacagcuau

SEQ ID NO: 3715261 - RNA, 17 nt, Salmonella enterica enterica serovar Typhi Ty2
cacaggcuuggcagccc

SEQ ID NO: 3715262 - RNA, 18 nt, Salmonella enterica enterica serovar Typhi Ty2
cacagggacuauaggcaa

SEQ ID NO: 3715263 - RNA, 17 nt, Salmonella enterica enterica serovar Typhi Ty2
cacagggggaacauuua

SEQ ID NO: 3715264 - RNA, 18 nt, Salmonella enterica enterica serovar Typhi Ty2
cacagguaaacgcauagg

SEQ ID NO: 3715265 - RNA, 14 nt, Salmonella enterica enterica serovar Typhi Ty2
cacagguacaggcc

SEQ ID NO: 3715266 - RNA, 20 nt, Salmonella enterica enterica serovar Typhi Ty2
cacaguaaaaaaacgccugu

SEQ ID NO: 3715267 - RNA, 15 nt, Salmonella enterica enterica serovar Typhi Ty2
cacaguacgcccggc

SEQ ID NO: 3715268 - RNA, 20 nt, Salmonella enterica enterica serovar Typhi Ty2
cacaguacgcccggcgggua

SEQ ID NO: 3715269 - RNA, 18 nt, Salmonella enterica enterica serovar Typhi Ty2
cacagugacccgccgcca

SEQ ID NO: 3715270 - RNA, 22 nt, Salmonella enterica enterica serovar Typhi Ty2
cacagugacccgccgccagcac

SEQ ID NO: 3715271 - RNA, 15 nt, Salmonella enterica enterica serovar Typhi Ty2
cacaguuuuuccccg

SEQ ID NO: 3715272 - RNA, 18 nt, Salmonella enterica enterica serovar Typhi Ty2
cacauaagcaacuugaag

SEQ ID NO: 3715273 - RNA, 14 nt, Salmonella enterica enterica serovar Typhi Ty2
cacauaagccacuu

SEQ ID NO: 3715274 - RNA, 13 nt, Salmonella enterica enterica serovar Typhi Ty2
cacauagagugau

SEQ ID NO: 3715275 - RNA, 18 nt, Salmonella enterica enterica serovar Typhi Ty2
cacauagcauccagaccc

SEQ ID NO: 3715276 - RNA, 14 nt, Salmonella enterica enterica serovar Typhi Ty2
cacauaggcaaaca

SEQ ID NO: 3715277 - RNA, 15 nt, Salmonella enterica enterica serovar Typhi Ty2
cacauaggcaaacac

SEQ ID NO: 3715278 - RNA, 21 nt, Salmonella enterica enterica serovar Typhi Ty2
cacauauaacaaacgccgcuc

SEQ ID NO: 3715279 - RNA, 15 nt, Salmonella enterica enterica serovar Typhi Ty2
cacauauauuucugu

SEQ ID NO: 3715280 - RNA, 19 nt, Salmonella enterica enterica serovar Typhi Ty2
cacauauucaauaauauua

SEQ ID NO: 3715281 - RNA, 14 nt, Salmonella enterica enterica serovar Typhi Ty2
cacauauugcgcuu

SEQ ID NO: 3715282 - RNA, 17 nt, Salmonella enterica enterica serovar Typhi Ty2
cacauauugcgcuucac

SEQ ID NO: 3715283 - RNA, 15 nt, Salmonella enterica enterica serovar Typhi Ty2
cacaucacaaucucc

SEQ ID NO: 3715284 - RNA, 20 nt, Salmonella enterica enterica serovar Typhi Ty2
cacaucaugaugaucuucag

SEQ ID NO: 3715285 - RNA, 23 nt, Salmonella enterica enterica serovar Typhi Ty2
cacaucaugaugaucuucagccc

SEQ ID NO: 3715286 - RNA, 12 nt, Salmonella enterica enterica serovar Typhi Ty2
cacaucauuaaa

SEQ ID NO: 3715287 - RNA, 17 nt, Salmonella enterica enterica serovar Typhi Ty2
cacaucauuaaagcgcu

SEQ ID NO: 3715288 - RNA, 20 nt, Salmonella enterica enterica serovar Typhi Ty2
cacauccagacagccgacgg

SEQ ID NO: 3715289 - RNA, 13 nt, Salmonella enterica enterica serovar Typhi Ty2
cacauccagcgcc

SEQ ID NO: 3715290 - RNA, 23 nt, Salmonella enterica enterica serovar Typhi Ty2
cacauccagcgccagcgccaccu

SEQ ID NO: 3715291 - RNA, 13 nt, Salmonella enterica enterica serovar Typhi Ty2
cacauccauguac

SEQ ID NO: 3715292 - RNA, 16 nt, Salmonella enterica enterica serovar Typhi Ty2
cacauccgccagcgcc

SEQ ID NO: 3715293 - RNA, 14 nt, Salmonella enterica enterica serovar Typhi Ty2
cacauccugcggga

SEQ ID NO: 3715294 - RNA, 17 nt, Salmonella enterica enterica serovar Typhi Ty2
cacaucgcccugauggc

SEQ ID NO: 3715295 - RNA, 15 nt, Salmonella enterica enterica serovar Typhi Ty2
cacaucgcgcagcag

SEQ ID NO: 3715296 - RNA, 20 nt, Salmonella enterica enterica serovar Typhi Ty2
cacaucguaaaucagcguga

SEQ ID NO: 3715297 - RNA, 18 nt, Salmonella enterica enterica serovar Typhi Ty2
cacaucguuaucuaugcu

SEQ ID NO: 3715298 - RNA, 23 nt, Salmonella enterica enterica serovar Typhi Ty2
cacaucuguuugagaaaaacauc

SEQ ID NO: 3715299 - RNA, 17 nt, Salmonella enterica enterica serovar Typhi Ty2
cacaugauguuuuaaca

SEQ ID NO: 3715300 - RNA, 20 nt, Salmonella enterica enterica serovar Typhi Ty2
cacaugcaaaaaagcccauc

SEQ ID NO: 3715301 - RNA, 19 nt, Salmonella enterica enterica serovar Typhi Ty2
cacaugcaagucgaacggu

SEQ ID NO: 3715302 - RNA, 14 nt, Salmonella enterica enterica serovar Typhi Ty2
cacauguuggcauu

SEQ ID NO: 3715303 - RNA, 20 nt, Salmonella enterica enterica serovar Typhi Ty2
cacauucagagcguccacgc

SEQ ID NO: 3715304 - RNA, 22 nt, Salmonella enterica enterica serovar Typhi Ty2
cacauucagagcguccacgcca

SEQ ID NO: 3715305 - RNA, 13 nt, Salmonella enterica enterica serovar Typhi Ty2
cacauucagcagc

SEQ ID NO: 3715306 - RNA, 12 nt, Salmonella enterica enterica serovar Typhi Ty2
cacauuccauuu

SEQ ID NO: 3715307 - RNA, 22 nt, Salmonella enterica enterica serovar Typhi Ty2
cacauucugcccgcguuuccac

SEQ ID NO: 3715308 - RNA, 14 nt, Salmonella enterica enterica serovar Typhi Ty2
cacauugcgcgccg

SEQ ID NO: 3715309 - RNA, 16 nt, Salmonella enterica enterica serovar Typhi Ty2
cacauugcgguucauu

SEQ ID NO: 3715310 - RNA, 19 nt, Salmonella enterica enterica serovar Typhi Ty2
cacauuggaaaaccccauc

SEQ ID NO: 3715311 - RNA, 14 nt, Salmonella enterica enterica serovar Typhi Ty2
cacauuggccccug

SEQ ID NO: 3715312 - RNA, 15 nt, Salmonella enterica enterica serovar Typhi Ty2
cacauuggccccugg

SEQ ID NO: 3715313 - RNA, 20 nt, Salmonella enterica enterica serovar Typhi Ty2
cacauuggcugcgcuucuga

SEQ ID NO: 3715314 - RNA, 17 nt, Salmonella enterica enterica serovar Typhi Ty2
cacauuucagcgcagaa

SEQ ID NO: 3715315 - RNA, 13 nt, Salmonella enterica enterica serovar Typhi Ty2
cacauuuuuauca

SEQ ID NO: 3715316 - RNA, 15 nt, Salmonella enterica enterica serovar Typhi Ty2
cacauuuuuaucagg

SEQ ID NO: 3715317 - RNA, 23 nt, Salmonella enterica enterica serovar Typhi Ty2
cacauuuuuaucaggccugccug

SEQ ID NO: 3715318 - RNA, 13 nt, Salmonella enterica enterica serovar Typhi Ty2
caccaaaaagcca

SEQ ID NO: 3715319 - RNA, 19 nt, Salmonella enterica enterica serovar Typhi Ty2
caccaaagccaggccgcca

SEQ ID NO: 3715320 - RNA, 23 nt, Salmonella enterica enterica serovar Typhi Ty2
caccaacgauaaauuuucagaca

SEQ ID NO: 3715321 - RNA, 23 nt, Salmonella enterica enterica serovar Typhi Ty2
caccaacggcgacgcccgccauc

SEQ ID NO: 3715322 - RNA, 21 nt, Salmonella enterica enterica serovar Typhi Ty2
caccaauuucaccggaugcgc

SEQ ID NO: 3715323 - RNA, 22 nt, Salmonella enterica enterica serovar Typhi Ty2
caccacaaacgccgucacaaag

SEQ ID NO: 3715324 - RNA, 19 nt, Salmonella enterica enterica serovar Typhi Ty2
caccacagucaucgcgcca

SEQ ID NO: 3715325 - RNA, 21 nt, Salmonella enterica enterica serovar Typhi Ty2
caccacauaccgucaccacgc

SEQ ID NO: 3715326 - RNA, 14 nt, Salmonella enterica enterica serovar Typhi Ty2
caccaccaggaacg

SEQ ID NO: 3715327 - RNA, 12 nt, Salmonella enterica enterica serovar Typhi Ty2
caccaccgccgc

SEQ ID NO: 3715328 - RNA, 14 nt, Salmonella enterica enterica serovar Typhi Ty2
caccaccuccugcu

SEQ ID NO: 3715329 - RNA, 13 nt, Salmonella enterica enterica serovar Typhi Ty2
caccaccugguua

SEQ ID NO: 3715330 - RNA, 15 nt, Salmonella enterica enterica serovar Typhi Ty2
caccacgcaaaccgc

SEQ ID NO: 3715331 - RNA, 14 nt, Salmonella enterica enterica serovar Typhi Ty2
caccacgcagcccg

SEQ ID NO: 3715332 - RNA, 22 nt, Salmonella enterica enterica serovar Typhi Ty2
caccacgcccggaucaaacaua

SEQ ID NO: 3715333 - RNA, 15 nt, Salmonella enterica enterica serovar Typhi Ty2
caccacgcccuucac

SEQ ID NO: 3715334 - RNA, 19 nt, Salmonella enterica enterica serovar Typhi Ty2
caccacgguguaccccgcc

SEQ ID NO: 3715335 - RNA, 22 nt, Salmonella enterica enterica serovar Typhi Ty2
caccacgguguaccccgccuga

SEQ ID NO: 3715336 - RNA, 18 nt, Salmonella enterica enterica serovar Typhi Ty2
caccacguaaugcgcccc

SEQ ID NO: 3715337 - RNA, 14 nt, Salmonella enterica enterica serovar Typhi Ty2
caccgauccgaaga

SEQ ID NO: 3715338 - RNA, 23 nt, Salmonella enterica enterica serovar Typhi Ty2
caccgauuucaucgcugaauuug

SEQ ID NO: 3715339 - RNA, 22 nt, Salmonella enterica enterica serovar Typhi Ty2
caccgcaaauucgucgccgcca

SEQ ID NO: 3715340 - RNA, 15 nt, Salmonella enterica enterica serovar Typhi Ty2
caccgccaaacgcgg

SEQ ID NO: 3715341 - RNA, 15 nt, Salmonella enterica enterica serovar Typhi Ty2
caccgccacuuccgc

SEQ ID NO: 3715342 - RNA, 18 nt, Salmonella enterica enterica serovar Typhi Ty2
caccgccagucccagcac

SEQ ID NO: 3715343 - RNA, 15 nt, Salmonella enterica enterica serovar Typhi Ty2
caccgccauauauuu

SEQ ID NO: 3715344 - RNA, 22 nt, Salmonella enterica enterica serovar Typhi Ty2
caccgccauauuaugcuggccu

SEQ ID NO: 3715345 - RNA, 15 nt, Salmonella enterica enterica serovar Typhi Ty2
caccgcccagagaau

SEQ ID NO: 3715346 - RNA, 15 nt, Salmonella enterica enterica serovar Typhi Ty2
caccgcccgccgggc

SEQ ID NO: 3715347 - RNA, 16 nt, Salmonella enterica enterica serovar Typhi Ty2
caccgcccgccgggcg

SEQ ID NO: 3715348 - RNA, 16 nt, Salmonella enterica enterica serovar Typhi Ty2
caccgcccuggcggga

SEQ ID NO: 3715349 - RNA, 21 nt, Salmonella enterica enterica serovar Typhi Ty2
caccgccgcgagagucgccag

SEQ ID NO: 3715350 - RNA, 12 nt, Salmonella enterica enterica serovar Typhi Ty2
caccgccgcgcu

SEQ ID NO: 3715351 - RNA, 22 nt, Salmonella enterica enterica serovar Typhi Ty2
caccgcgaauauacgcaccuga

SEQ ID NO: 3715352 - RNA, 13 nt, Salmonella enterica enterica serovar Typhi Ty2
caccgcgaugacc

SEQ ID NO: 3715353 - RNA, 15 nt, Salmonella enterica enterica serovar Typhi Ty2
caccgcgaugcugcu

SEQ ID NO: 3715354 - RNA, 22 nt, Salmonella enterica enterica serovar Typhi Ty2
caccgcgaugcugcucuccacg

SEQ ID NO: 3715355 - RNA, 16 nt, Salmonella enterica enterica serovar Typhi Ty2
caccgcgcgcgcggca

SEQ ID NO: 3715356 - RNA, 17 nt, Salmonella enterica enterica serovar Typhi Ty2
caccgcggcgcucgcca

SEQ ID NO: 3715357 - RNA, 20 nt, Salmonella enterica enterica serovar Typhi Ty2
caccgcuaaaaaacaggcgc

SEQ ID NO: 3715358 - RNA, 21 nt, Salmonella enterica enterica serovar Typhi Ty2
caccgcuucacauacccgcuu

SEQ ID NO: 3715359 - RNA, 14 nt, Salmonella enterica enterica serovar Typhi Ty2
caccgcuugccggc

SEQ ID NO: 3715360 - RNA, 19 nt, Salmonella enterica enterica serovar Typhi Ty2
caccgcuuuggcgcccauu

SEQ ID NO: 3715361 - RNA, 13 nt, Salmonella enterica enterica serovar Typhi Ty2
caccggaagugaa

SEQ ID NO: 3715362 - RNA, 13 nt, Salmonella enterica enterica serovar Typhi Ty2
caccggacauccc

SEQ ID NO: 3715363 - RNA, 18 nt, Salmonella enterica enterica serovar Typhi Ty2
caccggcacauccagcug

SEQ ID NO: 3715364 - RNA, 20 nt, Salmonella enterica enterica serovar Typhi Ty2
caccggccauugccgcgccg

SEQ ID NO: 3715365 - RNA, 15 nt, Salmonella enterica enterica serovar Typhi Ty2
caccggcccccggcc

SEQ ID NO: 3715366 - RNA, 13 nt, Salmonella enterica enterica serovar Typhi Ty2
caccggcgcgcca

SEQ ID NO: 3715367 - RNA, 14 nt, Salmonella enterica enterica serovar Typhi Ty2
caccggcgcgccag

SEQ ID NO: 3715368 - RNA, 12 nt, Salmonella enterica enterica serovar Typhi Ty2
caccggcggcca

SEQ ID NO: 3715369 - RNA, 14 nt, Salmonella enterica enterica serovar Typhi Ty2
caccggcggcgcca

SEQ ID NO: 3715370 - RNA, 19 nt, Salmonella enterica enterica serovar Typhi Ty2
caccggguuaaagcccuga

SEQ ID NO: 3715371 - RNA, 20 nt, Salmonella enterica enterica serovar Typhi Ty2
caccgguacacacgcgcuga

SEQ ID NO: 3715372 - RNA, 19 nt, Salmonella enterica enterica serovar Typhi Ty2
caccgguacgcuccagggc

SEQ ID NO: 3715373 - RNA, 21 nt, Salmonella enterica enterica serovar Typhi Ty2
caccgguugcgcaaccuccgc

SEQ ID NO: 3715374 - RNA, 21 nt, Salmonella enterica enterica serovar Typhi Ty2
caccgguuuuuccgcuucacc

SEQ ID NO: 3715375 - RNA, 15 nt, Salmonella enterica enterica serovar Typhi Ty2
caccguaaacggcuc

SEQ ID NO: 3715376 - RNA, 19 nt, Salmonella enterica enterica serovar Typhi Ty2
caccguaggccugauaaga

SEQ ID NO: 3715377 - RNA, 13 nt, Salmonella enterica enterica serovar Typhi Ty2
caccguauccggc

SEQ ID NO: 3715378 - RNA, 22 nt, Salmonella enterica enterica serovar Typhi Ty2
caccguaucgacauaguacccu

SEQ ID NO: 3715379 - RNA, 22 nt, Salmonella enterica enterica serovar Typhi Ty2
caccgucaacaucaucccgcgc

SEQ ID NO: 3715380 - RNA, 13 nt, Salmonella enterica enterica serovar Typhi Ty2
caccgucaauaac

SEQ ID NO: 3715381 - RNA, 21 nt, Salmonella enterica enterica serovar Typhi Ty2
caccgucacugaaccugccuu

SEQ ID NO: 3715382 - RNA, 23 nt, Salmonella enterica enterica serovar Typhi Ty2
caccgucgagaaaccgcucgccg

SEQ ID NO: 3715383 - RNA, 19 nt, Salmonella enterica enterica serovar Typhi Ty2
caccgucuccggcgcgccg

SEQ ID NO: 3715384 - RNA, 21 nt, Salmonella enterica enterica serovar Typhi Ty2
caccguuacgaacgaagguca

SEQ ID NO: 3715385 - RNA, 12 nt, Salmonella enterica enterica serovar Typhi Ty2
caccguuauccg

SEQ ID NO: 3715386 - RNA, 16 nt, Salmonella enterica enterica serovar Typhi Ty2
caccguucuggcugcc

SEQ ID NO: 3715387 - RNA, 20 nt, Salmonella enterica enterica serovar Typhi Ty2
caccguuucuuugcugccgu

SEQ ID NO: 3715388 - RNA, 18 nt, Salmonella enterica enterica serovar Typhi Ty2
caccguuugcagccagau

SEQ ID NO: 3715389 - RNA, 15 nt, Salmonella enterica enterica serovar Typhi Ty2
caccuaacccaccau

SEQ ID NO: 3715390 - RNA, 16 nt, Salmonella enterica enterica serovar Typhi Ty2
caccuaacccaccaua

SEQ ID NO: 3715391 - RNA, 22 nt, Salmonella enterica enterica serovar Typhi Ty2
caccucaagguagcgugucuac

SEQ ID NO: 3715392 - RNA, 23 nt, Salmonella enterica enterica serovar Typhi Ty2
caccucaccggcuguauacacuu

SEQ ID NO: 3715393 - RNA, 19 nt, Salmonella enterica enterica serovar Typhi Ty2
caccucacguucugcauau

SEQ ID NO: 3715394 - RNA, 14 nt, Salmonella enterica enterica serovar Typhi Ty2
caccucagccaacc

SEQ ID NO: 3715395 - RNA, 19 nt, Salmonella enterica enterica serovar Typhi Ty2
caccucagccaacccacgc

SEQ ID NO: 3715396 - RNA, 22 nt, Salmonella enterica enterica serovar Typhi Ty2
caccucagguaaauccgccagu

SEQ ID NO: 3715397 - RNA, 16 nt, Salmonella enterica enterica serovar Typhi Ty2
caccucaucaacgcca

SEQ ID NO: 3715398 - RNA, 23 nt, Salmonella enterica enterica serovar Typhi Ty2
caccucaucgcuaccuucuuccc

SEQ ID NO: 3715399 - RNA, 14 nt, Salmonella enterica enterica serovar Typhi Ty2
caccuccagcgccu

SEQ ID NO: 3715400 - RNA, 12 nt, Salmonella enterica enterica serovar Typhi Ty2
caccuccgccac

SEQ ID NO: 3715401 - RNA, 13 nt, Salmonella enterica enterica serovar Typhi Ty2
caccucgcaauau

SEQ ID NO: 3715402 - RNA, 23 nt, Salmonella enterica enterica serovar Typhi Ty2
caccucgcgacggugagcugaaa

SEQ ID NO: 3715403 - RNA, 16 nt, Salmonella enterica enterica serovar Typhi Ty2
caccucuuccgccagg

SEQ ID NO: 3715404 - RNA, 19 nt, Salmonella enterica enterica serovar Typhi Ty2
caccucuuccgccaggucg

SEQ ID NO: 3715405 - RNA, 16 nt, Salmonella enterica enterica serovar Typhi Ty2
caccugaaugcaaaga

SEQ ID NO: 3715406 - RNA, 12 nt, Salmonella enterica enterica serovar Typhi Ty2
caccugaugccc

SEQ ID NO: 3715407 - RNA, 18 nt, Salmonella enterica enterica serovar Typhi Ty2
caccugaugguuauuuuc

SEQ ID NO: 3715408 - RNA, 22 nt, Salmonella enterica enterica serovar Typhi Ty2
caccugauugauacgcgcccga

SEQ ID NO: 3715409 - RNA, 22 nt, Salmonella enterica enterica serovar Typhi Ty2
caccugcaaacguagcgcguca

SEQ ID NO: 3715410 - RNA, 22 nt, Salmonella enterica enterica serovar Typhi Ty2
caccugcaucacgcccggcggu

SEQ ID NO: 3715411 - RNA, 17 nt, Salmonella enterica enterica serovar Typhi Ty2
caccugccauucacgcu

SEQ ID NO: 3715412 - RNA, 20 nt, Salmonella enterica enterica serovar Typhi Ty2
caccugccauucacgcuggg

SEQ ID NO: 3715413 - RNA, 20 nt, Salmonella enterica enterica serovar Typhi Ty2
caccugcuguugcggaauac

SEQ ID NO: 3715414 - RNA, 18 nt, Salmonella enterica enterica serovar Typhi Ty2
caccuggagcgccuccca

SEQ ID NO: 3715415 - RNA, 23 nt, Salmonella enterica enterica serovar Typhi Ty2
caccugguaagcgccaagcggca

SEQ ID NO: 3715416 - RNA, 15 nt, Salmonella enterica enterica serovar Typhi Ty2
caccuggugcauuuu

SEQ ID NO: 3715417 - RNA, 20 nt, Salmonella enterica enterica serovar Typhi Ty2
caccugguuauuagaugcga

SEQ ID NO: 3715418 - RNA, 18 nt, Salmonella enterica enterica serovar Typhi Ty2
caccuguaaccccagcau

SEQ ID NO: 3715419 - RNA, 20 nt, Salmonella enterica enterica serovar Typhi Ty2
cacgcgcgcgcgucaacgcc

SEQ ID NO: 3715420 - RNA, 13 nt, Salmonella enterica enterica serovar Typhi Ty2
cacgcgcggcgcc

SEQ ID NO: 3715421 - RNA, 14 nt, Salmonella enterica enterica serovar Typhi Ty2
cacgcgcggcgcca

SEQ ID NO: 3715422 - RNA, 14 nt, Salmonella enterica enterica serovar Typhi Ty2
cacgcgcgucagga

SEQ ID NO: 3715423 - RNA, 22 nt, Salmonella enterica enterica serovar Typhi Ty2
cacgcggaaucgucacagaccc

SEQ ID NO: 3715424 - RNA, 17 nt, Salmonella enterica enterica serovar Typhi Ty2
cacgcguaaacuuccgc

SEQ ID NO: 3715425 - RNA, 20 nt, Salmonella enterica enterica serovar Typhi Ty2
cacgcguaucuggucaucgu

SEQ ID NO: 3715426 - RNA, 14 nt, Salmonella enterica enterica serovar Typhi Ty2
cacgcguuauacgc

SEQ ID NO: 3715427 - RNA, 16 nt, Salmonella enterica enterica serovar Typhi Ty2
cacgcguuauacgcau

SEQ ID NO: 3715428 - RNA, 18 nt, Salmonella enterica enterica serovar Typhi Ty2
cacgcuaaaaaaggcaga

SEQ ID NO: 3715429 - RNA, 13 nt, Salmonella enterica enterica serovar Typhi Ty2
cacgcuaaagcgc

SEQ ID NO: 3715430 - RNA, 19 nt, Salmonella enterica enterica serovar Typhi Ty2
cacgcucaauggcgcgcca

SEQ ID NO: 3715431 - RNA, 18 nt, Salmonella enterica enterica serovar Typhi Ty2
cacgcucccggaaccgac

SEQ ID NO: 3715432 - RNA, 23 nt, Salmonella enterica enterica serovar Typhi Ty2
cacgcucgaguucuucacgcuga

SEQ ID NO: 3715433 - RNA, 14 nt, Salmonella enterica enterica serovar Typhi Ty2
cacgcucgcggaag

SEQ ID NO: 3715434 - RNA, 17 nt, Salmonella enterica enterica serovar Typhi Ty2
cacgcugaggcgccguc

SEQ ID NO: 3715435 - RNA, 18 nt, Salmonella enterica enterica serovar Typhi Ty2
cacgcugaugcugugcag

SEQ ID NO: 3715436 - RNA, 13 nt, Salmonella enterica enterica serovar Typhi Ty2
cacgcugccgccg

SEQ ID NO: 3715437 - RNA, 14 nt, Salmonella enterica enterica serovar Typhi Ty2
cacgcugccgccgc

SEQ ID NO: 3715438 - RNA, 21 nt, Salmonella enterica enterica serovar Typhi Ty2
cacgcuggauaagacgacggu

SEQ ID NO: 3715439 - RNA, 13 nt, Salmonella enterica enterica serovar Typhi Ty2
cacgcuucgccug

SEQ ID NO: 3715440 - RNA, 18 nt, Salmonella enterica enterica serovar Typhi Ty2
cacgcuuuuacaucgcug

SEQ ID NO: 3715441 - RNA, 15 nt, Salmonella enterica enterica serovar Typhi Ty2
cacgcuuuucagcgc

SEQ ID NO: 3715442 - RNA, 18 nt, Salmonella enterica enterica serovar Typhi Ty2
cacgcuuuucagcgccag

SEQ ID NO: 3715443 - RNA, 15 nt, Salmonella enterica enterica serovar Typhi Ty2
cacggacagcgcgca

SEQ ID NO: 3715444 - RNA, 20 nt, Salmonella enterica enterica serovar Typhi Ty2
cacggagagacaguucagau

SEQ ID NO: 3715445 - RNA, 15 nt, Salmonella enterica enterica serovar Typhi Ty2
cacggaugaucuuca

SEQ ID NO: 3715446 - RNA, 16 nt, Salmonella enterica enterica serovar Typhi Ty2
cacggcaguacacgca

SEQ ID NO: 3715447 - RNA, 15 nt, Salmonella enterica enterica serovar Typhi Ty2
cacggcauaagccuc

SEQ ID NO: 3715448 - RNA, 17 nt, Salmonella enterica enterica serovar Typhi Ty2
cacggcauaagccucau

SEQ ID NO: 3715449 - RNA, 13 nt, Salmonella enterica enterica serovar Typhi Ty2
cacggcauucacg

SEQ ID NO: 3715450 - RNA, 23 nt, Salmonella enterica enterica serovar Typhi Ty2
cacggcauucacgucgcgcgccg

SEQ ID NO: 3715451 - RNA, 13 nt, Salmonella enterica enterica serovar Typhi Ty2
cacggcauucagu

SEQ ID NO: 3715452 - RNA, 15 nt, Salmonella enterica enterica serovar Typhi Ty2
cacggccacagccau

SEQ ID NO: 3715453 - RNA, 13 nt, Salmonella enterica enterica serovar Typhi Ty2
cacggccaccaua

SEQ ID NO: 3715454 - RNA, 16 nt, Salmonella enterica enterica serovar Typhi Ty2
cacggcgacaaccgga

SEQ ID NO: 3715455 - RNA, 14 nt, Salmonella enterica enterica serovar Typhi Ty2
cacggcgcagauau

SEQ ID NO: 3715456 - RNA, 22 nt, Salmonella enterica enterica serovar Typhi Ty2
cacggcgcucaggaucgccgga

SEQ ID NO: 3715457 - RNA, 15 nt, Salmonella enterica enterica serovar Typhi Ty2
cacggcggccauuac

SEQ ID NO: 3715458 - RNA, 20 nt, Salmonella enterica enterica serovar Typhi Ty2
cacggcguguugaaauccuc

SEQ ID NO: 3715459 - RNA, 21 nt, Salmonella enterica enterica serovar Typhi Ty2
cacggcucgccuuugcgcccg

SEQ ID NO: 3715460 - RNA, 13 nt, Salmonella enterica enterica serovar Typhi Ty2
cacggcuggcaau

SEQ ID NO: 3715461 - RNA, 15 nt, Salmonella enterica enterica serovar Typhi Ty2
cacgggcgcaccaua

SEQ ID NO: 3715462 - RNA, 18 nt, Salmonella enterica enterica serovar Typhi Ty2
cacggggcggacgaugaa

SEQ ID NO: 3715463 - RNA, 14 nt, Salmonella enterica enterica serovar Typhi Ty2
cacggggcggcaau

SEQ ID NO: 3715464 - RNA, 18 nt, Salmonella enterica enterica serovar Typhi Ty2
cacggguagcuagccaau

SEQ ID NO: 3715465 - RNA, 16 nt, Salmonella enterica enterica serovar Typhi Ty2
cacgguaaaacacgcc

SEQ ID NO: 3715466 - RNA, 17 nt, Salmonella enterica enterica serovar Typhi Ty2
cacgguauuaacaggcg

SEQ ID NO: 3715467 - RNA, 17 nt, Salmonella enterica enterica serovar Typhi Ty2
cacggucaaucaucaga

SEQ ID NO: 3715468 - RNA, 17 nt, Salmonella enterica enterica serovar Typhi Ty2
cacgguguaccccgccu

SEQ ID NO: 3715469 - RNA, 15 nt, Salmonella enterica enterica serovar Typhi Ty2
cacggugugccgcca

SEQ ID NO: 3715470 - RNA, 21 nt, Salmonella enterica enterica serovar Typhi Ty2
cacgguuaucuggcgcaaccg

SEQ ID NO: 3715471 - RNA, 14 nt, Salmonella enterica enterica serovar Typhi Ty2
cacgguucacauuc

SEQ ID NO: 3715472 - RNA, 23 nt, Salmonella enterica enterica serovar Typhi Ty2
cacgguucacggccaaagcgcga

SEQ ID NO: 3715473 - RNA, 13 nt, Salmonella enterica enterica serovar Typhi Ty2
cacgguugaagcg

SEQ ID NO: 3715474 - RNA, 15 nt, Salmonella enterica enterica serovar Typhi Ty2
cacgguuggcccagc

SEQ ID NO: 3715475 - RNA, 17 nt, Salmonella enterica enterica serovar Typhi Ty2
cacgguuucugcgcgcu

SEQ ID NO: 3715476 - RNA, 23 nt, Salmonella enterica enterica serovar Typhi Ty2
cacguaaugcgccccggcggcgu

SEQ ID NO: 3715477 - RNA, 13 nt, Salmonella enterica enterica serovar Typhi Ty2
cacguaauuuauu

SEQ ID NO: 3715478 - RNA, 16 nt, Salmonella enterica enterica serovar Typhi Ty2
cacguaauuuauuacg

SEQ ID NO: 3715479 - RNA, 18 nt, Salmonella enterica enterica serovar Typhi Ty2
cacguagccgucggcuuu

SEQ ID NO: 3715480 - RNA, 15 nt, Salmonella enterica enterica serovar Typhi Ty2
cacguaguaaugcau

SEQ ID NO: 3715481 - RNA, 20 nt, Salmonella enterica enterica serovar Typhi Ty2
cacguauucggcuuacccaa

SEQ ID NO: 3715482 - RNA, 19 nt, Salmonella enterica enterica serovar Typhi Ty2
cacgucacgcaacaggccg

SEQ ID NO: 3715483 - RNA, 19 nt, Salmonella enterica enterica serovar Typhi Ty2
cacgucagcgaccauugcg

SEQ ID NO: 3715484 - RNA, 17 nt, Salmonella enterica enterica serovar Typhi Ty2
cacgucauccggcaagc

SEQ ID NO: 3715485 - RNA, 18 nt, Salmonella enterica enterica serovar Typhi Ty2
cacgucuccucagaugua

SEQ ID NO: 3715486 - RNA, 17 nt, Salmonella enterica enterica serovar Typhi Ty2
cacgucugaugcguggc

SEQ ID NO: 3715487 - RNA, 17 nt, Salmonella enterica enterica serovar Typhi Ty2
cacgugguacacaauca

SEQ ID NO: 3715488 - RNA, 16 nt, Salmonella enterica enterica serovar Typhi Ty2
cacguuaaacaccuca

SEQ ID NO: 3715489 - RNA, 18 nt, Salmonella enterica enterica serovar Typhi Ty2
cacguuacccgccagucg

SEQ ID NO: 3715490 - RNA, 22 nt, Salmonella enterica enterica serovar Typhi Ty2
cacguuaccgcgcaguucaaua

SEQ ID NO: 3715491 - RNA, 23 nt, Salmonella enterica enterica serovar Typhi Ty2
cacguuccauuucagcgagugcg

SEQ ID NO: 3715492 - RNA, 16 nt, Salmonella enterica enterica serovar Typhi Ty2
cacguuuugcagcgcc

SEQ ID NO: 3715493 - RNA, 14 nt, Salmonella enterica enterica serovar Typhi Ty2
cacuaaaaacaggc

SEQ ID NO: 3715494 - RNA, 15 nt, Salmonella enterica enterica serovar Typhi Ty2
cacuaaaaacaggcu

SEQ ID NO: 3715495 - RNA, 13 nt, Salmonella enterica enterica serovar Typhi Ty2
cacuaaaacaccg

SEQ ID NO: 3715496 - RNA, 16 nt, Salmonella enterica enterica serovar Typhi Ty2
cacuaacgauguaaaa

SEQ ID NO: 3715497 - RNA, 20 nt, Salmonella enterica enterica serovar Typhi Ty2
cacuaacgauguaaaaccug

SEQ ID NO: 3715498 - RNA, 18 nt, Salmonella enterica enterica serovar Typhi Ty2
cacuaacuaauuguuugu

SEQ ID NO: 3715499 - RNA, 18 nt, Salmonella enterica enterica serovar Typhi Ty2
cacuaauccccauuuuuu

SEQ ID NO: 3715500 - RNA, 13 nt, Salmonella enterica enterica serovar Typhi Ty2
cacuaccagaaac

SEQ ID NO: 3715501 - RNA, 15 nt, Salmonella enterica enterica serovar Typhi Ty2
cacuuuuccagccaa

SEQ ID NO: 3715502 - RNA, 20 nt, Salmonella enterica enterica serovar Typhi Ty2
cacuuuucccgccagcugcg

SEQ ID NO: 3715503 - RNA, 18 nt, Salmonella enterica enterica serovar Typhi Ty2
cacuuuucuuuccugcaa

SEQ ID NO: 3715504 - RNA, 21 nt, Salmonella enterica enterica serovar Typhi Ty2
cacuuuucuuuccugcaaauu

SEQ ID NO: 3715505 - RNA, 19 nt, Salmonella enterica enterica serovar Typhi Ty2
cacuuuuggcgacaggaac

SEQ ID NO: 3715506 - RNA, 21 nt, Salmonella enterica enterica serovar Typhi Ty2
cacuuuuuauuuguuccucuu

SEQ ID NO: 3715507 - RNA, 19 nt, Salmonella enterica enterica serovar Typhi Ty2
cagaaaaaagccaagcaca

SEQ ID NO: 3715508 - RNA, 22 nt, Salmonella enterica enterica serovar Typhi Ty2
cagaaaaaagccaagcacaaaa

SEQ ID NO: 3715509 - RNA, 19 nt, Salmonella enterica enterica serovar Typhi Ty2
cagaaaaaaugcaccgccu

SEQ ID NO: 3715510 - RNA, 15 nt, Salmonella enterica enterica serovar Typhi Ty2
cagaaaaagccccca

SEQ ID NO: 3715511 - RNA, 22 nt, Salmonella enterica enterica serovar Typhi Ty2
cagaaacaagaagcacgacaca

SEQ ID NO: 3715512 - RNA, 17 nt, Salmonella enterica enterica serovar Typhi Ty2
cagaaagcaacagcaag

SEQ ID NO: 3715513 - RNA, 17 nt, Salmonella enterica enterica serovar Typhi Ty2
cagaaagccauaaaacu

SEQ ID NO: 3715514 - RNA, 13 nt, Salmonella enterica enterica serovar Typhi Ty2
cagaaaggaugcc

SEQ ID NO: 3715515 - RNA, 14 nt, Salmonella enterica enterica serovar Typhi Ty2
cagaaauaaaauac

SEQ ID NO: 3715516 - RNA, 16 nt, Salmonella enterica enterica serovar Typhi Ty2
cagaaaucgccgggcu

SEQ ID NO: 3715517 - RNA, 15 nt, Salmonella enterica enterica serovar Typhi Ty2
cagaaaucggcagca

SEQ ID NO: 3715518 - RNA, 10 nt, Salmonella enterica enterica serovar Typhi Ty2
cagaaaugac

SEQ ID NO: 3715519 - RNA, 21 nt, Salmonella enterica enterica serovar Typhi Ty2
cagaaauugaauuauaauaaa

SEQ ID NO: 3715520 - RNA, 13 nt, Salmonella enterica enterica serovar Typhi Ty2
cagaacaaaggcu

SEQ ID NO: 3715521 - RNA, 13 nt, Salmonella enterica enterica serovar Typhi Ty2
cagaacaucaagc

SEQ ID NO: 3715522 - RNA, 18 nt, Salmonella enterica enterica serovar Typhi Ty2
cagaaccccaucgccuga

SEQ ID NO: 3715523 - RNA, 19 nt, Salmonella enterica enterica serovar Typhi Ty2
cagaaccuguucaugccag

SEQ ID NO: 3715524 - RNA, 20 nt, Salmonella enterica enterica serovar Typhi Ty2
cagaaccuguucaugccaga

SEQ ID NO: 3715525 - RNA, 17 nt, Salmonella enterica enterica serovar Typhi Ty2
cagaacgcuuuugcgca

SEQ ID NO: 3715526 - RNA, 21 nt, Salmonella enterica enterica serovar Typhi Ty2
cagaacggcagcguccgccau

SEQ ID NO: 3715527 - RNA, 15 nt, Salmonella enterica enterica serovar Typhi Ty2
cagaacgggaaagcg

SEQ ID NO: 3715528 - RNA, 14 nt, Salmonella enterica enterica serovar Typhi Ty2
cagaacucaucuuc

SEQ ID NO: 3715529 - RNA, 20 nt, Salmonella enterica enterica serovar Typhi Ty2
cagaacucaucuucuuuuuc

SEQ ID NO: 3715530 - RNA, 21 nt, Salmonella enterica enterica serovar Typhi Ty2
cagaacucccuguuccuguau

SEQ ID NO: 3715531 - RNA, 17 nt, Salmonella enterica enterica serovar Typhi Ty2
cagaacugcgaaaucac

SEQ ID NO: 3715532 - RNA, 23 nt, Salmonella enterica enterica serovar Typhi Ty2
cagaagaaaaucaacacgucgau

SEQ ID NO: 3715533 - RNA, 16 nt, Salmonella enterica enterica serovar Typhi Ty2
cagaagacagaagcug

SEQ ID NO: 3715534 - RNA, 12 nt, Salmonella enterica enterica serovar Typhi Ty2
cagaagagaaug

SEQ ID NO: 3715535 - RNA, 16 nt, Salmonella enterica enterica serovar Typhi Ty2
cagaagcaaauucagg

SEQ ID NO: 3715536 - RNA, 14 nt, Salmonella enterica enterica serovar Typhi Ty2
cagaagcuaaggga

SEQ ID NO: 3715537 - RNA, 11 nt, Salmonella enterica enterica serovar Typhi Ty2
cagaagcuucg

SEQ ID NO: 3715538 - RNA, 12 nt, Salmonella enterica enterica serovar Typhi Ty2
cagaaggcaaaa

SEQ ID NO: 3715539 - RNA, 17 nt, Salmonella enterica enterica serovar Typhi Ty2
cagaaggcuaacagcug

SEQ ID NO: 3715540 - RNA, 19 nt, Salmonella enterica enterica serovar Typhi Ty2
cagaaggcuaacagcuggc

SEQ ID NO: 3715541 - RNA, 20 nt, Salmonella enterica enterica serovar Typhi Ty2
cagaaggcuaacagcuggcu

SEQ ID NO: 3715542 - RNA, 21 nt, Salmonella enterica enterica serovar Typhi Ty2
cagaaggcuaacagcuggcuu

SEQ ID NO: 3715543 - RNA, 23 nt, Salmonella enterica enterica serovar Typhi Ty2
cagaaggcuugauacugaggauu

SEQ ID NO: 3715544 - RNA, 23 nt, Salmonella enterica enterica serovar Typhi Ty2
cagaaggugaguuucgcaucagg

SEQ ID NO: 3715545 - RNA, 20 nt, Salmonella enterica enterica serovar Typhi Ty2
cagaauaaacggcagggcag

SEQ ID NO: 3715546 - RNA, 16 nt, Salmonella enterica enterica serovar Typhi Ty2
cagaauaagccagguu

SEQ ID NO: 3715547 - RNA, 18 nt, Salmonella enterica enterica serovar Typhi Ty2
cagaauaaugcuggcgga

SEQ ID NO: 3715548 - RNA, 13 nt, Salmonella enterica enterica serovar Typhi Ty2
cagaauaauguug

SEQ ID NO: 3715549 - RNA, 16 nt, Salmonella enterica enterica serovar Typhi Ty2
cagaauacacuucuca

SEQ ID NO: 3715550 - RNA, 13 nt, Salmonella enterica enterica serovar Typhi Ty2
cagaauaccagaa

SEQ ID NO: 3715551 - RNA, 17 nt, Salmonella enterica enterica serovar Typhi Ty2
cagaauacgaauauuca

SEQ ID NO: 3715552 - RNA, 17 nt, Salmonella enterica enterica serovar Typhi Ty2
cagaauagcgucaauaa

SEQ ID NO: 3715553 - RNA, 15 nt, Salmonella enterica enterica serovar Typhi Ty2
cagaauaucuuuuac

SEQ ID NO: 3715554 - RNA, 17 nt, Salmonella enterica enterica serovar Typhi Ty2
cagaauauuuuucucag

SEQ ID NO: 3715555 - RNA, 21 nt, Salmonella enterica enterica serovar Typhi Ty2
cagaaucaccucuuucuccac

SEQ ID NO: 3715556 - RNA, 13 nt, Salmonella enterica enterica serovar Typhi Ty2
cagaaucaggcca

SEQ ID NO: 3715557 - RNA, 18 nt, Salmonella enterica enterica serovar Typhi Ty2
cagaaucaucaugucguc

SEQ ID NO: 3715558 - RNA, 19 nt, Salmonella enterica enterica serovar Typhi Ty2
cagaaucaucaugucguca

SEQ ID NO: 3715559 - RNA, 21 nt, Salmonella enterica enterica serovar Typhi Ty2
cagaauccgucagguuuuuug

SEQ ID NO: 3715560 - RNA, 14 nt, Salmonella enterica enterica serovar Typhi Ty2
cagaaucgccagca

SEQ ID NO: 3715561 - RNA, 15 nt, Salmonella enterica enterica serovar Typhi Ty2
cagaaucgccagcau

SEQ ID NO: 3715562 - RNA, 24 nt, Salmonella enterica enterica serovar Typhi Ty2
cagaaugauaaugccgcugauaau

SEQ ID NO: 3715563 - RNA, 15 nt, Salmonella enterica enterica serovar Typhi Ty2
cagaaugccagcgcc

SEQ ID NO: 3715564 - RNA, 15 nt, Salmonella enterica enterica serovar Typhi Ty2
cagaaugcccagcaa

SEQ ID NO: 3715565 - RNA, 16 nt, Salmonella enterica enterica serovar Typhi Ty2
cagaaugcccugcugu

SEQ ID NO: 3715566 - RNA, 17 nt, Salmonella enterica enterica serovar Typhi Ty2
cagaauggcgauuaacg

SEQ ID NO: 3715567 - RNA, 20 nt, Salmonella enterica enterica serovar Typhi Ty2
cagaauucguacguuuuucc

SEQ ID NO: 3715568 - RNA, 15 nt, Salmonella enterica enterica serovar Typhi Ty2
cagaauuuauuucug

SEQ ID NO: 3715569 - RNA, 16 nt, Salmonella enterica enterica serovar Typhi Ty2
cagaauuuauuucugc

SEQ ID NO: 3715570 - RNA, 21 nt, Salmonella enterica enterica serovar Typhi Ty2
cagaauuucgcccuguauaca

SEQ ID NO: 3715571 - RNA, 15 nt, Salmonella enterica enterica serovar Typhi Ty2
cagaauuuguuuaug

SEQ ID NO: 3715572 - RNA, 15 nt, Salmonella enterica enterica serovar Typhi Ty2
cagaauuuuuaacca

SEQ ID NO: 3715573 - RNA, 21 nt, Salmonella enterica enterica serovar Typhi Ty2
cagacaaaaucuuuccagcuc

SEQ ID NO: 3715574 - RNA, 18 nt, Salmonella enterica enterica serovar Typhi Ty2
cagacaaagggcacaccg

SEQ ID NO: 3715575 - RNA, 16 nt, Salmonella enterica enterica serovar Typhi Ty2
cagacaacgccgccug

SEQ ID NO: 3715576 - RNA, 17 nt, Salmonella enterica enterica serovar Typhi Ty2
cagacaacguccugcgg

SEQ ID NO: 3715577 - RNA, 16 nt, Salmonella enterica enterica serovar Typhi Ty2
cagacaagcacauaac

SEQ ID NO: 3715578 - RNA, 18 nt, Salmonella enterica enterica serovar Typhi Ty2
cagacaauaaacgguccg

SEQ ID NO: 3715579 - RNA, 14 nt, Salmonella enterica enterica serovar Typhi Ty2
cagacaauccgcgg

SEQ ID NO: 3715580 - RNA, 20 nt, Salmonella enterica enterica serovar Typhi Ty2
cagacaaucugugugggcac

SEQ ID NO: 3715581 - RNA, 12 nt, Salmonella enterica enterica serovar Typhi Ty2
cagacacuggaa

SEQ ID NO: 3715582 - RNA, 19 nt, Salmonella enterica enterica serovar Typhi Ty2
cagacacuggaaacagcca

SEQ ID NO: 3715583 - RNA, 16 nt, Salmonella enterica enterica serovar Typhi Ty2
cagagagggaaaaaaa

SEQ ID NO: 3715584 - RNA, 18 nt, Salmonella enterica enterica serovar Typhi Ty2
cagagagggaaaaaaauc

SEQ ID NO: 3715585 - RNA, 17 nt, Salmonella enterica enterica serovar Typhi Ty2
cagagauaauuuuccca

SEQ ID NO: 3715586 - RNA, 17 nt, Salmonella enterica enterica serovar Typhi Ty2
cagagauccacauuggu

SEQ ID NO: 3715587 - RNA, 22 nt, Salmonella enterica enterica serovar Typhi Ty2
cagagauucgccguucuguucu

SEQ ID NO: 3715588 - RNA, 12 nt, Salmonella enterica enterica serovar Typhi Ty2
cagagcaacgag

SEQ ID NO: 3715589 - RNA, 16 nt, Salmonella enterica enterica serovar Typhi Ty2
cagagcaucuaccgca

SEQ ID NO: 3715590 - RNA, 16 nt, Salmonella enterica enterica serovar Typhi Ty2
cagagcgauaaagaac

SEQ ID NO: 3715591 - RNA, 20 nt, Salmonella enterica enterica serovar Typhi Ty2
cagagcgccggcaaagccau

SEQ ID NO: 3715592 - RNA, 17 nt, Salmonella enterica enterica serovar Typhi Ty2
cagagcgcgcuggcaag

SEQ ID NO: 3715593 - RNA, 20 nt, Salmonella enterica enterica serovar Typhi Ty2
cagagcgcgcuggcaagcgc

SEQ ID NO: 3715594 - RNA, 15 nt, Salmonella enterica enterica serovar Typhi Ty2
cagagcggauaaaua

SEQ ID NO: 3715595 - RNA, 17 nt, Salmonella enterica enterica serovar Typhi Ty2
cagagcggggaaacucu

SEQ ID NO: 3715596 - RNA, 18 nt, Salmonella enterica enterica serovar Typhi Ty2
cagagcucgucaaaaauc

SEQ ID NO: 3715597 - RNA, 20 nt, Salmonella enterica enterica serovar Typhi Ty2
cagagcucgucaaaaaucac

SEQ ID NO: 3715598 - RNA, 16 nt, Salmonella enterica enterica serovar Typhi Ty2
cagaggccugaaugca

SEQ ID NO: 3715599 - RNA, 18 nt, Salmonella enterica enterica serovar Typhi Ty2
cagaguaaaaaaaccggc

SEQ ID NO: 3715600 - RNA, 12 nt, Salmonella enterica enterica serovar Typhi Ty2
cagaguacauuc

SEQ ID NO: 3715601 - RNA, 14 nt, Salmonella enterica enterica serovar Typhi Ty2
cagaguacgucgcc

SEQ ID NO: 3715602 - RNA, 20 nt, Salmonella enterica enterica serovar Typhi Ty2
cagaguacuggaauaucuaa

SEQ ID NO: 3715603 - RNA, 16 nt, Salmonella enterica enterica serovar Typhi Ty2
cagaguaugcugcuaa

SEQ ID NO: 3715604 - RNA, 17 nt, Salmonella enterica enterica serovar Typhi Ty2
cagaguccagcggcagc

SEQ ID NO: 3715605 - RNA, 17 nt, Salmonella enterica enterica serovar Typhi Ty2
cagagucugaaaacuca

SEQ ID NO: 3715606 - RNA, 15 nt, Salmonella enterica enterica serovar Typhi Ty2
cagagugcucaauaa

SEQ ID NO: 3715607 - RNA, 16 nt, Salmonella enterica enterica serovar Typhi Ty2
cagagugcucaauaag

SEQ ID NO: 3715608 - RNA, 18 nt, Salmonella enterica enterica serovar Typhi Ty2
cagaguucuuuugaggcu

SEQ ID NO: 3715609 - RNA, 14 nt, Salmonella enterica enterica serovar Typhi Ty2
cagauaaaucagcc

SEQ ID NO: 3715610 - RNA, 15 nt, Salmonella enterica enterica serovar Typhi Ty2
cagauaacaccagcg

SEQ ID NO: 3715611 - RNA, 18 nt, Salmonella enterica enterica serovar Typhi Ty2
cagauaacaggcaguuuc

SEQ ID NO: 3715612 - RNA, 12 nt, Salmonella enterica enterica serovar Typhi Ty2
cagauaacccgg

SEQ ID NO: 3715613 - RNA, 17 nt, Salmonella enterica enterica serovar Typhi Ty2
cagauaacccggcgcag

SEQ ID NO: 3715614 - RNA, 13 nt, Salmonella enterica enterica serovar Typhi Ty2
cagauaaccgucg

SEQ ID NO: 3715615 - RNA, 22 nt, Salmonella enterica enterica serovar Typhi Ty2
cagauaacgaaccaucauuaau

SEQ ID NO: 3715616 - RNA, 22 nt, Salmonella enterica enterica serovar Typhi Ty2
cagauaacgcaucagacuguua

SEQ ID NO: 3715617 - RNA, 13 nt, Salmonella enterica enterica serovar Typhi Ty2
cagauaacugagc

SEQ ID NO: 3715618 - RNA, 13 nt, Salmonella enterica enterica serovar Typhi Ty2
cagauaacuuccu

SEQ ID NO: 3715619 - RNA, 21 nt, Salmonella enterica enterica serovar Typhi Ty2
cagauaagcucuccuggaugc

SEQ ID NO: 3715620 - RNA, 23 nt, Salmonella enterica enterica serovar Typhi Ty2
cagauaaguuugcagaucggccu

SEQ ID NO: 3715621 - RNA, 15 nt, Salmonella enterica enterica serovar Typhi Ty2
cagauaauccagcgu

SEQ ID NO: 3715622 - RNA, 17 nt, Salmonella enterica enterica serovar Typhi Ty2
cagauaauuaauaaugg

SEQ ID NO: 3715623 - RNA, 23 nt, Salmonella enterica enterica serovar Typhi Ty2
cagauacacgccuuccuccagca

SEQ ID NO: 3715624 - RNA, 19 nt, Salmonella enterica enterica serovar Typhi Ty2
cagauaccagcguugaauc

SEQ ID NO: 3715625 - RNA, 21 nt, Salmonella enterica enterica serovar Typhi Ty2
cagauaccgaccgugagaauc

SEQ ID NO: 3715626 - RNA, 17 nt, Salmonella enterica enterica serovar Typhi Ty2
cagauacggcuccagca

SEQ ID NO: 3715627 - RNA, 20 nt, Salmonella enterica enterica serovar Typhi Ty2
cagauacugcgcguggcaaa

SEQ ID NO: 3715628 - RNA, 15 nt, Salmonella enterica enterica serovar Typhi Ty2
cagauacuucaguuu

SEQ ID NO: 3715629 - RNA, 20 nt, Salmonella enterica enterica serovar Typhi Ty2
cagauagcaaaaaagcgccu

SEQ ID NO: 3715630 - RNA, 13 nt, Salmonella enterica enterica serovar Typhi Ty2
cagauagcgcugc

SEQ ID NO: 3715631 - RNA, 15 nt, Salmonella enterica enterica serovar Typhi Ty2
cagauagcguaaccg

SEQ ID NO: 3715632 - RNA, 15 nt, Salmonella enterica enterica serovar Typhi Ty2
cagauagcuuccaug

SEQ ID NO: 3715633 - RNA, 20 nt, Salmonella enterica enterica serovar Typhi Ty2
cagauaggcggcaaauaaag

SEQ ID NO: 3715634 - RNA, 24 nt, Salmonella enterica enterica serovar Typhi Ty2
cagauaggcggcaaauaaagccag

SEQ ID NO: 3715635 - RNA, 17 nt, Salmonella enterica enterica serovar Typhi Ty2
cagauagggccaggcgc

SEQ ID NO: 3715636 - RNA, 12 nt, Salmonella enterica enterica serovar Typhi Ty2
cagauagucauc

SEQ ID NO: 3715637 - RNA, 19 nt, Salmonella enterica enterica serovar Typhi Ty2
cagauaguggcugaggccg

SEQ ID NO: 3715638 - RNA, 21 nt, Salmonella enterica enterica serovar Typhi Ty2
cagauaguuagcuaucgcgcc

SEQ ID NO: 3715639 - RNA, 18 nt, Salmonella enterica enterica serovar Typhi Ty2
cagauauuccagcgacau

SEQ ID NO: 3715640 - RNA, 18 nt, Salmonella enterica enterica serovar Typhi Ty2
cagaucagcacgcgccgu

SEQ ID NO: 3715641 - RNA, 16 nt, Salmonella enterica enterica serovar Typhi Ty2
cagaucaggucugaga

SEQ ID NO: 3715642 - RNA, 14 nt, Salmonella enterica enterica serovar Typhi Ty2
cagauccaaauggc

SEQ ID NO: 3715643 - RNA, 15 nt, Salmonella enterica enterica serovar Typhi Ty2
cagauccuuuuucug

SEQ ID NO: 3715644 - RNA, 15 nt, Salmonella enterica enterica serovar Typhi Ty2
cagaucgaaugaaaa

SEQ ID NO: 3715645 - RNA, 22 nt, Salmonella enterica enterica serovar Typhi Ty2
cagaucgccacgauugaucuca

SEQ ID NO: 3715646 - RNA, 19 nt, Salmonella enterica enterica serovar Typhi Ty2
cagaucggcagacaguuuc

SEQ ID NO: 3715647 - RNA, 15 nt, Salmonella enterica enterica serovar Typhi Ty2
cagaucgguuuaucc

SEQ ID NO: 3715648 - RNA, 22 nt, Salmonella enterica enterica serovar Typhi Ty2
cagaucgguuuauccccgcugg

SEQ ID NO: 3715649 - RNA, 23 nt, Salmonella enterica enterica serovar Typhi Ty2
cagaucguagccauguuccucac

SEQ ID NO: 3715650 - RNA, 18 nt, Salmonella enterica enterica serovar Typhi Ty2
cagaucguaugcgccugu

SEQ ID NO: 3715651 - RNA, 22 nt, Salmonella enterica enterica serovar Typhi Ty2
cagaucuuauaugagcgggccg

SEQ ID NO: 3715652 - RNA, 14 nt, Salmonella enterica enterica serovar Typhi Ty2
cagaucuucaaucg

SEQ ID NO: 3715653 - RNA, 21 nt, Salmonella enterica enterica serovar Typhi Ty2
cagaucuucaaucgugaccac

SEQ ID NO: 3715654 - RNA, 18 nt, Salmonella enterica enterica serovar Typhi Ty2
cagaucuugugaguaaua

SEQ ID NO: 3715655 - RNA, 17 nt, Salmonella enterica enterica serovar Typhi Ty2
cagaucuuuauccugca

SEQ ID NO: 3715656 - RNA, 17 nt, Salmonella enterica enterica serovar Typhi Ty2
cagaugaagcgcaucgg

SEQ ID NO: 3715657 - RNA, 19 nt, Salmonella enterica enterica serovar Typhi Ty2
cagaugcagguucccgccc

SEQ ID NO: 3715658 - RNA, 21 nt, Salmonella enterica enterica serovar Typhi Ty2
cagaugcagguucccgcccug

SEQ ID NO: 3715659 - RNA, 19 nt, Salmonella enterica enterica serovar Typhi Ty2
cagaugcccguaaagcucg

SEQ ID NO: 3715660 - RNA, 21 nt, Salmonella enterica enterica serovar Typhi Ty2
cagaugcgccagauucaugau

SEQ ID NO: 3715661 - RNA, 15 nt, Salmonella enterica enterica serovar Typhi Ty2
cagaugcgcuucaag

SEQ ID NO: 3715662 - RNA, 21 nt, Salmonella enterica enterica serovar Typhi Ty2
cagaugcugucuuagugaaag

SEQ ID NO: 3715663 - RNA, 17 nt, Salmonella enterica enterica serovar Typhi Ty2
cagaugcuuaaacugcg

SEQ ID NO: 3715664 - RNA, 23 nt, Salmonella enterica enterica serovar Typhi Ty2
cagaugcuuaaugcucugcugug

SEQ ID NO: 3715665 - RNA, 13 nt, Salmonella enterica enterica serovar Typhi Ty2
cagcaccuccagc

SEQ ID NO: 3715666 - RNA, 14 nt, Salmonella enterica enterica serovar Typhi Ty2
cagcaccuccagcg

SEQ ID NO: 3715667 - RNA, 15 nt, Salmonella enterica enterica serovar Typhi Ty2
cagcaccuccagcgc

SEQ ID NO: 3715668 - RNA, 16 nt, Salmonella enterica enterica serovar Typhi Ty2
cagcaccuccagcgcc

SEQ ID NO: 3715669 - RNA, 15 nt, Salmonella enterica enterica serovar Typhi Ty2
cagcacgagcgccag

SEQ ID NO: 3715670 - RNA, 19 nt, Salmonella enterica enterica serovar Typhi Ty2
cagcacgccgcccgccuga

SEQ ID NO: 3715671 - RNA, 19 nt, Salmonella enterica enterica serovar Typhi Ty2
cagcacgcgcugcgccgca

SEQ ID NO: 3715672 - RNA, 14 nt, Salmonella enterica enterica serovar Typhi Ty2
cagcacgggccugu

SEQ ID NO: 3715673 - RNA, 17 nt, Salmonella enterica enterica serovar Typhi Ty2
cagcacgguaaaccucu

SEQ ID NO: 3715674 - RNA, 19 nt, Salmonella enterica enterica serovar Typhi Ty2
cagcacguagcuuauaaau

SEQ ID NO: 3715675 - RNA, 18 nt, Salmonella enterica enterica serovar Typhi Ty2
cagcacguuaccggcggu

SEQ ID NO: 3715676 - RNA, 18 nt, Salmonella enterica enterica serovar Typhi Ty2
cagcacuaacagcagcag

SEQ ID NO: 3715677 - RNA, 23 nt, Salmonella enterica enterica serovar Typhi Ty2
cagcacuaacagcagcagcaaac

SEQ ID NO: 3715678 - RNA, 15 nt, Salmonella enterica enterica serovar Typhi Ty2
cagcacuucccgcuc

SEQ ID NO: 3715679 - RNA, 19 nt, Salmonella enterica enterica serovar Typhi Ty2
cagcagaacaaccagugcg

SEQ ID NO: 3715680 - RNA, 12 nt, Salmonella enterica enterica serovar Typhi Ty2
cagcagaauaac

SEQ ID NO: 3715681 - RNA, 17 nt, Salmonella enterica enterica serovar Typhi Ty2
cagcagaaucaggcaca

SEQ ID NO: 3715682 - RNA, 16 nt, Salmonella enterica enterica serovar Typhi Ty2
cagcagacaggugaac

SEQ ID NO: 3715683 - RNA, 20 nt, Salmonella enterica enterica serovar Typhi Ty2
cagcagacugccuacgcggc

SEQ ID NO: 3715684 - RNA, 22 nt, Salmonella enterica enterica serovar Typhi Ty2
cagcagacugccuacgcggcca

SEQ ID NO: 3715685 - RNA, 15 nt, Salmonella enterica enterica serovar Typhi Ty2
cagcagacugguaac

SEQ ID NO: 3715686 - RNA, 24 nt, Salmonella enterica enterica serovar Typhi Ty2
cagcagauaauuuuucagacguca

SEQ ID NO: 3715687 - RNA, 23 nt, Salmonella enterica enterica serovar Typhi Ty2
cagcagauagcccgccagcacca

SEQ ID NO: 3715688 - RNA, 15 nt, Salmonella enterica enterica serovar Typhi Ty2
cagcagcaccggcug

SEQ ID NO: 3715689 - RNA, 16 nt, Salmonella enterica enterica serovar Typhi Ty2
cagcagcagaaucagg

SEQ ID NO: 3715690 - RNA, 12 nt, Salmonella enterica enterica serovar Typhi Ty2
cagcagccagaa

SEQ ID NO: 3715691 - RNA, 15 nt, Salmonella enterica enterica serovar Typhi Ty2
cagcagccaugccag

SEQ ID NO: 3715692 - RNA, 20 nt, Salmonella enterica enterica serovar Typhi Ty2
cagcagccgggccagacgcu

SEQ ID NO: 3715693 - RNA, 20 nt, Salmonella enterica enterica serovar Typhi Ty2
cagcagccgguauccagcgc

SEQ ID NO: 3715694 - RNA, 18 nt, Salmonella enterica enterica serovar Typhi Ty2
cagcagcgacgcauugag

SEQ ID NO: 3715695 - RNA, 15 nt, Salmonella enterica enterica serovar Typhi Ty2
cagcagcgagauggc

SEQ ID NO: 3715696 - RNA, 15 nt, Salmonella enterica enterica serovar Typhi Ty2
cagcagcgcaucaug

SEQ ID NO: 3715697 - RNA, 20 nt, Salmonella enterica enterica serovar Typhi Ty2
cagcagcgcccagccaaagc

SEQ ID NO: 3715698 - RNA, 13 nt, Salmonella enterica enterica serovar Typhi Ty2
cagcagcgcggca

SEQ ID NO: 3715699 - RNA, 22 nt, Salmonella enterica enterica serovar Typhi Ty2
cagcagcgcuuucuucuucacg

SEQ ID NO: 3715700 - RNA, 17 nt, Salmonella enterica enterica serovar Typhi Ty2
cagcagcggaaucgcuu

SEQ ID NO: 3715701 - RNA, 13 nt, Salmonella enterica enterica serovar Typhi Ty2
cagcagcugcugu

SEQ ID NO: 3715702 - RNA, 14 nt, Salmonella enterica enterica serovar Typhi Ty2
cagcagcuucagca

SEQ ID NO: 3715703 - RNA, 17 nt, Salmonella enterica enterica serovar Typhi Ty2
cagcagcuucaugcauc

SEQ ID NO: 3715704 - RNA, 22 nt, Salmonella enterica enterica serovar Typhi Ty2
cagcaggacaaccccuacgcag

SEQ ID NO: 3715705 - RNA, 16 nt, Salmonella enterica enterica serovar Typhi Ty2
cagcaggacgcgcacu

SEQ ID NO: 3715706 - RNA, 23 nt, Salmonella enterica enterica serovar Typhi Ty2
cagcaggauagcgaccagcguca

SEQ ID NO: 3715707 - RNA, 20 nt, Salmonella enterica enterica serovar Typhi Ty2
cagcaggcuuugcugcugcg

SEQ ID NO: 3715708 - RNA, 21 nt, Salmonella enterica enterica serovar Typhi Ty2
cagcagggauauacaaauauc

SEQ ID NO: 3715709 - RNA, 20 nt, Salmonella enterica enterica serovar Typhi Ty2
cagcagguuaaacagacaau

SEQ ID NO: 3715710 - RNA, 20 nt, Salmonella enterica enterica serovar Typhi Ty2
cagcagguugagucugcucg

SEQ ID NO: 3715711 - RNA, 20 nt, Salmonella enterica enterica serovar Typhi Ty2
cagcaguaaauaaucgacga

SEQ ID NO: 3715712 - RNA, 23 nt, Salmonella enterica enterica serovar Typhi Ty2
cagcaguggcucagucagucccg

SEQ ID NO: 3715713 - RNA, 16 nt, Salmonella enterica enterica serovar Typhi Ty2
cagcagugggaaaauu

SEQ ID NO: 3715714 - RNA, 13 nt, Salmonella enterica enterica serovar Typhi Ty2
cagcauaaacauc

SEQ ID NO: 3715715 - RNA, 18 nt, Salmonella enterica enterica serovar Typhi Ty2
cagcauaauauucauaac

SEQ ID NO: 3715716 - RNA, 17 nt, Salmonella enterica enterica serovar Typhi Ty2
cagcauaccgcccaaca

SEQ ID NO: 3715717 - RNA, 17 nt, Salmonella enterica enterica serovar Typhi Ty2
cagcauacgacaucgcc

SEQ ID NO: 3715718 - RNA, 18 nt, Salmonella enterica enterica serovar Typhi Ty2
cagcauacgacaucgcca

SEQ ID NO: 3715719 - RNA, 14 nt, Salmonella enterica enterica serovar Typhi Ty2
cagcauagucgcuc

SEQ ID NO: 3715720 - RNA, 15 nt, Salmonella enterica enterica serovar Typhi Ty2
cagcauagucgcucc

SEQ ID NO: 3715721 - RNA, 16 nt, Salmonella enterica enterica serovar Typhi Ty2
cagcauauccagcgcc

SEQ ID NO: 3715722 - RNA, 18 nt, Salmonella enterica enterica serovar Typhi Ty2
cagcauauuuuccggcgu

SEQ ID NO: 3715723 - RNA, 20 nt, Salmonella enterica enterica serovar Typhi Ty2
cagcaucaauagcagcuuca

SEQ ID NO: 3715724 - RNA, 15 nt, Salmonella enterica enterica serovar Typhi Ty2
cagcaucacaucaaa

SEQ ID NO: 3715725 - RNA, 16 nt, Salmonella enterica enterica serovar Typhi Ty2
cagcaucaccggcccc

SEQ ID NO: 3715726 - RNA, 18 nt, Salmonella enterica enterica serovar Typhi Ty2
cagcaucaucucccaggc

SEQ ID NO: 3715727 - RNA, 21 nt, Salmonella enterica enterica serovar Typhi Ty2
cagcaucaugggcucaucaaa

SEQ ID NO: 3715728 - RNA, 15 nt, Salmonella enterica enterica serovar Typhi Ty2
cagcaucaugucccc

SEQ ID NO: 3715729 - RNA, 14 nt, Salmonella enterica enterica serovar Typhi Ty2
cagcauccagcuca

SEQ ID NO: 3715730 - RNA, 19 nt, Salmonella enterica enterica serovar Typhi Ty2
cagcaucccgcuggcgcca

SEQ ID NO: 3715731 - RNA, 14 nt, Salmonella enterica enterica serovar Typhi Ty2
cagcaucccggcaa

SEQ ID NO: 3715732 - RNA, 14 nt, Salmonella enterica enterica serovar Typhi Ty2
cagcaucgcccggg

SEQ ID NO: 3715733 - RNA, 23 nt, Salmonella enterica enterica serovar Typhi Ty2
cagcaucgcccgggcaauuucuc

SEQ ID NO: 3715734 - RNA, 17 nt, Salmonella enterica enterica serovar Typhi Ty2
cagcaucgggaaucauc

SEQ ID NO: 3715735 - RNA, 14 nt, Salmonella enterica enterica serovar Typhi Ty2
cagcaucuccuggc

SEQ ID NO: 3715736 - RNA, 17 nt, Salmonella enterica enterica serovar Typhi Ty2
cagcaucuccuggcgca

SEQ ID NO: 3715737 - RNA, 14 nt, Salmonella enterica enterica serovar Typhi Ty2
cagcaucugcggcu

SEQ ID NO: 3715738 - RNA, 24 nt, Salmonella enterica enterica serovar Typhi Ty2
cagcaucugcggcuuucaucauuc

SEQ ID NO: 3715739 - RNA, 20 nt, Salmonella enterica enterica serovar Typhi Ty2
cagcaugaauaaccucccgc

SEQ ID NO: 3715740 - RNA, 17 nt, Salmonella enterica enterica serovar Typhi Ty2
cagcaugaucauacugc

SEQ ID NO: 3715741 - RNA, 23 nt, Salmonella enterica enterica serovar Typhi Ty2
cagcaugguguguucccgcgcca

SEQ ID NO: 3715742 - RNA, 14 nt, Salmonella enterica enterica serovar Typhi Ty2
cagcauuacccccg

SEQ ID NO: 3715743 - RNA, 17 nt, Salmonella enterica enterica serovar Typhi Ty2
cagcauugaccaccaua

SEQ ID NO: 3715744 - RNA, 19 nt, Salmonella enterica enterica serovar Typhi Ty2
cagcauugggauggauaaa

SEQ ID NO: 3715745 - RNA, 19 nt, Salmonella enterica enterica serovar Typhi Ty2
cagcauugggucaugcgga

SEQ ID NO: 3715746 - RNA, 23 nt, Salmonella enterica enterica serovar Typhi Ty2
cagcauuucaaucgcgcccgcca

SEQ ID NO: 3715747 - RNA, 17 nt, Salmonella enterica enterica serovar Typhi Ty2
cagcccgcucguuucaa

SEQ ID NO: 3715748 - RNA, 12 nt, Salmonella enterica enterica serovar Typhi Ty2
cagcccggcgug

SEQ ID NO: 3715749 - RNA, 20 nt, Salmonella enterica enterica serovar Typhi Ty2
cagcccguaaggggcugcgu

SEQ ID NO: 3715750 - RNA, 14 nt, Salmonella enterica enterica serovar Typhi Ty2
cagcccgucggcgu

SEQ ID NO: 3715751 - RNA, 18 nt, Salmonella enterica enterica serovar Typhi Ty2
cagcccgucggcgucugc

SEQ ID NO: 3715752 - RNA, 19 nt, Salmonella enterica enterica serovar Typhi Ty2
cagcccguucucgccgcgu

SEQ ID NO: 3715753 - RNA, 23 nt, Salmonella enterica enterica serovar Typhi Ty2
cagcccuaaauggagcgagcugg

SEQ ID NO: 3715754 - RNA, 22 nt, Salmonella enterica enterica serovar Typhi Ty2
cagcccucaacauugccggcau

SEQ ID NO: 3715755 - RNA, 13 nt, Salmonella enterica enterica serovar Typhi Ty2
cagcccugugccg

SEQ ID NO: 3715756 - RNA, 16 nt, Salmonella enterica enterica serovar Typhi Ty2
cagcccuuugagaaaa

SEQ ID NO: 3715757 - RNA, 21 nt, Salmonella enterica enterica serovar Typhi Ty2
cagccgacgcauuucuccuga

SEQ ID NO: 3715758 - RNA, 18 nt, Salmonella enterica enterica serovar Typhi Ty2
cagccgacuaucuucuuc

SEQ ID NO: 3715759 - RNA, 20 nt, Salmonella enterica enterica serovar Typhi Ty2
cagccgagacuaucgauagc

SEQ ID NO: 3715760 - RNA, 23 nt, Salmonella enterica enterica serovar Typhi Ty2
cagccgagcgguaagagccagac

SEQ ID NO: 3715761 - RNA, 22 nt, Salmonella enterica enterica serovar Typhi Ty2
cagccgauagcaccucgcaaua

SEQ ID NO: 3715762 - RNA, 17 nt, Salmonella enterica enterica serovar Typhi Ty2
cagccgaucuauuucau

SEQ ID NO: 3715763 - RNA, 13 nt, Salmonella enterica enterica serovar Typhi Ty2
cagccgccaaaaa

SEQ ID NO: 3715764 - RNA, 12 nt, Salmonella enterica enterica serovar Typhi Ty2
cagccgccacca

SEQ ID NO: 3715765 - RNA, 22 nt, Salmonella enterica enterica serovar Typhi Ty2
cagccgccaguuugguuaauuc

SEQ ID NO: 3715766 - RNA, 13 nt, Salmonella enterica enterica serovar Typhi Ty2
cagccgccauccg

SEQ ID NO: 3715767 - RNA, 15 nt, Salmonella enterica enterica serovar Typhi Ty2
cagccgccaucgcug

SEQ ID NO: 3715768 - RNA, 11 nt, Salmonella enterica enterica serovar Typhi Ty2
cagccgccauu

SEQ ID NO: 3715769 - RNA, 19 nt, Salmonella enterica enterica serovar Typhi Ty2
cagccgccauuaauaccau

SEQ ID NO: 3715770 - RNA, 21 nt, Salmonella enterica enterica serovar Typhi Ty2
cagccgcccgcgauaaaaauc

SEQ ID NO: 3715771 - RNA, 17 nt, Salmonella enterica enterica serovar Typhi Ty2
cagccgcgccaucuccu

SEQ ID NO: 3715772 - RNA, 20 nt, Salmonella enterica enterica serovar Typhi Ty2
cagccgcucugcuguuccuu

SEQ ID NO: 3715773 - RNA, 21 nt, Salmonella enterica enterica serovar Typhi Ty2
cagccggaaaagcgcuggcug

SEQ ID NO: 3715774 - RNA, 15 nt, Salmonella enterica enterica serovar Typhi Ty2
cagccgggcaggaaa

SEQ ID NO: 3715775 - RNA, 16 nt, Salmonella enterica enterica serovar Typhi Ty2
cagccgggcaggaaaa

SEQ ID NO: 3715776 - RNA, 16 nt, Salmonella enterica enterica serovar Typhi Ty2
cagccgguauccagcg

SEQ ID NO: 3715777 - RNA, 15 nt, Salmonella enterica enterica serovar Typhi Ty2
cagccguaccacccg

SEQ ID NO: 3715778 - RNA, 14 nt, Salmonella enterica enterica serovar Typhi Ty2
cagccguugugcug

SEQ ID NO: 3715779 - RNA, 16 nt, Salmonella enterica enterica serovar Typhi Ty2
cagccguuucuugucu

SEQ ID NO: 3715780 - RNA, 22 nt, Salmonella enterica enterica serovar Typhi Ty2
cagccguuuuccggucgcgcaa

SEQ ID NO: 3715781 - RNA, 20 nt, Salmonella enterica enterica serovar Typhi Ty2
cagccuauccccgaaaguua

SEQ ID NO: 3715782 - RNA, 13 nt, Salmonella enterica enterica serovar Typhi Ty2
cagccuaucgcca

SEQ ID NO: 3715783 - RNA, 17 nt, Salmonella enterica enterica serovar Typhi Ty2
cagccucaggccugccg

SEQ ID NO: 3715784 - RNA, 23 nt, Salmonella enterica enterica serovar Typhi Ty2
cagccucgcgcauccgggccgcu

SEQ ID NO: 3715785 - RNA, 18 nt, Salmonella enterica enterica serovar Typhi Ty2
cagccucgcguugagggu

SEQ ID NO: 3715786 - RNA, 16 nt, Salmonella enterica enterica serovar Typhi Ty2
cagccucguccugcaa

SEQ ID NO: 3715787 - RNA, 17 nt, Salmonella enterica enterica serovar Typhi Ty2
cagccucucuugauaac

SEQ ID NO: 3715788 - RNA, 19 nt, Salmonella enterica enterica serovar Typhi Ty2
cagccuggagagcagcgcc

SEQ ID NO: 3715789 - RNA, 21 nt, Salmonella enterica enterica serovar Typhi Ty2
cagccugugaucggagaaaua

SEQ ID NO: 3715790 - RNA, 11 nt, Salmonella enterica enterica serovar Typhi Ty2
cagccugugca

SEQ ID NO: 3715791 - RNA, 13 nt, Salmonella enterica enterica serovar Typhi Ty2
cagccuguuugga

SEQ ID NO: 3715792 - RNA, 18 nt, Salmonella enterica enterica serovar Typhi Ty2
cagccuucggacugcugg

SEQ ID NO: 3715793 - RNA, 18 nt, Salmonella enterica enterica serovar Typhi Ty2
cagccuugauaccgccgc

SEQ ID NO: 3715794 - RNA, 17 nt, Salmonella enterica enterica serovar Typhi Ty2
cagcgaaacgacgucga

SEQ ID NO: 3715795 - RNA, 23 nt, Salmonella enterica enterica serovar Typhi Ty2
cagcgaaacgacgucgacgccuu

SEQ ID NO: 3715796 - RNA, 21 nt, Salmonella enterica enterica serovar Typhi Ty2
cagcgaaagaugcguaccgcu

SEQ ID NO: 3715797 - RNA, 22 nt, Salmonella enterica enterica serovar Typhi Ty2
cagcgaaaugacggccaccagc

SEQ ID NO: 3715798 - RNA, 16 nt, Salmonella enterica enterica serovar Typhi Ty2
cagcgaaccgcggcau

SEQ ID NO: 3715799 - RNA, 16 nt, Salmonella enterica enterica serovar Typhi Ty2
cagcgaacuggcggca

SEQ ID NO: 3715800 - RNA, 14 nt, Salmonella enterica enterica serovar Typhi Ty2
cagcgaauaaugaa

SEQ ID NO: 3715801 - RNA, 21 nt, Salmonella enterica enterica serovar Typhi Ty2
cagcgacaaggcaccguuucu

SEQ ID NO: 3715802 - RNA, 15 nt, Salmonella enterica enterica serovar Typhi Ty2
cagcgacacuccgcg

SEQ ID NO: 3715803 - RNA, 19 nt, Salmonella enterica enterica serovar Typhi Ty2
cagcgacacuccgcgcaug

SEQ ID NO: 3715804 - RNA, 14 nt, Salmonella enterica enterica serovar Typhi Ty2
cagcgacaggcugu

SEQ ID NO: 3715805 - RNA, 17 nt, Salmonella enterica enterica serovar Typhi Ty2
cagcgacaggcugucga

SEQ ID NO: 3715806 - RNA, 16 nt, Salmonella enterica enterica serovar Typhi Ty2
cagcgaccacgccacc

SEQ ID NO: 3715807 - RNA, 13 nt, Salmonella enterica enterica serovar Typhi Ty2
cagcgaccuccgc

SEQ ID NO: 3715808 - RNA, 14 nt, Salmonella enterica enterica serovar Typhi Ty2
cagcgaccuccgcg

SEQ ID NO: 3715809 - RNA, 16 nt, Salmonella enterica enterica serovar Typhi Ty2
cagcgaccuccgcgca

SEQ ID NO: 3715810 - RNA, 13 nt, Salmonella enterica enterica serovar Typhi Ty2
cagcgacgccaga

SEQ ID NO: 3715811 - RNA, 14 nt, Salmonella enterica enterica serovar Typhi Ty2
cagcgacucauuca

SEQ ID NO: 3715812 - RNA, 15 nt, Salmonella enterica enterica serovar Typhi Ty2
cagcgacuucaggcg

SEQ ID NO: 3715813 - RNA, 15 nt, Salmonella enterica enterica serovar Typhi Ty2
cagcgagacgcugga

SEQ ID NO: 3715814 - RNA, 18 nt, Salmonella enterica enterica serovar Typhi Ty2
cagcgagcaggaauagcu

SEQ ID NO: 3715815 - RNA, 15 nt, Salmonella enterica enterica serovar Typhi Ty2
cagcgagugcgccca

SEQ ID NO: 3715816 - RNA, 19 nt, Salmonella enterica enterica serovar Typhi Ty2
cagcgaguuacguugcggc

SEQ ID NO: 3715817 - RNA, 20 nt, Salmonella enterica enterica serovar Typhi Ty2
cagcgaguuacguugcggcg

SEQ ID NO: 3715818 - RNA, 21 nt, Salmonella enterica enterica serovar Typhi Ty2
cagcgaguuacguugcggcgu

SEQ ID NO: 3715819 - RNA, 14 nt, Salmonella enterica enterica serovar Typhi Ty2
cagcgauauuucuc

SEQ ID NO: 3715820 - RNA, 16 nt, Salmonella enterica enterica serovar Typhi Ty2
cagcgauauuucuccg

SEQ ID NO: 3715821 - RNA, 13 nt, Salmonella enterica enterica serovar Typhi Ty2
cagcgaucacgcc

SEQ ID NO: 3715822 - RNA, 15 nt, Salmonella enterica enterica serovar Typhi Ty2
cagcgaucacgccgu

SEQ ID NO: 3715823 - RNA, 23 nt, Salmonella enterica enterica serovar Typhi Ty2
cagcgaucccaguugaucggcca

SEQ ID NO: 3715824 - RNA, 22 nt, Salmonella enterica enterica serovar Typhi Ty2
cagcgauccgccgucggcaaua

SEQ ID NO: 3715825 - RNA, 13 nt, Salmonella enterica enterica serovar Typhi Ty2
cagcgauccugcg

SEQ ID NO: 3715826 - RNA, 16 nt, Salmonella enterica enterica serovar Typhi Ty2
cagcgauccugcggca

SEQ ID NO: 3715827 - RNA, 19 nt, Salmonella enterica enterica serovar Typhi Ty2
cagcgaucugucgccgcgu

SEQ ID NO: 3715828 - RNA, 14 nt, Salmonella enterica enterica serovar Typhi Ty2
cagcgaugcgcgcg

SEQ ID NO: 3715829 - RNA, 18 nt, Salmonella enterica enterica serovar Typhi Ty2
cagcgcuugugccugcug

SEQ ID NO: 3715830 - RNA, 20 nt, Salmonella enterica enterica serovar Typhi Ty2
cagcgcuuucaccgcgucgu

SEQ ID NO: 3715831 - RNA, 11 nt, Salmonella enterica enterica serovar Typhi Ty2
cagcgcuuugc

SEQ ID NO: 3715832 - RNA, 18 nt, Salmonella enterica enterica serovar Typhi Ty2
cagcgcuuugccgcugcu

SEQ ID NO: 3715833 - RNA, 23 nt, Salmonella enterica enterica serovar Typhi Ty2
cagcgcuuugccgcugcugccuu

SEQ ID NO: 3715834 - RNA, 20 nt, Salmonella enterica enterica serovar Typhi Ty2
cagcgcuuuugccgcgccca

SEQ ID NO: 3715835 - RNA, 19 nt, Salmonella enterica enterica serovar Typhi Ty2
cagcggaaaauauucagca

SEQ ID NO: 3715836 - RNA, 20 nt, Salmonella enterica enterica serovar Typhi Ty2
cagcggaaaauauucagcac

SEQ ID NO: 3715837 - RNA, 23 nt, Salmonella enterica enterica serovar Typhi Ty2
cagcggaaagugaaggccagacu

SEQ ID NO: 3715838 - RNA, 20 nt, Salmonella enterica enterica serovar Typhi Ty2
cagcggaauccccgccgcca

SEQ ID NO: 3715839 - RNA, 22 nt, Salmonella enterica enterica serovar Typhi Ty2
cagcggacacccgcagccagaa

SEQ ID NO: 3715840 - RNA, 18 nt, Salmonella enterica enterica serovar Typhi Ty2
cagcggagagacauuggu

SEQ ID NO: 3715841 - RNA, 15 nt, Salmonella enterica enterica serovar Typhi Ty2
cagcggaucgauaac

SEQ ID NO: 3715842 - RNA, 13 nt, Salmonella enterica enterica serovar Typhi Ty2
cagcggaugcucu

SEQ ID NO: 3715843 - RNA, 23 nt, Salmonella enterica enterica serovar Typhi Ty2
cagcggauugccauacacgcggc

SEQ ID NO: 3715844 - RNA, 18 nt, Salmonella enterica enterica serovar Typhi Ty2
cagcggcagcucugccug

SEQ ID NO: 3715845 - RNA, 19 nt, Salmonella enterica enterica serovar Typhi Ty2
cagcggcagcuucagccag

SEQ ID NO: 3715846 - RNA, 16 nt, Salmonella enterica enterica serovar Typhi Ty2
cagcggcagugaugaa

SEQ ID NO: 3715847 - RNA, 22 nt, Salmonella enterica enterica serovar Typhi Ty2
cagcggcccgcgcugaauagcg

SEQ ID NO: 3715848 - RNA, 18 nt, Salmonella enterica enterica serovar Typhi Ty2
cagcggcgccaucaccau

SEQ ID NO: 3715849 - RNA, 15 nt, Salmonella enterica enterica serovar Typhi Ty2
cagcggcgcgccgcu

SEQ ID NO: 3715850 - RNA, 15 nt, Salmonella enterica enterica serovar Typhi Ty2
cagcggcggaaugcu

SEQ ID NO: 3715851 - RNA, 22 nt, Salmonella enterica enterica serovar Typhi Ty2
cagcggcggcuugccuucaucc

SEQ ID NO: 3715852 - RNA, 18 nt, Salmonella enterica enterica serovar Typhi Ty2
cagcggcgguuauccgcc

SEQ ID NO: 3715853 - RNA, 23 nt, Salmonella enterica enterica serovar Typhi Ty2
cagcggcguuggcgauuuccagc

SEQ ID NO: 3715854 - RNA, 12 nt, Salmonella enterica enterica serovar Typhi Ty2
cagcgggaacau

SEQ ID NO: 3715855 - RNA, 21 nt, Salmonella enterica enterica serovar Typhi Ty2
cagcgggugaucgcuugccac

SEQ ID NO: 3715856 - RNA, 15 nt, Salmonella enterica enterica serovar Typhi Ty2
cagcgguaugcaccu

SEQ ID NO: 3715857 - RNA, 20 nt, Salmonella enterica enterica serovar Typhi Ty2
cagcggucaggggucagcgu

SEQ ID NO: 3715858 - RNA, 20 nt, Salmonella enterica enterica serovar Typhi Ty2
cagcgguuacuuuugaacau

SEQ ID NO: 3715859 - RNA, 22 nt, Salmonella enterica enterica serovar Typhi Ty2
cagcgguuacuuuugaacauaa

SEQ ID NO: 3715860 - RNA, 18 nt, Salmonella enterica enterica serovar Typhi Ty2
cagcguaaaacuuuucug

SEQ ID NO: 3715861 - RNA, 19 nt, Salmonella enterica enterica serovar Typhi Ty2
cagcguaagucugauaaac

SEQ ID NO: 3715862 - RNA, 18 nt, Salmonella enterica enterica serovar Typhi Ty2
cagcguacaauggcaggc

SEQ ID NO: 3715863 - RNA, 21 nt, Salmonella enterica enterica serovar Typhi Ty2
cagcguacaauggcaggcaua

SEQ ID NO: 3715864 - RNA, 17 nt, Salmonella enterica enterica serovar Typhi Ty2
cagcguaccacgccgca

SEQ ID NO: 3715865 - RNA, 17 nt, Salmonella enterica enterica serovar Typhi Ty2
cagcguauugagcugga

SEQ ID NO: 3715866 - RNA, 17 nt, Salmonella enterica enterica serovar Typhi Ty2
cagcgucacaggcuucg

SEQ ID NO: 3715867 - RNA, 16 nt, Salmonella enterica enterica serovar Typhi Ty2
cagcgucaccucuuuc

SEQ ID NO: 3715868 - RNA, 18 nt, Salmonella enterica enterica serovar Typhi Ty2
cagcgucaucaggccauu

SEQ ID NO: 3715869 - RNA, 16 nt, Salmonella enterica enterica serovar Typhi Ty2
cagcgucgacagcccc

SEQ ID NO: 3715870 - RNA, 16 nt, Salmonella enterica enterica serovar Typhi Ty2
cagcgucgcaugggua

SEQ ID NO: 3715871 - RNA, 14 nt, Salmonella enterica enterica serovar Typhi Ty2
cagcgucgcuuugg

SEQ ID NO: 3715872 - RNA, 15 nt, Salmonella enterica enterica serovar Typhi Ty2
cagcgucggugaaga

SEQ ID NO: 3715873 - RNA, 18 nt, Salmonella enterica enterica serovar Typhi Ty2
cagcgucuauagaugaua

SEQ ID NO: 3715874 - RNA, 12 nt, Salmonella enterica enterica serovar Typhi Ty2
cagcgucugccc

SEQ ID NO: 3715875 - RNA, 18 nt, Salmonella enterica enterica serovar Typhi Ty2
cagcgucugcccuccuga

SEQ ID NO: 3715876 - RNA, 14 nt, Salmonella enterica enterica serovar Typhi Ty2
cagcgucuguuuca

SEQ ID NO: 3715877 - RNA, 14 nt, Salmonella enterica enterica serovar Typhi Ty2
cagcgucuuccugu

SEQ ID NO: 3715878 - RNA, 15 nt, Salmonella enterica enterica serovar Typhi Ty2
cagcgugacccagac

SEQ ID NO: 3715879 - RNA, 18 nt, Salmonella enterica enterica serovar Typhi Ty2
cagcgugccuucaaauau

SEQ ID NO: 3715880 - RNA, 16 nt, Salmonella enterica enterica serovar Typhi Ty2
cagcguggaugaacuc

SEQ ID NO: 3715881 - RNA, 16 nt, Salmonella enterica enterica serovar Typhi Ty2
cagcgugguuuccggc

SEQ ID NO: 3715882 - RNA, 18 nt, Salmonella enterica enterica serovar Typhi Ty2
cagcguguaaucgccgua

SEQ ID NO: 3715883 - RNA, 23 nt, Salmonella enterica enterica serovar Typhi Ty2
cagcguuaacgacgcuccagaau

SEQ ID NO: 3715884 - RNA, 21 nt, Salmonella enterica enterica serovar Typhi Ty2
cagcguuacugcaacugcgcg

SEQ ID NO: 3715885 - RNA, 22 nt, Salmonella enterica enterica serovar Typhi Ty2
cagcguugcguguuguacagca

SEQ ID NO: 3715886 - RNA, 18 nt, Salmonella enterica enterica serovar Typhi Ty2
cagcguuuaacugaacau

SEQ ID NO: 3715887 - RNA, 23 nt, Salmonella enterica enterica serovar Typhi Ty2
cagcguuuccggaaugagaugca

SEQ ID NO: 3715888 - RNA, 19 nt, Salmonella enterica enterica serovar Typhi Ty2
cagcuaaaaacgccaauca

SEQ ID NO: 3715889 - RNA, 15 nt, Salmonella enterica enterica serovar Typhi Ty2
cagcuaauuuuacuu

SEQ ID NO: 3715890 - RNA, 15 nt, Salmonella enterica enterica serovar Typhi Ty2
cagcuauccaguuuc

SEQ ID NO: 3715891 - RNA, 21 nt, Salmonella enterica enterica serovar Typhi Ty2
cagcucaacgccuuugcaauc

SEQ ID NO: 3715892 - RNA, 14 nt, Salmonella enterica enterica serovar Typhi Ty2
cagcucaacuauua

SEQ ID NO: 3715893 - RNA, 18 nt, Salmonella enterica enterica serovar Typhi Ty2
cagcucaccgagacugcc

SEQ ID NO: 3715894 - RNA, 16 nt, Salmonella enterica enterica serovar Typhi Ty2
cagcucauacccuucc

SEQ ID NO: 3715895 - RNA, 17 nt, Salmonella enterica enterica serovar Typhi Ty2
cagcucaucgaaccuau

SEQ ID NO: 3715896 - RNA, 22 nt, Salmonella enterica enterica serovar Typhi Ty2
cagcucaugcaagacaucuaac

SEQ ID NO: 3715897 - RNA, 17 nt, Salmonella enterica enterica serovar Typhi Ty2
cagcucaugcgcggcgg

SEQ ID NO: 3715898 - RNA, 17 nt, Salmonella enterica enterica serovar Typhi Ty2
cagcucauuuuuacaga

SEQ ID NO: 3715899 - RNA, 21 nt, Salmonella enterica enterica serovar Typhi Ty2
cagcucauuuuuacagacacg

SEQ ID NO: 3715900 - RNA, 16 nt, Salmonella enterica enterica serovar Typhi Ty2
cagcuccagcucaggg

SEQ ID NO: 3715901 - RNA, 22 nt, Salmonella enterica enterica serovar Typhi Ty2
cagcuccaugucuugcuaucaa

SEQ ID NO: 3715902 - RNA, 13 nt, Salmonella enterica enterica serovar Typhi Ty2
cagcucgccaugc

SEQ ID NO: 3715903 - RNA, 22 nt, Salmonella enterica enterica serovar Typhi Ty2
cagcucgcugccgaucagauug

SEQ ID NO: 3715904 - RNA, 16 nt, Salmonella enterica enterica serovar Typhi Ty2
cagcucguuauuuccg

SEQ ID NO: 3715905 - RNA, 18 nt, Salmonella enterica enterica serovar Typhi Ty2
cagcucuuuaggcaggaa

SEQ ID NO: 3715906 - RNA, 20 nt, Salmonella enterica enterica serovar Typhi Ty2
cagcucuuucaauccuucuu

SEQ ID NO: 3715907 - RNA, 13 nt, Salmonella enterica enterica serovar Typhi Ty2
cagcucuuuucug

SEQ ID NO: 3715908 - RNA, 18 nt, Salmonella enterica enterica serovar Typhi Ty2
cagcugaaacagaauaaa

SEQ ID NO: 3715909 - RNA, 17 nt, Salmonella enterica enterica serovar Typhi Ty2
cagcugacgacgccagc

SEQ ID NO: 3715910 - RNA, 21 nt, Salmonella enterica enterica serovar Typhi Ty2
cagcugagcuaaucacccacu

SEQ ID NO: 3715911 - RNA, 22 nt, Salmonella enterica enterica serovar Typhi Ty2
caggcaaaaaucggccucuuca

SEQ ID NO: 3715912 - RNA, 18 nt, Salmonella enterica enterica serovar Typhi Ty2
caggcaaaaggccuuuuu

SEQ ID NO: 3715913 - RNA, 14 nt, Salmonella enterica enterica serovar Typhi Ty2
caggcaaagcccca

SEQ ID NO: 3715914 - RNA, 16 nt, Salmonella enterica enterica serovar Typhi Ty2
caggcaaaggaaugcu

SEQ ID NO: 3715915 - RNA, 19 nt, Salmonella enterica enterica serovar Typhi Ty2
caggcaaucagcagccggg

SEQ ID NO: 3715916 - RNA, 18 nt, Salmonella enterica enterica serovar Typhi Ty2
caggcaccauccgguaaa

SEQ ID NO: 3715917 - RNA, 22 nt, Salmonella enterica enterica serovar Typhi Ty2
caggcaccuguaaccuuaaaag

SEQ ID NO: 3715918 - RNA, 13 nt, Salmonella enterica enterica serovar Typhi Ty2
caggcacgccugu

SEQ ID NO: 3715919 - RNA, 20 nt, Salmonella enterica enterica serovar Typhi Ty2
caggcacgggugccuguucu

SEQ ID NO: 3715920 - RNA, 17 nt, Salmonella enterica enterica serovar Typhi Ty2
caggcacgugcauaaaa

SEQ ID NO: 3715921 - RNA, 16 nt, Salmonella enterica enterica serovar Typhi Ty2
caggcacguuaaacac

SEQ ID NO: 3715922 - RNA, 17 nt, Salmonella enterica enterica serovar Typhi Ty2
caggcacuguggugugc

SEQ ID NO: 3715923 - RNA, 20 nt, Salmonella enterica enterica serovar Typhi Ty2
caggcacuguggugugccug

SEQ ID NO: 3715924 - RNA, 23 nt, Salmonella enterica enterica serovar Typhi Ty2
caggcacuguggugugccugcgc

SEQ ID NO: 3715925 - RNA, 13 nt, Salmonella enterica enterica serovar Typhi Ty2
caggcagaaauaa

SEQ ID NO: 3715926 - RNA, 13 nt, Salmonella enterica enterica serovar Typhi Ty2
caggcagccacaa

SEQ ID NO: 3715927 - RNA, 20 nt, Salmonella enterica enterica serovar Typhi Ty2
caggcagccggauuuuaaau

SEQ ID NO: 3715928 - RNA, 13 nt, Salmonella enterica enterica serovar Typhi Ty2
caggcagggcgau

SEQ ID NO: 3715929 - RNA, 19 nt, Salmonella enterica enterica serovar Typhi Ty2
caggcaguuugcgaaaagc

SEQ ID NO: 3715930 - RNA, 14 nt, Salmonella enterica enterica serovar Typhi Ty2
caggcauaaaaaaa

SEQ ID NO: 3715931 - RNA, 17 nt, Salmonella enterica enterica serovar Typhi Ty2
caggcauaaaaaagagg

SEQ ID NO: 3715932 - RNA, 16 nt, Salmonella enterica enterica serovar Typhi Ty2
caggcauaauggaacu

SEQ ID NO: 3715933 - RNA, 23 nt, Salmonella enterica enterica serovar Typhi Ty2
caggcauagaaaaagaacugcaa

SEQ ID NO: 3715934 - RNA, 22 nt, Salmonella enterica enterica serovar Typhi Ty2
caggcaucaacguuguccagcg

SEQ ID NO: 3715935 - RNA, 17 nt, Salmonella enterica enterica serovar Typhi Ty2
caggcauccgugaccug

SEQ ID NO: 3715936 - RNA, 17 nt, Salmonella enterica enterica serovar Typhi Ty2
caggcauccugcccugg

SEQ ID NO: 3715937 - RNA, 16 nt, Salmonella enterica enterica serovar Typhi Ty2
caggcaucgacgccag

SEQ ID NO: 3715938 - RNA, 13 nt, Salmonella enterica enterica serovar Typhi Ty2
caggcauucagcg

SEQ ID NO: 3715939 - RNA, 20 nt, Salmonella enterica enterica serovar Typhi Ty2
caggcauugauaaagcgcuc

SEQ ID NO: 3715940 - RNA, 15 nt, Salmonella enterica enterica serovar Typhi Ty2
caggcauugucaccu

SEQ ID NO: 3715941 - RNA, 18 nt, Salmonella enterica enterica serovar Typhi Ty2
caggcauuuuauuaccug

SEQ ID NO: 3715942 - RNA, 14 nt, Salmonella enterica enterica serovar Typhi Ty2
caggccaaaaccac

SEQ ID NO: 3715943 - RNA, 21 nt, Salmonella enterica enterica serovar Typhi Ty2
caggccaaaaccacagugacc

SEQ ID NO: 3715944 - RNA, 21 nt, Salmonella enterica enterica serovar Typhi Ty2
caggccaaacccugcgccgca

SEQ ID NO: 3715945 - RNA, 22 nt, Salmonella enterica enterica serovar Typhi Ty2
caggccaaacccugcgccgcaa

SEQ ID NO: 3715946 - RNA, 19 nt, Salmonella enterica enterica serovar Typhi Ty2
caggccaacguaguuauug

SEQ ID NO: 3715947 - RNA, 16 nt, Salmonella enterica enterica serovar Typhi Ty2
caggccaauuccgcca

SEQ ID NO: 3715948 - RNA, 19 nt, Salmonella enterica enterica serovar Typhi Ty2
caggccagaauucagcaug

SEQ ID NO: 3715949 - RNA, 22 nt, Salmonella enterica enterica serovar Typhi Ty2
caggccaugcgccgcgucagca

SEQ ID NO: 3715950 - RNA, 15 nt, Salmonella enterica enterica serovar Typhi Ty2
caggcccagccgcuc

SEQ ID NO: 3715951 - RNA, 18 nt, Salmonella enterica enterica serovar Typhi Ty2
caggcccaguaccauuga

SEQ ID NO: 3715952 - RNA, 16 nt, Salmonella enterica enterica serovar Typhi Ty2
caggcccaugaucagg

SEQ ID NO: 3715953 - RNA, 17 nt, Salmonella enterica enterica serovar Typhi Ty2
caggccgccaccgccuc

SEQ ID NO: 3715954 - RNA, 15 nt, Salmonella enterica enterica serovar Typhi Ty2
caggccgccagcaac

SEQ ID NO: 3715955 - RNA, 18 nt, Salmonella enterica enterica serovar Typhi Ty2
caggccgccgcaaaagcc

SEQ ID NO: 3715956 - RNA, 13 nt, Salmonella enterica enterica serovar Typhi Ty2
caggccgccgccu

SEQ ID NO: 3715957 - RNA, 14 nt, Salmonella enterica enterica serovar Typhi Ty2
caggccgcgcugau

SEQ ID NO: 3715958 - RNA, 18 nt, Salmonella enterica enterica serovar Typhi Ty2
caggccggacaggcgacg

SEQ ID NO: 3715959 - RNA, 17 nt, Salmonella enterica enterica serovar Typhi Ty2
caggccggauggcggcu

SEQ ID NO: 3715960 - RNA, 18 nt, Salmonella enterica enterica serovar Typhi Ty2
caggccgucggcgccagc

SEQ ID NO: 3715961 - RNA, 16 nt, Salmonella enterica enterica serovar Typhi Ty2
caggccuaacacaugc

SEQ ID NO: 3715962 - RNA, 18 nt, Salmonella enterica enterica serovar Typhi Ty2
caggccuacacucugcgc

SEQ ID NO: 3715963 - RNA, 16 nt, Salmonella enterica enterica serovar Typhi Ty2
caggccuacauccggc

SEQ ID NO: 3715964 - RNA, 16 nt, Salmonella enterica enterica serovar Typhi Ty2
caggccuaccagccga

SEQ ID NO: 3715965 - RNA, 17 nt, Salmonella enterica enterica serovar Typhi Ty2
caggccuaccagccgag

SEQ ID NO: 3715966 - RNA, 15 nt, Salmonella enterica enterica serovar Typhi Ty2
caggccuacccgcgu

SEQ ID NO: 3715967 - RNA, 23 nt, Salmonella enterica enterica serovar Typhi Ty2
caggccugacuccggguaacgga

SEQ ID NO: 3715968 - RNA, 19 nt, Salmonella enterica enterica serovar Typhi Ty2
caggccugauaagcgcagc

SEQ ID NO: 3715969 - RNA, 17 nt, Salmonella enterica enterica serovar Typhi Ty2
caggccugcaaaccucu

SEQ ID NO: 3715970 - RNA, 22 nt, Salmonella enterica enterica serovar Typhi Ty2
caggccugcauuugcuggcgug

SEQ ID NO: 3715971 - RNA, 19 nt, Salmonella enterica enterica serovar Typhi Ty2
caggccugccugaucgcca

SEQ ID NO: 3715972 - RNA, 16 nt, Salmonella enterica enterica serovar Typhi Ty2
caggccugguuaacaa

SEQ ID NO: 3715973 - RNA, 16 nt, Salmonella enterica enterica serovar Typhi Ty2
caggccuuucggcagc

SEQ ID NO: 3715974 - RNA, 13 nt, Salmonella enterica enterica serovar Typhi Ty2
caggcgacaugac

SEQ ID NO: 3715975 - RNA, 20 nt, Salmonella enterica enterica serovar Typhi Ty2
caggcgacgaaccgcguaac

SEQ ID NO: 3715976 - RNA, 19 nt, Salmonella enterica enterica serovar Typhi Ty2
caggcgacggaaacgcugu

SEQ ID NO: 3715977 - RNA, 23 nt, Salmonella enterica enterica serovar Typhi Ty2
caggcgacucauuacgccgcguu

SEQ ID NO: 3715978 - RNA, 15 nt, Salmonella enterica enterica serovar Typhi Ty2
caggcgagacgcgcc

SEQ ID NO: 3715979 - RNA, 19 nt, Salmonella enterica enterica serovar Typhi Ty2
caggcgauagccguccaug

SEQ ID NO: 3715980 - RNA, 17 nt, Salmonella enterica enterica serovar Typhi Ty2
caggcgauuacaacgcg

SEQ ID NO: 3715981 - RNA, 20 nt, Salmonella enterica enterica serovar Typhi Ty2
caggcgauuacaacgcgaug

SEQ ID NO: 3715982 - RNA, 24 nt, Salmonella enterica enterica serovar Typhi Ty2
caggcgcagagugagcaggcuaug

SEQ ID NO: 3715983 - RNA, 13 nt, Salmonella enterica enterica serovar Typhi Ty2
caggcgcaggcau

SEQ ID NO: 3715984 - RNA, 14 nt, Salmonella enterica enterica serovar Typhi Ty2
caggcgcaucagaa

SEQ ID NO: 3715985 - RNA, 19 nt, Salmonella enterica enterica serovar Typhi Ty2
caggcgccaguuggcguac

SEQ ID NO: 3715986 - RNA, 20 nt, Salmonella enterica enterica serovar Typhi Ty2
caggcgcgaauaaugcgucc

SEQ ID NO: 3715987 - RNA, 19 nt, Salmonella enterica enterica serovar Typhi Ty2
caggcgcgaccucaucaaa

SEQ ID NO: 3715988 - RNA, 19 nt, Salmonella enterica enterica serovar Typhi Ty2
caggcggaugaaacagucc

SEQ ID NO: 3715989 - RNA, 22 nt, Salmonella enterica enterica serovar Typhi Ty2
caggcggcaaaaaaugcauuga

SEQ ID NO: 3715990 - RNA, 14 nt, Salmonella enterica enterica serovar Typhi Ty2
caggcggcaugggu

SEQ ID NO: 3715991 - RNA, 14 nt, Salmonella enterica enterica serovar Typhi Ty2
caggcggcguuaua

SEQ ID NO: 3715992 - RNA, 16 nt, Salmonella enterica enterica serovar Typhi Ty2
caggcggcugcgcaug

SEQ ID NO: 3715993 - RNA, 13 nt, Salmonella enterica enterica serovar Typhi Ty2
caggguucacugc

SEQ ID NO: 3715994 - RNA, 17 nt, Salmonella enterica enterica serovar Typhi Ty2
caggguucacugccagu

SEQ ID NO: 3715995 - RNA, 22 nt, Salmonella enterica enterica serovar Typhi Ty2
caggguuccguucccaaugcuu

SEQ ID NO: 3715996 - RNA, 18 nt, Salmonella enterica enterica serovar Typhi Ty2
caggguucgcguacgcau

SEQ ID NO: 3715997 - RNA, 13 nt, Salmonella enterica enterica serovar Typhi Ty2
caggguugucuca

SEQ ID NO: 3715998 - RNA, 14 nt, Salmonella enterica enterica serovar Typhi Ty2
caggguuuaaucac

SEQ ID NO: 3715999 - RNA, 18 nt, Salmonella enterica enterica serovar Typhi Ty2
caggguuugccagcacca

SEQ ID NO: 3716000 - RNA, 23 nt, Salmonella enterica enterica serovar Typhi Ty2
caggguuugcgcagacugcgcca

SEQ ID NO: 3716001 - RNA, 15 nt, Salmonella enterica enterica serovar Typhi Ty2
cagguaaaaccagau

SEQ ID NO: 3716002 - RNA, 13 nt, Salmonella enterica enterica serovar Typhi Ty2
cagguaaaccggu

SEQ ID NO: 3716003 - RNA, 20 nt, Salmonella enterica enterica serovar Typhi Ty2
cagguaaaccggucagguag

SEQ ID NO: 3716004 - RNA, 23 nt, Salmonella enterica enterica serovar Typhi Ty2
cagguaaaccggucagguagcag

SEQ ID NO: 3716005 - RNA, 20 nt, Salmonella enterica enterica serovar Typhi Ty2
cagguaagcuauuacaaaaa

SEQ ID NO: 3716006 - RNA, 23 nt, Salmonella enterica enterica serovar Typhi Ty2
cagguaaucaucaccguuuucca

SEQ ID NO: 3716007 - RNA, 17 nt, Salmonella enterica enterica serovar Typhi Ty2
cagguaccccgccaccg

SEQ ID NO: 3716008 - RNA, 20 nt, Salmonella enterica enterica serovar Typhi Ty2
cagguaccccgccaccgccg

SEQ ID NO: 3716009 - RNA, 22 nt, Salmonella enterica enterica serovar Typhi Ty2
cagguacgcguuucacaaccuc

SEQ ID NO: 3716010 - RNA, 18 nt, Salmonella enterica enterica serovar Typhi Ty2
cagguagcagaccgguac

SEQ ID NO: 3716011 - RNA, 21 nt, Salmonella enterica enterica serovar Typhi Ty2
cagguaguuaccguauucugc

SEQ ID NO: 3716012 - RNA, 17 nt, Salmonella enterica enterica serovar Typhi Ty2
cagguaguugucggcgg

SEQ ID NO: 3716013 - RNA, 13 nt, Salmonella enterica enterica serovar Typhi Ty2
cagguaucauaug

SEQ ID NO: 3716014 - RNA, 19 nt, Salmonella enterica enterica serovar Typhi Ty2
cagguaucccgccagcggc

SEQ ID NO: 3716015 - RNA, 13 nt, Salmonella enterica enterica serovar Typhi Ty2
cagguauuaaaua

SEQ ID NO: 3716016 - RNA, 16 nt, Salmonella enterica enterica serovar Typhi Ty2
cagguauuaaauacag

SEQ ID NO: 3716017 - RNA, 18 nt, Salmonella enterica enterica serovar Typhi Ty2
cagguauuaaauacagag

SEQ ID NO: 3716018 - RNA, 13 nt, Salmonella enterica enterica serovar Typhi Ty2
cagguauucuaac

SEQ ID NO: 3716019 - RNA, 20 nt, Salmonella enterica enterica serovar Typhi Ty2
cagguauucuaacugaucag

SEQ ID NO: 3716020 - RNA, 23 nt, Salmonella enterica enterica serovar Typhi Ty2
caggucgaugaggauauugguau

SEQ ID NO: 3716021 - RNA, 15 nt, Salmonella enterica enterica serovar Typhi Ty2
caggucgccagcggg

SEQ ID NO: 3716022 - RNA, 18 nt, Salmonella enterica enterica serovar Typhi Ty2
caggucgcccagccauaa

SEQ ID NO: 3716023 - RNA, 13 nt, Salmonella enterica enterica serovar Typhi Ty2
caggucgcucuuu

SEQ ID NO: 3716024 - RNA, 21 nt, Salmonella enterica enterica serovar Typhi Ty2
caggucguccguugccaccca

SEQ ID NO: 3716025 - RNA, 14 nt, Salmonella enterica enterica serovar Typhi Ty2
caggucugcaccac

SEQ ID NO: 3716026 - RNA, 13 nt, Salmonella enterica enterica serovar Typhi Ty2
caggucugcgcgu

SEQ ID NO: 3716027 - RNA, 22 nt, Salmonella enterica enterica serovar Typhi Ty2
caggugauugcccuccagccau

SEQ ID NO: 3716028 - RNA, 18 nt, Salmonella enterica enterica serovar Typhi Ty2
caggugccgacucgcgca

SEQ ID NO: 3716029 - RNA, 21 nt, Salmonella enterica enterica serovar Typhi Ty2
caggugcggauaguccugcgc

SEQ ID NO: 3716030 - RNA, 13 nt, Salmonella enterica enterica serovar Typhi Ty2
caggugcugccac

SEQ ID NO: 3716031 - RNA, 16 nt, Salmonella enterica enterica serovar Typhi Ty2
caggugcugccacauc

SEQ ID NO: 3716032 - RNA, 17 nt, Salmonella enterica enterica serovar Typhi Ty2
caggugcugccacaucg

SEQ ID NO: 3716033 - RNA, 11 nt, Salmonella enterica enterica serovar Typhi Ty2
cagguggaucc

SEQ ID NO: 3716034 - RNA, 18 nt, Salmonella enterica enterica serovar Typhi Ty2
cagguggaucccccuggc

SEQ ID NO: 3716035 - RNA, 18 nt, Salmonella enterica enterica serovar Typhi Ty2
cagguggaucggaaauca

SEQ ID NO: 3716036 - RNA, 20 nt, Salmonella enterica enterica serovar Typhi Ty2
caggugguacaucaaaucag

SEQ ID NO: 3716037 - RNA, 18 nt, Salmonella enterica enterica serovar Typhi Ty2
caggugucguuaaugcuc

SEQ ID NO: 3716038 - RNA, 23 nt, Salmonella enterica enterica serovar Typhi Ty2
cagguguuauucgcccaaaugca

SEQ ID NO: 3716039 - RNA, 12 nt, Salmonella enterica enterica serovar Typhi Ty2
cagguuaaccca

SEQ ID NO: 3716040 - RNA, 20 nt, Salmonella enterica enterica serovar Typhi Ty2
cagguuacucuuccaccauc

SEQ ID NO: 3716041 - RNA, 15 nt, Salmonella enterica enterica serovar Typhi Ty2
cagguuagcagccac

SEQ ID NO: 3716042 - RNA, 20 nt, Salmonella enterica enterica serovar Typhi Ty2
cagguuauauuccgccucgu

SEQ ID NO: 3716043 - RNA, 17 nt, Salmonella enterica enterica serovar Typhi Ty2
cagguuauuguugcuac

SEQ ID NO: 3716044 - RNA, 22 nt, Salmonella enterica enterica serovar Typhi Ty2
cagguuauuguugcuacgcgcc

SEQ ID NO: 3716045 - RNA, 12 nt, Salmonella enterica enterica serovar Typhi Ty2
cagguucagcaa

SEQ ID NO: 3716046 - RNA, 16 nt, Salmonella enterica enterica serovar Typhi Ty2
cagguuccccaaugau

SEQ ID NO: 3716047 - RNA, 17 nt, Salmonella enterica enterica serovar Typhi Ty2
cagguucccgcccugcc

SEQ ID NO: 3716048 - RNA, 22 nt, Salmonella enterica enterica serovar Typhi Ty2
cagguucccgcccugcccgcca

SEQ ID NO: 3716049 - RNA, 17 nt, Salmonella enterica enterica serovar Typhi Ty2
cagguugcguccgccgc

SEQ ID NO: 3716050 - RNA, 19 nt, Salmonella enterica enterica serovar Typhi Ty2
cagguugcguccgccgcua

SEQ ID NO: 3716051 - RNA, 21 nt, Salmonella enterica enterica serovar Typhi Ty2
cagguuguaucauguuccggc

SEQ ID NO: 3716052 - RNA, 20 nt, Salmonella enterica enterica serovar Typhi Ty2
cagguuguccugauagcaau

SEQ ID NO: 3716053 - RNA, 14 nt, Salmonella enterica enterica serovar Typhi Ty2
cagguugugcaucu

SEQ ID NO: 3716054 - RNA, 17 nt, Salmonella enterica enterica serovar Typhi Ty2
cagguuuacccugauuu

SEQ ID NO: 3716055 - RNA, 20 nt, Salmonella enterica enterica serovar Typhi Ty2
cagguuuacguagcagcgcg

SEQ ID NO: 3716056 - RNA, 18 nt, Salmonella enterica enterica serovar Typhi Ty2
cagguuucuggcaacagc

SEQ ID NO: 3716057 - RNA, 20 nt, Salmonella enterica enterica serovar Typhi Ty2
cagguuucuggcaacagcca

SEQ ID NO: 3716058 - RNA, 20 nt, Salmonella enterica enterica serovar Typhi Ty2
cagguuuuuaagcugcccac

SEQ ID NO: 3716059 - RNA, 21 nt, Salmonella enterica enterica serovar Typhi Ty2
cagguuuuuuuauaacauaaa

SEQ ID NO: 3716060 - RNA, 20 nt, Salmonella enterica enterica serovar Typhi Ty2
caguaaauuaaacagcugua

SEQ ID NO: 3716061 - RNA, 18 nt, Salmonella enterica enterica serovar Typhi Ty2
caguaacacaaucaggcg

SEQ ID NO: 3716062 - RNA, 12 nt, Salmonella enterica enterica serovar Typhi Ty2
caguaacacccg

SEQ ID NO: 3716063 - RNA, 16 nt, Salmonella enterica enterica serovar Typhi Ty2
caguaacacccgcgcc

SEQ ID NO: 3716064 - RNA, 15 nt, Salmonella enterica enterica serovar Typhi Ty2
caguaaccgccacag

SEQ ID NO: 3716065 - RNA, 18 nt, Salmonella enterica enterica serovar Typhi Ty2
caguaaccgccacagcau

SEQ ID NO: 3716066 - RNA, 21 nt, Salmonella enterica enterica serovar Typhi Ty2
caguaaccuauuuuacaaaau

SEQ ID NO: 3716067 - RNA, 15 nt, Salmonella enterica enterica serovar Typhi Ty2
caguaacgcacuuuu

SEQ ID NO: 3716068 - RNA, 15 nt, Salmonella enterica enterica serovar Typhi Ty2
caguaacgcguccaa

SEQ ID NO: 3716069 - RNA, 14 nt, Salmonella enterica enterica serovar Typhi Ty2
caguaacucaucgc

SEQ ID NO: 3716070 - RNA, 17 nt, Salmonella enterica enterica serovar Typhi Ty2
caguaacucaucgccag

SEQ ID NO: 3716071 - RNA, 21 nt, Salmonella enterica enterica serovar Typhi Ty2
caguaagucgccgcagcucca

SEQ ID NO: 3716072 - RNA, 16 nt, Salmonella enterica enterica serovar Typhi Ty2
caguaauaauauaaag

SEQ ID NO: 3716073 - RNA, 21 nt, Salmonella enterica enterica serovar Typhi Ty2
caguaauauaaccaauuuaaa

SEQ ID NO: 3716074 - RNA, 20 nt, Salmonella enterica enterica serovar Typhi Ty2
caguaauauccccaucccag

SEQ ID NO: 3716075 - RNA, 13 nt, Salmonella enterica enterica serovar Typhi Ty2
cagugacgccagu

SEQ ID NO: 3716076 - RNA, 17 nt, Salmonella enterica enterica serovar Typhi Ty2
cagugagcccuccucca

SEQ ID NO: 3716077 - RNA, 15 nt, Salmonella enterica enterica serovar Typhi Ty2
cagugaguaacguua

SEQ ID NO: 3716078 - RNA, 22 nt, Salmonella enterica enterica serovar Typhi Ty2
cagugauccaucgguucucugc

SEQ ID NO: 3716079 - RNA, 13 nt, Salmonella enterica enterica serovar Typhi Ty2
cagugaugacggc

SEQ ID NO: 3716080 - RNA, 16 nt, Salmonella enterica enterica serovar Typhi Ty2
cagugauggauuucac

SEQ ID NO: 3716081 - RNA, 15 nt, Salmonella enterica enterica serovar Typhi Ty2
cagugauuacaaaau

SEQ ID NO: 3716082 - RNA, 23 nt, Salmonella enterica enterica serovar Typhi Ty2
cagugauucgcgaaucgcuucac

SEQ ID NO: 3716083 - RNA, 16 nt, Salmonella enterica enterica serovar Typhi Ty2
cagugcagaaagugug

SEQ ID NO: 3716084 - RNA, 20 nt, Salmonella enterica enterica serovar Typhi Ty2
cagugcaguauugcaccagg

SEQ ID NO: 3716085 - RNA, 21 nt, Salmonella enterica enterica serovar Typhi Ty2
cagugccaguccgguauaaaa

SEQ ID NO: 3716086 - RNA, 23 nt, Salmonella enterica enterica serovar Typhi Ty2
cagugccugauagcgcugugcua

SEQ ID NO: 3716087 - RNA, 12 nt, Salmonella enterica enterica serovar Typhi Ty2
cagugcgauacc

SEQ ID NO: 3716088 - RNA, 18 nt, Salmonella enterica enterica serovar Typhi Ty2
cagugcgucacuuuaacc

SEQ ID NO: 3716089 - RNA, 20 nt, Salmonella enterica enterica serovar Typhi Ty2
cagugcugagcacgcccggu

SEQ ID NO: 3716090 - RNA, 17 nt, Salmonella enterica enterica serovar Typhi Ty2
caguggacgauaagcac

SEQ ID NO: 3716091 - RNA, 16 nt, Salmonella enterica enterica serovar Typhi Ty2
caguggacgcgucgcu

SEQ ID NO: 3716092 - RNA, 18 nt, Salmonella enterica enterica serovar Typhi Ty2
caguggccagaaugaucg

SEQ ID NO: 3716093 - RNA, 22 nt, Salmonella enterica enterica serovar Typhi Ty2
caguggccagaaugaucgcauc

SEQ ID NO: 3716094 - RNA, 23 nt, Salmonella enterica enterica serovar Typhi Ty2
caguggcuuaccguaugcaaaag

SEQ ID NO: 3716095 - RNA, 18 nt, Salmonella enterica enterica serovar Typhi Ty2
caguggcuuuaacgucag

SEQ ID NO: 3716096 - RNA, 20 nt, Salmonella enterica enterica serovar Typhi Ty2
caguggcuuuaacgucagca

SEQ ID NO: 3716097 - RNA, 19 nt, Salmonella enterica enterica serovar Typhi Ty2
cagugggaaaacgugcccc

SEQ ID NO: 3716098 - RNA, 19 nt, Salmonella enterica enterica serovar Typhi Ty2
cagugguggcuauagcuca

SEQ ID NO: 3716099 - RNA, 15 nt, Salmonella enterica enterica serovar Typhi Ty2
caguguaaacgccag

SEQ ID NO: 3716100 - RNA, 23 nt, Salmonella enterica enterica serovar Typhi Ty2
cagugugguuucaagcggcagac

SEQ ID NO: 3716101 - RNA, 20 nt, Salmonella enterica enterica serovar Typhi Ty2
caguguuaaucucacgcuca

SEQ ID NO: 3716102 - RNA, 23 nt, Salmonella enterica enterica serovar Typhi Ty2
caguguugauugaaacucgccau

SEQ ID NO: 3716103 - RNA, 17 nt, Salmonella enterica enterica serovar Typhi Ty2
caguguuucccaacaau

SEQ ID NO: 3716104 - RNA, 17 nt, Salmonella enterica enterica serovar Typhi Ty2
caguuaaauaaacaaaa

SEQ ID NO: 3716105 - RNA, 19 nt, Salmonella enterica enterica serovar Typhi Ty2
caguuaacagaaugcugaa

SEQ ID NO: 3716106 - RNA, 16 nt, Salmonella enterica enterica serovar Typhi Ty2
caguuaccccgaagcg

SEQ ID NO: 3716107 - RNA, 16 nt, Salmonella enterica enterica serovar Typhi Ty2
caguuagcgaaacagu

SEQ ID NO: 3716108 - RNA, 22 nt, Salmonella enterica enterica serovar Typhi Ty2
caguuauuaaucaagcccagcu

SEQ ID NO: 3716109 - RNA, 24 nt, Salmonella enterica enterica serovar Typhi Ty2
caguuauuaaucaagcccagcuca

SEQ ID NO: 3716110 - RNA, 18 nt, Salmonella enterica enterica serovar Typhi Ty2
caguuauuuuacgggcgu

SEQ ID NO: 3716111 - RNA, 16 nt, Salmonella enterica enterica serovar Typhi Ty2
caguucacgccgccgc

SEQ ID NO: 3716112 - RNA, 20 nt, Salmonella enterica enterica serovar Typhi Ty2
caguucacuccuaagagaaa

SEQ ID NO: 3716113 - RNA, 14 nt, Salmonella enterica enterica serovar Typhi Ty2
caguucagaaacgg

SEQ ID NO: 3716114 - RNA, 14 nt, Salmonella enterica enterica serovar Typhi Ty2
caguucagccgcca

SEQ ID NO: 3716115 - RNA, 18 nt, Salmonella enterica enterica serovar Typhi Ty2
caguucauaagucaucca

SEQ ID NO: 3716116 - RNA, 23 nt, Salmonella enterica enterica serovar Typhi Ty2
caguucauauuugcuggcuugcu

SEQ ID NO: 3716117 - RNA, 18 nt, Salmonella enterica enterica serovar Typhi Ty2
caguucauccacgucaua

SEQ ID NO: 3716118 - RNA, 19 nt, Salmonella enterica enterica serovar Typhi Ty2
caguucauccacgucauaa

SEQ ID NO: 3716119 - RNA, 13 nt, Salmonella enterica enterica serovar Typhi Ty2
caguucauuccgc

SEQ ID NO: 3716120 - RNA, 17 nt, Salmonella enterica enterica serovar Typhi Ty2
caguucauucgccacca

SEQ ID NO: 3716121 - RNA, 17 nt, Salmonella enterica enterica serovar Typhi Ty2
caguuccaaucucuuuu

SEQ ID NO: 3716122 - RNA, 20 nt, Salmonella enterica enterica serovar Typhi Ty2
caguuccaccguaugugcgc

SEQ ID NO: 3716123 - RNA, 15 nt, Salmonella enterica enterica serovar Typhi Ty2
caguuccccgccgcg

SEQ ID NO: 3716124 - RNA, 16 nt, Salmonella enterica enterica serovar Typhi Ty2
caguuccccgccgcgg

SEQ ID NO: 3716125 - RNA, 20 nt, Salmonella enterica enterica serovar Typhi Ty2
caguuccgccagacucagcc

SEQ ID NO: 3716126 - RNA, 12 nt, Salmonella enterica enterica serovar Typhi Ty2
caguuccugugc

SEQ ID NO: 3716127 - RNA, 14 nt, Salmonella enterica enterica serovar Typhi Ty2
caguucggcaaagc

SEQ ID NO: 3716128 - RNA, 22 nt, Salmonella enterica enterica serovar Typhi Ty2
caguucgggacuaacuggucgc

SEQ ID NO: 3716129 - RNA, 14 nt, Salmonella enterica enterica serovar Typhi Ty2
caguucguucugcg

SEQ ID NO: 3716130 - RNA, 16 nt, Salmonella enterica enterica serovar Typhi Ty2
caguucguucugcguc

SEQ ID NO: 3716131 - RNA, 16 nt, Salmonella enterica enterica serovar Typhi Ty2
caguucuaacaggaag

SEQ ID NO: 3716132 - RNA, 14 nt, Salmonella enterica enterica serovar Typhi Ty2
caguucucaaucgc

SEQ ID NO: 3716133 - RNA, 16 nt, Salmonella enterica enterica serovar Typhi Ty2
caguucucgcgccacc

SEQ ID NO: 3716134 - RNA, 22 nt, Salmonella enterica enterica serovar Typhi Ty2
caguucuucgccguuaucggcc

SEQ ID NO: 3716135 - RNA, 14 nt, Salmonella enterica enterica serovar Typhi Ty2
caguugaugaugcc

SEQ ID NO: 3716136 - RNA, 17 nt, Salmonella enterica enterica serovar Typhi Ty2
caguugccuugccucac

SEQ ID NO: 3716137 - RNA, 12 nt, Salmonella enterica enterica serovar Typhi Ty2
caguugcgcuac

SEQ ID NO: 3716138 - RNA, 15 nt, Salmonella enterica enterica serovar Typhi Ty2
caguugcgucagcgc

SEQ ID NO: 3716139 - RNA, 14 nt, Salmonella enterica enterica serovar Typhi Ty2
caguugcuggagca

SEQ ID NO: 3716140 - RNA, 13 nt, Salmonella enterica enterica serovar Typhi Ty2
caguugcuggauu

SEQ ID NO: 3716141 - RNA, 15 nt, Salmonella enterica enterica serovar Typhi Ty2
caguuggcgaccgcu

SEQ ID NO: 3716142 - RNA, 16 nt, Salmonella enterica enterica serovar Typhi Ty2
caguuggcgaccgcug

SEQ ID NO: 3716143 - RNA, 18 nt, Salmonella enterica enterica serovar Typhi Ty2
caguuggcgaccgcugca

SEQ ID NO: 3716144 - RNA, 17 nt, Salmonella enterica enterica serovar Typhi Ty2
caguuggcuucagcaaa

SEQ ID NO: 3716145 - RNA, 17 nt, Salmonella enterica enterica serovar Typhi Ty2
caguuggucgcguuuac

SEQ ID NO: 3716146 - RNA, 17 nt, Salmonella enterica enterica serovar Typhi Ty2
caguuguccgcugguca

SEQ ID NO: 3716147 - RNA, 16 nt, Salmonella enterica enterica serovar Typhi Ty2
caguuguuccagcagc

SEQ ID NO: 3716148 - RNA, 23 nt, Salmonella enterica enterica serovar Typhi Ty2
caguuuagcuaaaucacgcaggu

SEQ ID NO: 3716149 - RNA, 17 nt, Salmonella enterica enterica serovar Typhi Ty2
caguuuagggaucaucu

SEQ ID NO: 3716150 - RNA, 20 nt, Salmonella enterica enterica serovar Typhi Ty2
caguuucucaaacacuucua

SEQ ID NO: 3716151 - RNA, 14 nt, Salmonella enterica enterica serovar Typhi Ty2
caguuugcgaaaag

SEQ ID NO: 3716152 - RNA, 15 nt, Salmonella enterica enterica serovar Typhi Ty2
caguuugcgaaaagc

SEQ ID NO: 3716153 - RNA, 16 nt, Salmonella enterica enterica serovar Typhi Ty2
caguuugguaauacua

SEQ ID NO: 3716154 - RNA, 19 nt, Salmonella enterica enterica serovar Typhi Ty2
caguuuugaucgaaucucc

SEQ ID NO: 3716155 - RNA, 12 nt, Salmonella enterica enterica serovar Typhi Ty2
caguuuuuccuu

SEQ ID NO: 3716156 - RNA, 17 nt, Salmonella enterica enterica serovar Typhi Ty2
caguuuuugcauuauau

SEQ ID NO: 3716157 - RNA, 12 nt, Salmonella enterica enterica serovar Typhi Ty2
cauacgauucag

SEQ ID NO: 3716158 - RNA, 15 nt, Salmonella enterica enterica serovar Typhi Ty2
cauacgcgcgccaca

SEQ ID NO: 3716159 - RNA, 16 nt, Salmonella enterica enterica serovar Typhi Ty2
cauacgcuuuacgcuu

SEQ ID NO: 3716160 - RNA, 19 nt, Salmonella enterica enterica serovar Typhi Ty2
cauacguuuuuauuaucug

SEQ ID NO: 3716161 - RNA, 19 nt, Salmonella enterica enterica serovar Typhi Ty2
cauacuauccaacagaagg

SEQ ID NO: 3716162 - RNA, 12 nt, Salmonella enterica enterica serovar Typhi Ty2
cauacucacauu

SEQ ID NO: 3716163 - RNA, 21 nt, Salmonella enterica enterica serovar Typhi Ty2
cauacucacauucauaaaaga

SEQ ID NO: 3716164 - RNA, 17 nt, Salmonella enterica enterica serovar Typhi Ty2
cauacucacgaauaaga

SEQ ID NO: 3716165 - RNA, 21 nt, Salmonella enterica enterica serovar Typhi Ty2
cauacuccugccugacaauga

SEQ ID NO: 3716166 - RNA, 21 nt, Salmonella enterica enterica serovar Typhi Ty2
cauacucuuggagagcaucau

SEQ ID NO: 3716167 - RNA, 23 nt, Salmonella enterica enterica serovar Typhi Ty2
cauacugaagauaaacagcagcg

SEQ ID NO: 3716168 - RNA, 19 nt, Salmonella enterica enterica serovar Typhi Ty2
cauacugaccaacaacaga

SEQ ID NO: 3716169 - RNA, 19 nt, Salmonella enterica enterica serovar Typhi Ty2
cauacugauuucggaauga

SEQ ID NO: 3716170 - RNA, 14 nt, Salmonella enterica enterica serovar Typhi Ty2
cauacugcccagcc

SEQ ID NO: 3716171 - RNA, 18 nt, Salmonella enterica enterica serovar Typhi Ty2
cauacuguuuaucagacc

SEQ ID NO: 3716172 - RNA, 15 nt, Salmonella enterica enterica serovar Typhi Ty2
cauacuuacugcugu

SEQ ID NO: 3716173 - RNA, 16 nt, Salmonella enterica enterica serovar Typhi Ty2
cauacuuacugcuguc

SEQ ID NO: 3716174 - RNA, 15 nt, Salmonella enterica enterica serovar Typhi Ty2
cauacuuccucaccg

SEQ ID NO: 3716175 - RNA, 13 nt, Salmonella enterica enterica serovar Typhi Ty2
cauacuuugcauu

SEQ ID NO: 3716176 - RNA, 14 nt, Salmonella enterica enterica serovar Typhi Ty2
cauagaaaaagaac

SEQ ID NO: 3716177 - RNA, 15 nt, Salmonella enterica enterica serovar Typhi Ty2
cauagaaaauauaug

SEQ ID NO: 3716178 - RNA, 23 nt, Salmonella enterica enterica serovar Typhi Ty2
cauagaaaauauaugacaacacu

SEQ ID NO: 3716179 - RNA, 17 nt, Salmonella enterica enterica serovar Typhi Ty2
cauagaaaucagcaggu

SEQ ID NO: 3716180 - RNA, 12 nt, Salmonella enterica enterica serovar Typhi Ty2
cauagaaccacu

SEQ ID NO: 3716181 - RNA, 16 nt, Salmonella enterica enterica serovar Typhi Ty2
cauagaacgcuugucu

SEQ ID NO: 3716182 - RNA, 14 nt, Salmonella enterica enterica serovar Typhi Ty2
cauagacgcccugc

SEQ ID NO: 3716183 - RNA, 20 nt, Salmonella enterica enterica serovar Typhi Ty2
cauagacgcccugcaaagca

SEQ ID NO: 3716184 - RNA, 20 nt, Salmonella enterica enterica serovar Typhi Ty2
cauagagaagucugagcgca

SEQ ID NO: 3716185 - RNA, 17 nt, Salmonella enterica enterica serovar Typhi Ty2
cauagauauaacccagu

SEQ ID NO: 3716186 - RNA, 14 nt, Salmonella enterica enterica serovar Typhi Ty2
cauagcaucguuac

SEQ ID NO: 3716187 - RNA, 20 nt, Salmonella enterica enterica serovar Typhi Ty2
cauagccaacacauaagcca

SEQ ID NO: 3716188 - RNA, 15 nt, Salmonella enterica enterica serovar Typhi Ty2
cauagccgcgcguca

SEQ ID NO: 3716189 - RNA, 22 nt, Salmonella enterica enterica serovar Typhi Ty2
cauagccggcgauagcgcccca

SEQ ID NO: 3716190 - RNA, 22 nt, Salmonella enterica enterica serovar Typhi Ty2
cauagccguggcuggcgucccg

SEQ ID NO: 3716191 - RNA, 13 nt, Salmonella enterica enterica serovar Typhi Ty2
cauagccuaauga

SEQ ID NO: 3716192 - RNA, 23 nt, Salmonella enterica enterica serovar Typhi Ty2
cauagccuuugucgaaauugccg

SEQ ID NO: 3716193 - RNA, 19 nt, Salmonella enterica enterica serovar Typhi Ty2
cauagcggccagauggcaa

SEQ ID NO: 3716194 - RNA, 18 nt, Salmonella enterica enterica serovar Typhi Ty2
cauagcgggagauugaaa

SEQ ID NO: 3716195 - RNA, 18 nt, Salmonella enterica enterica serovar Typhi Ty2
cauagcuaaauaaaaaua

SEQ ID NO: 3716196 - RNA, 20 nt, Salmonella enterica enterica serovar Typhi Ty2
cauagcuaaauaaaaauaau

SEQ ID NO: 3716197 - RNA, 13 nt, Salmonella enterica enterica serovar Typhi Ty2
cauagcuaccgcg

SEQ ID NO: 3716198 - RNA, 12 nt, Salmonella enterica enterica serovar Typhi Ty2
cauaggacugau

SEQ ID NO: 3716199 - RNA, 15 nt, Salmonella enterica enterica serovar Typhi Ty2
cauaggccagcguca

SEQ ID NO: 3716200 - RNA, 17 nt, Salmonella enterica enterica serovar Typhi Ty2
cauaggccggcgaagau

SEQ ID NO: 3716201 - RNA, 22 nt, Salmonella enterica enterica serovar Typhi Ty2
cauaggcgacaggcgugauagc

SEQ ID NO: 3716202 - RNA, 18 nt, Salmonella enterica enterica serovar Typhi Ty2
cauaguacccucugcacc

SEQ ID NO: 3716203 - RNA, 20 nt, Salmonella enterica enterica serovar Typhi Ty2
cauaguacccucugcaccag

SEQ ID NO: 3716204 - RNA, 22 nt, Salmonella enterica enterica serovar Typhi Ty2
cauaguauugacgguuacgcaa

SEQ ID NO: 3716205 - RNA, 16 nt, Salmonella enterica enterica serovar Typhi Ty2
cauagucgucuauuuc

SEQ ID NO: 3716206 - RNA, 15 nt, Salmonella enterica enterica serovar Typhi Ty2
cauaguuugcauaac

SEQ ID NO: 3716207 - RNA, 19 nt, Salmonella enterica enterica serovar Typhi Ty2
cauaguuugcauaaccggu

SEQ ID NO: 3716208 - RNA, 18 nt, Salmonella enterica enterica serovar Typhi Ty2
cauaguuugcucaggcuc

SEQ ID NO: 3716209 - RNA, 16 nt, Salmonella enterica enterica serovar Typhi Ty2
cauaguuuuuccccau

SEQ ID NO: 3716210 - RNA, 23 nt, Salmonella enterica enterica serovar Typhi Ty2
cauauaaccacgaaaauuauuuu

SEQ ID NO: 3716211 - RNA, 16 nt, Salmonella enterica enterica serovar Typhi Ty2
cauauaacuuucaaua

SEQ ID NO: 3716212 - RNA, 19 nt, Salmonella enterica enterica serovar Typhi Ty2
cauauaccgcaccugggua

SEQ ID NO: 3716213 - RNA, 19 nt, Salmonella enterica enterica serovar Typhi Ty2
cauauagcagcagucucua

SEQ ID NO: 3716214 - RNA, 18 nt, Salmonella enterica enterica serovar Typhi Ty2
cauauagugcgugacaau

SEQ ID NO: 3716215 - RNA, 16 nt, Salmonella enterica enterica serovar Typhi Ty2
cauauaugcgacagaa

SEQ ID NO: 3716216 - RNA, 17 nt, Salmonella enterica enterica serovar Typhi Ty2
cauauaugcgacagaaa

SEQ ID NO: 3716217 - RNA, 12 nt, Salmonella enterica enterica serovar Typhi Ty2
cauauauuuacu

SEQ ID NO: 3716218 - RNA, 13 nt, Salmonella enterica enterica serovar Typhi Ty2
cauauauuuacug

SEQ ID NO: 3716219 - RNA, 20 nt, Salmonella enterica enterica serovar Typhi Ty2
cauaucaauauguuccggcg

SEQ ID NO: 3716220 - RNA, 22 nt, Salmonella enterica enterica serovar Typhi Ty2
cauaucaauauguuccggcguc

SEQ ID NO: 3716221 - RNA, 22 nt, Salmonella enterica enterica serovar Typhi Ty2
cauaucaaugaacuacggcccu

SEQ ID NO: 3716222 - RNA, 13 nt, Salmonella enterica enterica serovar Typhi Ty2
cauaucaguugcc

SEQ ID NO: 3716223 - RNA, 16 nt, Salmonella enterica enterica serovar Typhi Ty2
cauauccaagccccuc

SEQ ID NO: 3716224 - RNA, 11 nt, Salmonella enterica enterica serovar Typhi Ty2
cauauccagcc

SEQ ID NO: 3716225 - RNA, 14 nt, Salmonella enterica enterica serovar Typhi Ty2
cauaucgcaauuga

SEQ ID NO: 3716226 - RNA, 15 nt, Salmonella enterica enterica serovar Typhi Ty2
cauaucgcgcagcgu

SEQ ID NO: 3716227 - RNA, 15 nt, Salmonella enterica enterica serovar Typhi Ty2
cauaucgcggguaaa

SEQ ID NO: 3716228 - RNA, 19 nt, Salmonella enterica enterica serovar Typhi Ty2
cauaucgcggguaaacuca

SEQ ID NO: 3716229 - RNA, 19 nt, Salmonella enterica enterica serovar Typhi Ty2
cauaucguacugcuuuaau

SEQ ID NO: 3716230 - RNA, 16 nt, Salmonella enterica enterica serovar Typhi Ty2
cauaucuggacgggcc

SEQ ID NO: 3716231 - RNA, 23 nt, Salmonella enterica enterica serovar Typhi Ty2
cauaucuggcgaggcuuuguccu

SEQ ID NO: 3716232 - RNA, 21 nt, Salmonella enterica enterica serovar Typhi Ty2
cauaucuucgcgcguggugcu

SEQ ID NO: 3716233 - RNA, 13 nt, Salmonella enterica enterica serovar Typhi Ty2
cauaugcgcggcg

SEQ ID NO: 3716234 - RNA, 14 nt, Salmonella enterica enterica serovar Typhi Ty2
cauaugcgcggcga

SEQ ID NO: 3716235 - RNA, 14 nt, Salmonella enterica enterica serovar Typhi Ty2
cauaugcucuccug

SEQ ID NO: 3716236 - RNA, 16 nt, Salmonella enterica enterica serovar Typhi Ty2
cauauggcauucgcag

SEQ ID NO: 3716237 - RNA, 12 nt, Salmonella enterica enterica serovar Typhi Ty2
cauaugggaaga

SEQ ID NO: 3716238 - RNA, 17 nt, Salmonella enterica enterica serovar Typhi Ty2
cauaugggaagacauuc

SEQ ID NO: 3716239 - RNA, 14 nt, Salmonella enterica enterica serovar Typhi Ty2
caucagcaaaauac

SEQ ID NO: 3716240 - RNA, 22 nt, Salmonella enterica enterica serovar Typhi Ty2
caucagcaaaauaccggcagcg

SEQ ID NO: 3716241 - RNA, 15 nt, Salmonella enterica enterica serovar Typhi Ty2
caucagcaaaugaac

SEQ ID NO: 3716242 - RNA, 14 nt, Salmonella enterica enterica serovar Typhi Ty2
caucagcaggauag

SEQ ID NO: 3716243 - RNA, 17 nt, Salmonella enterica enterica serovar Typhi Ty2
caucagccagcagcuca

SEQ ID NO: 3716244 - RNA, 14 nt, Salmonella enterica enterica serovar Typhi Ty2
caucagccagcauc

SEQ ID NO: 3716245 - RNA, 17 nt, Salmonella enterica enterica serovar Typhi Ty2
caucagccagccgccaa

SEQ ID NO: 3716246 - RNA, 23 nt, Salmonella enterica enterica serovar Typhi Ty2
caucagccagccgccaaaaauau

SEQ ID NO: 3716247 - RNA, 22 nt, Salmonella enterica enterica serovar Typhi Ty2
caucagccauuuguuagcguuu

SEQ ID NO: 3716248 - RNA, 19 nt, Salmonella enterica enterica serovar Typhi Ty2
caucagccguuacuucccc

SEQ ID NO: 3716249 - RNA, 18 nt, Salmonella enterica enterica serovar Typhi Ty2
caucagcgccagcccugc

SEQ ID NO: 3716250 - RNA, 10 nt, Salmonella enterica enterica serovar Typhi Ty2
caucagcgcu

SEQ ID NO: 3716251 - RNA, 21 nt, Salmonella enterica enterica serovar Typhi Ty2
caucagcgcuaccagcgcggc

SEQ ID NO: 3716252 - RNA, 20 nt, Salmonella enterica enterica serovar Typhi Ty2
caucagcgggcuaugcugaa

SEQ ID NO: 3716253 - RNA, 13 nt, Salmonella enterica enterica serovar Typhi Ty2
caucaggaaugcc

SEQ ID NO: 3716254 - RNA, 19 nt, Salmonella enterica enterica serovar Typhi Ty2
caucaggcaucugaaaugc

SEQ ID NO: 3716255 - RNA, 19 nt, Salmonella enterica enterica serovar Typhi Ty2
caucaggcauggcagcagg

SEQ ID NO: 3716256 - RNA, 15 nt, Salmonella enterica enterica serovar Typhi Ty2
caucaggccugcaaa

SEQ ID NO: 3716257 - RNA, 17 nt, Salmonella enterica enterica serovar Typhi Ty2
caucaggccugcaaacc

SEQ ID NO: 3716258 - RNA, 21 nt, Salmonella enterica enterica serovar Typhi Ty2
caucaggcugacgaagaacuu

SEQ ID NO: 3716259 - RNA, 16 nt, Salmonella enterica enterica serovar Typhi Ty2
caucaggcuggcguua

SEQ ID NO: 3716260 - RNA, 17 nt, Salmonella enterica enterica serovar Typhi Ty2
caucaggcuuugcgcca

SEQ ID NO: 3716261 - RNA, 17 nt, Salmonella enterica enterica serovar Typhi Ty2
caucagguggaagaaac

SEQ ID NO: 3716262 - RNA, 18 nt, Salmonella enterica enterica serovar Typhi Ty2
caucagguggaagaaacg

SEQ ID NO: 3716263 - RNA, 13 nt, Salmonella enterica enterica serovar Typhi Ty2
caucaguaacuga

SEQ ID NO: 3716264 - RNA, 15 nt, Salmonella enterica enterica serovar Typhi Ty2
caucaguacaaacgc

SEQ ID NO: 3716265 - RNA, 15 nt, Salmonella enterica enterica serovar Typhi Ty2
caucaguccuguuga

SEQ ID NO: 3716266 - RNA, 13 nt, Salmonella enterica enterica serovar Typhi Ty2
caucagucucaaa

SEQ ID NO: 3716267 - RNA, 14 nt, Salmonella enterica enterica serovar Typhi Ty2
caucaguuuaaccg

SEQ ID NO: 3716268 - RNA, 13 nt, Salmonella enterica enterica serovar Typhi Ty2
caucauaaaaggc

SEQ ID NO: 3716269 - RNA, 22 nt, Salmonella enterica enterica serovar Typhi Ty2
caucauaaaaggcaucgcucuu

SEQ ID NO: 3716270 - RNA, 16 nt, Salmonella enterica enterica serovar Typhi Ty2
caucauaaauggcuga

SEQ ID NO: 3716271 - RNA, 14 nt, Salmonella enterica enterica serovar Typhi Ty2
caucauaauaauug

SEQ ID NO: 3716272 - RNA, 14 nt, Salmonella enterica enterica serovar Typhi Ty2
caucauaauccuua

SEQ ID NO: 3716273 - RNA, 16 nt, Salmonella enterica enterica serovar Typhi Ty2
caucauaauccuuauu

SEQ ID NO: 3716274 - RNA, 20 nt, Salmonella enterica enterica serovar Typhi Ty2
caucauauaaccacgaaaau

SEQ ID NO: 3716275 - RNA, 19 nt, Salmonella enterica enterica serovar Typhi Ty2
caucauaucccggcugaca

SEQ ID NO: 3716276 - RNA, 18 nt, Salmonella enterica enterica serovar Typhi Ty2
caucaucaggacucaauc

SEQ ID NO: 3716277 - RNA, 19 nt, Salmonella enterica enterica serovar Typhi Ty2
caucaucaggacucaauca

SEQ ID NO: 3716278 - RNA, 22 nt, Salmonella enterica enterica serovar Typhi Ty2
caucaucaggguuauccuccag

SEQ ID NO: 3716279 - RNA, 19 nt, Salmonella enterica enterica serovar Typhi Ty2
caucaucaucggcacagcc

SEQ ID NO: 3716280 - RNA, 14 nt, Salmonella enterica enterica serovar Typhi Ty2
caucaucccgcgcc

SEQ ID NO: 3716281 - RNA, 17 nt, Salmonella enterica enterica serovar Typhi Ty2
caucauccugcagggua

SEQ ID NO: 3716282 - RNA, 17 nt, Salmonella enterica enterica serovar Typhi Ty2
caucaucgccgauuucu

SEQ ID NO: 3716283 - RNA, 19 nt, Salmonella enterica enterica serovar Typhi Ty2
caucaucugccauuucugc

SEQ ID NO: 3716284 - RNA, 20 nt, Salmonella enterica enterica serovar Typhi Ty2
caucaucuuguccucaucau

SEQ ID NO: 3716285 - RNA, 20 nt, Salmonella enterica enterica serovar Typhi Ty2
caucaugaaaaacaguaccg

SEQ ID NO: 3716286 - RNA, 13 nt, Salmonella enterica enterica serovar Typhi Ty2
caucaugauauaa

SEQ ID NO: 3716287 - RNA, 15 nt, Salmonella enterica enterica serovar Typhi Ty2
caucaugauauaauu

SEQ ID NO: 3716288 - RNA, 22 nt, Salmonella enterica enterica serovar Typhi Ty2
caucaugaugaucuucagcccg

SEQ ID NO: 3716289 - RNA, 23 nt, Salmonella enterica enterica serovar Typhi Ty2
caucaugaugaucuucagcccgu

SEQ ID NO: 3716290 - RNA, 22 nt, Salmonella enterica enterica serovar Typhi Ty2
caucaugcaagagucccagaac

SEQ ID NO: 3716291 - RNA, 17 nt, Salmonella enterica enterica serovar Typhi Ty2
caucaugcccacaggca

SEQ ID NO: 3716292 - RNA, 19 nt, Salmonella enterica enterica serovar Typhi Ty2
caucaugcuaaaagcgacu

SEQ ID NO: 3716293 - RNA, 16 nt, Salmonella enterica enterica serovar Typhi Ty2
caucaugcuugcuuug

SEQ ID NO: 3716294 - RNA, 17 nt, Salmonella enterica enterica serovar Typhi Ty2
caucaugucacccacgc

SEQ ID NO: 3716295 - RNA, 20 nt, Salmonella enterica enterica serovar Typhi Ty2
caucauguugaaauauuuga

SEQ ID NO: 3716296 - RNA, 16 nt, Salmonella enterica enterica serovar Typhi Ty2
caucauuaaagcgcuc

SEQ ID NO: 3716297 - RNA, 19 nt, Salmonella enterica enterica serovar Typhi Ty2
caucauuaaagcgcucaag

SEQ ID NO: 3716298 - RNA, 14 nt, Salmonella enterica enterica serovar Typhi Ty2
caucauuaauauaa

SEQ ID NO: 3716299 - RNA, 19 nt, Salmonella enterica enterica serovar Typhi Ty2
caucauuaccuuuuccggc

SEQ ID NO: 3716300 - RNA, 23 nt, Salmonella enterica enterica serovar Typhi Ty2
caucauuaccuuuuccggcggca

SEQ ID NO: 3716301 - RNA, 14 nt, Salmonella enterica enterica serovar Typhi Ty2
caucauuauucccc

SEQ ID NO: 3716302 - RNA, 16 nt, Salmonella enterica enterica serovar Typhi Ty2
caucauuauuccccuc

SEQ ID NO: 3716303 - RNA, 19 nt, Salmonella enterica enterica serovar Typhi Ty2
caucauucaacgcaucaaa

SEQ ID NO: 3716304 - RNA, 22 nt, Salmonella enterica enterica serovar Typhi Ty2
caucauucgguuaggaauagca

SEQ ID NO: 3716305 - RNA, 17 nt, Salmonella enterica enterica serovar Typhi Ty2
caucauugauacuguac

SEQ ID NO: 3716306 - RNA, 13 nt, Salmonella enterica enterica serovar Typhi Ty2
caucauugcgcca

SEQ ID NO: 3716307 - RNA, 17 nt, Salmonella enterica enterica serovar Typhi Ty2
caucauuggcugucuua

SEQ ID NO: 3716308 - RNA, 13 nt, Salmonella enterica enterica serovar Typhi Ty2
cauccacagcgcc

SEQ ID NO: 3716309 - RNA, 14 nt, Salmonella enterica enterica serovar Typhi Ty2
cauccacagcgcca

SEQ ID NO: 3716310 - RNA, 23 nt, Salmonella enterica enterica serovar Typhi Ty2
cauccacauucguaacaugcugg

SEQ ID NO: 3716311 - RNA, 17 nt, Salmonella enterica enterica serovar Typhi Ty2
cauccaccaggcaugca

SEQ ID NO: 3716312 - RNA, 13 nt, Salmonella enterica enterica serovar Typhi Ty2
cauccacccuggc

SEQ ID NO: 3716313 - RNA, 18 nt, Salmonella enterica enterica serovar Typhi Ty2
cauccaccuuauccuggc

SEQ ID NO: 3716314 - RNA, 21 nt, Salmonella enterica enterica serovar Typhi Ty2
cauccacuuuucgcggauaac

SEQ ID NO: 3716315 - RNA, 18 nt, Salmonella enterica enterica serovar Typhi Ty2
cauccagaaggcaaaaug

SEQ ID NO: 3716316 - RNA, 16 nt, Salmonella enterica enterica serovar Typhi Ty2
cauccagacaugcaca

SEQ ID NO: 3716317 - RNA, 19 nt, Salmonella enterica enterica serovar Typhi Ty2
cauccagacaugcacaugg

SEQ ID NO: 3716318 - RNA, 11 nt, Salmonella enterica enterica serovar Typhi Ty2
cauccagacca

SEQ ID NO: 3716319 - RNA, 14 nt, Salmonella enterica enterica serovar Typhi Ty2
cauccagagcaguc

SEQ ID NO: 3716320 - RNA, 18 nt, Salmonella enterica enterica serovar Typhi Ty2
cauccagcagcagcaccg

SEQ ID NO: 3716321 - RNA, 17 nt, Salmonella enterica enterica serovar Typhi Ty2
caucgccugaugaccgc

SEQ ID NO: 3716322 - RNA, 22 nt, Salmonella enterica enterica serovar Typhi Ty2
caucgcgaauuucaaucgccag

SEQ ID NO: 3716323 - RNA, 16 nt, Salmonella enterica enterica serovar Typhi Ty2
caucgcgacacccaau

SEQ ID NO: 3716324 - RNA, 16 nt, Salmonella enterica enterica serovar Typhi Ty2
caucgcgaccggauca

SEQ ID NO: 3716325 - RNA, 22 nt, Salmonella enterica enterica serovar Typhi Ty2
caucgcgccaaacgggcaagcc

SEQ ID NO: 3716326 - RNA, 14 nt, Salmonella enterica enterica serovar Typhi Ty2
caucgcgccaugau

SEQ ID NO: 3716327 - RNA, 16 nt, Salmonella enterica enterica serovar Typhi Ty2
caucgcgcgcaggccc

SEQ ID NO: 3716328 - RNA, 15 nt, Salmonella enterica enterica serovar Typhi Ty2
caucgcgguuuuccg

SEQ ID NO: 3716329 - RNA, 18 nt, Salmonella enterica enterica serovar Typhi Ty2
caucgcgucgccaucagg

SEQ ID NO: 3716330 - RNA, 18 nt, Salmonella enterica enterica serovar Typhi Ty2
caucgcuaaccggcggcg

SEQ ID NO: 3716331 - RNA, 15 nt, Salmonella enterica enterica serovar Typhi Ty2
caucgcuaucaugcu

SEQ ID NO: 3716332 - RNA, 13 nt, Salmonella enterica enterica serovar Typhi Ty2
caucgcuccagac

SEQ ID NO: 3716333 - RNA, 13 nt, Salmonella enterica enterica serovar Typhi Ty2
caucgcucccggc

SEQ ID NO: 3716334 - RNA, 13 nt, Salmonella enterica enterica serovar Typhi Ty2
caucgcucuuggc

SEQ ID NO: 3716335 - RNA, 23 nt, Salmonella enterica enterica serovar Typhi Ty2
caucgcugaauuuggcggcgcgc

SEQ ID NO: 3716336 - RNA, 20 nt, Salmonella enterica enterica serovar Typhi Ty2
caucgcuggucgcuaccaca

SEQ ID NO: 3716337 - RNA, 21 nt, Salmonella enterica enterica serovar Typhi Ty2
caucgcuggugugcagccagu

SEQ ID NO: 3716338 - RNA, 17 nt, Salmonella enterica enterica serovar Typhi Ty2
caucgcuuaacggccca

SEQ ID NO: 3716339 - RNA, 18 nt, Salmonella enterica enterica serovar Typhi Ty2
caucgcuucuacagccac

SEQ ID NO: 3716340 - RNA, 14 nt, Salmonella enterica enterica serovar Typhi Ty2
caucggagauuuca

SEQ ID NO: 3716341 - RNA, 18 nt, Salmonella enterica enterica serovar Typhi Ty2
caucggagauuucauccu

SEQ ID NO: 3716342 - RNA, 12 nt, Salmonella enterica enterica serovar Typhi Ty2
caucggcaaacg

SEQ ID NO: 3716343 - RNA, 19 nt, Salmonella enterica enterica serovar Typhi Ty2
caucggcaaacgccgccug

SEQ ID NO: 3716344 - RNA, 22 nt, Salmonella enterica enterica serovar Typhi Ty2
caucggcacacuuucgcccggc

SEQ ID NO: 3716345 - RNA, 15 nt, Salmonella enterica enterica serovar Typhi Ty2
caucggcacagccag

SEQ ID NO: 3716346 - RNA, 19 nt, Salmonella enterica enterica serovar Typhi Ty2
caucggcagcgccagugac

SEQ ID NO: 3716347 - RNA, 15 nt, Salmonella enterica enterica serovar Typhi Ty2
caucggcagcgucag

SEQ ID NO: 3716348 - RNA, 19 nt, Salmonella enterica enterica serovar Typhi Ty2
caucggccagcaggcgcac

SEQ ID NO: 3716349 - RNA, 18 nt, Salmonella enterica enterica serovar Typhi Ty2
caucggcccacgcgcaga

SEQ ID NO: 3716350 - RNA, 15 nt, Salmonella enterica enterica serovar Typhi Ty2
caucggcgcgucgcu

SEQ ID NO: 3716351 - RNA, 16 nt, Salmonella enterica enterica serovar Typhi Ty2
caucggcggcaaugcc

SEQ ID NO: 3716352 - RNA, 21 nt, Salmonella enterica enterica serovar Typhi Ty2
caucggcucagcaaucacuuc

SEQ ID NO: 3716353 - RNA, 19 nt, Salmonella enterica enterica serovar Typhi Ty2
caucgggaacggcauacug

SEQ ID NO: 3716354 - RNA, 19 nt, Salmonella enterica enterica serovar Typhi Ty2
caucgggacggcggucgcu

SEQ ID NO: 3716355 - RNA, 18 nt, Salmonella enterica enterica serovar Typhi Ty2
caucgggauuuacaaccg

SEQ ID NO: 3716356 - RNA, 17 nt, Salmonella enterica enterica serovar Typhi Ty2
caucgggucgcgcgccg

SEQ ID NO: 3716357 - RNA, 15 nt, Salmonella enterica enterica serovar Typhi Ty2
caucgguaagcgcaa

SEQ ID NO: 3716358 - RNA, 15 nt, Salmonella enterica enterica serovar Typhi Ty2
caucggucaguguuu

SEQ ID NO: 3716359 - RNA, 17 nt, Salmonella enterica enterica serovar Typhi Ty2
caucguaccaauaccca

SEQ ID NO: 3716360 - RNA, 20 nt, Salmonella enterica enterica serovar Typhi Ty2
caucguagucaggcaacagg

SEQ ID NO: 3716361 - RNA, 21 nt, Salmonella enterica enterica serovar Typhi Ty2
caucgucgccagacccagcgc

SEQ ID NO: 3716362 - RNA, 13 nt, Salmonella enterica enterica serovar Typhi Ty2
caucgugauaaac

SEQ ID NO: 3716363 - RNA, 19 nt, Salmonella enterica enterica serovar Typhi Ty2
caucgugguuaauacauca

SEQ ID NO: 3716364 - RNA, 22 nt, Salmonella enterica enterica serovar Typhi Ty2
caucguguauaccaaaaauaau

SEQ ID NO: 3716365 - RNA, 14 nt, Salmonella enterica enterica serovar Typhi Ty2
caucguuacccauu

SEQ ID NO: 3716366 - RNA, 21 nt, Salmonella enterica enterica serovar Typhi Ty2
caucguuacccauuaccuggc

SEQ ID NO: 3716367 - RNA, 20 nt, Salmonella enterica enterica serovar Typhi Ty2
caucguuugcgcuacgcugc

SEQ ID NO: 3716368 - RNA, 20 nt, Salmonella enterica enterica serovar Typhi Ty2
caucuaacacaaauucgcua

SEQ ID NO: 3716369 - RNA, 21 nt, Salmonella enterica enterica serovar Typhi Ty2
caucuauaauaccuccugucu

SEQ ID NO: 3716370 - RNA, 23 nt, Salmonella enterica enterica serovar Typhi Ty2
caucuauaauaccuccugucuau

SEQ ID NO: 3716371 - RNA, 12 nt, Salmonella enterica enterica serovar Typhi Ty2
caucuauuuaac

SEQ ID NO: 3716372 - RNA, 15 nt, Salmonella enterica enterica serovar Typhi Ty2
caucucaucggcuuu

SEQ ID NO: 3716373 - RNA, 12 nt, Salmonella enterica enterica serovar Typhi Ty2
caucucaucuug

SEQ ID NO: 3716374 - RNA, 21 nt, Salmonella enterica enterica serovar Typhi Ty2
caucuccagcguggcagugag

SEQ ID NO: 3716375 - RNA, 14 nt, Salmonella enterica enterica serovar Typhi Ty2
caucucccaggccg

SEQ ID NO: 3716376 - RNA, 18 nt, Salmonella enterica enterica serovar Typhi Ty2
caucucccaggccgccac

SEQ ID NO: 3716377 - RNA, 21 nt, Salmonella enterica enterica serovar Typhi Ty2
caucucccaggccgccaccgc

SEQ ID NO: 3716378 - RNA, 21 nt, Salmonella enterica enterica serovar Typhi Ty2
caucuccgauaaauaagaagg

SEQ ID NO: 3716379 - RNA, 22 nt, Salmonella enterica enterica serovar Typhi Ty2
caucuccuccucauucagcggc

SEQ ID NO: 3716380 - RNA, 14 nt, Salmonella enterica enterica serovar Typhi Ty2
caucuccucgcgcg

SEQ ID NO: 3716381 - RNA, 15 nt, Salmonella enterica enterica serovar Typhi Ty2
caucuccuguaauga

SEQ ID NO: 3716382 - RNA, 12 nt, Salmonella enterica enterica serovar Typhi Ty2
caucucgccaaa

SEQ ID NO: 3716383 - RNA, 18 nt, Salmonella enterica enterica serovar Typhi Ty2
caucucgguuaugaccaa

SEQ ID NO: 3716384 - RNA, 22 nt, Salmonella enterica enterica serovar Typhi Ty2
caucucgucaaacucuuccggg

SEQ ID NO: 3716385 - RNA, 13 nt, Salmonella enterica enterica serovar Typhi Ty2
caucucuccgcgu

SEQ ID NO: 3716386 - RNA, 15 nt, Salmonella enterica enterica serovar Typhi Ty2
caucucuuucagaau

SEQ ID NO: 3716387 - RNA, 16 nt, Salmonella enterica enterica serovar Typhi Ty2
caucucuuucagaaua

SEQ ID NO: 3716388 - RNA, 19 nt, Salmonella enterica enterica serovar Typhi Ty2
caucucuuuuaauuuucug

SEQ ID NO: 3716389 - RNA, 19 nt, Salmonella enterica enterica serovar Typhi Ty2
caucugaaaugcucaauca

SEQ ID NO: 3716390 - RNA, 14 nt, Salmonella enterica enterica serovar Typhi Ty2
caucugaccgugag

SEQ ID NO: 3716391 - RNA, 16 nt, Salmonella enterica enterica serovar Typhi Ty2
caucugccauuucugc

SEQ ID NO: 3716392 - RNA, 22 nt, Salmonella enterica enterica serovar Typhi Ty2
caucugcggcaugaauugccgu

SEQ ID NO: 3716393 - RNA, 20 nt, Salmonella enterica enterica serovar Typhi Ty2
caucugcguugcgcgcguca

SEQ ID NO: 3716394 - RNA, 23 nt, Salmonella enterica enterica serovar Typhi Ty2
caucugcuccggcguacgggcaa

SEQ ID NO: 3716395 - RNA, 16 nt, Salmonella enterica enterica serovar Typhi Ty2
caucuggcguugccug

SEQ ID NO: 3716396 - RNA, 17 nt, Salmonella enterica enterica serovar Typhi Ty2
caucugggcugagaaaa

SEQ ID NO: 3716397 - RNA, 15 nt, Salmonella enterica enterica serovar Typhi Ty2
caucugggggaagau

SEQ ID NO: 3716398 - RNA, 22 nt, Salmonella enterica enterica serovar Typhi Ty2
caucugguuguuucuuaacccc

SEQ ID NO: 3716399 - RNA, 18 nt, Salmonella enterica enterica serovar Typhi Ty2
caucugugccagcccaau

SEQ ID NO: 3716400 - RNA, 17 nt, Salmonella enterica enterica serovar Typhi Ty2
caucuguggcaauuuuc

SEQ ID NO: 3716401 - RNA, 15 nt, Salmonella enterica enterica serovar Typhi Ty2
caucuguucaacuuu

SEQ ID NO: 3716402 - RNA, 18 nt, Salmonella enterica enterica serovar Typhi Ty2
caucuguucaacuuuucg

SEQ ID NO: 3716403 - RNA, 21 nt, Salmonella enterica enterica serovar Typhi Ty2
caugccauaaucgauauaauu

SEQ ID NO: 3716404 - RNA, 23 nt, Salmonella enterica enterica serovar Typhi Ty2
caugccaucauuaauuuacugau

SEQ ID NO: 3716405 - RNA, 15 nt, Salmonella enterica enterica serovar Typhi Ty2
caugccaucccgcga

SEQ ID NO: 3716406 - RNA, 16 nt, Salmonella enterica enterica serovar Typhi Ty2
caugccaucucuuaau

SEQ ID NO: 3716407 - RNA, 14 nt, Salmonella enterica enterica serovar Typhi Ty2
caugccauugcuuu

SEQ ID NO: 3716408 - RNA, 15 nt, Salmonella enterica enterica serovar Typhi Ty2
caugcccacaggcag

SEQ ID NO: 3716409 - RNA, 18 nt, Salmonella enterica enterica serovar Typhi Ty2
caugcccacaggcagggc

SEQ ID NO: 3716410 - RNA, 20 nt, Salmonella enterica enterica serovar Typhi Ty2
caugcccaguuuacccagcg

SEQ ID NO: 3716411 - RNA, 14 nt, Salmonella enterica enterica serovar Typhi Ty2
caugcccgccagcg

SEQ ID NO: 3716412 - RNA, 21 nt, Salmonella enterica enterica serovar Typhi Ty2
caugcccgucugggagccgcu

SEQ ID NO: 3716413 - RNA, 14 nt, Salmonella enterica enterica serovar Typhi Ty2
caugccgccaaacu

SEQ ID NO: 3716414 - RNA, 15 nt, Salmonella enterica enterica serovar Typhi Ty2
caugccgccacuucg

SEQ ID NO: 3716415 - RNA, 13 nt, Salmonella enterica enterica serovar Typhi Ty2
caugccgccagac

SEQ ID NO: 3716416 - RNA, 15 nt, Salmonella enterica enterica serovar Typhi Ty2
caugccgcugcuggc

SEQ ID NO: 3716417 - RNA, 22 nt, Salmonella enterica enterica serovar Typhi Ty2
caugccggugcgagaaaaagca

SEQ ID NO: 3716418 - RNA, 15 nt, Salmonella enterica enterica serovar Typhi Ty2
caugccguaccguug

SEQ ID NO: 3716419 - RNA, 18 nt, Salmonella enterica enterica serovar Typhi Ty2
caugccguauuuaugcua

SEQ ID NO: 3716420 - RNA, 16 nt, Salmonella enterica enterica serovar Typhi Ty2
caugccugauggcgcu

SEQ ID NO: 3716421 - RNA, 21 nt, Salmonella enterica enterica serovar Typhi Ty2
caugccuuuauuucaagcaau

SEQ ID NO: 3716422 - RNA, 18 nt, Salmonella enterica enterica serovar Typhi Ty2
caugcgaucgggcaaucc

SEQ ID NO: 3716423 - RNA, 22 nt, Salmonella enterica enterica serovar Typhi Ty2
caugcgcgucccggcagugcau

SEQ ID NO: 3716424 - RNA, 13 nt, Salmonella enterica enterica serovar Typhi Ty2
caugcgcuggacu

SEQ ID NO: 3716425 - RNA, 20 nt, Salmonella enterica enterica serovar Typhi Ty2
caugcgcuggacugggucga

SEQ ID NO: 3716426 - RNA, 15 nt, Salmonella enterica enterica serovar Typhi Ty2
caugcgggagcuugg

SEQ ID NO: 3716427 - RNA, 22 nt, Salmonella enterica enterica serovar Typhi Ty2
caugcgggggaaucuuauuuuc

SEQ ID NO: 3716428 - RNA, 23 nt, Salmonella enterica enterica serovar Typhi Ty2
caugcgggggaaucuuauuuucc

SEQ ID NO: 3716429 - RNA, 23 nt, Salmonella enterica enterica serovar Typhi Ty2
caugcguccgcccagaaagauca

SEQ ID NO: 3716430 - RNA, 18 nt, Salmonella enterica enterica serovar Typhi Ty2
caugcgucuucauuuucg

SEQ ID NO: 3716431 - RNA, 17 nt, Salmonella enterica enterica serovar Typhi Ty2
caugcuacaggcaaguu

SEQ ID NO: 3716432 - RNA, 19 nt, Salmonella enterica enterica serovar Typhi Ty2
caugcucauccaacugcgc

SEQ ID NO: 3716433 - RNA, 20 nt, Salmonella enterica enterica serovar Typhi Ty2
caugcucaugcgaucgggca

SEQ ID NO: 3716434 - RNA, 20 nt, Salmonella enterica enterica serovar Typhi Ty2
caugcucauuuugauaaauc

SEQ ID NO: 3716435 - RNA, 12 nt, Salmonella enterica enterica serovar Typhi Ty2
caugcugguugg

SEQ ID NO: 3716436 - RNA, 22 nt, Salmonella enterica enterica serovar Typhi Ty2
caugcuguauaaacucagcaau

SEQ ID NO: 3716437 - RNA, 15 nt, Salmonella enterica enterica serovar Typhi Ty2
caugcuucucaaaga

SEQ ID NO: 3716438 - RNA, 17 nt, Salmonella enterica enterica serovar Typhi Ty2
caugcuugcuuugcggc

SEQ ID NO: 3716439 - RNA, 16 nt, Salmonella enterica enterica serovar Typhi Ty2
caugcuuucaauaaau

SEQ ID NO: 3716440 - RNA, 15 nt, Salmonella enterica enterica serovar Typhi Ty2
cauggagauccagua

SEQ ID NO: 3716441 - RNA, 22 nt, Salmonella enterica enterica serovar Typhi Ty2
cauggcaaaagacauccccgcc

SEQ ID NO: 3716442 - RNA, 20 nt, Salmonella enterica enterica serovar Typhi Ty2
cauggcagauaaaccacgcc

SEQ ID NO: 3716443 - RNA, 15 nt, Salmonella enterica enterica serovar Typhi Ty2
cauggcagccccggc

SEQ ID NO: 3716444 - RNA, 18 nt, Salmonella enterica enterica serovar Typhi Ty2
cauggcaggcagcacaau

SEQ ID NO: 3716445 - RNA, 13 nt, Salmonella enterica enterica serovar Typhi Ty2
cauggcccaaaag

SEQ ID NO: 3716446 - RNA, 21 nt, Salmonella enterica enterica serovar Typhi Ty2
cauggccggucuuaugcugcc

SEQ ID NO: 3716447 - RNA, 19 nt, Salmonella enterica enterica serovar Typhi Ty2
cauggccuucaaucagcac

SEQ ID NO: 3716448 - RNA, 17 nt, Salmonella enterica enterica serovar Typhi Ty2
cauggcgaagugcagcg

SEQ ID NO: 3716449 - RNA, 13 nt, Salmonella enterica enterica serovar Typhi Ty2
cauggcgccacca

SEQ ID NO: 3716450 - RNA, 15 nt, Salmonella enterica enterica serovar Typhi Ty2
cauggcgccaccagc

SEQ ID NO: 3716451 - RNA, 16 nt, Salmonella enterica enterica serovar Typhi Ty2
cauggcggcgacaaug

SEQ ID NO: 3716452 - RNA, 19 nt, Salmonella enterica enterica serovar Typhi Ty2
cauggcggcgacaaugcuc

SEQ ID NO: 3716453 - RNA, 20 nt, Salmonella enterica enterica serovar Typhi Ty2
cauggcgucggcgacuuuca

SEQ ID NO: 3716454 - RNA, 16 nt, Salmonella enterica enterica serovar Typhi Ty2
cauggcguuaaugcgc

SEQ ID NO: 3716455 - RNA, 14 nt, Salmonella enterica enterica serovar Typhi Ty2
caugggaaauaacg

SEQ ID NO: 3716456 - RNA, 17 nt, Salmonella enterica enterica serovar Typhi Ty2
caugggaaauaacguua

SEQ ID NO: 3716457 - RNA, 22 nt, Salmonella enterica enterica serovar Typhi Ty2
caugggacgggucuccaucaga

SEQ ID NO: 3716458 - RNA, 14 nt, Salmonella enterica enterica serovar Typhi Ty2
caugggcaggaaca

SEQ ID NO: 3716459 - RNA, 20 nt, Salmonella enterica enterica serovar Typhi Ty2
caugggcgcggcgaacuggu

SEQ ID NO: 3716460 - RNA, 19 nt, Salmonella enterica enterica serovar Typhi Ty2
caugggcgucuuaaugcuc

SEQ ID NO: 3716461 - RNA, 16 nt, Salmonella enterica enterica serovar Typhi Ty2
cauggguaaagcccau

SEQ ID NO: 3716462 - RNA, 15 nt, Salmonella enterica enterica serovar Typhi Ty2
cauggguuugaccca

SEQ ID NO: 3716463 - RNA, 20 nt, Salmonella enterica enterica serovar Typhi Ty2
caugguaaaauccuuuuuca

SEQ ID NO: 3716464 - RNA, 15 nt, Salmonella enterica enterica serovar Typhi Ty2
caugguacucaacau

SEQ ID NO: 3716465 - RNA, 23 nt, Salmonella enterica enterica serovar Typhi Ty2
cauggucgccguccauuucaaug

SEQ ID NO: 3716466 - RNA, 14 nt, Salmonella enterica enterica serovar Typhi Ty2
caugguguucagau

SEQ ID NO: 3716467 - RNA, 21 nt, Salmonella enterica enterica serovar Typhi Ty2
caugguguucagauggccaau

SEQ ID NO: 3716468 - RNA, 22 nt, Salmonella enterica enterica serovar Typhi Ty2
caugguuaaaaucacuaagacc

SEQ ID NO: 3716469 - RNA, 14 nt, Salmonella enterica enterica serovar Typhi Ty2
caugguuaaccacc

SEQ ID NO: 3716470 - RNA, 16 nt, Salmonella enterica enterica serovar Typhi Ty2
caugguuccgccguua

SEQ ID NO: 3716471 - RNA, 13 nt, Salmonella enterica enterica serovar Typhi Ty2
caugguugaaaaa

SEQ ID NO: 3716472 - RNA, 18 nt, Salmonella enterica enterica serovar Typhi Ty2
caugguugaaaaaagccg

SEQ ID NO: 3716473 - RNA, 19 nt, Salmonella enterica enterica serovar Typhi Ty2
caugguugacuuacaaaaa

SEQ ID NO: 3716474 - RNA, 14 nt, Salmonella enterica enterica serovar Typhi Ty2
cauguaaacuccau

SEQ ID NO: 3716475 - RNA, 19 nt, Salmonella enterica enterica serovar Typhi Ty2
cauguaaacuccauuaaau

SEQ ID NO: 3716476 - RNA, 16 nt, Salmonella enterica enterica serovar Typhi Ty2
cauguaaauaaggcug

SEQ ID NO: 3716477 - RNA, 13 nt, Salmonella enterica enterica serovar Typhi Ty2
cauguaaaugacg

SEQ ID NO: 3716478 - RNA, 21 nt, Salmonella enterica enterica serovar Typhi Ty2
cauguaaaugacgccagacua

SEQ ID NO: 3716479 - RNA, 14 nt, Salmonella enterica enterica serovar Typhi Ty2
cauguaaccaaagc

SEQ ID NO: 3716480 - RNA, 15 nt, Salmonella enterica enterica serovar Typhi Ty2
cauguaccauuguca

SEQ ID NO: 3716481 - RNA, 20 nt, Salmonella enterica enterica serovar Typhi Ty2
cauguacgcaggcgacuggc

SEQ ID NO: 3716482 - RNA, 22 nt, Salmonella enterica enterica serovar Typhi Ty2
caugucagcgcaaagccaauac

SEQ ID NO: 3716483 - RNA, 16 nt, Salmonella enterica enterica serovar Typhi Ty2
cauguccagaucuuca

SEQ ID NO: 3716484 - RNA, 14 nt, Salmonella enterica enterica serovar Typhi Ty2
cauguccccaggug

SEQ ID NO: 3716485 - RNA, 17 nt, Salmonella enterica enterica serovar Typhi Ty2
cauucuaccggcugugg

SEQ ID NO: 3716486 - RNA, 18 nt, Salmonella enterica enterica serovar Typhi Ty2
cauucucugucgccgccc

SEQ ID NO: 3716487 - RNA, 18 nt, Salmonella enterica enterica serovar Typhi Ty2
cauucugacggcccuuuu

SEQ ID NO: 3716488 - RNA, 23 nt, Salmonella enterica enterica serovar Typhi Ty2
cauucugauuuuacuaaugaauu

SEQ ID NO: 3716489 - RNA, 18 nt, Salmonella enterica enterica serovar Typhi Ty2
cauucugcugaugcuggu

SEQ ID NO: 3716490 - RNA, 19 nt, Salmonella enterica enterica serovar Typhi Ty2
cauucugcuuaccagaccg

SEQ ID NO: 3716491 - RNA, 12 nt, Salmonella enterica enterica serovar Typhi Ty2
cauucugucaga

SEQ ID NO: 3716492 - RNA, 22 nt, Salmonella enterica enterica serovar Typhi Ty2
cauucuguuuucgagccuugcc

SEQ ID NO: 3716493 - RNA, 19 nt, Salmonella enterica enterica serovar Typhi Ty2
cauucuuuaaaaugacuca

SEQ ID NO: 3716494 - RNA, 22 nt, Salmonella enterica enterica serovar Typhi Ty2
cauugaccaccauauucgccac

SEQ ID NO: 3716495 - RNA, 14 nt, Salmonella enterica enterica serovar Typhi Ty2
cauugacucaugaa

SEQ ID NO: 3716496 - RNA, 15 nt, Salmonella enterica enterica serovar Typhi Ty2
cauugagcauucuac

SEQ ID NO: 3716497 - RNA, 18 nt, Salmonella enterica enterica serovar Typhi Ty2
cauugagcauucuacagu

SEQ ID NO: 3716498 - RNA, 19 nt, Salmonella enterica enterica serovar Typhi Ty2
cauugaggcuacccagaca

SEQ ID NO: 3716499 - RNA, 21 nt, Salmonella enterica enterica serovar Typhi Ty2
cauugauauagaguccagcca

SEQ ID NO: 3716500 - RNA, 18 nt, Salmonella enterica enterica serovar Typhi Ty2
cauugaucaggcaaaaau

SEQ ID NO: 3716501 - RNA, 17 nt, Salmonella enterica enterica serovar Typhi Ty2
cauugcaauaccggcug

SEQ ID NO: 3716502 - RNA, 23 nt, Salmonella enterica enterica serovar Typhi Ty2
cauugcauagaucuuugggccgg

SEQ ID NO: 3716503 - RNA, 23 nt, Salmonella enterica enterica serovar Typhi Ty2
cauugccaugaugagcgccauau

SEQ ID NO: 3716504 - RNA, 19 nt, Salmonella enterica enterica serovar Typhi Ty2
cauugccauguuaauacca

SEQ ID NO: 3716505 - RNA, 20 nt, Salmonella enterica enterica serovar Typhi Ty2
cauugccauguuaauaccag

SEQ ID NO: 3716506 - RNA, 23 nt, Salmonella enterica enterica serovar Typhi Ty2
cauugccauguuaauaccagcgc

SEQ ID NO: 3716507 - RNA, 18 nt, Salmonella enterica enterica serovar Typhi Ty2
cauugccccagcccugcu

SEQ ID NO: 3716508 - RNA, 15 nt, Salmonella enterica enterica serovar Typhi Ty2
cauugccccucccug

SEQ ID NO: 3716509 - RNA, 19 nt, Salmonella enterica enterica serovar Typhi Ty2
cauugccguuaacugcugc

SEQ ID NO: 3716510 - RNA, 19 nt, Salmonella enterica enterica serovar Typhi Ty2
cauugccuguaucgcuauc

SEQ ID NO: 3716511 - RNA, 17 nt, Salmonella enterica enterica serovar Typhi Ty2
cauugccuuccaggcgg

SEQ ID NO: 3716512 - RNA, 17 nt, Salmonella enterica enterica serovar Typhi Ty2
cauugccuuucgcgcga

SEQ ID NO: 3716513 - RNA, 14 nt, Salmonella enterica enterica serovar Typhi Ty2
cauugcgagaaaaa

SEQ ID NO: 3716514 - RNA, 18 nt, Salmonella enterica enterica serovar Typhi Ty2
cauugcgagaaaaaacuc

SEQ ID NO: 3716515 - RNA, 16 nt, Salmonella enterica enterica serovar Typhi Ty2
cauugcgccccagcac

SEQ ID NO: 3716516 - RNA, 22 nt, Salmonella enterica enterica serovar Typhi Ty2
cauugcgcucuaucgccgcccg

SEQ ID NO: 3716517 - RNA, 21 nt, Salmonella enterica enterica serovar Typhi Ty2
cauugcggaucuucaccacgc

SEQ ID NO: 3716518 - RNA, 13 nt, Salmonella enterica enterica serovar Typhi Ty2
cauugcguauuuc

SEQ ID NO: 3716519 - RNA, 15 nt, Salmonella enterica enterica serovar Typhi Ty2
cauugcuguggaaaa

SEQ ID NO: 3716520 - RNA, 14 nt, Salmonella enterica enterica serovar Typhi Ty2
cauugcuuucuuga

SEQ ID NO: 3716521 - RNA, 19 nt, Salmonella enterica enterica serovar Typhi Ty2
cauuggaaaaccccauccc

SEQ ID NO: 3716522 - RNA, 20 nt, Salmonella enterica enterica serovar Typhi Ty2
cauuggaaaaccccaucccg

SEQ ID NO: 3716523 - RNA, 17 nt, Salmonella enterica enterica serovar Typhi Ty2
cauuggcaaaccccugc

SEQ ID NO: 3716524 - RNA, 13 nt, Salmonella enterica enterica serovar Typhi Ty2
cauuggcaccacc

SEQ ID NO: 3716525 - RNA, 17 nt, Salmonella enterica enterica serovar Typhi Ty2
cauuggcccggcgcgcg

SEQ ID NO: 3716526 - RNA, 22 nt, Salmonella enterica enterica serovar Typhi Ty2
cauuggggggaaauuaaacugc

SEQ ID NO: 3716527 - RNA, 19 nt, Salmonella enterica enterica serovar Typhi Ty2
cauugguggggcuaaguga

SEQ ID NO: 3716528 - RNA, 20 nt, Salmonella enterica enterica serovar Typhi Ty2
cauuguacuuuuaaaucauc

SEQ ID NO: 3716529 - RNA, 19 nt, Salmonella enterica enterica serovar Typhi Ty2
cauuguauuucagggaaaa

SEQ ID NO: 3716530 - RNA, 12 nt, Salmonella enterica enterica serovar Typhi Ty2
cauugucaaaaa

SEQ ID NO: 3716531 - RNA, 19 nt, Salmonella enterica enterica serovar Typhi Ty2
cauuguccuuuaucugccc

SEQ ID NO: 3716532 - RNA, 23 nt, Salmonella enterica enterica serovar Typhi Ty2
cauuguccuuuaucugcccuuuc

SEQ ID NO: 3716533 - RNA, 17 nt, Salmonella enterica enterica serovar Typhi Ty2
cauugucggaacgcugu

SEQ ID NO: 3716534 - RNA, 19 nt, Salmonella enterica enterica serovar Typhi Ty2
cauugucggcgcuaucuau

SEQ ID NO: 3716535 - RNA, 14 nt, Salmonella enterica enterica serovar Typhi Ty2
cauugucuuuuucu

SEQ ID NO: 3716536 - RNA, 20 nt, Salmonella enterica enterica serovar Typhi Ty2
cauugugccugauggcgcua

SEQ ID NO: 3716537 - RNA, 13 nt, Salmonella enterica enterica serovar Typhi Ty2
cauuguuaaucca

SEQ ID NO: 3716538 - RNA, 19 nt, Salmonella enterica enterica serovar Typhi Ty2
cauuguuccugcuggcaaa

SEQ ID NO: 3716539 - RNA, 18 nt, Salmonella enterica enterica serovar Typhi Ty2
cauuguugggguuaucgc

SEQ ID NO: 3716540 - RNA, 15 nt, Salmonella enterica enterica serovar Typhi Ty2
cauuuaagaaacaau

SEQ ID NO: 3716541 - RNA, 16 nt, Salmonella enterica enterica serovar Typhi Ty2
cauuuaagauuuaaaa

SEQ ID NO: 3716542 - RNA, 13 nt, Salmonella enterica enterica serovar Typhi Ty2
cauuuacaauaau

SEQ ID NO: 3716543 - RNA, 15 nt, Salmonella enterica enterica serovar Typhi Ty2
cauuuaccagugcua

SEQ ID NO: 3716544 - RNA, 16 nt, Salmonella enterica enterica serovar Typhi Ty2
cauuuaccuuucccca

SEQ ID NO: 3716545 - RNA, 19 nt, Salmonella enterica enterica serovar Typhi Ty2
cauuuacgccagccagaau

SEQ ID NO: 3716546 - RNA, 12 nt, Salmonella enterica enterica serovar Typhi Ty2
cauuucaagcag

SEQ ID NO: 3716547 - RNA, 13 nt, Salmonella enterica enterica serovar Typhi Ty2
cauuucaaucgcc

SEQ ID NO: 3716548 - RNA, 19 nt, Salmonella enterica enterica serovar Typhi Ty2
cauuucaaucgccaccaca

SEQ ID NO: 3716549 - RNA, 13 nt, Salmonella enterica enterica serovar Typhi Ty2
cauuucaaugcau

SEQ ID NO: 3716550 - RNA, 20 nt, Salmonella enterica enterica serovar Typhi Ty2
cauuucacgauacuguugca

SEQ ID NO: 3716551 - RNA, 16 nt, Salmonella enterica enterica serovar Typhi Ty2
cauuucacuauaaaaa

SEQ ID NO: 3716552 - RNA, 15 nt, Salmonella enterica enterica serovar Typhi Ty2
cauuucacuuguucu

SEQ ID NO: 3716553 - RNA, 16 nt, Salmonella enterica enterica serovar Typhi Ty2
cauuucaggcaaaaaa

SEQ ID NO: 3716554 - RNA, 18 nt, Salmonella enterica enterica serovar Typhi Ty2
cauuucagucuaauuuau

SEQ ID NO: 3716555 - RNA, 12 nt, Salmonella enterica enterica serovar Typhi Ty2
cauuucaugacc

SEQ ID NO: 3716556 - RNA, 14 nt, Salmonella enterica enterica serovar Typhi Ty2
cauuucaugaccga

SEQ ID NO: 3716557 - RNA, 18 nt, Salmonella enterica enterica serovar Typhi Ty2
cauuucccaauaguuuau

SEQ ID NO: 3716558 - RNA, 14 nt, Salmonella enterica enterica serovar Typhi Ty2
cauuuccggcgcgc

SEQ ID NO: 3716559 - RNA, 15 nt, Salmonella enterica enterica serovar Typhi Ty2
cauuuccucugcgga

SEQ ID NO: 3716560 - RNA, 12 nt, Salmonella enterica enterica serovar Typhi Ty2
cauuuccugcau

SEQ ID NO: 3716561 - RNA, 17 nt, Salmonella enterica enterica serovar Typhi Ty2
cauuuccugcauuaacg

SEQ ID NO: 3716562 - RNA, 21 nt, Salmonella enterica enterica serovar Typhi Ty2
cauuucgacgucaacgguaaa

SEQ ID NO: 3716563 - RNA, 15 nt, Salmonella enterica enterica serovar Typhi Ty2
cauuucgaucuguuu

SEQ ID NO: 3716564 - RNA, 14 nt, Salmonella enterica enterica serovar Typhi Ty2
cauuucgccgccau

SEQ ID NO: 3716565 - RNA, 19 nt, Salmonella enterica enterica serovar Typhi Ty2
cauuucgccgccauccggc

SEQ ID NO: 3716566 - RNA, 21 nt, Salmonella enterica enterica serovar Typhi Ty2
cauuucgccgccucguaucug

SEQ ID NO: 3716567 - RNA, 19 nt, Salmonella enterica enterica serovar Typhi Ty2
ccaacacaucgacaugcag

SEQ ID NO: 3716568 - RNA, 16 nt, Salmonella enterica enterica serovar Typhi Ty2
ccaacaccagccgcau

SEQ ID NO: 3716569 - RNA, 15 nt, Salmonella enterica enterica serovar Typhi Ty2
ccaacacggcgcuca

SEQ ID NO: 3716570 - RNA, 18 nt, Salmonella enterica enterica serovar Typhi Ty2
ccaacacggcgcucagga

SEQ ID NO: 3716571 - RNA, 21 nt, Salmonella enterica enterica serovar Typhi Ty2
ccaacagggcggccuccuggc

SEQ ID NO: 3716572 - RNA, 21 nt, Salmonella enterica enterica serovar Typhi Ty2
ccaacagguuaaucagcacau

SEQ ID NO: 3716573 - RNA, 15 nt, Salmonella enterica enterica serovar Typhi Ty2
ccaacagucaugaaa

SEQ ID NO: 3716574 - RNA, 20 nt, Salmonella enterica enterica serovar Typhi Ty2
ccaacauaacgaaauccgcg

SEQ ID NO: 3716575 - RNA, 15 nt, Salmonella enterica enterica serovar Typhi Ty2
ccaacauacaugccu

SEQ ID NO: 3716576 - RNA, 20 nt, Salmonella enterica enterica serovar Typhi Ty2
ccaacauagcggcaaggaaa

SEQ ID NO: 3716577 - RNA, 21 nt, Salmonella enterica enterica serovar Typhi Ty2
ccaacauguaauuacggcaca

SEQ ID NO: 3716578 - RNA, 12 nt, Salmonella enterica enterica serovar Typhi Ty2
ccaaccaaccca

SEQ ID NO: 3716579 - RNA, 14 nt, Salmonella enterica enterica serovar Typhi Ty2
ccaaccgccacaau

SEQ ID NO: 3716580 - RNA, 23 nt, Salmonella enterica enterica serovar Typhi Ty2
ccaaccgcgacggggcgcagaaa

SEQ ID NO: 3716581 - RNA, 20 nt, Salmonella enterica enterica serovar Typhi Ty2
ccaacgaaacucagcggccc

SEQ ID NO: 3716582 - RNA, 21 nt, Salmonella enterica enterica serovar Typhi Ty2
ccaacgagaauaagaccaaua

SEQ ID NO: 3716583 - RNA, 13 nt, Salmonella enterica enterica serovar Typhi Ty2
ccaacgcaaugcg

SEQ ID NO: 3716584 - RNA, 18 nt, Salmonella enterica enterica serovar Typhi Ty2
ccaacgcaaugcgauaag

SEQ ID NO: 3716585 - RNA, 14 nt, Salmonella enterica enterica serovar Typhi Ty2
ccaacgccaacaua

SEQ ID NO: 3716586 - RNA, 15 nt, Salmonella enterica enterica serovar Typhi Ty2
ccaacgccagcagcg

SEQ ID NO: 3716587 - RNA, 15 nt, Salmonella enterica enterica serovar Typhi Ty2
ccaacgccggcaaca

SEQ ID NO: 3716588 - RNA, 14 nt, Salmonella enterica enterica serovar Typhi Ty2
ccaacguauaaaau

SEQ ID NO: 3716589 - RNA, 15 nt, Salmonella enterica enterica serovar Typhi Ty2
ccaacgucagcaucu

SEQ ID NO: 3716590 - RNA, 16 nt, Salmonella enterica enterica serovar Typhi Ty2
ccaacugccaaaccac

SEQ ID NO: 3716591 - RNA, 16 nt, Salmonella enterica enterica serovar Typhi Ty2
ccaacugcgccugaag

SEQ ID NO: 3716592 - RNA, 17 nt, Salmonella enterica enterica serovar Typhi Ty2
ccaacugcgccugaaga

SEQ ID NO: 3716593 - RNA, 18 nt, Salmonella enterica enterica serovar Typhi Ty2
ccaagaccgccuaacagc

SEQ ID NO: 3716594 - RNA, 14 nt, Salmonella enterica enterica serovar Typhi Ty2
ccaagauccagcgg

SEQ ID NO: 3716595 - RNA, 13 nt, Salmonella enterica enterica serovar Typhi Ty2
ccaagcagcgcca

SEQ ID NO: 3716596 - RNA, 14 nt, Salmonella enterica enterica serovar Typhi Ty2
ccaagcagcgccac

SEQ ID NO: 3716597 - RNA, 22 nt, Salmonella enterica enterica serovar Typhi Ty2
ccaagcggcaacucugugcguu

SEQ ID NO: 3716598 - RNA, 18 nt, Salmonella enterica enterica serovar Typhi Ty2
ccaaguaauaaagagaac

SEQ ID NO: 3716599 - RNA, 17 nt, Salmonella enterica enterica serovar Typhi Ty2
ccaagucuccgcccagc

SEQ ID NO: 3716600 - RNA, 18 nt, Salmonella enterica enterica serovar Typhi Ty2
ccaauaaaaacugcuaaa

SEQ ID NO: 3716601 - RNA, 17 nt, Salmonella enterica enterica serovar Typhi Ty2
ccaauaacguaaccgcu

SEQ ID NO: 3716602 - RNA, 19 nt, Salmonella enterica enterica serovar Typhi Ty2
ccaauaaugccgccgucgc

SEQ ID NO: 3716603 - RNA, 13 nt, Salmonella enterica enterica serovar Typhi Ty2
ccaauaauuuuag

SEQ ID NO: 3716604 - RNA, 17 nt, Salmonella enterica enterica serovar Typhi Ty2
ccaauaccacaaccgga

SEQ ID NO: 3716605 - RNA, 12 nt, Salmonella enterica enterica serovar Typhi Ty2
ccaauacccagc

SEQ ID NO: 3716606 - RNA, 16 nt, Salmonella enterica enterica serovar Typhi Ty2
ccaauacccagcgcca

SEQ ID NO: 3716607 - RNA, 17 nt, Salmonella enterica enterica serovar Typhi Ty2
ccaauacccagcgccaa

SEQ ID NO: 3716608 - RNA, 15 nt, Salmonella enterica enterica serovar Typhi Ty2
ccaauaccggcguaa

SEQ ID NO: 3716609 - RNA, 23 nt, Salmonella enterica enterica serovar Typhi Ty2
ccaauaccggcguaauugcgccu

SEQ ID NO: 3716610 - RNA, 17 nt, Salmonella enterica enterica serovar Typhi Ty2
ccaaucaacgccgccag

SEQ ID NO: 3716611 - RNA, 21 nt, Salmonella enterica enterica serovar Typhi Ty2
ccaaucaacgccgccaggaua

SEQ ID NO: 3716612 - RNA, 13 nt, Salmonella enterica enterica serovar Typhi Ty2
ccaaucagcccca

SEQ ID NO: 3716613 - RNA, 16 nt, Salmonella enterica enterica serovar Typhi Ty2
ccaauccugcacccgc

SEQ ID NO: 3716614 - RNA, 17 nt, Salmonella enterica enterica serovar Typhi Ty2
ccaaucgccgccgcgug

SEQ ID NO: 3716615 - RNA, 15 nt, Salmonella enterica enterica serovar Typhi Ty2
ccaaugacaauaauc

SEQ ID NO: 3716616 - RNA, 17 nt, Salmonella enterica enterica serovar Typhi Ty2
ccaaugacgcuauccgc

SEQ ID NO: 3716617 - RNA, 12 nt, Salmonella enterica enterica serovar Typhi Ty2
ccaaugagcugc

SEQ ID NO: 3716618 - RNA, 15 nt, Salmonella enterica enterica serovar Typhi Ty2
ccaaugcaacgccuu

SEQ ID NO: 3716619 - RNA, 16 nt, Salmonella enterica enterica serovar Typhi Ty2
ccaaugccaaaaaaac

SEQ ID NO: 3716620 - RNA, 14 nt, Salmonella enterica enterica serovar Typhi Ty2
ccaaugcgaaaaua

SEQ ID NO: 3716621 - RNA, 18 nt, Salmonella enterica enterica serovar Typhi Ty2
ccaauguacguaaaacca

SEQ ID NO: 3716622 - RNA, 20 nt, Salmonella enterica enterica serovar Typhi Ty2
ccaauucguguuuuugaaca

SEQ ID NO: 3716623 - RNA, 17 nt, Salmonella enterica enterica serovar Typhi Ty2
ccacaaaaccguugucg

SEQ ID NO: 3716624 - RNA, 18 nt, Salmonella enterica enterica serovar Typhi Ty2
ccacaaacuccagacgau

SEQ ID NO: 3716625 - RNA, 13 nt, Salmonella enterica enterica serovar Typhi Ty2
ccacaaaggcgcg

SEQ ID NO: 3716626 - RNA, 16 nt, Salmonella enterica enterica serovar Typhi Ty2
ccacaaauucugaaga

SEQ ID NO: 3716627 - RNA, 12 nt, Salmonella enterica enterica serovar Typhi Ty2
ccacaaccggcu

SEQ ID NO: 3716628 - RNA, 17 nt, Salmonella enterica enterica serovar Typhi Ty2
ccacaacgccugaugcu

SEQ ID NO: 3716629 - RNA, 23 nt, Salmonella enterica enterica serovar Typhi Ty2
ccacaacgccugaugcugcgcau

SEQ ID NO: 3716630 - RNA, 18 nt, Salmonella enterica enterica serovar Typhi Ty2
ccacaacggcaauuuuua

SEQ ID NO: 3716631 - RNA, 19 nt, Salmonella enterica enterica serovar Typhi Ty2
ccacaagaaaugcaggcgu

SEQ ID NO: 3716632 - RNA, 22 nt, Salmonella enterica enterica serovar Typhi Ty2
ccacaagagcagcaacccugcc

SEQ ID NO: 3716633 - RNA, 18 nt, Salmonella enterica enterica serovar Typhi Ty2
ccacaauugccagcaggu

SEQ ID NO: 3716634 - RNA, 14 nt, Salmonella enterica enterica serovar Typhi Ty2
ccacaauuguagcu

SEQ ID NO: 3716635 - RNA, 20 nt, Salmonella enterica enterica serovar Typhi Ty2
ccacaauuguagcugcgcca

SEQ ID NO: 3716636 - RNA, 14 nt, Salmonella enterica enterica serovar Typhi Ty2
ccacacaugcaaaa

SEQ ID NO: 3716637 - RNA, 15 nt, Salmonella enterica enterica serovar Typhi Ty2
ccacacaugcaaaaa

SEQ ID NO: 3716638 - RNA, 20 nt, Salmonella enterica enterica serovar Typhi Ty2
ccacacaugcaaaaaagccc

SEQ ID NO: 3716639 - RNA, 17 nt, Salmonella enterica enterica serovar Typhi Ty2
ccacacccauagcagcu

SEQ ID NO: 3716640 - RNA, 14 nt, Salmonella enterica enterica serovar Typhi Ty2
ccacaccggcgcau

SEQ ID NO: 3716641 - RNA, 21 nt, Salmonella enterica enterica serovar Typhi Ty2
ccacaccugaugguuauuuuc

SEQ ID NO: 3716642 - RNA, 13 nt, Salmonella enterica enterica serovar Typhi Ty2
ccacacugcaucg

SEQ ID NO: 3716643 - RNA, 19 nt, Salmonella enterica enterica serovar Typhi Ty2
ccacagaucuaucugaaca

SEQ ID NO: 3716644 - RNA, 22 nt, Salmonella enterica enterica serovar Typhi Ty2
ccacagcauaccgugugcagug

SEQ ID NO: 3716645 - RNA, 17 nt, Salmonella enterica enterica serovar Typhi Ty2
ccacagccgcauuuuuu

SEQ ID NO: 3716646 - RNA, 20 nt, Salmonella enterica enterica serovar Typhi Ty2
ccacagccgcauuuuuucuu

SEQ ID NO: 3716647 - RNA, 20 nt, Salmonella enterica enterica serovar Typhi Ty2
ccacagcgaauuccggccau

SEQ ID NO: 3716648 - RNA, 11 nt, Salmonella enterica enterica serovar Typhi Ty2
ccacagcgcca

SEQ ID NO: 3716649 - RNA, 17 nt, Salmonella enterica enterica serovar Typhi Ty2
ccacgaucugauucaau

SEQ ID NO: 3716650 - RNA, 21 nt, Salmonella enterica enterica serovar Typhi Ty2
ccacgauguaugccgaccgug

SEQ ID NO: 3716651 - RNA, 14 nt, Salmonella enterica enterica serovar Typhi Ty2
ccacgcaaaccgcu

SEQ ID NO: 3716652 - RNA, 11 nt, Salmonella enterica enterica serovar Typhi Ty2
ccacgcagccg

SEQ ID NO: 3716653 - RNA, 15 nt, Salmonella enterica enterica serovar Typhi Ty2
ccacgcagcgcagac

SEQ ID NO: 3716654 - RNA, 16 nt, Salmonella enterica enterica serovar Typhi Ty2
ccacgcagcggcauug

SEQ ID NO: 3716655 - RNA, 22 nt, Salmonella enterica enterica serovar Typhi Ty2
ccacgccaacguccgccgucag

SEQ ID NO: 3716656 - RNA, 21 nt, Salmonella enterica enterica serovar Typhi Ty2
ccacgccaauacgggagagcg

SEQ ID NO: 3716657 - RNA, 11 nt, Salmonella enterica enterica serovar Typhi Ty2
ccacgccaccg

SEQ ID NO: 3716658 - RNA, 18 nt, Salmonella enterica enterica serovar Typhi Ty2
ccacgccaccgccgccac

SEQ ID NO: 3716659 - RNA, 15 nt, Salmonella enterica enterica serovar Typhi Ty2
ccacgccaccgggcc

SEQ ID NO: 3716660 - RNA, 13 nt, Salmonella enterica enterica serovar Typhi Ty2
ccacgccaucauu

SEQ ID NO: 3716661 - RNA, 17 nt, Salmonella enterica enterica serovar Typhi Ty2
ccacgccaucgcggcgc

SEQ ID NO: 3716662 - RNA, 17 nt, Salmonella enterica enterica serovar Typhi Ty2
ccacgccauggccgcag

SEQ ID NO: 3716663 - RNA, 18 nt, Salmonella enterica enterica serovar Typhi Ty2
ccacgccauggccgcagc

SEQ ID NO: 3716664 - RNA, 15 nt, Salmonella enterica enterica serovar Typhi Ty2
ccacgcccagcgccg

SEQ ID NO: 3716665 - RNA, 18 nt, Salmonella enterica enterica serovar Typhi Ty2
ccacgccccuaaggcagc

SEQ ID NO: 3716666 - RNA, 13 nt, Salmonella enterica enterica serovar Typhi Ty2
ccacgcccgccgc

SEQ ID NO: 3716667 - RNA, 14 nt, Salmonella enterica enterica serovar Typhi Ty2
ccacgcccuucacg

SEQ ID NO: 3716668 - RNA, 16 nt, Salmonella enterica enterica serovar Typhi Ty2
ccacgccgaguaauuu

SEQ ID NO: 3716669 - RNA, 20 nt, Salmonella enterica enterica serovar Typhi Ty2
ccacgccgcaaggacgccag

SEQ ID NO: 3716670 - RNA, 12 nt, Salmonella enterica enterica serovar Typhi Ty2
ccacgccgccau

SEQ ID NO: 3716671 - RNA, 23 nt, Salmonella enterica enterica serovar Typhi Ty2
ccacgccggaaucgcgauccagc

SEQ ID NO: 3716672 - RNA, 14 nt, Salmonella enterica enterica serovar Typhi Ty2
ccacgccguagcug

SEQ ID NO: 3716673 - RNA, 14 nt, Salmonella enterica enterica serovar Typhi Ty2
ccacgccguccgga

SEQ ID NO: 3716674 - RNA, 16 nt, Salmonella enterica enterica serovar Typhi Ty2
ccacgcgagcugccag

SEQ ID NO: 3716675 - RNA, 18 nt, Salmonella enterica enterica serovar Typhi Ty2
ccacgcgaugcaaccccu

SEQ ID NO: 3716676 - RNA, 15 nt, Salmonella enterica enterica serovar Typhi Ty2
ccacgcgcaccaugu

SEQ ID NO: 3716677 - RNA, 17 nt, Salmonella enterica enterica serovar Typhi Ty2
ccacgcgcggcaucauu

SEQ ID NO: 3716678 - RNA, 19 nt, Salmonella enterica enterica serovar Typhi Ty2
ccacgcggcgugcgcugca

SEQ ID NO: 3716679 - RNA, 23 nt, Salmonella enterica enterica serovar Typhi Ty2
ccacgcgggcgguauuauccgcc

SEQ ID NO: 3716680 - RNA, 14 nt, Salmonella enterica enterica serovar Typhi Ty2
ccacgcugccgccg

SEQ ID NO: 3716681 - RNA, 15 nt, Salmonella enterica enterica serovar Typhi Ty2
ccacgcugccgccgc

SEQ ID NO: 3716682 - RNA, 14 nt, Salmonella enterica enterica serovar Typhi Ty2
ccacgcuuuuuuau

SEQ ID NO: 3716683 - RNA, 17 nt, Salmonella enterica enterica serovar Typhi Ty2
ccacggaugaucuucau

SEQ ID NO: 3716684 - RNA, 19 nt, Salmonella enterica enterica serovar Typhi Ty2
ccacggauggccucugcca

SEQ ID NO: 3716685 - RNA, 21 nt, Salmonella enterica enterica serovar Typhi Ty2
ccacggccaacgcgcccucug

SEQ ID NO: 3716686 - RNA, 12 nt, Salmonella enterica enterica serovar Typhi Ty2
ccacggccagca

SEQ ID NO: 3716687 - RNA, 15 nt, Salmonella enterica enterica serovar Typhi Ty2
ccacggccagcagcc

SEQ ID NO: 3716688 - RNA, 23 nt, Salmonella enterica enterica serovar Typhi Ty2
ccacggcguagcgagaaggcuuu

SEQ ID NO: 3716689 - RNA, 20 nt, Salmonella enterica enterica serovar Typhi Ty2
ccacggcguguugaaauccu

SEQ ID NO: 3716690 - RNA, 18 nt, Salmonella enterica enterica serovar Typhi Ty2
ccacggcuucagcggcgc

SEQ ID NO: 3716691 - RNA, 16 nt, Salmonella enterica enterica serovar Typhi Ty2
ccacgguguaccccgc

SEQ ID NO: 3716692 - RNA, 18 nt, Salmonella enterica enterica serovar Typhi Ty2
ccacgguuaucuggcgca

SEQ ID NO: 3716693 - RNA, 18 nt, Salmonella enterica enterica serovar Typhi Ty2
ccacgguucucaccgugg

SEQ ID NO: 3716694 - RNA, 16 nt, Salmonella enterica enterica serovar Typhi Ty2
ccacguaacucggcag

SEQ ID NO: 3716695 - RNA, 17 nt, Salmonella enterica enterica serovar Typhi Ty2
ccacguaacucggcagc

SEQ ID NO: 3716696 - RNA, 16 nt, Salmonella enterica enterica serovar Typhi Ty2
ccacguagcugcggua

SEQ ID NO: 3716697 - RNA, 18 nt, Salmonella enterica enterica serovar Typhi Ty2
ccacgugcggacguagcg

SEQ ID NO: 3716698 - RNA, 14 nt, Salmonella enterica enterica serovar Typhi Ty2
ccacguucuuccag

SEQ ID NO: 3716699 - RNA, 24 nt, Salmonella enterica enterica serovar Typhi Ty2
ccacguuuuccugcgcuugcaugg

SEQ ID NO: 3716700 - RNA, 14 nt, Salmonella enterica enterica serovar Typhi Ty2
ccacuaacccggcg

SEQ ID NO: 3716701 - RNA, 18 nt, Salmonella enterica enterica serovar Typhi Ty2
ccacuacgcagcuccagc

SEQ ID NO: 3716702 - RNA, 18 nt, Salmonella enterica enterica serovar Typhi Ty2
ccacucacgcucgcggaa

SEQ ID NO: 3716703 - RNA, 16 nt, Salmonella enterica enterica serovar Typhi Ty2
ccacuccaucgccuga

SEQ ID NO: 3716704 - RNA, 18 nt, Salmonella enterica enterica serovar Typhi Ty2
ccacuccguguugcugcc

SEQ ID NO: 3716705 - RNA, 22 nt, Salmonella enterica enterica serovar Typhi Ty2
ccacuccuuacgguaaagcgua

SEQ ID NO: 3716706 - RNA, 22 nt, Salmonella enterica enterica serovar Typhi Ty2
ccacucggcgagcaguacgccu

SEQ ID NO: 3716707 - RNA, 14 nt, Salmonella enterica enterica serovar Typhi Ty2
ccacucuuccagca

SEQ ID NO: 3716708 - RNA, 14 nt, Salmonella enterica enterica serovar Typhi Ty2
ccacucuuucagca

SEQ ID NO: 3716709 - RNA, 20 nt, Salmonella enterica enterica serovar Typhi Ty2
ccacugagcuucaccgccag

SEQ ID NO: 3716710 - RNA, 22 nt, Salmonella enterica enterica serovar Typhi Ty2
ccacugauaguccaucaccucu

SEQ ID NO: 3716711 - RNA, 22 nt, Salmonella enterica enterica serovar Typhi Ty2
ccacugauggaguuucaucagc

SEQ ID NO: 3716712 - RNA, 14 nt, Salmonella enterica enterica serovar Typhi Ty2
ccacugcacauccc

SEQ ID NO: 3716713 - RNA, 19 nt, Salmonella enterica enterica serovar Typhi Ty2
ccacugcacgccaggguaa

SEQ ID NO: 3716714 - RNA, 12 nt, Salmonella enterica enterica serovar Typhi Ty2
ccacugcccgcc

SEQ ID NO: 3716715 - RNA, 13 nt, Salmonella enterica enterica serovar Typhi Ty2
ccacuggcccccu

SEQ ID NO: 3716716 - RNA, 18 nt, Salmonella enterica enterica serovar Typhi Ty2
ccacuggcccccuguucc

SEQ ID NO: 3716717 - RNA, 19 nt, Salmonella enterica enterica serovar Typhi Ty2
ccacuggcuuuccugauca

SEQ ID NO: 3716718 - RNA, 15 nt, Salmonella enterica enterica serovar Typhi Ty2
ccacuggguuuccca

SEQ ID NO: 3716719 - RNA, 16 nt, Salmonella enterica enterica serovar Typhi Ty2
ccacuguucguccaua

SEQ ID NO: 3716720 - RNA, 17 nt, Salmonella enterica enterica serovar Typhi Ty2
ccacuuacggacaaaau

SEQ ID NO: 3716721 - RNA, 14 nt, Salmonella enterica enterica serovar Typhi Ty2
ccacuuaggcagcc

SEQ ID NO: 3716722 - RNA, 19 nt, Salmonella enterica enterica serovar Typhi Ty2
ccacuuauuuguauugacg

SEQ ID NO: 3716723 - RNA, 21 nt, Salmonella enterica enterica serovar Typhi Ty2
ccacuucaacgccgcgcuucu

SEQ ID NO: 3716724 - RNA, 19 nt, Salmonella enterica enterica serovar Typhi Ty2
ccacuuccagcgcgccguc

SEQ ID NO: 3716725 - RNA, 18 nt, Salmonella enterica enterica serovar Typhi Ty2
ccacuucugacagaauau

SEQ ID NO: 3716726 - RNA, 16 nt, Salmonella enterica enterica serovar Typhi Ty2
ccacuucuuccagcgu

SEQ ID NO: 3716727 - RNA, 14 nt, Salmonella enterica enterica serovar Typhi Ty2
ccacuuucagcucc

SEQ ID NO: 3716728 - RNA, 21 nt, Salmonella enterica enterica serovar Typhi Ty2
ccacuuucucggcuuuccagc

SEQ ID NO: 3716729 - RNA, 12 nt, Salmonella enterica enterica serovar Typhi Ty2
ccacuuugcgcu

SEQ ID NO: 3716730 - RNA, 15 nt, Salmonella enterica enterica serovar Typhi Ty2
ccacuuugggccgaa

SEQ ID NO: 3716731 - RNA, 19 nt, Salmonella enterica enterica serovar Typhi Ty2
ccagaucggcaugauggcg

SEQ ID NO: 3716732 - RNA, 17 nt, Salmonella enterica enterica serovar Typhi Ty2
ccagaucgucacgacgg

SEQ ID NO: 3716733 - RNA, 22 nt, Salmonella enterica enterica serovar Typhi Ty2
ccagaugcagcggcaguuccgg

SEQ ID NO: 3716734 - RNA, 16 nt, Salmonella enterica enterica serovar Typhi Ty2
ccagaugcgccaguac

SEQ ID NO: 3716735 - RNA, 18 nt, Salmonella enterica enterica serovar Typhi Ty2
ccagaugcgccaguacgu

SEQ ID NO: 3716736 - RNA, 18 nt, Salmonella enterica enterica serovar Typhi Ty2
ccagauggauaaccugcc

SEQ ID NO: 3716737 - RNA, 22 nt, Salmonella enterica enterica serovar Typhi Ty2
ccagauggcaagauuaaccagc

SEQ ID NO: 3716738 - RNA, 21 nt, Salmonella enterica enterica serovar Typhi Ty2
ccagauggcuaugaagcugga

SEQ ID NO: 3716739 - RNA, 18 nt, Salmonella enterica enterica serovar Typhi Ty2
ccagauggcugcacccgg

SEQ ID NO: 3716740 - RNA, 21 nt, Salmonella enterica enterica serovar Typhi Ty2
ccagauggcugcacccggaga

SEQ ID NO: 3716741 - RNA, 17 nt, Salmonella enterica enterica serovar Typhi Ty2
ccagauggggcuuccau

SEQ ID NO: 3716742 - RNA, 12 nt, Salmonella enterica enterica serovar Typhi Ty2
ccagaugguaag

SEQ ID NO: 3716743 - RNA, 18 nt, Salmonella enterica enterica serovar Typhi Ty2
ccagaugucgcggauaug

SEQ ID NO: 3716744 - RNA, 19 nt, Salmonella enterica enterica serovar Typhi Ty2
ccagauguugauacagaaa

SEQ ID NO: 3716745 - RNA, 13 nt, Salmonella enterica enterica serovar Typhi Ty2
ccagauuacgcau

SEQ ID NO: 3716746 - RNA, 17 nt, Salmonella enterica enterica serovar Typhi Ty2
ccagauuacugcccuga

SEQ ID NO: 3716747 - RNA, 17 nt, Salmonella enterica enterica serovar Typhi Ty2
ccagauuaucggccagc

SEQ ID NO: 3716748 - RNA, 14 nt, Salmonella enterica enterica serovar Typhi Ty2
ccagauucuuaguc

SEQ ID NO: 3716749 - RNA, 22 nt, Salmonella enterica enterica serovar Typhi Ty2
ccagauugucgcaaaccaccgg

SEQ ID NO: 3716750 - RNA, 20 nt, Salmonella enterica enterica serovar Typhi Ty2
ccagauuuuccaggccgcca

SEQ ID NO: 3716751 - RNA, 11 nt, Salmonella enterica enterica serovar Typhi Ty2
ccagcaaaauc

SEQ ID NO: 3716752 - RNA, 14 nt, Salmonella enterica enterica serovar Typhi Ty2
ccagcaaaaucacc

SEQ ID NO: 3716753 - RNA, 11 nt, Salmonella enterica enterica serovar Typhi Ty2
ccagcaaaauu

SEQ ID NO: 3716754 - RNA, 18 nt, Salmonella enterica enterica serovar Typhi Ty2
ccagcaaaccuuccgcca

SEQ ID NO: 3716755 - RNA, 20 nt, Salmonella enterica enterica serovar Typhi Ty2
ccagcaacacuuugcgcugc

SEQ ID NO: 3716756 - RNA, 21 nt, Salmonella enterica enterica serovar Typhi Ty2
ccagcaacagguaccccgcca

SEQ ID NO: 3716757 - RNA, 20 nt, Salmonella enterica enterica serovar Typhi Ty2
ccagcaacgagcuuuuuucu

SEQ ID NO: 3716758 - RNA, 19 nt, Salmonella enterica enterica serovar Typhi Ty2
ccagcaacgcgcuaaaugc

SEQ ID NO: 3716759 - RNA, 22 nt, Salmonella enterica enterica serovar Typhi Ty2
ccagcaacguauuccacggaau

SEQ ID NO: 3716760 - RNA, 17 nt, Salmonella enterica enterica serovar Typhi Ty2
ccagcaaggagacgccc

SEQ ID NO: 3716761 - RNA, 23 nt, Salmonella enterica enterica serovar Typhi Ty2
ccagcaaggagacgcccgucacc

SEQ ID NO: 3716762 - RNA, 18 nt, Salmonella enterica enterica serovar Typhi Ty2
ccagcaaggcugccgcca

SEQ ID NO: 3716763 - RNA, 19 nt, Salmonella enterica enterica serovar Typhi Ty2
ccagcaaggcugccgccag

SEQ ID NO: 3716764 - RNA, 21 nt, Salmonella enterica enterica serovar Typhi Ty2
ccagcaauaacaccggcggcg

SEQ ID NO: 3716765 - RNA, 15 nt, Salmonella enterica enterica serovar Typhi Ty2
ccagcaauacccaga

SEQ ID NO: 3716766 - RNA, 18 nt, Salmonella enterica enterica serovar Typhi Ty2
ccagcaaugagccgucgc

SEQ ID NO: 3716767 - RNA, 18 nt, Salmonella enterica enterica serovar Typhi Ty2
ccagcaaugccgccgcca

SEQ ID NO: 3716768 - RNA, 18 nt, Salmonella enterica enterica serovar Typhi Ty2
ccagcacacgcaucccgc

SEQ ID NO: 3716769 - RNA, 17 nt, Salmonella enterica enterica serovar Typhi Ty2
ccagcacagcccaguaa

SEQ ID NO: 3716770 - RNA, 19 nt, Salmonella enterica enterica serovar Typhi Ty2
ccagcacagguacaggccg

SEQ ID NO: 3716771 - RNA, 21 nt, Salmonella enterica enterica serovar Typhi Ty2
ccagcacagguacaggccgcc

SEQ ID NO: 3716772 - RNA, 12 nt, Salmonella enterica enterica serovar Typhi Ty2
ccagcacauuac

SEQ ID NO: 3716773 - RNA, 24 nt, Salmonella enterica enterica serovar Typhi Ty2
ccagcacauuacaggcaucuucca

SEQ ID NO: 3716774 - RNA, 16 nt, Salmonella enterica enterica serovar Typhi Ty2
ccagcaccaacgccgc

SEQ ID NO: 3716775 - RNA, 12 nt, Salmonella enterica enterica serovar Typhi Ty2
ccagcaccagca

SEQ ID NO: 3716776 - RNA, 16 nt, Salmonella enterica enterica serovar Typhi Ty2
ccagcaccagcagcgc

SEQ ID NO: 3716777 - RNA, 14 nt, Salmonella enterica enterica serovar Typhi Ty2
ccagcaccagcagu

SEQ ID NO: 3716778 - RNA, 15 nt, Salmonella enterica enterica serovar Typhi Ty2
ccagcaccagcagug

SEQ ID NO: 3716779 - RNA, 16 nt, Salmonella enterica enterica serovar Typhi Ty2
ccagcaccagcauuag

SEQ ID NO: 3716780 - RNA, 15 nt, Salmonella enterica enterica serovar Typhi Ty2
ccagcaccaucuuuu

SEQ ID NO: 3716781 - RNA, 22 nt, Salmonella enterica enterica serovar Typhi Ty2
ccagcaccaucuuuuccggcag

SEQ ID NO: 3716782 - RNA, 21 nt, Salmonella enterica enterica serovar Typhi Ty2
ccagcaccucaucacccaguc

SEQ ID NO: 3716783 - RNA, 13 nt, Salmonella enterica enterica serovar Typhi Ty2
ccagcaccugcuu

SEQ ID NO: 3716784 - RNA, 23 nt, Salmonella enterica enterica serovar Typhi Ty2
ccagcacgcccauauccagcucg

SEQ ID NO: 3716785 - RNA, 18 nt, Salmonella enterica enterica serovar Typhi Ty2
ccagcacggccuugaagu

SEQ ID NO: 3716786 - RNA, 16 nt, Salmonella enterica enterica serovar Typhi Ty2
ccagcacuaacagcag

SEQ ID NO: 3716787 - RNA, 17 nt, Salmonella enterica enterica serovar Typhi Ty2
ccagcacuaacagcagc

SEQ ID NO: 3716788 - RNA, 20 nt, Salmonella enterica enterica serovar Typhi Ty2
ccagcacuaacagcagcagc

SEQ ID NO: 3716789 - RNA, 19 nt, Salmonella enterica enterica serovar Typhi Ty2
ccagcagacucauggacaa

SEQ ID NO: 3716790 - RNA, 21 nt, Salmonella enterica enterica serovar Typhi Ty2
ccagcagaugcaguucacccu

SEQ ID NO: 3716791 - RNA, 22 nt, Salmonella enterica enterica serovar Typhi Ty2
ccagcagauuagcgaagaaguc

SEQ ID NO: 3716792 - RNA, 15 nt, Salmonella enterica enterica serovar Typhi Ty2
ccagcagcacuuccg

SEQ ID NO: 3716793 - RNA, 13 nt, Salmonella enterica enterica serovar Typhi Ty2
ccagcagcagcac

SEQ ID NO: 3716794 - RNA, 14 nt, Salmonella enterica enterica serovar Typhi Ty2
ccagcagcagcgca

SEQ ID NO: 3716795 - RNA, 23 nt, Salmonella enterica enterica serovar Typhi Ty2
ccagcagcauaaaaccgccgccc

SEQ ID NO: 3716796 - RNA, 12 nt, Salmonella enterica enterica serovar Typhi Ty2
ccagcagccaca

SEQ ID NO: 3716797 - RNA, 14 nt, Salmonella enterica enterica serovar Typhi Ty2
ccagcagccagccg

SEQ ID NO: 3716798 - RNA, 20 nt, Salmonella enterica enterica serovar Typhi Ty2
ccagcagccagccguugugc

SEQ ID NO: 3716799 - RNA, 21 nt, Salmonella enterica enterica serovar Typhi Ty2
ccagcagccaugccagcgcgg

SEQ ID NO: 3716800 - RNA, 13 nt, Salmonella enterica enterica serovar Typhi Ty2
ccagcagcgccag

SEQ ID NO: 3716801 - RNA, 19 nt, Salmonella enterica enterica serovar Typhi Ty2
ccagcagcguuuugcgcgu

SEQ ID NO: 3716802 - RNA, 16 nt, Salmonella enterica enterica serovar Typhi Ty2
ccagcagguaucccaa

SEQ ID NO: 3716803 - RNA, 21 nt, Salmonella enterica enterica serovar Typhi Ty2
ccagcaggucgcacuccucug

SEQ ID NO: 3716804 - RNA, 21 nt, Salmonella enterica enterica serovar Typhi Ty2
ccagcagguggaucugaaucu

SEQ ID NO: 3716805 - RNA, 18 nt, Salmonella enterica enterica serovar Typhi Ty2
ccagcaguugcagcguac

SEQ ID NO: 3716806 - RNA, 15 nt, Salmonella enterica enterica serovar Typhi Ty2
ccagcaguugccaua

SEQ ID NO: 3716807 - RNA, 17 nt, Salmonella enterica enterica serovar Typhi Ty2
ccagcaguugccauagc

SEQ ID NO: 3716808 - RNA, 14 nt, Salmonella enterica enterica serovar Typhi Ty2
ccagcauaaugagc

SEQ ID NO: 3716809 - RNA, 14 nt, Salmonella enterica enterica serovar Typhi Ty2
ccagcauaccgccc

SEQ ID NO: 3716810 - RNA, 23 nt, Salmonella enterica enterica serovar Typhi Ty2
ccagcauagucgcuccccauaaa

SEQ ID NO: 3716811 - RNA, 15 nt, Salmonella enterica enterica serovar Typhi Ty2
ccagcauauaaauac

SEQ ID NO: 3716812 - RNA, 18 nt, Salmonella enterica enterica serovar Typhi Ty2
ccagcaucaauagcagcu

SEQ ID NO: 3716813 - RNA, 16 nt, Salmonella enterica enterica serovar Typhi Ty2
ccagcgccaacgccac

SEQ ID NO: 3716814 - RNA, 18 nt, Salmonella enterica enterica serovar Typhi Ty2
ccagcgccaccaaagcca

SEQ ID NO: 3716815 - RNA, 12 nt, Salmonella enterica enterica serovar Typhi Ty2
ccagcgccagaa

SEQ ID NO: 3716816 - RNA, 13 nt, Salmonella enterica enterica serovar Typhi Ty2
ccagcgccagccg

SEQ ID NO: 3716817 - RNA, 14 nt, Salmonella enterica enterica serovar Typhi Ty2
ccagcgccagcgcc

SEQ ID NO: 3716818 - RNA, 14 nt, Salmonella enterica enterica serovar Typhi Ty2
ccagcgccaggcca

SEQ ID NO: 3716819 - RNA, 19 nt, Salmonella enterica enterica serovar Typhi Ty2
ccagcgccauaauccagaa

SEQ ID NO: 3716820 - RNA, 18 nt, Salmonella enterica enterica serovar Typhi Ty2
ccagcgcccuauccagcg

SEQ ID NO: 3716821 - RNA, 14 nt, Salmonella enterica enterica serovar Typhi Ty2
ccagcgccgagaaa

SEQ ID NO: 3716822 - RNA, 21 nt, Salmonella enterica enterica serovar Typhi Ty2
ccagcgccgagaaaaucagug

SEQ ID NO: 3716823 - RNA, 14 nt, Salmonella enterica enterica serovar Typhi Ty2
ccagcgccgccaga

SEQ ID NO: 3716824 - RNA, 12 nt, Salmonella enterica enterica serovar Typhi Ty2
ccagcgccgcga

SEQ ID NO: 3716825 - RNA, 18 nt, Salmonella enterica enterica serovar Typhi Ty2
ccagcgccgcgacaagca

SEQ ID NO: 3716826 - RNA, 13 nt, Salmonella enterica enterica serovar Typhi Ty2
ccagcgccgcgcg

SEQ ID NO: 3716827 - RNA, 14 nt, Salmonella enterica enterica serovar Typhi Ty2
ccagcgccgcgcga

SEQ ID NO: 3716828 - RNA, 14 nt, Salmonella enterica enterica serovar Typhi Ty2
ccagcgccggauaa

SEQ ID NO: 3716829 - RNA, 22 nt, Salmonella enterica enterica serovar Typhi Ty2
ccagcgccggauaauccagaca

SEQ ID NO: 3716830 - RNA, 19 nt, Salmonella enterica enterica serovar Typhi Ty2
ccagcgccgggauauccuc

SEQ ID NO: 3716831 - RNA, 20 nt, Salmonella enterica enterica serovar Typhi Ty2
ccagcgccgucauaccgccc

SEQ ID NO: 3716832 - RNA, 14 nt, Salmonella enterica enterica serovar Typhi Ty2
ccagcgccugcgcu

SEQ ID NO: 3716833 - RNA, 21 nt, Salmonella enterica enterica serovar Typhi Ty2
ccagcgccugcuguaaaauau

SEQ ID NO: 3716834 - RNA, 24 nt, Salmonella enterica enterica serovar Typhi Ty2
ccagcgcgaauuugccccagauac

SEQ ID NO: 3716835 - RNA, 14 nt, Salmonella enterica enterica serovar Typhi Ty2
ccagcgcgauacgc

SEQ ID NO: 3716836 - RNA, 14 nt, Salmonella enterica enterica serovar Typhi Ty2
ccagcgcgccgcca

SEQ ID NO: 3716837 - RNA, 13 nt, Salmonella enterica enterica serovar Typhi Ty2
ccagcgcgccguc

SEQ ID NO: 3716838 - RNA, 16 nt, Salmonella enterica enterica serovar Typhi Ty2
ccagcgcgcugagcgg

SEQ ID NO: 3716839 - RNA, 13 nt, Salmonella enterica enterica serovar Typhi Ty2
ccagcgcggcaca

SEQ ID NO: 3716840 - RNA, 14 nt, Salmonella enterica enterica serovar Typhi Ty2
ccagcgcggcgcca

SEQ ID NO: 3716841 - RNA, 22 nt, Salmonella enterica enterica serovar Typhi Ty2
ccagcgcgggcgaggccucguu

SEQ ID NO: 3716842 - RNA, 20 nt, Salmonella enterica enterica serovar Typhi Ty2
ccagcgcgguggcgcacagu

SEQ ID NO: 3716843 - RNA, 18 nt, Salmonella enterica enterica serovar Typhi Ty2
ccagcgcguaaauaccuu

SEQ ID NO: 3716844 - RNA, 21 nt, Salmonella enterica enterica serovar Typhi Ty2
ccagcgcuaacggcgguacca

SEQ ID NO: 3716845 - RNA, 19 nt, Salmonella enterica enterica serovar Typhi Ty2
ccagcgcugucagugaaaa

SEQ ID NO: 3716846 - RNA, 22 nt, Salmonella enterica enterica serovar Typhi Ty2
ccagcggaauauucgcuucuuc

SEQ ID NO: 3716847 - RNA, 19 nt, Salmonella enterica enterica serovar Typhi Ty2
ccagcggaauccccgccgc

SEQ ID NO: 3716848 - RNA, 21 nt, Salmonella enterica enterica serovar Typhi Ty2
ccagcggaauccccgccgcca

SEQ ID NO: 3716849 - RNA, 22 nt, Salmonella enterica enterica serovar Typhi Ty2
ccagcggaugucggucaucagg

SEQ ID NO: 3716850 - RNA, 23 nt, Salmonella enterica enterica serovar Typhi Ty2
ccagcggcaaaggcauggcaggu

SEQ ID NO: 3716851 - RNA, 14 nt, Salmonella enterica enterica serovar Typhi Ty2
ccagcggcaccagc

SEQ ID NO: 3716852 - RNA, 22 nt, Salmonella enterica enterica serovar Typhi Ty2
ccagcggcagaucguuuacgac

SEQ ID NO: 3716853 - RNA, 14 nt, Salmonella enterica enterica serovar Typhi Ty2
ccagcggccagcca

SEQ ID NO: 3716854 - RNA, 15 nt, Salmonella enterica enterica serovar Typhi Ty2
ccagcggccagccau

SEQ ID NO: 3716855 - RNA, 19 nt, Salmonella enterica enterica serovar Typhi Ty2
ccagcggcgacaguaacug

SEQ ID NO: 3716856 - RNA, 20 nt, Salmonella enterica enterica serovar Typhi Ty2
ccagcggcgcgcgguuaugc

SEQ ID NO: 3716857 - RNA, 23 nt, Salmonella enterica enterica serovar Typhi Ty2
ccagcgggccgacgauaaacaga

SEQ ID NO: 3716858 - RNA, 13 nt, Salmonella enterica enterica serovar Typhi Ty2
ccagcgggccgcu

SEQ ID NO: 3716859 - RNA, 20 nt, Salmonella enterica enterica serovar Typhi Ty2
ccagcgggugaugcgccagc

SEQ ID NO: 3716860 - RNA, 20 nt, Salmonella enterica enterica serovar Typhi Ty2
ccagcgguaugcaccucuuu

SEQ ID NO: 3716861 - RNA, 19 nt, Salmonella enterica enterica serovar Typhi Ty2
ccagcgguguuugccagac

SEQ ID NO: 3716862 - RNA, 16 nt, Salmonella enterica enterica serovar Typhi Ty2
ccagcgguugcgcuuc

SEQ ID NO: 3716863 - RNA, 15 nt, Salmonella enterica enterica serovar Typhi Ty2
ccagcguaagcgccc

SEQ ID NO: 3716864 - RNA, 21 nt, Salmonella enterica enterica serovar Typhi Ty2
ccagcguacguaacuucuugg

SEQ ID NO: 3716865 - RNA, 15 nt, Salmonella enterica enterica serovar Typhi Ty2
ccagcguagcuaaac

SEQ ID NO: 3716866 - RNA, 18 nt, Salmonella enterica enterica serovar Typhi Ty2
ccagcguauaauuaagcu

SEQ ID NO: 3716867 - RNA, 16 nt, Salmonella enterica enterica serovar Typhi Ty2
ccagcgucagccagaa

SEQ ID NO: 3716868 - RNA, 18 nt, Salmonella enterica enterica serovar Typhi Ty2
ccagcgucucagcaggcg

SEQ ID NO: 3716869 - RNA, 23 nt, Salmonella enterica enterica serovar Typhi Ty2
ccagcgucuccagacaauccgcg

SEQ ID NO: 3716870 - RNA, 19 nt, Salmonella enterica enterica serovar Typhi Ty2
ccagcgugacccagacaaa

SEQ ID NO: 3716871 - RNA, 15 nt, Salmonella enterica enterica serovar Typhi Ty2
ccagcgugccgagca

SEQ ID NO: 3716872 - RNA, 22 nt, Salmonella enterica enterica serovar Typhi Ty2
ccagcguggcagugaguaacgu

SEQ ID NO: 3716873 - RNA, 18 nt, Salmonella enterica enterica serovar Typhi Ty2
ccagcguugaauaucgua

SEQ ID NO: 3716874 - RNA, 13 nt, Salmonella enterica enterica serovar Typhi Ty2
ccagcuaaaaacg

SEQ ID NO: 3716875 - RNA, 15 nt, Salmonella enterica enterica serovar Typhi Ty2
ccagcuaaaccacgg

SEQ ID NO: 3716876 - RNA, 15 nt, Salmonella enterica enterica serovar Typhi Ty2
ccagcuaaccuguuc

SEQ ID NO: 3716877 - RNA, 16 nt, Salmonella enterica enterica serovar Typhi Ty2
ccagcuacaccugggc

SEQ ID NO: 3716878 - RNA, 18 nt, Salmonella enterica enterica serovar Typhi Ty2
ccagcuacuggccacgga

SEQ ID NO: 3716879 - RNA, 17 nt, Salmonella enterica enterica serovar Typhi Ty2
ccagcuauccaguuucu

SEQ ID NO: 3716880 - RNA, 22 nt, Salmonella enterica enterica serovar Typhi Ty2
ccagcucaaaugacgaauaccg

SEQ ID NO: 3716881 - RNA, 14 nt, Salmonella enterica enterica serovar Typhi Ty2
ccagcucaacgccu

SEQ ID NO: 3716882 - RNA, 16 nt, Salmonella enterica enterica serovar Typhi Ty2
ccagcucaacgccuuu

SEQ ID NO: 3716883 - RNA, 21 nt, Salmonella enterica enterica serovar Typhi Ty2
ccagcucaacgccuuugcaau

SEQ ID NO: 3716884 - RNA, 14 nt, Salmonella enterica enterica serovar Typhi Ty2
ccagcucaccagcc

SEQ ID NO: 3716885 - RNA, 23 nt, Salmonella enterica enterica serovar Typhi Ty2
ccagcucaccgagacugcccggc

SEQ ID NO: 3716886 - RNA, 18 nt, Salmonella enterica enterica serovar Typhi Ty2
ccagcucaggguccccau

SEQ ID NO: 3716887 - RNA, 15 nt, Salmonella enterica enterica serovar Typhi Ty2
ccagcucaucgaacc

SEQ ID NO: 3716888 - RNA, 21 nt, Salmonella enterica enterica serovar Typhi Ty2
ccagcucaugauagggcagca

SEQ ID NO: 3716889 - RNA, 14 nt, Salmonella enterica enterica serovar Typhi Ty2
ccagcucauuuuua

SEQ ID NO: 3716890 - RNA, 15 nt, Salmonella enterica enterica serovar Typhi Ty2
ccagcucauuuuuac

SEQ ID NO: 3716891 - RNA, 16 nt, Salmonella enterica enterica serovar Typhi Ty2
ccagcuccauccacca

SEQ ID NO: 3716892 - RNA, 18 nt, Salmonella enterica enterica serovar Typhi Ty2
ccagcuccauccaccagc

SEQ ID NO: 3716893 - RNA, 15 nt, Salmonella enterica enterica serovar Typhi Ty2
ccagcucccgcguca

SEQ ID NO: 3716894 - RNA, 16 nt, Salmonella enterica enterica serovar Typhi Ty2
ccagcucgucuugugu

SEQ ID NO: 3716895 - RNA, 21 nt, Salmonella enterica enterica serovar Typhi Ty2
ccaggucugcaccacgguguc

SEQ ID NO: 3716896 - RNA, 16 nt, Salmonella enterica enterica serovar Typhi Ty2
ccagguuauucaggug

SEQ ID NO: 3716897 - RNA, 18 nt, Salmonella enterica enterica serovar Typhi Ty2
ccagguuauucaggugga

SEQ ID NO: 3716898 - RNA, 19 nt, Salmonella enterica enterica serovar Typhi Ty2
ccagguuccccaaugauca

SEQ ID NO: 3716899 - RNA, 23 nt, Salmonella enterica enterica serovar Typhi Ty2
ccagguugcucagguuauacugu

SEQ ID NO: 3716900 - RNA, 21 nt, Salmonella enterica enterica serovar Typhi Ty2
ccagguuucuggcaacagcca

SEQ ID NO: 3716901 - RNA, 13 nt, Salmonella enterica enterica serovar Typhi Ty2
ccagguuuuacau

SEQ ID NO: 3716902 - RNA, 19 nt, Salmonella enterica enterica serovar Typhi Ty2
ccagguuuucaggccgcgu

SEQ ID NO: 3716903 - RNA, 16 nt, Salmonella enterica enterica serovar Typhi Ty2
ccagguuuugcucuga

SEQ ID NO: 3716904 - RNA, 20 nt, Salmonella enterica enterica serovar Typhi Ty2
ccagguuuuggucagcucac

SEQ ID NO: 3716905 - RNA, 20 nt, Salmonella enterica enterica serovar Typhi Ty2
ccaguaacgcguccaacugg

SEQ ID NO: 3716906 - RNA, 14 nt, Salmonella enterica enterica serovar Typhi Ty2
ccaguaacucaucg

SEQ ID NO: 3716907 - RNA, 20 nt, Salmonella enterica enterica serovar Typhi Ty2
ccaguaacucaucgccagcc

SEQ ID NO: 3716908 - RNA, 15 nt, Salmonella enterica enterica serovar Typhi Ty2
ccaguaagggcagcc

SEQ ID NO: 3716909 - RNA, 23 nt, Salmonella enterica enterica serovar Typhi Ty2
ccaguaauaucgccucccugccu

SEQ ID NO: 3716910 - RNA, 14 nt, Salmonella enterica enterica serovar Typhi Ty2
ccaguaaugccaua

SEQ ID NO: 3716911 - RNA, 15 nt, Salmonella enterica enterica serovar Typhi Ty2
ccaguaauucccccg

SEQ ID NO: 3716912 - RNA, 23 nt, Salmonella enterica enterica serovar Typhi Ty2
ccaguaauuuuucucccagcaga

SEQ ID NO: 3716913 - RNA, 19 nt, Salmonella enterica enterica serovar Typhi Ty2
ccaguacaaacaaauaaau

SEQ ID NO: 3716914 - RNA, 14 nt, Salmonella enterica enterica serovar Typhi Ty2
ccaguaccagcacu

SEQ ID NO: 3716915 - RNA, 16 nt, Salmonella enterica enterica serovar Typhi Ty2
ccaguaccgacgccau

SEQ ID NO: 3716916 - RNA, 13 nt, Salmonella enterica enterica serovar Typhi Ty2
ccaguaccgccgc

SEQ ID NO: 3716917 - RNA, 21 nt, Salmonella enterica enterica serovar Typhi Ty2
ccaguacuuuggccuaacagu

SEQ ID NO: 3716918 - RNA, 13 nt, Salmonella enterica enterica serovar Typhi Ty2
ccaguagcagaca

SEQ ID NO: 3716919 - RNA, 17 nt, Salmonella enterica enterica serovar Typhi Ty2
ccaguaucgcgccgcca

SEQ ID NO: 3716920 - RNA, 22 nt, Salmonella enterica enterica serovar Typhi Ty2
ccagucagcaauuaacaaauaa

SEQ ID NO: 3716921 - RNA, 19 nt, Salmonella enterica enterica serovar Typhi Ty2
ccagucaggcgaucccggc

SEQ ID NO: 3716922 - RNA, 20 nt, Salmonella enterica enterica serovar Typhi Ty2
ccagucaggcgaucccggcc

SEQ ID NO: 3716923 - RNA, 13 nt, Salmonella enterica enterica serovar Typhi Ty2
ccagucaguuuau

SEQ ID NO: 3716924 - RNA, 17 nt, Salmonella enterica enterica serovar Typhi Ty2
ccagucaucauaauuca

SEQ ID NO: 3716925 - RNA, 13 nt, Salmonella enterica enterica serovar Typhi Ty2
ccagucauccggu

SEQ ID NO: 3716926 - RNA, 13 nt, Salmonella enterica enterica serovar Typhi Ty2
ccagucccagcac

SEQ ID NO: 3716927 - RNA, 17 nt, Salmonella enterica enterica serovar Typhi Ty2
ccaguccgguauaaaac

SEQ ID NO: 3716928 - RNA, 16 nt, Salmonella enterica enterica serovar Typhi Ty2
ccaguccuuccgccgg

SEQ ID NO: 3716929 - RNA, 15 nt, Salmonella enterica enterica serovar Typhi Ty2
ccagucgacucaucu

SEQ ID NO: 3716930 - RNA, 18 nt, Salmonella enterica enterica serovar Typhi Ty2
ccagucgacucaucuuuu

SEQ ID NO: 3716931 - RNA, 18 nt, Salmonella enterica enterica serovar Typhi Ty2
ccagucgcagcaaacggc

SEQ ID NO: 3716932 - RNA, 17 nt, Salmonella enterica enterica serovar Typhi Ty2
ccagucggaaccggcaa

SEQ ID NO: 3716933 - RNA, 13 nt, Salmonella enterica enterica serovar Typhi Ty2
ccagucggacagc

SEQ ID NO: 3716934 - RNA, 16 nt, Salmonella enterica enterica serovar Typhi Ty2
ccagucggcaaagacc

SEQ ID NO: 3716935 - RNA, 15 nt, Salmonella enterica enterica serovar Typhi Ty2
ccagucguaauucag

SEQ ID NO: 3716936 - RNA, 21 nt, Salmonella enterica enterica serovar Typhi Ty2
ccagucuuauuguccuguuuc

SEQ ID NO: 3716937 - RNA, 17 nt, Salmonella enterica enterica serovar Typhi Ty2
ccagucuuccauuacaa

SEQ ID NO: 3716938 - RNA, 23 nt, Salmonella enterica enterica serovar Typhi Ty2
ccagugaaaguugguguuucuca

SEQ ID NO: 3716939 - RNA, 13 nt, Salmonella enterica enterica serovar Typhi Ty2
ccagugaaauaaa

SEQ ID NO: 3716940 - RNA, 17 nt, Salmonella enterica enterica serovar Typhi Ty2
ccagugaauccaccacg

SEQ ID NO: 3716941 - RNA, 20 nt, Salmonella enterica enterica serovar Typhi Ty2
ccagugaauccaccacguaa

SEQ ID NO: 3716942 - RNA, 14 nt, Salmonella enterica enterica serovar Typhi Ty2
ccagugacgccagu

SEQ ID NO: 3716943 - RNA, 13 nt, Salmonella enterica enterica serovar Typhi Ty2
ccagugccaagca

SEQ ID NO: 3716944 - RNA, 22 nt, Salmonella enterica enterica serovar Typhi Ty2
ccagugcccgaaagcaauacug

SEQ ID NO: 3716945 - RNA, 15 nt, Salmonella enterica enterica serovar Typhi Ty2
ccaguggaugcgcua

SEQ ID NO: 3716946 - RNA, 13 nt, Salmonella enterica enterica serovar Typhi Ty2
ccaguggcgaaac

SEQ ID NO: 3716947 - RNA, 15 nt, Salmonella enterica enterica serovar Typhi Ty2
ccaguguacugccaa

SEQ ID NO: 3716948 - RNA, 15 nt, Salmonella enterica enterica serovar Typhi Ty2
ccaguguuguucucu

SEQ ID NO: 3716949 - RNA, 19 nt, Salmonella enterica enterica serovar Typhi Ty2
ccaguuaacagaaugcuga

SEQ ID NO: 3716950 - RNA, 19 nt, Salmonella enterica enterica serovar Typhi Ty2
ccaguuagcgaucgcgccg

SEQ ID NO: 3716951 - RNA, 22 nt, Salmonella enterica enterica serovar Typhi Ty2
ccaguuaucaggacauaaaaca

SEQ ID NO: 3716952 - RNA, 19 nt, Salmonella enterica enterica serovar Typhi Ty2
ccaguuauuaaucaagccc

SEQ ID NO: 3716953 - RNA, 12 nt, Salmonella enterica enterica serovar Typhi Ty2
ccaguucacucc

SEQ ID NO: 3716954 - RNA, 22 nt, Salmonella enterica enterica serovar Typhi Ty2
ccaguucacuccuaagagaaaa

SEQ ID NO: 3716955 - RNA, 16 nt, Salmonella enterica enterica serovar Typhi Ty2
ccaguucauuaacauc

SEQ ID NO: 3716956 - RNA, 17 nt, Salmonella enterica enterica serovar Typhi Ty2
ccaguucauugauuaac

SEQ ID NO: 3716957 - RNA, 12 nt, Salmonella enterica enterica serovar Typhi Ty2
ccaguuccccau

SEQ ID NO: 3716958 - RNA, 18 nt, Salmonella enterica enterica serovar Typhi Ty2
ccaguucccccgguuacc

SEQ ID NO: 3716959 - RNA, 22 nt, Salmonella enterica enterica serovar Typhi Ty2
ccaguucggcgauuuccagcgc

SEQ ID NO: 3716960 - RNA, 17 nt, Salmonella enterica enterica serovar Typhi Ty2
ccaguucgucuuccgga

SEQ ID NO: 3716961 - RNA, 17 nt, Salmonella enterica enterica serovar Typhi Ty2
ccaguucuggcugcgcu

SEQ ID NO: 3716962 - RNA, 18 nt, Salmonella enterica enterica serovar Typhi Ty2
ccaguucuggcugcgcuu

SEQ ID NO: 3716963 - RNA, 15 nt, Salmonella enterica enterica serovar Typhi Ty2
ccaguugauagcgau

SEQ ID NO: 3716964 - RNA, 17 nt, Salmonella enterica enterica serovar Typhi Ty2
ccaguugaucggccagc

SEQ ID NO: 3716965 - RNA, 18 nt, Salmonella enterica enterica serovar Typhi Ty2
ccaguugcauacauaaau

SEQ ID NO: 3716966 - RNA, 23 nt, Salmonella enterica enterica serovar Typhi Ty2
ccaguugccaggguucaaccuga

SEQ ID NO: 3716967 - RNA, 14 nt, Salmonella enterica enterica serovar Typhi Ty2
ccaguugcgcaggg

SEQ ID NO: 3716968 - RNA, 12 nt, Salmonella enterica enterica serovar Typhi Ty2
ccaguugcgcca

SEQ ID NO: 3716969 - RNA, 17 nt, Salmonella enterica enterica serovar Typhi Ty2
ccaguugcuuaccuugu

SEQ ID NO: 3716970 - RNA, 20 nt, Salmonella enterica enterica serovar Typhi Ty2
ccaguuggcguaccaucagc

SEQ ID NO: 3716971 - RNA, 21 nt, Salmonella enterica enterica serovar Typhi Ty2
ccaguuguaacgccuggcgca

SEQ ID NO: 3716972 - RNA, 20 nt, Salmonella enterica enterica serovar Typhi Ty2
ccaguuguccgcuggucagc

SEQ ID NO: 3716973 - RNA, 18 nt, Salmonella enterica enterica serovar Typhi Ty2
ccaguuguuccagcagcu

SEQ ID NO: 3716974 - RNA, 20 nt, Salmonella enterica enterica serovar Typhi Ty2
ccaguuguuccgcgcugaug

SEQ ID NO: 3716975 - RNA, 16 nt, Salmonella enterica enterica serovar Typhi Ty2
ccaguuguucuuucac

SEQ ID NO: 3716976 - RNA, 14 nt, Salmonella enterica enterica serovar Typhi Ty2
ccaguuuccugacc

SEQ ID NO: 3716977 - RNA, 15 nt, Salmonella enterica enterica serovar Typhi Ty2
ccaucccccugccgu

SEQ ID NO: 3716978 - RNA, 23 nt, Salmonella enterica enterica serovar Typhi Ty2
ccauccgacgccuuuaccacccg

SEQ ID NO: 3716979 - RNA, 14 nt, Salmonella enterica enterica serovar Typhi Ty2
ccauccggcaaaau

SEQ ID NO: 3716980 - RNA, 16 nt, Salmonella enterica enterica serovar Typhi Ty2
ccauccggcaaacuca

SEQ ID NO: 3716981 - RNA, 20 nt, Salmonella enterica enterica serovar Typhi Ty2
ccauccggcaaacucagcgg

SEQ ID NO: 3716982 - RNA, 20 nt, Salmonella enterica enterica serovar Typhi Ty2
ccauccggcacacagaauua

SEQ ID NO: 3716983 - RNA, 17 nt, Salmonella enterica enterica serovar Typhi Ty2
ccauccggcacaguauu

SEQ ID NO: 3716984 - RNA, 22 nt, Salmonella enterica enterica serovar Typhi Ty2
ccauccggcacggucaaucauc

SEQ ID NO: 3716985 - RNA, 19 nt, Salmonella enterica enterica serovar Typhi Ty2
ccauccggcauuuuucuca

SEQ ID NO: 3716986 - RNA, 16 nt, Salmonella enterica enterica serovar Typhi Ty2
ccauccgggccacucu

SEQ ID NO: 3716987 - RNA, 18 nt, Salmonella enterica enterica serovar Typhi Ty2
ccauccgugcgaugagau

SEQ ID NO: 3716988 - RNA, 17 nt, Salmonella enterica enterica serovar Typhi Ty2
ccaucgacagcgccaua

SEQ ID NO: 3716989 - RNA, 23 nt, Salmonella enterica enterica serovar Typhi Ty2
ccaucgacgaaauggugugcaug

SEQ ID NO: 3716990 - RNA, 12 nt, Salmonella enterica enterica serovar Typhi Ty2
ccaucgccgcag

SEQ ID NO: 3716991 - RNA, 20 nt, Salmonella enterica enterica serovar Typhi Ty2
ccaucgccugaugaccgccg

SEQ ID NO: 3716992 - RNA, 21 nt, Salmonella enterica enterica serovar Typhi Ty2
ccaucgccugaugaccgccgu

SEQ ID NO: 3716993 - RNA, 21 nt, Salmonella enterica enterica serovar Typhi Ty2
ccaucgcgacacccaauccgg

SEQ ID NO: 3716994 - RNA, 18 nt, Salmonella enterica enterica serovar Typhi Ty2
ccaucgcgccaucggcuu

SEQ ID NO: 3716995 - RNA, 14 nt, Salmonella enterica enterica serovar Typhi Ty2
ccaucgcgccgcug

SEQ ID NO: 3716996 - RNA, 23 nt, Salmonella enterica enterica serovar Typhi Ty2
ccaucgcguuguaaucgccugaa

SEQ ID NO: 3716997 - RNA, 22 nt, Salmonella enterica enterica serovar Typhi Ty2
ccaucgcuuuacguuuggcggc

SEQ ID NO: 3716998 - RNA, 16 nt, Salmonella enterica enterica serovar Typhi Ty2
ccaucggaguccagca

SEQ ID NO: 3716999 - RNA, 20 nt, Salmonella enterica enterica serovar Typhi Ty2
ccaucggcugguuauacugg

SEQ ID NO: 3717000 - RNA, 23 nt, Salmonella enterica enterica serovar Typhi Ty2
ccaucgguucucugccaucaucc

SEQ ID NO: 3717001 - RNA, 15 nt, Salmonella enterica enterica serovar Typhi Ty2
ccaucguccagccau

SEQ ID NO: 3717002 - RNA, 18 nt, Salmonella enterica enterica serovar Typhi Ty2
ccaucucacgcauggcgu

SEQ ID NO: 3717003 - RNA, 19 nt, Salmonella enterica enterica serovar Typhi Ty2
ccaucucauucgccagcgg

SEQ ID NO: 3717004 - RNA, 14 nt, Salmonella enterica enterica serovar Typhi Ty2
ccaucuccaucauu

SEQ ID NO: 3717005 - RNA, 22 nt, Salmonella enterica enterica serovar Typhi Ty2
ccaucuccugcgauagcugcug

SEQ ID NO: 3717006 - RNA, 14 nt, Salmonella enterica enterica serovar Typhi Ty2
ccaucucuuccgcg

SEQ ID NO: 3717007 - RNA, 22 nt, Salmonella enterica enterica serovar Typhi Ty2
ccaucugaacucuuccagauac

SEQ ID NO: 3717008 - RNA, 13 nt, Salmonella enterica enterica serovar Typhi Ty2
ccaucuucacgca

SEQ ID NO: 3717009 - RNA, 18 nt, Salmonella enterica enterica serovar Typhi Ty2
ccaucuuccucacagccu

SEQ ID NO: 3717010 - RNA, 16 nt, Salmonella enterica enterica serovar Typhi Ty2
ccaucuuucacccauu

SEQ ID NO: 3717011 - RNA, 22 nt, Salmonella enterica enterica serovar Typhi Ty2
ccaucuuugcaccgcuaaaaaa

SEQ ID NO: 3717012 - RNA, 13 nt, Salmonella enterica enterica serovar Typhi Ty2
ccaugaaaaaaac

SEQ ID NO: 3717013 - RNA, 17 nt, Salmonella enterica enterica serovar Typhi Ty2
ccaugaacaccucauau

SEQ ID NO: 3717014 - RNA, 21 nt, Salmonella enterica enterica serovar Typhi Ty2
ccaugaagcgauuuauccacc

SEQ ID NO: 3717015 - RNA, 14 nt, Salmonella enterica enterica serovar Typhi Ty2
ccaugacgacaggu

SEQ ID NO: 3717016 - RNA, 15 nt, Salmonella enterica enterica serovar Typhi Ty2
ccaugagacgcguaa

SEQ ID NO: 3717017 - RNA, 15 nt, Salmonella enterica enterica serovar Typhi Ty2
ccaugagcgaaacuc

SEQ ID NO: 3717018 - RNA, 22 nt, Salmonella enterica enterica serovar Typhi Ty2
ccaugagcgaaacuccagcgau

SEQ ID NO: 3717019 - RNA, 24 nt, Salmonella enterica enterica serovar Typhi Ty2
ccaugagcgaaacuccagcgauaa

SEQ ID NO: 3717020 - RNA, 13 nt, Salmonella enterica enterica serovar Typhi Ty2
ccaugaguucaau

SEQ ID NO: 3717021 - RNA, 18 nt, Salmonella enterica enterica serovar Typhi Ty2
ccaugauccguucgauca

SEQ ID NO: 3717022 - RNA, 22 nt, Salmonella enterica enterica serovar Typhi Ty2
ccaugaucgauagcgacggcgc

SEQ ID NO: 3717023 - RNA, 14 nt, Salmonella enterica enterica serovar Typhi Ty2
ccaugaucgucagg

SEQ ID NO: 3717024 - RNA, 15 nt, Salmonella enterica enterica serovar Typhi Ty2
ccaugaugagcgcca

SEQ ID NO: 3717025 - RNA, 22 nt, Salmonella enterica enterica serovar Typhi Ty2
ccaugaugggcaagcguagucc

SEQ ID NO: 3717026 - RNA, 14 nt, Salmonella enterica enterica serovar Typhi Ty2
ccaugauucauccc

SEQ ID NO: 3717027 - RNA, 19 nt, Salmonella enterica enterica serovar Typhi Ty2
ccaugauucaucccgcugu

SEQ ID NO: 3717028 - RNA, 12 nt, Salmonella enterica enterica serovar Typhi Ty2
ccaugcaaaaaa

SEQ ID NO: 3717029 - RNA, 17 nt, Salmonella enterica enterica serovar Typhi Ty2
ccaugcauaaugcagcc

SEQ ID NO: 3717030 - RNA, 15 nt, Salmonella enterica enterica serovar Typhi Ty2
ccaugcaucaauggc

SEQ ID NO: 3717031 - RNA, 19 nt, Salmonella enterica enterica serovar Typhi Ty2
ccaugcccaguucaaucaa

SEQ ID NO: 3717032 - RNA, 11 nt, Salmonella enterica enterica serovar Typhi Ty2
ccaugccuuug

SEQ ID NO: 3717033 - RNA, 22 nt, Salmonella enterica enterica serovar Typhi Ty2
ccaugcuauccgccgccagcca

SEQ ID NO: 3717034 - RNA, 14 nt, Salmonella enterica enterica serovar Typhi Ty2
ccaugcucauccaa

SEQ ID NO: 3717035 - RNA, 13 nt, Salmonella enterica enterica serovar Typhi Ty2
ccaugcugguugg

SEQ ID NO: 3717036 - RNA, 13 nt, Salmonella enterica enterica serovar Typhi Ty2
ccaugcuuucaau

SEQ ID NO: 3717037 - RNA, 16 nt, Salmonella enterica enterica serovar Typhi Ty2
ccauggcaggcagcac

SEQ ID NO: 3717038 - RNA, 23 nt, Salmonella enterica enterica serovar Typhi Ty2
ccauggcaggcagcacaaucagc

SEQ ID NO: 3717039 - RNA, 15 nt, Salmonella enterica enterica serovar Typhi Ty2
ccauggcccaaaagg

SEQ ID NO: 3717040 - RNA, 14 nt, Salmonella enterica enterica serovar Typhi Ty2
ccauggccgcagcc

SEQ ID NO: 3717041 - RNA, 18 nt, Salmonella enterica enterica serovar Typhi Ty2
ccauggccgcagcccgcc

SEQ ID NO: 3717042 - RNA, 23 nt, Salmonella enterica enterica serovar Typhi Ty2
ccauggucagacgcucagccuua

SEQ ID NO: 3717043 - RNA, 14 nt, Salmonella enterica enterica serovar Typhi Ty2
ccauguacuccuga

SEQ ID NO: 3717044 - RNA, 18 nt, Salmonella enterica enterica serovar Typhi Ty2
ccaugucagcgcaaagcc

SEQ ID NO: 3717045 - RNA, 20 nt, Salmonella enterica enterica serovar Typhi Ty2
ccaugucuugcuaucaaacu

SEQ ID NO: 3717046 - RNA, 22 nt, Salmonella enterica enterica serovar Typhi Ty2
ccauguggccagcggccagcca

SEQ ID NO: 3717047 - RNA, 13 nt, Salmonella enterica enterica serovar Typhi Ty2
ccauguucaguuc

SEQ ID NO: 3717048 - RNA, 15 nt, Salmonella enterica enterica serovar Typhi Ty2
ccauguucauaaagu

SEQ ID NO: 3717049 - RNA, 22 nt, Salmonella enterica enterica serovar Typhi Ty2
ccauguugaucguaaaaugaaa

SEQ ID NO: 3717050 - RNA, 19 nt, Salmonella enterica enterica serovar Typhi Ty2
ccauguugcguaaauaaau

SEQ ID NO: 3717051 - RNA, 16 nt, Salmonella enterica enterica serovar Typhi Ty2
ccauguuuaccaucgc

SEQ ID NO: 3717052 - RNA, 19 nt, Salmonella enterica enterica serovar Typhi Ty2
ccauguuuaccaucgcguu

SEQ ID NO: 3717053 - RNA, 14 nt, Salmonella enterica enterica serovar Typhi Ty2
ccauguuuguuuaa

SEQ ID NO: 3717054 - RNA, 23 nt, Salmonella enterica enterica serovar Typhi Ty2
ccauguuuuauacucaaaaaauc

SEQ ID NO: 3717055 - RNA, 21 nt, Salmonella enterica enterica serovar Typhi Ty2
ccauuaauauagaguugugaa

SEQ ID NO: 3717056 - RNA, 13 nt, Salmonella enterica enterica serovar Typhi Ty2
ccauuaaugcagg

SEQ ID NO: 3717057 - RNA, 14 nt, Salmonella enterica enterica serovar Typhi Ty2
ccauuacgcccccu

SEQ ID NO: 3717058 - RNA, 21 nt, Salmonella enterica enterica serovar Typhi Ty2
ccauuacgcuauaaaguuccc

SEQ ID NO: 3717059 - RNA, 21 nt, Salmonella enterica enterica serovar Typhi Ty2
cccacuccggcgugaacgccu

SEQ ID NO: 3717060 - RNA, 15 nt, Salmonella enterica enterica serovar Typhi Ty2
cccacugcacauccc

SEQ ID NO: 3717061 - RNA, 20 nt, Salmonella enterica enterica serovar Typhi Ty2
cccacuuauggucguauuuu

SEQ ID NO: 3717062 - RNA, 12 nt, Salmonella enterica enterica serovar Typhi Ty2
cccacuucgccg

SEQ ID NO: 3717063 - RNA, 20 nt, Salmonella enterica enterica serovar Typhi Ty2
cccacuuguagcgagcgccg

SEQ ID NO: 3717064 - RNA, 17 nt, Salmonella enterica enterica serovar Typhi Ty2
cccacuuuacacgcgcu

SEQ ID NO: 3717065 - RNA, 18 nt, Salmonella enterica enterica serovar Typhi Ty2
cccacuuugcucaccacg

SEQ ID NO: 3717066 - RNA, 19 nt, Salmonella enterica enterica serovar Typhi Ty2
cccagaaagaucagcagaa

SEQ ID NO: 3717067 - RNA, 23 nt, Salmonella enterica enterica serovar Typhi Ty2
cccagaaugccgcccauccagag

SEQ ID NO: 3717068 - RNA, 23 nt, Salmonella enterica enterica serovar Typhi Ty2
cccagacgcccuucaauaucaac

SEQ ID NO: 3717069 - RNA, 21 nt, Salmonella enterica enterica serovar Typhi Ty2
cccagacggcgauacugcucc

SEQ ID NO: 3717070 - RNA, 20 nt, Salmonella enterica enterica serovar Typhi Ty2
cccagagucacuagcacuac

SEQ ID NO: 3717071 - RNA, 20 nt, Salmonella enterica enterica serovar Typhi Ty2
cccagauaauagcugaaaag

SEQ ID NO: 3717072 - RNA, 23 nt, Salmonella enterica enterica serovar Typhi Ty2
cccagauaucaggauugaugguc

SEQ ID NO: 3717073 - RNA, 19 nt, Salmonella enterica enterica serovar Typhi Ty2
cccagauauccgcgcucaa

SEQ ID NO: 3717074 - RNA, 13 nt, Salmonella enterica enterica serovar Typhi Ty2
cccagauuacugc

SEQ ID NO: 3717075 - RNA, 14 nt, Salmonella enterica enterica serovar Typhi Ty2
cccagcaaaccggc

SEQ ID NO: 3717076 - RNA, 20 nt, Salmonella enterica enterica serovar Typhi Ty2
cccagcaaugcacuacgaaa

SEQ ID NO: 3717077 - RNA, 13 nt, Salmonella enterica enterica serovar Typhi Ty2
cccagcaccaacg

SEQ ID NO: 3717078 - RNA, 19 nt, Salmonella enterica enterica serovar Typhi Ty2
cccagcaccgaaacagcac

SEQ ID NO: 3717079 - RNA, 22 nt, Salmonella enterica enterica serovar Typhi Ty2
cccagcacuaacagcagcagca

SEQ ID NO: 3717080 - RNA, 13 nt, Salmonella enterica enterica serovar Typhi Ty2
cccagcagcagaa

SEQ ID NO: 3717081 - RNA, 14 nt, Salmonella enterica enterica serovar Typhi Ty2
cccagcagcagaua

SEQ ID NO: 3717082 - RNA, 15 nt, Salmonella enterica enterica serovar Typhi Ty2
cccagcagcagccgg

SEQ ID NO: 3717083 - RNA, 14 nt, Salmonella enterica enterica serovar Typhi Ty2
cccagcauauuaac

SEQ ID NO: 3717084 - RNA, 16 nt, Salmonella enterica enterica serovar Typhi Ty2
cccagcaucccgcugg

SEQ ID NO: 3717085 - RNA, 22 nt, Salmonella enterica enterica serovar Typhi Ty2
cccagcaugggcauccccaugu

SEQ ID NO: 3717086 - RNA, 13 nt, Salmonella enterica enterica serovar Typhi Ty2
cccagccacgcgu

SEQ ID NO: 3717087 - RNA, 18 nt, Salmonella enterica enterica serovar Typhi Ty2
cccagccagacgccagcc

SEQ ID NO: 3717088 - RNA, 21 nt, Salmonella enterica enterica serovar Typhi Ty2
cccagccagagauccacauug

SEQ ID NO: 3717089 - RNA, 14 nt, Salmonella enterica enterica serovar Typhi Ty2
cccagcccugugcc

SEQ ID NO: 3717090 - RNA, 17 nt, Salmonella enterica enterica serovar Typhi Ty2
cccagcccugugccgcu

SEQ ID NO: 3717091 - RNA, 21 nt, Salmonella enterica enterica serovar Typhi Ty2
cccagccuuccuggucugcca

SEQ ID NO: 3717092 - RNA, 17 nt, Salmonella enterica enterica serovar Typhi Ty2
cccagcgaacugauaaa

SEQ ID NO: 3717093 - RNA, 17 nt, Salmonella enterica enterica serovar Typhi Ty2
cccagcgaucccaguug

SEQ ID NO: 3717094 - RNA, 14 nt, Salmonella enterica enterica serovar Typhi Ty2
cccagcgcccccag

SEQ ID NO: 3717095 - RNA, 16 nt, Salmonella enterica enterica serovar Typhi Ty2
cccagcgcccccagca

SEQ ID NO: 3717096 - RNA, 17 nt, Salmonella enterica enterica serovar Typhi Ty2
cccagcgcccccagcaa

SEQ ID NO: 3717097 - RNA, 22 nt, Salmonella enterica enterica serovar Typhi Ty2
cccagcgccgagaaaaucagug

SEQ ID NO: 3717098 - RNA, 21 nt, Salmonella enterica enterica serovar Typhi Ty2
cccagcgccggauaauccaga

SEQ ID NO: 3717099 - RNA, 22 nt, Salmonella enterica enterica serovar Typhi Ty2
cccagcgcgaauuugccccaga

SEQ ID NO: 3717100 - RNA, 17 nt, Salmonella enterica enterica serovar Typhi Ty2
cccagcgcgauacgcag

SEQ ID NO: 3717101 - RNA, 20 nt, Salmonella enterica enterica serovar Typhi Ty2
cccagcgcgccgcagcgccg

SEQ ID NO: 3717102 - RNA, 19 nt, Salmonella enterica enterica serovar Typhi Ty2
cccagcgcggcccauucaa

SEQ ID NO: 3717103 - RNA, 17 nt, Salmonella enterica enterica serovar Typhi Ty2
cccagcgcuccaccaac

SEQ ID NO: 3717104 - RNA, 20 nt, Salmonella enterica enterica serovar Typhi Ty2
cccagcgggaacaucacgga

SEQ ID NO: 3717105 - RNA, 22 nt, Salmonella enterica enterica serovar Typhi Ty2
cccagcgggugaugcgccagcc

SEQ ID NO: 3717106 - RNA, 17 nt, Salmonella enterica enterica serovar Typhi Ty2
cccagcguaccacgccg

SEQ ID NO: 3717107 - RNA, 22 nt, Salmonella enterica enterica serovar Typhi Ty2
cccagcugagcuaaucacccac

SEQ ID NO: 3717108 - RNA, 19 nt, Salmonella enterica enterica serovar Typhi Ty2
cccagcuugcccagauccu

SEQ ID NO: 3717109 - RNA, 20 nt, Salmonella enterica enterica serovar Typhi Ty2
cccaggcauaaaaaaagcgc

SEQ ID NO: 3717110 - RNA, 12 nt, Salmonella enterica enterica serovar Typhi Ty2
cccaggccgcca

SEQ ID NO: 3717111 - RNA, 18 nt, Salmonella enterica enterica serovar Typhi Ty2
cccaggccgccaccgccu

SEQ ID NO: 3717112 - RNA, 13 nt, Salmonella enterica enterica serovar Typhi Ty2
cccaggccggcau

SEQ ID NO: 3717113 - RNA, 12 nt, Salmonella enterica enterica serovar Typhi Ty2
cccaggcgcgca

SEQ ID NO: 3717114 - RNA, 13 nt, Salmonella enterica enterica serovar Typhi Ty2
cccaggcguccag

SEQ ID NO: 3717115 - RNA, 20 nt, Salmonella enterica enterica serovar Typhi Ty2
cccaggggcauauauuauua

SEQ ID NO: 3717116 - RNA, 21 nt, Salmonella enterica enterica serovar Typhi Ty2
cccagguuugaggcuugcagc

SEQ ID NO: 3717117 - RNA, 19 nt, Salmonella enterica enterica serovar Typhi Ty2
cccaguaaauuaacgcgaa

SEQ ID NO: 3717118 - RNA, 18 nt, Salmonella enterica enterica serovar Typhi Ty2
cccaguagcagacagccg

SEQ ID NO: 3717119 - RNA, 20 nt, Salmonella enterica enterica serovar Typhi Ty2
cccaguagcagacagccgau

SEQ ID NO: 3717120 - RNA, 12 nt, Salmonella enterica enterica serovar Typhi Ty2
cccaguagccau

SEQ ID NO: 3717121 - RNA, 12 nt, Salmonella enterica enterica serovar Typhi Ty2
cccagucauccg

SEQ ID NO: 3717122 - RNA, 22 nt, Salmonella enterica enterica serovar Typhi Ty2
cccagucauucucuuucugcgc

SEQ ID NO: 3717123 - RNA, 19 nt, Salmonella enterica enterica serovar Typhi Ty2
cccaguccacguuuuacuu

SEQ ID NO: 3717124 - RNA, 21 nt, Salmonella enterica enterica serovar Typhi Ty2
cccaguccuuccggcgagaga

SEQ ID NO: 3717125 - RNA, 17 nt, Salmonella enterica enterica serovar Typhi Ty2
cccagugccaccagccg

SEQ ID NO: 3717126 - RNA, 18 nt, Salmonella enterica enterica serovar Typhi Ty2
cccagugccaccagccgg

SEQ ID NO: 3717127 - RNA, 15 nt, Salmonella enterica enterica serovar Typhi Ty2
cccaguggcaaaauc

SEQ ID NO: 3717128 - RNA, 15 nt, Salmonella enterica enterica serovar Typhi Ty2
cccaguguacugcca

SEQ ID NO: 3717129 - RNA, 18 nt, Salmonella enterica enterica serovar Typhi Ty2
cccagugucaacugcgcc

SEQ ID NO: 3717130 - RNA, 12 nt, Salmonella enterica enterica serovar Typhi Ty2
cccaguuuaccc

SEQ ID NO: 3717131 - RNA, 13 nt, Salmonella enterica enterica serovar Typhi Ty2
cccauaaacaggu

SEQ ID NO: 3717132 - RNA, 14 nt, Salmonella enterica enterica serovar Typhi Ty2
cccauaaagauggc

SEQ ID NO: 3717133 - RNA, 19 nt, Salmonella enterica enterica serovar Typhi Ty2
cccauaaccgaugcacaug

SEQ ID NO: 3717134 - RNA, 23 nt, Salmonella enterica enterica serovar Typhi Ty2
cccauaauaaugacuaauuauua

SEQ ID NO: 3717135 - RNA, 11 nt, Salmonella enterica enterica serovar Typhi Ty2
cccauaaucac

SEQ ID NO: 3717136 - RNA, 22 nt, Salmonella enterica enterica serovar Typhi Ty2
cccauacugacggcgcucuuua

SEQ ID NO: 3717137 - RNA, 15 nt, Salmonella enterica enterica serovar Typhi Ty2
cccauacugcccagc

SEQ ID NO: 3717138 - RNA, 17 nt, Salmonella enterica enterica serovar Typhi Ty2
cccauaguagcuaauga

SEQ ID NO: 3717139 - RNA, 13 nt, Salmonella enterica enterica serovar Typhi Ty2
cccaucaccugac

SEQ ID NO: 3717140 - RNA, 18 nt, Salmonella enterica enterica serovar Typhi Ty2
cccaucacgcccuguaaa

SEQ ID NO: 3717141 - RNA, 17 nt, Salmonella enterica enterica serovar Typhi Ty2
cccaucagcgccagccc

SEQ ID NO: 3717142 - RNA, 18 nt, Salmonella enterica enterica serovar Typhi Ty2
cccaucagggaaaaaugu

SEQ ID NO: 3717143 - RNA, 21 nt, Salmonella enterica enterica serovar Typhi Ty2
cccaucauugacuucaacgca

SEQ ID NO: 3717144 - RNA, 13 nt, Salmonella enterica enterica serovar Typhi Ty2
cccauccccauau

SEQ ID NO: 3717145 - RNA, 13 nt, Salmonella enterica enterica serovar Typhi Ty2
cccaucccggcaa

SEQ ID NO: 3717146 - RNA, 16 nt, Salmonella enterica enterica serovar Typhi Ty2
cccauccgcccaccca

SEQ ID NO: 3717147 - RNA, 17 nt, Salmonella enterica enterica serovar Typhi Ty2
cccauccgucaggaugg

SEQ ID NO: 3717148 - RNA, 14 nt, Salmonella enterica enterica serovar Typhi Ty2
cccaucgccguagg

SEQ ID NO: 3717149 - RNA, 14 nt, Salmonella enterica enterica serovar Typhi Ty2
cccaucgcgccauc

SEQ ID NO: 3717150 - RNA, 21 nt, Salmonella enterica enterica serovar Typhi Ty2
cccaucgggccgcucagcauc

SEQ ID NO: 3717151 - RNA, 14 nt, Salmonella enterica enterica serovar Typhi Ty2
cccaucguaacgcc

SEQ ID NO: 3717152 - RNA, 17 nt, Salmonella enterica enterica serovar Typhi Ty2
cccaucuaaccgggccu

SEQ ID NO: 3717153 - RNA, 18 nt, Salmonella enterica enterica serovar Typhi Ty2
cccaugaugggcaagcgu

SEQ ID NO: 3717154 - RNA, 18 nt, Salmonella enterica enterica serovar Typhi Ty2
cccaugauggugaacaga

SEQ ID NO: 3717155 - RNA, 13 nt, Salmonella enterica enterica serovar Typhi Ty2
cccaugcuuccag

SEQ ID NO: 3717156 - RNA, 17 nt, Salmonella enterica enterica serovar Typhi Ty2
cccauggaugcgccgcc

SEQ ID NO: 3717157 - RNA, 18 nt, Salmonella enterica enterica serovar Typhi Ty2
cccauggaugcgccgccc

SEQ ID NO: 3717158 - RNA, 15 nt, Salmonella enterica enterica serovar Typhi Ty2
cccaugucagcgcaa

SEQ ID NO: 3717159 - RNA, 17 nt, Salmonella enterica enterica serovar Typhi Ty2
cccauuaugugcgacgu

SEQ ID NO: 3717160 - RNA, 13 nt, Salmonella enterica enterica serovar Typhi Ty2
cccauucugcuga

SEQ ID NO: 3717161 - RNA, 18 nt, Salmonella enterica enterica serovar Typhi Ty2
cccauugaugccugccca

SEQ ID NO: 3717162 - RNA, 15 nt, Salmonella enterica enterica serovar Typhi Ty2
cccauugggccagca

SEQ ID NO: 3717163 - RNA, 22 nt, Salmonella enterica enterica serovar Typhi Ty2
cccauuuaacagauaauuaaua

SEQ ID NO: 3717164 - RNA, 16 nt, Salmonella enterica enterica serovar Typhi Ty2
cccauuucaugaccga

SEQ ID NO: 3717165 - RNA, 14 nt, Salmonella enterica enterica serovar Typhi Ty2
ccccaaacugcucg

SEQ ID NO: 3717166 - RNA, 13 nt, Salmonella enterica enterica serovar Typhi Ty2
ccccaaccgccag

SEQ ID NO: 3717167 - RNA, 19 nt, Salmonella enterica enterica serovar Typhi Ty2
ccccacaaucccgccagac

SEQ ID NO: 3717168 - RNA, 19 nt, Salmonella enterica enterica serovar Typhi Ty2
ccccacacggccaccauau

SEQ ID NO: 3717169 - RNA, 12 nt, Salmonella enterica enterica serovar Typhi Ty2
ccccacagaccu

SEQ ID NO: 3717170 - RNA, 12 nt, Salmonella enterica enterica serovar Typhi Ty2
ccccaccaggaa

SEQ ID NO: 3717171 - RNA, 21 nt, Salmonella enterica enterica serovar Typhi Ty2
ccccacgcugacgcgaucgcc

SEQ ID NO: 3717172 - RNA, 19 nt, Salmonella enterica enterica serovar Typhi Ty2
ccccagaaucccgccuugc

SEQ ID NO: 3717173 - RNA, 20 nt, Salmonella enterica enterica serovar Typhi Ty2
ccccagaccgauauuuugcu

SEQ ID NO: 3717174 - RNA, 22 nt, Salmonella enterica enterica serovar Typhi Ty2
ccccagacgcccuucaauauca

SEQ ID NO: 3717175 - RNA, 12 nt, Salmonella enterica enterica serovar Typhi Ty2
ccccagcaccga

SEQ ID NO: 3717176 - RNA, 14 nt, Salmonella enterica enterica serovar Typhi Ty2
ccccagcaccgaaa

SEQ ID NO: 3717177 - RNA, 18 nt, Salmonella enterica enterica serovar Typhi Ty2
ccccagcacgacagagau

SEQ ID NO: 3717178 - RNA, 11 nt, Salmonella enterica enterica serovar Typhi Ty2
ccccagcgcca

SEQ ID NO: 3717179 - RNA, 15 nt, Salmonella enterica enterica serovar Typhi Ty2
ccccagcgccagccg

SEQ ID NO: 3717180 - RNA, 21 nt, Salmonella enterica enterica serovar Typhi Ty2
ccccagcgcuccaccaaccag

SEQ ID NO: 3717181 - RNA, 21 nt, Salmonella enterica enterica serovar Typhi Ty2
ccccaggcgauaccgcgcugg

SEQ ID NO: 3717182 - RNA, 21 nt, Salmonella enterica enterica serovar Typhi Ty2
ccccagggagacggccaccca

SEQ ID NO: 3717183 - RNA, 14 nt, Salmonella enterica enterica serovar Typhi Ty2
ccccauaaauaauc

SEQ ID NO: 3717184 - RNA, 21 nt, Salmonella enterica enterica serovar Typhi Ty2
ccccauauugauggccacauc

SEQ ID NO: 3717185 - RNA, 15 nt, Salmonella enterica enterica serovar Typhi Ty2
ccccaugacggccug

SEQ ID NO: 3717186 - RNA, 14 nt, Salmonella enterica enterica serovar Typhi Ty2
ccccaugugccuug

SEQ ID NO: 3717187 - RNA, 15 nt, Salmonella enterica enterica serovar Typhi Ty2
ccccaugugccuugc

SEQ ID NO: 3717188 - RNA, 18 nt, Salmonella enterica enterica serovar Typhi Ty2
cccccaacgucaccauca

SEQ ID NO: 3717189 - RNA, 15 nt, Salmonella enterica enterica serovar Typhi Ty2
cccccaccucaauca

SEQ ID NO: 3717190 - RNA, 20 nt, Salmonella enterica enterica serovar Typhi Ty2
cccccagauagaaccacgca

SEQ ID NO: 3717191 - RNA, 11 nt, Salmonella enterica enterica serovar Typhi Ty2
cccccagcacg

SEQ ID NO: 3717192 - RNA, 17 nt, Salmonella enterica enterica serovar Typhi Ty2
cccccauggccccaugu

SEQ ID NO: 3717193 - RNA, 19 nt, Salmonella enterica enterica serovar Typhi Ty2
cccccgguagccacaccca

SEQ ID NO: 3717194 - RNA, 15 nt, Salmonella enterica enterica serovar Typhi Ty2
cccccuaucuggaug

SEQ ID NO: 3717195 - RNA, 17 nt, Salmonella enterica enterica serovar Typhi Ty2
cccccuccauacccuau

SEQ ID NO: 3717196 - RNA, 15 nt, Salmonella enterica enterica serovar Typhi Ty2
cccccugccagcgcu

SEQ ID NO: 3717197 - RNA, 19 nt, Salmonella enterica enterica serovar Typhi Ty2
ccccgaaagucaucugcca

SEQ ID NO: 3717198 - RNA, 19 nt, Salmonella enterica enterica serovar Typhi Ty2
ccccgacauucccagucgu

SEQ ID NO: 3717199 - RNA, 17 nt, Salmonella enterica enterica serovar Typhi Ty2
ccccgacggccucuuca

SEQ ID NO: 3717200 - RNA, 17 nt, Salmonella enterica enterica serovar Typhi Ty2
ccccgauaaaccaggca

SEQ ID NO: 3717201 - RNA, 18 nt, Salmonella enterica enterica serovar Typhi Ty2
ccccgauaaaccaggcag

SEQ ID NO: 3717202 - RNA, 24 nt, Salmonella enterica enterica serovar Typhi Ty2
ccccgccauaaugcacaauacgcc

SEQ ID NO: 3717203 - RNA, 18 nt, Salmonella enterica enterica serovar Typhi Ty2
ccccgccaucuucacgca

SEQ ID NO: 3717204 - RNA, 12 nt, Salmonella enterica enterica serovar Typhi Ty2
ccccgccccagc

SEQ ID NO: 3717205 - RNA, 11 nt, Salmonella enterica enterica serovar Typhi Ty2
ccccgccgcca

SEQ ID NO: 3717206 - RNA, 13 nt, Salmonella enterica enterica serovar Typhi Ty2
ccccgccgccagu

SEQ ID NO: 3717207 - RNA, 16 nt, Salmonella enterica enterica serovar Typhi Ty2
ccccgccgcugaggau

SEQ ID NO: 3717208 - RNA, 20 nt, Salmonella enterica enterica serovar Typhi Ty2
ccccgcuuucagcguugcag

SEQ ID NO: 3717209 - RNA, 18 nt, Salmonella enterica enterica serovar Typhi Ty2
ccccggaucaccggcauu

SEQ ID NO: 3717210 - RNA, 11 nt, Salmonella enterica enterica serovar Typhi Ty2
ccccggcacca

SEQ ID NO: 3717211 - RNA, 13 nt, Salmonella enterica enterica serovar Typhi Ty2
ccccggcaccacg

SEQ ID NO: 3717212 - RNA, 22 nt, Salmonella enterica enterica serovar Typhi Ty2
ccccggcagcuuuaaucuacca

SEQ ID NO: 3717213 - RNA, 15 nt, Salmonella enterica enterica serovar Typhi Ty2
ccccggccucgcccg

SEQ ID NO: 3717214 - RNA, 15 nt, Salmonella enterica enterica serovar Typhi Ty2
ccccggcgaaagaaa

SEQ ID NO: 3717215 - RNA, 17 nt, Salmonella enterica enterica serovar Typhi Ty2
ccccggcgcccggaggg

SEQ ID NO: 3717216 - RNA, 13 nt, Salmonella enterica enterica serovar Typhi Ty2
ccccggcggcguu

SEQ ID NO: 3717217 - RNA, 17 nt, Salmonella enterica enterica serovar Typhi Ty2
ccccgguagccacaccc

SEQ ID NO: 3717218 - RNA, 18 nt, Salmonella enterica enterica serovar Typhi Ty2
ccccggucaacgcgccgc

SEQ ID NO: 3717219 - RNA, 23 nt, Salmonella enterica enterica serovar Typhi Ty2
ccccucaaacaggcugucugcca

SEQ ID NO: 3717220 - RNA, 19 nt, Salmonella enterica enterica serovar Typhi Ty2
ccccucuuccaucagccag

SEQ ID NO: 3717221 - RNA, 14 nt, Salmonella enterica enterica serovar Typhi Ty2
ccccugacgcgcgc

SEQ ID NO: 3717222 - RNA, 17 nt, Salmonella enterica enterica serovar Typhi Ty2
ccccugacgcgcgcagu

SEQ ID NO: 3717223 - RNA, 21 nt, Salmonella enterica enterica serovar Typhi Ty2
ccccugaugcguauccagcgc

SEQ ID NO: 3717224 - RNA, 21 nt, Salmonella enterica enterica serovar Typhi Ty2
cccggaaauaaacgccagugg

SEQ ID NO: 3717225 - RNA, 19 nt, Salmonella enterica enterica serovar Typhi Ty2
cccggaacaaaagaaagca

SEQ ID NO: 3717226 - RNA, 20 nt, Salmonella enterica enterica serovar Typhi Ty2
cccggaacaaaagaaagcaa

SEQ ID NO: 3717227 - RNA, 17 nt, Salmonella enterica enterica serovar Typhi Ty2
cccggacaaggcgcgcc

SEQ ID NO: 3717228 - RNA, 17 nt, Salmonella enterica enterica serovar Typhi Ty2
cccggacaucauccccg

SEQ ID NO: 3717229 - RNA, 22 nt, Salmonella enterica enterica serovar Typhi Ty2
cccggacaucauccccggcagg

SEQ ID NO: 3717230 - RNA, 16 nt, Salmonella enterica enterica serovar Typhi Ty2
cccggagagagcaacu

SEQ ID NO: 3717231 - RNA, 21 nt, Salmonella enterica enterica serovar Typhi Ty2
cccggagagagcaacuggcaa

SEQ ID NO: 3717232 - RNA, 18 nt, Salmonella enterica enterica serovar Typhi Ty2
cccggagggguuuucgcc

SEQ ID NO: 3717233 - RNA, 20 nt, Salmonella enterica enterica serovar Typhi Ty2
cccggaucgcuaauuuuuaa

SEQ ID NO: 3717234 - RNA, 14 nt, Salmonella enterica enterica serovar Typhi Ty2
cccggcaacugcgc

SEQ ID NO: 3717235 - RNA, 24 nt, Salmonella enterica enterica serovar Typhi Ty2
cccggcaauuaccgccagcggcgu

SEQ ID NO: 3717236 - RNA, 12 nt, Salmonella enterica enterica serovar Typhi Ty2
cccggcaggcau

SEQ ID NO: 3717237 - RNA, 15 nt, Salmonella enterica enterica serovar Typhi Ty2
cccggcauacgccgg

SEQ ID NO: 3717238 - RNA, 18 nt, Salmonella enterica enterica serovar Typhi Ty2
cccggcaucaagcugcug

SEQ ID NO: 3717239 - RNA, 12 nt, Salmonella enterica enterica serovar Typhi Ty2
cccggccacagc

SEQ ID NO: 3717240 - RNA, 17 nt, Salmonella enterica enterica serovar Typhi Ty2
cccggccacagcgccag

SEQ ID NO: 3717241 - RNA, 14 nt, Salmonella enterica enterica serovar Typhi Ty2
cccggcccgccgcu

SEQ ID NO: 3717242 - RNA, 14 nt, Salmonella enterica enterica serovar Typhi Ty2
cccggccugacgca

SEQ ID NO: 3717243 - RNA, 22 nt, Salmonella enterica enterica serovar Typhi Ty2
cccggccuucgaacagcucauu

SEQ ID NO: 3717244 - RNA, 12 nt, Salmonella enterica enterica serovar Typhi Ty2
cccggcgcagcg

SEQ ID NO: 3717245 - RNA, 21 nt, Salmonella enterica enterica serovar Typhi Ty2
cccggcgccaaucaccgccag

SEQ ID NO: 3717246 - RNA, 16 nt, Salmonella enterica enterica serovar Typhi Ty2
cccggcgccagcucaa

SEQ ID NO: 3717247 - RNA, 15 nt, Salmonella enterica enterica serovar Typhi Ty2
cccggcgcgacgccg

SEQ ID NO: 3717248 - RNA, 11 nt, Salmonella enterica enterica serovar Typhi Ty2
cccggcuaaac

SEQ ID NO: 3717249 - RNA, 21 nt, Salmonella enterica enterica serovar Typhi Ty2
cccggcuuaccggcuaucagc

SEQ ID NO: 3717250 - RNA, 15 nt, Salmonella enterica enterica serovar Typhi Ty2
cccggcuuccagcgg

SEQ ID NO: 3717251 - RNA, 20 nt, Salmonella enterica enterica serovar Typhi Ty2
cccggcuuuauuacuucuuc

SEQ ID NO: 3717252 - RNA, 24 nt, Salmonella enterica enterica serovar Typhi Ty2
cccggcuuuuuuauugccuaagau

SEQ ID NO: 3717253 - RNA, 20 nt, Salmonella enterica enterica serovar Typhi Ty2
cccgggagaacgccgggccu

SEQ ID NO: 3717254 - RNA, 19 nt, Salmonella enterica enterica serovar Typhi Ty2
cccgguaagcgcagcgcca

SEQ ID NO: 3717255 - RNA, 16 nt, Salmonella enterica enterica serovar Typhi Ty2
cccggucaacgcgccg

SEQ ID NO: 3717256 - RNA, 18 nt, Salmonella enterica enterica serovar Typhi Ty2
cccggucaacgcgccgcc

SEQ ID NO: 3717257 - RNA, 19 nt, Salmonella enterica enterica serovar Typhi Ty2
cccggucaacgcgccgcca

SEQ ID NO: 3717258 - RNA, 23 nt, Salmonella enterica enterica serovar Typhi Ty2
cccggucaagcgcaaucacguua

SEQ ID NO: 3717259 - RNA, 17 nt, Salmonella enterica enterica serovar Typhi Ty2
cccggucugucgguaaa

SEQ ID NO: 3717260 - RNA, 16 nt, Salmonella enterica enterica serovar Typhi Ty2
cccggugagcgccgcg

SEQ ID NO: 3717261 - RNA, 17 nt, Salmonella enterica enterica serovar Typhi Ty2
cccggugagcgccgcgc

SEQ ID NO: 3717262 - RNA, 12 nt, Salmonella enterica enterica serovar Typhi Ty2
cccgguggcggc

SEQ ID NO: 3717263 - RNA, 11 nt, Salmonella enterica enterica serovar Typhi Ty2
cccggugggca

SEQ ID NO: 3717264 - RNA, 19 nt, Salmonella enterica enterica serovar Typhi Ty2
cccggugucaaagcgccag

SEQ ID NO: 3717265 - RNA, 22 nt, Salmonella enterica enterica serovar Typhi Ty2
cccgguucgccgcuucaaaaac

SEQ ID NO: 3717266 - RNA, 23 nt, Salmonella enterica enterica serovar Typhi Ty2
cccgguuuaugcgguucucccgg

SEQ ID NO: 3717267 - RNA, 23 nt, Salmonella enterica enterica serovar Typhi Ty2
cccgguuugggcgcgaaacugcu

SEQ ID NO: 3717268 - RNA, 15 nt, Salmonella enterica enterica serovar Typhi Ty2
cccguacaaggucgg

SEQ ID NO: 3717269 - RNA, 23 nt, Salmonella enterica enterica serovar Typhi Ty2
cccguagauaagcgccacgucgg

SEQ ID NO: 3717270 - RNA, 15 nt, Salmonella enterica enterica serovar Typhi Ty2
cccguagugauagca

SEQ ID NO: 3717271 - RNA, 16 nt, Salmonella enterica enterica serovar Typhi Ty2
cccguauucaggcgau

SEQ ID NO: 3717272 - RNA, 15 nt, Salmonella enterica enterica serovar Typhi Ty2
cccgucccaccacgc

SEQ ID NO: 3717273 - RNA, 16 nt, Salmonella enterica enterica serovar Typhi Ty2
cccgucgccuguuucu

SEQ ID NO: 3717274 - RNA, 21 nt, Salmonella enterica enterica serovar Typhi Ty2
cccgucgccuguuucugcgcc

SEQ ID NO: 3717275 - RNA, 18 nt, Salmonella enterica enterica serovar Typhi Ty2
cccguggcgggaugcccc

SEQ ID NO: 3717276 - RNA, 22 nt, Salmonella enterica enterica serovar Typhi Ty2
cccguggugggguucccgagcg

SEQ ID NO: 3717277 - RNA, 15 nt, Salmonella enterica enterica serovar Typhi Ty2
cccgugguuuuacug

SEQ ID NO: 3717278 - RNA, 22 nt, Salmonella enterica enterica serovar Typhi Ty2
cccguuaaauaccagcaccuga

SEQ ID NO: 3717279 - RNA, 12 nt, Salmonella enterica enterica serovar Typhi Ty2
cccguuauucau

SEQ ID NO: 3717280 - RNA, 22 nt, Salmonella enterica enterica serovar Typhi Ty2
cccguucacguuuuuacucuug

SEQ ID NO: 3717281 - RNA, 15 nt, Salmonella enterica enterica serovar Typhi Ty2
cccguucucgccgcg

SEQ ID NO: 3717282 - RNA, 16 nt, Salmonella enterica enterica serovar Typhi Ty2
cccguugcgucacgaa

SEQ ID NO: 3717283 - RNA, 15 nt, Salmonella enterica enterica serovar Typhi Ty2
cccguugucuucacc

SEQ ID NO: 3717284 - RNA, 21 nt, Salmonella enterica enterica serovar Typhi Ty2
cccguugucuucaccuugcug

SEQ ID NO: 3717285 - RNA, 19 nt, Salmonella enterica enterica serovar Typhi Ty2
cccguuugcgagacggcga

SEQ ID NO: 3717286 - RNA, 16 nt, Salmonella enterica enterica serovar Typhi Ty2
cccguuuucgccggau

SEQ ID NO: 3717287 - RNA, 20 nt, Salmonella enterica enterica serovar Typhi Ty2
cccuaaaaauagcaccaggc

SEQ ID NO: 3717288 - RNA, 19 nt, Salmonella enterica enterica serovar Typhi Ty2
cccuaaggcagcaagguac

SEQ ID NO: 3717289 - RNA, 16 nt, Salmonella enterica enterica serovar Typhi Ty2
cccuaaggucacgccg

SEQ ID NO: 3717290 - RNA, 17 nt, Salmonella enterica enterica serovar Typhi Ty2
cccuacgcuucucucca

SEQ ID NO: 3717291 - RNA, 19 nt, Salmonella enterica enterica serovar Typhi Ty2
cccuacgcuucucuccaua

SEQ ID NO: 3717292 - RNA, 17 nt, Salmonella enterica enterica serovar Typhi Ty2
cccuauaacagcgcugg

SEQ ID NO: 3717293 - RNA, 13 nt, Salmonella enterica enterica serovar Typhi Ty2
cccuaucccaauu

SEQ ID NO: 3717294 - RNA, 14 nt, Salmonella enterica enterica serovar Typhi Ty2
cccucaacgcgccc

SEQ ID NO: 3717295 - RNA, 23 nt, Salmonella enterica enterica serovar Typhi Ty2
cccucaaguuauguuauccccac

SEQ ID NO: 3717296 - RNA, 12 nt, Salmonella enterica enterica serovar Typhi Ty2
cccuccagccau

SEQ ID NO: 3717297 - RNA, 15 nt, Salmonella enterica enterica serovar Typhi Ty2
cccuccaguagcagc

SEQ ID NO: 3717298 - RNA, 17 nt, Salmonella enterica enterica serovar Typhi Ty2
cccuccaguagcagcga

SEQ ID NO: 3717299 - RNA, 20 nt, Salmonella enterica enterica serovar Typhi Ty2
cccuccaguagcagcgauga

SEQ ID NO: 3717300 - RNA, 16 nt, Salmonella enterica enterica serovar Typhi Ty2
cccuccggccagcgcc

SEQ ID NO: 3717301 - RNA, 19 nt, Salmonella enterica enterica serovar Typhi Ty2
cccuccugcuccaugcugu

SEQ ID NO: 3717302 - RNA, 12 nt, Salmonella enterica enterica serovar Typhi Ty2
cccucgccagca

SEQ ID NO: 3717303 - RNA, 13 nt, Salmonella enterica enterica serovar Typhi Ty2
cccucggcagcaa

SEQ ID NO: 3717304 - RNA, 22 nt, Salmonella enterica enterica serovar Typhi Ty2
cccucugaaacgcuucaccggc

SEQ ID NO: 3717305 - RNA, 22 nt, Salmonella enterica enterica serovar Typhi Ty2
cccucugauuggcuguuaguaa

SEQ ID NO: 3717306 - RNA, 17 nt, Salmonella enterica enterica serovar Typhi Ty2
cccucugcaccagaacu

SEQ ID NO: 3717307 - RNA, 14 nt, Salmonella enterica enterica serovar Typhi Ty2
cccucuuccaucag

SEQ ID NO: 3717308 - RNA, 22 nt, Salmonella enterica enterica serovar Typhi Ty2
cccucuuccaucagccaggcgg

SEQ ID NO: 3717309 - RNA, 16 nt, Salmonella enterica enterica serovar Typhi Ty2
cccugaaaccguggaa

SEQ ID NO: 3717310 - RNA, 11 nt, Salmonella enterica enterica serovar Typhi Ty2
cccugaaacug

SEQ ID NO: 3717311 - RNA, 18 nt, Salmonella enterica enterica serovar Typhi Ty2
cccugacacuguagcaac

SEQ ID NO: 3717312 - RNA, 14 nt, Salmonella enterica enterica serovar Typhi Ty2
cccugacgccgcug

SEQ ID NO: 3717313 - RNA, 13 nt, Salmonella enterica enterica serovar Typhi Ty2
cccugagcccaca

SEQ ID NO: 3717314 - RNA, 19 nt, Salmonella enterica enterica serovar Typhi Ty2
cccugagcgcuacgccugu

SEQ ID NO: 3717315 - RNA, 21 nt, Salmonella enterica enterica serovar Typhi Ty2
cccugauauacaaaacccaua

SEQ ID NO: 3717316 - RNA, 23 nt, Salmonella enterica enterica serovar Typhi Ty2
cccugauauacaaaacccauauc

SEQ ID NO: 3717317 - RNA, 19 nt, Salmonella enterica enterica serovar Typhi Ty2
cccugaugcguauccagcg

SEQ ID NO: 3717318 - RNA, 20 nt, Salmonella enterica enterica serovar Typhi Ty2
cccugaugcguauccagcgc

SEQ ID NO: 3717319 - RNA, 23 nt, Salmonella enterica enterica serovar Typhi Ty2
cccugauggcgcgccacuucuuu

SEQ ID NO: 3717320 - RNA, 13 nt, Salmonella enterica enterica serovar Typhi Ty2
cccugauguagcu

SEQ ID NO: 3717321 - RNA, 21 nt, Salmonella enterica enterica serovar Typhi Ty2
cccugcaaacuauguacgcca

SEQ ID NO: 3717322 - RNA, 24 nt, Salmonella enterica enterica serovar Typhi Ty2
cccugcaaagcaaaaaucaccaca

SEQ ID NO: 3717323 - RNA, 13 nt, Salmonella enterica enterica serovar Typhi Ty2
cccugcaucagcu

SEQ ID NO: 3717324 - RNA, 17 nt, Salmonella enterica enterica serovar Typhi Ty2
cccugcauuauccacga

SEQ ID NO: 3717325 - RNA, 12 nt, Salmonella enterica enterica serovar Typhi Ty2
cccugccacagu

SEQ ID NO: 3717326 - RNA, 20 nt, Salmonella enterica enterica serovar Typhi Ty2
cccugccagcguaagcgccc

SEQ ID NO: 3717327 - RNA, 13 nt, Salmonella enterica enterica serovar Typhi Ty2
cccugcccaugaa

SEQ ID NO: 3717328 - RNA, 13 nt, Salmonella enterica enterica serovar Typhi Ty2
cccugcccgccag

SEQ ID NO: 3717329 - RNA, 24 nt, Salmonella enterica enterica serovar Typhi Ty2
cccugccggaaaaugcgccaggaa

SEQ ID NO: 3717330 - RNA, 22 nt, Salmonella enterica enterica serovar Typhi Ty2
cccugccguuugcgccagcccg

SEQ ID NO: 3717331 - RNA, 18 nt, Salmonella enterica enterica serovar Typhi Ty2
cccugcgaacagcgcucc

SEQ ID NO: 3717332 - RNA, 15 nt, Salmonella enterica enterica serovar Typhi Ty2
cccugcgcauacguc

SEQ ID NO: 3717333 - RNA, 19 nt, Salmonella enterica enterica serovar Typhi Ty2
cccugcgccagcauggcgu

SEQ ID NO: 3717334 - RNA, 19 nt, Salmonella enterica enterica serovar Typhi Ty2
cccugcgccucaagcgcuu

SEQ ID NO: 3717335 - RNA, 13 nt, Salmonella enterica enterica serovar Typhi Ty2
cccugcgcggccu

SEQ ID NO: 3717336 - RNA, 15 nt, Salmonella enterica enterica serovar Typhi Ty2
cccugcgcggccugc

SEQ ID NO: 3717337 - RNA, 17 nt, Salmonella enterica enterica serovar Typhi Ty2
cccugcgcuuucaacca

SEQ ID NO: 3717338 - RNA, 21 nt, Salmonella enterica enterica serovar Typhi Ty2
cccugcggauuacgaauaccg

SEQ ID NO: 3717339 - RNA, 16 nt, Salmonella enterica enterica serovar Typhi Ty2
cccugcgguagcgccg

SEQ ID NO: 3717340 - RNA, 22 nt, Salmonella enterica enterica serovar Typhi Ty2
cccugcgguagcuccagacagg

SEQ ID NO: 3717341 - RNA, 21 nt, Salmonella enterica enterica serovar Typhi Ty2
cccugcgucgcguaccagcgc

SEQ ID NO: 3717342 - RNA, 13 nt, Salmonella enterica enterica serovar Typhi Ty2
cccugcucccaca

SEQ ID NO: 3717343 - RNA, 17 nt, Salmonella enterica enterica serovar Typhi Ty2
cccugcuggcgcaugau

SEQ ID NO: 3717344 - RNA, 22 nt, Salmonella enterica enterica serovar Typhi Ty2
cccugcuugucgaucaucagac

SEQ ID NO: 3717345 - RNA, 14 nt, Salmonella enterica enterica serovar Typhi Ty2
cccuggauugugau

SEQ ID NO: 3717346 - RNA, 22 nt, Salmonella enterica enterica serovar Typhi Ty2
cccuggauugugauuccaguug

SEQ ID NO: 3717347 - RNA, 23 nt, Salmonella enterica enterica serovar Typhi Ty2
cccuggcgaauaaaauucagcgc

SEQ ID NO: 3717348 - RNA, 21 nt, Salmonella enterica enterica serovar Typhi Ty2
cccuggcucaauccaggugga

SEQ ID NO: 3717349 - RNA, 15 nt, Salmonella enterica enterica serovar Typhi Ty2
cccuggcugguuaau

SEQ ID NO: 3717350 - RNA, 16 nt, Salmonella enterica enterica serovar Typhi Ty2
cccuggggcgcucuuu

SEQ ID NO: 3717351 - RNA, 21 nt, Salmonella enterica enterica serovar Typhi Ty2
cccuguaacagaauuaacgca

SEQ ID NO: 3717352 - RNA, 14 nt, Salmonella enterica enterica serovar Typhi Ty2
cccuguccuccaug

SEQ ID NO: 3717353 - RNA, 22 nt, Salmonella enterica enterica serovar Typhi Ty2
cccuguuauucagggcuuuauu

SEQ ID NO: 3717354 - RNA, 14 nt, Salmonella enterica enterica serovar Typhi Ty2
cccuguucaaaaua

SEQ ID NO: 3717355 - RNA, 18 nt, Salmonella enterica enterica serovar Typhi Ty2
cccuguuccuguauuuga

SEQ ID NO: 3717356 - RNA, 15 nt, Salmonella enterica enterica serovar Typhi Ty2
cccuuaaagccgccc

SEQ ID NO: 3717357 - RNA, 16 nt, Salmonella enterica enterica serovar Typhi Ty2
cccuuaaauccggccu

SEQ ID NO: 3717358 - RNA, 14 nt, Salmonella enterica enterica serovar Typhi Ty2
cccuuaucaaaggc

SEQ ID NO: 3717359 - RNA, 21 nt, Salmonella enterica enterica serovar Typhi Ty2
cccuuaugucauucaggucua

SEQ ID NO: 3717360 - RNA, 23 nt, Salmonella enterica enterica serovar Typhi Ty2
cccuucaauaucaagauccaaca

SEQ ID NO: 3717361 - RNA, 13 nt, Salmonella enterica enterica serovar Typhi Ty2
cccuucaggaaua

SEQ ID NO: 3717362 - RNA, 14 nt, Salmonella enterica enterica serovar Typhi Ty2
cccuucaucuucca

SEQ ID NO: 3717363 - RNA, 16 nt, Salmonella enterica enterica serovar Typhi Ty2
cccuuccagacagcuu

SEQ ID NO: 3717364 - RNA, 14 nt, Salmonella enterica enterica serovar Typhi Ty2
cccuucccaggugg

SEQ ID NO: 3717365 - RNA, 15 nt, Salmonella enterica enterica serovar Typhi Ty2
cccuuccucuccccc

SEQ ID NO: 3717366 - RNA, 22 nt, Salmonella enterica enterica serovar Typhi Ty2
cccuucgacaaucagcaccauu

SEQ ID NO: 3717367 - RNA, 17 nt, Salmonella enterica enterica serovar Typhi Ty2
cccuucgcccucgccag

SEQ ID NO: 3717368 - RNA, 23 nt, Salmonella enterica enterica serovar Typhi Ty2
cccuucgcggaauuucaggaagc

SEQ ID NO: 3717369 - RNA, 23 nt, Salmonella enterica enterica serovar Typhi Ty2
cccuucgcuauccaucgccgcgc

SEQ ID NO: 3717370 - RNA, 16 nt, Salmonella enterica enterica serovar Typhi Ty2
cccuucgcuguccauu

SEQ ID NO: 3717371 - RNA, 17 nt, Salmonella enterica enterica serovar Typhi Ty2
cccuucucgcuaauauc

SEQ ID NO: 3717372 - RNA, 18 nt, Salmonella enterica enterica serovar Typhi Ty2
cccuucuucuggcucaga

SEQ ID NO: 3717373 - RNA, 19 nt, Salmonella enterica enterica serovar Typhi Ty2
cccuucuuuaucuucugcu

SEQ ID NO: 3717374 - RNA, 20 nt, Salmonella enterica enterica serovar Typhi Ty2
cccuucuuuaugcgccuucu

SEQ ID NO: 3717375 - RNA, 21 nt, Salmonella enterica enterica serovar Typhi Ty2
cccuucuuuuacugccccgcc

SEQ ID NO: 3717376 - RNA, 16 nt, Salmonella enterica enterica serovar Typhi Ty2
cccuugccgcuuccag

SEQ ID NO: 3717377 - RNA, 12 nt, Salmonella enterica enterica serovar Typhi Ty2
cccuugcgcguu

SEQ ID NO: 3717378 - RNA, 22 nt, Salmonella enterica enterica serovar Typhi Ty2
cccuuguacaggauauacuuca

SEQ ID NO: 3717379 - RNA, 23 nt, Salmonella enterica enterica serovar Typhi Ty2
cccuuguuauccuaaaucugcca

SEQ ID NO: 3717380 - RNA, 16 nt, Salmonella enterica enterica serovar Typhi Ty2
cccuuuacacguucca

SEQ ID NO: 3717381 - RNA, 20 nt, Salmonella enterica enterica serovar Typhi Ty2
cccuuuaggcggcgccgcgc

SEQ ID NO: 3717382 - RNA, 19 nt, Salmonella enterica enterica serovar Typhi Ty2
cccuuucauucgucaaauu

SEQ ID NO: 3717383 - RNA, 19 nt, Salmonella enterica enterica serovar Typhi Ty2
cccuuucgguucgccgcgc

SEQ ID NO: 3717384 - RNA, 13 nt, Salmonella enterica enterica serovar Typhi Ty2
cccuuucuuaugc

SEQ ID NO: 3717385 - RNA, 18 nt, Salmonella enterica enterica serovar Typhi Ty2
cccuuuuuaaaaugaccg

SEQ ID NO: 3717386 - RNA, 11 nt, Salmonella enterica enterica serovar Typhi Ty2
cccuuuuucaa

SEQ ID NO: 3717387 - RNA, 13 nt, Salmonella enterica enterica serovar Typhi Ty2
cccuuuuucaauu

SEQ ID NO: 3717388 - RNA, 22 nt, Salmonella enterica enterica serovar Typhi Ty2
ccgauagcugaagugcggauag

SEQ ID NO: 3717389 - RNA, 20 nt, Salmonella enterica enterica serovar Typhi Ty2
ccgauagugcaagcucaucg

SEQ ID NO: 3717390 - RNA, 21 nt, Salmonella enterica enterica serovar Typhi Ty2
ccgauaguguaaacgcgccau

SEQ ID NO: 3717391 - RNA, 23 nt, Salmonella enterica enterica serovar Typhi Ty2
ccgauauugccuucacccagacu

SEQ ID NO: 3717392 - RNA, 16 nt, Salmonella enterica enterica serovar Typhi Ty2
ccgaucaccagcgcau

SEQ ID NO: 3717393 - RNA, 12 nt, Salmonella enterica enterica serovar Typhi Ty2
ccgaucagauug

SEQ ID NO: 3717394 - RNA, 13 nt, Salmonella enterica enterica serovar Typhi Ty2
ccgaucagauuga

SEQ ID NO: 3717395 - RNA, 23 nt, Salmonella enterica enterica serovar Typhi Ty2
ccgaucaucguaccaauacccag

SEQ ID NO: 3717396 - RNA, 23 nt, Salmonella enterica enterica serovar Typhi Ty2
ccgauccgaagaacagauucauu

SEQ ID NO: 3717397 - RNA, 22 nt, Salmonella enterica enterica serovar Typhi Ty2
ccgaucgagucacccugcaaca

SEQ ID NO: 3717398 - RNA, 12 nt, Salmonella enterica enterica serovar Typhi Ty2
ccgaucucccag

SEQ ID NO: 3717399 - RNA, 13 nt, Salmonella enterica enterica serovar Typhi Ty2
ccgaucucccagc

SEQ ID NO: 3717400 - RNA, 21 nt, Salmonella enterica enterica serovar Typhi Ty2
ccgaucugguuauccaccagc

SEQ ID NO: 3717401 - RNA, 14 nt, Salmonella enterica enterica serovar Typhi Ty2
ccgaugcccagcuu

SEQ ID NO: 3717402 - RNA, 17 nt, Salmonella enterica enterica serovar Typhi Ty2
ccgauggacucccaggu

SEQ ID NO: 3717403 - RNA, 23 nt, Salmonella enterica enterica serovar Typhi Ty2
ccgauggcgcugcguuuaucagg

SEQ ID NO: 3717404 - RNA, 16 nt, Salmonella enterica enterica serovar Typhi Ty2
ccgaugguauuuauuc

SEQ ID NO: 3717405 - RNA, 18 nt, Salmonella enterica enterica serovar Typhi Ty2
ccgauucugccaguucac

SEQ ID NO: 3717406 - RNA, 14 nt, Salmonella enterica enterica serovar Typhi Ty2
ccgauuuugaacau

SEQ ID NO: 3717407 - RNA, 12 nt, Salmonella enterica enterica serovar Typhi Ty2
ccgauuuuucgg

SEQ ID NO: 3717408 - RNA, 18 nt, Salmonella enterica enterica serovar Typhi Ty2
ccgauuuuucggcacgcu

SEQ ID NO: 3717409 - RNA, 23 nt, Salmonella enterica enterica serovar Typhi Ty2
ccgcaaaaugaggacacaguaau

SEQ ID NO: 3717410 - RNA, 16 nt, Salmonella enterica enterica serovar Typhi Ty2
ccgcaaacagagcgcc

SEQ ID NO: 3717411 - RNA, 22 nt, Salmonella enterica enterica serovar Typhi Ty2
ccgcaaacagcacgcccugcca

SEQ ID NO: 3717412 - RNA, 16 nt, Salmonella enterica enterica serovar Typhi Ty2
ccgcaaaccagaccaa

SEQ ID NO: 3717413 - RNA, 22 nt, Salmonella enterica enterica serovar Typhi Ty2
ccgcaaacgccgugaacgccaa

SEQ ID NO: 3717414 - RNA, 15 nt, Salmonella enterica enterica serovar Typhi Ty2
ccgcaaacuggccac

SEQ ID NO: 3717415 - RNA, 21 nt, Salmonella enterica enterica serovar Typhi Ty2
ccgcaaacuggccacagcaaa

SEQ ID NO: 3717416 - RNA, 20 nt, Salmonella enterica enterica serovar Typhi Ty2
ccgcaaaggaucaucggcca

SEQ ID NO: 3717417 - RNA, 20 nt, Salmonella enterica enterica serovar Typhi Ty2
ccgcaaauccacuggucguc

SEQ ID NO: 3717418 - RNA, 18 nt, Salmonella enterica enterica serovar Typhi Ty2
ccgcaaauuccaccacgu

SEQ ID NO: 3717419 - RNA, 17 nt, Salmonella enterica enterica serovar Typhi Ty2
ccgcaaccacggcgcag

SEQ ID NO: 3717420 - RNA, 16 nt, Salmonella enterica enterica serovar Typhi Ty2
ccgcaacccgauaagc

SEQ ID NO: 3717421 - RNA, 15 nt, Salmonella enterica enterica serovar Typhi Ty2
ccgcaacggucgguc

SEQ ID NO: 3717422 - RNA, 16 nt, Salmonella enterica enterica serovar Typhi Ty2
ccgcaacucucgauau

SEQ ID NO: 3717423 - RNA, 23 nt, Salmonella enterica enterica serovar Typhi Ty2
ccgcaagaaacaggcugacaaag

SEQ ID NO: 3717424 - RNA, 23 nt, Salmonella enterica enterica serovar Typhi Ty2
ccgcaauaacgccgauaaccagc

SEQ ID NO: 3717425 - RNA, 15 nt, Salmonella enterica enterica serovar Typhi Ty2
ccgcaauacagcccg

SEQ ID NO: 3717426 - RNA, 22 nt, Salmonella enterica enterica serovar Typhi Ty2
ccgcaauaccaauuaccggcuu

SEQ ID NO: 3717427 - RNA, 13 nt, Salmonella enterica enterica serovar Typhi Ty2
ccgcaauccccug

SEQ ID NO: 3717428 - RNA, 13 nt, Salmonella enterica enterica serovar Typhi Ty2
ccgcaaucuggcg

SEQ ID NO: 3717429 - RNA, 14 nt, Salmonella enterica enterica serovar Typhi Ty2
ccgcacagcagaca

SEQ ID NO: 3717430 - RNA, 23 nt, Salmonella enterica enterica serovar Typhi Ty2
ccgcacagcagacaaccgacgca

SEQ ID NO: 3717431 - RNA, 14 nt, Salmonella enterica enterica serovar Typhi Ty2
ccgcacauaaucac

SEQ ID NO: 3717432 - RNA, 21 nt, Salmonella enterica enterica serovar Typhi Ty2
ccgcaccauucaccgauaagc

SEQ ID NO: 3717433 - RNA, 21 nt, Salmonella enterica enterica serovar Typhi Ty2
ccgcaccuggguauuccacug

SEQ ID NO: 3717434 - RNA, 23 nt, Salmonella enterica enterica serovar Typhi Ty2
ccgcacgcgaccagacacggugu

SEQ ID NO: 3717435 - RNA, 16 nt, Salmonella enterica enterica serovar Typhi Ty2
ccgcacgguuagccgg

SEQ ID NO: 3717436 - RNA, 21 nt, Salmonella enterica enterica serovar Typhi Ty2
ccgcagauccagcacggccuu

SEQ ID NO: 3717437 - RNA, 14 nt, Salmonella enterica enterica serovar Typhi Ty2
ccgcagccaacaac

SEQ ID NO: 3717438 - RNA, 21 nt, Salmonella enterica enterica serovar Typhi Ty2
ccgcagccaacaacaggccgc

SEQ ID NO: 3717439 - RNA, 22 nt, Salmonella enterica enterica serovar Typhi Ty2
ccgcagccaacaacaggccgcc

SEQ ID NO: 3717440 - RNA, 11 nt, Salmonella enterica enterica serovar Typhi Ty2
ccgcagccacu

SEQ ID NO: 3717441 - RNA, 14 nt, Salmonella enterica enterica serovar Typhi Ty2
ccgcagccagaaca

SEQ ID NO: 3717442 - RNA, 21 nt, Salmonella enterica enterica serovar Typhi Ty2
ccgcagcccgcccacaggcug

SEQ ID NO: 3717443 - RNA, 19 nt, Salmonella enterica enterica serovar Typhi Ty2
ccgcagccgcaaucagcgu

SEQ ID NO: 3717444 - RNA, 19 nt, Salmonella enterica enterica serovar Typhi Ty2
ccgcagccgcucaggguaa

SEQ ID NO: 3717445 - RNA, 12 nt, Salmonella enterica enterica serovar Typhi Ty2
ccgcagcgccau

SEQ ID NO: 3717446 - RNA, 17 nt, Salmonella enterica enterica serovar Typhi Ty2
ccgcaggacagcgacau

SEQ ID NO: 3717447 - RNA, 14 nt, Salmonella enterica enterica serovar Typhi Ty2
ccgcaggccuggcu

SEQ ID NO: 3717448 - RNA, 17 nt, Salmonella enterica enterica serovar Typhi Ty2
ccgcaggcucuuuuucu

SEQ ID NO: 3717449 - RNA, 22 nt, Salmonella enterica enterica serovar Typhi Ty2
ccgcaggguauaugagcgcagg

SEQ ID NO: 3717450 - RNA, 20 nt, Salmonella enterica enterica serovar Typhi Ty2
ccgcagugaagaauggcgcc

SEQ ID NO: 3717451 - RNA, 12 nt, Salmonella enterica enterica serovar Typhi Ty2
ccgcauacaucg

SEQ ID NO: 3717452 - RNA, 18 nt, Salmonella enterica enterica serovar Typhi Ty2
ccgcaucagcaacgcgcc

SEQ ID NO: 3717453 - RNA, 13 nt, Salmonella enterica enterica serovar Typhi Ty2
ccgcauccccaua

SEQ ID NO: 3717454 - RNA, 19 nt, Salmonella enterica enterica serovar Typhi Ty2
ccgcauccccauagacagu

SEQ ID NO: 3717455 - RNA, 14 nt, Salmonella enterica enterica serovar Typhi Ty2
ccgcaucgaccaua

SEQ ID NO: 3717456 - RNA, 19 nt, Salmonella enterica enterica serovar Typhi Ty2
ccgcaucgauacccugcug

SEQ ID NO: 3717457 - RNA, 13 nt, Salmonella enterica enterica serovar Typhi Ty2
ccgcaucgccaua

SEQ ID NO: 3717458 - RNA, 17 nt, Salmonella enterica enterica serovar Typhi Ty2
ccgcaucgcccgcuccc

SEQ ID NO: 3717459 - RNA, 14 nt, Salmonella enterica enterica serovar Typhi Ty2
ccgcaucgccgcgg

SEQ ID NO: 3717460 - RNA, 15 nt, Salmonella enterica enterica serovar Typhi Ty2
ccgcaugugcggcgc

SEQ ID NO: 3717461 - RNA, 16 nt, Salmonella enterica enterica serovar Typhi Ty2
ccgcauuauaaauauc

SEQ ID NO: 3717462 - RNA, 16 nt, Salmonella enterica enterica serovar Typhi Ty2
ccgcauucuugccgca

SEQ ID NO: 3717463 - RNA, 17 nt, Salmonella enterica enterica serovar Typhi Ty2
ccgcauuuuaaacgauc

SEQ ID NO: 3717464 - RNA, 20 nt, Salmonella enterica enterica serovar Typhi Ty2
ccgccaaaccggcgaauagc

SEQ ID NO: 3717465 - RNA, 14 nt, Salmonella enterica enterica serovar Typhi Ty2
ccgccaaagcgccc

SEQ ID NO: 3717466 - RNA, 19 nt, Salmonella enterica enterica serovar Typhi Ty2
ccgccaagauuaagaccgu

SEQ ID NO: 3717467 - RNA, 13 nt, Salmonella enterica enterica serovar Typhi Ty2
ccgccaagcgcgg

SEQ ID NO: 3717468 - RNA, 18 nt, Salmonella enterica enterica serovar Typhi Ty2
ccgccaagcgcggacagc

SEQ ID NO: 3717469 - RNA, 13 nt, Salmonella enterica enterica serovar Typhi Ty2
ccgccaauaacca

SEQ ID NO: 3717470 - RNA, 14 nt, Salmonella enterica enterica serovar Typhi Ty2
ccgccgccgggccg

SEQ ID NO: 3717471 - RNA, 13 nt, Salmonella enterica enterica serovar Typhi Ty2
ccgccgcgaccag

SEQ ID NO: 3717472 - RNA, 17 nt, Salmonella enterica enterica serovar Typhi Ty2
ccgccgcgauguuugcu

SEQ ID NO: 3717473 - RNA, 14 nt, Salmonella enterica enterica serovar Typhi Ty2
ccgccgcggccagc

SEQ ID NO: 3717474 - RNA, 12 nt, Salmonella enterica enterica serovar Typhi Ty2
ccgccgcgguga

SEQ ID NO: 3717475 - RNA, 18 nt, Salmonella enterica enterica serovar Typhi Ty2
ccgccgcuauuaccccgc

SEQ ID NO: 3717476 - RNA, 15 nt, Salmonella enterica enterica serovar Typhi Ty2
ccgccgcuggcuggc

SEQ ID NO: 3717477 - RNA, 23 nt, Salmonella enterica enterica serovar Typhi Ty2
ccgccggagaggggacucaccgu

SEQ ID NO: 3717478 - RNA, 11 nt, Salmonella enterica enterica serovar Typhi Ty2
ccgccggaggg

SEQ ID NO: 3717479 - RNA, 12 nt, Salmonella enterica enterica serovar Typhi Ty2
ccgccggcagca

SEQ ID NO: 3717480 - RNA, 15 nt, Salmonella enterica enterica serovar Typhi Ty2
ccgccggcagcagcu

SEQ ID NO: 3717481 - RNA, 17 nt, Salmonella enterica enterica serovar Typhi Ty2
ccgccgggcauaugauc

SEQ ID NO: 3717482 - RNA, 21 nt, Salmonella enterica enterica serovar Typhi Ty2
ccgccgguuuauccccgcugg

SEQ ID NO: 3717483 - RNA, 20 nt, Salmonella enterica enterica serovar Typhi Ty2
ccgccgugauaaauacgcug

SEQ ID NO: 3717484 - RNA, 21 nt, Salmonella enterica enterica serovar Typhi Ty2
ccgccuaacagcgccgcgccg

SEQ ID NO: 3717485 - RNA, 16 nt, Salmonella enterica enterica serovar Typhi Ty2
ccgccuaccagcacau

SEQ ID NO: 3717486 - RNA, 15 nt, Salmonella enterica enterica serovar Typhi Ty2
ccgccuagcgucccg

SEQ ID NO: 3717487 - RNA, 12 nt, Salmonella enterica enterica serovar Typhi Ty2
ccgccucaaacg

SEQ ID NO: 3717488 - RNA, 20 nt, Salmonella enterica enterica serovar Typhi Ty2
ccgccucaauugccgccagc

SEQ ID NO: 3717489 - RNA, 13 nt, Salmonella enterica enterica serovar Typhi Ty2
ccgccuccuccgg

SEQ ID NO: 3717490 - RNA, 16 nt, Salmonella enterica enterica serovar Typhi Ty2
ccgccucgaccccuuc

SEQ ID NO: 3717491 - RNA, 23 nt, Salmonella enterica enterica serovar Typhi Ty2
ccgccugacgaaagucauccagu

SEQ ID NO: 3717492 - RNA, 19 nt, Salmonella enterica enterica serovar Typhi Ty2
ccgccugauuuaaugaacc

SEQ ID NO: 3717493 - RNA, 13 nt, Salmonella enterica enterica serovar Typhi Ty2
ccgccugccagau

SEQ ID NO: 3717494 - RNA, 22 nt, Salmonella enterica enterica serovar Typhi Ty2
ccgccugccagauccaacacau

SEQ ID NO: 3717495 - RNA, 14 nt, Salmonella enterica enterica serovar Typhi Ty2
ccgccugccgcgcc

SEQ ID NO: 3717496 - RNA, 15 nt, Salmonella enterica enterica serovar Typhi Ty2
ccgccugccgcgccc

SEQ ID NO: 3717497 - RNA, 16 nt, Salmonella enterica enterica serovar Typhi Ty2
ccgccugccgcgccgc

SEQ ID NO: 3717498 - RNA, 18 nt, Salmonella enterica enterica serovar Typhi Ty2
ccgccugccgcgccgccg

SEQ ID NO: 3717499 - RNA, 18 nt, Salmonella enterica enterica serovar Typhi Ty2
ccgccugcgccagcgccg

SEQ ID NO: 3717500 - RNA, 15 nt, Salmonella enterica enterica serovar Typhi Ty2
ccgccuggcgcgacu

SEQ ID NO: 3717501 - RNA, 19 nt, Salmonella enterica enterica serovar Typhi Ty2
ccgccuuaagaauguccau

SEQ ID NO: 3717502 - RNA, 13 nt, Salmonella enterica enterica serovar Typhi Ty2
ccgccuuaccgcg

SEQ ID NO: 3717503 - RNA, 15 nt, Salmonella enterica enterica serovar Typhi Ty2
ccgccuugcggcggc

SEQ ID NO: 3717504 - RNA, 16 nt, Salmonella enterica enterica serovar Typhi Ty2
ccgccuuguccggccu

SEQ ID NO: 3717505 - RNA, 21 nt, Salmonella enterica enterica serovar Typhi Ty2
ccgcgaaaaacgauauucgcg

SEQ ID NO: 3717506 - RNA, 23 nt, Salmonella enterica enterica serovar Typhi Ty2
ccgcgaacaaagccccgggcgcu

SEQ ID NO: 3717507 - RNA, 23 nt, Salmonella enterica enterica serovar Typhi Ty2
ccgcgacaucguuuccagcgaau

SEQ ID NO: 3717508 - RNA, 22 nt, Salmonella enterica enterica serovar Typhi Ty2
ccgcgacuuuggcuuuauccgg

SEQ ID NO: 3717509 - RNA, 17 nt, Salmonella enterica enterica serovar Typhi Ty2
ccgcgagaacuuccgcc

SEQ ID NO: 3717510 - RNA, 19 nt, Salmonella enterica enterica serovar Typhi Ty2
ccgcgauagaccacgccau

SEQ ID NO: 3717511 - RNA, 23 nt, Salmonella enterica enterica serovar Typhi Ty2
ccgcgauagaccacgccaucaac

SEQ ID NO: 3717512 - RNA, 17 nt, Salmonella enterica enterica serovar Typhi Ty2
ccgcgauuuagcguugg

SEQ ID NO: 3717513 - RNA, 18 nt, Salmonella enterica enterica serovar Typhi Ty2
ccgcgcacaaaaggcugg

SEQ ID NO: 3717514 - RNA, 21 nt, Salmonella enterica enterica serovar Typhi Ty2
ccgcgcagaaucacuucaucc

SEQ ID NO: 3717515 - RNA, 15 nt, Salmonella enterica enterica serovar Typhi Ty2
ccgcgcauagcuggc

SEQ ID NO: 3717516 - RNA, 15 nt, Salmonella enterica enterica serovar Typhi Ty2
ccgcgcauggccaua

SEQ ID NO: 3717517 - RNA, 14 nt, Salmonella enterica enterica serovar Typhi Ty2
ccgcgcauguaacc

SEQ ID NO: 3717518 - RNA, 17 nt, Salmonella enterica enterica serovar Typhi Ty2
ccgcgccaaacguggcg

SEQ ID NO: 3717519 - RNA, 13 nt, Salmonella enterica enterica serovar Typhi Ty2
ccgcgccagcgau

SEQ ID NO: 3717520 - RNA, 13 nt, Salmonella enterica enterica serovar Typhi Ty2
ccgcgccgauagc

SEQ ID NO: 3717521 - RNA, 11 nt, Salmonella enterica enterica serovar Typhi Ty2
ccgcgccgccg

SEQ ID NO: 3717522 - RNA, 12 nt, Salmonella enterica enterica serovar Typhi Ty2
ccgcgccgccgc

SEQ ID NO: 3717523 - RNA, 14 nt, Salmonella enterica enterica serovar Typhi Ty2
ccgcgccgccgccg

SEQ ID NO: 3717524 - RNA, 11 nt, Salmonella enterica enterica serovar Typhi Ty2
ccgcgccggac

SEQ ID NO: 3717525 - RNA, 15 nt, Salmonella enterica enterica serovar Typhi Ty2
ccgcgccuaccagcg

SEQ ID NO: 3717526 - RNA, 11 nt, Salmonella enterica enterica serovar Typhi Ty2
ccgcgccugaa

SEQ ID NO: 3717527 - RNA, 19 nt, Salmonella enterica enterica serovar Typhi Ty2
ccgcgccuucgcggugauc

SEQ ID NO: 3717528 - RNA, 13 nt, Salmonella enterica enterica serovar Typhi Ty2
ccgcgcgaagagg

SEQ ID NO: 3717529 - RNA, 14 nt, Salmonella enterica enterica serovar Typhi Ty2
ccgcgcgccgccuc

SEQ ID NO: 3717530 - RNA, 15 nt, Salmonella enterica enterica serovar Typhi Ty2
ccgcgcgcuuuccac

SEQ ID NO: 3717531 - RNA, 14 nt, Salmonella enterica enterica serovar Typhi Ty2
ccgcgcggcguucu

SEQ ID NO: 3717532 - RNA, 18 nt, Salmonella enterica enterica serovar Typhi Ty2
ccgcgcuagugccgccag

SEQ ID NO: 3717533 - RNA, 22 nt, Salmonella enterica enterica serovar Typhi Ty2
ccgcgcuagugccgccaggcaa

SEQ ID NO: 3717534 - RNA, 20 nt, Salmonella enterica enterica serovar Typhi Ty2
ccgcgcuaucgggucugcgc

SEQ ID NO: 3717535 - RNA, 21 nt, Salmonella enterica enterica serovar Typhi Ty2
ccgcgcuccuggaaccaguga

SEQ ID NO: 3717536 - RNA, 15 nt, Salmonella enterica enterica serovar Typhi Ty2
ccgcgcugaugcagc

SEQ ID NO: 3717537 - RNA, 19 nt, Salmonella enterica enterica serovar Typhi Ty2
ccgcgcuuuaugcagucgg

SEQ ID NO: 3717538 - RNA, 16 nt, Salmonella enterica enterica serovar Typhi Ty2
ccgcggacuuauuaac

SEQ ID NO: 3717539 - RNA, 19 nt, Salmonella enterica enterica serovar Typhi Ty2
ccgcggagaucgcucccgc

SEQ ID NO: 3717540 - RNA, 19 nt, Salmonella enterica enterica serovar Typhi Ty2
ccgcggcauuaauccgugc

SEQ ID NO: 3717541 - RNA, 17 nt, Salmonella enterica enterica serovar Typhi Ty2
ccgcggcgaucuccuga

SEQ ID NO: 3717542 - RNA, 15 nt, Salmonella enterica enterica serovar Typhi Ty2
ccgcggcggacagcg

SEQ ID NO: 3717543 - RNA, 21 nt, Salmonella enterica enterica serovar Typhi Ty2
ccgcggggaucgguuuauccc

SEQ ID NO: 3717544 - RNA, 19 nt, Salmonella enterica enterica serovar Typhi Ty2
ccgcgguacgaaucgccgc

SEQ ID NO: 3717545 - RNA, 21 nt, Salmonella enterica enterica serovar Typhi Ty2
ccgcgguacgaaucgccgcgc

SEQ ID NO: 3717546 - RNA, 13 nt, Salmonella enterica enterica serovar Typhi Ty2
ccgcgguccagcc

SEQ ID NO: 3717547 - RNA, 14 nt, Salmonella enterica enterica serovar Typhi Ty2
ccgcguaaucgcga

SEQ ID NO: 3717548 - RNA, 16 nt, Salmonella enterica enterica serovar Typhi Ty2
ccgcguaaucuucgcg

SEQ ID NO: 3717549 - RNA, 13 nt, Salmonella enterica enterica serovar Typhi Ty2
ccgcguaaugacu

SEQ ID NO: 3717550 - RNA, 20 nt, Salmonella enterica enterica serovar Typhi Ty2
ccgcguagcccagcgccgca

SEQ ID NO: 3717551 - RNA, 15 nt, Salmonella enterica enterica serovar Typhi Ty2
ccgcguagcguuauc

SEQ ID NO: 3717552 - RNA, 19 nt, Salmonella enterica enterica serovar Typhi Ty2
ccgcguaggugaauagcau

SEQ ID NO: 3717553 - RNA, 21 nt, Salmonella enterica enterica serovar Typhi Ty2
ccggauaagcauuagcgccau

SEQ ID NO: 3717554 - RNA, 20 nt, Salmonella enterica enterica serovar Typhi Ty2
ccggauaagcgcagcgccau

SEQ ID NO: 3717555 - RNA, 22 nt, Salmonella enterica enterica serovar Typhi Ty2
ccggauaagcgcagcgccauca

SEQ ID NO: 3717556 - RNA, 16 nt, Salmonella enterica enterica serovar Typhi Ty2
ccggauaagcggcagc

SEQ ID NO: 3717557 - RNA, 20 nt, Salmonella enterica enterica serovar Typhi Ty2
ccggauaagcguagcgccau

SEQ ID NO: 3717558 - RNA, 21 nt, Salmonella enterica enterica serovar Typhi Ty2
ccggauaaggccacgccgcca

SEQ ID NO: 3717559 - RNA, 21 nt, Salmonella enterica enterica serovar Typhi Ty2
ccggauaaggcgcuugcgcca

SEQ ID NO: 3717560 - RNA, 21 nt, Salmonella enterica enterica serovar Typhi Ty2
ccggauaaggcgcuugugaua

SEQ ID NO: 3717561 - RNA, 22 nt, Salmonella enterica enterica serovar Typhi Ty2
ccggauaaggcguucacgccgc

SEQ ID NO: 3717562 - RNA, 20 nt, Salmonella enterica enterica serovar Typhi Ty2
ccggauaauacgaaauugag

SEQ ID NO: 3717563 - RNA, 16 nt, Salmonella enterica enterica serovar Typhi Ty2
ccggauacaagguauc

SEQ ID NO: 3717564 - RNA, 19 nt, Salmonella enterica enterica serovar Typhi Ty2
ccggauagcggcuucgcca

SEQ ID NO: 3717565 - RNA, 17 nt, Salmonella enterica enterica serovar Typhi Ty2
ccggauauguuugacaa

SEQ ID NO: 3717566 - RNA, 15 nt, Salmonella enterica enterica serovar Typhi Ty2
ccggaucaccggcau

SEQ ID NO: 3717567 - RNA, 12 nt, Salmonella enterica enterica serovar Typhi Ty2
ccggaucgaucc

SEQ ID NO: 3717568 - RNA, 16 nt, Salmonella enterica enterica serovar Typhi Ty2
ccggaucgaucccggc

SEQ ID NO: 3717569 - RNA, 16 nt, Salmonella enterica enterica serovar Typhi Ty2
ccggaucgcugagcaa

SEQ ID NO: 3717570 - RNA, 16 nt, Salmonella enterica enterica serovar Typhi Ty2
ccggaucggccauauc

SEQ ID NO: 3717571 - RNA, 17 nt, Salmonella enterica enterica serovar Typhi Ty2
ccggaucggucuggcgc

SEQ ID NO: 3717572 - RNA, 20 nt, Salmonella enterica enterica serovar Typhi Ty2
ccggaugacggcagcgcguu

SEQ ID NO: 3717573 - RNA, 14 nt, Salmonella enterica enterica serovar Typhi Ty2
ccggaugcagucug

SEQ ID NO: 3717574 - RNA, 20 nt, Salmonella enterica enterica serovar Typhi Ty2
ccggaugccagucaauaagc

SEQ ID NO: 3717575 - RNA, 16 nt, Salmonella enterica enterica serovar Typhi Ty2
ccggaugccccaucac

SEQ ID NO: 3717576 - RNA, 15 nt, Salmonella enterica enterica serovar Typhi Ty2
ccggaugcgacgcgc

SEQ ID NO: 3717577 - RNA, 16 nt, Salmonella enterica enterica serovar Typhi Ty2
ccggaugcgccucauc

SEQ ID NO: 3717578 - RNA, 23 nt, Salmonella enterica enterica serovar Typhi Ty2
ccggaugcgccucaucugcuuca

SEQ ID NO: 3717579 - RNA, 18 nt, Salmonella enterica enterica serovar Typhi Ty2
ccggauggcacugcgcuu

SEQ ID NO: 3717580 - RNA, 22 nt, Salmonella enterica enterica serovar Typhi Ty2
ccggauggcaguacagggcgau

SEQ ID NO: 3717581 - RNA, 19 nt, Salmonella enterica enterica serovar Typhi Ty2
ccggauggcgcuaaugcuu

SEQ ID NO: 3717582 - RNA, 14 nt, Salmonella enterica enterica serovar Typhi Ty2
ccggauggcggcgc

SEQ ID NO: 3717583 - RNA, 23 nt, Salmonella enterica enterica serovar Typhi Ty2
ccggauggcggcgugaccgccuu

SEQ ID NO: 3717584 - RNA, 22 nt, Salmonella enterica enterica serovar Typhi Ty2
ccggauggcggcugcgccuuau

SEQ ID NO: 3717585 - RNA, 21 nt, Salmonella enterica enterica serovar Typhi Ty2
ccggauguaggccugauaagc

SEQ ID NO: 3717586 - RNA, 16 nt, Salmonella enterica enterica serovar Typhi Ty2
ccggaugugagcgcau

SEQ ID NO: 3717587 - RNA, 22 nt, Salmonella enterica enterica serovar Typhi Ty2
ccggauuaaggcguuugcgccg

SEQ ID NO: 3717588 - RNA, 21 nt, Salmonella enterica enterica serovar Typhi Ty2
ccggauuagcgacagcgcuau

SEQ ID NO: 3717589 - RNA, 14 nt, Salmonella enterica enterica serovar Typhi Ty2
ccggauuccagaau

SEQ ID NO: 3717590 - RNA, 15 nt, Salmonella enterica enterica serovar Typhi Ty2
ccggauugcccgcgg

SEQ ID NO: 3717591 - RNA, 20 nt, Salmonella enterica enterica serovar Typhi Ty2
ccggcaaaaagaaucgccag

SEQ ID NO: 3717592 - RNA, 17 nt, Salmonella enterica enterica serovar Typhi Ty2
ccggcaaaaaucagccc

SEQ ID NO: 3717593 - RNA, 20 nt, Salmonella enterica enterica serovar Typhi Ty2
ccggcaaacccuuaacuggc

SEQ ID NO: 3717594 - RNA, 19 nt, Salmonella enterica enterica serovar Typhi Ty2
ccggcaaaccuaccggcau

SEQ ID NO: 3717595 - RNA, 14 nt, Salmonella enterica enterica serovar Typhi Ty2
ccggcaaacucagc

SEQ ID NO: 3717596 - RNA, 23 nt, Salmonella enterica enterica serovar Typhi Ty2
ccggcaaaggaauuacgggcgau

SEQ ID NO: 3717597 - RNA, 19 nt, Salmonella enterica enterica serovar Typhi Ty2
ccggcaaagguugccgcaa

SEQ ID NO: 3717598 - RNA, 13 nt, Salmonella enterica enterica serovar Typhi Ty2
ccggcaagcgcug

SEQ ID NO: 3717599 - RNA, 12 nt, Salmonella enterica enterica serovar Typhi Ty2
ccggcaaucaga

SEQ ID NO: 3717600 - RNA, 20 nt, Salmonella enterica enterica serovar Typhi Ty2
ccggcaaugauaucggccgg

SEQ ID NO: 3717601 - RNA, 16 nt, Salmonella enterica enterica serovar Typhi Ty2
ccggcacaaccuggcu

SEQ ID NO: 3717602 - RNA, 21 nt, Salmonella enterica enterica serovar Typhi Ty2
ccggcacaccggccauugccg

SEQ ID NO: 3717603 - RNA, 20 nt, Salmonella enterica enterica serovar Typhi Ty2
ccggcacauauuccggcgcu

SEQ ID NO: 3717604 - RNA, 21 nt, Salmonella enterica enterica serovar Typhi Ty2
ccggcacauccagcgccugcu

SEQ ID NO: 3717605 - RNA, 14 nt, Salmonella enterica enterica serovar Typhi Ty2
ccggcacgcgcagc

SEQ ID NO: 3717606 - RNA, 15 nt, Salmonella enterica enterica serovar Typhi Ty2
ccggcagacgauagc

SEQ ID NO: 3717607 - RNA, 18 nt, Salmonella enterica enterica serovar Typhi Ty2
ccggcagacggcugggcu

SEQ ID NO: 3717608 - RNA, 21 nt, Salmonella enterica enterica serovar Typhi Ty2
ccggcagcagugagcuuugca

SEQ ID NO: 3717609 - RNA, 16 nt, Salmonella enterica enterica serovar Typhi Ty2
ccggcagccgcugaua

SEQ ID NO: 3717610 - RNA, 16 nt, Salmonella enterica enterica serovar Typhi Ty2
ccggcagcgcauaagc

SEQ ID NO: 3717611 - RNA, 16 nt, Salmonella enterica enterica serovar Typhi Ty2
ccggcagcuuuugcgc

SEQ ID NO: 3717612 - RNA, 20 nt, Salmonella enterica enterica serovar Typhi Ty2
ccggcaggcagcgccagcgg

SEQ ID NO: 3717613 - RNA, 19 nt, Salmonella enterica enterica serovar Typhi Ty2
ccggcaggcucaccagccc

SEQ ID NO: 3717614 - RNA, 23 nt, Salmonella enterica enterica serovar Typhi Ty2
ccggcagggucguacuaaagagc

SEQ ID NO: 3717615 - RNA, 19 nt, Salmonella enterica enterica serovar Typhi Ty2
ccggcagguagucauauuc

SEQ ID NO: 3717616 - RNA, 23 nt, Salmonella enterica enterica serovar Typhi Ty2
ccggcaguccuugcagccagaac

SEQ ID NO: 3717617 - RNA, 19 nt, Salmonella enterica enterica serovar Typhi Ty2
ccggcauuucaccgucaau

SEQ ID NO: 3717618 - RNA, 13 nt, Salmonella enterica enterica serovar Typhi Ty2
ccggcauuucacu

SEQ ID NO: 3717619 - RNA, 13 nt, Salmonella enterica enterica serovar Typhi Ty2
ccggccagcgcca

SEQ ID NO: 3717620 - RNA, 15 nt, Salmonella enterica enterica serovar Typhi Ty2
ccggccagcgccagc

SEQ ID NO: 3717621 - RNA, 13 nt, Salmonella enterica enterica serovar Typhi Ty2
ccggccagcguca

SEQ ID NO: 3717622 - RNA, 19 nt, Salmonella enterica enterica serovar Typhi Ty2
ccggccauuaugcaggccg

SEQ ID NO: 3717623 - RNA, 20 nt, Salmonella enterica enterica serovar Typhi Ty2
ccggcccgcuaucaccgccc

SEQ ID NO: 3717624 - RNA, 21 nt, Salmonella enterica enterica serovar Typhi Ty2
ccggccuacacguaacccugu

SEQ ID NO: 3717625 - RNA, 11 nt, Salmonella enterica enterica serovar Typhi Ty2
ccggccuacgu

SEQ ID NO: 3717626 - RNA, 20 nt, Salmonella enterica enterica serovar Typhi Ty2
ccggccuacucuugagccgg

SEQ ID NO: 3717627 - RNA, 17 nt, Salmonella enterica enterica serovar Typhi Ty2
ccggccucgcccgcgau

SEQ ID NO: 3717628 - RNA, 19 nt, Salmonella enterica enterica serovar Typhi Ty2
ccggccugcaaaccgccuc

SEQ ID NO: 3717629 - RNA, 15 nt, Salmonella enterica enterica serovar Typhi Ty2
ccggccuggcgcagc

SEQ ID NO: 3717630 - RNA, 15 nt, Salmonella enterica enterica serovar Typhi Ty2
ccggcgaaagcggac

SEQ ID NO: 3717631 - RNA, 18 nt, Salmonella enterica enterica serovar Typhi Ty2
ccggcgaaaucgugcgcc

SEQ ID NO: 3717632 - RNA, 18 nt, Salmonella enterica enterica serovar Typhi Ty2
ccggcgacgcuuucaccu

SEQ ID NO: 3717633 - RNA, 14 nt, Salmonella enterica enterica serovar Typhi Ty2
ccggcgacguauuc

SEQ ID NO: 3717634 - RNA, 18 nt, Salmonella enterica enterica serovar Typhi Ty2
ccggcgaggacuguacaa

SEQ ID NO: 3717635 - RNA, 18 nt, Salmonella enterica enterica serovar Typhi Ty2
ccgggugcaaauccaucu

SEQ ID NO: 3717636 - RNA, 16 nt, Salmonella enterica enterica serovar Typhi Ty2
ccgggugcgcgucgca

SEQ ID NO: 3717637 - RNA, 14 nt, Salmonella enterica enterica serovar Typhi Ty2
ccggguuaaagccc

SEQ ID NO: 3717638 - RNA, 14 nt, Salmonella enterica enterica serovar Typhi Ty2
ccggguuaaaucgc

SEQ ID NO: 3717639 - RNA, 19 nt, Salmonella enterica enterica serovar Typhi Ty2
ccggguucgcccggcauga

SEQ ID NO: 3717640 - RNA, 13 nt, Salmonella enterica enterica serovar Typhi Ty2
ccggguucugcgg

SEQ ID NO: 3717641 - RNA, 19 nt, Salmonella enterica enterica serovar Typhi Ty2
ccgguaaagcagugcagua

SEQ ID NO: 3717642 - RNA, 16 nt, Salmonella enterica enterica serovar Typhi Ty2
ccgguaacgccguagg

SEQ ID NO: 3717643 - RNA, 20 nt, Salmonella enterica enterica serovar Typhi Ty2
ccgguaacguaaauacccag

SEQ ID NO: 3717644 - RNA, 17 nt, Salmonella enterica enterica serovar Typhi Ty2
ccgguaagcgcagcgcc

SEQ ID NO: 3717645 - RNA, 19 nt, Salmonella enterica enterica serovar Typhi Ty2
ccgguacaccaacuaccaa

SEQ ID NO: 3717646 - RNA, 20 nt, Salmonella enterica enterica serovar Typhi Ty2
ccgguacacuucagccagac

SEQ ID NO: 3717647 - RNA, 15 nt, Salmonella enterica enterica serovar Typhi Ty2
ccgguagccagccaa

SEQ ID NO: 3717648 - RNA, 15 nt, Salmonella enterica enterica serovar Typhi Ty2
ccgguagccaggcgc

SEQ ID NO: 3717649 - RNA, 19 nt, Salmonella enterica enterica serovar Typhi Ty2
ccgguagcuucagcggcgc

SEQ ID NO: 3717650 - RNA, 15 nt, Salmonella enterica enterica serovar Typhi Ty2
ccgguauagcgccuu

SEQ ID NO: 3717651 - RNA, 18 nt, Salmonella enterica enterica serovar Typhi Ty2
ccgguaucgccggcagac

SEQ ID NO: 3717652 - RNA, 14 nt, Salmonella enterica enterica serovar Typhi Ty2
ccgguauuuuuucu

SEQ ID NO: 3717653 - RNA, 20 nt, Salmonella enterica enterica serovar Typhi Ty2
ccggucaacgcgccgccaac

SEQ ID NO: 3717654 - RNA, 14 nt, Salmonella enterica enterica serovar Typhi Ty2
ccggucaagcgcaa

SEQ ID NO: 3717655 - RNA, 13 nt, Salmonella enterica enterica serovar Typhi Ty2
ccggucauccagc

SEQ ID NO: 3717656 - RNA, 20 nt, Salmonella enterica enterica serovar Typhi Ty2
ccggucauguuccaacaaug

SEQ ID NO: 3717657 - RNA, 15 nt, Salmonella enterica enterica serovar Typhi Ty2
ccgguccgguggcgc

SEQ ID NO: 3717658 - RNA, 15 nt, Salmonella enterica enterica serovar Typhi Ty2
ccggucggcgcguca

SEQ ID NO: 3717659 - RNA, 14 nt, Salmonella enterica enterica serovar Typhi Ty2
ccggucuggcucac

SEQ ID NO: 3717660 - RNA, 14 nt, Salmonella enterica enterica serovar Typhi Ty2
ccggugagcgccgc

SEQ ID NO: 3717661 - RNA, 20 nt, Salmonella enterica enterica serovar Typhi Ty2
ccggugcagaccucugcaaa

SEQ ID NO: 3717662 - RNA, 23 nt, Salmonella enterica enterica serovar Typhi Ty2
ccggugccguuaauuuucacgca

SEQ ID NO: 3717663 - RNA, 19 nt, Salmonella enterica enterica serovar Typhi Ty2
ccggugcgagaaaaagcaa

SEQ ID NO: 3717664 - RNA, 21 nt, Salmonella enterica enterica serovar Typhi Ty2
ccggugcgcaggccgcgccgc

SEQ ID NO: 3717665 - RNA, 19 nt, Salmonella enterica enterica serovar Typhi Ty2
ccggugcggcaagcgcgcu

SEQ ID NO: 3717666 - RNA, 16 nt, Salmonella enterica enterica serovar Typhi Ty2
ccgguggcgcugcgcu

SEQ ID NO: 3717667 - RNA, 14 nt, Salmonella enterica enterica serovar Typhi Ty2
ccgguggcgcuguc

SEQ ID NO: 3717668 - RNA, 15 nt, Salmonella enterica enterica serovar Typhi Ty2
ccgguggcguggcgc

SEQ ID NO: 3717669 - RNA, 15 nt, Salmonella enterica enterica serovar Typhi Ty2
ccggugggcauauga

SEQ ID NO: 3717670 - RNA, 15 nt, Salmonella enterica enterica serovar Typhi Ty2
ccgguguaaaaaaug

SEQ ID NO: 3717671 - RNA, 15 nt, Salmonella enterica enterica serovar Typhi Ty2
ccgguguagcuggca

SEQ ID NO: 3717672 - RNA, 16 nt, Salmonella enterica enterica serovar Typhi Ty2
ccgguuauaccgccau

SEQ ID NO: 3717673 - RNA, 19 nt, Salmonella enterica enterica serovar Typhi Ty2
ccgguuauaccgccauccg

SEQ ID NO: 3717674 - RNA, 16 nt, Salmonella enterica enterica serovar Typhi Ty2
ccgguuauccauauga

SEQ ID NO: 3717675 - RNA, 21 nt, Salmonella enterica enterica serovar Typhi Ty2
ccgguugcccauuuugcgguu

SEQ ID NO: 3717676 - RNA, 13 nt, Salmonella enterica enterica serovar Typhi Ty2
ccgguugcgcgcu

SEQ ID NO: 3717677 - RNA, 22 nt, Salmonella enterica enterica serovar Typhi Ty2
ccgguugcugauaacgugcgcg

SEQ ID NO: 3717678 - RNA, 17 nt, Salmonella enterica enterica serovar Typhi Ty2
ccgguuucaauccaugu

SEQ ID NO: 3717679 - RNA, 20 nt, Salmonella enterica enterica serovar Typhi Ty2
ccgguuugggcgcgaaacug

SEQ ID NO: 3717680 - RNA, 23 nt, Salmonella enterica enterica serovar Typhi Ty2
ccgguuuuuuuuugccugaaaug

SEQ ID NO: 3717681 - RNA, 18 nt, Salmonella enterica enterica serovar Typhi Ty2
ccguaaacgccugcacca

SEQ ID NO: 3717682 - RNA, 19 nt, Salmonella enterica enterica serovar Typhi Ty2
ccguaagcggcggaccagc

SEQ ID NO: 3717683 - RNA, 19 nt, Salmonella enterica enterica serovar Typhi Ty2
ccguaaucaucgcgaucgc

SEQ ID NO: 3717684 - RNA, 21 nt, Salmonella enterica enterica serovar Typhi Ty2
ccguaccgcggcgcugcagau

SEQ ID NO: 3717685 - RNA, 20 nt, Salmonella enterica enterica serovar Typhi Ty2
ccguacgaucugacugaucg

SEQ ID NO: 3717686 - RNA, 15 nt, Salmonella enterica enterica serovar Typhi Ty2
ccguacgauguucga

SEQ ID NO: 3717687 - RNA, 16 nt, Salmonella enterica enterica serovar Typhi Ty2
ccguacuccagcccau

SEQ ID NO: 3717688 - RNA, 21 nt, Salmonella enterica enterica serovar Typhi Ty2
ccguagauaagcgccacgucg

SEQ ID NO: 3717689 - RNA, 15 nt, Salmonella enterica enterica serovar Typhi Ty2
ccguagcgacgccau

SEQ ID NO: 3717690 - RNA, 16 nt, Salmonella enterica enterica serovar Typhi Ty2
ccguagcucagcugga

SEQ ID NO: 3717691 - RNA, 16 nt, Salmonella enterica enterica serovar Typhi Ty2
ccguagcugcgcgccg

SEQ ID NO: 3717692 - RNA, 15 nt, Salmonella enterica enterica serovar Typhi Ty2
ccguauccgccacca

SEQ ID NO: 3717693 - RNA, 17 nt, Salmonella enterica enterica serovar Typhi Ty2
ccguauccgccaccaug

SEQ ID NO: 3717694 - RNA, 15 nt, Salmonella enterica enterica serovar Typhi Ty2
ccguauucaggcgau

SEQ ID NO: 3717695 - RNA, 22 nt, Salmonella enterica enterica serovar Typhi Ty2
ccgucaaaguugguucccagca

SEQ ID NO: 3717696 - RNA, 16 nt, Salmonella enterica enterica serovar Typhi Ty2
ccgucaacacgcagac

SEQ ID NO: 3717697 - RNA, 20 nt, Salmonella enterica enterica serovar Typhi Ty2
ccgucaaugccuggcagacg

SEQ ID NO: 3717698 - RNA, 12 nt, Salmonella enterica enterica serovar Typhi Ty2
ccgucacaaagc

SEQ ID NO: 3717699 - RNA, 20 nt, Salmonella enterica enterica serovar Typhi Ty2
ccgucacaccaucccggcgu

SEQ ID NO: 3717700 - RNA, 21 nt, Salmonella enterica enterica serovar Typhi Ty2
ccgucacugaaccugccuuug

SEQ ID NO: 3717701 - RNA, 17 nt, Salmonella enterica enterica serovar Typhi Ty2
ccgucagauucugcggu

SEQ ID NO: 3717702 - RNA, 14 nt, Salmonella enterica enterica serovar Typhi Ty2
ccgucagcaacccc

SEQ ID NO: 3717703 - RNA, 15 nt, Salmonella enterica enterica serovar Typhi Ty2
ccgucagcaaccccu

SEQ ID NO: 3717704 - RNA, 17 nt, Salmonella enterica enterica serovar Typhi Ty2
ccgucagcgaaucgauc

SEQ ID NO: 3717705 - RNA, 22 nt, Salmonella enterica enterica serovar Typhi Ty2
ccgucaggaacggauaacgacg

SEQ ID NO: 3717706 - RNA, 23 nt, Salmonella enterica enterica serovar Typhi Ty2
ccgucaggcuugccgcgccagac

SEQ ID NO: 3717707 - RNA, 16 nt, Salmonella enterica enterica serovar Typhi Ty2
ccgucagucgccagaa

SEQ ID NO: 3717708 - RNA, 23 nt, Salmonella enterica enterica serovar Typhi Ty2
ccgucagucgccagaaggcaggc

SEQ ID NO: 3717709 - RNA, 18 nt, Salmonella enterica enterica serovar Typhi Ty2
ccgucagugagcccuccu

SEQ ID NO: 3717710 - RNA, 23 nt, Salmonella enterica enterica serovar Typhi Ty2
ccgucaguuauaggucagguuua

SEQ ID NO: 3717711 - RNA, 20 nt, Salmonella enterica enterica serovar Typhi Ty2
ccgucauauagccgcgcagu

SEQ ID NO: 3717712 - RNA, 20 nt, Salmonella enterica enterica serovar Typhi Ty2
ccgucauccagcagcagagc

SEQ ID NO: 3717713 - RNA, 14 nt, Salmonella enterica enterica serovar Typhi Ty2
ccgucaucgacuuc

SEQ ID NO: 3717714 - RNA, 15 nt, Salmonella enterica enterica serovar Typhi Ty2
ccgucaucgcccagg

SEQ ID NO: 3717715 - RNA, 16 nt, Salmonella enterica enterica serovar Typhi Ty2
ccgucaugauguuugu

SEQ ID NO: 3717716 - RNA, 19 nt, Salmonella enterica enterica serovar Typhi Ty2
ccgucauucgagucaugaa

SEQ ID NO: 3717717 - RNA, 18 nt, Salmonella enterica enterica serovar Typhi Ty2
ccuaacuggaaaaagacc

SEQ ID NO: 3717718 - RNA, 21 nt, Salmonella enterica enterica serovar Typhi Ty2
ccuaaggucacgccggaaauc

SEQ ID NO: 3717719 - RNA, 16 nt, Salmonella enterica enterica serovar Typhi Ty2
ccuacaaaaucgccca

SEQ ID NO: 3717720 - RNA, 18 nt, Salmonella enterica enterica serovar Typhi Ty2
ccuacaagaauuuaucgc

SEQ ID NO: 3717721 - RNA, 17 nt, Salmonella enterica enterica serovar Typhi Ty2
ccuacaaggcauucagg

SEQ ID NO: 3717722 - RNA, 18 nt, Salmonella enterica enterica serovar Typhi Ty2
ccuacaaggcauucaggc

SEQ ID NO: 3717723 - RNA, 17 nt, Salmonella enterica enterica serovar Typhi Ty2
ccuacacaaaaucauuc

SEQ ID NO: 3717724 - RNA, 18 nt, Salmonella enterica enterica serovar Typhi Ty2
ccuacacaaaaucauucg

SEQ ID NO: 3717725 - RNA, 22 nt, Salmonella enterica enterica serovar Typhi Ty2
ccuacagguugucgcaacgugu

SEQ ID NO: 3717726 - RNA, 16 nt, Salmonella enterica enterica serovar Typhi Ty2
ccuaccagucgacuca

SEQ ID NO: 3717727 - RNA, 13 nt, Salmonella enterica enterica serovar Typhi Ty2
ccuaccgaggcag

SEQ ID NO: 3717728 - RNA, 18 nt, Salmonella enterica enterica serovar Typhi Ty2
ccuaccggcggcacccgu

SEQ ID NO: 3717729 - RNA, 15 nt, Salmonella enterica enterica serovar Typhi Ty2
ccuaccugccgccau

SEQ ID NO: 3717730 - RNA, 13 nt, Salmonella enterica enterica serovar Typhi Ty2
ccuacgcuauccg

SEQ ID NO: 3717731 - RNA, 22 nt, Salmonella enterica enterica serovar Typhi Ty2
ccuacgcuuaccgggccugugu

SEQ ID NO: 3717732 - RNA, 19 nt, Salmonella enterica enterica serovar Typhi Ty2
ccuacugcccuacgcuucu

SEQ ID NO: 3717733 - RNA, 21 nt, Salmonella enterica enterica serovar Typhi Ty2
ccuacuguggugugccugcgu

SEQ ID NO: 3717734 - RNA, 14 nt, Salmonella enterica enterica serovar Typhi Ty2
ccuagcgucccggc

SEQ ID NO: 3717735 - RNA, 21 nt, Salmonella enterica enterica serovar Typhi Ty2
ccuagcgucccggcaauacug

SEQ ID NO: 3717736 - RNA, 14 nt, Salmonella enterica enterica serovar Typhi Ty2
ccuaggccagugcc

SEQ ID NO: 3717737 - RNA, 16 nt, Salmonella enterica enterica serovar Typhi Ty2
ccuauaagcugccucu

SEQ ID NO: 3717738 - RNA, 17 nt, Salmonella enterica enterica serovar Typhi Ty2
ccuauaagcugccucuu

SEQ ID NO: 3717739 - RNA, 14 nt, Salmonella enterica enterica serovar Typhi Ty2
ccuauaaugcgcca

SEQ ID NO: 3717740 - RNA, 17 nt, Salmonella enterica enterica serovar Typhi Ty2
ccuauauuaguguuaua

SEQ ID NO: 3717741 - RNA, 22 nt, Salmonella enterica enterica serovar Typhi Ty2
ccuaucaggaucaaaaucgcgc

SEQ ID NO: 3717742 - RNA, 17 nt, Salmonella enterica enterica serovar Typhi Ty2
ccuauugcaacgccgau

SEQ ID NO: 3717743 - RNA, 21 nt, Salmonella enterica enterica serovar Typhi Ty2
ccuauuucaguacagccaaaa

SEQ ID NO: 3717744 - RNA, 23 nt, Salmonella enterica enterica serovar Typhi Ty2
ccuauuucaguacagccaaaaau

SEQ ID NO: 3717745 - RNA, 19 nt, Salmonella enterica enterica serovar Typhi Ty2
ccuauuuuaaauucccagc

SEQ ID NO: 3717746 - RNA, 23 nt, Salmonella enterica enterica serovar Typhi Ty2
ccuauuuuaaauucccagcguac

SEQ ID NO: 3717747 - RNA, 15 nt, Salmonella enterica enterica serovar Typhi Ty2
ccuauuuuacaaaau

SEQ ID NO: 3717748 - RNA, 14 nt, Salmonella enterica enterica serovar Typhi Ty2
ccuauuuugcaaaa

SEQ ID NO: 3717749 - RNA, 17 nt, Salmonella enterica enterica serovar Typhi Ty2
ccuauuuugcaaaacug

SEQ ID NO: 3717750 - RNA, 17 nt, Salmonella enterica enterica serovar Typhi Ty2
ccucaacaucucuucgu

SEQ ID NO: 3717751 - RNA, 18 nt, Salmonella enterica enterica serovar Typhi Ty2
ccucaacauugccggcau

SEQ ID NO: 3717752 - RNA, 13 nt, Salmonella enterica enterica serovar Typhi Ty2
ccucaaccaacgg

SEQ ID NO: 3717753 - RNA, 21 nt, Salmonella enterica enterica serovar Typhi Ty2
ccucaacgucgcucagaauag

SEQ ID NO: 3717754 - RNA, 22 nt, Salmonella enterica enterica serovar Typhi Ty2
ccucaacgucgcucagaauagg

SEQ ID NO: 3717755 - RNA, 11 nt, Salmonella enterica enterica serovar Typhi Ty2
ccucaauccgu

SEQ ID NO: 3717756 - RNA, 15 nt, Salmonella enterica enterica serovar Typhi Ty2
ccucacaaacggcau

SEQ ID NO: 3717757 - RNA, 18 nt, Salmonella enterica enterica serovar Typhi Ty2
ccucacgcaaccagguca

SEQ ID NO: 3717758 - RNA, 22 nt, Salmonella enterica enterica serovar Typhi Ty2
ccucacgcuuaucgccaaacca

SEQ ID NO: 3717759 - RNA, 23 nt, Salmonella enterica enterica serovar Typhi Ty2
ccucacgcuuaucgccaaaccag

SEQ ID NO: 3717760 - RNA, 11 nt, Salmonella enterica enterica serovar Typhi Ty2
ccucacuccag

SEQ ID NO: 3717761 - RNA, 13 nt, Salmonella enterica enterica serovar Typhi Ty2
ccucacugccgac

SEQ ID NO: 3717762 - RNA, 18 nt, Salmonella enterica enterica serovar Typhi Ty2
ccucacugcguaaaaucg

SEQ ID NO: 3717763 - RNA, 12 nt, Salmonella enterica enterica serovar Typhi Ty2
ccucacuguuga

SEQ ID NO: 3717764 - RNA, 22 nt, Salmonella enterica enterica serovar Typhi Ty2
ccucagaaagcguuggcgugcg

SEQ ID NO: 3717765 - RNA, 12 nt, Salmonella enterica enterica serovar Typhi Ty2
ccucagaauccg

SEQ ID NO: 3717766 - RNA, 19 nt, Salmonella enterica enterica serovar Typhi Ty2
ccucagauguaucgcgcuu

SEQ ID NO: 3717767 - RNA, 19 nt, Salmonella enterica enterica serovar Typhi Ty2
ccucagcaaugauuuuuag

SEQ ID NO: 3717768 - RNA, 18 nt, Salmonella enterica enterica serovar Typhi Ty2
ccucagucgcuuguaccg

SEQ ID NO: 3717769 - RNA, 19 nt, Salmonella enterica enterica serovar Typhi Ty2
ccucauacagcccgcgcag

SEQ ID NO: 3717770 - RNA, 22 nt, Salmonella enterica enterica serovar Typhi Ty2
ccucauacagcccgcgcagaau

SEQ ID NO: 3717771 - RNA, 13 nt, Salmonella enterica enterica serovar Typhi Ty2
ccucauauuugua

SEQ ID NO: 3717772 - RNA, 19 nt, Salmonella enterica enterica serovar Typhi Ty2
ccucauauuuguaucuggu

SEQ ID NO: 3717773 - RNA, 13 nt, Salmonella enterica enterica serovar Typhi Ty2
ccucauccccagc

SEQ ID NO: 3717774 - RNA, 18 nt, Salmonella enterica enterica serovar Typhi Ty2
ccucaucgggacggcggu

SEQ ID NO: 3717775 - RNA, 16 nt, Salmonella enterica enterica serovar Typhi Ty2
ccucaucugcuucaac

SEQ ID NO: 3717776 - RNA, 14 nt, Salmonella enterica enterica serovar Typhi Ty2
ccucauucagcggc

SEQ ID NO: 3717777 - RNA, 16 nt, Salmonella enterica enterica serovar Typhi Ty2
ccucauuuuguugcuc

SEQ ID NO: 3717778 - RNA, 14 nt, Salmonella enterica enterica serovar Typhi Ty2
ccuccagcgacccu

SEQ ID NO: 3717779 - RNA, 17 nt, Salmonella enterica enterica serovar Typhi Ty2
ccuccagcgccuguuga

SEQ ID NO: 3717780 - RNA, 17 nt, Salmonella enterica enterica serovar Typhi Ty2
ccuccauggcuugucgc

SEQ ID NO: 3717781 - RNA, 21 nt, Salmonella enterica enterica serovar Typhi Ty2
ccuccauggcuugucgccaac

SEQ ID NO: 3717782 - RNA, 15 nt, Salmonella enterica enterica serovar Typhi Ty2
ccucccugacuggcu

SEQ ID NO: 3717783 - RNA, 12 nt, Salmonella enterica enterica serovar Typhi Ty2
ccucccugccua

SEQ ID NO: 3717784 - RNA, 11 nt, Salmonella enterica enterica serovar Typhi Ty2
ccucccuuucu

SEQ ID NO: 3717785 - RNA, 18 nt, Salmonella enterica enterica serovar Typhi Ty2
ccuccgccacuagcgcuu

SEQ ID NO: 3717786 - RNA, 11 nt, Salmonella enterica enterica serovar Typhi Ty2
ccuccgcccgg

SEQ ID NO: 3717787 - RNA, 21 nt, Salmonella enterica enterica serovar Typhi Ty2
ccuccgcguagcccagcgccg

SEQ ID NO: 3717788 - RNA, 22 nt, Salmonella enterica enterica serovar Typhi Ty2
ccuccgcguagcccagcgccgc

SEQ ID NO: 3717789 - RNA, 15 nt, Salmonella enterica enterica serovar Typhi Ty2
ccuccggcgcggcgc

SEQ ID NO: 3717790 - RNA, 17 nt, Salmonella enterica enterica serovar Typhi Ty2
ccuccggcggugaagca

SEQ ID NO: 3717791 - RNA, 18 nt, Salmonella enterica enterica serovar Typhi Ty2
ccuccggcugaagcccca

SEQ ID NO: 3717792 - RNA, 15 nt, Salmonella enterica enterica serovar Typhi Ty2
ccuccgggaaaacau

SEQ ID NO: 3717793 - RNA, 22 nt, Salmonella enterica enterica serovar Typhi Ty2
ccuccguaugaccgccgcgcgu

SEQ ID NO: 3717794 - RNA, 16 nt, Salmonella enterica enterica serovar Typhi Ty2
ccuccgucaccuccgc

SEQ ID NO: 3717795 - RNA, 18 nt, Salmonella enterica enterica serovar Typhi Ty2
ccuccucgacguuuucca

SEQ ID NO: 3717796 - RNA, 18 nt, Salmonella enterica enterica serovar Typhi Ty2
ccuccugaauagcuuuca

SEQ ID NO: 3717797 - RNA, 23 nt, Salmonella enterica enterica serovar Typhi Ty2
ccuccugauaaccuauuuugcaa

SEQ ID NO: 3717798 - RNA, 19 nt, Salmonella enterica enterica serovar Typhi Ty2
ccuccugccgaugccgccg

SEQ ID NO: 3717799 - RNA, 22 nt, Salmonella enterica enterica serovar Typhi Ty2
ccugauaagguaaagccgccau

SEQ ID NO: 3717800 - RNA, 13 nt, Salmonella enterica enterica serovar Typhi Ty2
ccugauagcgcug

SEQ ID NO: 3717801 - RNA, 18 nt, Salmonella enterica enterica serovar Typhi Ty2
ccugauauacaaaaccca

SEQ ID NO: 3717802 - RNA, 23 nt, Salmonella enterica enterica serovar Typhi Ty2
ccugauauugcguaagcagcugc

SEQ ID NO: 3717803 - RNA, 15 nt, Salmonella enterica enterica serovar Typhi Ty2
ccugaucaaggcgca

SEQ ID NO: 3717804 - RNA, 19 nt, Salmonella enterica enterica serovar Typhi Ty2
ccugaucaucggcgcgucg

SEQ ID NO: 3717805 - RNA, 19 nt, Salmonella enterica enterica serovar Typhi Ty2
ccugauccagcucuucuuc

SEQ ID NO: 3717806 - RNA, 18 nt, Salmonella enterica enterica serovar Typhi Ty2
ccugauccggcuguucca

SEQ ID NO: 3717807 - RNA, 12 nt, Salmonella enterica enterica serovar Typhi Ty2
ccugaucgccaa

SEQ ID NO: 3717808 - RNA, 15 nt, Salmonella enterica enterica serovar Typhi Ty2
ccugaucggccagcg

SEQ ID NO: 3717809 - RNA, 19 nt, Salmonella enterica enterica serovar Typhi Ty2
ccugaucggccagcgucgc

SEQ ID NO: 3717810 - RNA, 16 nt, Salmonella enterica enterica serovar Typhi Ty2
ccugaugauagcgcca

SEQ ID NO: 3717811 - RNA, 20 nt, Salmonella enterica enterica serovar Typhi Ty2
ccugaugauggaaaacgcgc

SEQ ID NO: 3717812 - RNA, 22 nt, Salmonella enterica enterica serovar Typhi Ty2
ccugaugcgcguuuagcgccag

SEQ ID NO: 3717813 - RNA, 12 nt, Salmonella enterica enterica serovar Typhi Ty2
ccugauggcgcu

SEQ ID NO: 3717814 - RNA, 19 nt, Salmonella enterica enterica serovar Typhi Ty2
ccugauggcgcuacgccau

SEQ ID NO: 3717815 - RNA, 17 nt, Salmonella enterica enterica serovar Typhi Ty2
ccugauggcgcugcgcu

SEQ ID NO: 3717816 - RNA, 19 nt, Salmonella enterica enterica serovar Typhi Ty2
ccugauggcguagcgccau

SEQ ID NO: 3717817 - RNA, 17 nt, Salmonella enterica enterica serovar Typhi Ty2
ccugaugguuauuuuca

SEQ ID NO: 3717818 - RNA, 15 nt, Salmonella enterica enterica serovar Typhi Ty2
ccugaugugcuuuuu

SEQ ID NO: 3717819 - RNA, 19 nt, Salmonella enterica enterica serovar Typhi Ty2
ccugauucaccaacugcug

SEQ ID NO: 3717820 - RNA, 16 nt, Salmonella enterica enterica serovar Typhi Ty2
ccugauugaccagcau

SEQ ID NO: 3717821 - RNA, 20 nt, Salmonella enterica enterica serovar Typhi Ty2
ccugauugauacgcgcccga

SEQ ID NO: 3717822 - RNA, 19 nt, Salmonella enterica enterica serovar Typhi Ty2
ccugauuuaacgaguugaa

SEQ ID NO: 3717823 - RNA, 13 nt, Salmonella enterica enterica serovar Typhi Ty2
ccugauuuaucac

SEQ ID NO: 3717824 - RNA, 14 nt, Salmonella enterica enterica serovar Typhi Ty2
ccugauuuaucacg

SEQ ID NO: 3717825 - RNA, 15 nt, Salmonella enterica enterica serovar Typhi Ty2
ccugauuuaucacgu

SEQ ID NO: 3717826 - RNA, 21 nt, Salmonella enterica enterica serovar Typhi Ty2
ccugcaaacuauguacgccaa

SEQ ID NO: 3717827 - RNA, 22 nt, Salmonella enterica enterica serovar Typhi Ty2
ccugcaaagcaaaaaucaccac

SEQ ID NO: 3717828 - RNA, 15 nt, Salmonella enterica enterica serovar Typhi Ty2
ccugcaacagcacca

SEQ ID NO: 3717829 - RNA, 20 nt, Salmonella enterica enterica serovar Typhi Ty2
ccugcaacgcuuuagugccg

SEQ ID NO: 3717830 - RNA, 12 nt, Salmonella enterica enterica serovar Typhi Ty2
ccugcaauuccg

SEQ ID NO: 3717831 - RNA, 23 nt, Salmonella enterica enterica serovar Typhi Ty2
ccugcaauuccggcgaaaaaccg

SEQ ID NO: 3717832 - RNA, 12 nt, Salmonella enterica enterica serovar Typhi Ty2
ccugcacccgcc

SEQ ID NO: 3717833 - RNA, 16 nt, Salmonella enterica enterica serovar Typhi Ty2
ccugcacguuacccgc

SEQ ID NO: 3717834 - RNA, 12 nt, Salmonella enterica enterica serovar Typhi Ty2
ccugcagggaau

SEQ ID NO: 3717835 - RNA, 22 nt, Salmonella enterica enterica serovar Typhi Ty2
ccugcaggguuugcgcagacug

SEQ ID NO: 3717836 - RNA, 23 nt, Salmonella enterica enterica serovar Typhi Ty2
ccugcauacucacauucauaaaa

SEQ ID NO: 3717837 - RNA, 16 nt, Salmonella enterica enterica serovar Typhi Ty2
ccugcauauuuuucau

SEQ ID NO: 3717838 - RNA, 18 nt, Salmonella enterica enterica serovar Typhi Ty2
ccugcauguacauaaaau

SEQ ID NO: 3717839 - RNA, 15 nt, Salmonella enterica enterica serovar Typhi Ty2
ccugcauugccugau

SEQ ID NO: 3717840 - RNA, 14 nt, Salmonella enterica enterica serovar Typhi Ty2
ccugccagauaguu

SEQ ID NO: 3717841 - RNA, 11 nt, Salmonella enterica enterica serovar Typhi Ty2
ccugccagauu

SEQ ID NO: 3717842 - RNA, 13 nt, Salmonella enterica enterica serovar Typhi Ty2
ccugccagccgcu

SEQ ID NO: 3717843 - RNA, 18 nt, Salmonella enterica enterica serovar Typhi Ty2
ccugccaguccgcccgcc

SEQ ID NO: 3717844 - RNA, 18 nt, Salmonella enterica enterica serovar Typhi Ty2
ccugccauagcaucacca

SEQ ID NO: 3717845 - RNA, 15 nt, Salmonella enterica enterica serovar Typhi Ty2
ccugccauucccagc

SEQ ID NO: 3717846 - RNA, 16 nt, Salmonella enterica enterica serovar Typhi Ty2
ccugccauucccagcc

SEQ ID NO: 3717847 - RNA, 19 nt, Salmonella enterica enterica serovar Typhi Ty2
ccugcccuuucuucaaugg

SEQ ID NO: 3717848 - RNA, 15 nt, Salmonella enterica enterica serovar Typhi Ty2
ccugccgcauguccc

SEQ ID NO: 3717849 - RNA, 14 nt, Salmonella enterica enterica serovar Typhi Ty2
ccugccgccuccag

SEQ ID NO: 3717850 - RNA, 22 nt, Salmonella enterica enterica serovar Typhi Ty2
ccugccggacugauaccgcguu

SEQ ID NO: 3717851 - RNA, 15 nt, Salmonella enterica enterica serovar Typhi Ty2
ccugccggguuuaau

SEQ ID NO: 3717852 - RNA, 23 nt, Salmonella enterica enterica serovar Typhi Ty2
ccugccgucaaacuuaaugccug

SEQ ID NO: 3717853 - RNA, 18 nt, Salmonella enterica enterica serovar Typhi Ty2
ccugccgucucaaccagc

SEQ ID NO: 3717854 - RNA, 17 nt, Salmonella enterica enterica serovar Typhi Ty2
ccugccguuuauuauuu

SEQ ID NO: 3717855 - RNA, 16 nt, Salmonella enterica enterica serovar Typhi Ty2
ccugccguuugcgcca

SEQ ID NO: 3717856 - RNA, 15 nt, Salmonella enterica enterica serovar Typhi Ty2
ccugccguuuuuaac

SEQ ID NO: 3717857 - RNA, 18 nt, Salmonella enterica enterica serovar Typhi Ty2
ccugccuaagccggacgc

SEQ ID NO: 3717858 - RNA, 21 nt, Salmonella enterica enterica serovar Typhi Ty2
ccugccugacaaugacgcuuc

SEQ ID NO: 3717859 - RNA, 21 nt, Salmonella enterica enterica serovar Typhi Ty2
ccugccuuaauccccggcccg

SEQ ID NO: 3717860 - RNA, 20 nt, Salmonella enterica enterica serovar Typhi Ty2
ccugcgagcuguagcgaagg

SEQ ID NO: 3717861 - RNA, 22 nt, Salmonella enterica enterica serovar Typhi Ty2
ccugcgauaccggacacccggc

SEQ ID NO: 3717862 - RNA, 18 nt, Salmonella enterica enterica serovar Typhi Ty2
ccugcgauagcugcugac

SEQ ID NO: 3717863 - RNA, 14 nt, Salmonella enterica enterica serovar Typhi Ty2
ccugcgcacagcau

SEQ ID NO: 3717864 - RNA, 14 nt, Salmonella enterica enterica serovar Typhi Ty2
ccugcgccagccgg

SEQ ID NO: 3717865 - RNA, 15 nt, Salmonella enterica enterica serovar Typhi Ty2
ccugcgccagccgga

SEQ ID NO: 3717866 - RNA, 12 nt, Salmonella enterica enterica serovar Typhi Ty2
ccugcgccagcg

SEQ ID NO: 3717867 - RNA, 14 nt, Salmonella enterica enterica serovar Typhi Ty2
ccugcgccguuucu

SEQ ID NO: 3717868 - RNA, 17 nt, Salmonella enterica enterica serovar Typhi Ty2
ccugcgcguaaauuuca

SEQ ID NO: 3717869 - RNA, 19 nt, Salmonella enterica enterica serovar Typhi Ty2
ccugcgcucauauacccug

SEQ ID NO: 3717870 - RNA, 22 nt, Salmonella enterica enterica serovar Typhi Ty2
ccugcgcugucaccagcagcau

SEQ ID NO: 3717871 - RNA, 16 nt, Salmonella enterica enterica serovar Typhi Ty2
ccugcgcuugcggccg

SEQ ID NO: 3717872 - RNA, 19 nt, Salmonella enterica enterica serovar Typhi Ty2
ccugcggacgcagcucaua

SEQ ID NO: 3717873 - RNA, 19 nt, Salmonella enterica enterica serovar Typhi Ty2
ccugcggcagaccggucgc

SEQ ID NO: 3717874 - RNA, 23 nt, Salmonella enterica enterica serovar Typhi Ty2
ccugcggcagaccggucgcggaa

SEQ ID NO: 3717875 - RNA, 19 nt, Salmonella enterica enterica serovar Typhi Ty2
ccugcggccuugccgccag

SEQ ID NO: 3717876 - RNA, 20 nt, Salmonella enterica enterica serovar Typhi Ty2
ccugcggguucaucgccaca

SEQ ID NO: 3717877 - RNA, 16 nt, Salmonella enterica enterica serovar Typhi Ty2
ccugcgguaaacgcuc

SEQ ID NO: 3717878 - RNA, 17 nt, Salmonella enterica enterica serovar Typhi Ty2
ccugcgguaaucgccgc

SEQ ID NO: 3717879 - RNA, 16 nt, Salmonella enterica enterica serovar Typhi Ty2
ccugcgguacugcugg

SEQ ID NO: 3717880 - RNA, 19 nt, Salmonella enterica enterica serovar Typhi Ty2
ccugcgguagcuccagaca

SEQ ID NO: 3717881 - RNA, 12 nt, Salmonella enterica enterica serovar Typhi Ty2
ccuguaaagcuu

SEQ ID NO: 3717882 - RNA, 21 nt, Salmonella enterica enterica serovar Typhi Ty2
ccuguaacaacuguuuuucac

SEQ ID NO: 3717883 - RNA, 14 nt, Salmonella enterica enterica serovar Typhi Ty2
ccuguaacacacug

SEQ ID NO: 3717884 - RNA, 15 nt, Salmonella enterica enterica serovar Typhi Ty2
ccuguaaccccagca

SEQ ID NO: 3717885 - RNA, 21 nt, Salmonella enterica enterica serovar Typhi Ty2
ccuguaaccccagcaucugca

SEQ ID NO: 3717886 - RNA, 16 nt, Salmonella enterica enterica serovar Typhi Ty2
ccuguaaccuuaaaag

SEQ ID NO: 3717887 - RNA, 17 nt, Salmonella enterica enterica serovar Typhi Ty2
ccuguaaggcucucuua

SEQ ID NO: 3717888 - RNA, 19 nt, Salmonella enterica enterica serovar Typhi Ty2
ccuguaaugucuggugcag

SEQ ID NO: 3717889 - RNA, 15 nt, Salmonella enterica enterica serovar Typhi Ty2
ccuguaccaccacgc

SEQ ID NO: 3717890 - RNA, 17 nt, Salmonella enterica enterica serovar Typhi Ty2
ccuguaccgggcagaca

SEQ ID NO: 3717891 - RNA, 17 nt, Salmonella enterica enterica serovar Typhi Ty2
ccuguacuugcgccgcc

SEQ ID NO: 3717892 - RNA, 18 nt, Salmonella enterica enterica serovar Typhi Ty2
ccugucaggcgagcgccu

SEQ ID NO: 3717893 - RNA, 17 nt, Salmonella enterica enterica serovar Typhi Ty2
ccugucaguacgucgca

SEQ ID NO: 3717894 - RNA, 19 nt, Salmonella enterica enterica serovar Typhi Ty2
ccugucaguacgucgcaua

SEQ ID NO: 3717895 - RNA, 15 nt, Salmonella enterica enterica serovar Typhi Ty2
ccuguccauugcgag

SEQ ID NO: 3717896 - RNA, 16 nt, Salmonella enterica enterica serovar Typhi Ty2
ccugucggucuuuuuc

SEQ ID NO: 3717897 - RNA, 18 nt, Salmonella enterica enterica serovar Typhi Ty2
ccugucggucuuuuucgc

SEQ ID NO: 3717898 - RNA, 16 nt, Salmonella enterica enterica serovar Typhi Ty2
ccugucguacgccuaa

SEQ ID NO: 3717899 - RNA, 15 nt, Salmonella enterica enterica serovar Typhi Ty2
ccugucgucaccagc

SEQ ID NO: 3717900 - RNA, 21 nt, Salmonella enterica enterica serovar Typhi Ty2
ccugucuauuguuuagacaga

SEQ ID NO: 3717901 - RNA, 15 nt, Salmonella enterica enterica serovar Typhi Ty2
ccugucuuaaagaaa

SEQ ID NO: 3717902 - RNA, 18 nt, Salmonella enterica enterica serovar Typhi Ty2
ccugugcaaccagcucuu

SEQ ID NO: 3717903 - RNA, 19 nt, Salmonella enterica enterica serovar Typhi Ty2
ccugugcuuucgccaccag

SEQ ID NO: 3717904 - RNA, 22 nt, Salmonella enterica enterica serovar Typhi Ty2
ccugugucguuucauccugaca

SEQ ID NO: 3717905 - RNA, 19 nt, Salmonella enterica enterica serovar Typhi Ty2
ccuguguuacgccaauaau

SEQ ID NO: 3717906 - RNA, 23 nt, Salmonella enterica enterica serovar Typhi Ty2
ccuguguuacgccaauaauauug

SEQ ID NO: 3717907 - RNA, 20 nt, Salmonella enterica enterica serovar Typhi Ty2
ccuguuagggcgcggcuggu

SEQ ID NO: 3717908 - RNA, 13 nt, Salmonella enterica enterica serovar Typhi Ty2
ccuguucaacaug

SEQ ID NO: 3717909 - RNA, 19 nt, Salmonella enterica enterica serovar Typhi Ty2
ccuguucaagcaauaaugc

SEQ ID NO: 3717910 - RNA, 20 nt, Salmonella enterica enterica serovar Typhi Ty2
ccuguuccagggcuuccaga

SEQ ID NO: 3717911 - RNA, 22 nt, Salmonella enterica enterica serovar Typhi Ty2
ccuguucuggcucggccugucg

SEQ ID NO: 3717912 - RNA, 23 nt, Salmonella enterica enterica serovar Typhi Ty2
ccuguugcgggccagcagccagg

SEQ ID NO: 3717913 - RNA, 24 nt, Salmonella enterica enterica serovar Typhi Ty2
ccuguuuaaaaucaacgcucagac

SEQ ID NO: 3717914 - RNA, 13 nt, Salmonella enterica enterica serovar Typhi Ty2
ccuguuuaucuga

SEQ ID NO: 3717915 - RNA, 16 nt, Salmonella enterica enterica serovar Typhi Ty2
ccuguuuaucugaugc

SEQ ID NO: 3717916 - RNA, 18 nt, Salmonella enterica enterica serovar Typhi Ty2
ccuguuucugcgccgcuu

SEQ ID NO: 3717917 - RNA, 20 nt, Salmonella enterica enterica serovar Typhi Ty2
ccuguuuuuucagcgcgccg

SEQ ID NO: 3717918 - RNA, 13 nt, Salmonella enterica enterica serovar Typhi Ty2
ccuuaaaaaggac

SEQ ID NO: 3717919 - RNA, 23 nt, Salmonella enterica enterica serovar Typhi Ty2
ccuuaauccccggcccgccgcug

SEQ ID NO: 3717920 - RNA, 16 nt, Salmonella enterica enterica serovar Typhi Ty2
ccuuaaucgacuucau

SEQ ID NO: 3717921 - RNA, 20 nt, Salmonella enterica enterica serovar Typhi Ty2
ccuuacaggcgcaucagaaa

SEQ ID NO: 3717922 - RNA, 21 nt, Salmonella enterica enterica serovar Typhi Ty2
ccuuacaggcgcaucagaaaa

SEQ ID NO: 3717923 - RNA, 18 nt, Salmonella enterica enterica serovar Typhi Ty2
ccuuacccgaccuacauc

SEQ ID NO: 3717924 - RNA, 14 nt, Salmonella enterica enterica serovar Typhi Ty2
ccuuacccggccug

SEQ ID NO: 3717925 - RNA, 17 nt, Salmonella enterica enterica serovar Typhi Ty2
ccuuaccgucagccacu

SEQ ID NO: 3717926 - RNA, 20 nt, Salmonella enterica enterica serovar Typhi Ty2
ccuuacgaauuuuaucuucc

SEQ ID NO: 3717927 - RNA, 23 nt, Salmonella enterica enterica serovar Typhi Ty2
ccuuacgcacaugaucuucguug

SEQ ID NO: 3717928 - RNA, 20 nt, Salmonella enterica enterica serovar Typhi Ty2
ccuuacgcucgcugauggcg

SEQ ID NO: 3717929 - RNA, 13 nt, Salmonella enterica enterica serovar Typhi Ty2
ccuuacggcuccu

SEQ ID NO: 3717930 - RNA, 19 nt, Salmonella enterica enterica serovar Typhi Ty2
ccuuacuaagccaguucuc

SEQ ID NO: 3717931 - RNA, 15 nt, Salmonella enterica enterica serovar Typhi Ty2
ccuuaguaaaaccga

SEQ ID NO: 3717932 - RNA, 12 nt, Salmonella enterica enterica serovar Typhi Ty2
ccuuauaaugcu

SEQ ID NO: 3717933 - RNA, 19 nt, Salmonella enterica enterica serovar Typhi Ty2
ccuuaucaagccuacaccu

SEQ ID NO: 3717934 - RNA, 14 nt, Salmonella enterica enterica serovar Typhi Ty2
ccuuaucaggccug

SEQ ID NO: 3717935 - RNA, 13 nt, Salmonella enterica enterica serovar Typhi Ty2
ccuuauccggccc

SEQ ID NO: 3717936 - RNA, 21 nt, Salmonella enterica enterica serovar Typhi Ty2
ccuuauccggccugcaggcaa

SEQ ID NO: 3717937 - RNA, 16 nt, Salmonella enterica enterica serovar Typhi Ty2
ccuuauccggcgugua

SEQ ID NO: 3717938 - RNA, 18 nt, Salmonella enterica enterica serovar Typhi Ty2
ccuuaucgaccaggcgac

SEQ ID NO: 3717939 - RNA, 18 nt, Salmonella enterica enterica serovar Typhi Ty2
ccuuaucgcagucagccu

SEQ ID NO: 3717940 - RNA, 20 nt, Salmonella enterica enterica serovar Typhi Ty2
ccuuaugggucacauccaga

SEQ ID NO: 3717941 - RNA, 23 nt, Salmonella enterica enterica serovar Typhi Ty2
ccuuauucgcuagcgugccauua

SEQ ID NO: 3717942 - RNA, 13 nt, Salmonella enterica enterica serovar Typhi Ty2
ccuuauuuuucag

SEQ ID NO: 3717943 - RNA, 19 nt, Salmonella enterica enterica serovar Typhi Ty2
ccuuauuuuucagcgccag

SEQ ID NO: 3717944 - RNA, 23 nt, Salmonella enterica enterica serovar Typhi Ty2
ccuucaaauauauugaaaaggga

SEQ ID NO: 3717945 - RNA, 14 nt, Salmonella enterica enterica serovar Typhi Ty2
ccuucaacccagca

SEQ ID NO: 3717946 - RNA, 12 nt, Salmonella enterica enterica serovar Typhi Ty2
ccuucaaucagc

SEQ ID NO: 3717947 - RNA, 20 nt, Salmonella enterica enterica serovar Typhi Ty2
ccuucaaucgguacgccaag

SEQ ID NO: 3717948 - RNA, 21 nt, Salmonella enterica enterica serovar Typhi Ty2
ccuucaauuugaccugaccug

SEQ ID NO: 3717949 - RNA, 23 nt, Salmonella enterica enterica serovar Typhi Ty2
ccuucacauuggcaaaccccugc

SEQ ID NO: 3717950 - RNA, 16 nt, Salmonella enterica enterica serovar Typhi Ty2
ccuucacgaucgagcc

SEQ ID NO: 3717951 - RNA, 18 nt, Salmonella enterica enterica serovar Typhi Ty2
ccuucacgcagugcgcga

SEQ ID NO: 3717952 - RNA, 22 nt, Salmonella enterica enterica serovar Typhi Ty2
ccuucacguuauucggaaugau

SEQ ID NO: 3717953 - RNA, 17 nt, Salmonella enterica enterica serovar Typhi Ty2
ccuucacucuucgacau

SEQ ID NO: 3717954 - RNA, 19 nt, Salmonella enterica enterica serovar Typhi Ty2
ccuucagaaaauuauuuuc

SEQ ID NO: 3717955 - RNA, 14 nt, Salmonella enterica enterica serovar Typhi Ty2
ccuucagcgcgccc

SEQ ID NO: 3717956 - RNA, 12 nt, Salmonella enterica enterica serovar Typhi Ty2
ccuucauaaaua

SEQ ID NO: 3717957 - RNA, 23 nt, Salmonella enterica enterica serovar Typhi Ty2
ccuucauucagaucaaaaaucug

SEQ ID NO: 3717958 - RNA, 19 nt, Salmonella enterica enterica serovar Typhi Ty2
ccuucccccagaaugccgc

SEQ ID NO: 3717959 - RNA, 19 nt, Salmonella enterica enterica serovar Typhi Ty2
ccuucccgcgauaaaaaca

SEQ ID NO: 3717960 - RNA, 22 nt, Salmonella enterica enterica serovar Typhi Ty2
ccuuccgcaagcucaccaucuu

SEQ ID NO: 3717961 - RNA, 14 nt, Salmonella enterica enterica serovar Typhi Ty2
ccuuccgccaccag

SEQ ID NO: 3717962 - RNA, 17 nt, Salmonella enterica enterica serovar Typhi Ty2
ccuuccuguggaaggca

SEQ ID NO: 3717963 - RNA, 15 nt, Salmonella enterica enterica serovar Typhi Ty2
cgaaaaugcgcauga

SEQ ID NO: 3717964 - RNA, 22 nt, Salmonella enterica enterica serovar Typhi Ty2
cgaaacaaccgucgauuuuaau

SEQ ID NO: 3717965 - RNA, 18 nt, Salmonella enterica enterica serovar Typhi Ty2
cgaaacagauuaaaaagc

SEQ ID NO: 3717966 - RNA, 20 nt, Salmonella enterica enterica serovar Typhi Ty2
cgaaacaggaaaaacauggg

SEQ ID NO: 3717967 - RNA, 23 nt, Salmonella enterica enterica serovar Typhi Ty2
cgaaacgaaucucaucagacugu

SEQ ID NO: 3717968 - RNA, 13 nt, Salmonella enterica enterica serovar Typhi Ty2
cgaaacggcggaa

SEQ ID NO: 3717969 - RNA, 13 nt, Salmonella enterica enterica serovar Typhi Ty2
cgaaacucagcgg

SEQ ID NO: 3717970 - RNA, 17 nt, Salmonella enterica enterica serovar Typhi Ty2
cgaaacucagcggccca

SEQ ID NO: 3717971 - RNA, 15 nt, Salmonella enterica enterica serovar Typhi Ty2
cgaaacuccagcgau

SEQ ID NO: 3717972 - RNA, 19 nt, Salmonella enterica enterica serovar Typhi Ty2
cgaaacuccagcgauaaac

SEQ ID NO: 3717973 - RNA, 15 nt, Salmonella enterica enterica serovar Typhi Ty2
cgaaagauaaaaaua

SEQ ID NO: 3717974 - RNA, 19 nt, Salmonella enterica enterica serovar Typhi Ty2
cgaaagcacuucucgcgca

SEQ ID NO: 3717975 - RNA, 12 nt, Salmonella enterica enterica serovar Typhi Ty2
cgaaagccggua

SEQ ID NO: 3717976 - RNA, 17 nt, Salmonella enterica enterica serovar Typhi Ty2
cgaaagcgaccuucucc

SEQ ID NO: 3717977 - RNA, 15 nt, Salmonella enterica enterica serovar Typhi Ty2
cgaaagcugccuuuu

SEQ ID NO: 3717978 - RNA, 13 nt, Salmonella enterica enterica serovar Typhi Ty2
cgaaaggaagcgg

SEQ ID NO: 3717979 - RNA, 23 nt, Salmonella enterica enterica serovar Typhi Ty2
cgaaaggaagcgggccaguauua

SEQ ID NO: 3717980 - RNA, 18 nt, Salmonella enterica enterica serovar Typhi Ty2
cgaaagucaucugccagu

SEQ ID NO: 3717981 - RNA, 18 nt, Salmonella enterica enterica serovar Typhi Ty2
cgaaaucagagacaaaua

SEQ ID NO: 3717982 - RNA, 16 nt, Salmonella enterica enterica serovar Typhi Ty2
cgaaaucaucaauggc

SEQ ID NO: 3717983 - RNA, 14 nt, Salmonella enterica enterica serovar Typhi Ty2
cgaaaucguccguu

SEQ ID NO: 3717984 - RNA, 12 nt, Salmonella enterica enterica serovar Typhi Ty2
cgaaauuuaaua

SEQ ID NO: 3717985 - RNA, 14 nt, Salmonella enterica enterica serovar Typhi Ty2
cgaacaacacggcg

SEQ ID NO: 3717986 - RNA, 19 nt, Salmonella enterica enterica serovar Typhi Ty2
cgaacaaguaguuguuaua

SEQ ID NO: 3717987 - RNA, 12 nt, Salmonella enterica enterica serovar Typhi Ty2
cgaacagccagg

SEQ ID NO: 3717988 - RNA, 11 nt, Salmonella enterica enterica serovar Typhi Ty2
cgaacagcgca

SEQ ID NO: 3717989 - RNA, 17 nt, Salmonella enterica enterica serovar Typhi Ty2
cgaacagcgcuccacgc

SEQ ID NO: 3717990 - RNA, 19 nt, Salmonella enterica enterica serovar Typhi Ty2
cgaacagcggcaggcggaa

SEQ ID NO: 3717991 - RNA, 19 nt, Salmonella enterica enterica serovar Typhi Ty2
cgaacaggcucagcgccac

SEQ ID NO: 3717992 - RNA, 20 nt, Salmonella enterica enterica serovar Typhi Ty2
cgaacagguuauuguugcua

SEQ ID NO: 3717993 - RNA, 19 nt, Salmonella enterica enterica serovar Typhi Ty2
cgaacaguguaaacgccag

SEQ ID NO: 3717994 - RNA, 20 nt, Salmonella enterica enterica serovar Typhi Ty2
cgaacaucugcguugcgcgc

SEQ ID NO: 3717995 - RNA, 14 nt, Salmonella enterica enterica serovar Typhi Ty2
cgaacaugccgacg

SEQ ID NO: 3717996 - RNA, 18 nt, Salmonella enterica enterica serovar Typhi Ty2
cgaacauuacauccucaa

SEQ ID NO: 3717997 - RNA, 15 nt, Salmonella enterica enterica serovar Typhi Ty2
cgaacauucuuaugc

SEQ ID NO: 3717998 - RNA, 13 nt, Salmonella enterica enterica serovar Typhi Ty2
cgaacauuucagc

SEQ ID NO: 3717999 - RNA, 21 nt, Salmonella enterica enterica serovar Typhi Ty2
cgaaccaccguuuaaucgccc

SEQ ID NO: 3718000 - RNA, 20 nt, Salmonella enterica enterica serovar Typhi Ty2
cgaaccaucauuaauauaau

SEQ ID NO: 3718001 - RNA, 17 nt, Salmonella enterica enterica serovar Typhi Ty2
cgaacccaucagggaaa

SEQ ID NO: 3718002 - RNA, 21 nt, Salmonella enterica enterica serovar Typhi Ty2
cgaaccggaccagcacaaaaa

SEQ ID NO: 3718003 - RNA, 19 nt, Salmonella enterica enterica serovar Typhi Ty2
cgaaccggcaucggcagcg

SEQ ID NO: 3718004 - RNA, 18 nt, Salmonella enterica enterica serovar Typhi Ty2
cgaaccguaaacgccugc

SEQ ID NO: 3718005 - RNA, 20 nt, Salmonella enterica enterica serovar Typhi Ty2
cgaaccugguacaccagacg

SEQ ID NO: 3718006 - RNA, 17 nt, Salmonella enterica enterica serovar Typhi Ty2
cgaacgcaucaaagcca

SEQ ID NO: 3718007 - RNA, 12 nt, Salmonella enterica enterica serovar Typhi Ty2
cgaacggccuga

SEQ ID NO: 3718008 - RNA, 18 nt, Salmonella enterica enterica serovar Typhi Ty2
cgaacggcuuuccagcag

SEQ ID NO: 3718009 - RNA, 13 nt, Salmonella enterica enterica serovar Typhi Ty2
cgaacugaauagu

SEQ ID NO: 3718010 - RNA, 18 nt, Salmonella enterica enterica serovar Typhi Ty2
cgaacugauggcgcuaag

SEQ ID NO: 3718011 - RNA, 18 nt, Salmonella enterica enterica serovar Typhi Ty2
cgaacugucugaaucagu

SEQ ID NO: 3718012 - RNA, 24 nt, Salmonella enterica enterica serovar Typhi Ty2
cgaacugucugaaucagugcaucu

SEQ ID NO: 3718013 - RNA, 20 nt, Salmonella enterica enterica serovar Typhi Ty2
cgaacuucgcgguugcgccc

SEQ ID NO: 3718014 - RNA, 16 nt, Salmonella enterica enterica serovar Typhi Ty2
cgaacuugaccagcac

SEQ ID NO: 3718015 - RNA, 22 nt, Salmonella enterica enterica serovar Typhi Ty2
cgaagaccgcaucacggcagca

SEQ ID NO: 3718016 - RNA, 20 nt, Salmonella enterica enterica serovar Typhi Ty2
cgaagauacggauucuugac

SEQ ID NO: 3718017 - RNA, 22 nt, Salmonella enterica enterica serovar Typhi Ty2
cgaagauaugcccccgaucacg

SEQ ID NO: 3718018 - RNA, 15 nt, Salmonella enterica enterica serovar Typhi Ty2
cgaagaucagugaga

SEQ ID NO: 3718019 - RNA, 19 nt, Salmonella enterica enterica serovar Typhi Ty2
cgaagauccgcucacgcca

SEQ ID NO: 3718020 - RNA, 15 nt, Salmonella enterica enterica serovar Typhi Ty2
cgaagcaggcggaga

SEQ ID NO: 3718021 - RNA, 20 nt, Salmonella enterica enterica serovar Typhi Ty2
cgaagccaccggauugccuu

SEQ ID NO: 3718022 - RNA, 23 nt, Salmonella enterica enterica serovar Typhi Ty2
cgaagcccaugauggugaacaga

SEQ ID NO: 3718023 - RNA, 17 nt, Salmonella enterica enterica serovar Typhi Ty2
cgaagccgcgggcggua

SEQ ID NO: 3718024 - RNA, 23 nt, Salmonella enterica enterica serovar Typhi Ty2
cgaagccgcgggcgguauuacau

SEQ ID NO: 3718025 - RNA, 19 nt, Salmonella enterica enterica serovar Typhi Ty2
cgaagcggcaguugaacuc

SEQ ID NO: 3718026 - RNA, 19 nt, Salmonella enterica enterica serovar Typhi Ty2
cgaagcgucauccggcaau

SEQ ID NO: 3718027 - RNA, 20 nt, Salmonella enterica enterica serovar Typhi Ty2
cgaaggauaauccgguguuu

SEQ ID NO: 3718028 - RNA, 23 nt, Salmonella enterica enterica serovar Typhi Ty2
cgaaggauaauccgguguuuguc

SEQ ID NO: 3718029 - RNA, 22 nt, Salmonella enterica enterica serovar Typhi Ty2
cgaaggcuuuugcuacgucgcc

SEQ ID NO: 3718030 - RNA, 19 nt, Salmonella enterica enterica serovar Typhi Ty2
cgaaggggcgggcagcagc

SEQ ID NO: 3718031 - RNA, 18 nt, Salmonella enterica enterica serovar Typhi Ty2
cgaagguaaacgcgacca

SEQ ID NO: 3718032 - RNA, 16 nt, Salmonella enterica enterica serovar Typhi Ty2
cgaaggucagauccuu

SEQ ID NO: 3718033 - RNA, 18 nt, Salmonella enterica enterica serovar Typhi Ty2
cgaagguuaccuacgguu

SEQ ID NO: 3718034 - RNA, 19 nt, Salmonella enterica enterica serovar Typhi Ty2
cgaaguagauuacgaaugu

SEQ ID NO: 3718035 - RNA, 15 nt, Salmonella enterica enterica serovar Typhi Ty2
cgaagucgccacccg

SEQ ID NO: 3718036 - RNA, 22 nt, Salmonella enterica enterica serovar Typhi Ty2
cgaagugcagcguuuccagcca

SEQ ID NO: 3718037 - RNA, 13 nt, Salmonella enterica enterica serovar Typhi Ty2
cgaaguggugggu

SEQ ID NO: 3718038 - RNA, 16 nt, Salmonella enterica enterica serovar Typhi Ty2
cgaaguucucaaugaa

SEQ ID NO: 3718039 - RNA, 14 nt, Salmonella enterica enterica serovar Typhi Ty2
cgaauaaaacugcc

SEQ ID NO: 3718040 - RNA, 15 nt, Salmonella enterica enterica serovar Typhi Ty2
cgaauaaaauucagc

SEQ ID NO: 3718041 - RNA, 15 nt, Salmonella enterica enterica serovar Typhi Ty2
cgaauaacauaauau

SEQ ID NO: 3718042 - RNA, 17 nt, Salmonella enterica enterica serovar Typhi Ty2
cgaauaacgccagguag

SEQ ID NO: 3718043 - RNA, 18 nt, Salmonella enterica enterica serovar Typhi Ty2
cgaauaaucaaccauaca

SEQ ID NO: 3718044 - RNA, 13 nt, Salmonella enterica enterica serovar Typhi Ty2
cgaauaauuauuu

SEQ ID NO: 3718045 - RNA, 12 nt, Salmonella enterica enterica serovar Typhi Ty2
cgacaucgccag

SEQ ID NO: 3718046 - RNA, 24 nt, Salmonella enterica enterica serovar Typhi Ty2
cgacaucgccaguugcagauuacu

SEQ ID NO: 3718047 - RNA, 15 nt, Salmonella enterica enterica serovar Typhi Ty2
cgacaucucaggcaa

SEQ ID NO: 3718048 - RNA, 21 nt, Salmonella enterica enterica serovar Typhi Ty2
cgacaucucaggcaagacaca

SEQ ID NO: 3718049 - RNA, 17 nt, Salmonella enterica enterica serovar Typhi Ty2
cgacaucuuuuccugaa

SEQ ID NO: 3718050 - RNA, 21 nt, Salmonella enterica enterica serovar Typhi Ty2
cgacaugcagaucgcgggcaa

SEQ ID NO: 3718051 - RNA, 17 nt, Salmonella enterica enterica serovar Typhi Ty2
cgacaugcuccugcauc

SEQ ID NO: 3718052 - RNA, 18 nt, Salmonella enterica enterica serovar Typhi Ty2
cgacaugcuccugcaucu

SEQ ID NO: 3718053 - RNA, 19 nt, Salmonella enterica enterica serovar Typhi Ty2
cgacauggcgguaaucgcg

SEQ ID NO: 3718054 - RNA, 17 nt, Salmonella enterica enterica serovar Typhi Ty2
cgacaugucaugacuua

SEQ ID NO: 3718055 - RNA, 20 nt, Salmonella enterica enterica serovar Typhi Ty2
cgacauguucgaacaugccg

SEQ ID NO: 3718056 - RNA, 23 nt, Salmonella enterica enterica serovar Typhi Ty2
cgacauucgauguuacugagcaa

SEQ ID NO: 3718057 - RNA, 19 nt, Salmonella enterica enterica serovar Typhi Ty2
cgacauuuuuguuaauauu

SEQ ID NO: 3718058 - RNA, 15 nt, Salmonella enterica enterica serovar Typhi Ty2
cgaccacuccggcau

SEQ ID NO: 3718059 - RNA, 17 nt, Salmonella enterica enterica serovar Typhi Ty2
cgaccacuucaacgccg

SEQ ID NO: 3718060 - RNA, 22 nt, Salmonella enterica enterica serovar Typhi Ty2
cgaccacuucaacgccgcgcuu

SEQ ID NO: 3718061 - RNA, 16 nt, Salmonella enterica enterica serovar Typhi Ty2
cgaccagcagaugcag

SEQ ID NO: 3718062 - RNA, 13 nt, Salmonella enterica enterica serovar Typhi Ty2
cgaccagcgcgcc

SEQ ID NO: 3718063 - RNA, 17 nt, Salmonella enterica enterica serovar Typhi Ty2
cgaccagcgucagccag

SEQ ID NO: 3718064 - RNA, 13 nt, Salmonella enterica enterica serovar Typhi Ty2
cgaccaggaucag

SEQ ID NO: 3718065 - RNA, 18 nt, Salmonella enterica enterica serovar Typhi Ty2
cgaccaguccuuccgccg

SEQ ID NO: 3718066 - RNA, 18 nt, Salmonella enterica enterica serovar Typhi Ty2
cgaccaguuuuugcgcca

SEQ ID NO: 3718067 - RNA, 18 nt, Salmonella enterica enterica serovar Typhi Ty2
cgaccaugguucccgcca

SEQ ID NO: 3718068 - RNA, 20 nt, Salmonella enterica enterica serovar Typhi Ty2
cgaccaugguucccgccacu

SEQ ID NO: 3718069 - RNA, 19 nt, Salmonella enterica enterica serovar Typhi Ty2
cgaccaugguuucgaacgc

SEQ ID NO: 3718070 - RNA, 21 nt, Salmonella enterica enterica serovar Typhi Ty2
cgaccauuggcaccaccagga

SEQ ID NO: 3718071 - RNA, 22 nt, Salmonella enterica enterica serovar Typhi Ty2
cgaccauuguuguaagggcugg

SEQ ID NO: 3718072 - RNA, 13 nt, Salmonella enterica enterica serovar Typhi Ty2
cgacccacaaugg

SEQ ID NO: 3718073 - RNA, 19 nt, Salmonella enterica enterica serovar Typhi Ty2
cgacccauaacgggaagcc

SEQ ID NO: 3718074 - RNA, 15 nt, Salmonella enterica enterica serovar Typhi Ty2
cgacccaucaauaac

SEQ ID NO: 3718075 - RNA, 20 nt, Salmonella enterica enterica serovar Typhi Ty2
cgaccccuucgcccucgcca

SEQ ID NO: 3718076 - RNA, 16 nt, Salmonella enterica enterica serovar Typhi Ty2
cgacccgcaucagacc

SEQ ID NO: 3718077 - RNA, 14 nt, Salmonella enterica enterica serovar Typhi Ty2
cgaccgaucaucau

SEQ ID NO: 3718078 - RNA, 19 nt, Salmonella enterica enterica serovar Typhi Ty2
cgaccgcaggcucuuuuuc

SEQ ID NO: 3718079 - RNA, 13 nt, Salmonella enterica enterica serovar Typhi Ty2
cgaccgccagcag

SEQ ID NO: 3718080 - RNA, 21 nt, Salmonella enterica enterica serovar Typhi Ty2
cgaccgcgccacggccaacgc

SEQ ID NO: 3718081 - RNA, 20 nt, Salmonella enterica enterica serovar Typhi Ty2
cgaccggcacucaccucuuc

SEQ ID NO: 3718082 - RNA, 11 nt, Salmonella enterica enterica serovar Typhi Ty2
cgaccggcucg

SEQ ID NO: 3718083 - RNA, 14 nt, Salmonella enterica enterica serovar Typhi Ty2
cgaccguauccgcc

SEQ ID NO: 3718084 - RNA, 22 nt, Salmonella enterica enterica serovar Typhi Ty2
cgaccguauccgccaccaugau

SEQ ID NO: 3718085 - RNA, 22 nt, Salmonella enterica enterica serovar Typhi Ty2
cgaccguuagcgacggcgcgcc

SEQ ID NO: 3718086 - RNA, 13 nt, Salmonella enterica enterica serovar Typhi Ty2
cgaccucaucaaa

SEQ ID NO: 3718087 - RNA, 21 nt, Salmonella enterica enterica serovar Typhi Ty2
cgaccucgcagguacgacacc

SEQ ID NO: 3718088 - RNA, 19 nt, Salmonella enterica enterica serovar Typhi Ty2
cgaccuguagaugaaacuc

SEQ ID NO: 3718089 - RNA, 21 nt, Salmonella enterica enterica serovar Typhi Ty2
cgaccuguucaaaauugccac

SEQ ID NO: 3718090 - RNA, 14 nt, Salmonella enterica enterica serovar Typhi Ty2
cgaccuuauuccca

SEQ ID NO: 3718091 - RNA, 17 nt, Salmonella enterica enterica serovar Typhi Ty2
cgaccuucacgccgcca

SEQ ID NO: 3718092 - RNA, 19 nt, Salmonella enterica enterica serovar Typhi Ty2
cgacgauaaaaaaaguauc

SEQ ID NO: 3718093 - RNA, 19 nt, Salmonella enterica enterica serovar Typhi Ty2
cgacgauacaacucaucca

SEQ ID NO: 3718094 - RNA, 22 nt, Salmonella enterica enterica serovar Typhi Ty2
cgacgauugaccggggcgcaau

SEQ ID NO: 3718095 - RNA, 14 nt, Salmonella enterica enterica serovar Typhi Ty2
cgacgcacuccaga

SEQ ID NO: 3718096 - RNA, 15 nt, Salmonella enterica enterica serovar Typhi Ty2
cgacgcacuccagau

SEQ ID NO: 3718097 - RNA, 12 nt, Salmonella enterica enterica serovar Typhi Ty2
cgacgcauugag

SEQ ID NO: 3718098 - RNA, 20 nt, Salmonella enterica enterica serovar Typhi Ty2
cgacgcauugagacaugccg

SEQ ID NO: 3718099 - RNA, 17 nt, Salmonella enterica enterica serovar Typhi Ty2
cgacgcauuucuccuga

SEQ ID NO: 3718100 - RNA, 20 nt, Salmonella enterica enterica serovar Typhi Ty2
cgacgccaaucggcgucuug

SEQ ID NO: 3718101 - RNA, 23 nt, Salmonella enterica enterica serovar Typhi Ty2
cgacgccaaucggcgucuugccg

SEQ ID NO: 3718102 - RNA, 13 nt, Salmonella enterica enterica serovar Typhi Ty2
cgacgccaggcgg

SEQ ID NO: 3718103 - RNA, 17 nt, Salmonella enterica enterica serovar Typhi Ty2
cgacgccauuccccagc

SEQ ID NO: 3718104 - RNA, 20 nt, Salmonella enterica enterica serovar Typhi Ty2
cgacgcccugcccaugaagc

SEQ ID NO: 3718105 - RNA, 22 nt, Salmonella enterica enterica serovar Typhi Ty2
cgacgccgccgacacaguaaaa

SEQ ID NO: 3718106 - RNA, 19 nt, Salmonella enterica enterica serovar Typhi Ty2
cgacgcgcacccggcaacg

SEQ ID NO: 3718107 - RNA, 16 nt, Salmonella enterica enterica serovar Typhi Ty2
cgacgcgccaccaucg

SEQ ID NO: 3718108 - RNA, 19 nt, Salmonella enterica enterica serovar Typhi Ty2
cgacgcgcgguugcggcgg

SEQ ID NO: 3718109 - RNA, 17 nt, Salmonella enterica enterica serovar Typhi Ty2
cgacgcgggaucgucaa

SEQ ID NO: 3718110 - RNA, 12 nt, Salmonella enterica enterica serovar Typhi Ty2
cgacgcgggccg

SEQ ID NO: 3718111 - RNA, 17 nt, Salmonella enterica enterica serovar Typhi Ty2
cgacgcguggcaucuua

SEQ ID NO: 3718112 - RNA, 21 nt, Salmonella enterica enterica serovar Typhi Ty2
cgacgcguuucacaucgccag

SEQ ID NO: 3718113 - RNA, 14 nt, Salmonella enterica enterica serovar Typhi Ty2
cgacgcguuuucca

SEQ ID NO: 3718114 - RNA, 12 nt, Salmonella enterica enterica serovar Typhi Ty2
cgacgcucaacc

SEQ ID NO: 3718115 - RNA, 17 nt, Salmonella enterica enterica serovar Typhi Ty2
cgacgcucuuccucaau

SEQ ID NO: 3718116 - RNA, 13 nt, Salmonella enterica enterica serovar Typhi Ty2
cgacgcugccaca

SEQ ID NO: 3718117 - RNA, 18 nt, Salmonella enterica enterica serovar Typhi Ty2
cgacgcugcgaccgagug

SEQ ID NO: 3718118 - RNA, 14 nt, Salmonella enterica enterica serovar Typhi Ty2
cgacgcuguuuaug

SEQ ID NO: 3718119 - RNA, 14 nt, Salmonella enterica enterica serovar Typhi Ty2
cgacgcuucacgua

SEQ ID NO: 3718120 - RNA, 21 nt, Salmonella enterica enterica serovar Typhi Ty2
cgacggccucuucacgcagcg

SEQ ID NO: 3718121 - RNA, 17 nt, Salmonella enterica enterica serovar Typhi Ty2
cgacggcguauucggca

SEQ ID NO: 3718122 - RNA, 20 nt, Salmonella enterica enterica serovar Typhi Ty2
cgacgggaaaaagcgcgccc

SEQ ID NO: 3718123 - RNA, 21 nt, Salmonella enterica enterica serovar Typhi Ty2
cgacgggcggcgacagagaau

SEQ ID NO: 3718124 - RNA, 16 nt, Salmonella enterica enterica serovar Typhi Ty2
cgacggggcgcagaag

SEQ ID NO: 3718125 - RNA, 13 nt, Salmonella enterica enterica serovar Typhi Ty2
cgacggggcguua

SEQ ID NO: 3718126 - RNA, 21 nt, Salmonella enterica enterica serovar Typhi Ty2
cgacggucuuuuucgacggca

SEQ ID NO: 3718127 - RNA, 23 nt, Salmonella enterica enterica serovar Typhi Ty2
cgaggaacaucagccagcagcuc

SEQ ID NO: 3718128 - RNA, 15 nt, Salmonella enterica enterica serovar Typhi Ty2
cgaggaacgcgcaga

SEQ ID NO: 3718129 - RNA, 20 nt, Salmonella enterica enterica serovar Typhi Ty2
cgaggaacuguucagccagc

SEQ ID NO: 3718130 - RNA, 22 nt, Salmonella enterica enterica serovar Typhi Ty2
cgaggaguaguuaaaaaagguc

SEQ ID NO: 3718131 - RNA, 14 nt, Salmonella enterica enterica serovar Typhi Ty2
cgaggcauucagcc

SEQ ID NO: 3718132 - RNA, 18 nt, Salmonella enterica enterica serovar Typhi Ty2
cgaggccacgcagcgcag

SEQ ID NO: 3718133 - RNA, 15 nt, Salmonella enterica enterica serovar Typhi Ty2
cgaggcgcccaacgc

SEQ ID NO: 3718134 - RNA, 23 nt, Salmonella enterica enterica serovar Typhi Ty2
cgaggcuuaauacggcaacggga

SEQ ID NO: 3718135 - RNA, 18 nt, Salmonella enterica enterica serovar Typhi Ty2
cgaggcuuauaacccugu

SEQ ID NO: 3718136 - RNA, 14 nt, Salmonella enterica enterica serovar Typhi Ty2
cgagggaaggggau

SEQ ID NO: 3718137 - RNA, 17 nt, Salmonella enterica enterica serovar Typhi Ty2
cgagggaggcaaucgca

SEQ ID NO: 3718138 - RNA, 20 nt, Salmonella enterica enterica serovar Typhi Ty2
cgagggauuuccuggcaguu

SEQ ID NO: 3718139 - RNA, 22 nt, Salmonella enterica enterica serovar Typhi Ty2
cgaggucagcauuucauccauu

SEQ ID NO: 3718140 - RNA, 17 nt, Salmonella enterica enterica serovar Typhi Ty2
cgaggugaauaaauccu

SEQ ID NO: 3718141 - RNA, 18 nt, Salmonella enterica enterica serovar Typhi Ty2
cgaggugaauaaauccuu

SEQ ID NO: 3718142 - RNA, 22 nt, Salmonella enterica enterica serovar Typhi Ty2
cgagguucaccagcgcgccgcc

SEQ ID NO: 3718143 - RNA, 18 nt, Salmonella enterica enterica serovar Typhi Ty2
cgagguucccgccgccau

SEQ ID NO: 3718144 - RNA, 17 nt, Salmonella enterica enterica serovar Typhi Ty2
cgaguagcugagcguca

SEQ ID NO: 3718145 - RNA, 14 nt, Salmonella enterica enterica serovar Typhi Ty2
cgagucacccugca

SEQ ID NO: 3718146 - RNA, 20 nt, Salmonella enterica enterica serovar Typhi Ty2
cgagucgaucgucgggauaa

SEQ ID NO: 3718147 - RNA, 16 nt, Salmonella enterica enterica serovar Typhi Ty2
cgagucgucaguucca

SEQ ID NO: 3718148 - RNA, 16 nt, Salmonella enterica enterica serovar Typhi Ty2
cgagugcguucuucca

SEQ ID NO: 3718149 - RNA, 19 nt, Salmonella enterica enterica serovar Typhi Ty2
cgagugcguucuuccacuu

SEQ ID NO: 3718150 - RNA, 19 nt, Salmonella enterica enterica serovar Typhi Ty2
cgaguggaaucagccagga

SEQ ID NO: 3718151 - RNA, 12 nt, Salmonella enterica enterica serovar Typhi Ty2
cgaguucaaguc

SEQ ID NO: 3718152 - RNA, 16 nt, Salmonella enterica enterica serovar Typhi Ty2
cgaguugcggcaacgu

SEQ ID NO: 3718153 - RNA, 23 nt, Salmonella enterica enterica serovar Typhi Ty2
cgaguuuuaacacuauauguccu

SEQ ID NO: 3718154 - RNA, 14 nt, Salmonella enterica enterica serovar Typhi Ty2
cgauaaaaaagccu

SEQ ID NO: 3718155 - RNA, 14 nt, Salmonella enterica enterica serovar Typhi Ty2
cgauaaaaacagcg

SEQ ID NO: 3718156 - RNA, 18 nt, Salmonella enterica enterica serovar Typhi Ty2
cgauaaaaacccaccagc

SEQ ID NO: 3718157 - RNA, 19 nt, Salmonella enterica enterica serovar Typhi Ty2
cgauaaaaacccaccagcg

SEQ ID NO: 3718158 - RNA, 21 nt, Salmonella enterica enterica serovar Typhi Ty2
cgauaaaaacccaccagcgcc

SEQ ID NO: 3718159 - RNA, 22 nt, Salmonella enterica enterica serovar Typhi Ty2
cgauaaaaacccaccagcgcca

SEQ ID NO: 3718160 - RNA, 22 nt, Salmonella enterica enterica serovar Typhi Ty2
cgauaaacaguuugugccgcca

SEQ ID NO: 3718161 - RNA, 15 nt, Salmonella enterica enterica serovar Typhi Ty2
cgauaaaccaggcag

SEQ ID NO: 3718162 - RNA, 16 nt, Salmonella enterica enterica serovar Typhi Ty2
cgauaaaccgcugcca

SEQ ID NO: 3718163 - RNA, 14 nt, Salmonella enterica enterica serovar Typhi Ty2
cgauaaacgccagc

SEQ ID NO: 3718164 - RNA, 19 nt, Salmonella enterica enterica serovar Typhi Ty2
cgauaaacucaaucaggcu

SEQ ID NO: 3718165 - RNA, 18 nt, Salmonella enterica enterica serovar Typhi Ty2
cgauaaagaacgcgccga

SEQ ID NO: 3718166 - RNA, 23 nt, Salmonella enterica enterica serovar Typhi Ty2
cgauaaagaacgcgccgaccauu

SEQ ID NO: 3718167 - RNA, 14 nt, Salmonella enterica enterica serovar Typhi Ty2
cgauaaauaagaag

SEQ ID NO: 3718168 - RNA, 15 nt, Salmonella enterica enterica serovar Typhi Ty2
cgauaaauaagaagg

SEQ ID NO: 3718169 - RNA, 17 nt, Salmonella enterica enterica serovar Typhi Ty2
cgauaaccaccagcgga

SEQ ID NO: 3718170 - RNA, 15 nt, Salmonella enterica enterica serovar Typhi Ty2
cgauaaccaugcuca

SEQ ID NO: 3718171 - RNA, 17 nt, Salmonella enterica enterica serovar Typhi Ty2
cgauaacccgcgcaugg

SEQ ID NO: 3718172 - RNA, 22 nt, Salmonella enterica enterica serovar Typhi Ty2
cgauaaccggacgauuuaagcu

SEQ ID NO: 3718173 - RNA, 17 nt, Salmonella enterica enterica serovar Typhi Ty2
cgauaaccucucaccgc

SEQ ID NO: 3718174 - RNA, 14 nt, Salmonella enterica enterica serovar Typhi Ty2
cgauaaccuguaaa

SEQ ID NO: 3718175 - RNA, 14 nt, Salmonella enterica enterica serovar Typhi Ty2
cgauaacgcagcgc

SEQ ID NO: 3718176 - RNA, 15 nt, Salmonella enterica enterica serovar Typhi Ty2
cgauaacucuucauc

SEQ ID NO: 3718177 - RNA, 15 nt, Salmonella enterica enterica serovar Typhi Ty2
cgauaagcaagcgcc

SEQ ID NO: 3718178 - RNA, 13 nt, Salmonella enterica enterica serovar Typhi Ty2
cgauaagcgcugu

SEQ ID NO: 3718179 - RNA, 19 nt, Salmonella enterica enterica serovar Typhi Ty2
cgauaaggauaucuugaug

SEQ ID NO: 3718180 - RNA, 20 nt, Salmonella enterica enterica serovar Typhi Ty2
cgauaaggucgcuauccagc

SEQ ID NO: 3718181 - RNA, 18 nt, Salmonella enterica enterica serovar Typhi Ty2
cgauaauaauuaccacgc

SEQ ID NO: 3718182 - RNA, 18 nt, Salmonella enterica enterica serovar Typhi Ty2
cgauaauacagccugcgu

SEQ ID NO: 3718183 - RNA, 18 nt, Salmonella enterica enterica serovar Typhi Ty2
cgauaaucaccagcccga

SEQ ID NO: 3718184 - RNA, 18 nt, Salmonella enterica enterica serovar Typhi Ty2
cgauaaucccggcgcgcg

SEQ ID NO: 3718185 - RNA, 22 nt, Salmonella enterica enterica serovar Typhi Ty2
cgauaaucuccgccgugcguuu

SEQ ID NO: 3718186 - RNA, 18 nt, Salmonella enterica enterica serovar Typhi Ty2
cgauaaugcgguucauuu

SEQ ID NO: 3718187 - RNA, 17 nt, Salmonella enterica enterica serovar Typhi Ty2
cgauaauugcucaccca

SEQ ID NO: 3718188 - RNA, 13 nt, Salmonella enterica enterica serovar Typhi Ty2
cgauacaccuuca

SEQ ID NO: 3718189 - RNA, 15 nt, Salmonella enterica enterica serovar Typhi Ty2
cgauacaccuucaca

SEQ ID NO: 3718190 - RNA, 18 nt, Salmonella enterica enterica serovar Typhi Ty2
cgauacacgccgacgcau

SEQ ID NO: 3718191 - RNA, 21 nt, Salmonella enterica enterica serovar Typhi Ty2
cgauacagcacggcaguacac

SEQ ID NO: 3718192 - RNA, 21 nt, Salmonella enterica enterica serovar Typhi Ty2
cgauacaggacugacugcugu

SEQ ID NO: 3718193 - RNA, 17 nt, Salmonella enterica enterica serovar Typhi Ty2
cgauacccgcccagauc

SEQ ID NO: 3718194 - RNA, 22 nt, Salmonella enterica enterica serovar Typhi Ty2
cgauacccgcccagaucaggcc

SEQ ID NO: 3718195 - RNA, 13 nt, Salmonella enterica enterica serovar Typhi Ty2
cgauaccggcaac

SEQ ID NO: 3718196 - RNA, 17 nt, Salmonella enterica enterica serovar Typhi Ty2
cgauacgccccugcugg

SEQ ID NO: 3718197 - RNA, 18 nt, Salmonella enterica enterica serovar Typhi Ty2
cgauacuccauugucggc

SEQ ID NO: 3718198 - RNA, 16 nt, Salmonella enterica enterica serovar Typhi Ty2
cgauagacagcaccau

SEQ ID NO: 3718199 - RNA, 13 nt, Salmonella enterica enterica serovar Typhi Ty2
cgauagaccacgc

SEQ ID NO: 3718200 - RNA, 19 nt, Salmonella enterica enterica serovar Typhi Ty2
cgauagagaccgcuuuagc

SEQ ID NO: 3718201 - RNA, 18 nt, Salmonella enterica enterica serovar Typhi Ty2
cgauagagacugccgccg

SEQ ID NO: 3718202 - RNA, 12 nt, Salmonella enterica enterica serovar Typhi Ty2
cgauagcgccgc

SEQ ID NO: 3718203 - RNA, 16 nt, Salmonella enterica enterica serovar Typhi Ty2
cgauagcugcugacgu

SEQ ID NO: 3718204 - RNA, 17 nt, Salmonella enterica enterica serovar Typhi Ty2
cgauaggugacuuuccu

SEQ ID NO: 3718205 - RNA, 18 nt, Salmonella enterica enterica serovar Typhi Ty2
cgauaggugccgccgcac

SEQ ID NO: 3718206 - RNA, 18 nt, Salmonella enterica enterica serovar Typhi Ty2
cgauaguccauuuuccua

SEQ ID NO: 3718207 - RNA, 18 nt, Salmonella enterica enterica serovar Typhi Ty2
cgauaguguaaacgcgcc

SEQ ID NO: 3718208 - RNA, 13 nt, Salmonella enterica enterica serovar Typhi Ty2
cgauauaagcgcc

SEQ ID NO: 3718209 - RNA, 20 nt, Salmonella enterica enterica serovar Typhi Ty2
cgauggugcggcgcacugcc

SEQ ID NO: 3718210 - RNA, 21 nt, Salmonella enterica enterica serovar Typhi Ty2
cgaugguguuggcaaucagcg

SEQ ID NO: 3718211 - RNA, 18 nt, Salmonella enterica enterica serovar Typhi Ty2
cgauguauuuauccacgc

SEQ ID NO: 3718212 - RNA, 14 nt, Salmonella enterica enterica serovar Typhi Ty2
cgaugucgccgccg

SEQ ID NO: 3718213 - RNA, 23 nt, Salmonella enterica enterica serovar Typhi Ty2
cgaugugcguauugagcgcagug

SEQ ID NO: 3718214 - RNA, 20 nt, Salmonella enterica enterica serovar Typhi Ty2
cgauguucggauaaacgcug

SEQ ID NO: 3718215 - RNA, 16 nt, Salmonella enterica enterica serovar Typhi Ty2
cgauuaacgcauguuc

SEQ ID NO: 3718216 - RNA, 17 nt, Salmonella enterica enterica serovar Typhi Ty2
cgauuaaugcuccaaua

SEQ ID NO: 3718217 - RNA, 21 nt, Salmonella enterica enterica serovar Typhi Ty2
cgauuaaugcuccaauaaaua

SEQ ID NO: 3718218 - RNA, 16 nt, Salmonella enterica enterica serovar Typhi Ty2
cgauucaaucugguga

SEQ ID NO: 3718219 - RNA, 16 nt, Salmonella enterica enterica serovar Typhi Ty2
cgauucgcaugaauuc

SEQ ID NO: 3718220 - RNA, 16 nt, Salmonella enterica enterica serovar Typhi Ty2
cgauugcggaggccgg

SEQ ID NO: 3718221 - RNA, 18 nt, Salmonella enterica enterica serovar Typhi Ty2
cgauugcggaggccggcc

SEQ ID NO: 3718222 - RNA, 13 nt, Salmonella enterica enterica serovar Typhi Ty2
cgauugucaucau

SEQ ID NO: 3718223 - RNA, 20 nt, Salmonella enterica enterica serovar Typhi Ty2
cgauugucaucauucgcgaa

SEQ ID NO: 3718224 - RNA, 21 nt, Salmonella enterica enterica serovar Typhi Ty2
cgauuuaccucucaccaguag

SEQ ID NO: 3718225 - RNA, 15 nt, Salmonella enterica enterica serovar Typhi Ty2
cgauuuauccaccgc

SEQ ID NO: 3718226 - RNA, 12 nt, Salmonella enterica enterica serovar Typhi Ty2
cgauuuauucuu

SEQ ID NO: 3718227 - RNA, 17 nt, Salmonella enterica enterica serovar Typhi Ty2
cgauuucauuacgccug

SEQ ID NO: 3718228 - RNA, 18 nt, Salmonella enterica enterica serovar Typhi Ty2
cgauuucauuacgccugu

SEQ ID NO: 3718229 - RNA, 14 nt, Salmonella enterica enterica serovar Typhi Ty2
cgauuuccagcgaa

SEQ ID NO: 3718230 - RNA, 20 nt, Salmonella enterica enterica serovar Typhi Ty2
cgauuuccuguguuacgcca

SEQ ID NO: 3718231 - RNA, 16 nt, Salmonella enterica enterica serovar Typhi Ty2
cgauuuuaugcauggu

SEQ ID NO: 3718232 - RNA, 20 nt, Salmonella enterica enterica serovar Typhi Ty2
cgauuuucagcaccuuacga

SEQ ID NO: 3718233 - RNA, 21 nt, Salmonella enterica enterica serovar Typhi Ty2
cgauuuucccuucugaaauga

SEQ ID NO: 3718234 - RNA, 20 nt, Salmonella enterica enterica serovar Typhi Ty2
cgauuuugaacaugcgcaga

SEQ ID NO: 3718235 - RNA, 19 nt, Salmonella enterica enterica serovar Typhi Ty2
cgauuuuugaucucuuuag

SEQ ID NO: 3718236 - RNA, 15 nt, Salmonella enterica enterica serovar Typhi Ty2
cgcaaaaccauacug

SEQ ID NO: 3718237 - RNA, 14 nt, Salmonella enterica enterica serovar Typhi Ty2
cgcaaaaccuucau

SEQ ID NO: 3718238 - RNA, 20 nt, Salmonella enterica enterica serovar Typhi Ty2
cgcaaacagagcgccggcaa

SEQ ID NO: 3718239 - RNA, 15 nt, Salmonella enterica enterica serovar Typhi Ty2
cgcaaacaguacgcc

SEQ ID NO: 3718240 - RNA, 22 nt, Salmonella enterica enterica serovar Typhi Ty2
cgcaaaccgcuuucaucauauc

SEQ ID NO: 3718241 - RNA, 11 nt, Salmonella enterica enterica serovar Typhi Ty2
cgcaaacugcc

SEQ ID NO: 3718242 - RNA, 19 nt, Salmonella enterica enterica serovar Typhi Ty2
cgcaaacugccaggcaauc

SEQ ID NO: 3718243 - RNA, 17 nt, Salmonella enterica enterica serovar Typhi Ty2
cgcaaacuggccacagc

SEQ ID NO: 3718244 - RNA, 22 nt, Salmonella enterica enterica serovar Typhi Ty2
cgcaaacuuugcgccauuucaa

SEQ ID NO: 3718245 - RNA, 19 nt, Salmonella enterica enterica serovar Typhi Ty2
cgcaaagacaggugaccag

SEQ ID NO: 3718246 - RNA, 16 nt, Salmonella enterica enterica serovar Typhi Ty2
cgcaaagcccaucagc

SEQ ID NO: 3718247 - RNA, 20 nt, Salmonella enterica enterica serovar Typhi Ty2
cgcaaagcccaucagcgcca

SEQ ID NO: 3718248 - RNA, 16 nt, Salmonella enterica enterica serovar Typhi Ty2
cgcaaaggaccaacac

SEQ ID NO: 3718249 - RNA, 22 nt, Salmonella enterica enterica serovar Typhi Ty2
cgcaaaguuuucuuccgugccg

SEQ ID NO: 3718250 - RNA, 17 nt, Salmonella enterica enterica serovar Typhi Ty2
cgcaaaugaccagauca

SEQ ID NO: 3718251 - RNA, 19 nt, Salmonella enterica enterica serovar Typhi Ty2
cgcaaauucgucgccgcca

SEQ ID NO: 3718252 - RNA, 16 nt, Salmonella enterica enterica serovar Typhi Ty2
cgcaacaggccgcauc

SEQ ID NO: 3718253 - RNA, 18 nt, Salmonella enterica enterica serovar Typhi Ty2
cgcaacaggccgcaucgg

SEQ ID NO: 3718254 - RNA, 14 nt, Salmonella enterica enterica serovar Typhi Ty2
cgcaaccuccgcgg

SEQ ID NO: 3718255 - RNA, 23 nt, Salmonella enterica enterica serovar Typhi Ty2
cgcaacgccggugccugccgccu

SEQ ID NO: 3718256 - RNA, 13 nt, Salmonella enterica enterica serovar Typhi Ty2
cgcaacgcgcacg

SEQ ID NO: 3718257 - RNA, 16 nt, Salmonella enterica enterica serovar Typhi Ty2
cgcaacgcgcacggcg

SEQ ID NO: 3718258 - RNA, 23 nt, Salmonella enterica enterica serovar Typhi Ty2
cgcaacgcuuaucaguccccaca

SEQ ID NO: 3718259 - RNA, 16 nt, Salmonella enterica enterica serovar Typhi Ty2
cgcaacguuucuuuca

SEQ ID NO: 3718260 - RNA, 21 nt, Salmonella enterica enterica serovar Typhi Ty2
cgcaacguuucuuucaucaga

SEQ ID NO: 3718261 - RNA, 19 nt, Salmonella enterica enterica serovar Typhi Ty2
cgcaacuuaguguccacuc

SEQ ID NO: 3718262 - RNA, 20 nt, Salmonella enterica enterica serovar Typhi Ty2
cgcaacuucugcuggcggaa

SEQ ID NO: 3718263 - RNA, 18 nt, Salmonella enterica enterica serovar Typhi Ty2
cgcaagauuccagauagc

SEQ ID NO: 3718264 - RNA, 22 nt, Salmonella enterica enterica serovar Typhi Ty2
cgcaagcacugaaugcugacgc

SEQ ID NO: 3718265 - RNA, 13 nt, Salmonella enterica enterica serovar Typhi Ty2
cgcaagcagcaca

SEQ ID NO: 3718266 - RNA, 14 nt, Salmonella enterica enterica serovar Typhi Ty2
cgcaagcggcguuc

SEQ ID NO: 3718267 - RNA, 11 nt, Salmonella enterica enterica serovar Typhi Ty2
cgcaaggaaau

SEQ ID NO: 3718268 - RNA, 22 nt, Salmonella enterica enterica serovar Typhi Ty2
cgcaauaacugacucugccuca

SEQ ID NO: 3718269 - RNA, 18 nt, Salmonella enterica enterica serovar Typhi Ty2
cgcaauagggggugacau

SEQ ID NO: 3718270 - RNA, 14 nt, Salmonella enterica enterica serovar Typhi Ty2
cgcaauaugcguca

SEQ ID NO: 3718271 - RNA, 21 nt, Salmonella enterica enterica serovar Typhi Ty2
cgcaaucacgcguuauacgca

SEQ ID NO: 3718272 - RNA, 15 nt, Salmonella enterica enterica serovar Typhi Ty2
cgcaaucaugacaga

SEQ ID NO: 3718273 - RNA, 13 nt, Salmonella enterica enterica serovar Typhi Ty2
cgcaauccccugg

SEQ ID NO: 3718274 - RNA, 12 nt, Salmonella enterica enterica serovar Typhi Ty2
cgcaauccgcgc

SEQ ID NO: 3718275 - RNA, 14 nt, Salmonella enterica enterica serovar Typhi Ty2
cgcaaucgccgauc

SEQ ID NO: 3718276 - RNA, 16 nt, Salmonella enterica enterica serovar Typhi Ty2
cgcaaucggcuuugac

SEQ ID NO: 3718277 - RNA, 18 nt, Salmonella enterica enterica serovar Typhi Ty2
cgcaaucuccgccgcuuu

SEQ ID NO: 3718278 - RNA, 21 nt, Salmonella enterica enterica serovar Typhi Ty2
cgcaaucucuuccgcccagau

SEQ ID NO: 3718279 - RNA, 21 nt, Salmonella enterica enterica serovar Typhi Ty2
cgcaaucucuuuauugcuggu

SEQ ID NO: 3718280 - RNA, 17 nt, Salmonella enterica enterica serovar Typhi Ty2
cgcaaucuggcggacaa

SEQ ID NO: 3718281 - RNA, 15 nt, Salmonella enterica enterica serovar Typhi Ty2
cgcaaugccaccaca

SEQ ID NO: 3718282 - RNA, 19 nt, Salmonella enterica enterica serovar Typhi Ty2
cgcaaugccugaccaacgu

SEQ ID NO: 3718283 - RNA, 18 nt, Salmonella enterica enterica serovar Typhi Ty2
cgcaauguggacaaucag

SEQ ID NO: 3718284 - RNA, 22 nt, Salmonella enterica enterica serovar Typhi Ty2
cgcaauuccugacugcgcgccu

SEQ ID NO: 3718285 - RNA, 23 nt, Salmonella enterica enterica serovar Typhi Ty2
cgcaauugguaauuaaaggcagc

SEQ ID NO: 3718286 - RNA, 15 nt, Salmonella enterica enterica serovar Typhi Ty2
cgcacaaaccgcgcg

SEQ ID NO: 3718287 - RNA, 22 nt, Salmonella enterica enterica serovar Typhi Ty2
cgcacaaucgccgugaucccaa

SEQ ID NO: 3718288 - RNA, 15 nt, Salmonella enterica enterica serovar Typhi Ty2
cgcacacgccgugca

SEQ ID NO: 3718289 - RNA, 12 nt, Salmonella enterica enterica serovar Typhi Ty2
cgcacagcgcca

SEQ ID NO: 3718290 - RNA, 18 nt, Salmonella enterica enterica serovar Typhi Ty2
cgcacagggugaaaucac

SEQ ID NO: 3718291 - RNA, 18 nt, Salmonella enterica enterica serovar Typhi Ty2
cgcagucagcacuggcga

SEQ ID NO: 3718292 - RNA, 23 nt, Salmonella enterica enterica serovar Typhi Ty2
cgcaguccaacaaggauauccgc

SEQ ID NO: 3718293 - RNA, 22 nt, Salmonella enterica enterica serovar Typhi Ty2
cgcaguccagaugcgccagauu

SEQ ID NO: 3718294 - RNA, 22 nt, Salmonella enterica enterica serovar Typhi Ty2
cgcagucguuucuauuauugau

SEQ ID NO: 3718295 - RNA, 14 nt, Salmonella enterica enterica serovar Typhi Ty2
cgcagugaccagca

SEQ ID NO: 3718296 - RNA, 16 nt, Salmonella enterica enterica serovar Typhi Ty2
cgcagugaccagcauc

SEQ ID NO: 3718297 - RNA, 16 nt, Salmonella enterica enterica serovar Typhi Ty2
cgcagugcagcggaug

SEQ ID NO: 3718298 - RNA, 19 nt, Salmonella enterica enterica serovar Typhi Ty2
cgcaguucauccacgcggg

SEQ ID NO: 3718299 - RNA, 15 nt, Salmonella enterica enterica serovar Typhi Ty2
cgcaguucgccgcca

SEQ ID NO: 3718300 - RNA, 17 nt, Salmonella enterica enterica serovar Typhi Ty2
cgcaguugggcgcgcga

SEQ ID NO: 3718301 - RNA, 14 nt, Salmonella enterica enterica serovar Typhi Ty2
cgcauaaaaaauga

SEQ ID NO: 3718302 - RNA, 13 nt, Salmonella enterica enterica serovar Typhi Ty2
cgcauaaccgauu

SEQ ID NO: 3718303 - RNA, 17 nt, Salmonella enterica enterica serovar Typhi Ty2
cgcauaaugagcgcuug

SEQ ID NO: 3718304 - RNA, 19 nt, Salmonella enterica enterica serovar Typhi Ty2
cgcauaaugcgccccgcaa

SEQ ID NO: 3718305 - RNA, 22 nt, Salmonella enterica enterica serovar Typhi Ty2
cgcauacaucgcagacauggca

SEQ ID NO: 3718306 - RNA, 17 nt, Salmonella enterica enterica serovar Typhi Ty2
cgcauaccuucaugcau

SEQ ID NO: 3718307 - RNA, 22 nt, Salmonella enterica enterica serovar Typhi Ty2
cgcauacgccccgguggcggua

SEQ ID NO: 3718308 - RNA, 15 nt, Salmonella enterica enterica serovar Typhi Ty2
cgcauacuaccgcug

SEQ ID NO: 3718309 - RNA, 19 nt, Salmonella enterica enterica serovar Typhi Ty2
cgcauacucuuggagagca

SEQ ID NO: 3718310 - RNA, 22 nt, Salmonella enterica enterica serovar Typhi Ty2
cgcauagacgcccugcaaagca

SEQ ID NO: 3718311 - RNA, 21 nt, Salmonella enterica enterica serovar Typhi Ty2
cgcauagauauaaacgcccga

SEQ ID NO: 3718312 - RNA, 13 nt, Salmonella enterica enterica serovar Typhi Ty2
cgcauagcggcca

SEQ ID NO: 3718313 - RNA, 16 nt, Salmonella enterica enterica serovar Typhi Ty2
cgcauagcggccagau

SEQ ID NO: 3718314 - RNA, 13 nt, Salmonella enterica enterica serovar Typhi Ty2
cgcauagcugccc

SEQ ID NO: 3718315 - RNA, 18 nt, Salmonella enterica enterica serovar Typhi Ty2
cgcauaggcuuugcugag

SEQ ID NO: 3718316 - RNA, 23 nt, Salmonella enterica enterica serovar Typhi Ty2
cgcauauuuuuuaccgcccgcuu

SEQ ID NO: 3718317 - RNA, 19 nt, Salmonella enterica enterica serovar Typhi Ty2
cgcaucaacguaaauagag

SEQ ID NO: 3718318 - RNA, 20 nt, Salmonella enterica enterica serovar Typhi Ty2
cgcaucaaugcccagcgcaa

SEQ ID NO: 3718319 - RNA, 22 nt, Salmonella enterica enterica serovar Typhi Ty2
cgcaucacgcgaagcggcguca

SEQ ID NO: 3718320 - RNA, 14 nt, Salmonella enterica enterica serovar Typhi Ty2
cgcaucagaaaaac

SEQ ID NO: 3718321 - RNA, 18 nt, Salmonella enterica enterica serovar Typhi Ty2
cgcaucagaccuccgcca

SEQ ID NO: 3718322 - RNA, 18 nt, Salmonella enterica enterica serovar Typhi Ty2
cgcaucaggaucuucauc

SEQ ID NO: 3718323 - RNA, 15 nt, Salmonella enterica enterica serovar Typhi Ty2
cgcaucauucaucuc

SEQ ID NO: 3718324 - RNA, 13 nt, Salmonella enterica enterica serovar Typhi Ty2
cgcauccagccac

SEQ ID NO: 3718325 - RNA, 13 nt, Salmonella enterica enterica serovar Typhi Ty2
cgcauccagcgca

SEQ ID NO: 3718326 - RNA, 13 nt, Salmonella enterica enterica serovar Typhi Ty2
cgcauccagcguc

SEQ ID NO: 3718327 - RNA, 14 nt, Salmonella enterica enterica serovar Typhi Ty2
cgcauccagcguca

SEQ ID NO: 3718328 - RNA, 14 nt, Salmonella enterica enterica serovar Typhi Ty2
cgcaucccgccaac

SEQ ID NO: 3718329 - RNA, 18 nt, Salmonella enterica enterica serovar Typhi Ty2
cgcauccggcaaaacgaa

SEQ ID NO: 3718330 - RNA, 14 nt, Salmonella enterica enterica serovar Typhi Ty2
cgcauccggcauca

SEQ ID NO: 3718331 - RNA, 22 nt, Salmonella enterica enterica serovar Typhi Ty2
cgcauccgggaguuucaugcca

SEQ ID NO: 3718332 - RNA, 24 nt, Salmonella enterica enterica serovar Typhi Ty2
cgcauccgggaguuucaugccaua

SEQ ID NO: 3718333 - RNA, 23 nt, Salmonella enterica enterica serovar Typhi Ty2
cgcauccuguuuuuucagcgcgc

SEQ ID NO: 3718334 - RNA, 16 nt, Salmonella enterica enterica serovar Typhi Ty2
cgcaucgauaucuuua

SEQ ID NO: 3718335 - RNA, 17 nt, Salmonella enterica enterica serovar Typhi Ty2
cgcaucgccgcggcgcu

SEQ ID NO: 3718336 - RNA, 12 nt, Salmonella enterica enterica serovar Typhi Ty2
cgcaucgguaau

SEQ ID NO: 3718337 - RNA, 16 nt, Salmonella enterica enterica serovar Typhi Ty2
cgcaucguggccgaua

SEQ ID NO: 3718338 - RNA, 16 nt, Salmonella enterica enterica serovar Typhi Ty2
cgcaucucccugccag

SEQ ID NO: 3718339 - RNA, 20 nt, Salmonella enterica enterica serovar Typhi Ty2
cgcaucugacaucagaaaau

SEQ ID NO: 3718340 - RNA, 16 nt, Salmonella enterica enterica serovar Typhi Ty2
cgcaucuucgcccggc

SEQ ID NO: 3718341 - RNA, 14 nt, Salmonella enterica enterica serovar Typhi Ty2
cgcaucuuuuuccc

SEQ ID NO: 3718342 - RNA, 22 nt, Salmonella enterica enterica serovar Typhi Ty2
cgcaugaucucuugcauaauau

SEQ ID NO: 3718343 - RNA, 21 nt, Salmonella enterica enterica serovar Typhi Ty2
cgcauggacaaggaucguuac

SEQ ID NO: 3718344 - RNA, 17 nt, Salmonella enterica enterica serovar Typhi Ty2
cgcauggcagggcgaua

SEQ ID NO: 3718345 - RNA, 15 nt, Salmonella enterica enterica serovar Typhi Ty2
cgcauggcguugcug

SEQ ID NO: 3718346 - RNA, 15 nt, Salmonella enterica enterica serovar Typhi Ty2
cgcauggggagaccc

SEQ ID NO: 3718347 - RNA, 21 nt, Salmonella enterica enterica serovar Typhi Ty2
cgcaugugagcaucggcgauu

SEQ ID NO: 3718348 - RNA, 14 nt, Salmonella enterica enterica serovar Typhi Ty2
cgcauguuccgcua

SEQ ID NO: 3718349 - RNA, 16 nt, Salmonella enterica enterica serovar Typhi Ty2
cgcauguuucgcuuca

SEQ ID NO: 3718350 - RNA, 22 nt, Salmonella enterica enterica serovar Typhi Ty2
cgcauuaauauuucacgagcga

SEQ ID NO: 3718351 - RNA, 12 nt, Salmonella enterica enterica serovar Typhi Ty2
cgcauucauaag

SEQ ID NO: 3718352 - RNA, 17 nt, Salmonella enterica enterica serovar Typhi Ty2
cgcauucucgccgugac

SEQ ID NO: 3718353 - RNA, 20 nt, Salmonella enterica enterica serovar Typhi Ty2
cgcauucuucagcgcguccu

SEQ ID NO: 3718354 - RNA, 13 nt, Salmonella enterica enterica serovar Typhi Ty2
cgcauucuuuuuu

SEQ ID NO: 3718355 - RNA, 13 nt, Salmonella enterica enterica serovar Typhi Ty2
cgcauuuaaucgc

SEQ ID NO: 3718356 - RNA, 23 nt, Salmonella enterica enterica serovar Typhi Ty2
cgcauuuaaucgccugcgcgccu

SEQ ID NO: 3718357 - RNA, 19 nt, Salmonella enterica enterica serovar Typhi Ty2
cgcauuucaagcaggcgau

SEQ ID NO: 3718358 - RNA, 16 nt, Salmonella enterica enterica serovar Typhi Ty2
cgcauuuuaccucacg

SEQ ID NO: 3718359 - RNA, 16 nt, Salmonella enterica enterica serovar Typhi Ty2
cgccaaaaucaggcau

SEQ ID NO: 3718360 - RNA, 14 nt, Salmonella enterica enterica serovar Typhi Ty2
cgccaaaccggcga

SEQ ID NO: 3718361 - RNA, 19 nt, Salmonella enterica enterica serovar Typhi Ty2
cgccaaaccugccacaggc

SEQ ID NO: 3718362 - RNA, 21 nt, Salmonella enterica enterica serovar Typhi Ty2
cgccaaacgggcaagccagca

SEQ ID NO: 3718363 - RNA, 17 nt, Salmonella enterica enterica serovar Typhi Ty2
cgccaaacguggcggca

SEQ ID NO: 3718364 - RNA, 19 nt, Salmonella enterica enterica serovar Typhi Ty2
cgccaaacugcgcgccgcc

SEQ ID NO: 3718365 - RNA, 18 nt, Salmonella enterica enterica serovar Typhi Ty2
cgccaaagcagcugcugg

SEQ ID NO: 3718366 - RNA, 23 nt, Salmonella enterica enterica serovar Typhi Ty2
cgccaaagcagugaauccccaga

SEQ ID NO: 3718367 - RNA, 19 nt, Salmonella enterica enterica serovar Typhi Ty2
cgccaaagcgauccggcau

SEQ ID NO: 3718368 - RNA, 18 nt, Salmonella enterica enterica serovar Typhi Ty2
cgccaaaguuaaucagcg

SEQ ID NO: 3718369 - RNA, 16 nt, Salmonella enterica enterica serovar Typhi Ty2
cgccaacaccgcaucg

SEQ ID NO: 3718370 - RNA, 15 nt, Salmonella enterica enterica serovar Typhi Ty2
cgccaaccaucggca

SEQ ID NO: 3718371 - RNA, 13 nt, Salmonella enterica enterica serovar Typhi Ty2
cgccaaccgccau

SEQ ID NO: 3718372 - RNA, 12 nt, Salmonella enterica enterica serovar Typhi Ty2
cgccaaccggcu

SEQ ID NO: 3718373 - RNA, 13 nt, Salmonella enterica enterica serovar Typhi Ty2
cgccagcaacgcc

SEQ ID NO: 3718374 - RNA, 14 nt, Salmonella enterica enterica serovar Typhi Ty2
cgccagcaacgccc

SEQ ID NO: 3718375 - RNA, 15 nt, Salmonella enterica enterica serovar Typhi Ty2
cgccagcaacgccca

SEQ ID NO: 3718376 - RNA, 20 nt, Salmonella enterica enterica serovar Typhi Ty2
cgccagcaaugccgccgcca

SEQ ID NO: 3718377 - RNA, 21 nt, Salmonella enterica enterica serovar Typhi Ty2
cgccagcaaugccgccgccag

SEQ ID NO: 3718378 - RNA, 14 nt, Salmonella enterica enterica serovar Typhi Ty2
cgccagcaccacgu

SEQ ID NO: 3718379 - RNA, 16 nt, Salmonella enterica enterica serovar Typhi Ty2
cgccagcaccagcagc

SEQ ID NO: 3718380 - RNA, 13 nt, Salmonella enterica enterica serovar Typhi Ty2
cgccagcagcagc

SEQ ID NO: 3718381 - RNA, 11 nt, Salmonella enterica enterica serovar Typhi Ty2
cgccagcagcg

SEQ ID NO: 3718382 - RNA, 13 nt, Salmonella enterica enterica serovar Typhi Ty2
cgccagcagcgcg

SEQ ID NO: 3718383 - RNA, 13 nt, Salmonella enterica enterica serovar Typhi Ty2
cgccagcagcucg

SEQ ID NO: 3718384 - RNA, 22 nt, Salmonella enterica enterica serovar Typhi Ty2
cgccagcauaugcacacgcagc

SEQ ID NO: 3718385 - RNA, 20 nt, Salmonella enterica enterica serovar Typhi Ty2
cgccagcaucggcagcgcca

SEQ ID NO: 3718386 - RNA, 13 nt, Salmonella enterica enterica serovar Typhi Ty2
cgccagcauggcg

SEQ ID NO: 3718387 - RNA, 14 nt, Salmonella enterica enterica serovar Typhi Ty2
cgccagcauuucaa

SEQ ID NO: 3718388 - RNA, 15 nt, Salmonella enterica enterica serovar Typhi Ty2
cgccagccacugacu

SEQ ID NO: 3718389 - RNA, 18 nt, Salmonella enterica enterica serovar Typhi Ty2
cgccagccacugggugau

SEQ ID NO: 3718390 - RNA, 19 nt, Salmonella enterica enterica serovar Typhi Ty2
cgccagccagcucaccagc

SEQ ID NO: 3718391 - RNA, 21 nt, Salmonella enterica enterica serovar Typhi Ty2
cgccagccauuaaagaaggcg

SEQ ID NO: 3718392 - RNA, 18 nt, Salmonella enterica enterica serovar Typhi Ty2
cgccagccgaucaucgua

SEQ ID NO: 3718393 - RNA, 21 nt, Salmonella enterica enterica serovar Typhi Ty2
cgccagccgaucaucguacca

SEQ ID NO: 3718394 - RNA, 14 nt, Salmonella enterica enterica serovar Typhi Ty2
cgccagccgcgcca

SEQ ID NO: 3718395 - RNA, 15 nt, Salmonella enterica enterica serovar Typhi Ty2
cgccagccgcgccau

SEQ ID NO: 3718396 - RNA, 19 nt, Salmonella enterica enterica serovar Typhi Ty2
cgccagccgcgccaucucc

SEQ ID NO: 3718397 - RNA, 16 nt, Salmonella enterica enterica serovar Typhi Ty2
cgccagccuaucgcca

SEQ ID NO: 3718398 - RNA, 18 nt, Salmonella enterica enterica serovar Typhi Ty2
cgccagccuaucgccaua

SEQ ID NO: 3718399 - RNA, 15 nt, Salmonella enterica enterica serovar Typhi Ty2
cgccagcgagaugaa

SEQ ID NO: 3718400 - RNA, 19 nt, Salmonella enterica enterica serovar Typhi Ty2
cgccagcgagaugaaaagu

SEQ ID NO: 3718401 - RNA, 14 nt, Salmonella enterica enterica serovar Typhi Ty2
cgccagcgcaacgc

SEQ ID NO: 3718402 - RNA, 12 nt, Salmonella enterica enterica serovar Typhi Ty2
cgccagcgcauc

SEQ ID NO: 3718403 - RNA, 16 nt, Salmonella enterica enterica serovar Typhi Ty2
cgccagcgccaccugc

SEQ ID NO: 3718404 - RNA, 13 nt, Salmonella enterica enterica serovar Typhi Ty2
cgccagcgccgga

SEQ ID NO: 3718405 - RNA, 15 nt, Salmonella enterica enterica serovar Typhi Ty2
cgccagcgcgguggc

SEQ ID NO: 3718406 - RNA, 23 nt, Salmonella enterica enterica serovar Typhi Ty2
cgccagcgcgguuucuacaccuu

SEQ ID NO: 3718407 - RNA, 20 nt, Salmonella enterica enterica serovar Typhi Ty2
cgccagcgcuacccgcugac

SEQ ID NO: 3718408 - RNA, 19 nt, Salmonella enterica enterica serovar Typhi Ty2
cgccagcggcgacaguaac

SEQ ID NO: 3718409 - RNA, 20 nt, Salmonella enterica enterica serovar Typhi Ty2
cgccagcggcgccaucacca

SEQ ID NO: 3718410 - RNA, 21 nt, Salmonella enterica enterica serovar Typhi Ty2
cgccagcggcgccaucaccau

SEQ ID NO: 3718411 - RNA, 14 nt, Salmonella enterica enterica serovar Typhi Ty2
cgccagcggcguuu

SEQ ID NO: 3718412 - RNA, 18 nt, Salmonella enterica enterica serovar Typhi Ty2
cgccagcgugcuuaaucc

SEQ ID NO: 3718413 - RNA, 15 nt, Salmonella enterica enterica serovar Typhi Ty2
cgccagcuacgacaa

SEQ ID NO: 3718414 - RNA, 13 nt, Salmonella enterica enterica serovar Typhi Ty2
cgccagcucaacg

SEQ ID NO: 3718415 - RNA, 13 nt, Salmonella enterica enterica serovar Typhi Ty2
cgccagcucaugc

SEQ ID NO: 3718416 - RNA, 12 nt, Salmonella enterica enterica serovar Typhi Ty2
cgccagcucugc

SEQ ID NO: 3718417 - RNA, 17 nt, Salmonella enterica enterica serovar Typhi Ty2
cgccaggauaauaauga

SEQ ID NO: 3718418 - RNA, 20 nt, Salmonella enterica enterica serovar Typhi Ty2
cgccaggaucgccgccgcga

SEQ ID NO: 3718419 - RNA, 11 nt, Salmonella enterica enterica serovar Typhi Ty2
cgccaggccau

SEQ ID NO: 3718420 - RNA, 17 nt, Salmonella enterica enterica serovar Typhi Ty2
cgccaggccaucgacga

SEQ ID NO: 3718421 - RNA, 15 nt, Salmonella enterica enterica serovar Typhi Ty2
cgccaggccauugcu

SEQ ID NO: 3718422 - RNA, 18 nt, Salmonella enterica enterica serovar Typhi Ty2
cgccaggcccagccgcuc

SEQ ID NO: 3718423 - RNA, 18 nt, Salmonella enterica enterica serovar Typhi Ty2
cgccaggccgcggcugua

SEQ ID NO: 3718424 - RNA, 16 nt, Salmonella enterica enterica serovar Typhi Ty2
cgccagggcuucugcu

SEQ ID NO: 3718425 - RNA, 16 nt, Salmonella enterica enterica serovar Typhi Ty2
cgccaggguaucguca

SEQ ID NO: 3718426 - RNA, 22 nt, Salmonella enterica enterica serovar Typhi Ty2
cgccagguagccgacggccaua

SEQ ID NO: 3718427 - RNA, 19 nt, Salmonella enterica enterica serovar Typhi Ty2
cgccaggucucauagcgcc

SEQ ID NO: 3718428 - RNA, 13 nt, Salmonella enterica enterica serovar Typhi Ty2
cgccagucacccu

SEQ ID NO: 3718429 - RNA, 15 nt, Salmonella enterica enterica serovar Typhi Ty2
cgccagucaggcgau

SEQ ID NO: 3718430 - RNA, 15 nt, Salmonella enterica enterica serovar Typhi Ty2
cgccagucccagcac

SEQ ID NO: 3718431 - RNA, 16 nt, Salmonella enterica enterica serovar Typhi Ty2
cgccagugaauccacc

SEQ ID NO: 3718432 - RNA, 11 nt, Salmonella enterica enterica serovar Typhi Ty2
cgccagugaca

SEQ ID NO: 3718433 - RNA, 14 nt, Salmonella enterica enterica serovar Typhi Ty2
cgccagugacgcca

SEQ ID NO: 3718434 - RNA, 20 nt, Salmonella enterica enterica serovar Typhi Ty2
cgccagugacgccaguuccc

SEQ ID NO: 3718435 - RNA, 17 nt, Salmonella enterica enterica serovar Typhi Ty2
cgccagugaugccaaac

SEQ ID NO: 3718436 - RNA, 16 nt, Salmonella enterica enterica serovar Typhi Ty2
cgccaguuauucgacu

SEQ ID NO: 3718437 - RNA, 16 nt, Salmonella enterica enterica serovar Typhi Ty2
cgccaguucagcgucu

SEQ ID NO: 3718438 - RNA, 17 nt, Salmonella enterica enterica serovar Typhi Ty2
cgccaguuccaucauug

SEQ ID NO: 3718439 - RNA, 20 nt, Salmonella enterica enterica serovar Typhi Ty2
cgccaguucccacagcuuca

SEQ ID NO: 3718440 - RNA, 17 nt, Salmonella enterica enterica serovar Typhi Ty2
cgccaguuucuuuuucc

SEQ ID NO: 3718441 - RNA, 16 nt, Salmonella enterica enterica serovar Typhi Ty2
cgccaguuuuuauacu

SEQ ID NO: 3718442 - RNA, 15 nt, Salmonella enterica enterica serovar Typhi Ty2
cgccauaaagcugua

SEQ ID NO: 3718443 - RNA, 18 nt, Salmonella enterica enterica serovar Typhi Ty2
cgccauaaaucagaucca

SEQ ID NO: 3718444 - RNA, 20 nt, Salmonella enterica enterica serovar Typhi Ty2
cgccauaaaucccggcgauu

SEQ ID NO: 3718445 - RNA, 14 nt, Salmonella enterica enterica serovar Typhi Ty2
cgccauaacacaaa

SEQ ID NO: 3718446 - RNA, 14 nt, Salmonella enterica enterica serovar Typhi Ty2
cgccauaacgccgg

SEQ ID NO: 3718447 - RNA, 11 nt, Salmonella enterica enterica serovar Typhi Ty2
cgccauaauac

SEQ ID NO: 3718448 - RNA, 19 nt, Salmonella enterica enterica serovar Typhi Ty2
cgccauaauacuuaauuca

SEQ ID NO: 3718449 - RNA, 23 nt, Salmonella enterica enterica serovar Typhi Ty2
cgccauaauacuuaauucauaac

SEQ ID NO: 3718450 - RNA, 13 nt, Salmonella enterica enterica serovar Typhi Ty2
cgccauacguccg

SEQ ID NO: 3718451 - RNA, 16 nt, Salmonella enterica enterica serovar Typhi Ty2
cgccauacuuacugcu

SEQ ID NO: 3718452 - RNA, 16 nt, Salmonella enterica enterica serovar Typhi Ty2
cgccauauacgccacg

SEQ ID NO: 3718453 - RNA, 19 nt, Salmonella enterica enterica serovar Typhi Ty2
cgccauauauuuacugaau

SEQ ID NO: 3718454 - RNA, 23 nt, Salmonella enterica enterica serovar Typhi Ty2
cgccauauauuuacugaauaaau

SEQ ID NO: 3718455 - RNA, 16 nt, Salmonella enterica enterica serovar Typhi Ty2
cgccauaucgccgcca

SEQ ID NO: 3718456 - RNA, 21 nt, Salmonella enterica enterica serovar Typhi Ty2
cgcccauuccgccugccgcgc

SEQ ID NO: 3718457 - RNA, 12 nt, Salmonella enterica enterica serovar Typhi Ty2
cgccccaaagcg

SEQ ID NO: 3718458 - RNA, 16 nt, Salmonella enterica enterica serovar Typhi Ty2
cgccccaaucgccagu

SEQ ID NO: 3718459 - RNA, 14 nt, Salmonella enterica enterica serovar Typhi Ty2
cgccccacagaccu

SEQ ID NO: 3718460 - RNA, 12 nt, Salmonella enterica enterica serovar Typhi Ty2
cgccccacuggc

SEQ ID NO: 3718461 - RNA, 20 nt, Salmonella enterica enterica serovar Typhi Ty2
cgccccagaagagcgagucu

SEQ ID NO: 3718462 - RNA, 23 nt, Salmonella enterica enterica serovar Typhi Ty2
cgccccagcaugagccagcccuc

SEQ ID NO: 3718463 - RNA, 22 nt, Salmonella enterica enterica serovar Typhi Ty2
cgccccaguaacgugccccaga

SEQ ID NO: 3718464 - RNA, 13 nt, Salmonella enterica enterica serovar Typhi Ty2
cgcccccuccagu

SEQ ID NO: 3718465 - RNA, 12 nt, Salmonella enterica enterica serovar Typhi Ty2
cgcccccugcca

SEQ ID NO: 3718466 - RNA, 13 nt, Salmonella enterica enterica serovar Typhi Ty2
cgcccccugccag

SEQ ID NO: 3718467 - RNA, 13 nt, Salmonella enterica enterica serovar Typhi Ty2
cgccccgaccagg

SEQ ID NO: 3718468 - RNA, 21 nt, Salmonella enterica enterica serovar Typhi Ty2
cgccccggcgagugccugcug

SEQ ID NO: 3718469 - RNA, 14 nt, Salmonella enterica enterica serovar Typhi Ty2
cgcccgagcgacgc

SEQ ID NO: 3718470 - RNA, 14 nt, Salmonella enterica enterica serovar Typhi Ty2
cgcccgcaaaagcg

SEQ ID NO: 3718471 - RNA, 15 nt, Salmonella enterica enterica serovar Typhi Ty2
cgcccgcaacggcuu

SEQ ID NO: 3718472 - RNA, 15 nt, Salmonella enterica enterica serovar Typhi Ty2
cgcccgcaccgccga

SEQ ID NO: 3718473 - RNA, 14 nt, Salmonella enterica enterica serovar Typhi Ty2
cgcccgccgccagc

SEQ ID NO: 3718474 - RNA, 23 nt, Salmonella enterica enterica serovar Typhi Ty2
cgcccgcgauaaaaauccugcuc

SEQ ID NO: 3718475 - RNA, 21 nt, Salmonella enterica enterica serovar Typhi Ty2
cgcccgcggcaugauccacca

SEQ ID NO: 3718476 - RNA, 12 nt, Salmonella enterica enterica serovar Typhi Ty2
cgcccgcggcga

SEQ ID NO: 3718477 - RNA, 17 nt, Salmonella enterica enterica serovar Typhi Ty2
cgcccggauaacggcgc

SEQ ID NO: 3718478 - RNA, 18 nt, Salmonella enterica enterica serovar Typhi Ty2
cgcccggcgcgcuggagg

SEQ ID NO: 3718479 - RNA, 20 nt, Salmonella enterica enterica serovar Typhi Ty2
cgcccgguaaacgcgccauc

SEQ ID NO: 3718480 - RNA, 22 nt, Salmonella enterica enterica serovar Typhi Ty2
cgcccgguugcaauuccgccau

SEQ ID NO: 3718481 - RNA, 13 nt, Salmonella enterica enterica serovar Typhi Ty2
cgcccgguuuugu

SEQ ID NO: 3718482 - RNA, 17 nt, Salmonella enterica enterica serovar Typhi Ty2
cgcccguacaccugcaa

SEQ ID NO: 3718483 - RNA, 12 nt, Salmonella enterica enterica serovar Typhi Ty2
cgcccguacaga

SEQ ID NO: 3718484 - RNA, 15 nt, Salmonella enterica enterica serovar Typhi Ty2
cgcccucaucggcaa

SEQ ID NO: 3718485 - RNA, 15 nt, Salmonella enterica enterica serovar Typhi Ty2
cgcccucgccacggu

SEQ ID NO: 3718486 - RNA, 12 nt, Salmonella enterica enterica serovar Typhi Ty2
cgcccugaaagc

SEQ ID NO: 3718487 - RNA, 15 nt, Salmonella enterica enterica serovar Typhi Ty2
cgcccugacgccgcu

SEQ ID NO: 3718488 - RNA, 15 nt, Salmonella enterica enterica serovar Typhi Ty2
cgcccugcccgccag

SEQ ID NO: 3718489 - RNA, 14 nt, Salmonella enterica enterica serovar Typhi Ty2
cgcccugcgccagc

SEQ ID NO: 3718490 - RNA, 18 nt, Salmonella enterica enterica serovar Typhi Ty2
cgcccugcgccagcaugg

SEQ ID NO: 3718491 - RNA, 21 nt, Salmonella enterica enterica serovar Typhi Ty2
cgcccuggaggaacagcgccg

SEQ ID NO: 3718492 - RNA, 18 nt, Salmonella enterica enterica serovar Typhi Ty2
cgcccugggcuucgucga

SEQ ID NO: 3718493 - RNA, 15 nt, Salmonella enterica enterica serovar Typhi Ty2
cgcccuguaagaggc

SEQ ID NO: 3718494 - RNA, 19 nt, Salmonella enterica enterica serovar Typhi Ty2
cgcccuguauacaggcaug

SEQ ID NO: 3718495 - RNA, 20 nt, Salmonella enterica enterica serovar Typhi Ty2
cgcccuguauacaggcaugg

SEQ ID NO: 3718496 - RNA, 15 nt, Salmonella enterica enterica serovar Typhi Ty2
cgcccugucauuaag

SEQ ID NO: 3718497 - RNA, 15 nt, Salmonella enterica enterica serovar Typhi Ty2
cgcccuguccuccau

SEQ ID NO: 3718498 - RNA, 23 nt, Salmonella enterica enterica serovar Typhi Ty2
cgcccuguggaaacuccagcggc

SEQ ID NO: 3718499 - RNA, 20 nt, Salmonella enterica enterica serovar Typhi Ty2
cgcccuucacaaccaucguc

SEQ ID NO: 3718500 - RNA, 14 nt, Salmonella enterica enterica serovar Typhi Ty2
cgcccuucacgccg

SEQ ID NO: 3718501 - RNA, 16 nt, Salmonella enterica enterica serovar Typhi Ty2
cgcccuucgucaggag

SEQ ID NO: 3718502 - RNA, 15 nt, Salmonella enterica enterica serovar Typhi Ty2
cgcccuugccgcuuc

SEQ ID NO: 3718503 - RNA, 16 nt, Salmonella enterica enterica serovar Typhi Ty2
cgccgaaauuuucccg

SEQ ID NO: 3718504 - RNA, 19 nt, Salmonella enterica enterica serovar Typhi Ty2
cgccgaacaacacggcggc

SEQ ID NO: 3718505 - RNA, 14 nt, Salmonella enterica enterica serovar Typhi Ty2
cgccgaagcaggcg

SEQ ID NO: 3718506 - RNA, 15 nt, Salmonella enterica enterica serovar Typhi Ty2
cgccgaagcaggcgg

SEQ ID NO: 3718507 - RNA, 14 nt, Salmonella enterica enterica serovar Typhi Ty2
cgccgaagccagcg

SEQ ID NO: 3718508 - RNA, 15 nt, Salmonella enterica enterica serovar Typhi Ty2
cgccgaagccagcgc

SEQ ID NO: 3718509 - RNA, 22 nt, Salmonella enterica enterica serovar Typhi Ty2
cgccgaaggcaacgccgccagc

SEQ ID NO: 3718510 - RNA, 17 nt, Salmonella enterica enterica serovar Typhi Ty2
cgccgacaaccagcgaa

SEQ ID NO: 3718511 - RNA, 15 nt, Salmonella enterica enterica serovar Typhi Ty2
cgccgacaccggccu

SEQ ID NO: 3718512 - RNA, 18 nt, Salmonella enterica enterica serovar Typhi Ty2
cgccgacaucgccaccgc

SEQ ID NO: 3718513 - RNA, 21 nt, Salmonella enterica enterica serovar Typhi Ty2
cgccgaccacuucaacgccgc

SEQ ID NO: 3718514 - RNA, 14 nt, Salmonella enterica enterica serovar Typhi Ty2
cgccgaccauccag

SEQ ID NO: 3718515 - RNA, 23 nt, Salmonella enterica enterica serovar Typhi Ty2
cgccgaccauuggcaccaccagg

SEQ ID NO: 3718516 - RNA, 17 nt, Salmonella enterica enterica serovar Typhi Ty2
cgccgacccccuccuug

SEQ ID NO: 3718517 - RNA, 21 nt, Salmonella enterica enterica serovar Typhi Ty2
cgccgacgaccggcagcguca

SEQ ID NO: 3718518 - RNA, 18 nt, Salmonella enterica enterica serovar Typhi Ty2
cgccgacggaacccagca

SEQ ID NO: 3718519 - RNA, 14 nt, Salmonella enterica enterica serovar Typhi Ty2
cgccgacucacgca

SEQ ID NO: 3718520 - RNA, 15 nt, Salmonella enterica enterica serovar Typhi Ty2
cgccgacucacgcag

SEQ ID NO: 3718521 - RNA, 16 nt, Salmonella enterica enterica serovar Typhi Ty2
cgccgacucacgcagc

SEQ ID NO: 3718522 - RNA, 16 nt, Salmonella enterica enterica serovar Typhi Ty2
cgccgagaauuucagc

SEQ ID NO: 3718523 - RNA, 13 nt, Salmonella enterica enterica serovar Typhi Ty2
cgccgagccgccc

SEQ ID NO: 3718524 - RNA, 15 nt, Salmonella enterica enterica serovar Typhi Ty2
cgccgagccgcccuu

SEQ ID NO: 3718525 - RNA, 13 nt, Salmonella enterica enterica serovar Typhi Ty2
cgccgagcgccgu

SEQ ID NO: 3718526 - RNA, 18 nt, Salmonella enterica enterica serovar Typhi Ty2
cgccgaggcuaagccaga

SEQ ID NO: 3718527 - RNA, 19 nt, Salmonella enterica enterica serovar Typhi Ty2
cgccgaggcuaagccagaa

SEQ ID NO: 3718528 - RNA, 16 nt, Salmonella enterica enterica serovar Typhi Ty2
cgccgaguagcugagc

SEQ ID NO: 3718529 - RNA, 18 nt, Salmonella enterica enterica serovar Typhi Ty2
cgccgauaaauccuccgg

SEQ ID NO: 3718530 - RNA, 23 nt, Salmonella enterica enterica serovar Typhi Ty2
cgccgauaaccagcgcgccgcca

SEQ ID NO: 3718531 - RNA, 13 nt, Salmonella enterica enterica serovar Typhi Ty2
cgccgaucggcgu

SEQ ID NO: 3718532 - RNA, 18 nt, Salmonella enterica enterica serovar Typhi Ty2
cgccgaugccgccgacaa

SEQ ID NO: 3718533 - RNA, 15 nt, Salmonella enterica enterica serovar Typhi Ty2
cgccgauuccugcug

SEQ ID NO: 3718534 - RNA, 20 nt, Salmonella enterica enterica serovar Typhi Ty2
cgccgcaaauuccaccacgu

SEQ ID NO: 3718535 - RNA, 15 nt, Salmonella enterica enterica serovar Typhi Ty2
cgccgcaacgcgcac

SEQ ID NO: 3718536 - RNA, 17 nt, Salmonella enterica enterica serovar Typhi Ty2
cgccgcaaugccgccug

SEQ ID NO: 3718537 - RNA, 22 nt, Salmonella enterica enterica serovar Typhi Ty2
cgccgcaauuccugacugcgcg

SEQ ID NO: 3718538 - RNA, 17 nt, Salmonella enterica enterica serovar Typhi Ty2
cgccgcacuucacgcuc

SEQ ID NO: 3718539 - RNA, 19 nt, Salmonella enterica enterica serovar Typhi Ty2
cgccggguuuggcgggcuu

SEQ ID NO: 3718540 - RNA, 16 nt, Salmonella enterica enterica serovar Typhi Ty2
cgccgguacgcagcag

SEQ ID NO: 3718541 - RNA, 22 nt, Salmonella enterica enterica serovar Typhi Ty2
cgccggucacugaccggcguuu

SEQ ID NO: 3718542 - RNA, 18 nt, Salmonella enterica enterica serovar Typhi Ty2
cgccggucaggauacagc

SEQ ID NO: 3718543 - RNA, 15 nt, Salmonella enterica enterica serovar Typhi Ty2
cgccggucaugccau

SEQ ID NO: 3718544 - RNA, 21 nt, Salmonella enterica enterica serovar Typhi Ty2
cgccgguguuuagccugauac

SEQ ID NO: 3718545 - RNA, 16 nt, Salmonella enterica enterica serovar Typhi Ty2
cgccgguuccaacagc

SEQ ID NO: 3718546 - RNA, 14 nt, Salmonella enterica enterica serovar Typhi Ty2
cgccgguuuauccc

SEQ ID NO: 3718547 - RNA, 15 nt, Salmonella enterica enterica serovar Typhi Ty2
cgccguaaccgccug

SEQ ID NO: 3718548 - RNA, 14 nt, Salmonella enterica enterica serovar Typhi Ty2
cgccguaaggcgcc

SEQ ID NO: 3718549 - RNA, 19 nt, Salmonella enterica enterica serovar Typhi Ty2
cgccguaaggcguaccgcc

SEQ ID NO: 3718550 - RNA, 23 nt, Salmonella enterica enterica serovar Typhi Ty2
cgccguacacguauaaacgccgc

SEQ ID NO: 3718551 - RNA, 17 nt, Salmonella enterica enterica serovar Typhi Ty2
cgccguacuccagccca

SEQ ID NO: 3718552 - RNA, 20 nt, Salmonella enterica enterica serovar Typhi Ty2
cgccguacuccagcccauca

SEQ ID NO: 3718553 - RNA, 22 nt, Salmonella enterica enterica serovar Typhi Ty2
cgccguacuugacacaggcgug

SEQ ID NO: 3718554 - RNA, 17 nt, Salmonella enterica enterica serovar Typhi Ty2
cgccguagaacgggccg

SEQ ID NO: 3718555 - RNA, 19 nt, Salmonella enterica enterica serovar Typhi Ty2
cgccguagcugcgcgccgc

SEQ ID NO: 3718556 - RNA, 21 nt, Salmonella enterica enterica serovar Typhi Ty2
cgccguagcugcgcgccgcaa

SEQ ID NO: 3718557 - RNA, 14 nt, Salmonella enterica enterica serovar Typhi Ty2
cgccguauucuuac

SEQ ID NO: 3718558 - RNA, 18 nt, Salmonella enterica enterica serovar Typhi Ty2
cgccgucacguucgguac

SEQ ID NO: 3718559 - RNA, 15 nt, Salmonella enterica enterica serovar Typhi Ty2
cgccgucaggcuugc

SEQ ID NO: 3718560 - RNA, 17 nt, Salmonella enterica enterica serovar Typhi Ty2
cgccgucauaccgccca

SEQ ID NO: 3718561 - RNA, 15 nt, Salmonella enterica enterica serovar Typhi Ty2
cgccguccagcacca

SEQ ID NO: 3718562 - RNA, 18 nt, Salmonella enterica enterica serovar Typhi Ty2
cgccguccagcaccaccu

SEQ ID NO: 3718563 - RNA, 14 nt, Salmonella enterica enterica serovar Typhi Ty2
cgccguccggcgaa

SEQ ID NO: 3718564 - RNA, 13 nt, Salmonella enterica enterica serovar Typhi Ty2
cgccgucgcgcuu

SEQ ID NO: 3718565 - RNA, 18 nt, Salmonella enterica enterica serovar Typhi Ty2
cgccgucgcggcuacgga

SEQ ID NO: 3718566 - RNA, 16 nt, Salmonella enterica enterica serovar Typhi Ty2
cgccgucggcaauaaa

SEQ ID NO: 3718567 - RNA, 24 nt, Salmonella enterica enterica serovar Typhi Ty2
cgccgucucgcuuaauccgugaau

SEQ ID NO: 3718568 - RNA, 22 nt, Salmonella enterica enterica serovar Typhi Ty2
cgccgucuucuucuucgcgcau

SEQ ID NO: 3718569 - RNA, 19 nt, Salmonella enterica enterica serovar Typhi Ty2
cgccgugauaaauacgcug

SEQ ID NO: 3718570 - RNA, 21 nt, Salmonella enterica enterica serovar Typhi Ty2
cgccgugcucacuaggcguua

SEQ ID NO: 3718571 - RNA, 20 nt, Salmonella enterica enterica serovar Typhi Ty2
cgccguggcggugacuuccu

SEQ ID NO: 3718572 - RNA, 21 nt, Salmonella enterica enterica serovar Typhi Ty2
cgccguggcggugacuuccug

SEQ ID NO: 3718573 - RNA, 17 nt, Salmonella enterica enterica serovar Typhi Ty2
cgccguguaagagcugg

SEQ ID NO: 3718574 - RNA, 18 nt, Salmonella enterica enterica serovar Typhi Ty2
cgccgugucuggcgaacg

SEQ ID NO: 3718575 - RNA, 22 nt, Salmonella enterica enterica serovar Typhi Ty2
cgccguguugugugccgcgcug

SEQ ID NO: 3718576 - RNA, 16 nt, Salmonella enterica enterica serovar Typhi Ty2
cgccguuaaaccguua

SEQ ID NO: 3718577 - RNA, 15 nt, Salmonella enterica enterica serovar Typhi Ty2
cgccguuaucggccu

SEQ ID NO: 3718578 - RNA, 15 nt, Salmonella enterica enterica serovar Typhi Ty2
cgccguuccauucca

SEQ ID NO: 3718579 - RNA, 23 nt, Salmonella enterica enterica serovar Typhi Ty2
cgccguuggcguaaaucaggcca

SEQ ID NO: 3718580 - RNA, 22 nt, Salmonella enterica enterica serovar Typhi Ty2
cgccguuugccauaucuggaua

SEQ ID NO: 3718581 - RNA, 22 nt, Salmonella enterica enterica serovar Typhi Ty2
cgccguuuguuuauugccgcuu

SEQ ID NO: 3718582 - RNA, 15 nt, Salmonella enterica enterica serovar Typhi Ty2
cgccuaaaucaagca

SEQ ID NO: 3718583 - RNA, 21 nt, Salmonella enterica enterica serovar Typhi Ty2
cgccuaaaucaagcagugacg

SEQ ID NO: 3718584 - RNA, 22 nt, Salmonella enterica enterica serovar Typhi Ty2
cgccuaagaucggguggccuaa

SEQ ID NO: 3718585 - RNA, 17 nt, Salmonella enterica enterica serovar Typhi Ty2
cgccuaccagcacauga

SEQ ID NO: 3718586 - RNA, 18 nt, Salmonella enterica enterica serovar Typhi Ty2
cgccuagcgucccggcaa

SEQ ID NO: 3718587 - RNA, 21 nt, Salmonella enterica enterica serovar Typhi Ty2
cgccuaucgccagcaggguca

SEQ ID NO: 3718588 - RNA, 14 nt, Salmonella enterica enterica serovar Typhi Ty2
cgccuauuguucca

SEQ ID NO: 3718589 - RNA, 18 nt, Salmonella enterica enterica serovar Typhi Ty2
cgccuauuuucucuucca

SEQ ID NO: 3718590 - RNA, 14 nt, Salmonella enterica enterica serovar Typhi Ty2
cgccucaaaucagg

SEQ ID NO: 3718591 - RNA, 14 nt, Salmonella enterica enterica serovar Typhi Ty2
cgccucaauugccg

SEQ ID NO: 3718592 - RNA, 18 nt, Salmonella enterica enterica serovar Typhi Ty2
cgccucaauugccgccag

SEQ ID NO: 3718593 - RNA, 13 nt, Salmonella enterica enterica serovar Typhi Ty2
cgccucaucgaca

SEQ ID NO: 3718594 - RNA, 20 nt, Salmonella enterica enterica serovar Typhi Ty2
cgccucaucggcguugccca

SEQ ID NO: 3718595 - RNA, 14 nt, Salmonella enterica enterica serovar Typhi Ty2
cgccucccugccua

SEQ ID NO: 3718596 - RNA, 22 nt, Salmonella enterica enterica serovar Typhi Ty2
cgccuccugccgaugccgccgc

SEQ ID NO: 3718597 - RNA, 20 nt, Salmonella enterica enterica serovar Typhi Ty2
cgccucgaccccuucgcccu

SEQ ID NO: 3718598 - RNA, 22 nt, Salmonella enterica enterica serovar Typhi Ty2
cgccucgcguagcgccaacaug

SEQ ID NO: 3718599 - RNA, 20 nt, Salmonella enterica enterica serovar Typhi Ty2
cgccucguaucugucccagc

SEQ ID NO: 3718600 - RNA, 17 nt, Salmonella enterica enterica serovar Typhi Ty2
cgccugaauaaucggcg

SEQ ID NO: 3718601 - RNA, 20 nt, Salmonella enterica enterica serovar Typhi Ty2
cgccugauccggccuacaag

SEQ ID NO: 3718602 - RNA, 20 nt, Salmonella enterica enterica serovar Typhi Ty2
cgccugaucguuacccgugc

SEQ ID NO: 3718603 - RNA, 14 nt, Salmonella enterica enterica serovar Typhi Ty2
cgccugaugacgcu

SEQ ID NO: 3718604 - RNA, 17 nt, Salmonella enterica enterica serovar Typhi Ty2
cgccugaugcgccgccu

SEQ ID NO: 3718605 - RNA, 16 nt, Salmonella enterica enterica serovar Typhi Ty2
cgccugaugcuggcag

SEQ ID NO: 3718606 - RNA, 14 nt, Salmonella enterica enterica serovar Typhi Ty2
cgccugauggcgac

SEQ ID NO: 3718607 - RNA, 15 nt, Salmonella enterica enterica serovar Typhi Ty2
cgccugauucauucc

SEQ ID NO: 3718608 - RNA, 24 nt, Salmonella enterica enterica serovar Typhi Ty2
cgccugcaauguugaaucccacgc

SEQ ID NO: 3718609 - RNA, 11 nt, Salmonella enterica enterica serovar Typhi Ty2
cgccugcacca

SEQ ID NO: 3718610 - RNA, 13 nt, Salmonella enterica enterica serovar Typhi Ty2
cgccugcauaaug

SEQ ID NO: 3718611 - RNA, 13 nt, Salmonella enterica enterica serovar Typhi Ty2
cgccugccagaua

SEQ ID NO: 3718612 - RNA, 20 nt, Salmonella enterica enterica serovar Typhi Ty2
cgccugccauagcaucacca

SEQ ID NO: 3718613 - RNA, 15 nt, Salmonella enterica enterica serovar Typhi Ty2
cgccugccgcgccgc

SEQ ID NO: 3718614 - RNA, 20 nt, Salmonella enterica enterica serovar Typhi Ty2
cgccugccgcgccgccgccu

SEQ ID NO: 3718615 - RNA, 16 nt, Salmonella enterica enterica serovar Typhi Ty2
cgccugcgccagcgcc

SEQ ID NO: 3718616 - RNA, 13 nt, Salmonella enterica enterica serovar Typhi Ty2
cgccugcgcgccu

SEQ ID NO: 3718617 - RNA, 22 nt, Salmonella enterica enterica serovar Typhi Ty2
cgccugcgguaaucgccgcgac

SEQ ID NO: 3718618 - RNA, 18 nt, Salmonella enterica enterica serovar Typhi Ty2
cgccugcuccguccacgc

SEQ ID NO: 3718619 - RNA, 11 nt, Salmonella enterica enterica serovar Typhi Ty2
cgccugcugca

SEQ ID NO: 3718620 - RNA, 11 nt, Salmonella enterica enterica serovar Typhi Ty2
cgccugcugcg

SEQ ID NO: 3718621 - RNA, 21 nt, Salmonella enterica enterica serovar Typhi Ty2
cgcgacggcagccucuuucag

SEQ ID NO: 3718622 - RNA, 19 nt, Salmonella enterica enterica serovar Typhi Ty2
cgcgacguacuggaacagu

SEQ ID NO: 3718623 - RNA, 18 nt, Salmonella enterica enterica serovar Typhi Ty2
cgcgacguccgccaacag

SEQ ID NO: 3718624 - RNA, 20 nt, Salmonella enterica enterica serovar Typhi Ty2
cgcgacucccaggcgcgcag

SEQ ID NO: 3718625 - RNA, 21 nt, Salmonella enterica enterica serovar Typhi Ty2
cgcgacucccaggcgcgcagc

SEQ ID NO: 3718626 - RNA, 22 nt, Salmonella enterica enterica serovar Typhi Ty2
cgcgacuuuaauuaccugccag

SEQ ID NO: 3718627 - RNA, 19 nt, Salmonella enterica enterica serovar Typhi Ty2
cgcgagaaaauagaggaaa

SEQ ID NO: 3718628 - RNA, 21 nt, Salmonella enterica enterica serovar Typhi Ty2
cgcgagaagcccggccacagc

SEQ ID NO: 3718629 - RNA, 22 nt, Salmonella enterica enterica serovar Typhi Ty2
cgcgagaagcccggccacagcg

SEQ ID NO: 3718630 - RNA, 23 nt, Salmonella enterica enterica serovar Typhi Ty2
cgcgagaccaucgcgugacgcag

SEQ ID NO: 3718631 - RNA, 24 nt, Salmonella enterica enterica serovar Typhi Ty2
cgcgagagucgccaggaucgccgc

SEQ ID NO: 3718632 - RNA, 12 nt, Salmonella enterica enterica serovar Typhi Ty2
cgcgagcagcca

SEQ ID NO: 3718633 - RNA, 23 nt, Salmonella enterica enterica serovar Typhi Ty2
cgcgagcguucuauuuggccugc

SEQ ID NO: 3718634 - RNA, 23 nt, Salmonella enterica enterica serovar Typhi Ty2
cgcgaggcuuauaacccugucug

SEQ ID NO: 3718635 - RNA, 20 nt, Salmonella enterica enterica serovar Typhi Ty2
cgcgauaaaaacccaccagc

SEQ ID NO: 3718636 - RNA, 21 nt, Salmonella enterica enterica serovar Typhi Ty2
cgcgauacacuccggcgcgcg

SEQ ID NO: 3718637 - RNA, 22 nt, Salmonella enterica enterica serovar Typhi Ty2
cgcgauacacuccggcgcgcgc

SEQ ID NO: 3718638 - RNA, 18 nt, Salmonella enterica enterica serovar Typhi Ty2
cgcgauacgcagcaccgc

SEQ ID NO: 3718639 - RNA, 16 nt, Salmonella enterica enterica serovar Typhi Ty2
cgcgauacugccgccc

SEQ ID NO: 3718640 - RNA, 20 nt, Salmonella enterica enterica serovar Typhi Ty2
cgcgauagaccacgccauca

SEQ ID NO: 3718641 - RNA, 20 nt, Salmonella enterica enterica serovar Typhi Ty2
cgcgauauccaccaccugau

SEQ ID NO: 3718642 - RNA, 23 nt, Salmonella enterica enterica serovar Typhi Ty2
cgcgauauccaccaccugauucu

SEQ ID NO: 3718643 - RNA, 15 nt, Salmonella enterica enterica serovar Typhi Ty2
cgcgauauccaccug

SEQ ID NO: 3718644 - RNA, 20 nt, Salmonella enterica enterica serovar Typhi Ty2
cgcgauauguuugcgcgucg

SEQ ID NO: 3718645 - RNA, 19 nt, Salmonella enterica enterica serovar Typhi Ty2
cgcgaucaaucacgccgau

SEQ ID NO: 3718646 - RNA, 14 nt, Salmonella enterica enterica serovar Typhi Ty2
cgcgaucacagaca

SEQ ID NO: 3718647 - RNA, 22 nt, Salmonella enterica enterica serovar Typhi Ty2
cgcgaucaguucuugcaggcag

SEQ ID NO: 3718648 - RNA, 14 nt, Salmonella enterica enterica serovar Typhi Ty2
cgcgauccgccagc

SEQ ID NO: 3718649 - RNA, 14 nt, Salmonella enterica enterica serovar Typhi Ty2
cgcgaucgcggcaa

SEQ ID NO: 3718650 - RNA, 14 nt, Salmonella enterica enterica serovar Typhi Ty2
cgcgaugacggcgc

SEQ ID NO: 3718651 - RNA, 15 nt, Salmonella enterica enterica serovar Typhi Ty2
cgcgaugacucguau

SEQ ID NO: 3718652 - RNA, 18 nt, Salmonella enterica enterica serovar Typhi Ty2
cgcgaugagcugcgauaa

SEQ ID NO: 3718653 - RNA, 19 nt, Salmonella enterica enterica serovar Typhi Ty2
cgcgauggugacuauucuu

SEQ ID NO: 3718654 - RNA, 18 nt, Salmonella enterica enterica serovar Typhi Ty2
cgcgauguuugcucgcca

SEQ ID NO: 3718655 - RNA, 20 nt, Salmonella enterica enterica serovar Typhi Ty2
cgcgauucgcccacggauga

SEQ ID NO: 3718656 - RNA, 15 nt, Salmonella enterica enterica serovar Typhi Ty2
cgcgauucgggccgc

SEQ ID NO: 3718657 - RNA, 17 nt, Salmonella enterica enterica serovar Typhi Ty2
cgcgauuuucaucaagc

SEQ ID NO: 3718658 - RNA, 12 nt, Salmonella enterica enterica serovar Typhi Ty2
cgcgcaaacgcu

SEQ ID NO: 3718659 - RNA, 19 nt, Salmonella enterica enterica serovar Typhi Ty2
cgcgcaaagccuuuccgca

SEQ ID NO: 3718660 - RNA, 15 nt, Salmonella enterica enterica serovar Typhi Ty2
cgcgcaaccgcauca

SEQ ID NO: 3718661 - RNA, 18 nt, Salmonella enterica enterica serovar Typhi Ty2
cgcgcaaccgcaucacgc

SEQ ID NO: 3718662 - RNA, 18 nt, Salmonella enterica enterica serovar Typhi Ty2
cgcgcacagggugaaauc

SEQ ID NO: 3718663 - RNA, 13 nt, Salmonella enterica enterica serovar Typhi Ty2
cgcgcacgcgcgc

SEQ ID NO: 3718664 - RNA, 15 nt, Salmonella enterica enterica serovar Typhi Ty2
cgcgcagacaguggc

SEQ ID NO: 3718665 - RNA, 21 nt, Salmonella enterica enterica serovar Typhi Ty2
cgcgcagagauagccagcgau

SEQ ID NO: 3718666 - RNA, 22 nt, Salmonella enterica enterica serovar Typhi Ty2
cgcgcagcaacaguugcuggag

SEQ ID NO: 3718667 - RNA, 20 nt, Salmonella enterica enterica serovar Typhi Ty2
cgcgcagcaucugauagccc

SEQ ID NO: 3718668 - RNA, 12 nt, Salmonella enterica enterica serovar Typhi Ty2
cgcgcagcugcc

SEQ ID NO: 3718669 - RNA, 13 nt, Salmonella enterica enterica serovar Typhi Ty2
cgcgcaggcggaa

SEQ ID NO: 3718670 - RNA, 23 nt, Salmonella enterica enterica serovar Typhi Ty2
cgcgcaggucuucgucagcgcau

SEQ ID NO: 3718671 - RNA, 18 nt, Salmonella enterica enterica serovar Typhi Ty2
cgcgcaguucauccacgc

SEQ ID NO: 3718672 - RNA, 21 nt, Salmonella enterica enterica serovar Typhi Ty2
cgcgcaguuucuuaccuaccu

SEQ ID NO: 3718673 - RNA, 15 nt, Salmonella enterica enterica serovar Typhi Ty2
cgcgcaguuuuuauc

SEQ ID NO: 3718674 - RNA, 20 nt, Salmonella enterica enterica serovar Typhi Ty2
cgcgcaucccacaccacacg

SEQ ID NO: 3718675 - RNA, 11 nt, Salmonella enterica enterica serovar Typhi Ty2
cgcgcauggca

SEQ ID NO: 3718676 - RNA, 23 nt, Salmonella enterica enterica serovar Typhi Ty2
cgcgcauggcagggcgauaucca

SEQ ID NO: 3718677 - RNA, 13 nt, Salmonella enterica enterica serovar Typhi Ty2
cgcgcauggcgaa

SEQ ID NO: 3718678 - RNA, 19 nt, Salmonella enterica enterica serovar Typhi Ty2
cgcgccaaaagaggcagca

SEQ ID NO: 3718679 - RNA, 20 nt, Salmonella enterica enterica serovar Typhi Ty2
cgcgccaaaagaggcagcaa

SEQ ID NO: 3718680 - RNA, 15 nt, Salmonella enterica enterica serovar Typhi Ty2
cgcgccaaaccguuc

SEQ ID NO: 3718681 - RNA, 16 nt, Salmonella enterica enterica serovar Typhi Ty2
cgcgccaaacggcagc

SEQ ID NO: 3718682 - RNA, 21 nt, Salmonella enterica enterica serovar Typhi Ty2
cgcgccaauccaugccggcuu

SEQ ID NO: 3718683 - RNA, 18 nt, Salmonella enterica enterica serovar Typhi Ty2
cgcgccaauggccgcccc

SEQ ID NO: 3718684 - RNA, 19 nt, Salmonella enterica enterica serovar Typhi Ty2
cgcgccaauggccgccccc

SEQ ID NO: 3718685 - RNA, 14 nt, Salmonella enterica enterica serovar Typhi Ty2
cgcgccacauacug

SEQ ID NO: 3718686 - RNA, 22 nt, Salmonella enterica enterica serovar Typhi Ty2
cgcgccaccaucgucgccagac

SEQ ID NO: 3718687 - RNA, 12 nt, Salmonella enterica enterica serovar Typhi Ty2
cgcgccacgcau

SEQ ID NO: 3718688 - RNA, 21 nt, Salmonella enterica enterica serovar Typhi Ty2
cgcgccacggccaacgcgccc

SEQ ID NO: 3718689 - RNA, 12 nt, Salmonella enterica enterica serovar Typhi Ty2
cgcgccagcagg

SEQ ID NO: 3718690 - RNA, 15 nt, Salmonella enterica enterica serovar Typhi Ty2
cgcgccagcaggucg

SEQ ID NO: 3718691 - RNA, 16 nt, Salmonella enterica enterica serovar Typhi Ty2
cgcgccagccaauguc

SEQ ID NO: 3718692 - RNA, 13 nt, Salmonella enterica enterica serovar Typhi Ty2
cgcgccagcgaca

SEQ ID NO: 3718693 - RNA, 12 nt, Salmonella enterica enterica serovar Typhi Ty2
cgcgccagcgau

SEQ ID NO: 3718694 - RNA, 13 nt, Salmonella enterica enterica serovar Typhi Ty2
cgcgccagcggau

SEQ ID NO: 3718695 - RNA, 21 nt, Salmonella enterica enterica serovar Typhi Ty2
cgcgccagcggauugccauac

SEQ ID NO: 3718696 - RNA, 13 nt, Salmonella enterica enterica serovar Typhi Ty2
cgcgccagcgucg

SEQ ID NO: 3718697 - RNA, 13 nt, Salmonella enterica enterica serovar Typhi Ty2
cgcgccagggcgc

SEQ ID NO: 3718698 - RNA, 20 nt, Salmonella enterica enterica serovar Typhi Ty2
cgcgccagguauacagacaa

SEQ ID NO: 3718699 - RNA, 22 nt, Salmonella enterica enterica serovar Typhi Ty2
cgcgccaggucucauagcgccc

SEQ ID NO: 3718700 - RNA, 23 nt, Salmonella enterica enterica serovar Typhi Ty2
cgcgccaguaaucggcgcgaaac

SEQ ID NO: 3718701 - RNA, 19 nt, Salmonella enterica enterica serovar Typhi Ty2
cgcgccagucaucgccgcu

SEQ ID NO: 3718702 - RNA, 17 nt, Salmonella enterica enterica serovar Typhi Ty2
cgcgccaucgucaccgg

SEQ ID NO: 3718703 - RNA, 16 nt, Salmonella enterica enterica serovar Typhi Ty2
cgcggccaccgccagu

SEQ ID NO: 3718704 - RNA, 14 nt, Salmonella enterica enterica serovar Typhi Ty2
cgcggccagcaucg

SEQ ID NO: 3718705 - RNA, 22 nt, Salmonella enterica enterica serovar Typhi Ty2
cgcggccuccggaucgacagca

SEQ ID NO: 3718706 - RNA, 19 nt, Salmonella enterica enterica serovar Typhi Ty2
cgcggccuuugccuucgcc

SEQ ID NO: 3718707 - RNA, 16 nt, Salmonella enterica enterica serovar Typhi Ty2
cgcggcgaaaaagccg

SEQ ID NO: 3718708 - RNA, 21 nt, Salmonella enterica enterica serovar Typhi Ty2
cgcggcgaaaaagccggcgga

SEQ ID NO: 3718709 - RNA, 16 nt, Salmonella enterica enterica serovar Typhi Ty2
cgcggcgaaauaggcc

SEQ ID NO: 3718710 - RNA, 21 nt, Salmonella enterica enterica serovar Typhi Ty2
cgcggcgaaauaggccgcgau

SEQ ID NO: 3718711 - RNA, 16 nt, Salmonella enterica enterica serovar Typhi Ty2
cgcggcgaaccggcau

SEQ ID NO: 3718712 - RNA, 22 nt, Salmonella enterica enterica serovar Typhi Ty2
cgcggcgacggacucgcgcaga

SEQ ID NO: 3718713 - RNA, 23 nt, Salmonella enterica enterica serovar Typhi Ty2
cgcggcgcaacuuuuucgaugau

SEQ ID NO: 3718714 - RNA, 23 nt, Salmonella enterica enterica serovar Typhi Ty2
cgcggcgccgaagcaggcggaga

SEQ ID NO: 3718715 - RNA, 22 nt, Salmonella enterica enterica serovar Typhi Ty2
cgcggcgcgucuucccggcgcu

SEQ ID NO: 3718716 - RNA, 14 nt, Salmonella enterica enterica serovar Typhi Ty2
cgcggcgcucgcca

SEQ ID NO: 3718717 - RNA, 21 nt, Salmonella enterica enterica serovar Typhi Ty2
cgcggcggacaacgcuccagc

SEQ ID NO: 3718718 - RNA, 13 nt, Salmonella enterica enterica serovar Typhi Ty2
cgcggcggaccgc

SEQ ID NO: 3718719 - RNA, 14 nt, Salmonella enterica enterica serovar Typhi Ty2
cgcggcguaccgcg

SEQ ID NO: 3718720 - RNA, 17 nt, Salmonella enterica enterica serovar Typhi Ty2
cgcggcguucugcgcca

SEQ ID NO: 3718721 - RNA, 14 nt, Salmonella enterica enterica serovar Typhi Ty2
cgcggcucaccagc

SEQ ID NO: 3718722 - RNA, 13 nt, Salmonella enterica enterica serovar Typhi Ty2
cgcggcuccggcu

SEQ ID NO: 3718723 - RNA, 18 nt, Salmonella enterica enterica serovar Typhi Ty2
cgcggcugguaagagagc

SEQ ID NO: 3718724 - RNA, 17 nt, Salmonella enterica enterica serovar Typhi Ty2
cgcggcuuauccggcuu

SEQ ID NO: 3718725 - RNA, 15 nt, Salmonella enterica enterica serovar Typhi Ty2
cgcgggaaugcgcgc

SEQ ID NO: 3718726 - RNA, 16 nt, Salmonella enterica enterica serovar Typhi Ty2
cgcgggcgaaauuggc

SEQ ID NO: 3718727 - RNA, 22 nt, Salmonella enterica enterica serovar Typhi Ty2
cgcgggcgguauuauccgccgc

SEQ ID NO: 3718728 - RNA, 15 nt, Salmonella enterica enterica serovar Typhi Ty2
cgcgggcuggccggc

SEQ ID NO: 3718729 - RNA, 16 nt, Salmonella enterica enterica serovar Typhi Ty2
cgcgggcuucacguug

SEQ ID NO: 3718730 - RNA, 12 nt, Salmonella enterica enterica serovar Typhi Ty2
cgcggggaacac

SEQ ID NO: 3718731 - RNA, 20 nt, Salmonella enterica enterica serovar Typhi Ty2
cgcggggaucgguuuauccc

SEQ ID NO: 3718732 - RNA, 23 nt, Salmonella enterica enterica serovar Typhi Ty2
cgcgguauuucgcaacgccgccg

SEQ ID NO: 3718733 - RNA, 18 nt, Salmonella enterica enterica serovar Typhi Ty2
cgcgguauuucgccgccg

SEQ ID NO: 3718734 - RNA, 19 nt, Salmonella enterica enterica serovar Typhi Ty2
cgcgguauuucgccgccgc

SEQ ID NO: 3718735 - RNA, 21 nt, Salmonella enterica enterica serovar Typhi Ty2
cgcggucaacguuaacugcug

SEQ ID NO: 3718736 - RNA, 14 nt, Salmonella enterica enterica serovar Typhi Ty2
cgcggucagcggcg

SEQ ID NO: 3718737 - RNA, 18 nt, Salmonella enterica enterica serovar Typhi Ty2
cgcggucagcggcgcgcc

SEQ ID NO: 3718738 - RNA, 23 nt, Salmonella enterica enterica serovar Typhi Ty2
cgcggucagggugaaucccgcca

SEQ ID NO: 3718739 - RNA, 15 nt, Salmonella enterica enterica serovar Typhi Ty2
cgcggucgccugccg

SEQ ID NO: 3718740 - RNA, 22 nt, Salmonella enterica enterica serovar Typhi Ty2
cgcggugaucccaggccggcau

SEQ ID NO: 3718741 - RNA, 13 nt, Salmonella enterica enterica serovar Typhi Ty2
cgcgguugacgcu

SEQ ID NO: 3718742 - RNA, 16 nt, Salmonella enterica enterica serovar Typhi Ty2
cgcgguuuacuucuuc

SEQ ID NO: 3718743 - RNA, 17 nt, Salmonella enterica enterica serovar Typhi Ty2
cgcgguuucguggcgcu

SEQ ID NO: 3718744 - RNA, 14 nt, Salmonella enterica enterica serovar Typhi Ty2
cgcguaaauccaca

SEQ ID NO: 3718745 - RNA, 17 nt, Salmonella enterica enterica serovar Typhi Ty2
cgcguaaccccugcccg

SEQ ID NO: 3718746 - RNA, 21 nt, Salmonella enterica enterica serovar Typhi Ty2
cgcguaaccccugcccgcgau

SEQ ID NO: 3718747 - RNA, 23 nt, Salmonella enterica enterica serovar Typhi Ty2
cgcguaaguuugcguacucagca

SEQ ID NO: 3718748 - RNA, 13 nt, Salmonella enterica enterica serovar Typhi Ty2
cgcguaaucgcga

SEQ ID NO: 3718749 - RNA, 19 nt, Salmonella enterica enterica serovar Typhi Ty2
cgcguaaucuuccacccgc

SEQ ID NO: 3718750 - RNA, 20 nt, Salmonella enterica enterica serovar Typhi Ty2
cgcguaaucuuccacccgcg

SEQ ID NO: 3718751 - RNA, 23 nt, Salmonella enterica enterica serovar Typhi Ty2
cgcguaauuugcgacauggcgac

SEQ ID NO: 3718752 - RNA, 14 nt, Salmonella enterica enterica serovar Typhi Ty2
cgcguaccucagca

SEQ ID NO: 3718753 - RNA, 17 nt, Salmonella enterica enterica serovar Typhi Ty2
cgcguaccucagcaugu

SEQ ID NO: 3718754 - RNA, 12 nt, Salmonella enterica enterica serovar Typhi Ty2
cgcguagcagca

SEQ ID NO: 3718755 - RNA, 14 nt, Salmonella enterica enterica serovar Typhi Ty2
cgcguagcccagcg

SEQ ID NO: 3718756 - RNA, 18 nt, Salmonella enterica enterica serovar Typhi Ty2
cgcguagcccagcgccgc

SEQ ID NO: 3718757 - RNA, 19 nt, Salmonella enterica enterica serovar Typhi Ty2
cgcguauaacgccgccccc

SEQ ID NO: 3718758 - RNA, 17 nt, Salmonella enterica enterica serovar Typhi Ty2
cgcguauucucaaccag

SEQ ID NO: 3718759 - RNA, 19 nt, Salmonella enterica enterica serovar Typhi Ty2
cgcguauucucaaccagcc

SEQ ID NO: 3718760 - RNA, 23 nt, Salmonella enterica enterica serovar Typhi Ty2
cgcgucacaaaaacacccgcagc

SEQ ID NO: 3718761 - RNA, 23 nt, Salmonella enterica enterica serovar Typhi Ty2
cgcgucacaaucgcgccugccag

SEQ ID NO: 3718762 - RNA, 17 nt, Salmonella enterica enterica serovar Typhi Ty2
cgcgucagggcaaggcg

SEQ ID NO: 3718763 - RNA, 14 nt, Salmonella enterica enterica serovar Typhi Ty2
cgcgucagggcgau

SEQ ID NO: 3718764 - RNA, 17 nt, Salmonella enterica enterica serovar Typhi Ty2
cgcgucagggcgauaau

SEQ ID NO: 3718765 - RNA, 19 nt, Salmonella enterica enterica serovar Typhi Ty2
cgcgucagguuuaaucggc

SEQ ID NO: 3718766 - RNA, 22 nt, Salmonella enterica enterica serovar Typhi Ty2
cgcgucagugaauauccccuga

SEQ ID NO: 3718767 - RNA, 22 nt, Salmonella enterica enterica serovar Typhi Ty2
cgcgucauaaugcccagcgccg

SEQ ID NO: 3718768 - RNA, 15 nt, Salmonella enterica enterica serovar Typhi Ty2
cgcguccagcccgcu

SEQ ID NO: 3718769 - RNA, 15 nt, Salmonella enterica enterica serovar Typhi Ty2
cgcgucccucuccag

SEQ ID NO: 3718770 - RNA, 18 nt, Salmonella enterica enterica serovar Typhi Ty2
cgcgucgccauccggcga

SEQ ID NO: 3718771 - RNA, 12 nt, Salmonella enterica enterica serovar Typhi Ty2
cgcgucgcuguu

SEQ ID NO: 3718772 - RNA, 16 nt, Salmonella enterica enterica serovar Typhi Ty2
cgcgucguucacgcca

SEQ ID NO: 3718773 - RNA, 21 nt, Salmonella enterica enterica serovar Typhi Ty2
cgcgucguucacgucgcgaag

SEQ ID NO: 3718774 - RNA, 22 nt, Salmonella enterica enterica serovar Typhi Ty2
cgcgucguucacgucgcgaagc

SEQ ID NO: 3718775 - RNA, 12 nt, Salmonella enterica enterica serovar Typhi Ty2
cgcgucuucauc

SEQ ID NO: 3718776 - RNA, 19 nt, Salmonella enterica enterica serovar Typhi Ty2
cgcgugaauugcgguuuau

SEQ ID NO: 3718777 - RNA, 22 nt, Salmonella enterica enterica serovar Typhi Ty2
cgcgugaauugcgguuuauccc

SEQ ID NO: 3718778 - RNA, 17 nt, Salmonella enterica enterica serovar Typhi Ty2
cgcgugcucgcggcgga

SEQ ID NO: 3718779 - RNA, 20 nt, Salmonella enterica enterica serovar Typhi Ty2
cgcgugcuguaccgcguccu

SEQ ID NO: 3718780 - RNA, 19 nt, Salmonella enterica enterica serovar Typhi Ty2
cgcguggaaauaaucugua

SEQ ID NO: 3718781 - RNA, 13 nt, Salmonella enterica enterica serovar Typhi Ty2
cgcguggcaucuu

SEQ ID NO: 3718782 - RNA, 20 nt, Salmonella enterica enterica serovar Typhi Ty2
cgcguguuuguaaaaauaga

SEQ ID NO: 3718783 - RNA, 23 nt, Salmonella enterica enterica serovar Typhi Ty2
cgcguuaauauccuucagcguuu

SEQ ID NO: 3718784 - RNA, 18 nt, Salmonella enterica enterica serovar Typhi Ty2
cgcguuaauuuuccccgc

SEQ ID NO: 3718785 - RNA, 16 nt, Salmonella enterica enterica serovar Typhi Ty2
cgcucaggaucgccgg

SEQ ID NO: 3718786 - RNA, 16 nt, Salmonella enterica enterica serovar Typhi Ty2
cgcucaggcgcgcgcu

SEQ ID NO: 3718787 - RNA, 20 nt, Salmonella enterica enterica serovar Typhi Ty2
cgcucaucacaucgcgcagc

SEQ ID NO: 3718788 - RNA, 15 nt, Salmonella enterica enterica serovar Typhi Ty2
cgcucaugccacgcc

SEQ ID NO: 3718789 - RNA, 15 nt, Salmonella enterica enterica serovar Typhi Ty2
cgcucaugcgccugg

SEQ ID NO: 3718790 - RNA, 16 nt, Salmonella enterica enterica serovar Typhi Ty2
cgcucaugcgccuggc

SEQ ID NO: 3718791 - RNA, 17 nt, Salmonella enterica enterica serovar Typhi Ty2
cgcucauuuuauugaua

SEQ ID NO: 3718792 - RNA, 14 nt, Salmonella enterica enterica serovar Typhi Ty2
cgcuccaccgccgg

SEQ ID NO: 3718793 - RNA, 15 nt, Salmonella enterica enterica serovar Typhi Ty2
cgcuccacgcguccu

SEQ ID NO: 3718794 - RNA, 19 nt, Salmonella enterica enterica serovar Typhi Ty2
cgcuccacugauaguccau

SEQ ID NO: 3718795 - RNA, 11 nt, Salmonella enterica enterica serovar Typhi Ty2
cgcuccagaag

SEQ ID NO: 3718796 - RNA, 16 nt, Salmonella enterica enterica serovar Typhi Ty2
cgcuccagaccaccag

SEQ ID NO: 3718797 - RNA, 16 nt, Salmonella enterica enterica serovar Typhi Ty2
cgcuccagcaguucua

SEQ ID NO: 3718798 - RNA, 14 nt, Salmonella enterica enterica serovar Typhi Ty2
cgcuccagcuggcu

SEQ ID NO: 3718799 - RNA, 15 nt, Salmonella enterica enterica serovar Typhi Ty2
cgcucccccggcgau

SEQ ID NO: 3718800 - RNA, 14 nt, Salmonella enterica enterica serovar Typhi Ty2
cgcucccgcgcgcu

SEQ ID NO: 3718801 - RNA, 14 nt, Salmonella enterica enterica serovar Typhi Ty2
cgcucccuuccccc

SEQ ID NO: 3718802 - RNA, 17 nt, Salmonella enterica enterica serovar Typhi Ty2
cgcucccuucccccaga

SEQ ID NO: 3718803 - RNA, 21 nt, Salmonella enterica enterica serovar Typhi Ty2
cgcuccugcgguacggccagc

SEQ ID NO: 3718804 - RNA, 18 nt, Salmonella enterica enterica serovar Typhi Ty2
cgcucgaaaccaucgucg

SEQ ID NO: 3718805 - RNA, 20 nt, Salmonella enterica enterica serovar Typhi Ty2
cgcucgccagcauacgucug

SEQ ID NO: 3718806 - RNA, 24 nt, Salmonella enterica enterica serovar Typhi Ty2
cgcucgccagcauacgucugcgcu

SEQ ID NO: 3718807 - RNA, 15 nt, Salmonella enterica enterica serovar Typhi Ty2
cgcucgccauaucuu

SEQ ID NO: 3718808 - RNA, 14 nt, Salmonella enterica enterica serovar Typhi Ty2
cgcucgcccgccgc

SEQ ID NO: 3718809 - RNA, 16 nt, Salmonella enterica enterica serovar Typhi Ty2
cgcucgcccgccgcaa

SEQ ID NO: 3718810 - RNA, 16 nt, Salmonella enterica enterica serovar Typhi Ty2
cgcucgccgccucccc

SEQ ID NO: 3718811 - RNA, 22 nt, Salmonella enterica enterica serovar Typhi Ty2
cgcucgcggaagcgaccggcgu

SEQ ID NO: 3718812 - RNA, 22 nt, Salmonella enterica enterica serovar Typhi Ty2
cgcucgcucaucacaucgcgca

SEQ ID NO: 3718813 - RNA, 23 nt, Salmonella enterica enterica serovar Typhi Ty2
cgcucgcucaucacaucgcgcag

SEQ ID NO: 3718814 - RNA, 18 nt, Salmonella enterica enterica serovar Typhi Ty2
cgcucgcuuugccgccau

SEQ ID NO: 3718815 - RNA, 13 nt, Salmonella enterica enterica serovar Typhi Ty2
cgcucggcauaca

SEQ ID NO: 3718816 - RNA, 20 nt, Salmonella enterica enterica serovar Typhi Ty2
cgcucggcauacaccgccag

SEQ ID NO: 3718817 - RNA, 13 nt, Salmonella enterica enterica serovar Typhi Ty2
cgcucggccagau

SEQ ID NO: 3718818 - RNA, 16 nt, Salmonella enterica enterica serovar Typhi Ty2
cgcucggccagauaac

SEQ ID NO: 3718819 - RNA, 16 nt, Salmonella enterica enterica serovar Typhi Ty2
cgcucguacaaaucac

SEQ ID NO: 3718820 - RNA, 21 nt, Salmonella enterica enterica serovar Typhi Ty2
cgcucguuauaauugcccgca

SEQ ID NO: 3718821 - RNA, 19 nt, Salmonella enterica enterica serovar Typhi Ty2
cgcucuauauccugcccuu

SEQ ID NO: 3718822 - RNA, 18 nt, Salmonella enterica enterica serovar Typhi Ty2
cgcucuaucaccgcccgc

SEQ ID NO: 3718823 - RNA, 14 nt, Salmonella enterica enterica serovar Typhi Ty2
cgcucuaucgccug

SEQ ID NO: 3718824 - RNA, 22 nt, Salmonella enterica enterica serovar Typhi Ty2
cgcucucauagccgacccgcau

SEQ ID NO: 3718825 - RNA, 23 nt, Salmonella enterica enterica serovar Typhi Ty2
cgcucucgauauacuccgcgacg

SEQ ID NO: 3718826 - RNA, 22 nt, Salmonella enterica enterica serovar Typhi Ty2
cgcucucgccgcgcuccaucau

SEQ ID NO: 3718827 - RNA, 13 nt, Salmonella enterica enterica serovar Typhi Ty2
cgcucugccuuuu

SEQ ID NO: 3718828 - RNA, 15 nt, Salmonella enterica enterica serovar Typhi Ty2
cgcucugcuguuccu

SEQ ID NO: 3718829 - RNA, 21 nt, Salmonella enterica enterica serovar Typhi Ty2
cgcucugcuucggaaugacaa

SEQ ID NO: 3718830 - RNA, 12 nt, Salmonella enterica enterica serovar Typhi Ty2
cgcucuuaccgc

SEQ ID NO: 3718831 - RNA, 14 nt, Salmonella enterica enterica serovar Typhi Ty2
cgcucuuaccgcua

SEQ ID NO: 3718832 - RNA, 19 nt, Salmonella enterica enterica serovar Typhi Ty2
cgcucuuccgccagcgcca

SEQ ID NO: 3718833 - RNA, 12 nt, Salmonella enterica enterica serovar Typhi Ty2
cgcucuucgcca

SEQ ID NO: 3718834 - RNA, 23 nt, Salmonella enterica enterica serovar Typhi Ty2
cgcucuucgccaaucgccgccgc

SEQ ID NO: 3718835 - RNA, 21 nt, Salmonella enterica enterica serovar Typhi Ty2
cgcugaagcuugaaccgggua

SEQ ID NO: 3718836 - RNA, 16 nt, Salmonella enterica enterica serovar Typhi Ty2
cgcugaaguccgcgau

SEQ ID NO: 3718837 - RNA, 22 nt, Salmonella enterica enterica serovar Typhi Ty2
cgcugaccacgccgccgcgucc

SEQ ID NO: 3718838 - RNA, 22 nt, Salmonella enterica enterica serovar Typhi Ty2
cgcugaccgcgcuguaucacuu

SEQ ID NO: 3718839 - RNA, 21 nt, Salmonella enterica enterica serovar Typhi Ty2
cgcugacgaucaugccgccca

SEQ ID NO: 3718840 - RNA, 20 nt, Salmonella enterica enterica serovar Typhi Ty2
cgcugacgccgaccaccgcc

SEQ ID NO: 3718841 - RNA, 17 nt, Salmonella enterica enterica serovar Typhi Ty2
cgcugacgcugcccgcc

SEQ ID NO: 3718842 - RNA, 14 nt, Salmonella enterica enterica serovar Typhi Ty2
cgcugacugaacuc

SEQ ID NO: 3718843 - RNA, 17 nt, Salmonella enterica enterica serovar Typhi Ty2
cgcugagaugaccauau

SEQ ID NO: 3718844 - RNA, 22 nt, Salmonella enterica enterica serovar Typhi Ty2
cgcugagucagaaacggccugg

SEQ ID NO: 3718845 - RNA, 21 nt, Salmonella enterica enterica serovar Typhi Ty2
cgcugagucauccuuccccca

SEQ ID NO: 3718846 - RNA, 23 nt, Salmonella enterica enterica serovar Typhi Ty2
cgcugaguuucucccgccagaug

SEQ ID NO: 3718847 - RNA, 16 nt, Salmonella enterica enterica serovar Typhi Ty2
cgcugauagccacggc

SEQ ID NO: 3718848 - RNA, 16 nt, Salmonella enterica enterica serovar Typhi Ty2
cgcugaucgccacgcc

SEQ ID NO: 3718849 - RNA, 14 nt, Salmonella enterica enterica serovar Typhi Ty2
cgcugaugacgcgc

SEQ ID NO: 3718850 - RNA, 19 nt, Salmonella enterica enterica serovar Typhi Ty2
cgcugaugacgcgccggau

SEQ ID NO: 3718851 - RNA, 22 nt, Salmonella enterica enterica serovar Typhi Ty2
cgcugaugguuucggcaugcca

SEQ ID NO: 3718852 - RNA, 18 nt, Salmonella enterica enterica serovar Typhi Ty2
cgcugaugugcggccugg

SEQ ID NO: 3718853 - RNA, 23 nt, Salmonella enterica enterica serovar Typhi Ty2
cgcugauguuuugcgccgcgcgu

SEQ ID NO: 3718854 - RNA, 14 nt, Salmonella enterica enterica serovar Typhi Ty2
cgcugcacaaucgc

SEQ ID NO: 3718855 - RNA, 16 nt, Salmonella enterica enterica serovar Typhi Ty2
cgcugcagauuuugcu

SEQ ID NO: 3718856 - RNA, 20 nt, Salmonella enterica enterica serovar Typhi Ty2
cgcugcaucguuugcaguuc

SEQ ID NO: 3718857 - RNA, 20 nt, Salmonella enterica enterica serovar Typhi Ty2
cgcugccacacucucuccag

SEQ ID NO: 3718858 - RNA, 15 nt, Salmonella enterica enterica serovar Typhi Ty2
cgcugcccugacucg

SEQ ID NO: 3718859 - RNA, 13 nt, Salmonella enterica enterica serovar Typhi Ty2
cgcugccgccgcu

SEQ ID NO: 3718860 - RNA, 19 nt, Salmonella enterica enterica serovar Typhi Ty2
cgcugccggaaagccccag

SEQ ID NO: 3718861 - RNA, 21 nt, Salmonella enterica enterica serovar Typhi Ty2
cgcugccuuccgggcggcugu

SEQ ID NO: 3718862 - RNA, 15 nt, Salmonella enterica enterica serovar Typhi Ty2
cgcugcgaagugaau

SEQ ID NO: 3718863 - RNA, 14 nt, Salmonella enterica enterica serovar Typhi Ty2
cgcugcgcaggcgu

SEQ ID NO: 3718864 - RNA, 23 nt, Salmonella enterica enterica serovar Typhi Ty2
cgcugcgcauuagcaauaaucuc

SEQ ID NO: 3718865 - RNA, 14 nt, Salmonella enterica enterica serovar Typhi Ty2
cgcugcgccagauc

SEQ ID NO: 3718866 - RNA, 22 nt, Salmonella enterica enterica serovar Typhi Ty2
cgcugcgcuuacacacccggcc

SEQ ID NO: 3718867 - RNA, 13 nt, Salmonella enterica enterica serovar Typhi Ty2
cgcuuccugcagu

SEQ ID NO: 3718868 - RNA, 18 nt, Salmonella enterica enterica serovar Typhi Ty2
cgcuuccugccaggccgg

SEQ ID NO: 3718869 - RNA, 16 nt, Salmonella enterica enterica serovar Typhi Ty2
cgcuucgaugcguuca

SEQ ID NO: 3718870 - RNA, 23 nt, Salmonella enterica enterica serovar Typhi Ty2
cgcuucgcagcgauauuucuccg

SEQ ID NO: 3718871 - RNA, 21 nt, Salmonella enterica enterica serovar Typhi Ty2
cgcuucgccuguugcugacga

SEQ ID NO: 3718872 - RNA, 14 nt, Salmonella enterica enterica serovar Typhi Ty2
cgcuucgcgcgcca

SEQ ID NO: 3718873 - RNA, 20 nt, Salmonella enterica enterica serovar Typhi Ty2
cgcuucgcuuaccaggccua

SEQ ID NO: 3718874 - RNA, 15 nt, Salmonella enterica enterica serovar Typhi Ty2
cgcuucguauuucuu

SEQ ID NO: 3718875 - RNA, 19 nt, Salmonella enterica enterica serovar Typhi Ty2
cgcuucgucagcuccucgc

SEQ ID NO: 3718876 - RNA, 16 nt, Salmonella enterica enterica serovar Typhi Ty2
cgcuucuauuaccgca

SEQ ID NO: 3718877 - RNA, 18 nt, Salmonella enterica enterica serovar Typhi Ty2
cgcuucuauuaccgcagc

SEQ ID NO: 3718878 - RNA, 23 nt, Salmonella enterica enterica serovar Typhi Ty2
cgcuucucuauacggcgcgcagu

SEQ ID NO: 3718879 - RNA, 12 nt, Salmonella enterica enterica serovar Typhi Ty2
cgcuucuggaau

SEQ ID NO: 3718880 - RNA, 17 nt, Salmonella enterica enterica serovar Typhi Ty2
cgcuucuucaugggcgu

SEQ ID NO: 3718881 - RNA, 13 nt, Salmonella enterica enterica serovar Typhi Ty2
cgcuucuucggca

SEQ ID NO: 3718882 - RNA, 23 nt, Salmonella enterica enterica serovar Typhi Ty2
cgcuucuucggcagcuuccagca

SEQ ID NO: 3718883 - RNA, 17 nt, Salmonella enterica enterica serovar Typhi Ty2
cgcuucuucuaccaccu

SEQ ID NO: 3718884 - RNA, 14 nt, Salmonella enterica enterica serovar Typhi Ty2
cgcuugauacgcca

SEQ ID NO: 3718885 - RNA, 17 nt, Salmonella enterica enterica serovar Typhi Ty2
cgcuugauccagcucgc

SEQ ID NO: 3718886 - RNA, 12 nt, Salmonella enterica enterica serovar Typhi Ty2
cgcuugccacua

SEQ ID NO: 3718887 - RNA, 20 nt, Salmonella enterica enterica serovar Typhi Ty2
cgcuuuaaucaguucauagc

SEQ ID NO: 3718888 - RNA, 14 nt, Salmonella enterica enterica serovar Typhi Ty2
cgcuuuagcgauaa

SEQ ID NO: 3718889 - RNA, 22 nt, Salmonella enterica enterica serovar Typhi Ty2
cgcuuuaugcgcuuccagcaug

SEQ ID NO: 3718890 - RNA, 12 nt, Salmonella enterica enterica serovar Typhi Ty2
cgcuuucaaucg

SEQ ID NO: 3718891 - RNA, 13 nt, Salmonella enterica enterica serovar Typhi Ty2
cgcuuucaccauc

SEQ ID NO: 3718892 - RNA, 13 nt, Salmonella enterica enterica serovar Typhi Ty2
cgcuuucauacga

SEQ ID NO: 3718893 - RNA, 14 nt, Salmonella enterica enterica serovar Typhi Ty2
cgcuuucccggcau

SEQ ID NO: 3718894 - RNA, 19 nt, Salmonella enterica enterica serovar Typhi Ty2
cgcuuucugagccgcccgg

SEQ ID NO: 3718895 - RNA, 19 nt, Salmonella enterica enterica serovar Typhi Ty2
cgcuuugacauugucauaa

SEQ ID NO: 3718896 - RNA, 17 nt, Salmonella enterica enterica serovar Typhi Ty2
cgcuuugagcugcugcu

SEQ ID NO: 3718897 - RNA, 19 nt, Salmonella enterica enterica serovar Typhi Ty2
cgcuuugauuuugcgcagc

SEQ ID NO: 3718898 - RNA, 16 nt, Salmonella enterica enterica serovar Typhi Ty2
cgcuuugccagcaucg

SEQ ID NO: 3718899 - RNA, 22 nt, Salmonella enterica enterica serovar Typhi Ty2
cgcuuugcuuauccggccuaca

SEQ ID NO: 3718900 - RNA, 16 nt, Salmonella enterica enterica serovar Typhi Ty2
cgcuuuuaauugcgca

SEQ ID NO: 3718901 - RNA, 19 nt, Salmonella enterica enterica serovar Typhi Ty2
cgcuuuuacucuuccugcu

SEQ ID NO: 3718902 - RNA, 22 nt, Salmonella enterica enterica serovar Typhi Ty2
cgcuuuuagggccgauaccggc

SEQ ID NO: 3718903 - RNA, 15 nt, Salmonella enterica enterica serovar Typhi Ty2
cgcuuuucagcgucu

SEQ ID NO: 3718904 - RNA, 13 nt, Salmonella enterica enterica serovar Typhi Ty2
cgcuuuuccccgc

SEQ ID NO: 3718905 - RNA, 15 nt, Salmonella enterica enterica serovar Typhi Ty2
cgcuuuuccccgcag

SEQ ID NO: 3718906 - RNA, 16 nt, Salmonella enterica enterica serovar Typhi Ty2
cgcuuuuucacgacca

SEQ ID NO: 3718907 - RNA, 23 nt, Salmonella enterica enterica serovar Typhi Ty2
cgcuuuuuccagcauuagcgcca

SEQ ID NO: 3718908 - RNA, 14 nt, Salmonella enterica enterica serovar Typhi Ty2
cgcuuuuugcgcca

SEQ ID NO: 3718909 - RNA, 17 nt, Salmonella enterica enterica serovar Typhi Ty2
cgcuuuuugcuucgcca

SEQ ID NO: 3718910 - RNA, 23 nt, Salmonella enterica enterica serovar Typhi Ty2
cgcuuuuuuaacgauuuccccug

SEQ ID NO: 3718911 - RNA, 16 nt, Salmonella enterica enterica serovar Typhi Ty2
cgcuuuuuucucugcu

SEQ ID NO: 3718912 - RNA, 13 nt, Salmonella enterica enterica serovar Typhi Ty2
cggaaaaaacguu

SEQ ID NO: 3718913 - RNA, 23 nt, Salmonella enterica enterica serovar Typhi Ty2
cggaaaaaugucgcuuaucgccu

SEQ ID NO: 3718914 - RNA, 15 nt, Salmonella enterica enterica serovar Typhi Ty2
cggaaaagcgcccaa

SEQ ID NO: 3718915 - RNA, 20 nt, Salmonella enterica enterica serovar Typhi Ty2
cggaaaauauucagcacauc

SEQ ID NO: 3718916 - RNA, 14 nt, Salmonella enterica enterica serovar Typhi Ty2
cggaaaccccaggu

SEQ ID NO: 3718917 - RNA, 16 nt, Salmonella enterica enterica serovar Typhi Ty2
cggaaaccccagguca

SEQ ID NO: 3718918 - RNA, 14 nt, Salmonella enterica enterica serovar Typhi Ty2
cggaaacgcuguuc

SEQ ID NO: 3718919 - RNA, 17 nt, Salmonella enterica enterica serovar Typhi Ty2
cggaaacuauccuggcc

SEQ ID NO: 3718920 - RNA, 15 nt, Salmonella enterica enterica serovar Typhi Ty2
cggaaagaauaaucg

SEQ ID NO: 3718921 - RNA, 20 nt, Salmonella enterica enterica serovar Typhi Ty2
cggaaaggacguucuucucc

SEQ ID NO: 3718922 - RNA, 19 nt, Salmonella enterica enterica serovar Typhi Ty2
cggaaaggauauaagcgcc

SEQ ID NO: 3718923 - RNA, 16 nt, Salmonella enterica enterica serovar Typhi Ty2
cggaaaucaacaaucc

SEQ ID NO: 3718924 - RNA, 23 nt, Salmonella enterica enterica serovar Typhi Ty2
cggaaaucacaaacaccaccagu

SEQ ID NO: 3718925 - RNA, 14 nt, Salmonella enterica enterica serovar Typhi Ty2
cggaaaucacgcau

SEQ ID NO: 3718926 - RNA, 14 nt, Salmonella enterica enterica serovar Typhi Ty2
cggaaaucgcggcg

SEQ ID NO: 3718927 - RNA, 18 nt, Salmonella enterica enterica serovar Typhi Ty2
cggaaaugaaaaagauag

SEQ ID NO: 3718928 - RNA, 22 nt, Salmonella enterica enterica serovar Typhi Ty2
cggaaaugaucagacgcaucag

SEQ ID NO: 3718929 - RNA, 19 nt, Salmonella enterica enterica serovar Typhi Ty2
cggaaaugcggguccugau

SEQ ID NO: 3718930 - RNA, 12 nt, Salmonella enterica enterica serovar Typhi Ty2
cggaaauggucg

SEQ ID NO: 3718931 - RNA, 17 nt, Salmonella enterica enterica serovar Typhi Ty2
cggaaauuugcagcgcu

SEQ ID NO: 3718932 - RNA, 16 nt, Salmonella enterica enterica serovar Typhi Ty2
cggaacaggcuuuuca

SEQ ID NO: 3718933 - RNA, 17 nt, Salmonella enterica enterica serovar Typhi Ty2
cggaacagggccgcauc

SEQ ID NO: 3718934 - RNA, 17 nt, Salmonella enterica enterica serovar Typhi Ty2
cggaaccaaaugcccag

SEQ ID NO: 3718935 - RNA, 20 nt, Salmonella enterica enterica serovar Typhi Ty2
cggaaccgcguuugcgucgu

SEQ ID NO: 3718936 - RNA, 14 nt, Salmonella enterica enterica serovar Typhi Ty2
cggaaccuguccug

SEQ ID NO: 3718937 - RNA, 23 nt, Salmonella enterica enterica serovar Typhi Ty2
cggaacgcgacucccaggcgcgc

SEQ ID NO: 3718938 - RNA, 18 nt, Salmonella enterica enterica serovar Typhi Ty2
cggaagacuggcgcagca

SEQ ID NO: 3718939 - RNA, 18 nt, Salmonella enterica enterica serovar Typhi Ty2
cggaagcagauaccagcc

SEQ ID NO: 3718940 - RNA, 15 nt, Salmonella enterica enterica serovar Typhi Ty2
cggaagcgaccggcg

SEQ ID NO: 3718941 - RNA, 15 nt, Salmonella enterica enterica serovar Typhi Ty2
cggaagcugaccagg

SEQ ID NO: 3718942 - RNA, 21 nt, Salmonella enterica enterica serovar Typhi Ty2
cggaagcugaccagggcaaau

SEQ ID NO: 3718943 - RNA, 21 nt, Salmonella enterica enterica serovar Typhi Ty2
cggaagcuuuuaguuacgcac

SEQ ID NO: 3718944 - RNA, 16 nt, Salmonella enterica enterica serovar Typhi Ty2
cggaaggcgaaaacau

SEQ ID NO: 3718945 - RNA, 22 nt, Salmonella enterica enterica serovar Typhi Ty2
cggaaggcuaccgcugggauga

SEQ ID NO: 3718946 - RNA, 20 nt, Salmonella enterica enterica serovar Typhi Ty2
cggaaguagagaaccaacgu

SEQ ID NO: 3718947 - RNA, 16 nt, Salmonella enterica enterica serovar Typhi Ty2
cggaaguauacaucca

SEQ ID NO: 3718948 - RNA, 15 nt, Salmonella enterica enterica serovar Typhi Ty2
cggaaguauccugga

SEQ ID NO: 3718949 - RNA, 19 nt, Salmonella enterica enterica serovar Typhi Ty2
cggaucaaaaaggugagca

SEQ ID NO: 3718950 - RNA, 15 nt, Salmonella enterica enterica serovar Typhi Ty2
cggaucaauaaacag

SEQ ID NO: 3718951 - RNA, 15 nt, Salmonella enterica enterica serovar Typhi Ty2
cggaucaccggcauu

SEQ ID NO: 3718952 - RNA, 16 nt, Salmonella enterica enterica serovar Typhi Ty2
cggaucaccggcauuu

SEQ ID NO: 3718953 - RNA, 21 nt, Salmonella enterica enterica serovar Typhi Ty2
cggaucaggcguuagccgcca

SEQ ID NO: 3718954 - RNA, 13 nt, Salmonella enterica enterica serovar Typhi Ty2
cggauccagaacu

SEQ ID NO: 3718955 - RNA, 16 nt, Salmonella enterica enterica serovar Typhi Ty2
cggauccggcgcagac

SEQ ID NO: 3718956 - RNA, 16 nt, Salmonella enterica enterica serovar Typhi Ty2
cggaucgacagcaaug

SEQ ID NO: 3718957 - RNA, 18 nt, Salmonella enterica enterica serovar Typhi Ty2
cggaucgaucccggcaaa

SEQ ID NO: 3718958 - RNA, 16 nt, Salmonella enterica enterica serovar Typhi Ty2
cggaucgugauaacgc

SEQ ID NO: 3718959 - RNA, 16 nt, Salmonella enterica enterica serovar Typhi Ty2
cggaugaaacaguccg

SEQ ID NO: 3718960 - RNA, 15 nt, Salmonella enterica enterica serovar Typhi Ty2
cggaugaucuucaua

SEQ ID NO: 3718961 - RNA, 14 nt, Salmonella enterica enterica serovar Typhi Ty2
cggaugauuaucau

SEQ ID NO: 3718962 - RNA, 11 nt, Salmonella enterica enterica serovar Typhi Ty2
cggaugcgcgg

SEQ ID NO: 3718963 - RNA, 16 nt, Salmonella enterica enterica serovar Typhi Ty2
cggauggaauuuugca

SEQ ID NO: 3718964 - RNA, 14 nt, Salmonella enterica enterica serovar Typhi Ty2
cggauggcgcggca

SEQ ID NO: 3718965 - RNA, 22 nt, Salmonella enterica enterica serovar Typhi Ty2
cggauggcggcuaacgccugau

SEQ ID NO: 3718966 - RNA, 22 nt, Salmonella enterica enterica serovar Typhi Ty2
cggauggcguuuagcuggcggg

SEQ ID NO: 3718967 - RNA, 23 nt, Salmonella enterica enterica serovar Typhi Ty2
cggauggcguuuagcuggcgggg

SEQ ID NO: 3718968 - RNA, 12 nt, Salmonella enterica enterica serovar Typhi Ty2
cggaugggcaga

SEQ ID NO: 3718969 - RNA, 13 nt, Salmonella enterica enterica serovar Typhi Ty2
cggaugugcauug

SEQ ID NO: 3718970 - RNA, 14 nt, Salmonella enterica enterica serovar Typhi Ty2
cggaugugcauuga

SEQ ID NO: 3718971 - RNA, 20 nt, Salmonella enterica enterica serovar Typhi Ty2
cggauguuagcuucacuucg

SEQ ID NO: 3718972 - RNA, 20 nt, Salmonella enterica enterica serovar Typhi Ty2
cggauuaacaagcagauacc

SEQ ID NO: 3718973 - RNA, 20 nt, Salmonella enterica enterica serovar Typhi Ty2
cggauuaagcgaauccagcg

SEQ ID NO: 3718974 - RNA, 16 nt, Salmonella enterica enterica serovar Typhi Ty2
cggauuauuggucagu

SEQ ID NO: 3718975 - RNA, 14 nt, Salmonella enterica enterica serovar Typhi Ty2
cggauuccagaaua

SEQ ID NO: 3718976 - RNA, 19 nt, Salmonella enterica enterica serovar Typhi Ty2
cggauucgacugcggucgu

SEQ ID NO: 3718977 - RNA, 14 nt, Salmonella enterica enterica serovar Typhi Ty2
cggauucuuccucu

SEQ ID NO: 3718978 - RNA, 22 nt, Salmonella enterica enterica serovar Typhi Ty2
cggauugccgcgcucaaucuga

SEQ ID NO: 3718979 - RNA, 22 nt, Salmonella enterica enterica serovar Typhi Ty2
cggauugucaucugacugcgug

SEQ ID NO: 3718980 - RNA, 19 nt, Salmonella enterica enterica serovar Typhi Ty2
cggauuuaccagcgcuucu

SEQ ID NO: 3718981 - RNA, 18 nt, Salmonella enterica enterica serovar Typhi Ty2
cggauuuagcggcagcca

SEQ ID NO: 3718982 - RNA, 15 nt, Salmonella enterica enterica serovar Typhi Ty2
cggcaaaaaucagcc

SEQ ID NO: 3718983 - RNA, 19 nt, Salmonella enterica enterica serovar Typhi Ty2
cggcaaaaaucagcccgga

SEQ ID NO: 3718984 - RNA, 18 nt, Salmonella enterica enterica serovar Typhi Ty2
cggcaaaacgccgcagaa

SEQ ID NO: 3718985 - RNA, 13 nt, Salmonella enterica enterica serovar Typhi Ty2
cggcaaaagaggc

SEQ ID NO: 3718986 - RNA, 22 nt, Salmonella enterica enterica serovar Typhi Ty2
cggcaaaauaaauauccuccgg

SEQ ID NO: 3718987 - RNA, 20 nt, Salmonella enterica enterica serovar Typhi Ty2
cggcaaaauaguucagcgca

SEQ ID NO: 3718988 - RNA, 18 nt, Salmonella enterica enterica serovar Typhi Ty2
cggcaaacacaaucacgc

SEQ ID NO: 3718989 - RNA, 17 nt, Salmonella enterica enterica serovar Typhi Ty2
cggcaaacauagccuca

SEQ ID NO: 3718990 - RNA, 24 nt, Salmonella enterica enterica serovar Typhi Ty2
cggcaaaccaugaucgucaggcgc

SEQ ID NO: 3718991 - RNA, 18 nt, Salmonella enterica enterica serovar Typhi Ty2
cggcaaaccuaccggcau

SEQ ID NO: 3718992 - RNA, 15 nt, Salmonella enterica enterica serovar Typhi Ty2
cggcaaacgcuggug

SEQ ID NO: 3718993 - RNA, 21 nt, Salmonella enterica enterica serovar Typhi Ty2
cggcaaacgggcgaccgucgg

SEQ ID NO: 3718994 - RNA, 23 nt, Salmonella enterica enterica serovar Typhi Ty2
cggcaaacggggggauucauuau

SEQ ID NO: 3718995 - RNA, 17 nt, Salmonella enterica enterica serovar Typhi Ty2
cggcaaacucagcggcu

SEQ ID NO: 3718996 - RNA, 19 nt, Salmonella enterica enterica serovar Typhi Ty2
cggcaaagauaaucugaau

SEQ ID NO: 3718997 - RNA, 18 nt, Salmonella enterica enterica serovar Typhi Ty2
cggcaaagccaucaaucc

SEQ ID NO: 3718998 - RNA, 20 nt, Salmonella enterica enterica serovar Typhi Ty2
cggcaaagguugccgcaaua

SEQ ID NO: 3718999 - RNA, 14 nt, Salmonella enterica enterica serovar Typhi Ty2
cggcaaagucuuca

SEQ ID NO: 3719000 - RNA, 20 nt, Salmonella enterica enterica serovar Typhi Ty2
cggcaaauucuuuucacgca

SEQ ID NO: 3719001 - RNA, 13 nt, Salmonella enterica enterica serovar Typhi Ty2
cggcaacaguacc

SEQ ID NO: 3719002 - RNA, 22 nt, Salmonella enterica enterica serovar Typhi Ty2
cggcaacauaaauaaacagcgc

SEQ ID NO: 3719003 - RNA, 16 nt, Salmonella enterica enterica serovar Typhi Ty2
cggcaaccaaagucca

SEQ ID NO: 3719004 - RNA, 12 nt, Salmonella enterica enterica serovar Typhi Ty2
cggcaacccgcu

SEQ ID NO: 3719005 - RNA, 12 nt, Salmonella enterica enterica serovar Typhi Ty2
cggcaacugcgc

SEQ ID NO: 3719006 - RNA, 17 nt, Salmonella enterica enterica serovar Typhi Ty2
cggcaagcgcugggcga

SEQ ID NO: 3719007 - RNA, 18 nt, Salmonella enterica enterica serovar Typhi Ty2
cggcaagcgggcguugcu

SEQ ID NO: 3719008 - RNA, 14 nt, Salmonella enterica enterica serovar Typhi Ty2
cggcaagcuggcga

SEQ ID NO: 3719009 - RNA, 17 nt, Salmonella enterica enterica serovar Typhi Ty2
cggcaaggaaaaccagu

SEQ ID NO: 3719010 - RNA, 18 nt, Salmonella enterica enterica serovar Typhi Ty2
cggcaaggucugcgccca

SEQ ID NO: 3719011 - RNA, 23 nt, Salmonella enterica enterica serovar Typhi Ty2
cggcaauaaacucccgcauauau

SEQ ID NO: 3719012 - RNA, 14 nt, Salmonella enterica enterica serovar Typhi Ty2
cggcaauacuggac

SEQ ID NO: 3719013 - RNA, 13 nt, Salmonella enterica enterica serovar Typhi Ty2
cggcaaucaauac

SEQ ID NO: 3719014 - RNA, 15 nt, Salmonella enterica enterica serovar Typhi Ty2
cggcaaucaauacag

SEQ ID NO: 3719015 - RNA, 13 nt, Salmonella enterica enterica serovar Typhi Ty2
cggcaaucucacu

SEQ ID NO: 3719016 - RNA, 20 nt, Salmonella enterica enterica serovar Typhi Ty2
cggcaaugcucugcagguca

SEQ ID NO: 3719017 - RNA, 17 nt, Salmonella enterica enterica serovar Typhi Ty2
cggcaauggccagauga

SEQ ID NO: 3719018 - RNA, 21 nt, Salmonella enterica enterica serovar Typhi Ty2
cggcaauggccagaugaaacu

SEQ ID NO: 3719019 - RNA, 15 nt, Salmonella enterica enterica serovar Typhi Ty2
cggcaauuaccgcca

SEQ ID NO: 3719020 - RNA, 17 nt, Salmonella enterica enterica serovar Typhi Ty2
cggcaauuaccgccagc

SEQ ID NO: 3719021 - RNA, 20 nt, Salmonella enterica enterica serovar Typhi Ty2
cggcaauuaccgccagcggc

SEQ ID NO: 3719022 - RNA, 17 nt, Salmonella enterica enterica serovar Typhi Ty2
cggcaauuuacaaccgu

SEQ ID NO: 3719023 - RNA, 15 nt, Salmonella enterica enterica serovar Typhi Ty2
cggcaauuuccggcg

SEQ ID NO: 3719024 - RNA, 15 nt, Salmonella enterica enterica serovar Typhi Ty2
cggcacaaccuggcu

SEQ ID NO: 3719025 - RNA, 20 nt, Salmonella enterica enterica serovar Typhi Ty2
cggcacaaugcccggcauac

SEQ ID NO: 3719026 - RNA, 13 nt, Salmonella enterica enterica serovar Typhi Ty2
cggcacagccagu

SEQ ID NO: 3719027 - RNA, 15 nt, Salmonella enterica enterica serovar Typhi Ty2
cggcacaucaauaaa

SEQ ID NO: 3719028 - RNA, 17 nt, Salmonella enterica enterica serovar Typhi Ty2
cggcacaucgcgcguga

SEQ ID NO: 3719029 - RNA, 17 nt, Salmonella enterica enterica serovar Typhi Ty2
cggcacauucaccacgc

SEQ ID NO: 3719030 - RNA, 21 nt, Salmonella enterica enterica serovar Typhi Ty2
cggcacauucaccacgcagcc

SEQ ID NO: 3719031 - RNA, 22 nt, Salmonella enterica enterica serovar Typhi Ty2
cggccaaagcgcgacuggaacg

SEQ ID NO: 3719032 - RNA, 16 nt, Salmonella enterica enterica serovar Typhi Ty2
cggccaacgcgcccuc

SEQ ID NO: 3719033 - RNA, 12 nt, Salmonella enterica enterica serovar Typhi Ty2
cggccacagcgc

SEQ ID NO: 3719034 - RNA, 14 nt, Salmonella enterica enterica serovar Typhi Ty2
cggccacagcgcca

SEQ ID NO: 3719035 - RNA, 16 nt, Salmonella enterica enterica serovar Typhi Ty2
cggccacagcgccaga

SEQ ID NO: 3719036 - RNA, 14 nt, Salmonella enterica enterica serovar Typhi Ty2
cggccaccaggccu

SEQ ID NO: 3719037 - RNA, 15 nt, Salmonella enterica enterica serovar Typhi Ty2
cggccacgcgcguca

SEQ ID NO: 3719038 - RNA, 21 nt, Salmonella enterica enterica serovar Typhi Ty2
cggccagauaaguuugcagau

SEQ ID NO: 3719039 - RNA, 21 nt, Salmonella enterica enterica serovar Typhi Ty2
cggccagauaguggcugaggc

SEQ ID NO: 3719040 - RNA, 12 nt, Salmonella enterica enterica serovar Typhi Ty2
cggccagccaua

SEQ ID NO: 3719041 - RNA, 12 nt, Salmonella enterica enterica serovar Typhi Ty2
cggccagcgcag

SEQ ID NO: 3719042 - RNA, 16 nt, Salmonella enterica enterica serovar Typhi Ty2
cggccagcgcaggcug

SEQ ID NO: 3719043 - RNA, 14 nt, Salmonella enterica enterica serovar Typhi Ty2
cggccagcgccagc

SEQ ID NO: 3719044 - RNA, 19 nt, Salmonella enterica enterica serovar Typhi Ty2
cggccagcgccagcguaga

SEQ ID NO: 3719045 - RNA, 17 nt, Salmonella enterica enterica serovar Typhi Ty2
cggccagcgucaucaga

SEQ ID NO: 3719046 - RNA, 13 nt, Salmonella enterica enterica serovar Typhi Ty2
cggccaggauggc

SEQ ID NO: 3719047 - RNA, 19 nt, Salmonella enterica enterica serovar Typhi Ty2
cggccaggauggcccgguu

SEQ ID NO: 3719048 - RNA, 22 nt, Salmonella enterica enterica serovar Typhi Ty2
cggccaggcaaagauccaccag

SEQ ID NO: 3719049 - RNA, 20 nt, Salmonella enterica enterica serovar Typhi Ty2
cggccaguucuuguaguuuu

SEQ ID NO: 3719050 - RNA, 15 nt, Salmonella enterica enterica serovar Typhi Ty2
cggccauagcgugag

SEQ ID NO: 3719051 - RNA, 19 nt, Salmonella enterica enterica serovar Typhi Ty2
cggccauagcgugagguca

SEQ ID NO: 3719052 - RNA, 22 nt, Salmonella enterica enterica serovar Typhi Ty2
cggccauggaacauccucuccu

SEQ ID NO: 3719053 - RNA, 19 nt, Salmonella enterica enterica serovar Typhi Ty2
cggccauuaacacacaauc

SEQ ID NO: 3719054 - RNA, 16 nt, Salmonella enterica enterica serovar Typhi Ty2
cggccauuaccaguac

SEQ ID NO: 3719055 - RNA, 15 nt, Salmonella enterica enterica serovar Typhi Ty2
cggcccacgcgcaga

SEQ ID NO: 3719056 - RNA, 13 nt, Salmonella enterica enterica serovar Typhi Ty2
cggcccaggcauc

SEQ ID NO: 3719057 - RNA, 16 nt, Salmonella enterica enterica serovar Typhi Ty2
cggcccaggcaucgac

SEQ ID NO: 3719058 - RNA, 13 nt, Salmonella enterica enterica serovar Typhi Ty2
cggcccccggcca

SEQ ID NO: 3719059 - RNA, 18 nt, Salmonella enterica enterica serovar Typhi Ty2
cggcccccggccauagcg

SEQ ID NO: 3719060 - RNA, 14 nt, Salmonella enterica enterica serovar Typhi Ty2
cggccccgggcgac

SEQ ID NO: 3719061 - RNA, 20 nt, Salmonella enterica enterica serovar Typhi Ty2
cggcccgaugccuggauaau

SEQ ID NO: 3719062 - RNA, 13 nt, Salmonella enterica enterica serovar Typhi Ty2
cggcccgcgcuga

SEQ ID NO: 3719063 - RNA, 22 nt, Salmonella enterica enterica serovar Typhi Ty2
cggcccuggcucaauccaggug

SEQ ID NO: 3719064 - RNA, 17 nt, Salmonella enterica enterica serovar Typhi Ty2
cggccgccaucgcaauc

SEQ ID NO: 3719065 - RNA, 17 nt, Salmonella enterica enterica serovar Typhi Ty2
cggccgcuuuucggcgc

SEQ ID NO: 3719066 - RNA, 15 nt, Salmonella enterica enterica serovar Typhi Ty2
cggccggaugccagu

SEQ ID NO: 3719067 - RNA, 17 nt, Salmonella enterica enterica serovar Typhi Ty2
cggccuacaaagccaaa

SEQ ID NO: 3719068 - RNA, 15 nt, Salmonella enterica enterica serovar Typhi Ty2
cggccuacaacucag

SEQ ID NO: 3719069 - RNA, 12 nt, Salmonella enterica enterica serovar Typhi Ty2
cggccuauagcu

SEQ ID NO: 3719070 - RNA, 16 nt, Salmonella enterica enterica serovar Typhi Ty2
cggccucgcuggucag

SEQ ID NO: 3719071 - RNA, 19 nt, Salmonella enterica enterica serovar Typhi Ty2
cggccucgcuggucagcgc

SEQ ID NO: 3719072 - RNA, 19 nt, Salmonella enterica enterica serovar Typhi Ty2
cggccugaaucagcaucuu

SEQ ID NO: 3719073 - RNA, 16 nt, Salmonella enterica enterica serovar Typhi Ty2
cggccugcaggcaacg

SEQ ID NO: 3719074 - RNA, 16 nt, Salmonella enterica enterica serovar Typhi Ty2
cggccugcgguguaga

SEQ ID NO: 3719075 - RNA, 14 nt, Salmonella enterica enterica serovar Typhi Ty2
cggccuggcccggc

SEQ ID NO: 3719076 - RNA, 14 nt, Salmonella enterica enterica serovar Typhi Ty2
cggccuggcgcagc

SEQ ID NO: 3719077 - RNA, 15 nt, Salmonella enterica enterica serovar Typhi Ty2
cggccugucgcgacc

SEQ ID NO: 3719078 - RNA, 13 nt, Salmonella enterica enterica serovar Typhi Ty2
cggccuuauuuuu

SEQ ID NO: 3719079 - RNA, 16 nt, Salmonella enterica enterica serovar Typhi Ty2
cggccuucuuccguca

SEQ ID NO: 3719080 - RNA, 16 nt, Salmonella enterica enterica serovar Typhi Ty2
cggccuugccgccagc

SEQ ID NO: 3719081 - RNA, 16 nt, Salmonella enterica enterica serovar Typhi Ty2
cggccuuuauccagcg

SEQ ID NO: 3719082 - RNA, 21 nt, Salmonella enterica enterica serovar Typhi Ty2
cggccuuuuuccgucagcaac

SEQ ID NO: 3719083 - RNA, 18 nt, Salmonella enterica enterica serovar Typhi Ty2
cggcgaaaaagccggcgg

SEQ ID NO: 3719084 - RNA, 16 nt, Salmonella enterica enterica serovar Typhi Ty2
cggcgaaaccgauuuc

SEQ ID NO: 3719085 - RNA, 17 nt, Salmonella enterica enterica serovar Typhi Ty2
cggcgaaauauuaucgc

SEQ ID NO: 3719086 - RNA, 16 nt, Salmonella enterica enterica serovar Typhi Ty2
cggcgaaaucgugcgc

SEQ ID NO: 3719087 - RNA, 20 nt, Salmonella enterica enterica serovar Typhi Ty2
cggcgaaaucgugcgcccca

SEQ ID NO: 3719088 - RNA, 18 nt, Salmonella enterica enterica serovar Typhi Ty2
cggcgaacguuggcuggg

SEQ ID NO: 3719089 - RNA, 11 nt, Salmonella enterica enterica serovar Typhi Ty2
cggcgaaucgc

SEQ ID NO: 3719090 - RNA, 17 nt, Salmonella enterica enterica serovar Typhi Ty2
cggcgaauuguggucga

SEQ ID NO: 3719091 - RNA, 16 nt, Salmonella enterica enterica serovar Typhi Ty2
cggcgacaagaauaug

SEQ ID NO: 3719092 - RNA, 16 nt, Salmonella enterica enterica serovar Typhi Ty2
cggcgacaucgccaaa

SEQ ID NO: 3719093 - RNA, 20 nt, Salmonella enterica enterica serovar Typhi Ty2
cggcgaccuucacgccgcca

SEQ ID NO: 3719094 - RNA, 15 nt, Salmonella enterica enterica serovar Typhi Ty2
cggcgacgcccgcca

SEQ ID NO: 3719095 - RNA, 18 nt, Salmonella enterica enterica serovar Typhi Ty2
cggcgacuauugcgccga

SEQ ID NO: 3719096 - RNA, 14 nt, Salmonella enterica enterica serovar Typhi Ty2
cggcgacuccagaa

SEQ ID NO: 3719097 - RNA, 15 nt, Salmonella enterica enterica serovar Typhi Ty2
cggcgacuccagaau

SEQ ID NO: 3719098 - RNA, 17 nt, Salmonella enterica enterica serovar Typhi Ty2
cggcgacugccgcagac

SEQ ID NO: 3719099 - RNA, 13 nt, Salmonella enterica enterica serovar Typhi Ty2
cggcgagcaguac

SEQ ID NO: 3719100 - RNA, 17 nt, Salmonella enterica enterica serovar Typhi Ty2
cggcgauaacccgcgca

SEQ ID NO: 3719101 - RNA, 17 nt, Salmonella enterica enterica serovar Typhi Ty2
cggcgauauagcgcuga

SEQ ID NO: 3719102 - RNA, 19 nt, Salmonella enterica enterica serovar Typhi Ty2
cggcgauggugcggcgcac

SEQ ID NO: 3719103 - RNA, 17 nt, Salmonella enterica enterica serovar Typhi Ty2
cggcgauuuccagcgcc

SEQ ID NO: 3719104 - RNA, 19 nt, Salmonella enterica enterica serovar Typhi Ty2
cggcgauuuccagcgccgc

SEQ ID NO: 3719105 - RNA, 17 nt, Salmonella enterica enterica serovar Typhi Ty2
cggcgcaaauggcugcg

SEQ ID NO: 3719106 - RNA, 19 nt, Salmonella enterica enterica serovar Typhi Ty2
cggcgcaaauggcugcgac

SEQ ID NO: 3719107 - RNA, 13 nt, Salmonella enterica enterica serovar Typhi Ty2
cggcgcagcgacc

SEQ ID NO: 3719108 - RNA, 23 nt, Salmonella enterica enterica serovar Typhi Ty2
cggcgcagcgaccuccgcgcagc

SEQ ID NO: 3719109 - RNA, 18 nt, Salmonella enterica enterica serovar Typhi Ty2
cggcgcauuuucggcagc

SEQ ID NO: 3719110 - RNA, 18 nt, Salmonella enterica enterica serovar Typhi Ty2
cggcgccaaucaccgcca

SEQ ID NO: 3719111 - RNA, 20 nt, Salmonella enterica enterica serovar Typhi Ty2
cggcgccaaucaccgccagc

SEQ ID NO: 3719112 - RNA, 21 nt, Salmonella enterica enterica serovar Typhi Ty2
cggcgccaauuaacucuuccg

SEQ ID NO: 3719113 - RNA, 15 nt, Salmonella enterica enterica serovar Typhi Ty2
cggcgccacgcgcca

SEQ ID NO: 3719114 - RNA, 13 nt, Salmonella enterica enterica serovar Typhi Ty2
cggcgccagccac

SEQ ID NO: 3719115 - RNA, 15 nt, Salmonella enterica enterica serovar Typhi Ty2
cggcgccaucaccau

SEQ ID NO: 3719116 - RNA, 15 nt, Salmonella enterica enterica serovar Typhi Ty2
cggcgccaucgccuc

SEQ ID NO: 3719117 - RNA, 17 nt, Salmonella enterica enterica serovar Typhi Ty2
cggcgcccagccugccu

SEQ ID NO: 3719118 - RNA, 22 nt, Salmonella enterica enterica serovar Typhi Ty2
cggcgcccagcuuacgcgcaga

SEQ ID NO: 3719119 - RNA, 15 nt, Salmonella enterica enterica serovar Typhi Ty2
cggcgcccauccgcc

SEQ ID NO: 3719120 - RNA, 14 nt, Salmonella enterica enterica serovar Typhi Ty2
cggcgcccggaggg

SEQ ID NO: 3719121 - RNA, 23 nt, Salmonella enterica enterica serovar Typhi Ty2
cggcgccgaucaucccgcccagc

SEQ ID NO: 3719122 - RNA, 13 nt, Salmonella enterica enterica serovar Typhi Ty2
cggcgccggcgcg

SEQ ID NO: 3719123 - RNA, 17 nt, Salmonella enterica enterica serovar Typhi Ty2
cggcgcgaaagcgccuu

SEQ ID NO: 3719124 - RNA, 17 nt, Salmonella enterica enterica serovar Typhi Ty2
cggcgcgauauccacca

SEQ ID NO: 3719125 - RNA, 17 nt, Salmonella enterica enterica serovar Typhi Ty2
cggcgcgccaaacggca

SEQ ID NO: 3719126 - RNA, 13 nt, Salmonella enterica enterica serovar Typhi Ty2
cggcgcgccgcuc

SEQ ID NO: 3719127 - RNA, 12 nt, Salmonella enterica enterica serovar Typhi Ty2
cggcgcgcgcgc

SEQ ID NO: 3719128 - RNA, 15 nt, Salmonella enterica enterica serovar Typhi Ty2
cggcgcgcgcgguuc

SEQ ID NO: 3719129 - RNA, 17 nt, Salmonella enterica enterica serovar Typhi Ty2
cggcgcgcucuuuuucu

SEQ ID NO: 3719130 - RNA, 19 nt, Salmonella enterica enterica serovar Typhi Ty2
cggcgcggauagucauaau

SEQ ID NO: 3719131 - RNA, 23 nt, Salmonella enterica enterica serovar Typhi Ty2
cggcgcgggugaugacgcgcagg

SEQ ID NO: 3719132 - RNA, 22 nt, Salmonella enterica enterica serovar Typhi Ty2
cggcgcgguauuucgccgccgc

SEQ ID NO: 3719133 - RNA, 16 nt, Salmonella enterica enterica serovar Typhi Ty2
cggcgcgguuuccggu

SEQ ID NO: 3719134 - RNA, 20 nt, Salmonella enterica enterica serovar Typhi Ty2
cggcgcgucgggcagggaug

SEQ ID NO: 3719135 - RNA, 16 nt, Salmonella enterica enterica serovar Typhi Ty2
cggcgcuaaccagcgc

SEQ ID NO: 3719136 - RNA, 16 nt, Salmonella enterica enterica serovar Typhi Ty2
cggcgcuacggcguuu

SEQ ID NO: 3719137 - RNA, 13 nt, Salmonella enterica enterica serovar Typhi Ty2
cggcgcuggcgcu

SEQ ID NO: 3719138 - RNA, 19 nt, Salmonella enterica enterica serovar Typhi Ty2
cggcgcuucgcagcgauau

SEQ ID NO: 3719139 - RNA, 23 nt, Salmonella enterica enterica serovar Typhi Ty2
cggcggaaaaaagcagcaucccg

SEQ ID NO: 3719140 - RNA, 16 nt, Salmonella enterica enterica serovar Typhi Ty2
cggcggaaaagcgccc

SEQ ID NO: 3719141 - RNA, 13 nt, Salmonella enterica enterica serovar Typhi Ty2
cggcggaaaauag

SEQ ID NO: 3719142 - RNA, 16 nt, Salmonella enterica enterica serovar Typhi Ty2
cggcggaggccagacu

SEQ ID NO: 3719143 - RNA, 18 nt, Salmonella enterica enterica serovar Typhi Ty2
cggcggcaagcuggcgaa

SEQ ID NO: 3719144 - RNA, 13 nt, Salmonella enterica enterica serovar Typhi Ty2
cggcggccaaccc

SEQ ID NO: 3719145 - RNA, 21 nt, Salmonella enterica enterica serovar Typhi Ty2
cggcggcuugccuucauccgc

SEQ ID NO: 3719146 - RNA, 14 nt, Salmonella enterica enterica serovar Typhi Ty2
cggcggucagccag

SEQ ID NO: 3719147 - RNA, 21 nt, Salmonella enterica enterica serovar Typhi Ty2
cggcggugcagguugccugau

SEQ ID NO: 3719148 - RNA, 15 nt, Salmonella enterica enterica serovar Typhi Ty2
cggcgguggccaguc

SEQ ID NO: 3719149 - RNA, 21 nt, Salmonella enterica enterica serovar Typhi Ty2
cggcgguuauccgccagcgca

SEQ ID NO: 3719150 - RNA, 20 nt, Salmonella enterica enterica serovar Typhi Ty2
cggcgguuauccuccggguc

SEQ ID NO: 3719151 - RNA, 15 nt, Salmonella enterica enterica serovar Typhi Ty2
cggcgguucaucgga

SEQ ID NO: 3719152 - RNA, 15 nt, Salmonella enterica enterica serovar Typhi Ty2
cggcguaaacgccuu

SEQ ID NO: 3719153 - RNA, 15 nt, Salmonella enterica enterica serovar Typhi Ty2
cggcguaacccagug

SEQ ID NO: 3719154 - RNA, 19 nt, Salmonella enterica enterica serovar Typhi Ty2
cggcguaagaucgcggggc

SEQ ID NO: 3719155 - RNA, 13 nt, Salmonella enterica enterica serovar Typhi Ty2
cggcguaauguug

SEQ ID NO: 3719156 - RNA, 17 nt, Salmonella enterica enterica serovar Typhi Ty2
cggcguaccgcauaccc

SEQ ID NO: 3719157 - RNA, 17 nt, Salmonella enterica enterica serovar Typhi Ty2
cggcguaccgcgcgccc

SEQ ID NO: 3719158 - RNA, 16 nt, Salmonella enterica enterica serovar Typhi Ty2
cggcguagcucgccca

SEQ ID NO: 3719159 - RNA, 21 nt, Salmonella enterica enterica serovar Typhi Ty2
cggcgucaccaccgcaggcag

SEQ ID NO: 3719160 - RNA, 22 nt, Salmonella enterica enterica serovar Typhi Ty2
cggcgucauaguuuuccagccc

SEQ ID NO: 3719161 - RNA, 15 nt, Salmonella enterica enterica serovar Typhi Ty2
cggcguccaucaccg

SEQ ID NO: 3719162 - RNA, 13 nt, Salmonella enterica enterica serovar Typhi Ty2
cggcgucgccaga

SEQ ID NO: 3719163 - RNA, 16 nt, Salmonella enterica enterica serovar Typhi Ty2
cggcgucugcgcgcug

SEQ ID NO: 3719164 - RNA, 13 nt, Salmonella enterica enterica serovar Typhi Ty2
cggcgucuggcga

SEQ ID NO: 3719165 - RNA, 23 nt, Salmonella enterica enterica serovar Typhi Ty2
cggcgucuucauccucgccauaa

SEQ ID NO: 3719166 - RNA, 12 nt, Salmonella enterica enterica serovar Typhi Ty2
cggcgugaacgu

SEQ ID NO: 3719167 - RNA, 16 nt, Salmonella enterica enterica serovar Typhi Ty2
cggcgugaauaaaaua

SEQ ID NO: 3719168 - RNA, 17 nt, Salmonella enterica enterica serovar Typhi Ty2
cggcgugaauaaaauag

SEQ ID NO: 3719169 - RNA, 14 nt, Salmonella enterica enterica serovar Typhi Ty2
cggcgugaaucccc

SEQ ID NO: 3719170 - RNA, 14 nt, Salmonella enterica enterica serovar Typhi Ty2
cggcgugcgcugca

SEQ ID NO: 3719171 - RNA, 22 nt, Salmonella enterica enterica serovar Typhi Ty2
cggcguguaaacagaugcucac

SEQ ID NO: 3719172 - RNA, 16 nt, Salmonella enterica enterica serovar Typhi Ty2
cggcgugucagggcgg

SEQ ID NO: 3719173 - RNA, 22 nt, Salmonella enterica enterica serovar Typhi Ty2
cggcguguuguaaaacgcgccc

SEQ ID NO: 3719174 - RNA, 20 nt, Salmonella enterica enterica serovar Typhi Ty2
cggcguuacccgucuggcgc

SEQ ID NO: 3719175 - RNA, 15 nt, Salmonella enterica enterica serovar Typhi Ty2
cggcguuccgcccag

SEQ ID NO: 3719176 - RNA, 13 nt, Salmonella enterica enterica serovar Typhi Ty2
cggcguugcgccc

SEQ ID NO: 3719177 - RNA, 19 nt, Salmonella enterica enterica serovar Typhi Ty2
cggcguugcgcccaggcca

SEQ ID NO: 3719178 - RNA, 16 nt, Salmonella enterica enterica serovar Typhi Ty2
cggcguuuauauaaaa

SEQ ID NO: 3719179 - RNA, 18 nt, Salmonella enterica enterica serovar Typhi Ty2
cggcguuuuuuccugcug

SEQ ID NO: 3719180 - RNA, 21 nt, Salmonella enterica enterica serovar Typhi Ty2
cggcuaaaugacgcgcgagaa

SEQ ID NO: 3719181 - RNA, 20 nt, Salmonella enterica enterica serovar Typhi Ty2
cggcuaccccggcgcggcgc

SEQ ID NO: 3719182 - RNA, 18 nt, Salmonella enterica enterica serovar Typhi Ty2
cggcuacggaguucgccg

SEQ ID NO: 3719183 - RNA, 16 nt, Salmonella enterica enterica serovar Typhi Ty2
cggcuagcgcaguuug

SEQ ID NO: 3719184 - RNA, 15 nt, Salmonella enterica enterica serovar Typhi Ty2
cggcuagucaauaaa

SEQ ID NO: 3719185 - RNA, 19 nt, Salmonella enterica enterica serovar Typhi Ty2
cggcuauuccucgaucgcc

SEQ ID NO: 3719186 - RNA, 22 nt, Salmonella enterica enterica serovar Typhi Ty2
cggcucaccagcugacgcagca

SEQ ID NO: 3719187 - RNA, 13 nt, Salmonella enterica enterica serovar Typhi Ty2
cggcucagcaauc

SEQ ID NO: 3719188 - RNA, 16 nt, Salmonella enterica enterica serovar Typhi Ty2
cggcucauccagcaac

SEQ ID NO: 3719189 - RNA, 19 nt, Salmonella enterica enterica serovar Typhi Ty2
cggcuccagguugcucagg

SEQ ID NO: 3719190 - RNA, 18 nt, Salmonella enterica enterica serovar Typhi Ty2
cggcucccauuugcgggu

SEQ ID NO: 3719191 - RNA, 20 nt, Salmonella enterica enterica serovar Typhi Ty2
cggcucgcacauaucgcaau

SEQ ID NO: 3719192 - RNA, 20 nt, Salmonella enterica enterica serovar Typhi Ty2
cggcucgcuguucgccagac

SEQ ID NO: 3719193 - RNA, 15 nt, Salmonella enterica enterica serovar Typhi Ty2
cggcugaagcugccg

SEQ ID NO: 3719194 - RNA, 17 nt, Salmonella enterica enterica serovar Typhi Ty2
cggcugaccugaacgcc

SEQ ID NO: 3719195 - RNA, 16 nt, Salmonella enterica enterica serovar Typhi Ty2
cggcugacgcccauca

SEQ ID NO: 3719196 - RNA, 15 nt, Salmonella enterica enterica serovar Typhi Ty2
cgggcaggauacggc

SEQ ID NO: 3719197 - RNA, 23 nt, Salmonella enterica enterica serovar Typhi Ty2
cgggcaggcuuccacgcacgccg

SEQ ID NO: 3719198 - RNA, 19 nt, Salmonella enterica enterica serovar Typhi Ty2
cgggcagggaauacccgcc

SEQ ID NO: 3719199 - RNA, 12 nt, Salmonella enterica enterica serovar Typhi Ty2
cgggcagggcug

SEQ ID NO: 3719200 - RNA, 19 nt, Salmonella enterica enterica serovar Typhi Ty2
cgggcaggucgucuucuug

SEQ ID NO: 3719201 - RNA, 19 nt, Salmonella enterica enterica serovar Typhi Ty2
cgggcagucuggcggcagc

SEQ ID NO: 3719202 - RNA, 14 nt, Salmonella enterica enterica serovar Typhi Ty2
cgggcauaaccucu

SEQ ID NO: 3719203 - RNA, 15 nt, Salmonella enterica enterica serovar Typhi Ty2
cgggcaucgccgcaa

SEQ ID NO: 3719204 - RNA, 16 nt, Salmonella enterica enterica serovar Typhi Ty2
cgggccagcagccagg

SEQ ID NO: 3719205 - RNA, 14 nt, Salmonella enterica enterica serovar Typhi Ty2
cgggccgcacacca

SEQ ID NO: 3719206 - RNA, 21 nt, Salmonella enterica enterica serovar Typhi Ty2
cgggccgccaucuccggcagc

SEQ ID NO: 3719207 - RNA, 16 nt, Salmonella enterica enterica serovar Typhi Ty2
cgggccgccgcagcag

SEQ ID NO: 3719208 - RNA, 21 nt, Salmonella enterica enterica serovar Typhi Ty2
cgggccgccgcagcagaugug

SEQ ID NO: 3719209 - RNA, 13 nt, Salmonella enterica enterica serovar Typhi Ty2
cgggccgcgcugc

SEQ ID NO: 3719210 - RNA, 20 nt, Salmonella enterica enterica serovar Typhi Ty2
cgggccgcgcugcgccugcu

SEQ ID NO: 3719211 - RNA, 21 nt, Salmonella enterica enterica serovar Typhi Ty2
cgggccguaaaguucccagcg

SEQ ID NO: 3719212 - RNA, 19 nt, Salmonella enterica enterica serovar Typhi Ty2
cgggccguggccaggaaua

SEQ ID NO: 3719213 - RNA, 21 nt, Salmonella enterica enterica serovar Typhi Ty2
cgggccguuaucuacggagua

SEQ ID NO: 3719214 - RNA, 23 nt, Salmonella enterica enterica serovar Typhi Ty2
cgggccuacaaaaucgcccaggc

SEQ ID NO: 3719215 - RNA, 15 nt, Salmonella enterica enterica serovar Typhi Ty2
cgggccugagcgcgc

SEQ ID NO: 3719216 - RNA, 12 nt, Salmonella enterica enterica serovar Typhi Ty2
cgggccugugcc

SEQ ID NO: 3719217 - RNA, 15 nt, Salmonella enterica enterica serovar Typhi Ty2
cgggcgaagccugac

SEQ ID NO: 3719218 - RNA, 17 nt, Salmonella enterica enterica serovar Typhi Ty2
cgggcgacacgcgcgcu

SEQ ID NO: 3719219 - RNA, 15 nt, Salmonella enterica enterica serovar Typhi Ty2
cgggcgaccacccgc

SEQ ID NO: 3719220 - RNA, 16 nt, Salmonella enterica enterica serovar Typhi Ty2
cgggcgauaaaccagc

SEQ ID NO: 3719221 - RNA, 15 nt, Salmonella enterica enterica serovar Typhi Ty2
cgggcgauaaccucu

SEQ ID NO: 3719222 - RNA, 22 nt, Salmonella enterica enterica serovar Typhi Ty2
cgggcgauuauaaggucgauau

SEQ ID NO: 3719223 - RNA, 13 nt, Salmonella enterica enterica serovar Typhi Ty2
cgggcgcugguga

SEQ ID NO: 3719224 - RNA, 14 nt, Salmonella enterica enterica serovar Typhi Ty2
cgggcggcgcagcg

SEQ ID NO: 3719225 - RNA, 12 nt, Salmonella enterica enterica serovar Typhi Ty2
cgggcggcggcu

SEQ ID NO: 3719226 - RNA, 17 nt, Salmonella enterica enterica serovar Typhi Ty2
cgggcggcugucccaga

SEQ ID NO: 3719227 - RNA, 22 nt, Salmonella enterica enterica serovar Typhi Ty2
cgggcgguauuauccgccgcaa

SEQ ID NO: 3719228 - RNA, 19 nt, Salmonella enterica enterica serovar Typhi Ty2
cgggcguauagccaggcag

SEQ ID NO: 3719229 - RNA, 22 nt, Salmonella enterica enterica serovar Typhi Ty2
cgggcgucacccgccggcagca

SEQ ID NO: 3719230 - RNA, 13 nt, Salmonella enterica enterica serovar Typhi Ty2
cgggcgucgaaau

SEQ ID NO: 3719231 - RNA, 17 nt, Salmonella enterica enterica serovar Typhi Ty2
cgggcguggagaacgcc

SEQ ID NO: 3719232 - RNA, 23 nt, Salmonella enterica enterica serovar Typhi Ty2
cgggcguuucacauuccggcgcg

SEQ ID NO: 3719233 - RNA, 17 nt, Salmonella enterica enterica serovar Typhi Ty2
cgggcguuugcgcgcgc

SEQ ID NO: 3719234 - RNA, 15 nt, Salmonella enterica enterica serovar Typhi Ty2
cgggcucacgcuggu

SEQ ID NO: 3719235 - RNA, 13 nt, Salmonella enterica enterica serovar Typhi Ty2
cgggcucggcgcu

SEQ ID NO: 3719236 - RNA, 20 nt, Salmonella enterica enterica serovar Typhi Ty2
cgggcuggccggcgcaaugu

SEQ ID NO: 3719237 - RNA, 17 nt, Salmonella enterica enterica serovar Typhi Ty2
cgggcuguuauucagca

SEQ ID NO: 3719238 - RNA, 18 nt, Salmonella enterica enterica serovar Typhi Ty2
cgggcuuuuagccgcgcc

SEQ ID NO: 3719239 - RNA, 11 nt, Salmonella enterica enterica serovar Typhi Ty2
cggggaacacu

SEQ ID NO: 3719240 - RNA, 24 nt, Salmonella enterica enterica serovar Typhi Ty2
cggggaacacucuaaaucuaccca

SEQ ID NO: 3719241 - RNA, 21 nt, Salmonella enterica enterica serovar Typhi Ty2
cggggacagauuaucagcgag

SEQ ID NO: 3719242 - RNA, 16 nt, Salmonella enterica enterica serovar Typhi Ty2
cggggauaaucagcag

SEQ ID NO: 3719243 - RNA, 21 nt, Salmonella enterica enterica serovar Typhi Ty2
cggggauuuuuuugcccggug

SEQ ID NO: 3719244 - RNA, 23 nt, Salmonella enterica enterica serovar Typhi Ty2
cggggcaucuauuuaacagagag

SEQ ID NO: 3719245 - RNA, 13 nt, Salmonella enterica enterica serovar Typhi Ty2
cggggcgcaaaau

SEQ ID NO: 3719246 - RNA, 18 nt, Salmonella enterica enterica serovar Typhi Ty2
cggggcgcaaaaucgcaa

SEQ ID NO: 3719247 - RNA, 22 nt, Salmonella enterica enterica serovar Typhi Ty2
cggggcuuuugagucgcaucca

SEQ ID NO: 3719248 - RNA, 24 nt, Salmonella enterica enterica serovar Typhi Ty2
cggggcuuuugagucgcauccagu

SEQ ID NO: 3719249 - RNA, 17 nt, Salmonella enterica enterica serovar Typhi Ty2
cgggggacgcgacgccc

SEQ ID NO: 3719250 - RNA, 16 nt, Salmonella enterica enterica serovar Typhi Ty2
cgggggcgacagcccc

SEQ ID NO: 3719251 - RNA, 17 nt, Salmonella enterica enterica serovar Typhi Ty2
cgggggcgaucagcagg

SEQ ID NO: 3719252 - RNA, 15 nt, Salmonella enterica enterica serovar Typhi Ty2
cgggguaaaauggac

SEQ ID NO: 3719253 - RNA, 17 nt, Salmonella enterica enterica serovar Typhi Ty2
cgggguaucuguuuauu

SEQ ID NO: 3719254 - RNA, 14 nt, Salmonella enterica enterica serovar Typhi Ty2
cggggugcuguucu

SEQ ID NO: 3719255 - RNA, 14 nt, Salmonella enterica enterica serovar Typhi Ty2
cgggguuugcagau

SEQ ID NO: 3719256 - RNA, 14 nt, Salmonella enterica enterica serovar Typhi Ty2
cggguaaacaaaca

SEQ ID NO: 3719257 - RNA, 21 nt, Salmonella enterica enterica serovar Typhi Ty2
cggguaaacaaacacagccau

SEQ ID NO: 3719258 - RNA, 22 nt, Salmonella enterica enterica serovar Typhi Ty2
cggguaaacucacccaggcgau

SEQ ID NO: 3719259 - RNA, 16 nt, Salmonella enterica enterica serovar Typhi Ty2
cggguaaauagacguc

SEQ ID NO: 3719260 - RNA, 17 nt, Salmonella enterica enterica serovar Typhi Ty2
cggguagaaauuccuuc

SEQ ID NO: 3719261 - RNA, 14 nt, Salmonella enterica enterica serovar Typhi Ty2
cggguagucccagg

SEQ ID NO: 3719262 - RNA, 18 nt, Salmonella enterica enterica serovar Typhi Ty2
cggguagucccaggauag

SEQ ID NO: 3719263 - RNA, 19 nt, Salmonella enterica enterica serovar Typhi Ty2
cggguauccauugccagau

SEQ ID NO: 3719264 - RNA, 13 nt, Salmonella enterica enterica serovar Typhi Ty2
cgggucaacgcca

SEQ ID NO: 3719265 - RNA, 14 nt, Salmonella enterica enterica serovar Typhi Ty2
cgggucagcggggu

SEQ ID NO: 3719266 - RNA, 13 nt, Salmonella enterica enterica serovar Typhi Ty2
cgggucagcgucu

SEQ ID NO: 3719267 - RNA, 18 nt, Salmonella enterica enterica serovar Typhi Ty2
cggguccagucgcgccgc

SEQ ID NO: 3719268 - RNA, 17 nt, Salmonella enterica enterica serovar Typhi Ty2
cggguccugaucggcgg

SEQ ID NO: 3719269 - RNA, 20 nt, Salmonella enterica enterica serovar Typhi Ty2
cgggucgcagaacaucgcga

SEQ ID NO: 3719270 - RNA, 14 nt, Salmonella enterica enterica serovar Typhi Ty2
cgggucgcgcgccg

SEQ ID NO: 3719271 - RNA, 16 nt, Salmonella enterica enterica serovar Typhi Ty2
cgggucgcgcgccgca

SEQ ID NO: 3719272 - RNA, 22 nt, Salmonella enterica enterica serovar Typhi Ty2
cgggucggacgagcgcgucagc

SEQ ID NO: 3719273 - RNA, 20 nt, Salmonella enterica enterica serovar Typhi Ty2
cgggugaauaacuucacgcu

SEQ ID NO: 3719274 - RNA, 14 nt, Salmonella enterica enterica serovar Typhi Ty2
cgggugcagcguca

SEQ ID NO: 3719275 - RNA, 21 nt, Salmonella enterica enterica serovar Typhi Ty2
cgggugcauuuucaccuggau

SEQ ID NO: 3719276 - RNA, 15 nt, Salmonella enterica enterica serovar Typhi Ty2
cggguuaaagcccug

SEQ ID NO: 3719277 - RNA, 12 nt, Salmonella enterica enterica serovar Typhi Ty2
cggguugcugau

SEQ ID NO: 3719278 - RNA, 19 nt, Salmonella enterica enterica serovar Typhi Ty2
cggucuggaugcguucaaa

SEQ ID NO: 3719279 - RNA, 15 nt, Salmonella enterica enterica serovar Typhi Ty2
cggucuggcgcauaa

SEQ ID NO: 3719280 - RNA, 17 nt, Salmonella enterica enterica serovar Typhi Ty2
cggugaauagguaugua

SEQ ID NO: 3719281 - RNA, 14 nt, Salmonella enterica enterica serovar Typhi Ty2
cggugaccugccuu

SEQ ID NO: 3719282 - RNA, 23 nt, Salmonella enterica enterica serovar Typhi Ty2
cggugauauugccgaccgccagc

SEQ ID NO: 3719283 - RNA, 14 nt, Salmonella enterica enterica serovar Typhi Ty2
cggugauauugugu

SEQ ID NO: 3719284 - RNA, 14 nt, Salmonella enterica enterica serovar Typhi Ty2
cggugaucccacca

SEQ ID NO: 3719285 - RNA, 21 nt, Salmonella enterica enterica serovar Typhi Ty2
cggugaucccaggccggcaua

SEQ ID NO: 3719286 - RNA, 23 nt, Salmonella enterica enterica serovar Typhi Ty2
cggugaugaucaauaacgccggu

SEQ ID NO: 3719287 - RNA, 17 nt, Salmonella enterica enterica serovar Typhi Ty2
cggugcagaccucugca

SEQ ID NO: 3719288 - RNA, 16 nt, Salmonella enterica enterica serovar Typhi Ty2
cggugccugccgccuc

SEQ ID NO: 3719289 - RNA, 21 nt, Salmonella enterica enterica serovar Typhi Ty2
cggugccuuguucgcagguca

SEQ ID NO: 3719290 - RNA, 19 nt, Salmonella enterica enterica serovar Typhi Ty2
cggugcggucacaggcaua

SEQ ID NO: 3719291 - RNA, 17 nt, Salmonella enterica enterica serovar Typhi Ty2
cggugcguuuaaagaga

SEQ ID NO: 3719292 - RNA, 21 nt, Salmonella enterica enterica serovar Typhi Ty2
cggugcuuucgauaaucugac

SEQ ID NO: 3719293 - RNA, 16 nt, Salmonella enterica enterica serovar Typhi Ty2
cggugcuuucuccugc

SEQ ID NO: 3719294 - RNA, 17 nt, Salmonella enterica enterica serovar Typhi Ty2
cgguggaaaccgcagaa

SEQ ID NO: 3719295 - RNA, 16 nt, Salmonella enterica enterica serovar Typhi Ty2
cgguggcgcugcgcuu

SEQ ID NO: 3719296 - RNA, 17 nt, Salmonella enterica enterica serovar Typhi Ty2
cgguggcgcugcgcuua

SEQ ID NO: 3719297 - RNA, 16 nt, Salmonella enterica enterica serovar Typhi Ty2
cgguggcgcugugcuu

SEQ ID NO: 3719298 - RNA, 15 nt, Salmonella enterica enterica serovar Typhi Ty2
cgguggcgcuuuacc

SEQ ID NO: 3719299 - RNA, 23 nt, Salmonella enterica enterica serovar Typhi Ty2
cgguggggauaucuucgauaaga

SEQ ID NO: 3719300 - RNA, 19 nt, Salmonella enterica enterica serovar Typhi Ty2
cgguggugucaauggaugu

SEQ ID NO: 3719301 - RNA, 15 nt, Salmonella enterica enterica serovar Typhi Ty2
cgguguaccccgccu

SEQ ID NO: 3719302 - RNA, 19 nt, Salmonella enterica enterica serovar Typhi Ty2
cggugucaaagcgccagau

SEQ ID NO: 3719303 - RNA, 14 nt, Salmonella enterica enterica serovar Typhi Ty2
cgguguccggcgca

SEQ ID NO: 3719304 - RNA, 16 nt, Salmonella enterica enterica serovar Typhi Ty2
cggugugaccagcgcg

SEQ ID NO: 3719305 - RNA, 18 nt, Salmonella enterica enterica serovar Typhi Ty2
cggugugaccagcgcguu

SEQ ID NO: 3719306 - RNA, 17 nt, Salmonella enterica enterica serovar Typhi Ty2
cggugugaucaccgccc

SEQ ID NO: 3719307 - RNA, 16 nt, Salmonella enterica enterica serovar Typhi Ty2
cgguguuaaccagaua

SEQ ID NO: 3719308 - RNA, 19 nt, Salmonella enterica enterica serovar Typhi Ty2
cgguuaaaaacagccagca

SEQ ID NO: 3719309 - RNA, 22 nt, Salmonella enterica enterica serovar Typhi Ty2
cgguuaacugcccguuacgcau

SEQ ID NO: 3719310 - RNA, 13 nt, Salmonella enterica enterica serovar Typhi Ty2
cgguuacuccuua

SEQ ID NO: 3719311 - RNA, 21 nt, Salmonella enterica enterica serovar Typhi Ty2
cgguuagcgaacguccagcgg

SEQ ID NO: 3719312 - RNA, 14 nt, Salmonella enterica enterica serovar Typhi Ty2
cgguuauaauaaua

SEQ ID NO: 3719313 - RNA, 21 nt, Salmonella enterica enterica serovar Typhi Ty2
cgguuauaccgccauccggca

SEQ ID NO: 3719314 - RNA, 17 nt, Salmonella enterica enterica serovar Typhi Ty2
cgguuauccuccggguc

SEQ ID NO: 3719315 - RNA, 20 nt, Salmonella enterica enterica serovar Typhi Ty2
cgguuaucgaacagcuuacc

SEQ ID NO: 3719316 - RNA, 12 nt, Salmonella enterica enterica serovar Typhi Ty2
cgguuaucggca

SEQ ID NO: 3719317 - RNA, 18 nt, Salmonella enterica enterica serovar Typhi Ty2
cgguuaucuggcgcaacc

SEQ ID NO: 3719318 - RNA, 12 nt, Salmonella enterica enterica serovar Typhi Ty2
cgguuaugcgau

SEQ ID NO: 3719319 - RNA, 13 nt, Salmonella enterica enterica serovar Typhi Ty2
cgguucaggcuua

SEQ ID NO: 3719320 - RNA, 16 nt, Salmonella enterica enterica serovar Typhi Ty2
cgguucaucuucgccu

SEQ ID NO: 3719321 - RNA, 14 nt, Salmonella enterica enterica serovar Typhi Ty2
cgguucucccggca

SEQ ID NO: 3719322 - RNA, 15 nt, Salmonella enterica enterica serovar Typhi Ty2
cgguucucugccauc

SEQ ID NO: 3719323 - RNA, 15 nt, Salmonella enterica enterica serovar Typhi Ty2
cgguucuucccacuc

SEQ ID NO: 3719324 - RNA, 22 nt, Salmonella enterica enterica serovar Typhi Ty2
cgguucuucccacuccgcccag

SEQ ID NO: 3719325 - RNA, 22 nt, Salmonella enterica enterica serovar Typhi Ty2
cgguugccuuucgccagcauga

SEQ ID NO: 3719326 - RNA, 13 nt, Salmonella enterica enterica serovar Typhi Ty2
cgguugcugauaa

SEQ ID NO: 3719327 - RNA, 15 nt, Salmonella enterica enterica serovar Typhi Ty2
cgguuggccagcaug

SEQ ID NO: 3719328 - RNA, 15 nt, Salmonella enterica enterica serovar Typhi Ty2
cgguuggcuccagua

SEQ ID NO: 3719329 - RNA, 18 nt, Salmonella enterica enterica serovar Typhi Ty2
cgguuguuuacacggcaa

SEQ ID NO: 3719330 - RNA, 15 nt, Salmonella enterica enterica serovar Typhi Ty2
cgguuuaagccgcug

SEQ ID NO: 3719331 - RNA, 11 nt, Salmonella enterica enterica serovar Typhi Ty2
cgguuuauccc

SEQ ID NO: 3719332 - RNA, 20 nt, Salmonella enterica enterica serovar Typhi Ty2
cgguuucaacuuccaccacc

SEQ ID NO: 3719333 - RNA, 21 nt, Salmonella enterica enterica serovar Typhi Ty2
cgguuucaacuuccaccaccu

SEQ ID NO: 3719334 - RNA, 21 nt, Salmonella enterica enterica serovar Typhi Ty2
cgguuucaccauuaagcaauc

SEQ ID NO: 3719335 - RNA, 14 nt, Salmonella enterica enterica serovar Typhi Ty2
cgguuuccauggca

SEQ ID NO: 3719336 - RNA, 20 nt, Salmonella enterica enterica serovar Typhi Ty2
cgguuuccggcauccagcgc

SEQ ID NO: 3719337 - RNA, 16 nt, Salmonella enterica enterica serovar Typhi Ty2
cgguuucgcggcguuc

SEQ ID NO: 3719338 - RNA, 20 nt, Salmonella enterica enterica serovar Typhi Ty2
cgguuucuaccacccagcca

SEQ ID NO: 3719339 - RNA, 20 nt, Salmonella enterica enterica serovar Typhi Ty2
cgguuugggcgcgaaacugc

SEQ ID NO: 3719340 - RNA, 19 nt, Salmonella enterica enterica serovar Typhi Ty2
cgguuuguaagugcccgga

SEQ ID NO: 3719341 - RNA, 21 nt, Salmonella enterica enterica serovar Typhi Ty2
cgguuuuacuauugccgauaa

SEQ ID NO: 3719342 - RNA, 22 nt, Salmonella enterica enterica serovar Typhi Ty2
cgguuuuauaguagcgcgcgcu

SEQ ID NO: 3719343 - RNA, 17 nt, Salmonella enterica enterica serovar Typhi Ty2
cgguuuuauccccuuca

SEQ ID NO: 3719344 - RNA, 21 nt, Salmonella enterica enterica serovar Typhi Ty2
cgguuuuauccccuucaggaa

SEQ ID NO: 3719345 - RNA, 22 nt, Salmonella enterica enterica serovar Typhi Ty2
cgguuuuauccccuucaggaau

SEQ ID NO: 3719346 - RNA, 13 nt, Salmonella enterica enterica serovar Typhi Ty2
cgguuuugcgcug

SEQ ID NO: 3719347 - RNA, 16 nt, Salmonella enterica enterica serovar Typhi Ty2
cgguuuuuauggaagg

SEQ ID NO: 3719348 - RNA, 21 nt, Salmonella enterica enterica serovar Typhi Ty2
cgguuuuuuuguggccugcuu

SEQ ID NO: 3719349 - RNA, 22 nt, Salmonella enterica enterica serovar Typhi Ty2
cgguuuuuuuguggccugcuua

SEQ ID NO: 3719350 - RNA, 16 nt, Salmonella enterica enterica serovar Typhi Ty2
cguaaaaaacaucaua

SEQ ID NO: 3719351 - RNA, 14 nt, Salmonella enterica enterica serovar Typhi Ty2
cguaaaaacccuuu

SEQ ID NO: 3719352 - RNA, 22 nt, Salmonella enterica enterica serovar Typhi Ty2
cguaaaaauuguuccuguaaag

SEQ ID NO: 3719353 - RNA, 15 nt, Salmonella enterica enterica serovar Typhi Ty2
cguaaaacaacagcg

SEQ ID NO: 3719354 - RNA, 12 nt, Salmonella enterica enterica serovar Typhi Ty2
cguaaaacugca

SEQ ID NO: 3719355 - RNA, 23 nt, Salmonella enterica enterica serovar Typhi Ty2
cguaaaacuggcuaucgccguaa

SEQ ID NO: 3719356 - RNA, 14 nt, Salmonella enterica enterica serovar Typhi Ty2
cguaaaauauacag

SEQ ID NO: 3719357 - RNA, 22 nt, Salmonella enterica enterica serovar Typhi Ty2
cguaaaauauauauuuucucaa

SEQ ID NO: 3719358 - RNA, 13 nt, Salmonella enterica enterica serovar Typhi Ty2
cguaaaaucagca

SEQ ID NO: 3719359 - RNA, 15 nt, Salmonella enterica enterica serovar Typhi Ty2
cguaaaaucagcauc

SEQ ID NO: 3719360 - RNA, 14 nt, Salmonella enterica enterica serovar Typhi Ty2
cguauaauuaagcu

SEQ ID NO: 3719361 - RNA, 16 nt, Salmonella enterica enterica serovar Typhi Ty2
cguauagcccagaauc

SEQ ID NO: 3719362 - RNA, 18 nt, Salmonella enterica enterica serovar Typhi Ty2
cguauaucgcgauaaacu

SEQ ID NO: 3719363 - RNA, 19 nt, Salmonella enterica enterica serovar Typhi Ty2
cguauauucgcgaugcuca

SEQ ID NO: 3719364 - RNA, 17 nt, Salmonella enterica enterica serovar Typhi Ty2
cguaucgcccagauggc

SEQ ID NO: 3719365 - RNA, 20 nt, Salmonella enterica enterica serovar Typhi Ty2
cguaucggugcguuuaaaga

SEQ ID NO: 3719366 - RNA, 17 nt, Salmonella enterica enterica serovar Typhi Ty2
cguaucugucccagccu

SEQ ID NO: 3719367 - RNA, 14 nt, Salmonella enterica enterica serovar Typhi Ty2
cguaugcagccagg

SEQ ID NO: 3719368 - RNA, 20 nt, Salmonella enterica enterica serovar Typhi Ty2
cguauuacaaguaauaaaau

SEQ ID NO: 3719369 - RNA, 13 nt, Salmonella enterica enterica serovar Typhi Ty2
cguauuagauaag

SEQ ID NO: 3719370 - RNA, 20 nt, Salmonella enterica enterica serovar Typhi Ty2
cguauuaucaaaucuucauu

SEQ ID NO: 3719371 - RNA, 14 nt, Salmonella enterica enterica serovar Typhi Ty2
cguauuaugccgac

SEQ ID NO: 3719372 - RNA, 19 nt, Salmonella enterica enterica serovar Typhi Ty2
cguauuccacggaauacga

SEQ ID NO: 3719373 - RNA, 12 nt, Salmonella enterica enterica serovar Typhi Ty2
cguauucccccu

SEQ ID NO: 3719374 - RNA, 12 nt, Salmonella enterica enterica serovar Typhi Ty2
cguauucgcccg

SEQ ID NO: 3719375 - RNA, 17 nt, Salmonella enterica enterica serovar Typhi Ty2
cguauucggaauaaugu

SEQ ID NO: 3719376 - RNA, 17 nt, Salmonella enterica enterica serovar Typhi Ty2
cguauuuuauuuuucaa

SEQ ID NO: 3719377 - RNA, 16 nt, Salmonella enterica enterica serovar Typhi Ty2
cgucaaaacagauucc

SEQ ID NO: 3719378 - RNA, 12 nt, Salmonella enterica enterica serovar Typhi Ty2
cgucaaaacagg

SEQ ID NO: 3719379 - RNA, 18 nt, Salmonella enterica enterica serovar Typhi Ty2
cgucaaaacuuauuuuau

SEQ ID NO: 3719380 - RNA, 15 nt, Salmonella enterica enterica serovar Typhi Ty2
cgucaaacaguucag

SEQ ID NO: 3719381 - RNA, 18 nt, Salmonella enterica enterica serovar Typhi Ty2
cgucaaacucuuccgggc

SEQ ID NO: 3719382 - RNA, 23 nt, Salmonella enterica enterica serovar Typhi Ty2
cgucaaauagagaaaauaacaau

SEQ ID NO: 3719383 - RNA, 20 nt, Salmonella enterica enterica serovar Typhi Ty2
cgucaaauucacccguuauu

SEQ ID NO: 3719384 - RNA, 14 nt, Salmonella enterica enterica serovar Typhi Ty2
cgucaacgaccaga

SEQ ID NO: 3719385 - RNA, 20 nt, Salmonella enterica enterica serovar Typhi Ty2
cgucaagaucgcgcagcagg

SEQ ID NO: 3719386 - RNA, 19 nt, Salmonella enterica enterica serovar Typhi Ty2
cgucaaguagccaguuuuc

SEQ ID NO: 3719387 - RNA, 19 nt, Salmonella enterica enterica serovar Typhi Ty2
cgucaauaaagccgcccau

SEQ ID NO: 3719388 - RNA, 22 nt, Salmonella enterica enterica serovar Typhi Ty2
cgucaaugugaauccaggccag

SEQ ID NO: 3719389 - RNA, 23 nt, Salmonella enterica enterica serovar Typhi Ty2
cgucacaaaaacacccgcagccg

SEQ ID NO: 3719390 - RNA, 12 nt, Salmonella enterica enterica serovar Typhi Ty2
cgucacagaccc

SEQ ID NO: 3719391 - RNA, 18 nt, Salmonella enterica enterica serovar Typhi Ty2
cgucaccaccgcaggcag

SEQ ID NO: 3719392 - RNA, 20 nt, Salmonella enterica enterica serovar Typhi Ty2
cgucaccaccgcaggcagcg

SEQ ID NO: 3719393 - RNA, 22 nt, Salmonella enterica enterica serovar Typhi Ty2
cgucaccacgguguaccccgcc

SEQ ID NO: 3719394 - RNA, 13 nt, Salmonella enterica enterica serovar Typhi Ty2
cgucaccagcagg

SEQ ID NO: 3719395 - RNA, 16 nt, Salmonella enterica enterica serovar Typhi Ty2
cgucacccgccggcag

SEQ ID NO: 3719396 - RNA, 17 nt, Salmonella enterica enterica serovar Typhi Ty2
cgucacccgccggcagc

SEQ ID NO: 3719397 - RNA, 21 nt, Salmonella enterica enterica serovar Typhi Ty2
cgucacccgccggcagcagcu

SEQ ID NO: 3719398 - RNA, 23 nt, Salmonella enterica enterica serovar Typhi Ty2
cgucacccgccggcagcagcuuc

SEQ ID NO: 3719399 - RNA, 20 nt, Salmonella enterica enterica serovar Typhi Ty2
cgucacccuauuuugcgccu

SEQ ID NO: 3719400 - RNA, 15 nt, Salmonella enterica enterica serovar Typhi Ty2
cgucaccgccgcgcu

SEQ ID NO: 3719401 - RNA, 13 nt, Salmonella enterica enterica serovar Typhi Ty2
cgucaccgcgcac

SEQ ID NO: 3719402 - RNA, 18 nt, Salmonella enterica enterica serovar Typhi Ty2
cgucaccgggcugcagcc

SEQ ID NO: 3719403 - RNA, 20 nt, Salmonella enterica enterica serovar Typhi Ty2
cgucaccgucuuacgauccc

SEQ ID NO: 3719404 - RNA, 19 nt, Salmonella enterica enterica serovar Typhi Ty2
cgucacgaaugucgcguca

SEQ ID NO: 3719405 - RNA, 21 nt, Salmonella enterica enterica serovar Typhi Ty2
cgucacgaaugucgcgucagg

SEQ ID NO: 3719406 - RNA, 18 nt, Salmonella enterica enterica serovar Typhi Ty2
cgucacugaaccugccuu

SEQ ID NO: 3719407 - RNA, 15 nt, Salmonella enterica enterica serovar Typhi Ty2
cgucagaaauccgcg

SEQ ID NO: 3719408 - RNA, 17 nt, Salmonella enterica enterica serovar Typhi Ty2
cgucagacggcuccagc

SEQ ID NO: 3719409 - RNA, 22 nt, Salmonella enterica enterica serovar Typhi Ty2
cgucagacggcuccagcgccag

SEQ ID NO: 3719410 - RNA, 22 nt, Salmonella enterica enterica serovar Typhi Ty2
cgucagaugcguuuucugcauu

SEQ ID NO: 3719411 - RNA, 11 nt, Salmonella enterica enterica serovar Typhi Ty2
cgucagauucu

SEQ ID NO: 3719412 - RNA, 15 nt, Salmonella enterica enterica serovar Typhi Ty2
cgucagcaacaccac

SEQ ID NO: 3719413 - RNA, 16 nt, Salmonella enterica enterica serovar Typhi Ty2
cgucagcacgccgccc

SEQ ID NO: 3719414 - RNA, 20 nt, Salmonella enterica enterica serovar Typhi Ty2
cgucagccacuucuuccagc

SEQ ID NO: 3719415 - RNA, 22 nt, Salmonella enterica enterica serovar Typhi Ty2
cgucagcccaagcugacggaua

SEQ ID NO: 3719416 - RNA, 19 nt, Salmonella enterica enterica serovar Typhi Ty2
cgucagcgcauaccggcca

SEQ ID NO: 3719417 - RNA, 13 nt, Salmonella enterica enterica serovar Typhi Ty2
cgucagcgcgucg

SEQ ID NO: 3719418 - RNA, 17 nt, Salmonella enterica enterica serovar Typhi Ty2
cgucagcgcuugccgca

SEQ ID NO: 3719419 - RNA, 17 nt, Salmonella enterica enterica serovar Typhi Ty2
cgucaggacggcgaaua

SEQ ID NO: 3719420 - RNA, 17 nt, Salmonella enterica enterica serovar Typhi Ty2
cgucaggaggccugaau

SEQ ID NO: 3719421 - RNA, 20 nt, Salmonella enterica enterica serovar Typhi Ty2
cgucaggccgccgcaaaagc

SEQ ID NO: 3719422 - RNA, 18 nt, Salmonella enterica enterica serovar Typhi Ty2
cgucaggccgccgcacag

SEQ ID NO: 3719423 - RNA, 19 nt, Salmonella enterica enterica serovar Typhi Ty2
cgucaggccgccgcacagg

SEQ ID NO: 3719424 - RNA, 20 nt, Salmonella enterica enterica serovar Typhi Ty2
cgucaggcgaaguuccgggc

SEQ ID NO: 3719425 - RNA, 22 nt, Salmonella enterica enterica serovar Typhi Ty2
cgucaggcgaaguuccgggcuc

SEQ ID NO: 3719426 - RNA, 22 nt, Salmonella enterica enterica serovar Typhi Ty2
cgucaggcuguuguucuuuucu

SEQ ID NO: 3719427 - RNA, 20 nt, Salmonella enterica enterica serovar Typhi Ty2
cgucagguuuaaucggcgug

SEQ ID NO: 3719428 - RNA, 15 nt, Salmonella enterica enterica serovar Typhi Ty2
cgucaguaaaagccc

SEQ ID NO: 3719429 - RNA, 18 nt, Salmonella enterica enterica serovar Typhi Ty2
cgucaguaaaagcccgcc

SEQ ID NO: 3719430 - RNA, 20 nt, Salmonella enterica enterica serovar Typhi Ty2
cgucaguaaacuuucagacc

SEQ ID NO: 3719431 - RNA, 22 nt, Salmonella enterica enterica serovar Typhi Ty2
cgucaguaccagcgagauaacc

SEQ ID NO: 3719432 - RNA, 15 nt, Salmonella enterica enterica serovar Typhi Ty2
cgucagucgccagaa

SEQ ID NO: 3719433 - RNA, 13 nt, Salmonella enterica enterica serovar Typhi Ty2
cgucagucgcucu

SEQ ID NO: 3719434 - RNA, 21 nt, Salmonella enterica enterica serovar Typhi Ty2
cgucagugagcccuccuccag

SEQ ID NO: 3719435 - RNA, 15 nt, Salmonella enterica enterica serovar Typhi Ty2
cgucauaacgcgcau

SEQ ID NO: 3719436 - RNA, 22 nt, Salmonella enterica enterica serovar Typhi Ty2
cgucauacccgcgcucuccggc

SEQ ID NO: 3719437 - RNA, 17 nt, Salmonella enterica enterica serovar Typhi Ty2
cgucauaucauccagcc

SEQ ID NO: 3719438 - RNA, 23 nt, Salmonella enterica enterica serovar Typhi Ty2
cgucaucaggccauuaacgccgc

SEQ ID NO: 3719439 - RNA, 12 nt, Salmonella enterica enterica serovar Typhi Ty2
cgucaucaugcu

SEQ ID NO: 3719440 - RNA, 12 nt, Salmonella enterica enterica serovar Typhi Ty2
cgucaucauugc

SEQ ID NO: 3719441 - RNA, 13 nt, Salmonella enterica enterica serovar Typhi Ty2
cgucauccugcaa

SEQ ID NO: 3719442 - RNA, 17 nt, Salmonella enterica enterica serovar Typhi Ty2
cgucguccacucuuccg

SEQ ID NO: 3719443 - RNA, 21 nt, Salmonella enterica enterica serovar Typhi Ty2
cgucgugaguggcggcgcgca

SEQ ID NO: 3719444 - RNA, 17 nt, Salmonella enterica enterica serovar Typhi Ty2
cgucgugcagcgccgcc

SEQ ID NO: 3719445 - RNA, 19 nt, Salmonella enterica enterica serovar Typhi Ty2
cgucgugcagcgccgccug

SEQ ID NO: 3719446 - RNA, 14 nt, Salmonella enterica enterica serovar Typhi Ty2
cgucgugccaguga

SEQ ID NO: 3719447 - RNA, 18 nt, Salmonella enterica enterica serovar Typhi Ty2
cgucgugcugggcgcgcc

SEQ ID NO: 3719448 - RNA, 19 nt, Salmonella enterica enterica serovar Typhi Ty2
cgucgugcugggcgcgccu

SEQ ID NO: 3719449 - RNA, 14 nt, Salmonella enterica enterica serovar Typhi Ty2
cgucguugccuuug

SEQ ID NO: 3719450 - RNA, 17 nt, Salmonella enterica enterica serovar Typhi Ty2
cgucuacgucaggaaac

SEQ ID NO: 3719451 - RNA, 13 nt, Salmonella enterica enterica serovar Typhi Ty2
cgucuauagauga

SEQ ID NO: 3719452 - RNA, 21 nt, Salmonella enterica enterica serovar Typhi Ty2
cgucucaagcuuuuugcgcca

SEQ ID NO: 3719453 - RNA, 15 nt, Salmonella enterica enterica serovar Typhi Ty2
cgucucgauacgcug

SEQ ID NO: 3719454 - RNA, 21 nt, Salmonella enterica enterica serovar Typhi Ty2
cgucucguauaucgcgauaaa

SEQ ID NO: 3719455 - RNA, 15 nt, Salmonella enterica enterica serovar Typhi Ty2
cgucucucauuuucu

SEQ ID NO: 3719456 - RNA, 18 nt, Salmonella enterica enterica serovar Typhi Ty2
cgucucuuucauggaaau

SEQ ID NO: 3719457 - RNA, 16 nt, Salmonella enterica enterica serovar Typhi Ty2
cgucugacgcuugcau

SEQ ID NO: 3719458 - RNA, 14 nt, Salmonella enterica enterica serovar Typhi Ty2
cgucugauucaggu

SEQ ID NO: 3719459 - RNA, 22 nt, Salmonella enterica enterica serovar Typhi Ty2
cgucugcacguuuugcucuucu

SEQ ID NO: 3719460 - RNA, 18 nt, Salmonella enterica enterica serovar Typhi Ty2
cgucugcugaaaugccug

SEQ ID NO: 3719461 - RNA, 16 nt, Salmonella enterica enterica serovar Typhi Ty2
cgucugguaauaggcc

SEQ ID NO: 3719462 - RNA, 20 nt, Salmonella enterica enterica serovar Typhi Ty2
cgucugguacggccaccagg

SEQ ID NO: 3719463 - RNA, 17 nt, Salmonella enterica enterica serovar Typhi Ty2
cgucuguguuuauccgg

SEQ ID NO: 3719464 - RNA, 12 nt, Salmonella enterica enterica serovar Typhi Ty2
cgucuuaaaauu

SEQ ID NO: 3719465 - RNA, 20 nt, Salmonella enterica enterica serovar Typhi Ty2
cgucuuaaugcucuccagca

SEQ ID NO: 3719466 - RNA, 16 nt, Salmonella enterica enterica serovar Typhi Ty2
cgucuuauccggccuc

SEQ ID NO: 3719467 - RNA, 17 nt, Salmonella enterica enterica serovar Typhi Ty2
cgucuuauccggccugc

SEQ ID NO: 3719468 - RNA, 19 nt, Salmonella enterica enterica serovar Typhi Ty2
cgucuucaggucauucagg

SEQ ID NO: 3719469 - RNA, 12 nt, Salmonella enterica enterica serovar Typhi Ty2
cgucuucaucag

SEQ ID NO: 3719470 - RNA, 17 nt, Salmonella enterica enterica serovar Typhi Ty2
cgucuucaucagccagc

SEQ ID NO: 3719471 - RNA, 13 nt, Salmonella enterica enterica serovar Typhi Ty2
cgucuucaucuuc

SEQ ID NO: 3719472 - RNA, 17 nt, Salmonella enterica enterica serovar Typhi Ty2
cgucuucaucuucgucu

SEQ ID NO: 3719473 - RNA, 23 nt, Salmonella enterica enterica serovar Typhi Ty2
cgucuuuauucaucaucuugucc

SEQ ID NO: 3719474 - RNA, 14 nt, Salmonella enterica enterica serovar Typhi Ty2
cgucuuuuagucac

SEQ ID NO: 3719475 - RNA, 23 nt, Salmonella enterica enterica serovar Typhi Ty2
cgugaaaauaaaauauccagcgu

SEQ ID NO: 3719476 - RNA, 18 nt, Salmonella enterica enterica serovar Typhi Ty2
cgugaaauauccuccgcc

SEQ ID NO: 3719477 - RNA, 16 nt, Salmonella enterica enterica serovar Typhi Ty2
cgugaacaaugccauu

SEQ ID NO: 3719478 - RNA, 19 nt, Salmonella enterica enterica serovar Typhi Ty2
cgugaaccagcaucccacg

SEQ ID NO: 3719479 - RNA, 18 nt, Salmonella enterica enterica serovar Typhi Ty2
cgugaagaaacggaaauc

SEQ ID NO: 3719480 - RNA, 20 nt, Salmonella enterica enterica serovar Typhi Ty2
cgugaagauuagcagagcgg

SEQ ID NO: 3719481 - RNA, 14 nt, Salmonella enterica enterica serovar Typhi Ty2
cgugaauauggaaa

SEQ ID NO: 3719482 - RNA, 19 nt, Salmonella enterica enterica serovar Typhi Ty2
cgugaaugguuucccaggu

SEQ ID NO: 3719483 - RNA, 18 nt, Salmonella enterica enterica serovar Typhi Ty2
cgugaauugcgguuuauc

SEQ ID NO: 3719484 - RNA, 19 nt, Salmonella enterica enterica serovar Typhi Ty2
cgugaauugcgguuuaucc

SEQ ID NO: 3719485 - RNA, 17 nt, Salmonella enterica enterica serovar Typhi Ty2
cgugaauuucugcugcc

SEQ ID NO: 3719486 - RNA, 20 nt, Salmonella enterica enterica serovar Typhi Ty2
cgugacaccgguuugcgccu

SEQ ID NO: 3719487 - RNA, 15 nt, Salmonella enterica enterica serovar Typhi Ty2
cgugaccaccgccau

SEQ ID NO: 3719488 - RNA, 12 nt, Salmonella enterica enterica serovar Typhi Ty2
cgugaccaucgc

SEQ ID NO: 3719489 - RNA, 15 nt, Salmonella enterica enterica serovar Typhi Ty2
cgugaccccaggcau

SEQ ID NO: 3719490 - RNA, 14 nt, Salmonella enterica enterica serovar Typhi Ty2
cgugacccgccagc

SEQ ID NO: 3719491 - RNA, 23 nt, Salmonella enterica enterica serovar Typhi Ty2
cgugacgccuuccuccaguaauu

SEQ ID NO: 3719492 - RNA, 13 nt, Salmonella enterica enterica serovar Typhi Ty2
cgugacggcggaa

SEQ ID NO: 3719493 - RNA, 16 nt, Salmonella enterica enterica serovar Typhi Ty2
cgugacuguucacauc

SEQ ID NO: 3719494 - RNA, 19 nt, Salmonella enterica enterica serovar Typhi Ty2
cgugagaaguaagcgccag

SEQ ID NO: 3719495 - RNA, 18 nt, Salmonella enterica enterica serovar Typhi Ty2
cgugagagaaaaucacgc

SEQ ID NO: 3719496 - RNA, 22 nt, Salmonella enterica enterica serovar Typhi Ty2
cgugagccgaaauccaccagcg

SEQ ID NO: 3719497 - RNA, 20 nt, Salmonella enterica enterica serovar Typhi Ty2
cgugagccuauuaucagaau

SEQ ID NO: 3719498 - RNA, 13 nt, Salmonella enterica enterica serovar Typhi Ty2
cgugagcgcaucc

SEQ ID NO: 3719499 - RNA, 14 nt, Salmonella enterica enterica serovar Typhi Ty2
cgugagcgcgccgc

SEQ ID NO: 3719500 - RNA, 17 nt, Salmonella enterica enterica serovar Typhi Ty2
cgugagcgcgucaucau

SEQ ID NO: 3719501 - RNA, 13 nt, Salmonella enterica enterica serovar Typhi Ty2
cgugagcuacagc

SEQ ID NO: 3719502 - RNA, 22 nt, Salmonella enterica enterica serovar Typhi Ty2
cgugagcugucgcucgcggcag

SEQ ID NO: 3719503 - RNA, 21 nt, Salmonella enterica enterica serovar Typhi Ty2
cgugauaaaacauuccaucgc

SEQ ID NO: 3719504 - RNA, 22 nt, Salmonella enterica enterica serovar Typhi Ty2
cgugauaaacgguucagucagc

SEQ ID NO: 3719505 - RNA, 23 nt, Salmonella enterica enterica serovar Typhi Ty2
cgugauaaacgguucagucagcg

SEQ ID NO: 3719506 - RNA, 20 nt, Salmonella enterica enterica serovar Typhi Ty2
cgugauaaagguauagugga

SEQ ID NO: 3719507 - RNA, 18 nt, Salmonella enterica enterica serovar Typhi Ty2
cgugauaaauacgcugcg

SEQ ID NO: 3719508 - RNA, 23 nt, Salmonella enterica enterica serovar Typhi Ty2
cgugauaauaguggugcgcaucc

SEQ ID NO: 3719509 - RNA, 13 nt, Salmonella enterica enterica serovar Typhi Ty2
cgugaucacuccc

SEQ ID NO: 3719510 - RNA, 14 nt, Salmonella enterica enterica serovar Typhi Ty2
cgugauugagcaga

SEQ ID NO: 3719511 - RNA, 21 nt, Salmonella enterica enterica serovar Typhi Ty2
cgugauugagcagaucagcac

SEQ ID NO: 3719512 - RNA, 19 nt, Salmonella enterica enterica serovar Typhi Ty2
cgugcaaaaucacgcggcg

SEQ ID NO: 3719513 - RNA, 15 nt, Salmonella enterica enterica serovar Typhi Ty2
cgugcaaccccuugc

SEQ ID NO: 3719514 - RNA, 18 nt, Salmonella enterica enterica serovar Typhi Ty2
cgugcaaugucaugacug

SEQ ID NO: 3719515 - RNA, 19 nt, Salmonella enterica enterica serovar Typhi Ty2
cgugcaaugucaugacugg

SEQ ID NO: 3719516 - RNA, 13 nt, Salmonella enterica enterica serovar Typhi Ty2
cgugcacgcugcg

SEQ ID NO: 3719517 - RNA, 13 nt, Salmonella enterica enterica serovar Typhi Ty2
cgugcagcgccgc

SEQ ID NO: 3719518 - RNA, 15 nt, Salmonella enterica enterica serovar Typhi Ty2
cgugcagcgccgccu

SEQ ID NO: 3719519 - RNA, 20 nt, Salmonella enterica enterica serovar Typhi Ty2
cgugcaguucuguaggccgg

SEQ ID NO: 3719520 - RNA, 17 nt, Salmonella enterica enterica serovar Typhi Ty2
cgugcaguuuugcuuca

SEQ ID NO: 3719521 - RNA, 23 nt, Salmonella enterica enterica serovar Typhi Ty2
cgugcaguuuugcuucaugcaca

SEQ ID NO: 3719522 - RNA, 20 nt, Salmonella enterica enterica serovar Typhi Ty2
cgugcaugggauacgccagc

SEQ ID NO: 3719523 - RNA, 21 nt, Salmonella enterica enterica serovar Typhi Ty2
cgugcaugggauacgccagca

SEQ ID NO: 3719524 - RNA, 15 nt, Salmonella enterica enterica serovar Typhi Ty2
cguuacccggccagc

SEQ ID NO: 3719525 - RNA, 23 nt, Salmonella enterica enterica serovar Typhi Ty2
cguuaccggcuccggcaaauucu

SEQ ID NO: 3719526 - RNA, 21 nt, Salmonella enterica enterica serovar Typhi Ty2
cguuaccggugauauugccga

SEQ ID NO: 3719527 - RNA, 22 nt, Salmonella enterica enterica serovar Typhi Ty2
cguuacgcgccacgccauugcu

SEQ ID NO: 3719528 - RNA, 20 nt, Salmonella enterica enterica serovar Typhi Ty2
cguuacuguuuuaucaggga

SEQ ID NO: 3719529 - RNA, 19 nt, Salmonella enterica enterica serovar Typhi Ty2
cguuagauauagcuuuuca

SEQ ID NO: 3719530 - RNA, 19 nt, Salmonella enterica enterica serovar Typhi Ty2
cguuagcgacggcgcgccg

SEQ ID NO: 3719531 - RNA, 23 nt, Salmonella enterica enterica serovar Typhi Ty2
cguuagcgagguucccgccgcca

SEQ ID NO: 3719532 - RNA, 12 nt, Salmonella enterica enterica serovar Typhi Ty2
cguuagcgcaaa

SEQ ID NO: 3719533 - RNA, 18 nt, Salmonella enterica enterica serovar Typhi Ty2
cguuagcgccauccggca

SEQ ID NO: 3719534 - RNA, 16 nt, Salmonella enterica enterica serovar Typhi Ty2
cguuagcggcguugcc

SEQ ID NO: 3719535 - RNA, 15 nt, Salmonella enterica enterica serovar Typhi Ty2
cguuaggccacuuca

SEQ ID NO: 3719536 - RNA, 19 nt, Salmonella enterica enterica serovar Typhi Ty2
cguuagucaacucgcacag

SEQ ID NO: 3719537 - RNA, 21 nt, Salmonella enterica enterica serovar Typhi Ty2
cguuauaaggccugccguccu

SEQ ID NO: 3719538 - RNA, 20 nt, Salmonella enterica enterica serovar Typhi Ty2
cguuaucaaaaaaaaccaga

SEQ ID NO: 3719539 - RNA, 18 nt, Salmonella enterica enterica serovar Typhi Ty2
cguuauccagcagccaca

SEQ ID NO: 3719540 - RNA, 23 nt, Salmonella enterica enterica serovar Typhi Ty2
cguuaucguagugccacaacgcc

SEQ ID NO: 3719541 - RNA, 17 nt, Salmonella enterica enterica serovar Typhi Ty2
cguuaucugaccuacag

SEQ ID NO: 3719542 - RNA, 16 nt, Salmonella enterica enterica serovar Typhi Ty2
cguuaugaaucgcgug

SEQ ID NO: 3719543 - RNA, 12 nt, Salmonella enterica enterica serovar Typhi Ty2
cguuauggaagu

SEQ ID NO: 3719544 - RNA, 14 nt, Salmonella enterica enterica serovar Typhi Ty2
cguuauucgcuggc

SEQ ID NO: 3719545 - RNA, 15 nt, Salmonella enterica enterica serovar Typhi Ty2
cguucaaugagcguc

SEQ ID NO: 3719546 - RNA, 19 nt, Salmonella enterica enterica serovar Typhi Ty2
cguucaccagccacugcgc

SEQ ID NO: 3719547 - RNA, 11 nt, Salmonella enterica enterica serovar Typhi Ty2
cguucacgccg

SEQ ID NO: 3719548 - RNA, 14 nt, Salmonella enterica enterica serovar Typhi Ty2
cguucacgccgcca

SEQ ID NO: 3719549 - RNA, 12 nt, Salmonella enterica enterica serovar Typhi Ty2
cguucagccagc

SEQ ID NO: 3719550 - RNA, 19 nt, Salmonella enterica enterica serovar Typhi Ty2
cguucagcccuuauaucau

SEQ ID NO: 3719551 - RNA, 19 nt, Salmonella enterica enterica serovar Typhi Ty2
cguucauaguuugcauaac

SEQ ID NO: 3719552 - RNA, 18 nt, Salmonella enterica enterica serovar Typhi Ty2
cguucaucaggcaauaaa

SEQ ID NO: 3719553 - RNA, 14 nt, Salmonella enterica enterica serovar Typhi Ty2
cguucauccgacca

SEQ ID NO: 3719554 - RNA, 16 nt, Salmonella enterica enterica serovar Typhi Ty2
cguucaucggcauaca

SEQ ID NO: 3719555 - RNA, 15 nt, Salmonella enterica enterica serovar Typhi Ty2
cguucauucccgcca

SEQ ID NO: 3719556 - RNA, 19 nt, Salmonella enterica enterica serovar Typhi Ty2
cguuccacgucgcacgcca

SEQ ID NO: 3719557 - RNA, 22 nt, Salmonella enterica enterica serovar Typhi Ty2
cguuccauuccagaaucuggcc

SEQ ID NO: 3719558 - RNA, 15 nt, Salmonella enterica enterica serovar Typhi Ty2
cguuccccaacagcg

SEQ ID NO: 3719559 - RNA, 20 nt, Salmonella enterica enterica serovar Typhi Ty2
cguuccgcgauuuccugugu

SEQ ID NO: 3719560 - RNA, 18 nt, Salmonella enterica enterica serovar Typhi Ty2
cguuccgguucaggcuua

SEQ ID NO: 3719561 - RNA, 14 nt, Salmonella enterica enterica serovar Typhi Ty2
cguuccguuaauug

SEQ ID NO: 3719562 - RNA, 22 nt, Salmonella enterica enterica serovar Typhi Ty2
cguucgauagcguuuuccagcu

SEQ ID NO: 3719563 - RNA, 21 nt, Salmonella enterica enterica serovar Typhi Ty2
cguucgcauauucugcgaaag

SEQ ID NO: 3719564 - RNA, 22 nt, Salmonella enterica enterica serovar Typhi Ty2
cguucgcgaauuucacgcagca

SEQ ID NO: 3719565 - RNA, 16 nt, Salmonella enterica enterica serovar Typhi Ty2
cguucgcggaacggcg

SEQ ID NO: 3719566 - RNA, 22 nt, Salmonella enterica enterica serovar Typhi Ty2
cguucgcggggguuauucagcg

SEQ ID NO: 3719567 - RNA, 20 nt, Salmonella enterica enterica serovar Typhi Ty2
cguucgcgucacaaucgcgc

SEQ ID NO: 3719568 - RNA, 22 nt, Salmonella enterica enterica serovar Typhi Ty2
cguucggaaucggacacuugca

SEQ ID NO: 3719569 - RNA, 20 nt, Salmonella enterica enterica serovar Typhi Ty2
cguucggacuggggauggcc

SEQ ID NO: 3719570 - RNA, 18 nt, Salmonella enterica enterica serovar Typhi Ty2
cguucgggguugaugguu

SEQ ID NO: 3719571 - RNA, 18 nt, Salmonella enterica enterica serovar Typhi Ty2
cguucguugauagcgacg

SEQ ID NO: 3719572 - RNA, 22 nt, Salmonella enterica enterica serovar Typhi Ty2
cguucuaucagguaucccgcca

SEQ ID NO: 3719573 - RNA, 22 nt, Salmonella enterica enterica serovar Typhi Ty2
cguucuauugucaccgggcgcu

SEQ ID NO: 3719574 - RNA, 20 nt, Salmonella enterica enterica serovar Typhi Ty2
cguucucacggucuccugaa

SEQ ID NO: 3719575 - RNA, 24 nt, Salmonella enterica enterica serovar Typhi Ty2
cguucugcauaucgccuugcugcg

SEQ ID NO: 3719576 - RNA, 17 nt, Salmonella enterica enterica serovar Typhi Ty2
cguucuggcugccguca

SEQ ID NO: 3719577 - RNA, 16 nt, Salmonella enterica enterica serovar Typhi Ty2
cguucugucgauaaac

SEQ ID NO: 3719578 - RNA, 15 nt, Salmonella enterica enterica serovar Typhi Ty2
cguucuuccagaacg

SEQ ID NO: 3719579 - RNA, 11 nt, Salmonella enterica enterica serovar Typhi Ty2
cguucuuccug

SEQ ID NO: 3719580 - RNA, 21 nt, Salmonella enterica enterica serovar Typhi Ty2
cguucuugcccgguggcgcug

SEQ ID NO: 3719581 - RNA, 17 nt, Salmonella enterica enterica serovar Typhi Ty2
cguucuuuccaguucug

SEQ ID NO: 3719582 - RNA, 22 nt, Salmonella enterica enterica serovar Typhi Ty2
cguugaccagccuaccugccgc

SEQ ID NO: 3719583 - RNA, 22 nt, Salmonella enterica enterica serovar Typhi Ty2
cguugaccgcuucgccuucgcc

SEQ ID NO: 3719584 - RNA, 14 nt, Salmonella enterica enterica serovar Typhi Ty2
cguugacgggcgac

SEQ ID NO: 3719585 - RNA, 15 nt, Salmonella enterica enterica serovar Typhi Ty2
cguugacgugagaga

SEQ ID NO: 3719586 - RNA, 19 nt, Salmonella enterica enterica serovar Typhi Ty2
cguugagaaaaccauauaa

SEQ ID NO: 3719587 - RNA, 22 nt, Salmonella enterica enterica serovar Typhi Ty2
cguugaguauugacgaaaagau

SEQ ID NO: 3719588 - RNA, 19 nt, Salmonella enterica enterica serovar Typhi Ty2
cguugaguuugacugccag

SEQ ID NO: 3719589 - RNA, 13 nt, Salmonella enterica enterica serovar Typhi Ty2
cguugauggcgua

SEQ ID NO: 3719590 - RNA, 22 nt, Salmonella enterica enterica serovar Typhi Ty2
cguugaugugcccguuccaggc

SEQ ID NO: 3719591 - RNA, 21 nt, Salmonella enterica enterica serovar Typhi Ty2
cguugauguuuuuaaaagaag

SEQ ID NO: 3719592 - RNA, 18 nt, Salmonella enterica enterica serovar Typhi Ty2
cguugauuaucacccaca

SEQ ID NO: 3719593 - RNA, 20 nt, Salmonella enterica enterica serovar Typhi Ty2
cguugccaacggcgaucagc

SEQ ID NO: 3719594 - RNA, 13 nt, Salmonella enterica enterica serovar Typhi Ty2
cguugccagcggc

SEQ ID NO: 3719595 - RNA, 17 nt, Salmonella enterica enterica serovar Typhi Ty2
cguugcccaucgcaacg

SEQ ID NO: 3719596 - RNA, 17 nt, Salmonella enterica enterica serovar Typhi Ty2
cguugccgcaggcaacg

SEQ ID NO: 3719597 - RNA, 18 nt, Salmonella enterica enterica serovar Typhi Ty2
cguugccuggccuccggc

SEQ ID NO: 3719598 - RNA, 20 nt, Salmonella enterica enterica serovar Typhi Ty2
cguugccuggccuccggcgg

SEQ ID NO: 3719599 - RNA, 17 nt, Salmonella enterica enterica serovar Typhi Ty2
cguugcgaaucagguac

SEQ ID NO: 3719600 - RNA, 23 nt, Salmonella enterica enterica serovar Typhi Ty2
cguugcgacaaccuguaggccgg

SEQ ID NO: 3719601 - RNA, 13 nt, Salmonella enterica enterica serovar Typhi Ty2
cguugcgccgcca

SEQ ID NO: 3719602 - RNA, 17 nt, Salmonella enterica enterica serovar Typhi Ty2
cguugcgccuuuccggc

SEQ ID NO: 3719603 - RNA, 14 nt, Salmonella enterica enterica serovar Typhi Ty2
cguugcggcguauc

SEQ ID NO: 3719604 - RNA, 22 nt, Salmonella enterica enterica serovar Typhi Ty2
cguugcuggacauauuccagaa

SEQ ID NO: 3719605 - RNA, 22 nt, Salmonella enterica enterica serovar Typhi Ty2
cguuuuucugaagcguaacagc

SEQ ID NO: 3719606 - RNA, 15 nt, Salmonella enterica enterica serovar Typhi Ty2
cguuuuuguuuaaaa

SEQ ID NO: 3719607 - RNA, 16 nt, Salmonella enterica enterica serovar Typhi Ty2
cuaaaaacagcgcaau

SEQ ID NO: 3719608 - RNA, 21 nt, Salmonella enterica enterica serovar Typhi Ty2
cuaaaaaccagaauuuccaga

SEQ ID NO: 3719609 - RNA, 17 nt, Salmonella enterica enterica serovar Typhi Ty2
cuaaaaaggaaagggac

SEQ ID NO: 3719610 - RNA, 16 nt, Salmonella enterica enterica serovar Typhi Ty2
cuaaaacuuuaacacu

SEQ ID NO: 3719611 - RNA, 21 nt, Salmonella enterica enterica serovar Typhi Ty2
cuaaacaauuugcccagcgcu

SEQ ID NO: 3719612 - RNA, 16 nt, Salmonella enterica enterica serovar Typhi Ty2
cuaaacagcaaaucgg

SEQ ID NO: 3719613 - RNA, 19 nt, Salmonella enterica enterica serovar Typhi Ty2
cuaaacauauaccgcaccu

SEQ ID NO: 3719614 - RNA, 21 nt, Salmonella enterica enterica serovar Typhi Ty2
cuaaaccacaugaccagcgcc

SEQ ID NO: 3719615 - RNA, 13 nt, Salmonella enterica enterica serovar Typhi Ty2
cuaaaccacggaa

SEQ ID NO: 3719616 - RNA, 20 nt, Salmonella enterica enterica serovar Typhi Ty2
cuaaaccagauguacagaau

SEQ ID NO: 3719617 - RNA, 21 nt, Salmonella enterica enterica serovar Typhi Ty2
cuaaacguucaucuucccgaa

SEQ ID NO: 3719618 - RNA, 15 nt, Salmonella enterica enterica serovar Typhi Ty2
cuaaacucaacuggg

SEQ ID NO: 3719619 - RNA, 15 nt, Salmonella enterica enterica serovar Typhi Ty2
cuaaacucaucuuua

SEQ ID NO: 3719620 - RNA, 18 nt, Salmonella enterica enterica serovar Typhi Ty2
cuaaagacgguaaucaga

SEQ ID NO: 3719621 - RNA, 21 nt, Salmonella enterica enterica serovar Typhi Ty2
cuaaagccaguuucucuucuu

SEQ ID NO: 3719622 - RNA, 22 nt, Salmonella enterica enterica serovar Typhi Ty2
cuaaagcgacuuauccggccua

SEQ ID NO: 3719623 - RNA, 17 nt, Salmonella enterica enterica serovar Typhi Ty2
cuaaaguaaaggaauaa

SEQ ID NO: 3719624 - RNA, 23 nt, Salmonella enterica enterica serovar Typhi Ty2
cuaaaucaauacaggcgaccggg

SEQ ID NO: 3719625 - RNA, 24 nt, Salmonella enterica enterica serovar Typhi Ty2
cuaaaucagugauggauuucacga

SEQ ID NO: 3719626 - RNA, 14 nt, Salmonella enterica enterica serovar Typhi Ty2
cuaaaucauaccag

SEQ ID NO: 3719627 - RNA, 15 nt, Salmonella enterica enterica serovar Typhi Ty2
cuaaaucauaccagc

SEQ ID NO: 3719628 - RNA, 19 nt, Salmonella enterica enterica serovar Typhi Ty2
cuaaaugaccgccuuuuuu

SEQ ID NO: 3719629 - RNA, 22 nt, Salmonella enterica enterica serovar Typhi Ty2
cuaaaugacgcgcgagaacugc

SEQ ID NO: 3719630 - RNA, 23 nt, Salmonella enterica enterica serovar Typhi Ty2
cuaaaugcauagccccagcgcaa

SEQ ID NO: 3719631 - RNA, 21 nt, Salmonella enterica enterica serovar Typhi Ty2
cuaaauggcauagccugauau

SEQ ID NO: 3719632 - RNA, 17 nt, Salmonella enterica enterica serovar Typhi Ty2
cuaaaugggcaggagau

SEQ ID NO: 3719633 - RNA, 22 nt, Salmonella enterica enterica serovar Typhi Ty2
cuaacagcagcagcaaaccgau

SEQ ID NO: 3719634 - RNA, 23 nt, Salmonella enterica enterica serovar Typhi Ty2
cuaacagucgcgccgugcccagc

SEQ ID NO: 3719635 - RNA, 22 nt, Salmonella enterica enterica serovar Typhi Ty2
cuaacaucauucccguaucuuc

SEQ ID NO: 3719636 - RNA, 18 nt, Salmonella enterica enterica serovar Typhi Ty2
cuaacccgcugcgccguu

SEQ ID NO: 3719637 - RNA, 20 nt, Salmonella enterica enterica serovar Typhi Ty2
cuaaccuguaucugcugaca

SEQ ID NO: 3719638 - RNA, 18 nt, Salmonella enterica enterica serovar Typhi Ty2
cuaacgaaaccggcggcg

SEQ ID NO: 3719639 - RNA, 21 nt, Salmonella enterica enterica serovar Typhi Ty2
cuaacgacccgaagugguggg

SEQ ID NO: 3719640 - RNA, 22 nt, Salmonella enterica enterica serovar Typhi Ty2
cuaacgauguaaaaccuggcac

SEQ ID NO: 3719641 - RNA, 23 nt, Salmonella enterica enterica serovar Typhi Ty2
cuaacgcaacggaaggaaauaac

SEQ ID NO: 3719642 - RNA, 19 nt, Salmonella enterica enterica serovar Typhi Ty2
cuaacgccugauccggccu

SEQ ID NO: 3719643 - RNA, 18 nt, Salmonella enterica enterica serovar Typhi Ty2
cuaacgcgaagauuaacc

SEQ ID NO: 3719644 - RNA, 19 nt, Salmonella enterica enterica serovar Typhi Ty2
cuaacgcguacccggcuua

SEQ ID NO: 3719645 - RNA, 15 nt, Salmonella enterica enterica serovar Typhi Ty2
cuaacgcucuucucc

SEQ ID NO: 3719646 - RNA, 19 nt, Salmonella enterica enterica serovar Typhi Ty2
cuaacgcuuauccggccua

SEQ ID NO: 3719647 - RNA, 15 nt, Salmonella enterica enterica serovar Typhi Ty2
cuaacgucagcgcca

SEQ ID NO: 3719648 - RNA, 17 nt, Salmonella enterica enterica serovar Typhi Ty2
cuaacucaauaacgacu

SEQ ID NO: 3719649 - RNA, 20 nt, Salmonella enterica enterica serovar Typhi Ty2
cuaacugcggcuuacccuga

SEQ ID NO: 3719650 - RNA, 12 nt, Salmonella enterica enterica serovar Typhi Ty2
cuaacuuauuga

SEQ ID NO: 3719651 - RNA, 18 nt, Salmonella enterica enterica serovar Typhi Ty2
cuaagaccagcaccaucu

SEQ ID NO: 3719652 - RNA, 13 nt, Salmonella enterica enterica serovar Typhi Ty2
cuaagaccagcau

SEQ ID NO: 3719653 - RNA, 14 nt, Salmonella enterica enterica serovar Typhi Ty2
cuaagaccagcauc

SEQ ID NO: 3719654 - RNA, 13 nt, Salmonella enterica enterica serovar Typhi Ty2
cuaagagaaaacc

SEQ ID NO: 3719655 - RNA, 17 nt, Salmonella enterica enterica serovar Typhi Ty2
cuaagcagaacggcgau

SEQ ID NO: 3719656 - RNA, 21 nt, Salmonella enterica enterica serovar Typhi Ty2
cuaagcagaacggcgauacuc

SEQ ID NO: 3719657 - RNA, 19 nt, Salmonella enterica enterica serovar Typhi Ty2
cuaagccggacgcccgucc

SEQ ID NO: 3719658 - RNA, 16 nt, Salmonella enterica enterica serovar Typhi Ty2
cuaagccggcaggcag

SEQ ID NO: 3719659 - RNA, 18 nt, Salmonella enterica enterica serovar Typhi Ty2
cuaagcgcccguagcuca

SEQ ID NO: 3719660 - RNA, 15 nt, Salmonella enterica enterica serovar Typhi Ty2
cuaaggccuuauugu

SEQ ID NO: 3719661 - RNA, 20 nt, Salmonella enterica enterica serovar Typhi Ty2
cuaagguugaaaggccuaaa

SEQ ID NO: 3719662 - RNA, 14 nt, Salmonella enterica enterica serovar Typhi Ty2
cuaaguacggcguc

SEQ ID NO: 3719663 - RNA, 18 nt, Salmonella enterica enterica serovar Typhi Ty2
cuaaguauucacgugugu

SEQ ID NO: 3719664 - RNA, 16 nt, Salmonella enterica enterica serovar Typhi Ty2
cuaauaaaauaacuau

SEQ ID NO: 3719665 - RNA, 20 nt, Salmonella enterica enterica serovar Typhi Ty2
cuaauaaaauaacuauaauu

SEQ ID NO: 3719666 - RNA, 22 nt, Salmonella enterica enterica serovar Typhi Ty2
cuaauaaauauucaucaaaaug

SEQ ID NO: 3719667 - RNA, 19 nt, Salmonella enterica enterica serovar Typhi Ty2
cuaaucaauaaguuuuuuc

SEQ ID NO: 3719668 - RNA, 18 nt, Salmonella enterica enterica serovar Typhi Ty2
cuaaucacccacuucuca

SEQ ID NO: 3719669 - RNA, 16 nt, Salmonella enterica enterica serovar Typhi Ty2
cuaauccccagcgcuc

SEQ ID NO: 3719670 - RNA, 16 nt, Salmonella enterica enterica serovar Typhi Ty2
cuaauccccauuuuuu

SEQ ID NO: 3719671 - RNA, 20 nt, Salmonella enterica enterica serovar Typhi Ty2
cuaauccccauuuuuuucag

SEQ ID NO: 3719672 - RNA, 18 nt, Salmonella enterica enterica serovar Typhi Ty2
cuaaucccccggaucacc

SEQ ID NO: 3719673 - RNA, 21 nt, Salmonella enterica enterica serovar Typhi Ty2
cuaaucccuggcgaauaaaau

SEQ ID NO: 3719674 - RNA, 22 nt, Salmonella enterica enterica serovar Typhi Ty2
cuaauccucuucucugaaaaga

SEQ ID NO: 3719675 - RNA, 23 nt, Salmonella enterica enterica serovar Typhi Ty2
cuaaucgccacgacgcugguucc

SEQ ID NO: 3719676 - RNA, 15 nt, Salmonella enterica enterica serovar Typhi Ty2
cuaaugaauuuaaua

SEQ ID NO: 3719677 - RNA, 17 nt, Salmonella enterica enterica serovar Typhi Ty2
cuaaugacauagugcaa

SEQ ID NO: 3719678 - RNA, 15 nt, Salmonella enterica enterica serovar Typhi Ty2
cuaaugagccagaug

SEQ ID NO: 3719679 - RNA, 15 nt, Salmonella enterica enterica serovar Typhi Ty2
cuaauguacgccuaa

SEQ ID NO: 3719680 - RNA, 16 nt, Salmonella enterica enterica serovar Typhi Ty2
cuaauguacgccuaaa

SEQ ID NO: 3719681 - RNA, 19 nt, Salmonella enterica enterica serovar Typhi Ty2
cuaauuaaucugucgaugc

SEQ ID NO: 3719682 - RNA, 12 nt, Salmonella enterica enterica serovar Typhi Ty2
cuaauuaucugc

SEQ ID NO: 3719683 - RNA, 12 nt, Salmonella enterica enterica serovar Typhi Ty2
cuaauuccagga

SEQ ID NO: 3719684 - RNA, 14 nt, Salmonella enterica enterica serovar Typhi Ty2
cuaauuucaauuuu

SEQ ID NO: 3719685 - RNA, 21 nt, Salmonella enterica enterica serovar Typhi Ty2
cuaauuugagucgcagcacau

SEQ ID NO: 3719686 - RNA, 19 nt, Salmonella enterica enterica serovar Typhi Ty2
cuauagauuucgcgucagg

SEQ ID NO: 3719687 - RNA, 15 nt, Salmonella enterica enterica serovar Typhi Ty2
cuauaugcaggcaua

SEQ ID NO: 3719688 - RNA, 20 nt, Salmonella enterica enterica serovar Typhi Ty2
cuauauguccuuuacugcgc

SEQ ID NO: 3719689 - RNA, 16 nt, Salmonella enterica enterica serovar Typhi Ty2
cuauauuccagccagg

SEQ ID NO: 3719690 - RNA, 17 nt, Salmonella enterica enterica serovar Typhi Ty2
cuaucaagauaaaaaga

SEQ ID NO: 3719691 - RNA, 13 nt, Salmonella enterica enterica serovar Typhi Ty2
cuaucaccgccuc

SEQ ID NO: 3719692 - RNA, 20 nt, Salmonella enterica enterica serovar Typhi Ty2
cuaucaccgccucgaccccu

SEQ ID NO: 3719693 - RNA, 23 nt, Salmonella enterica enterica serovar Typhi Ty2
cuaucagaauauccgguacacca

SEQ ID NO: 3719694 - RNA, 19 nt, Salmonella enterica enterica serovar Typhi Ty2
cuaucaguagcuuuuccgc

SEQ ID NO: 3719695 - RNA, 22 nt, Salmonella enterica enterica serovar Typhi Ty2
cuaucauacacaucauuaccau

SEQ ID NO: 3719696 - RNA, 14 nt, Salmonella enterica enterica serovar Typhi Ty2
cuauccgcgccggg

SEQ ID NO: 3719697 - RNA, 18 nt, Salmonella enterica enterica serovar Typhi Ty2
cuauccguccucuuuccc

SEQ ID NO: 3719698 - RNA, 22 nt, Salmonella enterica enterica serovar Typhi Ty2
cuauccguccucuuucccuuuu

SEQ ID NO: 3719699 - RNA, 17 nt, Salmonella enterica enterica serovar Typhi Ty2
cuauccguuuugacgac

SEQ ID NO: 3719700 - RNA, 12 nt, Salmonella enterica enterica serovar Typhi Ty2
cuauccuggccu

SEQ ID NO: 3719701 - RNA, 16 nt, Salmonella enterica enterica serovar Typhi Ty2
cuaucgccaaacuggu

SEQ ID NO: 3719702 - RNA, 12 nt, Salmonella enterica enterica serovar Typhi Ty2
cuaucgccgccc

SEQ ID NO: 3719703 - RNA, 20 nt, Salmonella enterica enterica serovar Typhi Ty2
cuaucgcgacggaccggcag

SEQ ID NO: 3719704 - RNA, 14 nt, Salmonella enterica enterica serovar Typhi Ty2
cuaucgcggauaag

SEQ ID NO: 3719705 - RNA, 11 nt, Salmonella enterica enterica serovar Typhi Ty2
cuaucgcuauc

SEQ ID NO: 3719706 - RNA, 17 nt, Salmonella enterica enterica serovar Typhi Ty2
cuaucgcuccucccuga

SEQ ID NO: 3719707 - RNA, 15 nt, Salmonella enterica enterica serovar Typhi Ty2
cuaucgcugcgcugc

SEQ ID NO: 3719708 - RNA, 13 nt, Salmonella enterica enterica serovar Typhi Ty2
cuaucgcuuuaac

SEQ ID NO: 3719709 - RNA, 12 nt, Salmonella enterica enterica serovar Typhi Ty2
cuaucggccuga

SEQ ID NO: 3719710 - RNA, 22 nt, Salmonella enterica enterica serovar Typhi Ty2
cuaucgggucugcgcgccggaa

SEQ ID NO: 3719711 - RNA, 23 nt, Salmonella enterica enterica serovar Typhi Ty2
cuaucguuauauauacuucacca

SEQ ID NO: 3719712 - RNA, 22 nt, Salmonella enterica enterica serovar Typhi Ty2
cuaucugacagccaaacugcug

SEQ ID NO: 3719713 - RNA, 16 nt, Salmonella enterica enterica serovar Typhi Ty2
cuaucuggauacgaua

SEQ ID NO: 3719714 - RNA, 19 nt, Salmonella enterica enterica serovar Typhi Ty2
cuaucuggauacgauaagc

SEQ ID NO: 3719715 - RNA, 23 nt, Salmonella enterica enterica serovar Typhi Ty2
cuaucuguauaucuuucuuaucc

SEQ ID NO: 3719716 - RNA, 20 nt, Salmonella enterica enterica serovar Typhi Ty2
cuaugaagagaaacauacug

SEQ ID NO: 3719717 - RNA, 12 nt, Salmonella enterica enterica serovar Typhi Ty2
cuaugacaaguc

SEQ ID NO: 3719718 - RNA, 13 nt, Salmonella enterica enterica serovar Typhi Ty2
cuaugauaagccu

SEQ ID NO: 3719719 - RNA, 22 nt, Salmonella enterica enterica serovar Typhi Ty2
cuaugauggccgacuggcacca

SEQ ID NO: 3719720 - RNA, 15 nt, Salmonella enterica enterica serovar Typhi Ty2
cuaugcaaaagaaaa

SEQ ID NO: 3719721 - RNA, 16 nt, Salmonella enterica enterica serovar Typhi Ty2
cuaugcaaaagaaaaa

SEQ ID NO: 3719722 - RNA, 13 nt, Salmonella enterica enterica serovar Typhi Ty2
cuaugccagaaua

SEQ ID NO: 3719723 - RNA, 21 nt, Salmonella enterica enterica serovar Typhi Ty2
cuaugcuuauccggccugcac

SEQ ID NO: 3719724 - RNA, 23 nt, Salmonella enterica enterica serovar Typhi Ty2
cuauggcggagggauuuuaaacc

SEQ ID NO: 3719725 - RNA, 12 nt, Salmonella enterica enterica serovar Typhi Ty2
cuaugguacaca

SEQ ID NO: 3719726 - RNA, 22 nt, Salmonella enterica enterica serovar Typhi Ty2
cuaugguacggcguguuuaacu

SEQ ID NO: 3719727 - RNA, 20 nt, Salmonella enterica enterica serovar Typhi Ty2
cuauguaaagaaugaaaaaa

SEQ ID NO: 3719728 - RNA, 18 nt, Salmonella enterica enterica serovar Typhi Ty2
cuauguacgccaagcugc

SEQ ID NO: 3719729 - RNA, 19 nt, Salmonella enterica enterica serovar Typhi Ty2
cuauguacgccaagcugca

SEQ ID NO: 3719730 - RNA, 17 nt, Salmonella enterica enterica serovar Typhi Ty2
cuauuaaagcacaagaa

SEQ ID NO: 3719731 - RNA, 13 nt, Salmonella enterica enterica serovar Typhi Ty2
cuauuaaucaccu

SEQ ID NO: 3719732 - RNA, 19 nt, Salmonella enterica enterica serovar Typhi Ty2
cuauuacaaaaaucaugcc

SEQ ID NO: 3719733 - RNA, 18 nt, Salmonella enterica enterica serovar Typhi Ty2
cuauuaccggcuggaagc

SEQ ID NO: 3719734 - RNA, 22 nt, Salmonella enterica enterica serovar Typhi Ty2
cuauuagcgcgggauaucgcug

SEQ ID NO: 3719735 - RNA, 19 nt, Salmonella enterica enterica serovar Typhi Ty2
cuauuaggcacuaccaccu

SEQ ID NO: 3719736 - RNA, 17 nt, Salmonella enterica enterica serovar Typhi Ty2
cuauuaguucugaggcu

SEQ ID NO: 3719737 - RNA, 13 nt, Salmonella enterica enterica serovar Typhi Ty2
cuauuaucagaau

SEQ ID NO: 3719738 - RNA, 15 nt, Salmonella enterica enterica serovar Typhi Ty2
cuauucagcaguuca

SEQ ID NO: 3719739 - RNA, 20 nt, Salmonella enterica enterica serovar Typhi Ty2
cuauucauuauuuuuaaaua

SEQ ID NO: 3719740 - RNA, 23 nt, Salmonella enterica enterica serovar Typhi Ty2
cuauuccaacuaugugggcgaua

SEQ ID NO: 3719741 - RNA, 12 nt, Salmonella enterica enterica serovar Typhi Ty2
cuauucccaggc

SEQ ID NO: 3719742 - RNA, 13 nt, Salmonella enterica enterica serovar Typhi Ty2
cuauucuucaucg

SEQ ID NO: 3719743 - RNA, 16 nt, Salmonella enterica enterica serovar Typhi Ty2
cuauugaucgccauag

SEQ ID NO: 3719744 - RNA, 15 nt, Salmonella enterica enterica serovar Typhi Ty2
cuauugccuaaauaa

SEQ ID NO: 3719745 - RNA, 17 nt, Salmonella enterica enterica serovar Typhi Ty2
cuauugccuaaauaacu

SEQ ID NO: 3719746 - RNA, 19 nt, Salmonella enterica enterica serovar Typhi Ty2
cuauuuaaaaaccgccccc

SEQ ID NO: 3719747 - RNA, 11 nt, Salmonella enterica enterica serovar Typhi Ty2
cuauuuaaccc

SEQ ID NO: 3719748 - RNA, 12 nt, Salmonella enterica enterica serovar Typhi Ty2
cuauuuaacccu

SEQ ID NO: 3719749 - RNA, 16 nt, Salmonella enterica enterica serovar Typhi Ty2
cuauuucaacccggca

SEQ ID NO: 3719750 - RNA, 22 nt, Salmonella enterica enterica serovar Typhi Ty2
cuauuucaguacagccaaaaau

SEQ ID NO: 3719751 - RNA, 14 nt, Salmonella enterica enterica serovar Typhi Ty2
cuauuuccagaaau

SEQ ID NO: 3719752 - RNA, 16 nt, Salmonella enterica enterica serovar Typhi Ty2
cuauuucuuagcgcca

SEQ ID NO: 3719753 - RNA, 19 nt, Salmonella enterica enterica serovar Typhi Ty2
cuauuuuaaauucccagcg

SEQ ID NO: 3719754 - RNA, 18 nt, Salmonella enterica enterica serovar Typhi Ty2
cuauuuuacuugccauuu

SEQ ID NO: 3719755 - RNA, 23 nt, Salmonella enterica enterica serovar Typhi Ty2
cuauuuucuacucgggccagcuc

SEQ ID NO: 3719756 - RNA, 13 nt, Salmonella enterica enterica serovar Typhi Ty2
cuauuuucucuuc

SEQ ID NO: 3719757 - RNA, 19 nt, Salmonella enterica enterica serovar Typhi Ty2
cuauuuucucuuccacaaa

SEQ ID NO: 3719758 - RNA, 11 nt, Salmonella enterica enterica serovar Typhi Ty2
cuauuuuucac

SEQ ID NO: 3719759 - RNA, 15 nt, Salmonella enterica enterica serovar Typhi Ty2
cucaaaccccagauu

SEQ ID NO: 3719760 - RNA, 18 nt, Salmonella enterica enterica serovar Typhi Ty2
cucaacauacgccgccag

SEQ ID NO: 3719761 - RNA, 13 nt, Salmonella enterica enterica serovar Typhi Ty2
cucaacaucauua

SEQ ID NO: 3719762 - RNA, 16 nt, Salmonella enterica enterica serovar Typhi Ty2
cucaacauugccggca

SEQ ID NO: 3719763 - RNA, 22 nt, Salmonella enterica enterica serovar Typhi Ty2
cucaacauugccggcaucauuc

SEQ ID NO: 3719764 - RNA, 18 nt, Salmonella enterica enterica serovar Typhi Ty2
cucaaccaguaccgggcc

SEQ ID NO: 3719765 - RNA, 15 nt, Salmonella enterica enterica serovar Typhi Ty2
cucaaccgcgcggcg

SEQ ID NO: 3719766 - RNA, 18 nt, Salmonella enterica enterica serovar Typhi Ty2
cucaaccugaggaaaaag

SEQ ID NO: 3719767 - RNA, 21 nt, Salmonella enterica enterica serovar Typhi Ty2
cucaacgcaucgcugcgcuua

SEQ ID NO: 3719768 - RNA, 15 nt, Salmonella enterica enterica serovar Typhi Ty2
cucaucacccagucg

SEQ ID NO: 3719769 - RNA, 13 nt, Salmonella enterica enterica serovar Typhi Ty2
cucaucagaccgu

SEQ ID NO: 3719770 - RNA, 15 nt, Salmonella enterica enterica serovar Typhi Ty2
cucaucagaccguga

SEQ ID NO: 3719771 - RNA, 14 nt, Salmonella enterica enterica serovar Typhi Ty2
cucaucagcgccau

SEQ ID NO: 3719772 - RNA, 23 nt, Salmonella enterica enterica serovar Typhi Ty2
cucaucagguaauacaggguuug

SEQ ID NO: 3719773 - RNA, 17 nt, Salmonella enterica enterica serovar Typhi Ty2
cucauccagcaaaauaa

SEQ ID NO: 3719774 - RNA, 13 nt, Salmonella enterica enterica serovar Typhi Ty2
cucauccagcaac

SEQ ID NO: 3719775 - RNA, 16 nt, Salmonella enterica enterica serovar Typhi Ty2
cucauccccagcauca

SEQ ID NO: 3719776 - RNA, 21 nt, Salmonella enterica enterica serovar Typhi Ty2
cucaucggcaaacauagccuc

SEQ ID NO: 3719777 - RNA, 14 nt, Salmonella enterica enterica serovar Typhi Ty2
cucaucggucgcau

SEQ ID NO: 3719778 - RNA, 17 nt, Salmonella enterica enterica serovar Typhi Ty2
cucaucggucgcaucca

SEQ ID NO: 3719779 - RNA, 20 nt, Salmonella enterica enterica serovar Typhi Ty2
cucaucggucgcauccauau

SEQ ID NO: 3719780 - RNA, 19 nt, Salmonella enterica enterica serovar Typhi Ty2
cucaucgguuaacacauau

SEQ ID NO: 3719781 - RNA, 22 nt, Salmonella enterica enterica serovar Typhi Ty2
cucaucuucggcgggaucucca

SEQ ID NO: 3719782 - RNA, 17 nt, Salmonella enterica enterica serovar Typhi Ty2
cucaucuucuuuuuccg

SEQ ID NO: 3719783 - RNA, 19 nt, Salmonella enterica enterica serovar Typhi Ty2
cucaucuucuuuuuccgga

SEQ ID NO: 3719784 - RNA, 18 nt, Salmonella enterica enterica serovar Typhi Ty2
cucaugauagggcagcag

SEQ ID NO: 3719785 - RNA, 22 nt, Salmonella enterica enterica serovar Typhi Ty2
cucaugcaagacaucuaacucu

SEQ ID NO: 3719786 - RNA, 19 nt, Salmonella enterica enterica serovar Typhi Ty2
cucaugccguagaacagca

SEQ ID NO: 3719787 - RNA, 11 nt, Salmonella enterica enterica serovar Typhi Ty2
cucaugccucg

SEQ ID NO: 3719788 - RNA, 15 nt, Salmonella enterica enterica serovar Typhi Ty2
cucauggacaaaaaa

SEQ ID NO: 3719789 - RNA, 18 nt, Salmonella enterica enterica serovar Typhi Ty2
cucauguaaaggcgugug

SEQ ID NO: 3719790 - RNA, 16 nt, Salmonella enterica enterica serovar Typhi Ty2
cucaugugcagcaucc

SEQ ID NO: 3719791 - RNA, 15 nt, Salmonella enterica enterica serovar Typhi Ty2
cucauguucaagcug

SEQ ID NO: 3719792 - RNA, 19 nt, Salmonella enterica enterica serovar Typhi Ty2
cucauuaccgaccuguacc

SEQ ID NO: 3719793 - RNA, 18 nt, Salmonella enterica enterica serovar Typhi Ty2
cucauuaugccucccguu

SEQ ID NO: 3719794 - RNA, 23 nt, Salmonella enterica enterica serovar Typhi Ty2
cucauuauuaaauuaacacccaa

SEQ ID NO: 3719795 - RNA, 16 nt, Salmonella enterica enterica serovar Typhi Ty2
cucauucagcaacugc

SEQ ID NO: 3719796 - RNA, 21 nt, Salmonella enterica enterica serovar Typhi Ty2
cucauucgggcacuccggcuc

SEQ ID NO: 3719797 - RNA, 16 nt, Salmonella enterica enterica serovar Typhi Ty2
cucauuuuauccaaca

SEQ ID NO: 3719798 - RNA, 13 nt, Salmonella enterica enterica serovar Typhi Ty2
cucauuuucuuua

SEQ ID NO: 3719799 - RNA, 23 nt, Salmonella enterica enterica serovar Typhi Ty2
cucauuuuugaguuugucaucca

SEQ ID NO: 3719800 - RNA, 13 nt, Salmonella enterica enterica serovar Typhi Ty2
cuccaauaaauau

SEQ ID NO: 3719801 - RNA, 14 nt, Salmonella enterica enterica serovar Typhi Ty2
cuccaauauuucag

SEQ ID NO: 3719802 - RNA, 13 nt, Salmonella enterica enterica serovar Typhi Ty2
cuccaccaaccag

SEQ ID NO: 3719803 - RNA, 16 nt, Salmonella enterica enterica serovar Typhi Ty2
cuccaccauaucgcag

SEQ ID NO: 3719804 - RNA, 21 nt, Salmonella enterica enterica serovar Typhi Ty2
cuccaccauaucgcagaccau

SEQ ID NO: 3719805 - RNA, 18 nt, Salmonella enterica enterica serovar Typhi Ty2
cuccaccgugucauagcc

SEQ ID NO: 3719806 - RNA, 17 nt, Salmonella enterica enterica serovar Typhi Ty2
cuccacgcccagcgccg

SEQ ID NO: 3719807 - RNA, 23 nt, Salmonella enterica enterica serovar Typhi Ty2
cuccacugucaaaaauaacaggc

SEQ ID NO: 3719808 - RNA, 22 nt, Salmonella enterica enterica serovar Typhi Ty2
cuccagaauauugacaucgccg

SEQ ID NO: 3719809 - RNA, 13 nt, Salmonella enterica enterica serovar Typhi Ty2
cuccagacaggac

SEQ ID NO: 3719810 - RNA, 14 nt, Salmonella enterica enterica serovar Typhi Ty2
cuccagaccgcugc

SEQ ID NO: 3719811 - RNA, 18 nt, Salmonella enterica enterica serovar Typhi Ty2
cuccagaccgcugcggaa

SEQ ID NO: 3719812 - RNA, 22 nt, Salmonella enterica enterica serovar Typhi Ty2
cuccagacgaugauaauacauu

SEQ ID NO: 3719813 - RNA, 20 nt, Salmonella enterica enterica serovar Typhi Ty2
cuccagcacgcgcugcgccg

SEQ ID NO: 3719814 - RNA, 21 nt, Salmonella enterica enterica serovar Typhi Ty2
cuccagcacgcgcugcgccgc

SEQ ID NO: 3719815 - RNA, 14 nt, Salmonella enterica enterica serovar Typhi Ty2
cuccagcagaccgg

SEQ ID NO: 3719816 - RNA, 20 nt, Salmonella enterica enterica serovar Typhi Ty2
cuccagcagaccggcaaaaa

SEQ ID NO: 3719817 - RNA, 19 nt, Salmonella enterica enterica serovar Typhi Ty2
cuccagcagacgcugcuuc

SEQ ID NO: 3719818 - RNA, 14 nt, Salmonella enterica enterica serovar Typhi Ty2
cuccagccauaaug

SEQ ID NO: 3719819 - RNA, 17 nt, Salmonella enterica enterica serovar Typhi Ty2
cuccagcccgccgcccu

SEQ ID NO: 3719820 - RNA, 15 nt, Salmonella enterica enterica serovar Typhi Ty2
cuccagccgcugccu

SEQ ID NO: 3719821 - RNA, 15 nt, Salmonella enterica enterica serovar Typhi Ty2
cuccagcgauaaacg

SEQ ID NO: 3719822 - RNA, 17 nt, Salmonella enterica enterica serovar Typhi Ty2
cuccagcgccagcucca

SEQ ID NO: 3719823 - RNA, 16 nt, Salmonella enterica enterica serovar Typhi Ty2
cuccagcucagggucc

SEQ ID NO: 3719824 - RNA, 12 nt, Salmonella enterica enterica serovar Typhi Ty2
cuccagcuggcu

SEQ ID NO: 3719825 - RNA, 16 nt, Salmonella enterica enterica serovar Typhi Ty2
cuccagcuggcuggca

SEQ ID NO: 3719826 - RNA, 19 nt, Salmonella enterica enterica serovar Typhi Ty2
cuccaggcgaauccccauc

SEQ ID NO: 3719827 - RNA, 16 nt, Salmonella enterica enterica serovar Typhi Ty2
cuccaggcguuuauga

SEQ ID NO: 3719828 - RNA, 17 nt, Salmonella enterica enterica serovar Typhi Ty2
cuccaggcguuuaugag

SEQ ID NO: 3719829 - RNA, 21 nt, Salmonella enterica enterica serovar Typhi Ty2
cuccagggcaacggccagcgc

SEQ ID NO: 3719830 - RNA, 22 nt, Salmonella enterica enterica serovar Typhi Ty2
cuccaguugauacaggaauaac

SEQ ID NO: 3719831 - RNA, 20 nt, Salmonella enterica enterica serovar Typhi Ty2
cuccaguuguuccagcagcu

SEQ ID NO: 3719832 - RNA, 19 nt, Salmonella enterica enterica serovar Typhi Ty2
cuccauaaauaacauuuca

SEQ ID NO: 3719833 - RNA, 23 nt, Salmonella enterica enterica serovar Typhi Ty2
cuccauaauuugaaucgccuggc

SEQ ID NO: 3719834 - RNA, 23 nt, Salmonella enterica enterica serovar Typhi Ty2
cuccaucagacguuuauacccca

SEQ ID NO: 3719835 - RNA, 20 nt, Salmonella enterica enterica serovar Typhi Ty2
cuccaucaugggcgcggcga

SEQ ID NO: 3719836 - RNA, 18 nt, Salmonella enterica enterica serovar Typhi Ty2
cuccaucgccagcacguu

SEQ ID NO: 3719837 - RNA, 13 nt, Salmonella enterica enterica serovar Typhi Ty2
cuccaucgcuuua

SEQ ID NO: 3719838 - RNA, 13 nt, Salmonella enterica enterica serovar Typhi Ty2
cuccaugcccaca

SEQ ID NO: 3719839 - RNA, 14 nt, Salmonella enterica enterica serovar Typhi Ty2
cuccaugcccacac

SEQ ID NO: 3719840 - RNA, 22 nt, Salmonella enterica enterica serovar Typhi Ty2
cuccauggucagacgcucagcc

SEQ ID NO: 3719841 - RNA, 15 nt, Salmonella enterica enterica serovar Typhi Ty2
cuccauuaaauuacu

SEQ ID NO: 3719842 - RNA, 13 nt, Salmonella enterica enterica serovar Typhi Ty2
cuccauucccagc

SEQ ID NO: 3719843 - RNA, 23 nt, Salmonella enterica enterica serovar Typhi Ty2
cucccaaacucgggaaaauagcc

SEQ ID NO: 3719844 - RNA, 15 nt, Salmonella enterica enterica serovar Typhi Ty2
cucccaaauuuuuuu

SEQ ID NO: 3719845 - RNA, 19 nt, Salmonella enterica enterica serovar Typhi Ty2
cucccaaauuuuuuuagca

SEQ ID NO: 3719846 - RNA, 11 nt, Salmonella enterica enterica serovar Typhi Ty2
cucccaacaga

SEQ ID NO: 3719847 - RNA, 14 nt, Salmonella enterica enterica serovar Typhi Ty2
cucccacucuucca

SEQ ID NO: 3719848 - RNA, 20 nt, Salmonella enterica enterica serovar Typhi Ty2
cucccacucuuccagcaccg

SEQ ID NO: 3719849 - RNA, 13 nt, Salmonella enterica enterica serovar Typhi Ty2
cucccagcugagc

SEQ ID NO: 3719850 - RNA, 14 nt, Salmonella enterica enterica serovar Typhi Ty2
cuccuucauccaga

SEQ ID NO: 3719851 - RNA, 16 nt, Salmonella enterica enterica serovar Typhi Ty2
cuccuucuucgccguc

SEQ ID NO: 3719852 - RNA, 23 nt, Salmonella enterica enterica serovar Typhi Ty2
cuccuucuucgccgucauaaaac

SEQ ID NO: 3719853 - RNA, 16 nt, Salmonella enterica enterica serovar Typhi Ty2
cuccuuguaagggagg

SEQ ID NO: 3719854 - RNA, 16 nt, Salmonella enterica enterica serovar Typhi Ty2
cucgaaacgcugcgcu

SEQ ID NO: 3719855 - RNA, 23 nt, Salmonella enterica enterica serovar Typhi Ty2
cucgaagauacggauucuugacg

SEQ ID NO: 3719856 - RNA, 16 nt, Salmonella enterica enterica serovar Typhi Ty2
cucgauaacuuucggg

SEQ ID NO: 3719857 - RNA, 22 nt, Salmonella enterica enterica serovar Typhi Ty2
cucgauaauauccgacgccugu

SEQ ID NO: 3719858 - RNA, 23 nt, Salmonella enterica enterica serovar Typhi Ty2
cucgauaucagggcuuuuuucuc

SEQ ID NO: 3719859 - RNA, 22 nt, Salmonella enterica enterica serovar Typhi Ty2
cucgauuccugacgcacagugu

SEQ ID NO: 3719860 - RNA, 23 nt, Salmonella enterica enterica serovar Typhi Ty2
cucgauuugcccuuccagcagcc

SEQ ID NO: 3719861 - RNA, 13 nt, Salmonella enterica enterica serovar Typhi Ty2
cucgcaaaacaug

SEQ ID NO: 3719862 - RNA, 14 nt, Salmonella enterica enterica serovar Typhi Ty2
cucgcaauauucau

SEQ ID NO: 3719863 - RNA, 20 nt, Salmonella enterica enterica serovar Typhi Ty2
cucgcacugauagccgccag

SEQ ID NO: 3719864 - RNA, 17 nt, Salmonella enterica enterica serovar Typhi Ty2
cucgcacuggcgagcgg

SEQ ID NO: 3719865 - RNA, 21 nt, Salmonella enterica enterica serovar Typhi Ty2
cucgcaggccaaacagcggcu

SEQ ID NO: 3719866 - RNA, 17 nt, Salmonella enterica enterica serovar Typhi Ty2
cucgcagguacgacacc

SEQ ID NO: 3719867 - RNA, 14 nt, Salmonella enterica enterica serovar Typhi Ty2
cucgcauccuccau

SEQ ID NO: 3719868 - RNA, 18 nt, Salmonella enterica enterica serovar Typhi Ty2
cucgccaauauccccagc

SEQ ID NO: 3719869 - RNA, 17 nt, Salmonella enterica enterica serovar Typhi Ty2
cucgccaaugccgcagc

SEQ ID NO: 3719870 - RNA, 20 nt, Salmonella enterica enterica serovar Typhi Ty2
cucgccacgguuggcccagc

SEQ ID NO: 3719871 - RNA, 13 nt, Salmonella enterica enterica serovar Typhi Ty2
cucgccagcccga

SEQ ID NO: 3719872 - RNA, 11 nt, Salmonella enterica enterica serovar Typhi Ty2
cucgccagcgc

SEQ ID NO: 3719873 - RNA, 13 nt, Salmonella enterica enterica serovar Typhi Ty2
cucgccauaaaga

SEQ ID NO: 3719874 - RNA, 12 nt, Salmonella enterica enterica serovar Typhi Ty2
cucgcccagcac

SEQ ID NO: 3719875 - RNA, 15 nt, Salmonella enterica enterica serovar Typhi Ty2
cucgcccgcgaugau

SEQ ID NO: 3719876 - RNA, 22 nt, Salmonella enterica enterica serovar Typhi Ty2
cucgcccuucgggccgccgcaa

SEQ ID NO: 3719877 - RNA, 14 nt, Salmonella enterica enterica serovar Typhi Ty2
cucgccgcgcucca

SEQ ID NO: 3719878 - RNA, 21 nt, Salmonella enterica enterica serovar Typhi Ty2
cucgccgguuuuuuuacucug

SEQ ID NO: 3719879 - RNA, 15 nt, Salmonella enterica enterica serovar Typhi Ty2
cucgccgucggcaga

SEQ ID NO: 3719880 - RNA, 15 nt, Salmonella enterica enterica serovar Typhi Ty2
cucgccuucggccug

SEQ ID NO: 3719881 - RNA, 15 nt, Salmonella enterica enterica serovar Typhi Ty2
cucgccuuucuccau

SEQ ID NO: 3719882 - RNA, 21 nt, Salmonella enterica enterica serovar Typhi Ty2
cucgccuuucuccauggucag

SEQ ID NO: 3719883 - RNA, 14 nt, Salmonella enterica enterica serovar Typhi Ty2
cucgcgaccagaga

SEQ ID NO: 3719884 - RNA, 16 nt, Salmonella enterica enterica serovar Typhi Ty2
cucgcgauccgccagc

SEQ ID NO: 3719885 - RNA, 19 nt, Salmonella enterica enterica serovar Typhi Ty2
cucgcgcagaaucagcgug

SEQ ID NO: 3719886 - RNA, 22 nt, Salmonella enterica enterica serovar Typhi Ty2
cucgcgcaucaggaucuucauc

SEQ ID NO: 3719887 - RNA, 12 nt, Salmonella enterica enterica serovar Typhi Ty2
cucgcgcaugac

SEQ ID NO: 3719888 - RNA, 18 nt, Salmonella enterica enterica serovar Typhi Ty2
cucgcgccacgcagauau

SEQ ID NO: 3719889 - RNA, 18 nt, Salmonella enterica enterica serovar Typhi Ty2
cucgcgguugacgcugcu

SEQ ID NO: 3719890 - RNA, 14 nt, Salmonella enterica enterica serovar Typhi Ty2
cucgcguccccagc

SEQ ID NO: 3719891 - RNA, 13 nt, Salmonella enterica enterica serovar Typhi Ty2
cucgcuaaugccc

SEQ ID NO: 3719892 - RNA, 16 nt, Salmonella enterica enterica serovar Typhi Ty2
cucgcuacgcucgccc

SEQ ID NO: 3719893 - RNA, 13 nt, Salmonella enterica enterica serovar Typhi Ty2
cucgcuacuggca

SEQ ID NO: 3719894 - RNA, 23 nt, Salmonella enterica enterica serovar Typhi Ty2
cucgcuaugaaaacgcagcccca

SEQ ID NO: 3719895 - RNA, 13 nt, Salmonella enterica enterica serovar Typhi Ty2
cucgcucccuucc

SEQ ID NO: 3719896 - RNA, 16 nt, Salmonella enterica enterica serovar Typhi Ty2
cucgcucccuuccccc

SEQ ID NO: 3719897 - RNA, 22 nt, Salmonella enterica enterica serovar Typhi Ty2
cucgcugauacgcuggcacagg

SEQ ID NO: 3719898 - RNA, 16 nt, Salmonella enterica enterica serovar Typhi Ty2
cucgcuuacgcggcgc

SEQ ID NO: 3719899 - RNA, 17 nt, Salmonella enterica enterica serovar Typhi Ty2
cucgcuuugccgccauc

SEQ ID NO: 3719900 - RNA, 14 nt, Salmonella enterica enterica serovar Typhi Ty2
cucggaugugcauu

SEQ ID NO: 3719901 - RNA, 21 nt, Salmonella enterica enterica serovar Typhi Ty2
cucggcagcaauacgcccgcc

SEQ ID NO: 3719902 - RNA, 18 nt, Salmonella enterica enterica serovar Typhi Ty2
cucggcauacaccgccag

SEQ ID NO: 3719903 - RNA, 21 nt, Salmonella enterica enterica serovar Typhi Ty2
cucggcauacaccgccagcgu

SEQ ID NO: 3719904 - RNA, 23 nt, Salmonella enterica enterica serovar Typhi Ty2
cucggcauacaccgccagcgucu

SEQ ID NO: 3719905 - RNA, 13 nt, Salmonella enterica enterica serovar Typhi Ty2
cucggcgagcagu

SEQ ID NO: 3719906 - RNA, 17 nt, Salmonella enterica enterica serovar Typhi Ty2
cucggcggucagccaca

SEQ ID NO: 3719907 - RNA, 23 nt, Salmonella enterica enterica serovar Typhi Ty2
cucgggccuguuccggcgaggac

SEQ ID NO: 3719908 - RNA, 24 nt, Salmonella enterica enterica serovar Typhi Ty2
cucguaagagaggcuuuaugcuga

SEQ ID NO: 3719909 - RNA, 22 nt, Salmonella enterica enterica serovar Typhi Ty2
cucguacacgcgcccgccgcca

SEQ ID NO: 3719910 - RNA, 23 nt, Salmonella enterica enterica serovar Typhi Ty2
cucguaucugucccagccuuccu

SEQ ID NO: 3719911 - RNA, 21 nt, Salmonella enterica enterica serovar Typhi Ty2
cucgucauagugagcgacuuc

SEQ ID NO: 3719912 - RNA, 13 nt, Salmonella enterica enterica serovar Typhi Ty2
cucgucgcgcgcc

SEQ ID NO: 3719913 - RNA, 19 nt, Salmonella enterica enterica serovar Typhi Ty2
cucgucuguuuugccuugc

SEQ ID NO: 3719914 - RNA, 17 nt, Salmonella enterica enterica serovar Typhi Ty2
cucgugaucgccaaagc

SEQ ID NO: 3719915 - RNA, 22 nt, Salmonella enterica enterica serovar Typhi Ty2
cucgugcaggccggauaagccg

SEQ ID NO: 3719916 - RNA, 14 nt, Salmonella enterica enterica serovar Typhi Ty2
cucguguaaggcuu

SEQ ID NO: 3719917 - RNA, 14 nt, Salmonella enterica enterica serovar Typhi Ty2
cucguucaacggca

SEQ ID NO: 3719918 - RNA, 18 nt, Salmonella enterica enterica serovar Typhi Ty2
cucguugccauugguuca

SEQ ID NO: 3719919 - RNA, 13 nt, Salmonella enterica enterica serovar Typhi Ty2
cucuaaaaaggaa

SEQ ID NO: 3719920 - RNA, 18 nt, Salmonella enterica enterica serovar Typhi Ty2
cucuaaaugggcaggaga

SEQ ID NO: 3719921 - RNA, 20 nt, Salmonella enterica enterica serovar Typhi Ty2
cucuaaaugggcaggagaug

SEQ ID NO: 3719922 - RNA, 22 nt, Salmonella enterica enterica serovar Typhi Ty2
cucuaacgucagcgccacccau

SEQ ID NO: 3719923 - RNA, 24 nt, Salmonella enterica enterica serovar Typhi Ty2
cucuaacgucagcgccacccauuu

SEQ ID NO: 3719924 - RNA, 18 nt, Salmonella enterica enterica serovar Typhi Ty2
cucuaauugaauauggug

SEQ ID NO: 3719925 - RNA, 19 nt, Salmonella enterica enterica serovar Typhi Ty2
cucuacgccggcgcguaau

SEQ ID NO: 3719926 - RNA, 19 nt, Salmonella enterica enterica serovar Typhi Ty2
cucuacuuuccugaaggua

SEQ ID NO: 3719927 - RNA, 16 nt, Salmonella enterica enterica serovar Typhi Ty2
cucuaggcgcugcugg

SEQ ID NO: 3719928 - RNA, 21 nt, Salmonella enterica enterica serovar Typhi Ty2
cucuauaccauaaaugaaacc

SEQ ID NO: 3719929 - RNA, 23 nt, Salmonella enterica enterica serovar Typhi Ty2
cucuauagauuucgcgucagggc

SEQ ID NO: 3719930 - RNA, 14 nt, Salmonella enterica enterica serovar Typhi Ty2
cucuaucagcgccu

SEQ ID NO: 3719931 - RNA, 15 nt, Salmonella enterica enterica serovar Typhi Ty2
cucuaucggcaaacc

SEQ ID NO: 3719932 - RNA, 22 nt, Salmonella enterica enterica serovar Typhi Ty2
cugaaaaugugguauuaaccca

SEQ ID NO: 3719933 - RNA, 21 nt, Salmonella enterica enterica serovar Typhi Ty2
cugaaagccgacccgcaucag

SEQ ID NO: 3719934 - RNA, 13 nt, Salmonella enterica enterica serovar Typhi Ty2
cugaaauaacucu

SEQ ID NO: 3719935 - RNA, 22 nt, Salmonella enterica enterica serovar Typhi Ty2
cugaaauacccgacucuuuuuu

SEQ ID NO: 3719936 - RNA, 15 nt, Salmonella enterica enterica serovar Typhi Ty2
cugaaaucacgccac

SEQ ID NO: 3719937 - RNA, 15 nt, Salmonella enterica enterica serovar Typhi Ty2
cugaaaucagccugc

SEQ ID NO: 3719938 - RNA, 19 nt, Salmonella enterica enterica serovar Typhi Ty2
cugaaauggccgucgccac

SEQ ID NO: 3719939 - RNA, 19 nt, Salmonella enterica enterica serovar Typhi Ty2
cugaaauuucuuuuccaga

SEQ ID NO: 3719940 - RNA, 23 nt, Salmonella enterica enterica serovar Typhi Ty2
cugaacauacuuucucuccuuca

SEQ ID NO: 3719941 - RNA, 15 nt, Salmonella enterica enterica serovar Typhi Ty2
cugaacauagccauc

SEQ ID NO: 3719942 - RNA, 15 nt, Salmonella enterica enterica serovar Typhi Ty2
cugaaccaacagcug

SEQ ID NO: 3719943 - RNA, 19 nt, Salmonella enterica enterica serovar Typhi Ty2
cugaaccaacagcuggguc

SEQ ID NO: 3719944 - RNA, 16 nt, Salmonella enterica enterica serovar Typhi Ty2
cugaacccugccugcc

SEQ ID NO: 3719945 - RNA, 13 nt, Salmonella enterica enterica serovar Typhi Ty2
cugaaccugccuu

SEQ ID NO: 3719946 - RNA, 14 nt, Salmonella enterica enterica serovar Typhi Ty2
cugaaccugccuuu

SEQ ID NO: 3719947 - RNA, 15 nt, Salmonella enterica enterica serovar Typhi Ty2
cugaaccugccuuug

SEQ ID NO: 3719948 - RNA, 19 nt, Salmonella enterica enterica serovar Typhi Ty2
cugaacgggugguuucccu

SEQ ID NO: 3719949 - RNA, 21 nt, Salmonella enterica enterica serovar Typhi Ty2
cugaacucaucaugauauaau

SEQ ID NO: 3719950 - RNA, 23 nt, Salmonella enterica enterica serovar Typhi Ty2
cugaacucuuccagauacggguu

SEQ ID NO: 3719951 - RNA, 21 nt, Salmonella enterica enterica serovar Typhi Ty2
cugaacuuccguaaaaagaac

SEQ ID NO: 3719952 - RNA, 21 nt, Salmonella enterica enterica serovar Typhi Ty2
cugaacuuuuugcaggagcuc

SEQ ID NO: 3719953 - RNA, 16 nt, Salmonella enterica enterica serovar Typhi Ty2
cugaagauaaaauugu

SEQ ID NO: 3719954 - RNA, 17 nt, Salmonella enterica enterica serovar Typhi Ty2
cugaagauaaacagcag

SEQ ID NO: 3719955 - RNA, 19 nt, Salmonella enterica enterica serovar Typhi Ty2
cugaagauaaacagcagcg

SEQ ID NO: 3719956 - RNA, 22 nt, Salmonella enterica enterica serovar Typhi Ty2
cugaagccagcaaucagcccau

SEQ ID NO: 3719957 - RNA, 19 nt, Salmonella enterica enterica serovar Typhi Ty2
cugaagcgcaguguuaauc

SEQ ID NO: 3719958 - RNA, 20 nt, Salmonella enterica enterica serovar Typhi Ty2
cugaagcgcgacgggaagga

SEQ ID NO: 3719959 - RNA, 14 nt, Salmonella enterica enterica serovar Typhi Ty2
cugaagcguaaaaa

SEQ ID NO: 3719960 - RNA, 20 nt, Salmonella enterica enterica serovar Typhi Ty2
cugaagcguaacagcgcuau

SEQ ID NO: 3719961 - RNA, 22 nt, Salmonella enterica enterica serovar Typhi Ty2
cugaagcugccgucccagcgga

SEQ ID NO: 3719962 - RNA, 15 nt, Salmonella enterica enterica serovar Typhi Ty2
cugaaggacaagcug

SEQ ID NO: 3719963 - RNA, 16 nt, Salmonella enterica enterica serovar Typhi Ty2
cugaaggcguaugaau

SEQ ID NO: 3719964 - RNA, 15 nt, Salmonella enterica enterica serovar Typhi Ty2
cugaagguuuuuccc

SEQ ID NO: 3719965 - RNA, 17 nt, Salmonella enterica enterica serovar Typhi Ty2
cugaaguaucgacgcag

SEQ ID NO: 3719966 - RNA, 21 nt, Salmonella enterica enterica serovar Typhi Ty2
cugaaguaucgacgcagacaa

SEQ ID NO: 3719967 - RNA, 15 nt, Salmonella enterica enterica serovar Typhi Ty2
cugaauaaauugaau

SEQ ID NO: 3719968 - RNA, 18 nt, Salmonella enterica enterica serovar Typhi Ty2
cugaauaacccgcagccc

SEQ ID NO: 3719969 - RNA, 22 nt, Salmonella enterica enterica serovar Typhi Ty2
cugaauaaucggcgucauuuuc

SEQ ID NO: 3719970 - RNA, 19 nt, Salmonella enterica enterica serovar Typhi Ty2
cugaauaccuugauaacug

SEQ ID NO: 3719971 - RNA, 13 nt, Salmonella enterica enterica serovar Typhi Ty2
cugaauagccagc

SEQ ID NO: 3719972 - RNA, 15 nt, Salmonella enterica enterica serovar Typhi Ty2
cugaauagccagccc

SEQ ID NO: 3719973 - RNA, 14 nt, Salmonella enterica enterica serovar Typhi Ty2
cugaauagcgcugc

SEQ ID NO: 3719974 - RNA, 17 nt, Salmonella enterica enterica serovar Typhi Ty2
cugaauagcuuucaccg

SEQ ID NO: 3719975 - RNA, 16 nt, Salmonella enterica enterica serovar Typhi Ty2
cugaauagucggcugc

SEQ ID NO: 3719976 - RNA, 17 nt, Salmonella enterica enterica serovar Typhi Ty2
cugaauaucgucaguau

SEQ ID NO: 3719977 - RNA, 13 nt, Salmonella enterica enterica serovar Typhi Ty2
cugaauaucuucg

SEQ ID NO: 3719978 - RNA, 24 nt, Salmonella enterica enterica serovar Typhi Ty2
cugaauauuagaguggccgcgcaa

SEQ ID NO: 3719979 - RNA, 23 nt, Salmonella enterica enterica serovar Typhi Ty2
cugaaucagauacggcuccagca

SEQ ID NO: 3719980 - RNA, 14 nt, Salmonella enterica enterica serovar Typhi Ty2
cugaaucaguaucc

SEQ ID NO: 3719981 - RNA, 22 nt, Salmonella enterica enterica serovar Typhi Ty2
cugaaucagugcaucuucacug

SEQ ID NO: 3719982 - RNA, 21 nt, Salmonella enterica enterica serovar Typhi Ty2
cugaaucucuucccagcgcac

SEQ ID NO: 3719983 - RNA, 19 nt, Salmonella enterica enterica serovar Typhi Ty2
cugaaucugcggcugcgug

SEQ ID NO: 3719984 - RNA, 20 nt, Salmonella enterica enterica serovar Typhi Ty2
cugaaucuugcgcagcauau

SEQ ID NO: 3719985 - RNA, 21 nt, Salmonella enterica enterica serovar Typhi Ty2
cugaaugccuuuuacaauaac

SEQ ID NO: 3719986 - RNA, 14 nt, Salmonella enterica enterica serovar Typhi Ty2
cugaaugcucucau

SEQ ID NO: 3719987 - RNA, 22 nt, Salmonella enterica enterica serovar Typhi Ty2
cugaaugcugacgcguuuuuuc

SEQ ID NO: 3719988 - RNA, 12 nt, Salmonella enterica enterica serovar Typhi Ty2
cugaaugguucc

SEQ ID NO: 3719989 - RNA, 21 nt, Salmonella enterica enterica serovar Typhi Ty2
cugaauuuaauggucuuaaau

SEQ ID NO: 3719990 - RNA, 22 nt, Salmonella enterica enterica serovar Typhi Ty2
cugacaacacauccgcagcgaa

SEQ ID NO: 3719991 - RNA, 21 nt, Salmonella enterica enterica serovar Typhi Ty2
cugacagaaauagccgguaac

SEQ ID NO: 3719992 - RNA, 21 nt, Salmonella enterica enterica serovar Typhi Ty2
cugacagaauauaggagagcg

SEQ ID NO: 3719993 - RNA, 20 nt, Salmonella enterica enterica serovar Typhi Ty2
cugacagagcucgucaaaaa

SEQ ID NO: 3719994 - RNA, 23 nt, Salmonella enterica enterica serovar Typhi Ty2
cugacagagcucgucaaaaauca

SEQ ID NO: 3719995 - RNA, 16 nt, Salmonella enterica enterica serovar Typhi Ty2
cugacagccaaacugc

SEQ ID NO: 3719996 - RNA, 17 nt, Salmonella enterica enterica serovar Typhi Ty2
cugacagccaaacugcu

SEQ ID NO: 3719997 - RNA, 18 nt, Salmonella enterica enterica serovar Typhi Ty2
cugacagggucgcaauac

SEQ ID NO: 3719998 - RNA, 15 nt, Salmonella enterica enterica serovar Typhi Ty2
cugacagugacggca

SEQ ID NO: 3719999 - RNA, 16 nt, Salmonella enterica enterica serovar Typhi Ty2
cugacauaaucaugaa

SEQ ID NO: 3720000 - RNA, 20 nt, Salmonella enterica enterica serovar Typhi Ty2
cugacauaaucaugaacguu

SEQ ID NO: 3720001 - RNA, 14 nt, Salmonella enterica enterica serovar Typhi Ty2
cugacauccaucau

SEQ ID NO: 3720002 - RNA, 17 nt, Salmonella enterica enterica serovar Typhi Ty2
cugacaucucuuuuaau

SEQ ID NO: 3720003 - RNA, 15 nt, Salmonella enterica enterica serovar Typhi Ty2
cugacauucagcgcu

SEQ ID NO: 3720004 - RNA, 17 nt, Salmonella enterica enterica serovar Typhi Ty2
cugacauucagcgcuua

SEQ ID NO: 3720005 - RNA, 21 nt, Salmonella enterica enterica serovar Typhi Ty2
cugacauuugcaucaaacuuc

SEQ ID NO: 3720006 - RNA, 18 nt, Salmonella enterica enterica serovar Typhi Ty2
cugaccauugauuuccgc

SEQ ID NO: 3720007 - RNA, 21 nt, Salmonella enterica enterica serovar Typhi Ty2
cugaccauugauuuccgcgca

SEQ ID NO: 3720008 - RNA, 14 nt, Salmonella enterica enterica serovar Typhi Ty2
cugaccgagaucag

SEQ ID NO: 3720009 - RNA, 20 nt, Salmonella enterica enterica serovar Typhi Ty2
cugaccgcgaucgcuggacg

SEQ ID NO: 3720010 - RNA, 13 nt, Salmonella enterica enterica serovar Typhi Ty2
cugaccgcuccag

SEQ ID NO: 3720011 - RNA, 17 nt, Salmonella enterica enterica serovar Typhi Ty2
cugaccuuaauccagca

SEQ ID NO: 3720012 - RNA, 18 nt, Salmonella enterica enterica serovar Typhi Ty2
cugaccuuuuucauccuc

SEQ ID NO: 3720013 - RNA, 20 nt, Salmonella enterica enterica serovar Typhi Ty2
cugaucgugauaggccagac

SEQ ID NO: 3720014 - RNA, 14 nt, Salmonella enterica enterica serovar Typhi Ty2
cugaucgugcccac

SEQ ID NO: 3720015 - RNA, 17 nt, Salmonella enterica enterica serovar Typhi Ty2
cugaucguuuuugucca

SEQ ID NO: 3720016 - RNA, 22 nt, Salmonella enterica enterica serovar Typhi Ty2
cugaucuggcugcguaaaauca

SEQ ID NO: 3720017 - RNA, 17 nt, Salmonella enterica enterica serovar Typhi Ty2
cugaugaccgccgucau

SEQ ID NO: 3720018 - RNA, 16 nt, Salmonella enterica enterica serovar Typhi Ty2
cugaugacgcgccgga

SEQ ID NO: 3720019 - RNA, 18 nt, Salmonella enterica enterica serovar Typhi Ty2
cugaugacgcgccggaug

SEQ ID NO: 3720020 - RNA, 18 nt, Salmonella enterica enterica serovar Typhi Ty2
cugaugacgcugcgcuua

SEQ ID NO: 3720021 - RNA, 17 nt, Salmonella enterica enterica serovar Typhi Ty2
cugaugagcaggccagg

SEQ ID NO: 3720022 - RNA, 18 nt, Salmonella enterica enterica serovar Typhi Ty2
cugaugauuggccuccac

SEQ ID NO: 3720023 - RNA, 13 nt, Salmonella enterica enterica serovar Typhi Ty2
cugaugcaggcaa

SEQ ID NO: 3720024 - RNA, 17 nt, Salmonella enterica enterica serovar Typhi Ty2
cugaugcguauccagcg

SEQ ID NO: 3720025 - RNA, 19 nt, Salmonella enterica enterica serovar Typhi Ty2
cugaugcguuguaccguuu

SEQ ID NO: 3720026 - RNA, 22 nt, Salmonella enterica enterica serovar Typhi Ty2
cugaugcguuguaccguuuucc

SEQ ID NO: 3720027 - RNA, 19 nt, Salmonella enterica enterica serovar Typhi Ty2
cugaugcuggcagaaggca

SEQ ID NO: 3720028 - RNA, 18 nt, Salmonella enterica enterica serovar Typhi Ty2
cugauggcgcuacgcuua

SEQ ID NO: 3720029 - RNA, 18 nt, Salmonella enterica enterica serovar Typhi Ty2
cugauggcgcugcgcuua

SEQ ID NO: 3720030 - RNA, 23 nt, Salmonella enterica enterica serovar Typhi Ty2
cugauggcgcugcgcuuaucagg

SEQ ID NO: 3720031 - RNA, 21 nt, Salmonella enterica enterica serovar Typhi Ty2
cugauggcguggcgcaguaaa

SEQ ID NO: 3720032 - RNA, 17 nt, Salmonella enterica enterica serovar Typhi Ty2
cugauggcuuugcuguc

SEQ ID NO: 3720033 - RNA, 17 nt, Salmonella enterica enterica serovar Typhi Ty2
cugauguaccugcguua

SEQ ID NO: 3720034 - RNA, 16 nt, Salmonella enterica enterica serovar Typhi Ty2
cugauguccgcagccg

SEQ ID NO: 3720035 - RNA, 14 nt, Salmonella enterica enterica serovar Typhi Ty2
cugauguuccggca

SEQ ID NO: 3720036 - RNA, 21 nt, Salmonella enterica enterica serovar Typhi Ty2
cugauguuugcgcucuuuuuu

SEQ ID NO: 3720037 - RNA, 17 nt, Salmonella enterica enterica serovar Typhi Ty2
cugauuaauaugaacca

SEQ ID NO: 3720038 - RNA, 19 nt, Salmonella enterica enterica serovar Typhi Ty2
cugauuaauaugaaccaau

SEQ ID NO: 3720039 - RNA, 22 nt, Salmonella enterica enterica serovar Typhi Ty2
cugauuauucaguaccgccuuc

SEQ ID NO: 3720040 - RNA, 13 nt, Salmonella enterica enterica serovar Typhi Ty2
cugauucaauuaa

SEQ ID NO: 3720041 - RNA, 19 nt, Salmonella enterica enterica serovar Typhi Ty2
cugauugacuaucagccgc

SEQ ID NO: 3720042 - RNA, 13 nt, Salmonella enterica enterica serovar Typhi Ty2
cugauugucagca

SEQ ID NO: 3720043 - RNA, 14 nt, Salmonella enterica enterica serovar Typhi Ty2
cugauugucagcag

SEQ ID NO: 3720044 - RNA, 19 nt, Salmonella enterica enterica serovar Typhi Ty2
cugauuuaaucgcuucaau

SEQ ID NO: 3720045 - RNA, 19 nt, Salmonella enterica enterica serovar Typhi Ty2
cugauuucgccccacuggc

SEQ ID NO: 3720046 - RNA, 13 nt, Salmonella enterica enterica serovar Typhi Ty2
cugauuugccaaa

SEQ ID NO: 3720047 - RNA, 14 nt, Salmonella enterica enterica serovar Typhi Ty2
cugauuuucuccag

SEQ ID NO: 3720048 - RNA, 13 nt, Salmonella enterica enterica serovar Typhi Ty2
cugauuuuuccau

SEQ ID NO: 3720049 - RNA, 16 nt, Salmonella enterica enterica serovar Typhi Ty2
cugcaaaaagccuugc

SEQ ID NO: 3720050 - RNA, 13 nt, Salmonella enterica enterica serovar Typhi Ty2
cugcaaaagagga

SEQ ID NO: 3720051 - RNA, 16 nt, Salmonella enterica enterica serovar Typhi Ty2
cugcaaaauauauaau

SEQ ID NO: 3720052 - RNA, 19 nt, Salmonella enterica enterica serovar Typhi Ty2
cugcaaauaccacaucaga

SEQ ID NO: 3720053 - RNA, 22 nt, Salmonella enterica enterica serovar Typhi Ty2
cugcaaauacugcuuuuccggc

SEQ ID NO: 3720054 - RNA, 18 nt, Salmonella enterica enterica serovar Typhi Ty2
cugcaaauagcgcugaug

SEQ ID NO: 3720055 - RNA, 18 nt, Salmonella enterica enterica serovar Typhi Ty2
cugcaaaucuucggcaaa

SEQ ID NO: 3720056 - RNA, 20 nt, Salmonella enterica enterica serovar Typhi Ty2
cugcaacagaagaguuaacu

SEQ ID NO: 3720057 - RNA, 14 nt, Salmonella enterica enterica serovar Typhi Ty2
cugcaacagcacca

SEQ ID NO: 3720058 - RNA, 18 nt, Salmonella enterica enterica serovar Typhi Ty2
cugcaacagcaccagcag

SEQ ID NO: 3720059 - RNA, 16 nt, Salmonella enterica enterica serovar Typhi Ty2
cugcaacagcacggga

SEQ ID NO: 3720060 - RNA, 14 nt, Salmonella enterica enterica serovar Typhi Ty2
cugcaacgccagau

SEQ ID NO: 3720061 - RNA, 15 nt, Salmonella enterica enterica serovar Typhi Ty2
cugcaacgccagaug

SEQ ID NO: 3720062 - RNA, 17 nt, Salmonella enterica enterica serovar Typhi Ty2
cugcaacgccugcggau

SEQ ID NO: 3720063 - RNA, 18 nt, Salmonella enterica enterica serovar Typhi Ty2
cugcaacggcgaggugcu

SEQ ID NO: 3720064 - RNA, 19 nt, Salmonella enterica enterica serovar Typhi Ty2
cugcaacuccacaaauagc

SEQ ID NO: 3720065 - RNA, 12 nt, Salmonella enterica enterica serovar Typhi Ty2
cugcaacuccug

SEQ ID NO: 3720066 - RNA, 17 nt, Salmonella enterica enterica serovar Typhi Ty2
cugcaacuccugggcaa

SEQ ID NO: 3720067 - RNA, 14 nt, Salmonella enterica enterica serovar Typhi Ty2
cugcaacucuccca

SEQ ID NO: 3720068 - RNA, 17 nt, Salmonella enterica enterica serovar Typhi Ty2
cugcaauagcagaucgc

SEQ ID NO: 3720069 - RNA, 20 nt, Salmonella enterica enterica serovar Typhi Ty2
cugcaauauaugcgccguug

SEQ ID NO: 3720070 - RNA, 22 nt, Salmonella enterica enterica serovar Typhi Ty2
cugcaaugguaaaacgcuggcc

SEQ ID NO: 3720071 - RNA, 20 nt, Salmonella enterica enterica serovar Typhi Ty2
cugcacaacauuccgcuucc

SEQ ID NO: 3720072 - RNA, 17 nt, Salmonella enterica enterica serovar Typhi Ty2
cugcacaauaccaauaa

SEQ ID NO: 3720073 - RNA, 14 nt, Salmonella enterica enterica serovar Typhi Ty2
cugcacaaucgcca

SEQ ID NO: 3720074 - RNA, 17 nt, Salmonella enterica enterica serovar Typhi Ty2
cugcacaaucgccagcc

SEQ ID NO: 3720075 - RNA, 12 nt, Salmonella enterica enterica serovar Typhi Ty2
cugcacaucccg

SEQ ID NO: 3720076 - RNA, 22 nt, Salmonella enterica enterica serovar Typhi Ty2
cugcaccagaacucccuguucc

SEQ ID NO: 3720077 - RNA, 23 nt, Salmonella enterica enterica serovar Typhi Ty2
cugcaccaggagcaaaccgaccc

SEQ ID NO: 3720078 - RNA, 17 nt, Salmonella enterica enterica serovar Typhi Ty2
cugcacccggagagaaa

SEQ ID NO: 3720079 - RNA, 14 nt, Salmonella enterica enterica serovar Typhi Ty2
cugcaccucagacc

SEQ ID NO: 3720080 - RNA, 14 nt, Salmonella enterica enterica serovar Typhi Ty2
cugcaccuggucga

SEQ ID NO: 3720081 - RNA, 20 nt, Salmonella enterica enterica serovar Typhi Ty2
cugcaccuuuuuuuccagcg

SEQ ID NO: 3720082 - RNA, 24 nt, Salmonella enterica enterica serovar Typhi Ty2
cugcaccuuuuuuuccagcgucug

SEQ ID NO: 3720083 - RNA, 17 nt, Salmonella enterica enterica serovar Typhi Ty2
cugcacgaaauguagag

SEQ ID NO: 3720084 - RNA, 15 nt, Salmonella enterica enterica serovar Typhi Ty2
cugcacggcauacuc

SEQ ID NO: 3720085 - RNA, 23 nt, Salmonella enterica enterica serovar Typhi Ty2
cugcacgucgcgcucgcucauca

SEQ ID NO: 3720086 - RNA, 22 nt, Salmonella enterica enterica serovar Typhi Ty2
cugcacguuuugcucuucuucc

SEQ ID NO: 3720087 - RNA, 14 nt, Salmonella enterica enterica serovar Typhi Ty2
cugcacucggaugu

SEQ ID NO: 3720088 - RNA, 14 nt, Salmonella enterica enterica serovar Typhi Ty2
cugcacuuccugcg

SEQ ID NO: 3720089 - RNA, 22 nt, Salmonella enterica enterica serovar Typhi Ty2
cugcacuuuaaaccacaccuga

SEQ ID NO: 3720090 - RNA, 22 nt, Salmonella enterica enterica serovar Typhi Ty2
cugcagaaucccgauaaucaau

SEQ ID NO: 3720091 - RNA, 13 nt, Salmonella enterica enterica serovar Typhi Ty2
cugcagaaucucu

SEQ ID NO: 3720092 - RNA, 20 nt, Salmonella enterica enterica serovar Typhi Ty2
cugcagacccacuuucagcu

SEQ ID NO: 3720093 - RNA, 16 nt, Salmonella enterica enterica serovar Typhi Ty2
cugcagccauacauug

SEQ ID NO: 3720094 - RNA, 17 nt, Salmonella enterica enterica serovar Typhi Ty2
cugcagcccuuacgcuu

SEQ ID NO: 3720095 - RNA, 18 nt, Salmonella enterica enterica serovar Typhi Ty2
cugccuguuuacggcagg

SEQ ID NO: 3720096 - RNA, 17 nt, Salmonella enterica enterica serovar Typhi Ty2
cugccuuauccggccug

SEQ ID NO: 3720097 - RNA, 16 nt, Salmonella enterica enterica serovar Typhi Ty2
cugccuucggcgcugg

SEQ ID NO: 3720098 - RNA, 16 nt, Salmonella enterica enterica serovar Typhi Ty2
cugccuucugaaaguu

SEQ ID NO: 3720099 - RNA, 19 nt, Salmonella enterica enterica serovar Typhi Ty2
cugccuuuaacaaauuaaa

SEQ ID NO: 3720100 - RNA, 21 nt, Salmonella enterica enterica serovar Typhi Ty2
cugccuuuguacagcuugccg

SEQ ID NO: 3720101 - RNA, 15 nt, Salmonella enterica enterica serovar Typhi Ty2
cugcgaacagcgcuc

SEQ ID NO: 3720102 - RNA, 22 nt, Salmonella enterica enterica serovar Typhi Ty2
cugcgaccgagugucgcccgcu

SEQ ID NO: 3720103 - RNA, 22 nt, Salmonella enterica enterica serovar Typhi Ty2
cugcgacgccaggcgccacgau

SEQ ID NO: 3720104 - RNA, 20 nt, Salmonella enterica enterica serovar Typhi Ty2
cugcgaguuuaugguugucu

SEQ ID NO: 3720105 - RNA, 19 nt, Salmonella enterica enterica serovar Typhi Ty2
cugcgcaacauucugcuuc

SEQ ID NO: 3720106 - RNA, 20 nt, Salmonella enterica enterica serovar Typhi Ty2
cugcgcaacauucugcuucc

SEQ ID NO: 3720107 - RNA, 20 nt, Salmonella enterica enterica serovar Typhi Ty2
cugcgcauacgucaugccuu

SEQ ID NO: 3720108 - RNA, 17 nt, Salmonella enterica enterica serovar Typhi Ty2
cugcgcauccgcggcgc

SEQ ID NO: 3720109 - RNA, 14 nt, Salmonella enterica enterica serovar Typhi Ty2
cugcgccaaaucgg

SEQ ID NO: 3720110 - RNA, 20 nt, Salmonella enterica enterica serovar Typhi Ty2
cugcgccacaucauugcugu

SEQ ID NO: 3720111 - RNA, 13 nt, Salmonella enterica enterica serovar Typhi Ty2
cugcgccagcaug

SEQ ID NO: 3720112 - RNA, 12 nt, Salmonella enterica enterica serovar Typhi Ty2
cugcgccagccg

SEQ ID NO: 3720113 - RNA, 16 nt, Salmonella enterica enterica serovar Typhi Ty2
cugcgccagccugcug

SEQ ID NO: 3720114 - RNA, 13 nt, Salmonella enterica enterica serovar Typhi Ty2
cugcgccagcgca

SEQ ID NO: 3720115 - RNA, 14 nt, Salmonella enterica enterica serovar Typhi Ty2
cugcgccagcucau

SEQ ID NO: 3720116 - RNA, 15 nt, Salmonella enterica enterica serovar Typhi Ty2
cugcgccauauccuc

SEQ ID NO: 3720117 - RNA, 22 nt, Salmonella enterica enterica serovar Typhi Ty2
cugcgccauauccucgcugggc

SEQ ID NO: 3720118 - RNA, 14 nt, Salmonella enterica enterica serovar Typhi Ty2
cugcgccaucuucc

SEQ ID NO: 3720119 - RNA, 23 nt, Salmonella enterica enterica serovar Typhi Ty2
cugcgccauugcgggagcuugcc

SEQ ID NO: 3720120 - RNA, 16 nt, Salmonella enterica enterica serovar Typhi Ty2
cugcgcccgccugcug

SEQ ID NO: 3720121 - RNA, 16 nt, Salmonella enterica enterica serovar Typhi Ty2
cugcgccgcaucgcca

SEQ ID NO: 3720122 - RNA, 13 nt, Salmonella enterica enterica serovar Typhi Ty2
cugcgccgccagc

SEQ ID NO: 3720123 - RNA, 13 nt, Salmonella enterica enterica serovar Typhi Ty2
cugcgccgcuugu

SEQ ID NO: 3720124 - RNA, 14 nt, Salmonella enterica enterica serovar Typhi Ty2
cugcgccgggcaga

SEQ ID NO: 3720125 - RNA, 22 nt, Salmonella enterica enterica serovar Typhi Ty2
cugcgccguuccguucgcguca

SEQ ID NO: 3720126 - RNA, 23 nt, Salmonella enterica enterica serovar Typhi Ty2
cugcgccugaaaggcacgcuccu

SEQ ID NO: 3720127 - RNA, 12 nt, Salmonella enterica enterica serovar Typhi Ty2
cugcgccugcau

SEQ ID NO: 3720128 - RNA, 15 nt, Salmonella enterica enterica serovar Typhi Ty2
cugcgccugcucagc

SEQ ID NO: 3720129 - RNA, 18 nt, Salmonella enterica enterica serovar Typhi Ty2
cugcgccugcucagcauu

SEQ ID NO: 3720130 - RNA, 22 nt, Salmonella enterica enterica serovar Typhi Ty2
cugcgccuggaaaaaagcgccc

SEQ ID NO: 3720131 - RNA, 13 nt, Salmonella enterica enterica serovar Typhi Ty2
cugcgcgccaaac

SEQ ID NO: 3720132 - RNA, 17 nt, Salmonella enterica enterica serovar Typhi Ty2
cugcgcgccaaaccguu

SEQ ID NO: 3720133 - RNA, 13 nt, Salmonella enterica enterica serovar Typhi Ty2
cugcgcgccgcag

SEQ ID NO: 3720134 - RNA, 21 nt, Salmonella enterica enterica serovar Typhi Ty2
cugcgcgccgcccugcaucau

SEQ ID NO: 3720135 - RNA, 18 nt, Salmonella enterica enterica serovar Typhi Ty2
cugcgcgccgggcuucau

SEQ ID NO: 3720136 - RNA, 20 nt, Salmonella enterica enterica serovar Typhi Ty2
cugcgcgcgaugcugcucca

SEQ ID NO: 3720137 - RNA, 15 nt, Salmonella enterica enterica serovar Typhi Ty2
cugcgcggcaaugag

SEQ ID NO: 3720138 - RNA, 17 nt, Salmonella enterica enterica serovar Typhi Ty2
cugcgcgucccucucca

SEQ ID NO: 3720139 - RNA, 16 nt, Salmonella enterica enterica serovar Typhi Ty2
cugcgcguucugcucc

SEQ ID NO: 3720140 - RNA, 20 nt, Salmonella enterica enterica serovar Typhi Ty2
cugcgcguucugcuccagac

SEQ ID NO: 3720141 - RNA, 17 nt, Salmonella enterica enterica serovar Typhi Ty2
cugcgcuacuucagggg

SEQ ID NO: 3720142 - RNA, 17 nt, Salmonella enterica enterica serovar Typhi Ty2
cugcgcucacgcggcgc

SEQ ID NO: 3720143 - RNA, 17 nt, Salmonella enterica enterica serovar Typhi Ty2
cugcgcugacggcggca

SEQ ID NO: 3720144 - RNA, 18 nt, Salmonella enterica enterica serovar Typhi Ty2
cugcgcuuaccgggccua

SEQ ID NO: 3720145 - RNA, 15 nt, Salmonella enterica enterica serovar Typhi Ty2
cugcgcuuacggcca

SEQ ID NO: 3720146 - RNA, 19 nt, Salmonella enterica enterica serovar Typhi Ty2
cugcgcuuaucaggccuac

SEQ ID NO: 3720147 - RNA, 24 nt, Salmonella enterica enterica serovar Typhi Ty2
cugcgcuuaucaggccuaccagcc

SEQ ID NO: 3720148 - RNA, 14 nt, Salmonella enterica enterica serovar Typhi Ty2
cugcgcuucggcca

SEQ ID NO: 3720149 - RNA, 18 nt, Salmonella enterica enterica serovar Typhi Ty2
cugcgcuucuauccacug

SEQ ID NO: 3720150 - RNA, 11 nt, Salmonella enterica enterica serovar Typhi Ty2
cugcgcuuuga

SEQ ID NO: 3720151 - RNA, 16 nt, Salmonella enterica enterica serovar Typhi Ty2
cugcgcuuuggguuaa

SEQ ID NO: 3720152 - RNA, 11 nt, Salmonella enterica enterica serovar Typhi Ty2
cugcgcuuugu

SEQ ID NO: 3720153 - RNA, 23 nt, Salmonella enterica enterica serovar Typhi Ty2
cugcggaacuaacccgcagccgg

SEQ ID NO: 3720154 - RNA, 21 nt, Salmonella enterica enterica serovar Typhi Ty2
cugcggcacgaaaaauaaaaa

SEQ ID NO: 3720155 - RNA, 22 nt, Salmonella enterica enterica serovar Typhi Ty2
cugcggcauacuuucgcgcggc

SEQ ID NO: 3720156 - RNA, 13 nt, Salmonella enterica enterica serovar Typhi Ty2
cugcggccaugau

SEQ ID NO: 3720157 - RNA, 23 nt, Salmonella enterica enterica serovar Typhi Ty2
cugcggcccauaaacaggucaca

SEQ ID NO: 3720158 - RNA, 17 nt, Salmonella enterica enterica serovar Typhi Ty2
cugcggccuugccgcca

SEQ ID NO: 3720159 - RNA, 15 nt, Salmonella enterica enterica serovar Typhi Ty2
cugcggcguggagca

SEQ ID NO: 3720160 - RNA, 15 nt, Salmonella enterica enterica serovar Typhi Ty2
cugcggcucgccaau

SEQ ID NO: 3720161 - RNA, 18 nt, Salmonella enterica enterica serovar Typhi Ty2
cugcgguaaucugccagc

SEQ ID NO: 3720162 - RNA, 19 nt, Salmonella enterica enterica serovar Typhi Ty2
cugcgguagagaacagcau

SEQ ID NO: 3720163 - RNA, 15 nt, Salmonella enterica enterica serovar Typhi Ty2
cugcgguauauuccc

SEQ ID NO: 3720164 - RNA, 23 nt, Salmonella enterica enterica serovar Typhi Ty2
cugcguaaaccauuucuccugca

SEQ ID NO: 3720165 - RNA, 17 nt, Salmonella enterica enterica serovar Typhi Ty2
cugcguaggggcgaccg

SEQ ID NO: 3720166 - RNA, 13 nt, Salmonella enterica enterica serovar Typhi Ty2
cugcgucacagac

SEQ ID NO: 3720167 - RNA, 22 nt, Salmonella enterica enterica serovar Typhi Ty2
cugcgucacgcgcaaagcugcg

SEQ ID NO: 3720168 - RNA, 14 nt, Salmonella enterica enterica serovar Typhi Ty2
cugcguccugcuua

SEQ ID NO: 3720169 - RNA, 14 nt, Salmonella enterica enterica serovar Typhi Ty2
cugcgucgcgcgcg

SEQ ID NO: 3720170 - RNA, 16 nt, Salmonella enterica enterica serovar Typhi Ty2
cugcgucgcgcgcguu

SEQ ID NO: 3720171 - RNA, 13 nt, Salmonella enterica enterica serovar Typhi Ty2
cugcgugaaaagg

SEQ ID NO: 3720172 - RNA, 22 nt, Salmonella enterica enterica serovar Typhi Ty2
cugcguggucguaaaacugcac

SEQ ID NO: 3720173 - RNA, 15 nt, Salmonella enterica enterica serovar Typhi Ty2
cugcguugcgcgcgu

SEQ ID NO: 3720174 - RNA, 20 nt, Salmonella enterica enterica serovar Typhi Ty2
cugcguugcuauggcaacaa

SEQ ID NO: 3720175 - RNA, 16 nt, Salmonella enterica enterica serovar Typhi Ty2
cugcguuuaucaggcc

SEQ ID NO: 3720176 - RNA, 22 nt, Salmonella enterica enterica serovar Typhi Ty2
cugcguuugcggaucgaucucg

SEQ ID NO: 3720177 - RNA, 16 nt, Salmonella enterica enterica serovar Typhi Ty2
cuggaugacugaauua

SEQ ID NO: 3720178 - RNA, 17 nt, Salmonella enterica enterica serovar Typhi Ty2
cuggauggacuguuucg

SEQ ID NO: 3720179 - RNA, 13 nt, Salmonella enterica enterica serovar Typhi Ty2
cuggauuccucca

SEQ ID NO: 3720180 - RNA, 23 nt, Salmonella enterica enterica serovar Typhi Ty2
cuggauucucucccaggcauccu

SEQ ID NO: 3720181 - RNA, 13 nt, Salmonella enterica enterica serovar Typhi Ty2
cuggcaaaacgca

SEQ ID NO: 3720182 - RNA, 14 nt, Salmonella enterica enterica serovar Typhi Ty2
cuggcaaaugaagc

SEQ ID NO: 3720183 - RNA, 14 nt, Salmonella enterica enterica serovar Typhi Ty2
cuggcaacagccau

SEQ ID NO: 3720184 - RNA, 22 nt, Salmonella enterica enterica serovar Typhi Ty2
cuggcaagaccgauagagacug

SEQ ID NO: 3720185 - RNA, 13 nt, Salmonella enterica enterica serovar Typhi Ty2
cuggcagccucgu

SEQ ID NO: 3720186 - RNA, 22 nt, Salmonella enterica enterica serovar Typhi Ty2
cuggcagccucguccugcaauu

SEQ ID NO: 3720187 - RNA, 19 nt, Salmonella enterica enterica serovar Typhi Ty2
cuggcagcgccugacggcg

SEQ ID NO: 3720188 - RNA, 20 nt, Salmonella enterica enterica serovar Typhi Ty2
cuggcagcgcugaaucgcaa

SEQ ID NO: 3720189 - RNA, 21 nt, Salmonella enterica enterica serovar Typhi Ty2
cuggcagugauccaucgguuc

SEQ ID NO: 3720190 - RNA, 23 nt, Salmonella enterica enterica serovar Typhi Ty2
cuggcaguucaucuucccgcaga

SEQ ID NO: 3720191 - RNA, 18 nt, Salmonella enterica enterica serovar Typhi Ty2
cuggcauggcucgccgcu

SEQ ID NO: 3720192 - RNA, 18 nt, Salmonella enterica enterica serovar Typhi Ty2
cuggccaauggcucaacu

SEQ ID NO: 3720193 - RNA, 22 nt, Salmonella enterica enterica serovar Typhi Ty2
cuggccaauuuuucacaugcaa

SEQ ID NO: 3720194 - RNA, 18 nt, Salmonella enterica enterica serovar Typhi Ty2
cuggccacccaccacgau

SEQ ID NO: 3720195 - RNA, 17 nt, Salmonella enterica enterica serovar Typhi Ty2
cuggccacggagugcgc

SEQ ID NO: 3720196 - RNA, 23 nt, Salmonella enterica enterica serovar Typhi Ty2
cuggccaggcauugauaaagcgc

SEQ ID NO: 3720197 - RNA, 14 nt, Salmonella enterica enterica serovar Typhi Ty2
cuggccaggcuuuc

SEQ ID NO: 3720198 - RNA, 13 nt, Salmonella enterica enterica serovar Typhi Ty2
cuggccagggcau

SEQ ID NO: 3720199 - RNA, 14 nt, Salmonella enterica enterica serovar Typhi Ty2
cuggccaguuucaa

SEQ ID NO: 3720200 - RNA, 17 nt, Salmonella enterica enterica serovar Typhi Ty2
cuggccauuucaucauu

SEQ ID NO: 3720201 - RNA, 22 nt, Salmonella enterica enterica serovar Typhi Ty2
cuggccccgcauuuuaccucac

SEQ ID NO: 3720202 - RNA, 15 nt, Salmonella enterica enterica serovar Typhi Ty2
cuggccgcgauggug

SEQ ID NO: 3720203 - RNA, 23 nt, Salmonella enterica enterica serovar Typhi Ty2
cuggccggaaaggauauaagcgc

SEQ ID NO: 3720204 - RNA, 17 nt, Salmonella enterica enterica serovar Typhi Ty2
cuggccguuuucccggc

SEQ ID NO: 3720205 - RNA, 18 nt, Salmonella enterica enterica serovar Typhi Ty2
cuggccguuuucccggca

SEQ ID NO: 3720206 - RNA, 19 nt, Salmonella enterica enterica serovar Typhi Ty2
cuggccguuuucccggcaa

SEQ ID NO: 3720207 - RNA, 20 nt, Salmonella enterica enterica serovar Typhi Ty2
cuggccguuuucccggcaau

SEQ ID NO: 3720208 - RNA, 20 nt, Salmonella enterica enterica serovar Typhi Ty2
cuggccuacggaaagcuguu

SEQ ID NO: 3720209 - RNA, 16 nt, Salmonella enterica enterica serovar Typhi Ty2
cuggccucccaguucc

SEQ ID NO: 3720210 - RNA, 17 nt, Salmonella enterica enterica serovar Typhi Ty2
cuggccucccaguuccc

SEQ ID NO: 3720211 - RNA, 13 nt, Salmonella enterica enterica serovar Typhi Ty2
cuggccuccggcg

SEQ ID NO: 3720212 - RNA, 23 nt, Salmonella enterica enterica serovar Typhi Ty2
cuggccugauaagcgcagcgcca

SEQ ID NO: 3720213 - RNA, 18 nt, Salmonella enterica enterica serovar Typhi Ty2
cuggccugcagaccuaua

SEQ ID NO: 3720214 - RNA, 13 nt, Salmonella enterica enterica serovar Typhi Ty2
cuggccuucuuuc

SEQ ID NO: 3720215 - RNA, 17 nt, Salmonella enterica enterica serovar Typhi Ty2
cuggcgaaccaccagcc

SEQ ID NO: 3720216 - RNA, 15 nt, Salmonella enterica enterica serovar Typhi Ty2
cuggcgaauccggga

SEQ ID NO: 3720217 - RNA, 20 nt, Salmonella enterica enterica serovar Typhi Ty2
cuggcgaauccgggaaaugg

SEQ ID NO: 3720218 - RNA, 19 nt, Salmonella enterica enterica serovar Typhi Ty2
cuggcgaccagccugccgu

SEQ ID NO: 3720219 - RNA, 17 nt, Salmonella enterica enterica serovar Typhi Ty2
cuggcgaccgccaccau

SEQ ID NO: 3720220 - RNA, 23 nt, Salmonella enterica enterica serovar Typhi Ty2
cuggcgacggcggucgccgcaug

SEQ ID NO: 3720221 - RNA, 18 nt, Salmonella enterica enterica serovar Typhi Ty2
cuggcgagaaaguggugg

SEQ ID NO: 3720222 - RNA, 19 nt, Salmonella enterica enterica serovar Typhi Ty2
cuggcgagaaagugguggg

SEQ ID NO: 3720223 - RNA, 18 nt, Salmonella enterica enterica serovar Typhi Ty2
cuggcgagaauagaagcc

SEQ ID NO: 3720224 - RNA, 19 nt, Salmonella enterica enterica serovar Typhi Ty2
cuggcgaucguucgauagu

SEQ ID NO: 3720225 - RNA, 21 nt, Salmonella enterica enterica serovar Typhi Ty2
cuggcgaugugcccgagugac

SEQ ID NO: 3720226 - RNA, 19 nt, Salmonella enterica enterica serovar Typhi Ty2
cuggcgauuuucauagcug

SEQ ID NO: 3720227 - RNA, 15 nt, Salmonella enterica enterica serovar Typhi Ty2
cuggcgcaaaugggc

SEQ ID NO: 3720228 - RNA, 19 nt, Salmonella enterica enterica serovar Typhi Ty2
cuggcgcacauugcugccu

SEQ ID NO: 3720229 - RNA, 22 nt, Salmonella enterica enterica serovar Typhi Ty2
cuggcgcacgcgucaucggcgc

SEQ ID NO: 3720230 - RNA, 19 nt, Salmonella enterica enterica serovar Typhi Ty2
cuggcgcagcgcuuuugcc

SEQ ID NO: 3720231 - RNA, 13 nt, Salmonella enterica enterica serovar Typhi Ty2
cuggcgccgcaaa

SEQ ID NO: 3720232 - RNA, 22 nt, Salmonella enterica enterica serovar Typhi Ty2
cuggcgccuuuuggcagcagcg

SEQ ID NO: 3720233 - RNA, 17 nt, Salmonella enterica enterica serovar Typhi Ty2
cuggcgcggggaacaca

SEQ ID NO: 3720234 - RNA, 18 nt, Salmonella enterica enterica serovar Typhi Ty2
cuggcgcggggaacacac

SEQ ID NO: 3720235 - RNA, 19 nt, Salmonella enterica enterica serovar Typhi Ty2
cuggcgcggggaacacauu

SEQ ID NO: 3720236 - RNA, 17 nt, Salmonella enterica enterica serovar Typhi Ty2
cuggcgcggggaacacc

SEQ ID NO: 3720237 - RNA, 22 nt, Salmonella enterica enterica serovar Typhi Ty2
cuggcgcggggaacacggacag

SEQ ID NO: 3720238 - RNA, 17 nt, Salmonella enterica enterica serovar Typhi Ty2
cuggcgcggggaacacu

SEQ ID NO: 3720239 - RNA, 17 nt, Salmonella enterica enterica serovar Typhi Ty2
cuggcgcugaccgcccc

SEQ ID NO: 3720240 - RNA, 23 nt, Salmonella enterica enterica serovar Typhi Ty2
cuggcgcugaccgccccguauca

SEQ ID NO: 3720241 - RNA, 15 nt, Salmonella enterica enterica serovar Typhi Ty2
cuggcgcuggcugcc

SEQ ID NO: 3720242 - RNA, 17 nt, Salmonella enterica enterica serovar Typhi Ty2
cuggcgcuuuuccagca

SEQ ID NO: 3720243 - RNA, 19 nt, Salmonella enterica enterica serovar Typhi Ty2
cuggcgcuuuuccagcacg

SEQ ID NO: 3720244 - RNA, 14 nt, Salmonella enterica enterica serovar Typhi Ty2
cuggcggcaaaaac

SEQ ID NO: 3720245 - RNA, 21 nt, Salmonella enterica enterica serovar Typhi Ty2
cuggcgggcagccuucaaguu

SEQ ID NO: 3720246 - RNA, 20 nt, Salmonella enterica enterica serovar Typhi Ty2
cuggcgguaaauacgcggca

SEQ ID NO: 3720247 - RNA, 22 nt, Salmonella enterica enterica serovar Typhi Ty2
cuggcgguaugaaagccaucgc

SEQ ID NO: 3720248 - RNA, 20 nt, Salmonella enterica enterica serovar Typhi Ty2
cuggcggucgggaacgcugu

SEQ ID NO: 3720249 - RNA, 13 nt, Salmonella enterica enterica serovar Typhi Ty2
cuggcguacgcca

SEQ ID NO: 3720250 - RNA, 21 nt, Salmonella enterica enterica serovar Typhi Ty2
cuggcguaugcuuucagcaug

SEQ ID NO: 3720251 - RNA, 23 nt, Salmonella enterica enterica serovar Typhi Ty2
cuggcgucccuuucccuuccagc

SEQ ID NO: 3720252 - RNA, 18 nt, Salmonella enterica enterica serovar Typhi Ty2
cuggcgucgccaaagcag

SEQ ID NO: 3720253 - RNA, 16 nt, Salmonella enterica enterica serovar Typhi Ty2
cuggcgucuguccggc

SEQ ID NO: 3720254 - RNA, 19 nt, Salmonella enterica enterica serovar Typhi Ty2
cuggcgugacguguggcgc

SEQ ID NO: 3720255 - RNA, 17 nt, Salmonella enterica enterica serovar Typhi Ty2
cuggcguuaucguccgu

SEQ ID NO: 3720256 - RNA, 15 nt, Salmonella enterica enterica serovar Typhi Ty2
cuggcuaucgccgua

SEQ ID NO: 3720257 - RNA, 14 nt, Salmonella enterica enterica serovar Typhi Ty2
cuggcucacugacu

SEQ ID NO: 3720258 - RNA, 14 nt, Salmonella enterica enterica serovar Typhi Ty2
cugguucgaaucca

SEQ ID NO: 3720259 - RNA, 13 nt, Salmonella enterica enterica serovar Typhi Ty2
cugguugcagcgc

SEQ ID NO: 3720260 - RNA, 14 nt, Salmonella enterica enterica serovar Typhi Ty2
cugguuggcgcgcu

SEQ ID NO: 3720261 - RNA, 15 nt, Salmonella enterica enterica serovar Typhi Ty2
cugguuguuucuuaa

SEQ ID NO: 3720262 - RNA, 14 nt, Salmonella enterica enterica serovar Typhi Ty2
cugguuucaauacu

SEQ ID NO: 3720263 - RNA, 16 nt, Salmonella enterica enterica serovar Typhi Ty2
cugguuucccugccuc

SEQ ID NO: 3720264 - RNA, 21 nt, Salmonella enterica enterica serovar Typhi Ty2
cugguuucggcaucccaggcg

SEQ ID NO: 3720265 - RNA, 22 nt, Salmonella enterica enterica serovar Typhi Ty2
cugguuucuccggccagucugg

SEQ ID NO: 3720266 - RNA, 18 nt, Salmonella enterica enterica serovar Typhi Ty2
cugguuuuagcuuauccc

SEQ ID NO: 3720267 - RNA, 18 nt, Salmonella enterica enterica serovar Typhi Ty2
cugguuuugcguaaucca

SEQ ID NO: 3720268 - RNA, 12 nt, Salmonella enterica enterica serovar Typhi Ty2
cuguaaaaggga

SEQ ID NO: 3720269 - RNA, 23 nt, Salmonella enterica enterica serovar Typhi Ty2
cuguaaaagggauacgguuuuuu

SEQ ID NO: 3720270 - RNA, 14 nt, Salmonella enterica enterica serovar Typhi Ty2
cuguaaaccgccuc

SEQ ID NO: 3720271 - RNA, 17 nt, Salmonella enterica enterica serovar Typhi Ty2
cuguaaacguuccugcc

SEQ ID NO: 3720272 - RNA, 20 nt, Salmonella enterica enterica serovar Typhi Ty2
cuguaaacguuccugccagc

SEQ ID NO: 3720273 - RNA, 23 nt, Salmonella enterica enterica serovar Typhi Ty2
cuguaaaucgcgcccgacauggc

SEQ ID NO: 3720274 - RNA, 18 nt, Salmonella enterica enterica serovar Typhi Ty2
cuguaacaacuguuuuuc

SEQ ID NO: 3720275 - RNA, 14 nt, Salmonella enterica enterica serovar Typhi Ty2
cuguaacacugccg

SEQ ID NO: 3720276 - RNA, 15 nt, Salmonella enterica enterica serovar Typhi Ty2
cuguaacaguauccg

SEQ ID NO: 3720277 - RNA, 22 nt, Salmonella enterica enterica serovar Typhi Ty2
cuguaauggcgcucuuuuccag

SEQ ID NO: 3720278 - RNA, 17 nt, Salmonella enterica enterica serovar Typhi Ty2
cuguaaugucuggugca

SEQ ID NO: 3720279 - RNA, 18 nt, Salmonella enterica enterica serovar Typhi Ty2
cuguaauuauaaauauua

SEQ ID NO: 3720280 - RNA, 20 nt, Salmonella enterica enterica serovar Typhi Ty2
cuguaauuauaaauauuaau

SEQ ID NO: 3720281 - RNA, 23 nt, Salmonella enterica enterica serovar Typhi Ty2
cuguaauuauaaauauuaaugaa

SEQ ID NO: 3720282 - RNA, 13 nt, Salmonella enterica enterica serovar Typhi Ty2
cuguaauuuauaa

SEQ ID NO: 3720283 - RNA, 16 nt, Salmonella enterica enterica serovar Typhi Ty2
cuguaauuucgcuggc

SEQ ID NO: 3720284 - RNA, 16 nt, Salmonella enterica enterica serovar Typhi Ty2
cuguaccaccacgccc

SEQ ID NO: 3720285 - RNA, 13 nt, Salmonella enterica enterica serovar Typhi Ty2
cuguaccaccaga

SEQ ID NO: 3720286 - RNA, 19 nt, Salmonella enterica enterica serovar Typhi Ty2
cuguaccagacgcgaacgu

SEQ ID NO: 3720287 - RNA, 15 nt, Salmonella enterica enterica serovar Typhi Ty2
cuguaccaggacgca

SEQ ID NO: 3720288 - RNA, 17 nt, Salmonella enterica enterica serovar Typhi Ty2
cuguaccgcguccugac

SEQ ID NO: 3720289 - RNA, 18 nt, Salmonella enterica enterica serovar Typhi Ty2
cuguaccugauccagcuc

SEQ ID NO: 3720290 - RNA, 15 nt, Salmonella enterica enterica serovar Typhi Ty2
cuguacgcccagccg

SEQ ID NO: 3720291 - RNA, 14 nt, Salmonella enterica enterica serovar Typhi Ty2
cuguacgccucuuu

SEQ ID NO: 3720292 - RNA, 17 nt, Salmonella enterica enterica serovar Typhi Ty2
cuguagauaccuacuuu

SEQ ID NO: 3720293 - RNA, 18 nt, Salmonella enterica enterica serovar Typhi Ty2
cuguagauaccuacuuua

SEQ ID NO: 3720294 - RNA, 13 nt, Salmonella enterica enterica serovar Typhi Ty2
cuguagaugaaac

SEQ ID NO: 3720295 - RNA, 16 nt, Salmonella enterica enterica serovar Typhi Ty2
cuguagcagcgccagc

SEQ ID NO: 3720296 - RNA, 14 nt, Salmonella enterica enterica serovar Typhi Ty2
cuguagccagccug

SEQ ID NO: 3720297 - RNA, 13 nt, Salmonella enterica enterica serovar Typhi Ty2
cuguagccgugcc

SEQ ID NO: 3720298 - RNA, 20 nt, Salmonella enterica enterica serovar Typhi Ty2
cuguagcgucucaucaaaaa

SEQ ID NO: 3720299 - RNA, 23 nt, Salmonella enterica enterica serovar Typhi Ty2
cuguagcgucucaucaaaaaggc

SEQ ID NO: 3720300 - RNA, 21 nt, Salmonella enterica enterica serovar Typhi Ty2
cuguagcguuucacgcgcgcc

SEQ ID NO: 3720301 - RNA, 15 nt, Salmonella enterica enterica serovar Typhi Ty2
cuguauaaacucagc

SEQ ID NO: 3720302 - RNA, 15 nt, Salmonella enterica enterica serovar Typhi Ty2
cuguauaaauaaccg

SEQ ID NO: 3720303 - RNA, 23 nt, Salmonella enterica enterica serovar Typhi Ty2
cuguauaaauaaccgguaacugu

SEQ ID NO: 3720304 - RNA, 16 nt, Salmonella enterica enterica serovar Typhi Ty2
cuguauacacuuucca

SEQ ID NO: 3720305 - RNA, 18 nt, Salmonella enterica enterica serovar Typhi Ty2
cuguauacauacauacca

SEQ ID NO: 3720306 - RNA, 16 nt, Salmonella enterica enterica serovar Typhi Ty2
cuguaucacuuuuuau

SEQ ID NO: 3720307 - RNA, 11 nt, Salmonella enterica enterica serovar Typhi Ty2
cuguauccacc

SEQ ID NO: 3720308 - RNA, 21 nt, Salmonella enterica enterica serovar Typhi Ty2
cuguaucuucgccguauucuu

SEQ ID NO: 3720309 - RNA, 18 nt, Salmonella enterica enterica serovar Typhi Ty2
cugucaaaacccagccca

SEQ ID NO: 3720310 - RNA, 13 nt, Salmonella enterica enterica serovar Typhi Ty2
cugucaccagcag

SEQ ID NO: 3720311 - RNA, 20 nt, Salmonella enterica enterica serovar Typhi Ty2
cugucacuccggcugcacca

SEQ ID NO: 3720312 - RNA, 13 nt, Salmonella enterica enterica serovar Typhi Ty2
cugucagccgcac

SEQ ID NO: 3720313 - RNA, 17 nt, Salmonella enterica enterica serovar Typhi Ty2
cugucaggacuagcgcg

SEQ ID NO: 3720314 - RNA, 18 nt, Salmonella enterica enterica serovar Typhi Ty2
cugucauaggcgacaggc

SEQ ID NO: 3720315 - RNA, 12 nt, Salmonella enterica enterica serovar Typhi Ty2
cugucaucauca

SEQ ID NO: 3720316 - RNA, 13 nt, Salmonella enterica enterica serovar Typhi Ty2
cugucaucaucaa

SEQ ID NO: 3720317 - RNA, 21 nt, Salmonella enterica enterica serovar Typhi Ty2
cugucaucaucaaguaccgug

SEQ ID NO: 3720318 - RNA, 23 nt, Salmonella enterica enterica serovar Typhi Ty2
cugucaucgaaggcgauaccggu

SEQ ID NO: 3720319 - RNA, 18 nt, Salmonella enterica enterica serovar Typhi Ty2
cuguccaugacgaccaca

SEQ ID NO: 3720320 - RNA, 19 nt, Salmonella enterica enterica serovar Typhi Ty2
cugucccagccuuccuggu

SEQ ID NO: 3720321 - RNA, 16 nt, Salmonella enterica enterica serovar Typhi Ty2
cugucccugccagcgu

SEQ ID NO: 3720322 - RNA, 17 nt, Salmonella enterica enterica serovar Typhi Ty2
cugucccugccagcgua

SEQ ID NO: 3720323 - RNA, 21 nt, Salmonella enterica enterica serovar Typhi Ty2
cuguccgccuuaucaggccug

SEQ ID NO: 3720324 - RNA, 13 nt, Salmonella enterica enterica serovar Typhi Ty2
cuguccggguauc

SEQ ID NO: 3720325 - RNA, 19 nt, Salmonella enterica enterica serovar Typhi Ty2
cuguccugaguaaagccug

SEQ ID NO: 3720326 - RNA, 16 nt, Salmonella enterica enterica serovar Typhi Ty2
cugucgaaaccagcau

SEQ ID NO: 3720327 - RNA, 16 nt, Salmonella enterica enterica serovar Typhi Ty2
cugucgauaaacucau

SEQ ID NO: 3720328 - RNA, 21 nt, Salmonella enterica enterica serovar Typhi Ty2
cugucgauaacagcauaaacg

SEQ ID NO: 3720329 - RNA, 22 nt, Salmonella enterica enterica serovar Typhi Ty2
cugucgauaacagcauaaacgu

SEQ ID NO: 3720330 - RNA, 14 nt, Salmonella enterica enterica serovar Typhi Ty2
cugucgaucgguga

SEQ ID NO: 3720331 - RNA, 21 nt, Salmonella enterica enterica serovar Typhi Ty2
cugucgaugauauccagcacg

SEQ ID NO: 3720332 - RNA, 13 nt, Salmonella enterica enterica serovar Typhi Ty2
cugucgccaccac

SEQ ID NO: 3720333 - RNA, 14 nt, Salmonella enterica enterica serovar Typhi Ty2
cugucgccaccacu

SEQ ID NO: 3720334 - RNA, 15 nt, Salmonella enterica enterica serovar Typhi Ty2
cugucgccaccacuc

SEQ ID NO: 3720335 - RNA, 14 nt, Salmonella enterica enterica serovar Typhi Ty2
cugucgccgcccgu

SEQ ID NO: 3720336 - RNA, 15 nt, Salmonella enterica enterica serovar Typhi Ty2
cugucgccgcccguc

SEQ ID NO: 3720337 - RNA, 13 nt, Salmonella enterica enterica serovar Typhi Ty2
cugucgccgcgca

SEQ ID NO: 3720338 - RNA, 19 nt, Salmonella enterica enterica serovar Typhi Ty2
cugucggcagaaccugacc

SEQ ID NO: 3720339 - RNA, 16 nt, Salmonella enterica enterica serovar Typhi Ty2
cugucgggagccucuu

SEQ ID NO: 3720340 - RNA, 17 nt, Salmonella enterica enterica serovar Typhi Ty2
cuguuuaagcuuuuucu

SEQ ID NO: 3720341 - RNA, 22 nt, Salmonella enterica enterica serovar Typhi Ty2
cuguuuaaugcuuucaauacuc

SEQ ID NO: 3720342 - RNA, 19 nt, Salmonella enterica enterica serovar Typhi Ty2
cuguuuacccacuucuucc

SEQ ID NO: 3720343 - RNA, 23 nt, Salmonella enterica enterica serovar Typhi Ty2
cuguuucaguaaaucccgcauca

SEQ ID NO: 3720344 - RNA, 14 nt, Salmonella enterica enterica serovar Typhi Ty2
cuguuuccaguuac

SEQ ID NO: 3720345 - RNA, 20 nt, Salmonella enterica enterica serovar Typhi Ty2
cuguuucgcaggccggauaa

SEQ ID NO: 3720346 - RNA, 17 nt, Salmonella enterica enterica serovar Typhi Ty2
cuguuucgccaggccgc

SEQ ID NO: 3720347 - RNA, 20 nt, Salmonella enterica enterica serovar Typhi Ty2
cuguuucgcccgcucgcgau

SEQ ID NO: 3720348 - RNA, 23 nt, Salmonella enterica enterica serovar Typhi Ty2
cuguuucuccguuguugcaccac

SEQ ID NO: 3720349 - RNA, 22 nt, Salmonella enterica enterica serovar Typhi Ty2
cuguuucugcgccgcuugugcc

SEQ ID NO: 3720350 - RNA, 13 nt, Salmonella enterica enterica serovar Typhi Ty2
cuguuuuaauucc

SEQ ID NO: 3720351 - RNA, 14 nt, Salmonella enterica enterica serovar Typhi Ty2
cuguuuuccgcuuu

SEQ ID NO: 3720352 - RNA, 23 nt, Salmonella enterica enterica serovar Typhi Ty2
cuguuuuuggaaacuaugcaaaa

SEQ ID NO: 3720353 - RNA, 15 nt, Salmonella enterica enterica serovar Typhi Ty2
cuguuuuuugccaca

SEQ ID NO: 3720354 - RNA, 19 nt, Salmonella enterica enterica serovar Typhi Ty2
cuguuuuuuguugauuuua

SEQ ID NO: 3720355 - RNA, 13 nt, Salmonella enterica enterica serovar Typhi Ty2
cuuaaaaaauccu

SEQ ID NO: 3720356 - RNA, 14 nt, Salmonella enterica enterica serovar Typhi Ty2
cuuaaaaaauccug

SEQ ID NO: 3720357 - RNA, 19 nt, Salmonella enterica enterica serovar Typhi Ty2
cuuaaaagggaguauuuac

SEQ ID NO: 3720358 - RNA, 21 nt, Salmonella enterica enterica serovar Typhi Ty2
cuuaaaagggaguauuuaccu

SEQ ID NO: 3720359 - RNA, 14 nt, Salmonella enterica enterica serovar Typhi Ty2
cuuaaaauugaauu

SEQ ID NO: 3720360 - RNA, 20 nt, Salmonella enterica enterica serovar Typhi Ty2
cuuaaacgccggauuccaga

SEQ ID NO: 3720361 - RNA, 21 nt, Salmonella enterica enterica serovar Typhi Ty2
cuuaaacgccggauuccagaa

SEQ ID NO: 3720362 - RNA, 21 nt, Salmonella enterica enterica serovar Typhi Ty2
cuuaaauggcgcuguaaggca

SEQ ID NO: 3720363 - RNA, 18 nt, Salmonella enterica enterica serovar Typhi Ty2
cuuaaauuaaugauuaaa

SEQ ID NO: 3720364 - RNA, 22 nt, Salmonella enterica enterica serovar Typhi Ty2
cuuaaauuaaugauuaaaauaa

SEQ ID NO: 3720365 - RNA, 13 nt, Salmonella enterica enterica serovar Typhi Ty2
cuuaaauuuuuaa

SEQ ID NO: 3720366 - RNA, 19 nt, Salmonella enterica enterica serovar Typhi Ty2
cuuaacagaauugcgccac

SEQ ID NO: 3720367 - RNA, 16 nt, Salmonella enterica enterica serovar Typhi Ty2
cuuaacgauaacguca

SEQ ID NO: 3720368 - RNA, 18 nt, Salmonella enterica enterica serovar Typhi Ty2
cuuaagaauguccaucuc

SEQ ID NO: 3720369 - RNA, 21 nt, Salmonella enterica enterica serovar Typhi Ty2
cuuaagaauguccaucucuuu

SEQ ID NO: 3720370 - RNA, 16 nt, Salmonella enterica enterica serovar Typhi Ty2
cuuaagggccauguuu

SEQ ID NO: 3720371 - RNA, 13 nt, Salmonella enterica enterica serovar Typhi Ty2
cuuaauaacagcg

SEQ ID NO: 3720372 - RNA, 23 nt, Salmonella enterica enterica serovar Typhi Ty2
cuuaauacccauuucuucuucaa

SEQ ID NO: 3720373 - RNA, 14 nt, Salmonella enterica enterica serovar Typhi Ty2
cuuaauaucaauau

SEQ ID NO: 3720374 - RNA, 17 nt, Salmonella enterica enterica serovar Typhi Ty2
cuuaauaucaauauaau

SEQ ID NO: 3720375 - RNA, 18 nt, Salmonella enterica enterica serovar Typhi Ty2
cuuaauaucaauauaauu

SEQ ID NO: 3720376 - RNA, 22 nt, Salmonella enterica enterica serovar Typhi Ty2
cuuaauauccaguugcgccagc

SEQ ID NO: 3720377 - RNA, 23 nt, Salmonella enterica enterica serovar Typhi Ty2
cuuaauaugcugccuacugcccu

SEQ ID NO: 3720378 - RNA, 21 nt, Salmonella enterica enterica serovar Typhi Ty2
cuuaaugaguacggguauucc

SEQ ID NO: 3720379 - RNA, 18 nt, Salmonella enterica enterica serovar Typhi Ty2
cuuaaugcauggcagaua

SEQ ID NO: 3720380 - RNA, 22 nt, Salmonella enterica enterica serovar Typhi Ty2
cuuaaugcauggcagauaaacc

SEQ ID NO: 3720381 - RNA, 16 nt, Salmonella enterica enterica serovar Typhi Ty2
cuuaaugcucugcugu

SEQ ID NO: 3720382 - RNA, 13 nt, Salmonella enterica enterica serovar Typhi Ty2
cuuacaaaaaaua

SEQ ID NO: 3720383 - RNA, 17 nt, Salmonella enterica enterica serovar Typhi Ty2
cuuacacacccggccua

SEQ ID NO: 3720384 - RNA, 22 nt, Salmonella enterica enterica serovar Typhi Ty2
cuuacacugauaccccagcgau

SEQ ID NO: 3720385 - RNA, 17 nt, Salmonella enterica enterica serovar Typhi Ty2
cuuacaggcgcaucaga

SEQ ID NO: 3720386 - RNA, 14 nt, Salmonella enterica enterica serovar Typhi Ty2
cuuaccgggcagga

SEQ ID NO: 3720387 - RNA, 15 nt, Salmonella enterica enterica serovar Typhi Ty2
cuuaccgggcaucug

SEQ ID NO: 3720388 - RNA, 15 nt, Salmonella enterica enterica serovar Typhi Ty2
cuuaccuaagucagu

SEQ ID NO: 3720389 - RNA, 18 nt, Salmonella enterica enterica serovar Typhi Ty2
cuuacgaauuuuaucuuc

SEQ ID NO: 3720390 - RNA, 21 nt, Salmonella enterica enterica serovar Typhi Ty2
cuuacgcacaaaccgcgcggu

SEQ ID NO: 3720391 - RNA, 15 nt, Salmonella enterica enterica serovar Typhi Ty2
cuuacgcggcgcgcu

SEQ ID NO: 3720392 - RNA, 14 nt, Salmonella enterica enterica serovar Typhi Ty2
cuuacgcuccugcg

SEQ ID NO: 3720393 - RNA, 16 nt, Salmonella enterica enterica serovar Typhi Ty2
cuuacgcucgcugaug

SEQ ID NO: 3720394 - RNA, 22 nt, Salmonella enterica enterica serovar Typhi Ty2
cuuacguuucucacuaauuuga

SEQ ID NO: 3720395 - RNA, 13 nt, Salmonella enterica enterica serovar Typhi Ty2
cuuacuaauaaau

SEQ ID NO: 3720396 - RNA, 18 nt, Salmonella enterica enterica serovar Typhi Ty2
cuuacuuguaggccuggu

SEQ ID NO: 3720397 - RNA, 18 nt, Salmonella enterica enterica serovar Typhi Ty2
cuuacuuuccaaaaucca

SEQ ID NO: 3720398 - RNA, 22 nt, Salmonella enterica enterica serovar Typhi Ty2
cuuacuuuccaaaauccaggga

SEQ ID NO: 3720399 - RNA, 19 nt, Salmonella enterica enterica serovar Typhi Ty2
cuuagaucguaucggcugg

SEQ ID NO: 3720400 - RNA, 19 nt, Salmonella enterica enterica serovar Typhi Ty2
cuuagcaacugccggcuua

SEQ ID NO: 3720401 - RNA, 17 nt, Salmonella enterica enterica serovar Typhi Ty2
cuuagcagcauaaacau

SEQ ID NO: 3720402 - RNA, 16 nt, Salmonella enterica enterica serovar Typhi Ty2
cuuagcaguagugagc

SEQ ID NO: 3720403 - RNA, 18 nt, Salmonella enterica enterica serovar Typhi Ty2
cuuagcaguagugagcca

SEQ ID NO: 3720404 - RNA, 17 nt, Salmonella enterica enterica serovar Typhi Ty2
cuuagcgccagcagaaa

SEQ ID NO: 3720405 - RNA, 16 nt, Salmonella enterica enterica serovar Typhi Ty2
cuuaggauaauucccc

SEQ ID NO: 3720406 - RNA, 18 nt, Salmonella enterica enterica serovar Typhi Ty2
cuuaggauaauuccccca

SEQ ID NO: 3720407 - RNA, 23 nt, Salmonella enterica enterica serovar Typhi Ty2
cuuaggcagccaggcaaagcccc

SEQ ID NO: 3720408 - RNA, 15 nt, Salmonella enterica enterica serovar Typhi Ty2
cuuaguccucagcga

SEQ ID NO: 3720409 - RNA, 23 nt, Salmonella enterica enterica serovar Typhi Ty2
cuuauaaaucagcuuugcggcca

SEQ ID NO: 3720410 - RNA, 14 nt, Salmonella enterica enterica serovar Typhi Ty2
cuuauacagcgcau

SEQ ID NO: 3720411 - RNA, 16 nt, Salmonella enterica enterica serovar Typhi Ty2
cuuauacugauaaacu

SEQ ID NO: 3720412 - RNA, 19 nt, Salmonella enterica enterica serovar Typhi Ty2
cuuauacugauaaacuauc

SEQ ID NO: 3720413 - RNA, 12 nt, Salmonella enterica enterica serovar Typhi Ty2
cuuauauuuauu

SEQ ID NO: 3720414 - RNA, 15 nt, Salmonella enterica enterica serovar Typhi Ty2
cuuaucaaaccagcu

SEQ ID NO: 3720415 - RNA, 14 nt, Salmonella enterica enterica serovar Typhi Ty2
cuuaucaagcgaua

SEQ ID NO: 3720416 - RNA, 15 nt, Salmonella enterica enterica serovar Typhi Ty2
cuuaucaaguaacgu

SEQ ID NO: 3720417 - RNA, 22 nt, Salmonella enterica enterica serovar Typhi Ty2
cuuaucaggccgacaaaugacg

SEQ ID NO: 3720418 - RNA, 19 nt, Salmonella enterica enterica serovar Typhi Ty2
cuuaucaggccuaccagcc

SEQ ID NO: 3720419 - RNA, 20 nt, Salmonella enterica enterica serovar Typhi Ty2
cuuaucccagccgcgaugau

SEQ ID NO: 3720420 - RNA, 14 nt, Salmonella enterica enterica serovar Typhi Ty2
cuuaucccauugcg

SEQ ID NO: 3720421 - RNA, 19 nt, Salmonella enterica enterica serovar Typhi Ty2
cuuauccgcuuuuaaacgg

SEQ ID NO: 3720422 - RNA, 17 nt, Salmonella enterica enterica serovar Typhi Ty2
cuucauaggugaacaug

SEQ ID NO: 3720423 - RNA, 18 nt, Salmonella enterica enterica serovar Typhi Ty2
cuucauaggugaacauga

SEQ ID NO: 3720424 - RNA, 20 nt, Salmonella enterica enterica serovar Typhi Ty2
cuucauauuaaauuccggcu

SEQ ID NO: 3720425 - RNA, 19 nt, Salmonella enterica enterica serovar Typhi Ty2
cuucaucaaagaaauaccc

SEQ ID NO: 3720426 - RNA, 17 nt, Salmonella enterica enterica serovar Typhi Ty2
cuucaucaguaacugac

SEQ ID NO: 3720427 - RNA, 19 nt, Salmonella enterica enterica serovar Typhi Ty2
cuucaucaguaacugacga

SEQ ID NO: 3720428 - RNA, 14 nt, Salmonella enterica enterica serovar Typhi Ty2
cuucauccacgccg

SEQ ID NO: 3720429 - RNA, 15 nt, Salmonella enterica enterica serovar Typhi Ty2
cuucauccagauagg

SEQ ID NO: 3720430 - RNA, 15 nt, Salmonella enterica enterica serovar Typhi Ty2
cuucaucccacucaa

SEQ ID NO: 3720431 - RNA, 16 nt, Salmonella enterica enterica serovar Typhi Ty2
cuucaucgauggcgcc

SEQ ID NO: 3720432 - RNA, 14 nt, Salmonella enterica enterica serovar Typhi Ty2
cuucaucgcgccuc

SEQ ID NO: 3720433 - RNA, 17 nt, Salmonella enterica enterica serovar Typhi Ty2
cuucaucggauagauga

SEQ ID NO: 3720434 - RNA, 16 nt, Salmonella enterica enterica serovar Typhi Ty2
cuucaucguuacgcag

SEQ ID NO: 3720435 - RNA, 19 nt, Salmonella enterica enterica serovar Typhi Ty2
cuucaugaguaaaugaacg

SEQ ID NO: 3720436 - RNA, 21 nt, Salmonella enterica enterica serovar Typhi Ty2
cuucaugaguaaaugaacguu

SEQ ID NO: 3720437 - RNA, 14 nt, Salmonella enterica enterica serovar Typhi Ty2
cuucaugcagcccg

SEQ ID NO: 3720438 - RNA, 19 nt, Salmonella enterica enterica serovar Typhi Ty2
cuucaugugguaggcuuca

SEQ ID NO: 3720439 - RNA, 18 nt, Salmonella enterica enterica serovar Typhi Ty2
cuuccacacggcauucac

SEQ ID NO: 3720440 - RNA, 16 nt, Salmonella enterica enterica serovar Typhi Ty2
cuuccacccgcgcgcu

SEQ ID NO: 3720441 - RNA, 16 nt, Salmonella enterica enterica serovar Typhi Ty2
cuuccaccucuucugc

SEQ ID NO: 3720442 - RNA, 17 nt, Salmonella enterica enterica serovar Typhi Ty2
cuuccacgcacgccggc

SEQ ID NO: 3720443 - RNA, 14 nt, Salmonella enterica enterica serovar Typhi Ty2
cuuccacucguaac

SEQ ID NO: 3720444 - RNA, 12 nt, Salmonella enterica enterica serovar Typhi Ty2
cuuccacugcgg

SEQ ID NO: 3720445 - RNA, 21 nt, Salmonella enterica enterica serovar Typhi Ty2
cuuccagaacgcguacggcuu

SEQ ID NO: 3720446 - RNA, 23 nt, Salmonella enterica enterica serovar Typhi Ty2
cuuccagaauucguacguuuuuc

SEQ ID NO: 3720447 - RNA, 13 nt, Salmonella enterica enterica serovar Typhi Ty2
cuuccagcaaacc

SEQ ID NO: 3720448 - RNA, 15 nt, Salmonella enterica enterica serovar Typhi Ty2
cuuccagcaauucgu

SEQ ID NO: 3720449 - RNA, 14 nt, Salmonella enterica enterica serovar Typhi Ty2
cuuccagcaccgcg

SEQ ID NO: 3720450 - RNA, 13 nt, Salmonella enterica enterica serovar Typhi Ty2
cuuccagcagcca

SEQ ID NO: 3720451 - RNA, 15 nt, Salmonella enterica enterica serovar Typhi Ty2
cuuccagcagccagc

SEQ ID NO: 3720452 - RNA, 12 nt, Salmonella enterica enterica serovar Typhi Ty2
cuuccagcgcca

SEQ ID NO: 3720453 - RNA, 22 nt, Salmonella enterica enterica serovar Typhi Ty2
cuuccagcgcgccgucaucgcu

SEQ ID NO: 3720454 - RNA, 24 nt, Salmonella enterica enterica serovar Typhi Ty2
cuuccagcgcgccgucaucgcuca

SEQ ID NO: 3720455 - RNA, 18 nt, Salmonella enterica enterica serovar Typhi Ty2
cuuccagcgcguccagcc

SEQ ID NO: 3720456 - RNA, 20 nt, Salmonella enterica enterica serovar Typhi Ty2
cuuccagcgcguccagcccg

SEQ ID NO: 3720457 - RNA, 22 nt, Salmonella enterica enterica serovar Typhi Ty2
cuuccagcgcgucggccggcac

SEQ ID NO: 3720458 - RNA, 15 nt, Salmonella enterica enterica serovar Typhi Ty2
cuuccagcgucucca

SEQ ID NO: 3720459 - RNA, 12 nt, Salmonella enterica enterica serovar Typhi Ty2
cuuccagcucca

SEQ ID NO: 3720460 - RNA, 15 nt, Salmonella enterica enterica serovar Typhi Ty2
cuuccagcuccaucc

SEQ ID NO: 3720461 - RNA, 15 nt, Salmonella enterica enterica serovar Typhi Ty2
cuuccaguagccuau

SEQ ID NO: 3720462 - RNA, 16 nt, Salmonella enterica enterica serovar Typhi Ty2
cuuccaguccagcgcg

SEQ ID NO: 3720463 - RNA, 22 nt, Salmonella enterica enterica serovar Typhi Ty2
cuuccaguucgcugaggcguug

SEQ ID NO: 3720464 - RNA, 15 nt, Salmonella enterica enterica serovar Typhi Ty2
cuuccaucagccagg

SEQ ID NO: 3720465 - RNA, 15 nt, Salmonella enterica enterica serovar Typhi Ty2
cuuccauccauguga

SEQ ID NO: 3720466 - RNA, 20 nt, Salmonella enterica enterica serovar Typhi Ty2
cuuccccuguaacugcaccu

SEQ ID NO: 3720467 - RNA, 20 nt, Salmonella enterica enterica serovar Typhi Ty2
cuuccccuucacucuucgac

SEQ ID NO: 3720468 - RNA, 15 nt, Salmonella enterica enterica serovar Typhi Ty2
cuucccgacgcuggc

SEQ ID NO: 3720469 - RNA, 14 nt, Salmonella enterica enterica serovar Typhi Ty2
cuucccgcgauaaa

SEQ ID NO: 3720470 - RNA, 19 nt, Salmonella enterica enterica serovar Typhi Ty2
cuucccgcgcagugcagcg

SEQ ID NO: 3720471 - RNA, 16 nt, Salmonella enterica enterica serovar Typhi Ty2
cuucccggcaggcauu

SEQ ID NO: 3720472 - RNA, 19 nt, Salmonella enterica enterica serovar Typhi Ty2
cuucccggggaacagaagc

SEQ ID NO: 3720473 - RNA, 18 nt, Salmonella enterica enterica serovar Typhi Ty2
cuucccugaccagcgacg

SEQ ID NO: 3720474 - RNA, 17 nt, Salmonella enterica enterica serovar Typhi Ty2
cuucccugacgcgcagc

SEQ ID NO: 3720475 - RNA, 15 nt, Salmonella enterica enterica serovar Typhi Ty2
cuuccgccagcgcgu

SEQ ID NO: 3720476 - RNA, 21 nt, Salmonella enterica enterica serovar Typhi Ty2
cuuccggagacuaucuugccg

SEQ ID NO: 3720477 - RNA, 18 nt, Salmonella enterica enterica serovar Typhi Ty2
cuuccggauuaaagacgc

SEQ ID NO: 3720478 - RNA, 18 nt, Salmonella enterica enterica serovar Typhi Ty2
cuuccggcacucuucuuc

SEQ ID NO: 3720479 - RNA, 20 nt, Salmonella enterica enterica serovar Typhi Ty2
cuuccggcaucacaucgccg

SEQ ID NO: 3720480 - RNA, 18 nt, Salmonella enterica enterica serovar Typhi Ty2
cuuccggccacuccgcca

SEQ ID NO: 3720481 - RNA, 22 nt, Salmonella enterica enterica serovar Typhi Ty2
cuuccgggcgacgauacaacuc

SEQ ID NO: 3720482 - RNA, 20 nt, Salmonella enterica enterica serovar Typhi Ty2
cuuccggugugaccagcgcg

SEQ ID NO: 3720483 - RNA, 23 nt, Salmonella enterica enterica serovar Typhi Ty2
cuuccgucaaaaaaucgaccaac

SEQ ID NO: 3720484 - RNA, 15 nt, Salmonella enterica enterica serovar Typhi Ty2
cuuccgucagcgaau

SEQ ID NO: 3720485 - RNA, 14 nt, Salmonella enterica enterica serovar Typhi Ty2
cuuccguccccagc

SEQ ID NO: 3720486 - RNA, 18 nt, Salmonella enterica enterica serovar Typhi Ty2
cuuccguccccagcccau

SEQ ID NO: 3720487 - RNA, 22 nt, Salmonella enterica enterica serovar Typhi Ty2
cuuccucaauauugucuucguc

SEQ ID NO: 3720488 - RNA, 18 nt, Salmonella enterica enterica serovar Typhi Ty2
cuuccucacagccuugcc

SEQ ID NO: 3720489 - RNA, 19 nt, Salmonella enterica enterica serovar Typhi Ty2
cuuccucaccguagcucca

SEQ ID NO: 3720490 - RNA, 21 nt, Salmonella enterica enterica serovar Typhi Ty2
cuuccuccccaggcgcuauuc

SEQ ID NO: 3720491 - RNA, 16 nt, Salmonella enterica enterica serovar Typhi Ty2
cuuccugagcagacau

SEQ ID NO: 3720492 - RNA, 19 nt, Salmonella enterica enterica serovar Typhi Ty2
cuuccugcacgccugcuuc

SEQ ID NO: 3720493 - RNA, 21 nt, Salmonella enterica enterica serovar Typhi Ty2
cuuccugcgcgccaaaccguu

SEQ ID NO: 3720494 - RNA, 15 nt, Salmonella enterica enterica serovar Typhi Ty2
cuuccugcgucaggc

SEQ ID NO: 3720495 - RNA, 15 nt, Salmonella enterica enterica serovar Typhi Ty2
cuuccugcugcgcuu

SEQ ID NO: 3720496 - RNA, 21 nt, Salmonella enterica enterica serovar Typhi Ty2
cuuccuguacaaaaucaucau

SEQ ID NO: 3720497 - RNA, 23 nt, Salmonella enterica enterica serovar Typhi Ty2
cuuccuguacaaaaucaucauca

SEQ ID NO: 3720498 - RNA, 17 nt, Salmonella enterica enterica serovar Typhi Ty2
cuuccuguaucccaaac

SEQ ID NO: 3720499 - RNA, 18 nt, Salmonella enterica enterica serovar Typhi Ty2
cuuccuucguuacuuuca

SEQ ID NO: 3720500 - RNA, 15 nt, Salmonella enterica enterica serovar Typhi Ty2
cuuccuucuaccggc

SEQ ID NO: 3720501 - RNA, 16 nt, Salmonella enterica enterica serovar Typhi Ty2
cuuccuuuucaucugg

SEQ ID NO: 3720502 - RNA, 20 nt, Salmonella enterica enterica serovar Typhi Ty2
cuucgaauucuucgccgaag

SEQ ID NO: 3720503 - RNA, 18 nt, Salmonella enterica enterica serovar Typhi Ty2
cuucgacaaucagcacca

SEQ ID NO: 3720504 - RNA, 19 nt, Salmonella enterica enterica serovar Typhi Ty2
cuugauaaugucaacuuaa

SEQ ID NO: 3720505 - RNA, 13 nt, Salmonella enterica enterica serovar Typhi Ty2
cuugauacgccau

SEQ ID NO: 3720506 - RNA, 20 nt, Salmonella enterica enterica serovar Typhi Ty2
cuugauacgccaucuuucuu

SEQ ID NO: 3720507 - RNA, 16 nt, Salmonella enterica enterica serovar Typhi Ty2
cuugauacggcuuuca

SEQ ID NO: 3720508 - RNA, 19 nt, Salmonella enterica enterica serovar Typhi Ty2
cuugauccagcucgcgaua

SEQ ID NO: 3720509 - RNA, 17 nt, Salmonella enterica enterica serovar Typhi Ty2
cuugauccuguaacgca

SEQ ID NO: 3720510 - RNA, 16 nt, Salmonella enterica enterica serovar Typhi Ty2
cuugaucgcgcagcaa

SEQ ID NO: 3720511 - RNA, 15 nt, Salmonella enterica enterica serovar Typhi Ty2
cuugaucucucccug

SEQ ID NO: 3720512 - RNA, 20 nt, Salmonella enterica enterica serovar Typhi Ty2
cuugaugauacccccagaga

SEQ ID NO: 3720513 - RNA, 21 nt, Salmonella enterica enterica serovar Typhi Ty2
cuugauggcgaucagcgccac

SEQ ID NO: 3720514 - RNA, 19 nt, Salmonella enterica enterica serovar Typhi Ty2
cuugaugugucuauuuauu

SEQ ID NO: 3720515 - RNA, 12 nt, Salmonella enterica enterica serovar Typhi Ty2
cuugauuccugg

SEQ ID NO: 3720516 - RNA, 23 nt, Salmonella enterica enterica serovar Typhi Ty2
cuugcaaugaaaaauccccgcaa

SEQ ID NO: 3720517 - RNA, 18 nt, Salmonella enterica enterica serovar Typhi Ty2
cuugcacaauacuuuuug

SEQ ID NO: 3720518 - RNA, 15 nt, Salmonella enterica enterica serovar Typhi Ty2
cuugcaucucauaaa

SEQ ID NO: 3720519 - RNA, 14 nt, Salmonella enterica enterica serovar Typhi Ty2
cuugcaugaccauc

SEQ ID NO: 3720520 - RNA, 23 nt, Salmonella enterica enterica serovar Typhi Ty2
cuugcauuuuacguagccgcaga

SEQ ID NO: 3720521 - RNA, 19 nt, Salmonella enterica enterica serovar Typhi Ty2
cuugccacuacgcagcucc

SEQ ID NO: 3720522 - RNA, 13 nt, Salmonella enterica enterica serovar Typhi Ty2
cuugccagcgcau

SEQ ID NO: 3720523 - RNA, 21 nt, Salmonella enterica enterica serovar Typhi Ty2
cuugcccagcauauuaacagu

SEQ ID NO: 3720524 - RNA, 14 nt, Salmonella enterica enterica serovar Typhi Ty2
cuugcccagcgccu

SEQ ID NO: 3720525 - RNA, 18 nt, Salmonella enterica enterica serovar Typhi Ty2
cuugcccgcgccagaggc

SEQ ID NO: 3720526 - RNA, 17 nt, Salmonella enterica enterica serovar Typhi Ty2
cuugccgaauuuacugu

SEQ ID NO: 3720527 - RNA, 18 nt, Salmonella enterica enterica serovar Typhi Ty2
cuugccgaguggaaucag

SEQ ID NO: 3720528 - RNA, 21 nt, Salmonella enterica enterica serovar Typhi Ty2
cuugccgcaucuucgcccggc

SEQ ID NO: 3720529 - RNA, 23 nt, Salmonella enterica enterica serovar Typhi Ty2
cuugccgcaucuucgcccggcgu

SEQ ID NO: 3720530 - RNA, 15 nt, Salmonella enterica enterica serovar Typhi Ty2
cuugccgccagcgcg

SEQ ID NO: 3720531 - RNA, 20 nt, Salmonella enterica enterica serovar Typhi Ty2
cuugccgcgccagacgccau

SEQ ID NO: 3720532 - RNA, 18 nt, Salmonella enterica enterica serovar Typhi Ty2
cuugccgcuuccagucca

SEQ ID NO: 3720533 - RNA, 17 nt, Salmonella enterica enterica serovar Typhi Ty2
cuugccgggccuggcau

SEQ ID NO: 3720534 - RNA, 13 nt, Salmonella enterica enterica serovar Typhi Ty2
cuugccgucaaca

SEQ ID NO: 3720535 - RNA, 23 nt, Salmonella enterica enterica serovar Typhi Ty2
cuugccgucaacacgcagaccca

SEQ ID NO: 3720536 - RNA, 17 nt, Salmonella enterica enterica serovar Typhi Ty2
cuugccgugaaaacgaa

SEQ ID NO: 3720537 - RNA, 15 nt, Salmonella enterica enterica serovar Typhi Ty2
cuugccguuuuucuc

SEQ ID NO: 3720538 - RNA, 19 nt, Salmonella enterica enterica serovar Typhi Ty2
cuugccguuuuucucauca

SEQ ID NO: 3720539 - RNA, 18 nt, Salmonella enterica enterica serovar Typhi Ty2
cuugcgaccacuccggca

SEQ ID NO: 3720540 - RNA, 21 nt, Salmonella enterica enterica serovar Typhi Ty2
cuugcggaaagaagaauaagc

SEQ ID NO: 3720541 - RNA, 15 nt, Salmonella enterica enterica serovar Typhi Ty2
cuugcggcgccagga

SEQ ID NO: 3720542 - RNA, 18 nt, Salmonella enterica enterica serovar Typhi Ty2
cuugcggcgccaggacaa

SEQ ID NO: 3720543 - RNA, 19 nt, Salmonella enterica enterica serovar Typhi Ty2
cuugcugcggcacgaaaaa

SEQ ID NO: 3720544 - RNA, 15 nt, Salmonella enterica enterica serovar Typhi Ty2
cuugcugcugcugau

SEQ ID NO: 3720545 - RNA, 11 nt, Salmonella enterica enterica serovar Typhi Ty2
cuugcuuuauu

SEQ ID NO: 3720546 - RNA, 17 nt, Salmonella enterica enterica serovar Typhi Ty2
cuugcuuuucaucacca

SEQ ID NO: 3720547 - RNA, 18 nt, Salmonella enterica enterica serovar Typhi Ty2
cuugcuuuucaucaccau

SEQ ID NO: 3720548 - RNA, 21 nt, Salmonella enterica enterica serovar Typhi Ty2
cuuggagagcaucaucugcca

SEQ ID NO: 3720549 - RNA, 22 nt, Salmonella enterica enterica serovar Typhi Ty2
cuuggcagccccugaaauaaca

SEQ ID NO: 3720550 - RNA, 19 nt, Salmonella enterica enterica serovar Typhi Ty2
cuuggcguauagccgcccc

SEQ ID NO: 3720551 - RNA, 19 nt, Salmonella enterica enterica serovar Typhi Ty2
cuuggcguuaaagacgcca

SEQ ID NO: 3720552 - RNA, 18 nt, Salmonella enterica enterica serovar Typhi Ty2
cuugguaccaaacagcag

SEQ ID NO: 3720553 - RNA, 22 nt, Salmonella enterica enterica serovar Typhi Ty2
cuugguauggcgcuaacaccgc

SEQ ID NO: 3720554 - RNA, 12 nt, Salmonella enterica enterica serovar Typhi Ty2
cuuggucauaau

SEQ ID NO: 3720555 - RNA, 23 nt, Salmonella enterica enterica serovar Typhi Ty2
cuuguaagggaggugcucuccca

SEQ ID NO: 3720556 - RNA, 20 nt, Salmonella enterica enterica serovar Typhi Ty2
cuuguaggccugauagcaca

SEQ ID NO: 3720557 - RNA, 23 nt, Salmonella enterica enterica serovar Typhi Ty2
cuuguauuacguguaguuauaaa

SEQ ID NO: 3720558 - RNA, 13 nt, Salmonella enterica enterica serovar Typhi Ty2
cuugugacugaua

SEQ ID NO: 3720559 - RNA, 15 nt, Salmonella enterica enterica serovar Typhi Ty2
cuugugaugagcuca

SEQ ID NO: 3720560 - RNA, 15 nt, Salmonella enterica enterica serovar Typhi Ty2
cuugugcuuccagcu

SEQ ID NO: 3720561 - RNA, 16 nt, Salmonella enterica enterica serovar Typhi Ty2
cuugugcuuccagcuc

SEQ ID NO: 3720562 - RNA, 22 nt, Salmonella enterica enterica serovar Typhi Ty2
cuugugcuuccagcuccaucca

SEQ ID NO: 3720563 - RNA, 23 nt, Salmonella enterica enterica serovar Typhi Ty2
cuuguguggagguuucuucauca

SEQ ID NO: 3720564 - RNA, 20 nt, Salmonella enterica enterica serovar Typhi Ty2
cuuguuauccaucagccagg

SEQ ID NO: 3720565 - RNA, 24 nt, Salmonella enterica enterica serovar Typhi Ty2
cuuguuauccuaaaucugccauca

SEQ ID NO: 3720566 - RNA, 14 nt, Salmonella enterica enterica serovar Typhi Ty2
cuuguucgcagguc

SEQ ID NO: 3720567 - RNA, 15 nt, Salmonella enterica enterica serovar Typhi Ty2
cuuguucuuccauug

SEQ ID NO: 3720568 - RNA, 13 nt, Salmonella enterica enterica serovar Typhi Ty2
cuuguucuuuuca

SEQ ID NO: 3720569 - RNA, 19 nt, Salmonella enterica enterica serovar Typhi Ty2
cuuguuucaucgucagcuc

SEQ ID NO: 3720570 - RNA, 16 nt, Salmonella enterica enterica serovar Typhi Ty2
cuuuaaagcccagcac

SEQ ID NO: 3720571 - RNA, 15 nt, Salmonella enterica enterica serovar Typhi Ty2
cuuuaacaauuuauc

SEQ ID NO: 3720572 - RNA, 14 nt, Salmonella enterica enterica serovar Typhi Ty2
cuuuaaccacagcc

SEQ ID NO: 3720573 - RNA, 13 nt, Salmonella enterica enterica serovar Typhi Ty2
cuuuaaccucuuu

SEQ ID NO: 3720574 - RNA, 22 nt, Salmonella enterica enterica serovar Typhi Ty2
cuuuaagaugccggagcgaugu

SEQ ID NO: 3720575 - RNA, 20 nt, Salmonella enterica enterica serovar Typhi Ty2
cuuuaagccgauugaauaau

SEQ ID NO: 3720576 - RNA, 22 nt, Salmonella enterica enterica serovar Typhi Ty2
cuuuaaugcccgguauuuuuuc

SEQ ID NO: 3720577 - RNA, 13 nt, Salmonella enterica enterica serovar Typhi Ty2
cuuuacaccccac

SEQ ID NO: 3720578 - RNA, 19 nt, Salmonella enterica enterica serovar Typhi Ty2
cuuuacccgggccaucuuu

SEQ ID NO: 3720579 - RNA, 14 nt, Salmonella enterica enterica serovar Typhi Ty2
cuuuaccgugaaug

SEQ ID NO: 3720580 - RNA, 23 nt, Salmonella enterica enterica serovar Typhi Ty2
cuuuacgcagauaacuuccuuug

SEQ ID NO: 3720581 - RNA, 15 nt, Salmonella enterica enterica serovar Typhi Ty2
cuuuacgcagcaaga

SEQ ID NO: 3720582 - RNA, 19 nt, Salmonella enterica enterica serovar Typhi Ty2
cuuuacuaauaccuggaau

SEQ ID NO: 3720583 - RNA, 17 nt, Salmonella enterica enterica serovar Typhi Ty2
cuuuacuucuuugcgau

SEQ ID NO: 3720584 - RNA, 20 nt, Salmonella enterica enterica serovar Typhi Ty2
cuuuagaaaaagaaaccucc

SEQ ID NO: 3720585 - RNA, 20 nt, Salmonella enterica enterica serovar Typhi Ty2
cuuuaggcggcgccgcgccg

SEQ ID NO: 3720586 - RNA, 18 nt, Salmonella enterica enterica serovar Typhi Ty2
cuuugcacguucugcugg

SEQ ID NO: 3720587 - RNA, 20 nt, Salmonella enterica enterica serovar Typhi Ty2
cuuugcccgagcgcuggcau

SEQ ID NO: 3720588 - RNA, 23 nt, Salmonella enterica enterica serovar Typhi Ty2
cuuugccgcaaacgccgaagcca

SEQ ID NO: 3720589 - RNA, 16 nt, Salmonella enterica enterica serovar Typhi Ty2
cuuugccgcugcugcc

SEQ ID NO: 3720590 - RNA, 22 nt, Salmonella enterica enterica serovar Typhi Ty2
cuuugccguucucugacaaaau

SEQ ID NO: 3720591 - RNA, 19 nt, Salmonella enterica enterica serovar Typhi Ty2
cuuugccuucuguuuuuug

SEQ ID NO: 3720592 - RNA, 13 nt, Salmonella enterica enterica serovar Typhi Ty2
cuuugccuuucuu

SEQ ID NO: 3720593 - RNA, 18 nt, Salmonella enterica enterica serovar Typhi Ty2
cuuugcgauagcccggca

SEQ ID NO: 3720594 - RNA, 19 nt, Salmonella enterica enterica serovar Typhi Ty2
cuuugcgauagcccggcau

SEQ ID NO: 3720595 - RNA, 20 nt, Salmonella enterica enterica serovar Typhi Ty2
cuuugcgccauuucaauaau

SEQ ID NO: 3720596 - RNA, 21 nt, Salmonella enterica enterica serovar Typhi Ty2
cuuugcgcucaugcgccuggc

SEQ ID NO: 3720597 - RNA, 12 nt, Salmonella enterica enterica serovar Typhi Ty2
cuuugcucuccu

SEQ ID NO: 3720598 - RNA, 14 nt, Salmonella enterica enterica serovar Typhi Ty2
cuuugcugacgcca

SEQ ID NO: 3720599 - RNA, 16 nt, Salmonella enterica enterica serovar Typhi Ty2
cuuugcuuauccggcc

SEQ ID NO: 3720600 - RNA, 14 nt, Salmonella enterica enterica serovar Typhi Ty2
cuuugcuuuguagc

SEQ ID NO: 3720601 - RNA, 17 nt, Salmonella enterica enterica serovar Typhi Ty2
cuuuggacggcaucagg

SEQ ID NO: 3720602 - RNA, 19 nt, Salmonella enterica enterica serovar Typhi Ty2
cuuuggacggcaucaggaa

SEQ ID NO: 3720603 - RNA, 18 nt, Salmonella enterica enterica serovar Typhi Ty2
cuuuggcaaacggcgcca

SEQ ID NO: 3720604 - RNA, 22 nt, Salmonella enterica enterica serovar Typhi Ty2
cuuuggcaggccucuaucuucu

SEQ ID NO: 3720605 - RNA, 23 nt, Salmonella enterica enterica serovar Typhi Ty2
cuuuggccuggagaucagcaugg

SEQ ID NO: 3720606 - RNA, 14 nt, Salmonella enterica enterica serovar Typhi Ty2
cuuuggcgcccauu

SEQ ID NO: 3720607 - RNA, 21 nt, Salmonella enterica enterica serovar Typhi Ty2
cuuuggcgcgcgguuuauccc

SEQ ID NO: 3720608 - RNA, 18 nt, Salmonella enterica enterica serovar Typhi Ty2
cuuuggcuguccagccgc

SEQ ID NO: 3720609 - RNA, 21 nt, Salmonella enterica enterica serovar Typhi Ty2
cuuuggcuuaaucauugcuca

SEQ ID NO: 3720610 - RNA, 19 nt, Salmonella enterica enterica serovar Typhi Ty2
cuuugggccggauacguca

SEQ ID NO: 3720611 - RNA, 14 nt, Salmonella enterica enterica serovar Typhi Ty2
cuuugucaccggag

SEQ ID NO: 3720612 - RNA, 22 nt, Salmonella enterica enterica serovar Typhi Ty2
cuuugucaccggaguuaccauc

SEQ ID NO: 3720613 - RNA, 18 nt, Salmonella enterica enterica serovar Typhi Ty2
cuuugucauccaccagaa

SEQ ID NO: 3720614 - RNA, 14 nt, Salmonella enterica enterica serovar Typhi Ty2
cuuuguccugaagg

SEQ ID NO: 3720615 - RNA, 21 nt, Salmonella enterica enterica serovar Typhi Ty2
cuuugugaucugguuugguaa

SEQ ID NO: 3720616 - RNA, 16 nt, Salmonella enterica enterica serovar Typhi Ty2
cuuugugcaggaucaa

SEQ ID NO: 3720617 - RNA, 18 nt, Salmonella enterica enterica serovar Typhi Ty2
cuuuuaaagacuuugaug

SEQ ID NO: 3720618 - RNA, 14 nt, Salmonella enterica enterica serovar Typhi Ty2
cuuuuaacaaaucg

SEQ ID NO: 3720619 - RNA, 22 nt, Salmonella enterica enterica serovar Typhi Ty2
cuuuuaacaaaucgacagccag

SEQ ID NO: 3720620 - RNA, 23 nt, Salmonella enterica enterica serovar Typhi Ty2
cuuuuaacaaaucgacagccagc

SEQ ID NO: 3720621 - RNA, 23 nt, Salmonella enterica enterica serovar Typhi Ty2
cuuuuaacauaagugauacaugc

SEQ ID NO: 3720622 - RNA, 23 nt, Salmonella enterica enterica serovar Typhi Ty2
cuuuuaaccacgcaaucucuucc

SEQ ID NO: 3720623 - RNA, 19 nt, Salmonella enterica enterica serovar Typhi Ty2
cuuuuaaggcggcaaagau

SEQ ID NO: 3720624 - RNA, 21 nt, Salmonella enterica enterica serovar Typhi Ty2
cuuuuaaggcggcaaagauaa

SEQ ID NO: 3720625 - RNA, 17 nt, Salmonella enterica enterica serovar Typhi Ty2
cuuuuaagguuaauucu

SEQ ID NO: 3720626 - RNA, 21 nt, Salmonella enterica enterica serovar Typhi Ty2
cuuuuaauagcguagccugca

SEQ ID NO: 3720627 - RNA, 15 nt, Salmonella enterica enterica serovar Typhi Ty2
cuuuuaauuuuuaug

SEQ ID NO: 3720628 - RNA, 16 nt, Salmonella enterica enterica serovar Typhi Ty2
cuuuuacccuucaugu

SEQ ID NO: 3720629 - RNA, 21 nt, Salmonella enterica enterica serovar Typhi Ty2
cuuuuacgaucgccaccgcau

SEQ ID NO: 3720630 - RNA, 21 nt, Salmonella enterica enterica serovar Typhi Ty2
cuuuuacucuuccugcugcgc

SEQ ID NO: 3720631 - RNA, 12 nt, Salmonella enterica enterica serovar Typhi Ty2
cuuuuacugccc

SEQ ID NO: 3720632 - RNA, 19 nt, Salmonella enterica enterica serovar Typhi Ty2
cuuuuagaauuaucugaaa

SEQ ID NO: 3720633 - RNA, 21 nt, Salmonella enterica enterica serovar Typhi Ty2
cuuuuaggcugaaagcgccuu

SEQ ID NO: 3720634 - RNA, 21 nt, Salmonella enterica enterica serovar Typhi Ty2
cuuuucaagaauuacaucaau

SEQ ID NO: 3720635 - RNA, 21 nt, Salmonella enterica enterica serovar Typhi Ty2
cuuuucacccaacauuuuuag

SEQ ID NO: 3720636 - RNA, 18 nt, Salmonella enterica enterica serovar Typhi Ty2
cuuuucacgcauugccac

SEQ ID NO: 3720637 - RNA, 21 nt, Salmonella enterica enterica serovar Typhi Ty2
cuuuucagcccaggcuuuagu

SEQ ID NO: 3720638 - RNA, 18 nt, Salmonella enterica enterica serovar Typhi Ty2
cuuuucaggcgcugucug

SEQ ID NO: 3720639 - RNA, 22 nt, Salmonella enterica enterica serovar Typhi Ty2
cuuuucaucaccaucugaccgu

SEQ ID NO: 3720640 - RNA, 17 nt, Salmonella enterica enterica serovar Typhi Ty2
cuuuuccagcacgccca

SEQ ID NO: 3720641 - RNA, 11 nt, Salmonella enterica enterica serovar Typhi Ty2
cuuuuccagcc

SEQ ID NO: 3720642 - RNA, 17 nt, Salmonella enterica enterica serovar Typhi Ty2
cuuuuccaggcgaccag

SEQ ID NO: 3720643 - RNA, 23 nt, Salmonella enterica enterica serovar Typhi Ty2
cuuuuccaguaagaucaccuucu

SEQ ID NO: 3720644 - RNA, 20 nt, Salmonella enterica enterica serovar Typhi Ty2
cuuuucccguaaugcccagg

SEQ ID NO: 3720645 - RNA, 14 nt, Salmonella enterica enterica serovar Typhi Ty2
cuuuuccggcaccu

SEQ ID NO: 3720646 - RNA, 19 nt, Salmonella enterica enterica serovar Typhi Ty2
cuuuuccucgucauaucug

SEQ ID NO: 3720647 - RNA, 14 nt, Salmonella enterica enterica serovar Typhi Ty2
cuuuuccugccagc

SEQ ID NO: 3720648 - RNA, 14 nt, Salmonella enterica enterica serovar Typhi Ty2
cuuuuccugcugcc

SEQ ID NO: 3720649 - RNA, 15 nt, Salmonella enterica enterica serovar Typhi Ty2
cuuuuccugcugcca

SEQ ID NO: 3720650 - RNA, 18 nt, Salmonella enterica enterica serovar Typhi Ty2
cuuuuccuuccagcgcau

SEQ ID NO: 3720651 - RNA, 22 nt, Salmonella enterica enterica serovar Typhi Ty2
cuuuucgcaauagggggugaca

SEQ ID NO: 3720652 - RNA, 14 nt, Salmonella enterica enterica serovar Typhi Ty2
cuuuucgggcacug

SEQ ID NO: 3720653 - RNA, 17 nt, Salmonella enterica enterica serovar Typhi Ty2
cuuuucggguguccacu

SEQ ID NO: 3720654 - RNA, 18 nt, Salmonella enterica enterica serovar Typhi Ty2
cuuuucggguguccacuc

SEQ ID NO: 3720655 - RNA, 14 nt, Salmonella enterica enterica serovar Typhi Ty2
cuuuucuagccaau

SEQ ID NO: 3720656 - RNA, 23 nt, Salmonella enterica enterica serovar Typhi Ty2
cuuuucucucucguucccgccug

SEQ ID NO: 3720657 - RNA, 23 nt, Salmonella enterica enterica serovar Typhi Ty2
cuuuucuuuaaacaacgccauaa

SEQ ID NO: 3720658 - RNA, 18 nt, Salmonella enterica enterica serovar Typhi Ty2
cuuuucuuucagcucuuc

SEQ ID NO: 3720659 - RNA, 15 nt, Salmonella enterica enterica serovar Typhi Ty2
cuuuucuuuccugca

SEQ ID NO: 3720660 - RNA, 12 nt, Salmonella enterica enterica serovar Typhi Ty2
cuuuugagcagc

SEQ ID NO: 3720661 - RNA, 14 nt, Salmonella enterica enterica serovar Typhi Ty2
cuuuugauacucug

SEQ ID NO: 3720662 - RNA, 22 nt, Salmonella enterica enterica serovar Typhi Ty2
cuuuugcccgguggcgcugcgc

SEQ ID NO: 3720663 - RNA, 23 nt, Salmonella enterica enterica serovar Typhi Ty2
cuuuugccgcgacuuccgucucc

SEQ ID NO: 3720664 - RNA, 13 nt, Salmonella enterica enterica serovar Typhi Ty2
cuuuugccgcgcc

SEQ ID NO: 3720665 - RNA, 16 nt, Salmonella enterica enterica serovar Typhi Ty2
cuuuugcgccuuccag

SEQ ID NO: 3720666 - RNA, 20 nt, Salmonella enterica enterica serovar Typhi Ty2
cuuuugcgcguuccccaaca

SEQ ID NO: 3720667 - RNA, 22 nt, Salmonella enterica enterica serovar Typhi Ty2
gaaaaucagugaacacccugcc

SEQ ID NO: 3720668 - RNA, 20 nt, Salmonella enterica enterica serovar Typhi Ty2
gaaaaucugcgccaaucgcg

SEQ ID NO: 3720669 - RNA, 20 nt, Salmonella enterica enterica serovar Typhi Ty2
gaaaaugagagacggagaaa

SEQ ID NO: 3720670 - RNA, 23 nt, Salmonella enterica enterica serovar Typhi Ty2
gaaaaugccagcgauuauuucau

SEQ ID NO: 3720671 - RNA, 16 nt, Salmonella enterica enterica serovar Typhi Ty2
gaaaaugguuuugccc

SEQ ID NO: 3720672 - RNA, 14 nt, Salmonella enterica enterica serovar Typhi Ty2
gaaaaugugcaaag

SEQ ID NO: 3720673 - RNA, 23 nt, Salmonella enterica enterica serovar Typhi Ty2
gaaaauuaaucccaacccgacca

SEQ ID NO: 3720674 - RNA, 15 nt, Salmonella enterica enterica serovar Typhi Ty2
gaaaauuccuggauu

SEQ ID NO: 3720675 - RNA, 21 nt, Salmonella enterica enterica serovar Typhi Ty2
gaaaauuguccacggggcggc

SEQ ID NO: 3720676 - RNA, 22 nt, Salmonella enterica enterica serovar Typhi Ty2
gaaaauuguccacggggcggca

SEQ ID NO: 3720677 - RNA, 22 nt, Salmonella enterica enterica serovar Typhi Ty2
gaaacaacacgaucgaugcccu

SEQ ID NO: 3720678 - RNA, 15 nt, Salmonella enterica enterica serovar Typhi Ty2
gaaacaagcggcggc

SEQ ID NO: 3720679 - RNA, 17 nt, Salmonella enterica enterica serovar Typhi Ty2
gaaacaauagcugugag

SEQ ID NO: 3720680 - RNA, 16 nt, Salmonella enterica enterica serovar Typhi Ty2
gaaacaggaaaaacau

SEQ ID NO: 3720681 - RNA, 13 nt, Salmonella enterica enterica serovar Typhi Ty2
gaaacauacuguc

SEQ ID NO: 3720682 - RNA, 14 nt, Salmonella enterica enterica serovar Typhi Ty2
gaaacauauauauc

SEQ ID NO: 3720683 - RNA, 19 nt, Salmonella enterica enterica serovar Typhi Ty2
gaaaccagauacccuuuau

SEQ ID NO: 3720684 - RNA, 22 nt, Salmonella enterica enterica serovar Typhi Ty2
gaaaccccaaaucagcaaaaac

SEQ ID NO: 3720685 - RNA, 16 nt, Salmonella enterica enterica serovar Typhi Ty2
gaaacccgccaccgcc

SEQ ID NO: 3720686 - RNA, 17 nt, Salmonella enterica enterica serovar Typhi Ty2
gaaacccgcucgcccgc

SEQ ID NO: 3720687 - RNA, 14 nt, Salmonella enterica enterica serovar Typhi Ty2
gaaaccgauuuccu

SEQ ID NO: 3720688 - RNA, 16 nt, Salmonella enterica enterica serovar Typhi Ty2
gaaaccgcagaaaaag

SEQ ID NO: 3720689 - RNA, 18 nt, Salmonella enterica enterica serovar Typhi Ty2
gaaaccgcucgccgccuc

SEQ ID NO: 3720690 - RNA, 16 nt, Salmonella enterica enterica serovar Typhi Ty2
gaaaccggccgccauc

SEQ ID NO: 3720691 - RNA, 21 nt, Salmonella enterica enterica serovar Typhi Ty2
gaaaccggcgcgccuuccagc

SEQ ID NO: 3720692 - RNA, 15 nt, Salmonella enterica enterica serovar Typhi Ty2
gaaacgacugguaau

SEQ ID NO: 3720693 - RNA, 18 nt, Salmonella enterica enterica serovar Typhi Ty2
gaaacgacugguaauguc

SEQ ID NO: 3720694 - RNA, 18 nt, Salmonella enterica enterica serovar Typhi Ty2
gaaacgcacccgcgcagg

SEQ ID NO: 3720695 - RNA, 20 nt, Salmonella enterica enterica serovar Typhi Ty2
gaaacgcauacgcaggacuu

SEQ ID NO: 3720696 - RNA, 21 nt, Salmonella enterica enterica serovar Typhi Ty2
gaaacgcgccacgcgccagcc

SEQ ID NO: 3720697 - RNA, 17 nt, Salmonella enterica enterica serovar Typhi Ty2
gaaacgcggcguagccg

SEQ ID NO: 3720698 - RNA, 15 nt, Salmonella enterica enterica serovar Typhi Ty2
gaaacggcggaacca

SEQ ID NO: 3720699 - RNA, 20 nt, Salmonella enterica enterica serovar Typhi Ty2
gaaacgguuaaaaacagcca

SEQ ID NO: 3720700 - RNA, 16 nt, Salmonella enterica enterica serovar Typhi Ty2
gaaacguccccugcgg

SEQ ID NO: 3720701 - RNA, 16 nt, Salmonella enterica enterica serovar Typhi Ty2
gaaacguguuuauccc

SEQ ID NO: 3720702 - RNA, 14 nt, Salmonella enterica enterica serovar Typhi Ty2
gaaacucagcggcc

SEQ ID NO: 3720703 - RNA, 19 nt, Salmonella enterica enterica serovar Typhi Ty2
gaaacuccuccgggaaaac

SEQ ID NO: 3720704 - RNA, 21 nt, Salmonella enterica enterica serovar Typhi Ty2
gaaacuccuccgggaaaacau

SEQ ID NO: 3720705 - RNA, 21 nt, Salmonella enterica enterica serovar Typhi Ty2
gaaacucgacgggaaucuccg

SEQ ID NO: 3720706 - RNA, 22 nt, Salmonella enterica enterica serovar Typhi Ty2
gaaacucgccaugccaucggcc

SEQ ID NO: 3720707 - RNA, 18 nt, Salmonella enterica enterica serovar Typhi Ty2
gaaacugcauaucgccgc

SEQ ID NO: 3720708 - RNA, 17 nt, Salmonella enterica enterica serovar Typhi Ty2
gaaacuggcgucauguu

SEQ ID NO: 3720709 - RNA, 11 nt, Salmonella enterica enterica serovar Typhi Ty2
gaaagaaaauu

SEQ ID NO: 3720710 - RNA, 15 nt, Salmonella enterica enterica serovar Typhi Ty2
gaaagaagaaaccau

SEQ ID NO: 3720711 - RNA, 11 nt, Salmonella enterica enterica serovar Typhi Ty2
gaaagagaaag

SEQ ID NO: 3720712 - RNA, 20 nt, Salmonella enterica enterica serovar Typhi Ty2
gaaagaucaaacaggcgaaa

SEQ ID NO: 3720713 - RNA, 23 nt, Salmonella enterica enterica serovar Typhi Ty2
gaaagaucagcagaacaaaggcu

SEQ ID NO: 3720714 - RNA, 21 nt, Salmonella enterica enterica serovar Typhi Ty2
gaaagauuacuucaggcugcc

SEQ ID NO: 3720715 - RNA, 21 nt, Salmonella enterica enterica serovar Typhi Ty2
gaaagauuucaucaggcugac

SEQ ID NO: 3720716 - RNA, 14 nt, Salmonella enterica enterica serovar Typhi Ty2
gaaagcaacagcaa

SEQ ID NO: 3720717 - RNA, 14 nt, Salmonella enterica enterica serovar Typhi Ty2
gaaagcaauacugu

SEQ ID NO: 3720718 - RNA, 15 nt, Salmonella enterica enterica serovar Typhi Ty2
gaaagcaauacugua

SEQ ID NO: 3720719 - RNA, 22 nt, Salmonella enterica enterica serovar Typhi Ty2
gaaagcacuucucgcgcaucag

SEQ ID NO: 3720720 - RNA, 14 nt, Salmonella enterica enterica serovar Typhi Ty2
gaaagcagguuuug

SEQ ID NO: 3720721 - RNA, 18 nt, Salmonella enterica enterica serovar Typhi Ty2
gaaagccccggcucaagc

SEQ ID NO: 3720722 - RNA, 15 nt, Salmonella enterica enterica serovar Typhi Ty2
gaaagccucuuccgc

SEQ ID NO: 3720723 - RNA, 17 nt, Salmonella enterica enterica serovar Typhi Ty2
gaaagcggcgaauauag

SEQ ID NO: 3720724 - RNA, 20 nt, Salmonella enterica enterica serovar Typhi Ty2
gaaagcuguacuuugccggg

SEQ ID NO: 3720725 - RNA, 21 nt, Salmonella enterica enterica serovar Typhi Ty2
gaaagcuguacuuugccgggg

SEQ ID NO: 3720726 - RNA, 14 nt, Salmonella enterica enterica serovar Typhi Ty2
gaaaggaagcgggc

SEQ ID NO: 3720727 - RNA, 13 nt, Salmonella enterica enterica serovar Typhi Ty2
gaaaggcuugcag

SEQ ID NO: 3720728 - RNA, 19 nt, Salmonella enterica enterica serovar Typhi Ty2
gaaaggcuugcaggauguc

SEQ ID NO: 3720729 - RNA, 23 nt, Salmonella enterica enterica serovar Typhi Ty2
gaaaggggagggcaacaaacaua

SEQ ID NO: 3720730 - RNA, 17 nt, Salmonella enterica enterica serovar Typhi Ty2
gaaagggugcccgccug

SEQ ID NO: 3720731 - RNA, 15 nt, Salmonella enterica enterica serovar Typhi Ty2
gaaagguaaaugcca

SEQ ID NO: 3720732 - RNA, 22 nt, Salmonella enterica enterica serovar Typhi Ty2
gaaaguaccaaaacagaaaaga

SEQ ID NO: 3720733 - RNA, 23 nt, Salmonella enterica enterica serovar Typhi Ty2
gaaaguaccaaaacagaaaagau

SEQ ID NO: 3720734 - RNA, 21 nt, Salmonella enterica enterica serovar Typhi Ty2
gaaaguaggcgguuucaucga

SEQ ID NO: 3720735 - RNA, 21 nt, Salmonella enterica enterica serovar Typhi Ty2
gaaagucuucccgcaaacugg

SEQ ID NO: 3720736 - RNA, 19 nt, Salmonella enterica enterica serovar Typhi Ty2
gaaagugggcgcuuuguua

SEQ ID NO: 3720737 - RNA, 15 nt, Salmonella enterica enterica serovar Typhi Ty2
gaaagugggucacau

SEQ ID NO: 3720738 - RNA, 13 nt, Salmonella enterica enterica serovar Typhi Ty2
gaaaguggugggu

SEQ ID NO: 3720739 - RNA, 21 nt, Salmonella enterica enterica serovar Typhi Ty2
gaaaguggugggugaugacgg

SEQ ID NO: 3720740 - RNA, 23 nt, Salmonella enterica enterica serovar Typhi Ty2
gaaaguuacuuuccauauacucu

SEQ ID NO: 3720741 - RNA, 24 nt, Salmonella enterica enterica serovar Typhi Ty2
gaaaguuacuuuccauauacucuu

SEQ ID NO: 3720742 - RNA, 14 nt, Salmonella enterica enterica serovar Typhi Ty2
gaaaguuucaggau

SEQ ID NO: 3720743 - RNA, 14 nt, Salmonella enterica enterica serovar Typhi Ty2
gaaaguuugaagug

SEQ ID NO: 3720744 - RNA, 22 nt, Salmonella enterica enterica serovar Typhi Ty2
gaaauaaauauguuauuuacaa

SEQ ID NO: 3720745 - RNA, 17 nt, Salmonella enterica enterica serovar Typhi Ty2
gaaauaacgcacuacca

SEQ ID NO: 3720746 - RNA, 19 nt, Salmonella enterica enterica serovar Typhi Ty2
gaaauagacgagcgaaaaa

SEQ ID NO: 3720747 - RNA, 15 nt, Salmonella enterica enterica serovar Typhi Ty2
gaaauaggggagacu

SEQ ID NO: 3720748 - RNA, 18 nt, Salmonella enterica enterica serovar Typhi Ty2
gaaccaacugccaaacca

SEQ ID NO: 3720749 - RNA, 16 nt, Salmonella enterica enterica serovar Typhi Ty2
gaaccacauagaguga

SEQ ID NO: 3720750 - RNA, 18 nt, Salmonella enterica enterica serovar Typhi Ty2
gaaccacgcaaaggcguu

SEQ ID NO: 3720751 - RNA, 15 nt, Salmonella enterica enterica serovar Typhi Ty2
gaaccagcaucccac

SEQ ID NO: 3720752 - RNA, 13 nt, Salmonella enterica enterica serovar Typhi Ty2
gaaccagcggcac

SEQ ID NO: 3720753 - RNA, 21 nt, Salmonella enterica enterica serovar Typhi Ty2
gaaccagcggcaccagcacga

SEQ ID NO: 3720754 - RNA, 13 nt, Salmonella enterica enterica serovar Typhi Ty2
gaaccauaauaaa

SEQ ID NO: 3720755 - RNA, 18 nt, Salmonella enterica enterica serovar Typhi Ty2
gaaccaucauuaauauaa

SEQ ID NO: 3720756 - RNA, 22 nt, Salmonella enterica enterica serovar Typhi Ty2
gaaccaucauuaauauaauccu

SEQ ID NO: 3720757 - RNA, 12 nt, Salmonella enterica enterica serovar Typhi Ty2
gaaccaucggca

SEQ ID NO: 3720758 - RNA, 18 nt, Salmonella enterica enterica serovar Typhi Ty2
gaaccauggcaacaugga

SEQ ID NO: 3720759 - RNA, 23 nt, Salmonella enterica enterica serovar Typhi Ty2
gaaccauuuccucugcggacggc

SEQ ID NO: 3720760 - RNA, 14 nt, Salmonella enterica enterica serovar Typhi Ty2
gaacccaucaggga

SEQ ID NO: 3720761 - RNA, 13 nt, Salmonella enterica enterica serovar Typhi Ty2
gaaccgacggugc

SEQ ID NO: 3720762 - RNA, 13 nt, Salmonella enterica enterica serovar Typhi Ty2
gaaccgccgaccc

SEQ ID NO: 3720763 - RNA, 18 nt, Salmonella enterica enterica serovar Typhi Ty2
gaaccgccgacccccucc

SEQ ID NO: 3720764 - RNA, 12 nt, Salmonella enterica enterica serovar Typhi Ty2
gaaccggaccag

SEQ ID NO: 3720765 - RNA, 15 nt, Salmonella enterica enterica serovar Typhi Ty2
gaaccggcaucggca

SEQ ID NO: 3720766 - RNA, 20 nt, Salmonella enterica enterica serovar Typhi Ty2
gaaccggguauugaauccau

SEQ ID NO: 3720767 - RNA, 18 nt, Salmonella enterica enterica serovar Typhi Ty2
gaaccguaaacgccugca

SEQ ID NO: 3720768 - RNA, 19 nt, Salmonella enterica enterica serovar Typhi Ty2
gaaccguaaacgccugcac

SEQ ID NO: 3720769 - RNA, 13 nt, Salmonella enterica enterica serovar Typhi Ty2
gaaccgucaucag

SEQ ID NO: 3720770 - RNA, 14 nt, Salmonella enterica enterica serovar Typhi Ty2
gaaccgucaucagc

SEQ ID NO: 3720771 - RNA, 18 nt, Salmonella enterica enterica serovar Typhi Ty2
gaaccguucagaauagcg

SEQ ID NO: 3720772 - RNA, 22 nt, Salmonella enterica enterica serovar Typhi Ty2
gaaccguugcgcccaucaucau

SEQ ID NO: 3720773 - RNA, 22 nt, Salmonella enterica enterica serovar Typhi Ty2
gaaccucaccguccgccaggcc

SEQ ID NO: 3720774 - RNA, 22 nt, Salmonella enterica enterica serovar Typhi Ty2
gaaccuggcagaaaggugaaaa

SEQ ID NO: 3720775 - RNA, 16 nt, Salmonella enterica enterica serovar Typhi Ty2
gaaccuguucaugcca

SEQ ID NO: 3720776 - RNA, 13 nt, Salmonella enterica enterica serovar Typhi Ty2
gaaccuucacgcu

SEQ ID NO: 3720777 - RNA, 19 nt, Salmonella enterica enterica serovar Typhi Ty2
gaacgcacuuaaugcaaug

SEQ ID NO: 3720778 - RNA, 17 nt, Salmonella enterica enterica serovar Typhi Ty2
gaacgcauccagccacg

SEQ ID NO: 3720779 - RNA, 12 nt, Salmonella enterica enterica serovar Typhi Ty2
gaacgccaggcc

SEQ ID NO: 3720780 - RNA, 17 nt, Salmonella enterica enterica serovar Typhi Ty2
gaacgccgcuagcggcg

SEQ ID NO: 3720781 - RNA, 16 nt, Salmonella enterica enterica serovar Typhi Ty2
gaacgccuuauccggc

SEQ ID NO: 3720782 - RNA, 15 nt, Salmonella enterica enterica serovar Typhi Ty2
gaacgcgagaagccc

SEQ ID NO: 3720783 - RNA, 18 nt, Salmonella enterica enterica serovar Typhi Ty2
gaacgcuggcggcaggcc

SEQ ID NO: 3720784 - RNA, 18 nt, Salmonella enterica enterica serovar Typhi Ty2
gaacgcugguuucggcau

SEQ ID NO: 3720785 - RNA, 19 nt, Salmonella enterica enterica serovar Typhi Ty2
gaacggaucaugguugaaa

SEQ ID NO: 3720786 - RNA, 20 nt, Salmonella enterica enterica serovar Typhi Ty2
gaacggcaccggaaccggca

SEQ ID NO: 3720787 - RNA, 18 nt, Salmonella enterica enterica serovar Typhi Ty2
gaacggcuaggguggcgc

SEQ ID NO: 3720788 - RNA, 21 nt, Salmonella enterica enterica serovar Typhi Ty2
gaacggcuuuccagcagccag

SEQ ID NO: 3720789 - RNA, 23 nt, Salmonella enterica enterica serovar Typhi Ty2
gaacggcuuuccagcagccagaa

SEQ ID NO: 3720790 - RNA, 22 nt, Salmonella enterica enterica serovar Typhi Ty2
gaacggguaaaugcgcgcggcu

SEQ ID NO: 3720791 - RNA, 14 nt, Salmonella enterica enterica serovar Typhi Ty2
gaacgggugguuuc

SEQ ID NO: 3720792 - RNA, 14 nt, Salmonella enterica enterica serovar Typhi Ty2
gaacguaauggcau

SEQ ID NO: 3720793 - RNA, 12 nt, Salmonella enterica enterica serovar Typhi Ty2
gaacgucaucau

SEQ ID NO: 3720794 - RNA, 22 nt, Salmonella enterica enterica serovar Typhi Ty2
gaacguccagcggccaguguac

SEQ ID NO: 3720795 - RNA, 17 nt, Salmonella enterica enterica serovar Typhi Ty2
gaacguucaaaaucaaa

SEQ ID NO: 3720796 - RNA, 15 nt, Salmonella enterica enterica serovar Typhi Ty2
gaacguuggcgauaa

SEQ ID NO: 3720797 - RNA, 23 nt, Salmonella enterica enterica serovar Typhi Ty2
gaacuacccuucaaggagaaaau

SEQ ID NO: 3720798 - RNA, 11 nt, Salmonella enterica enterica serovar Typhi Ty2
gaacucaucuu

SEQ ID NO: 3720799 - RNA, 13 nt, Salmonella enterica enterica serovar Typhi Ty2
gaacuccagcgcg

SEQ ID NO: 3720800 - RNA, 20 nt, Salmonella enterica enterica serovar Typhi Ty2
gaacucggucaggguaauag

SEQ ID NO: 3720801 - RNA, 16 nt, Salmonella enterica enterica serovar Typhi Ty2
gaacucgucuuauccg

SEQ ID NO: 3720802 - RNA, 21 nt, Salmonella enterica enterica serovar Typhi Ty2
gaacucuaugcaaaagaaaaa

SEQ ID NO: 3720803 - RNA, 13 nt, Salmonella enterica enterica serovar Typhi Ty2
gaacucuuucaga

SEQ ID NO: 3720804 - RNA, 16 nt, Salmonella enterica enterica serovar Typhi Ty2
gaacugauaaaagaga

SEQ ID NO: 3720805 - RNA, 22 nt, Salmonella enterica enterica serovar Typhi Ty2
gaacugauggcgcuaagccagc

SEQ ID NO: 3720806 - RNA, 17 nt, Salmonella enterica enterica serovar Typhi Ty2
gaacugauguuccggca

SEQ ID NO: 3720807 - RNA, 18 nt, Salmonella enterica enterica serovar Typhi Ty2
gaacugauguuccggcac

SEQ ID NO: 3720808 - RNA, 11 nt, Salmonella enterica enterica serovar Typhi Ty2
gaacugcagcg

SEQ ID NO: 3720809 - RNA, 17 nt, Salmonella enterica enterica serovar Typhi Ty2
gaacugcaucccugcuu

SEQ ID NO: 3720810 - RNA, 22 nt, Salmonella enterica enterica serovar Typhi Ty2
gaacugcgaaaucaccgacagg

SEQ ID NO: 3720811 - RNA, 13 nt, Salmonella enterica enterica serovar Typhi Ty2
gaacugggugccg

SEQ ID NO: 3720812 - RNA, 14 nt, Salmonella enterica enterica serovar Typhi Ty2
gaacuguucagcca

SEQ ID NO: 3720813 - RNA, 14 nt, Salmonella enterica enterica serovar Typhi Ty2
gaacuuaaauuaau

SEQ ID NO: 3720814 - RNA, 17 nt, Salmonella enterica enterica serovar Typhi Ty2
gaacuuaggauaauucc

SEQ ID NO: 3720815 - RNA, 17 nt, Salmonella enterica enterica serovar Typhi Ty2
gaacuuccgccaccacc

SEQ ID NO: 3720816 - RNA, 20 nt, Salmonella enterica enterica serovar Typhi Ty2
gaagaaaaaggcaauaaagu

SEQ ID NO: 3720817 - RNA, 14 nt, Salmonella enterica enterica serovar Typhi Ty2
gaagaacagcgucg

SEQ ID NO: 3720818 - RNA, 17 nt, Salmonella enterica enterica serovar Typhi Ty2
gaagaaggcuccggcac

SEQ ID NO: 3720819 - RNA, 14 nt, Salmonella enterica enterica serovar Typhi Ty2
gaagaauccaggga

SEQ ID NO: 3720820 - RNA, 22 nt, Salmonella enterica enterica serovar Typhi Ty2
gaagaauccagggaugaacagc

SEQ ID NO: 3720821 - RNA, 20 nt, Salmonella enterica enterica serovar Typhi Ty2
gaagaaucuguauaaaauau

SEQ ID NO: 3720822 - RNA, 15 nt, Salmonella enterica enterica serovar Typhi Ty2
gaagaauuauuauca

SEQ ID NO: 3720823 - RNA, 17 nt, Salmonella enterica enterica serovar Typhi Ty2
gaagaauucgcaaugug

SEQ ID NO: 3720824 - RNA, 22 nt, Salmonella enterica enterica serovar Typhi Ty2
gaagacaacgucgcucuuuuca

SEQ ID NO: 3720825 - RNA, 17 nt, Salmonella enterica enterica serovar Typhi Ty2
gaagacacaacgugcca

SEQ ID NO: 3720826 - RNA, 20 nt, Salmonella enterica enterica serovar Typhi Ty2
gaagacauucacauauauuu

SEQ ID NO: 3720827 - RNA, 14 nt, Salmonella enterica enterica serovar Typhi Ty2
gaagaccuuauccc

SEQ ID NO: 3720828 - RNA, 14 nt, Salmonella enterica enterica serovar Typhi Ty2
gaagagaccugugu

SEQ ID NO: 3720829 - RNA, 18 nt, Salmonella enterica enterica serovar Typhi Ty2
gaagagagauaguugagc

SEQ ID NO: 3720830 - RNA, 22 nt, Salmonella enterica enterica serovar Typhi Ty2
gaauaacccccgcgaacgcgau

SEQ ID NO: 3720831 - RNA, 15 nt, Salmonella enterica enterica serovar Typhi Ty2
gaauaacccgcagcc

SEQ ID NO: 3720832 - RNA, 13 nt, Salmonella enterica enterica serovar Typhi Ty2
gaauaaccucccg

SEQ ID NO: 3720833 - RNA, 17 nt, Salmonella enterica enterica serovar Typhi Ty2
gaauaacguguuaugcg

SEQ ID NO: 3720834 - RNA, 19 nt, Salmonella enterica enterica serovar Typhi Ty2
gaauaagcugaaugguaaa

SEQ ID NO: 3720835 - RNA, 19 nt, Salmonella enterica enterica serovar Typhi Ty2
gaauaauaauacaccgcca

SEQ ID NO: 3720836 - RNA, 17 nt, Salmonella enterica enterica serovar Typhi Ty2
gaauaaucauccgcuuc

SEQ ID NO: 3720837 - RNA, 15 nt, Salmonella enterica enterica serovar Typhi Ty2
gaauaaucccggcgc

SEQ ID NO: 3720838 - RNA, 17 nt, Salmonella enterica enterica serovar Typhi Ty2
gaauaaugaccagcgcc

SEQ ID NO: 3720839 - RNA, 17 nt, Salmonella enterica enterica serovar Typhi Ty2
gaauaauguaaaaaaau

SEQ ID NO: 3720840 - RNA, 16 nt, Salmonella enterica enterica serovar Typhi Ty2
gaauaauuucggcggc

SEQ ID NO: 3720841 - RNA, 23 nt, Salmonella enterica enterica serovar Typhi Ty2
gaauaccacuucggcagaaaaag

SEQ ID NO: 3720842 - RNA, 20 nt, Salmonella enterica enterica serovar Typhi Ty2
gaauaccagaaucaccgaca

SEQ ID NO: 3720843 - RNA, 19 nt, Salmonella enterica enterica serovar Typhi Ty2
gaauacggaaggauagccg

SEQ ID NO: 3720844 - RNA, 21 nt, Salmonella enterica enterica serovar Typhi Ty2
gaauacggccuucuuccguca

SEQ ID NO: 3720845 - RNA, 19 nt, Salmonella enterica enterica serovar Typhi Ty2
gaauacugggcgcaugagg

SEQ ID NO: 3720846 - RNA, 15 nt, Salmonella enterica enterica serovar Typhi Ty2
gaauagacuggcgcc

SEQ ID NO: 3720847 - RNA, 16 nt, Salmonella enterica enterica serovar Typhi Ty2
gaauagaggcgcuggc

SEQ ID NO: 3720848 - RNA, 17 nt, Salmonella enterica enterica serovar Typhi Ty2
gaauagaggcgcuggcg

SEQ ID NO: 3720849 - RNA, 19 nt, Salmonella enterica enterica serovar Typhi Ty2
gaauagaguaauacaucca

SEQ ID NO: 3720850 - RNA, 15 nt, Salmonella enterica enterica serovar Typhi Ty2
gaauagccagccccc

SEQ ID NO: 3720851 - RNA, 20 nt, Salmonella enterica enterica serovar Typhi Ty2
gaauagccagcccccugcca

SEQ ID NO: 3720852 - RNA, 23 nt, Salmonella enterica enterica serovar Typhi Ty2
gaauagccccucaauuauguauu

SEQ ID NO: 3720853 - RNA, 19 nt, Salmonella enterica enterica serovar Typhi Ty2
gaauagccugggcaaggcu

SEQ ID NO: 3720854 - RNA, 22 nt, Salmonella enterica enterica serovar Typhi Ty2
gaauagcguauuuuuguacuuu

SEQ ID NO: 3720855 - RNA, 19 nt, Salmonella enterica enterica serovar Typhi Ty2
gaauaggccgccaaugaca

SEQ ID NO: 3720856 - RNA, 13 nt, Salmonella enterica enterica serovar Typhi Ty2
gaauauaccauca

SEQ ID NO: 3720857 - RNA, 19 nt, Salmonella enterica enterica serovar Typhi Ty2
gaauauccccugacagagc

SEQ ID NO: 3720858 - RNA, 15 nt, Salmonella enterica enterica serovar Typhi Ty2
gaauauccgccgccc

SEQ ID NO: 3720859 - RNA, 17 nt, Salmonella enterica enterica serovar Typhi Ty2
gaauauccgguacacca

SEQ ID NO: 3720860 - RNA, 20 nt, Salmonella enterica enterica serovar Typhi Ty2
gaauauccgguacaccaacu

SEQ ID NO: 3720861 - RNA, 12 nt, Salmonella enterica enterica serovar Typhi Ty2
gaauaucgccaa

SEQ ID NO: 3720862 - RNA, 18 nt, Salmonella enterica enterica serovar Typhi Ty2
gaauaucggcgucaacgu

SEQ ID NO: 3720863 - RNA, 15 nt, Salmonella enterica enterica serovar Typhi Ty2
gaauaucuuuguccu

SEQ ID NO: 3720864 - RNA, 16 nt, Salmonella enterica enterica serovar Typhi Ty2
gaauaugauuuaaaaa

SEQ ID NO: 3720865 - RNA, 22 nt, Salmonella enterica enterica serovar Typhi Ty2
gaauaugcagugcugcugccau

SEQ ID NO: 3720866 - RNA, 23 nt, Salmonella enterica enterica serovar Typhi Ty2
gaauauggaaaggaugcagcauc

SEQ ID NO: 3720867 - RNA, 21 nt, Salmonella enterica enterica serovar Typhi Ty2
gaauauugacaguaauaaugu

SEQ ID NO: 3720868 - RNA, 15 nt, Salmonella enterica enterica serovar Typhi Ty2
gaaucacgccgauga

SEQ ID NO: 3720869 - RNA, 16 nt, Salmonella enterica enterica serovar Typhi Ty2
gaaucacguaaucggc

SEQ ID NO: 3720870 - RNA, 11 nt, Salmonella enterica enterica serovar Typhi Ty2
gaaucagccag

SEQ ID NO: 3720871 - RNA, 18 nt, Salmonella enterica enterica serovar Typhi Ty2
gaaucaguaacacaauca

SEQ ID NO: 3720872 - RNA, 22 nt, Salmonella enterica enterica serovar Typhi Ty2
gaaucaguaacacaaucaggcg

SEQ ID NO: 3720873 - RNA, 14 nt, Salmonella enterica enterica serovar Typhi Ty2
gaaucaguauccac

SEQ ID NO: 3720874 - RNA, 20 nt, Salmonella enterica enterica serovar Typhi Ty2
gaaucagugcaucuucacug

SEQ ID NO: 3720875 - RNA, 14 nt, Salmonella enterica enterica serovar Typhi Ty2
gaaucaucacaauu

SEQ ID NO: 3720876 - RNA, 19 nt, Salmonella enterica enterica serovar Typhi Ty2
gaaucauuaauaaccccag

SEQ ID NO: 3720877 - RNA, 12 nt, Salmonella enterica enterica serovar Typhi Ty2
gaauccagcagg

SEQ ID NO: 3720878 - RNA, 14 nt, Salmonella enterica enterica serovar Typhi Ty2
gaauccccaucucc

SEQ ID NO: 3720879 - RNA, 16 nt, Salmonella enterica enterica serovar Typhi Ty2
gaauccccaucuccag

SEQ ID NO: 3720880 - RNA, 21 nt, Salmonella enterica enterica serovar Typhi Ty2
gaauccccggcuuccagcggc

SEQ ID NO: 3720881 - RNA, 13 nt, Salmonella enterica enterica serovar Typhi Ty2
gaaucccgccauc

SEQ ID NO: 3720882 - RNA, 20 nt, Salmonella enterica enterica serovar Typhi Ty2
gaaucccgccaucguccagc

SEQ ID NO: 3720883 - RNA, 14 nt, Salmonella enterica enterica serovar Typhi Ty2
gaauccggcggcuu

SEQ ID NO: 3720884 - RNA, 14 nt, Salmonella enterica enterica serovar Typhi Ty2
gaauccgucagguu

SEQ ID NO: 3720885 - RNA, 18 nt, Salmonella enterica enterica serovar Typhi Ty2
gaauccucccggaugcac

SEQ ID NO: 3720886 - RNA, 19 nt, Salmonella enterica enterica serovar Typhi Ty2
gaaucgcagagcguaauuc

SEQ ID NO: 3720887 - RNA, 15 nt, Salmonella enterica enterica serovar Typhi Ty2
gaaucgccagucgca

SEQ ID NO: 3720888 - RNA, 18 nt, Salmonella enterica enterica serovar Typhi Ty2
gaaucgccagucgcagca

SEQ ID NO: 3720889 - RNA, 21 nt, Salmonella enterica enterica serovar Typhi Ty2
gaaucgccuggcuugccggca

SEQ ID NO: 3720890 - RNA, 15 nt, Salmonella enterica enterica serovar Typhi Ty2
gaaucgcgauaacgu

SEQ ID NO: 3720891 - RNA, 15 nt, Salmonella enterica enterica serovar Typhi Ty2
gaaucgcgauccagc

SEQ ID NO: 3720892 - RNA, 16 nt, Salmonella enterica enterica serovar Typhi Ty2
gaaucgcucacccgau

SEQ ID NO: 3720893 - RNA, 14 nt, Salmonella enterica enterica serovar Typhi Ty2
gaaucgcuuccugg

SEQ ID NO: 3720894 - RNA, 14 nt, Salmonella enterica enterica serovar Typhi Ty2
gaaucguccagauu

SEQ ID NO: 3720895 - RNA, 14 nt, Salmonella enterica enterica serovar Typhi Ty2
gaaucguucgccag

SEQ ID NO: 3720896 - RNA, 19 nt, Salmonella enterica enterica serovar Typhi Ty2
gaaucguucgccagugaca

SEQ ID NO: 3720897 - RNA, 18 nt, Salmonella enterica enterica serovar Typhi Ty2
gaaucuauuauuaaucug

SEQ ID NO: 3720898 - RNA, 16 nt, Salmonella enterica enterica serovar Typhi Ty2
gaaucucaucagacug

SEQ ID NO: 3720899 - RNA, 20 nt, Salmonella enterica enterica serovar Typhi Ty2
gaaucucgugaucgccaaag

SEQ ID NO: 3720900 - RNA, 23 nt, Salmonella enterica enterica serovar Typhi Ty2
gaaucugcggcugcgugauuuug

SEQ ID NO: 3720901 - RNA, 16 nt, Salmonella enterica enterica serovar Typhi Ty2
gaaucuguauaaaaua

SEQ ID NO: 3720902 - RNA, 18 nt, Salmonella enterica enterica serovar Typhi Ty2
gaaugaaaaaaaaauuac

SEQ ID NO: 3720903 - RNA, 14 nt, Salmonella enterica enterica serovar Typhi Ty2
gaaugaagccuuag

SEQ ID NO: 3720904 - RNA, 23 nt, Salmonella enterica enterica serovar Typhi Ty2
gaaugacacauuucuauagagag

SEQ ID NO: 3720905 - RNA, 20 nt, Salmonella enterica enterica serovar Typhi Ty2
gaaugagggcgcgaauacuc

SEQ ID NO: 3720906 - RNA, 14 nt, Salmonella enterica enterica serovar Typhi Ty2
gaaugaggugcggu

SEQ ID NO: 3720907 - RNA, 21 nt, Salmonella enterica enterica serovar Typhi Ty2
gaaugcaaagaagggcagggg

SEQ ID NO: 3720908 - RNA, 22 nt, Salmonella enterica enterica serovar Typhi Ty2
gaaugcaagcagcauaaugaau

SEQ ID NO: 3720909 - RNA, 15 nt, Salmonella enterica enterica serovar Typhi Ty2
gaaugcacuguuucu

SEQ ID NO: 3720910 - RNA, 15 nt, Salmonella enterica enterica serovar Typhi Ty2
gaaugccaagcgcau

SEQ ID NO: 3720911 - RNA, 13 nt, Salmonella enterica enterica serovar Typhi Ty2
gaaugccagcgcc

SEQ ID NO: 3720912 - RNA, 17 nt, Salmonella enterica enterica serovar Typhi Ty2
gacacuggaaacagcca

SEQ ID NO: 3720913 - RNA, 18 nt, Salmonella enterica enterica serovar Typhi Ty2
gacacuggaaacagccaa

SEQ ID NO: 3720914 - RNA, 20 nt, Salmonella enterica enterica serovar Typhi Ty2
gacacuuuccgacguuuuuc

SEQ ID NO: 3720915 - RNA, 13 nt, Salmonella enterica enterica serovar Typhi Ty2
gacagaacaggau

SEQ ID NO: 3720916 - RNA, 14 nt, Salmonella enterica enterica serovar Typhi Ty2
gacagacgcaucuu

SEQ ID NO: 3720917 - RNA, 16 nt, Salmonella enterica enterica serovar Typhi Ty2
gacagagaaccugaac

SEQ ID NO: 3720918 - RNA, 16 nt, Salmonella enterica enterica serovar Typhi Ty2
gacagauaacaccagc

SEQ ID NO: 3720919 - RNA, 17 nt, Salmonella enterica enterica serovar Typhi Ty2
gacagauaacaccagcg

SEQ ID NO: 3720920 - RNA, 19 nt, Salmonella enterica enterica serovar Typhi Ty2
gacagaucgguuuaucccc

SEQ ID NO: 3720921 - RNA, 17 nt, Salmonella enterica enterica serovar Typhi Ty2
gacagauuaucagcgag

SEQ ID NO: 3720922 - RNA, 15 nt, Salmonella enterica enterica serovar Typhi Ty2
gacagcaaaacggcu

SEQ ID NO: 3720923 - RNA, 11 nt, Salmonella enterica enterica serovar Typhi Ty2
gacagcaagau

SEQ ID NO: 3720924 - RNA, 18 nt, Salmonella enterica enterica serovar Typhi Ty2
gacagcaaguugcgccac

SEQ ID NO: 3720925 - RNA, 22 nt, Salmonella enterica enterica serovar Typhi Ty2
gacagcaaguugcgccacugcc

SEQ ID NO: 3720926 - RNA, 23 nt, Salmonella enterica enterica serovar Typhi Ty2
gacagcaaguugcgccacugcca

SEQ ID NO: 3720927 - RNA, 17 nt, Salmonella enterica enterica serovar Typhi Ty2
gacagcaauaucagcca

SEQ ID NO: 3720928 - RNA, 14 nt, Salmonella enterica enterica serovar Typhi Ty2
gacagcaaugagca

SEQ ID NO: 3720929 - RNA, 23 nt, Salmonella enterica enterica serovar Typhi Ty2
gacagcaauguuaaauucagcau

SEQ ID NO: 3720930 - RNA, 22 nt, Salmonella enterica enterica serovar Typhi Ty2
gacagcaggcuuugcugcugcg

SEQ ID NO: 3720931 - RNA, 18 nt, Salmonella enterica enterica serovar Typhi Ty2
gacagcauuuuucacagu

SEQ ID NO: 3720932 - RNA, 18 nt, Salmonella enterica enterica serovar Typhi Ty2
gacagccagcauuuccag

SEQ ID NO: 3720933 - RNA, 19 nt, Salmonella enterica enterica serovar Typhi Ty2
gacagccagcauuuccagc

SEQ ID NO: 3720934 - RNA, 19 nt, Salmonella enterica enterica serovar Typhi Ty2
gacagcccccauaaauaau

SEQ ID NO: 3720935 - RNA, 20 nt, Salmonella enterica enterica serovar Typhi Ty2
gacagcccggcguguuucag

SEQ ID NO: 3720936 - RNA, 15 nt, Salmonella enterica enterica serovar Typhi Ty2
gacagccgacggcaa

SEQ ID NO: 3720937 - RNA, 16 nt, Salmonella enterica enterica serovar Typhi Ty2
gacagccgacggcaaa

SEQ ID NO: 3720938 - RNA, 23 nt, Salmonella enterica enterica serovar Typhi Ty2
gacagcgaacaguguaaacgcca

SEQ ID NO: 3720939 - RNA, 22 nt, Salmonella enterica enterica serovar Typhi Ty2
gacagcgcccaacgcuucacaa

SEQ ID NO: 3720940 - RNA, 18 nt, Salmonella enterica enterica serovar Typhi Ty2
gacagcggggugugaagu

SEQ ID NO: 3720941 - RNA, 18 nt, Salmonella enterica enterica serovar Typhi Ty2
gacagcuuagauucaacc

SEQ ID NO: 3720942 - RNA, 14 nt, Salmonella enterica enterica serovar Typhi Ty2
gacaggacgccagc

SEQ ID NO: 3720943 - RNA, 16 nt, Salmonella enterica enterica serovar Typhi Ty2
gacaggcgcagaguga

SEQ ID NO: 3720944 - RNA, 20 nt, Salmonella enterica enterica serovar Typhi Ty2
gacaggcggccgcuuacugu

SEQ ID NO: 3720945 - RNA, 18 nt, Salmonella enterica enterica serovar Typhi Ty2
gacaggggggaacagcaa

SEQ ID NO: 3720946 - RNA, 20 nt, Salmonella enterica enterica serovar Typhi Ty2
gacaggguuugccagcacca

SEQ ID NO: 3720947 - RNA, 15 nt, Salmonella enterica enterica serovar Typhi Ty2
gacagugaaacgggu

SEQ ID NO: 3720948 - RNA, 23 nt, Salmonella enterica enterica serovar Typhi Ty2
gacagugaaacgggugaggucgg

SEQ ID NO: 3720949 - RNA, 17 nt, Salmonella enterica enterica serovar Typhi Ty2
gacagugaacggcauaa

SEQ ID NO: 3720950 - RNA, 23 nt, Salmonella enterica enterica serovar Typhi Ty2
gacagugauuuacuccaaaaaua

SEQ ID NO: 3720951 - RNA, 12 nt, Salmonella enterica enterica serovar Typhi Ty2
gacagugcuaua

SEQ ID NO: 3720952 - RNA, 13 nt, Salmonella enterica enterica serovar Typhi Ty2
gacaguggcuuua

SEQ ID NO: 3720953 - RNA, 13 nt, Salmonella enterica enterica serovar Typhi Ty2
gacaguucccggc

SEQ ID NO: 3720954 - RNA, 22 nt, Salmonella enterica enterica serovar Typhi Ty2
gacauaaaacaguacgccgagg

SEQ ID NO: 3720955 - RNA, 17 nt, Salmonella enterica enterica serovar Typhi Ty2
gacauaaaacccgccuc

SEQ ID NO: 3720956 - RNA, 18 nt, Salmonella enterica enterica serovar Typhi Ty2
gacauaaacgccucaucc

SEQ ID NO: 3720957 - RNA, 13 nt, Salmonella enterica enterica serovar Typhi Ty2
gacauacaggaau

SEQ ID NO: 3720958 - RNA, 20 nt, Salmonella enterica enterica serovar Typhi Ty2
gacauagagcgggucaacgc

SEQ ID NO: 3720959 - RNA, 20 nt, Salmonella enterica enterica serovar Typhi Ty2
gacauaguaauuaccggacg

SEQ ID NO: 3720960 - RNA, 15 nt, Salmonella enterica enterica serovar Typhi Ty2
gacauaguacccucu

SEQ ID NO: 3720961 - RNA, 19 nt, Salmonella enterica enterica serovar Typhi Ty2
gacauaguacccucugcac

SEQ ID NO: 3720962 - RNA, 22 nt, Salmonella enterica enterica serovar Typhi Ty2
gacauagucgucuauuuccgcu

SEQ ID NO: 3720963 - RNA, 15 nt, Salmonella enterica enterica serovar Typhi Ty2
gacauauucaugguu

SEQ ID NO: 3720964 - RNA, 22 nt, Salmonella enterica enterica serovar Typhi Ty2
gacaucacguucgcgcauaccu

SEQ ID NO: 3720965 - RNA, 11 nt, Salmonella enterica enterica serovar Typhi Ty2
gacaucagcca

SEQ ID NO: 3720966 - RNA, 20 nt, Salmonella enterica enterica serovar Typhi Ty2
gacaucagccagccgccaaa

SEQ ID NO: 3720967 - RNA, 20 nt, Salmonella enterica enterica serovar Typhi Ty2
gacaucauccccggcaggcu

SEQ ID NO: 3720968 - RNA, 14 nt, Salmonella enterica enterica serovar Typhi Ty2
gacauccaucaucu

SEQ ID NO: 3720969 - RNA, 21 nt, Salmonella enterica enterica serovar Typhi Ty2
gacauccaugauaaucagcac

SEQ ID NO: 3720970 - RNA, 16 nt, Salmonella enterica enterica serovar Typhi Ty2
gacauccccgccgaga

SEQ ID NO: 3720971 - RNA, 23 nt, Salmonella enterica enterica serovar Typhi Ty2
gacauccucuucauaacgacauu

SEQ ID NO: 3720972 - RNA, 16 nt, Salmonella enterica enterica serovar Typhi Ty2
gacaucgcaaugccac

SEQ ID NO: 3720973 - RNA, 20 nt, Salmonella enterica enterica serovar Typhi Ty2
gacaucgccaccgcauggaa

SEQ ID NO: 3720974 - RNA, 17 nt, Salmonella enterica enterica serovar Typhi Ty2
gacaucgcucccggcac

SEQ ID NO: 3720975 - RNA, 20 nt, Salmonella enterica enterica serovar Typhi Ty2
gacaucggagauuucauccu

SEQ ID NO: 3720976 - RNA, 13 nt, Salmonella enterica enterica serovar Typhi Ty2
gacaucggcacgc

SEQ ID NO: 3720977 - RNA, 17 nt, Salmonella enterica enterica serovar Typhi Ty2
gacaucucaucggcuuu

SEQ ID NO: 3720978 - RNA, 11 nt, Salmonella enterica enterica serovar Typhi Ty2
gacaucuucau

SEQ ID NO: 3720979 - RNA, 19 nt, Salmonella enterica enterica serovar Typhi Ty2
gacaucuuggcgcugccgu

SEQ ID NO: 3720980 - RNA, 22 nt, Salmonella enterica enterica serovar Typhi Ty2
gacaucuuugccaaacugcugg

SEQ ID NO: 3720981 - RNA, 15 nt, Salmonella enterica enterica serovar Typhi Ty2
gacaugcucaugaag

SEQ ID NO: 3720982 - RNA, 17 nt, Salmonella enterica enterica serovar Typhi Ty2
gacaugcuguugaaacg

SEQ ID NO: 3720983 - RNA, 23 nt, Salmonella enterica enterica serovar Typhi Ty2
gacaugcuguugaaacgccguuu

SEQ ID NO: 3720984 - RNA, 15 nt, Salmonella enterica enterica serovar Typhi Ty2
gacauggaguuccag

SEQ ID NO: 3720985 - RNA, 17 nt, Salmonella enterica enterica serovar Typhi Ty2
gacauggcaauggcuuc

SEQ ID NO: 3720986 - RNA, 21 nt, Salmonella enterica enterica serovar Typhi Ty2
gacauggcggucgccauaugu

SEQ ID NO: 3720987 - RNA, 19 nt, Salmonella enterica enterica serovar Typhi Ty2
gacauggucgaacaucugc

SEQ ID NO: 3720988 - RNA, 21 nt, Salmonella enterica enterica serovar Typhi Ty2
gacauguccgauagcauuauu

SEQ ID NO: 3720989 - RNA, 14 nt, Salmonella enterica enterica serovar Typhi Ty2
gacauguuccgccc

SEQ ID NO: 3720990 - RNA, 19 nt, Salmonella enterica enterica serovar Typhi Ty2
gacauuaacaaugccuuau

SEQ ID NO: 3720991 - RNA, 12 nt, Salmonella enterica enterica serovar Typhi Ty2
gacauuacccau

SEQ ID NO: 3720992 - RNA, 12 nt, Salmonella enterica enterica serovar Typhi Ty2
gacauucccugc

SEQ ID NO: 3720993 - RNA, 16 nt, Salmonella enterica enterica serovar Typhi Ty2
gacauucugacggccc

SEQ ID NO: 3720994 - RNA, 19 nt, Salmonella enterica enterica serovar Typhi Ty2
gaccgacaagccccccgca

SEQ ID NO: 3720995 - RNA, 19 nt, Salmonella enterica enterica serovar Typhi Ty2
gaccgacauaaaacccgcc

SEQ ID NO: 3720996 - RNA, 23 nt, Salmonella enterica enterica serovar Typhi Ty2
gaccgacgcguuuuccagcacca

SEQ ID NO: 3720997 - RNA, 13 nt, Salmonella enterica enterica serovar Typhi Ty2
gaccgagaucagg

SEQ ID NO: 3720998 - RNA, 15 nt, Salmonella enterica enterica serovar Typhi Ty2
gaccgagaucaggcc

SEQ ID NO: 3720999 - RNA, 17 nt, Salmonella enterica enterica serovar Typhi Ty2
gaccgagugucgcccgc

SEQ ID NO: 3721000 - RNA, 22 nt, Salmonella enterica enterica serovar Typhi Ty2
gaccgauagagacugccgccgu

SEQ ID NO: 3721001 - RNA, 16 nt, Salmonella enterica enterica serovar Typhi Ty2
gaccgauauagccacu

SEQ ID NO: 3721002 - RNA, 16 nt, Salmonella enterica enterica serovar Typhi Ty2
gaccgaucucaugcaa

SEQ ID NO: 3721003 - RNA, 23 nt, Salmonella enterica enterica serovar Typhi Ty2
gaccgcaaaccgaauucguccac

SEQ ID NO: 3721004 - RNA, 20 nt, Salmonella enterica enterica serovar Typhi Ty2
gaccgcagaccggaugaugg

SEQ ID NO: 3721005 - RNA, 15 nt, Salmonella enterica enterica serovar Typhi Ty2
gaccgccaagcgcgg

SEQ ID NO: 3721006 - RNA, 18 nt, Salmonella enterica enterica serovar Typhi Ty2
gaccgccaagcgcggaca

SEQ ID NO: 3721007 - RNA, 14 nt, Salmonella enterica enterica serovar Typhi Ty2
gaccgccagcagag

SEQ ID NO: 3721008 - RNA, 19 nt, Salmonella enterica enterica serovar Typhi Ty2
gaccgccccguaucauuag

SEQ ID NO: 3721009 - RNA, 18 nt, Salmonella enterica enterica serovar Typhi Ty2
gaccgccgaguccgaggc

SEQ ID NO: 3721010 - RNA, 21 nt, Salmonella enterica enterica serovar Typhi Ty2
gaccgccgaugcugaauagcc

SEQ ID NO: 3721011 - RNA, 22 nt, Salmonella enterica enterica serovar Typhi Ty2
gaccgccgucauagcaggagau

SEQ ID NO: 3721012 - RNA, 16 nt, Salmonella enterica enterica serovar Typhi Ty2
gaccgcugauggaccu

SEQ ID NO: 3721013 - RNA, 14 nt, Salmonella enterica enterica serovar Typhi Ty2
gaccgcuucgcugg

SEQ ID NO: 3721014 - RNA, 23 nt, Salmonella enterica enterica serovar Typhi Ty2
gaccgcuuuagccaguagcuggu

SEQ ID NO: 3721015 - RNA, 15 nt, Salmonella enterica enterica serovar Typhi Ty2
gaccgcuuuuuccag

SEQ ID NO: 3721016 - RNA, 17 nt, Salmonella enterica enterica serovar Typhi Ty2
gaccggaacggacgugc

SEQ ID NO: 3721017 - RNA, 17 nt, Salmonella enterica enterica serovar Typhi Ty2
gaccggacguugaaaaa

SEQ ID NO: 3721018 - RNA, 23 nt, Salmonella enterica enterica serovar Typhi Ty2
gaccggcaaaaagaaucgccagu

SEQ ID NO: 3721019 - RNA, 19 nt, Salmonella enterica enterica serovar Typhi Ty2
gaccggcagccguuuuccg

SEQ ID NO: 3721020 - RNA, 16 nt, Salmonella enterica enterica serovar Typhi Ty2
gaccggcgcagcgccc

SEQ ID NO: 3721021 - RNA, 17 nt, Salmonella enterica enterica serovar Typhi Ty2
gaccgggcugcacgcca

SEQ ID NO: 3721022 - RNA, 18 nt, Salmonella enterica enterica serovar Typhi Ty2
gaccggugaugugcuggc

SEQ ID NO: 3721023 - RNA, 21 nt, Salmonella enterica enterica serovar Typhi Ty2
gaccggugaugugcuggcgga

SEQ ID NO: 3721024 - RNA, 17 nt, Salmonella enterica enterica serovar Typhi Ty2
gaccguauccgccacca

SEQ ID NO: 3721025 - RNA, 14 nt, Salmonella enterica enterica serovar Typhi Ty2
gaccgucagcagca

SEQ ID NO: 3721026 - RNA, 21 nt, Salmonella enterica enterica serovar Typhi Ty2
gaccgucgcgcccuccuccag

SEQ ID NO: 3721027 - RNA, 17 nt, Salmonella enterica enterica serovar Typhi Ty2
gaccgucgugccugcgg

SEQ ID NO: 3721028 - RNA, 19 nt, Salmonella enterica enterica serovar Typhi Ty2
gaccgucuuugucaagcac

SEQ ID NO: 3721029 - RNA, 23 nt, Salmonella enterica enterica serovar Typhi Ty2
gaccguguucaugcagccauagc

SEQ ID NO: 3721030 - RNA, 13 nt, Salmonella enterica enterica serovar Typhi Ty2
gaccuaaauaagc

SEQ ID NO: 3721031 - RNA, 15 nt, Salmonella enterica enterica serovar Typhi Ty2
gaccuaauagccagc

SEQ ID NO: 3721032 - RNA, 13 nt, Salmonella enterica enterica serovar Typhi Ty2
gaccuacaggccg

SEQ ID NO: 3721033 - RNA, 14 nt, Salmonella enterica enterica serovar Typhi Ty2
gaccuacaggccga

SEQ ID NO: 3721034 - RNA, 20 nt, Salmonella enterica enterica serovar Typhi Ty2
gaccucacgcuuaucgccaa

SEQ ID NO: 3721035 - RNA, 13 nt, Salmonella enterica enterica serovar Typhi Ty2
gaccuccgccauc

SEQ ID NO: 3721036 - RNA, 18 nt, Salmonella enterica enterica serovar Typhi Ty2
gaccucuuuaucuuuuag

SEQ ID NO: 3721037 - RNA, 22 nt, Salmonella enterica enterica serovar Typhi Ty2
gaccugaauauucggcuccagg

SEQ ID NO: 3721038 - RNA, 18 nt, Salmonella enterica enterica serovar Typhi Ty2
gaccugagcgugcaaugu

SEQ ID NO: 3721039 - RNA, 20 nt, Salmonella enterica enterica serovar Typhi Ty2
gaccugcagcuccgcaauuu

SEQ ID NO: 3721040 - RNA, 21 nt, Salmonella enterica enterica serovar Typhi Ty2
gaccugccgcgccugauucau

SEQ ID NO: 3721041 - RNA, 18 nt, Salmonella enterica enterica serovar Typhi Ty2
gaccuggcgcucaaucag

SEQ ID NO: 3721042 - RNA, 16 nt, Salmonella enterica enterica serovar Typhi Ty2
gaccuguagaugaaac

SEQ ID NO: 3721043 - RNA, 22 nt, Salmonella enterica enterica serovar Typhi Ty2
gaccuguucuguaggcugugca

SEQ ID NO: 3721044 - RNA, 14 nt, Salmonella enterica enterica serovar Typhi Ty2
gaccuuaauccagc

SEQ ID NO: 3721045 - RNA, 22 nt, Salmonella enterica enterica serovar Typhi Ty2
gaccuuauucccauuccugcaa

SEQ ID NO: 3721046 - RNA, 17 nt, Salmonella enterica enterica serovar Typhi Ty2
gaccuucaucucuuugc

SEQ ID NO: 3721047 - RNA, 15 nt, Salmonella enterica enterica serovar Typhi Ty2
gaccuucauggcguu

SEQ ID NO: 3721048 - RNA, 15 nt, Salmonella enterica enterica serovar Typhi Ty2
gacgaaagucaucca

SEQ ID NO: 3721049 - RNA, 13 nt, Salmonella enterica enterica serovar Typhi Ty2
gacgaacaacauc

SEQ ID NO: 3721050 - RNA, 18 nt, Salmonella enterica enterica serovar Typhi Ty2
gacgaaccggcgccguuu

SEQ ID NO: 3721051 - RNA, 12 nt, Salmonella enterica enterica serovar Typhi Ty2
gacgaacgcuau

SEQ ID NO: 3721052 - RNA, 19 nt, Salmonella enterica enterica serovar Typhi Ty2
gacgaagaucgcguacagc

SEQ ID NO: 3721053 - RNA, 19 nt, Salmonella enterica enterica serovar Typhi Ty2
gacgaaguccuucacaaac

SEQ ID NO: 3721054 - RNA, 16 nt, Salmonella enterica enterica serovar Typhi Ty2
gacgacccuguguagu

SEQ ID NO: 3721055 - RNA, 23 nt, Salmonella enterica enterica serovar Typhi Ty2
gacgaccguaauagcaauacuuu

SEQ ID NO: 3721056 - RNA, 21 nt, Salmonella enterica enterica serovar Typhi Ty2
gacgacgcagcuucgccgcgu

SEQ ID NO: 3721057 - RNA, 18 nt, Salmonella enterica enterica serovar Typhi Ty2
gacgacgguuaaaaagua

SEQ ID NO: 3721058 - RNA, 21 nt, Salmonella enterica enterica serovar Typhi Ty2
gacgacguucgauacuauaac

SEQ ID NO: 3721059 - RNA, 18 nt, Salmonella enterica enterica serovar Typhi Ty2
gacgacuucacccgcggg

SEQ ID NO: 3721060 - RNA, 20 nt, Salmonella enterica enterica serovar Typhi Ty2
gacgacuucacccgcgggcg

SEQ ID NO: 3721061 - RNA, 14 nt, Salmonella enterica enterica serovar Typhi Ty2
gacgagcgaaaaac

SEQ ID NO: 3721062 - RNA, 16 nt, Salmonella enterica enterica serovar Typhi Ty2
gacgagcgaaaaacug

SEQ ID NO: 3721063 - RNA, 14 nt, Salmonella enterica enterica serovar Typhi Ty2
gacgaggaaaaaug

SEQ ID NO: 3721064 - RNA, 18 nt, Salmonella enterica enterica serovar Typhi Ty2
gacgagguuuccggcggg

SEQ ID NO: 3721065 - RNA, 14 nt, Salmonella enterica enterica serovar Typhi Ty2
gacgauaaaaaaag

SEQ ID NO: 3721066 - RNA, 13 nt, Salmonella enterica enterica serovar Typhi Ty2
gacgauaaccgga

SEQ ID NO: 3721067 - RNA, 22 nt, Salmonella enterica enterica serovar Typhi Ty2
gacgauaaccggacgauuuaag

SEQ ID NO: 3721068 - RNA, 17 nt, Salmonella enterica enterica serovar Typhi Ty2
gacgauacgucauauca

SEQ ID NO: 3721069 - RNA, 21 nt, Salmonella enterica enterica serovar Typhi Ty2
gacgauacucagccccaggcc

SEQ ID NO: 3721070 - RNA, 14 nt, Salmonella enterica enterica serovar Typhi Ty2
gacgaucagcgcca

SEQ ID NO: 3721071 - RNA, 13 nt, Salmonella enterica enterica serovar Typhi Ty2
gacgaugauaaua

SEQ ID NO: 3721072 - RNA, 18 nt, Salmonella enterica enterica serovar Typhi Ty2
gacgaugaugagauacgu

SEQ ID NO: 3721073 - RNA, 16 nt, Salmonella enterica enterica serovar Typhi Ty2
gacgauucguaccauc

SEQ ID NO: 3721074 - RNA, 23 nt, Salmonella enterica enterica serovar Typhi Ty2
gacgauuugcgcucgcgccagau

SEQ ID NO: 3721075 - RNA, 16 nt, Salmonella enterica enterica serovar Typhi Ty2
gacgcaacucacgcca

SEQ ID NO: 3721076 - RNA, 20 nt, Salmonella enterica enterica serovar Typhi Ty2
gacgguggucaucuggucaa

SEQ ID NO: 3721077 - RNA, 16 nt, Salmonella enterica enterica serovar Typhi Ty2
gacgguuauuuuucag

SEQ ID NO: 3721078 - RNA, 18 nt, Salmonella enterica enterica serovar Typhi Ty2
gacguaaacgucggccuu

SEQ ID NO: 3721079 - RNA, 23 nt, Salmonella enterica enterica serovar Typhi Ty2
gacguaacgguguuucaucuuca

SEQ ID NO: 3721080 - RNA, 15 nt, Salmonella enterica enterica serovar Typhi Ty2
gacguacccaggcgu

SEQ ID NO: 3721081 - RNA, 12 nt, Salmonella enterica enterica serovar Typhi Ty2
gacguagcgcca

SEQ ID NO: 3721082 - RNA, 17 nt, Salmonella enterica enterica serovar Typhi Ty2
gacguagcgccaucagg

SEQ ID NO: 3721083 - RNA, 19 nt, Salmonella enterica enterica serovar Typhi Ty2
gacguaggccgaauaagac

SEQ ID NO: 3721084 - RNA, 20 nt, Salmonella enterica enterica serovar Typhi Ty2
gacguauucaccucccugca

SEQ ID NO: 3721085 - RNA, 19 nt, Salmonella enterica enterica serovar Typhi Ty2
gacgucgguaaucacauca

SEQ ID NO: 3721086 - RNA, 13 nt, Salmonella enterica enterica serovar Typhi Ty2
gacgucgucacca

SEQ ID NO: 3721087 - RNA, 15 nt, Salmonella enterica enterica serovar Typhi Ty2
gacgucgucaccacg

SEQ ID NO: 3721088 - RNA, 14 nt, Salmonella enterica enterica serovar Typhi Ty2
gacgugaccgguug

SEQ ID NO: 3721089 - RNA, 22 nt, Salmonella enterica enterica serovar Typhi Ty2
gacgugcaccguaucggcaguc

SEQ ID NO: 3721090 - RNA, 19 nt, Salmonella enterica enterica serovar Typhi Ty2
gacgugcggcagggcgguc

SEQ ID NO: 3721091 - RNA, 20 nt, Salmonella enterica enterica serovar Typhi Ty2
gacguuaucucgccaggaac

SEQ ID NO: 3721092 - RNA, 17 nt, Salmonella enterica enterica serovar Typhi Ty2
gacguucaauucauaga

SEQ ID NO: 3721093 - RNA, 15 nt, Salmonella enterica enterica serovar Typhi Ty2
gacguucgacccgca

SEQ ID NO: 3721094 - RNA, 18 nt, Salmonella enterica enterica serovar Typhi Ty2
gacguugaaaaaacgggc

SEQ ID NO: 3721095 - RNA, 18 nt, Salmonella enterica enterica serovar Typhi Ty2
gacguugaucgccaucgc

SEQ ID NO: 3721096 - RNA, 20 nt, Salmonella enterica enterica serovar Typhi Ty2
gacguuuaugccgccauccg

SEQ ID NO: 3721097 - RNA, 18 nt, Salmonella enterica enterica serovar Typhi Ty2
gacguuugcguaaagcug

SEQ ID NO: 3721098 - RNA, 15 nt, Salmonella enterica enterica serovar Typhi Ty2
gacuaaaaagcgcgu

SEQ ID NO: 3721099 - RNA, 16 nt, Salmonella enterica enterica serovar Typhi Ty2
gacuaaaagacgccau

SEQ ID NO: 3721100 - RNA, 15 nt, Salmonella enterica enterica serovar Typhi Ty2
gacuaaccuugauuc

SEQ ID NO: 3721101 - RNA, 18 nt, Salmonella enterica enterica serovar Typhi Ty2
gacuaaccuugauucccu

SEQ ID NO: 3721102 - RNA, 16 nt, Salmonella enterica enterica serovar Typhi Ty2
gacuaauggcauuucc

SEQ ID NO: 3721103 - RNA, 15 nt, Salmonella enterica enterica serovar Typhi Ty2
gacuaauuauuuuuc

SEQ ID NO: 3721104 - RNA, 15 nt, Salmonella enterica enterica serovar Typhi Ty2
gacuacccaucacgc

SEQ ID NO: 3721105 - RNA, 14 nt, Salmonella enterica enterica serovar Typhi Ty2
gacuacgucagaug

SEQ ID NO: 3721106 - RNA, 18 nt, Salmonella enterica enterica serovar Typhi Ty2
gacuacguucaucaggca

SEQ ID NO: 3721107 - RNA, 21 nt, Salmonella enterica enterica serovar Typhi Ty2
gacuauacccaaaauaauucg

SEQ ID NO: 3721108 - RNA, 17 nt, Salmonella enterica enterica serovar Typhi Ty2
gacuaucagaaaaaauu

SEQ ID NO: 3721109 - RNA, 16 nt, Salmonella enterica enterica serovar Typhi Ty2
gacuaucccucugaaa

SEQ ID NO: 3721110 - RNA, 22 nt, Salmonella enterica enterica serovar Typhi Ty2
gacuaucgaaagagcaaauacu

SEQ ID NO: 3721111 - RNA, 18 nt, Salmonella enterica enterica serovar Typhi Ty2
gacuauuccgcaaacgcc

SEQ ID NO: 3721112 - RNA, 20 nt, Salmonella enterica enterica serovar Typhi Ty2
gacuauucgcuaucagaaua

SEQ ID NO: 3721113 - RNA, 14 nt, Salmonella enterica enterica serovar Typhi Ty2
gacuauucuucccc

SEQ ID NO: 3721114 - RNA, 16 nt, Salmonella enterica enterica serovar Typhi Ty2
gacuauuggaaucgcu

SEQ ID NO: 3721115 - RNA, 21 nt, Salmonella enterica enterica serovar Typhi Ty2
gacucaaacagauagccauca

SEQ ID NO: 3721116 - RNA, 13 nt, Salmonella enterica enterica serovar Typhi Ty2
gacucaaagaaaa

SEQ ID NO: 3721117 - RNA, 17 nt, Salmonella enterica enterica serovar Typhi Ty2
gacucacauaacaaaac

SEQ ID NO: 3721118 - RNA, 22 nt, Salmonella enterica enterica serovar Typhi Ty2
gacucacauaacaaaaccagca

SEQ ID NO: 3721119 - RNA, 20 nt, Salmonella enterica enterica serovar Typhi Ty2
gacucaccccuucuuuaucu

SEQ ID NO: 3721120 - RNA, 12 nt, Salmonella enterica enterica serovar Typhi Ty2
gacucacgcagc

SEQ ID NO: 3721121 - RNA, 13 nt, Salmonella enterica enterica serovar Typhi Ty2
gacucagggugac

SEQ ID NO: 3721122 - RNA, 22 nt, Salmonella enterica enterica serovar Typhi Ty2
gacucaggguuuuacgcuggac

SEQ ID NO: 3721123 - RNA, 12 nt, Salmonella enterica enterica serovar Typhi Ty2
gacucauccagc

SEQ ID NO: 3721124 - RNA, 16 nt, Salmonella enterica enterica serovar Typhi Ty2
gacucauccagcaucg

SEQ ID NO: 3721125 - RNA, 17 nt, Salmonella enterica enterica serovar Typhi Ty2
gacucaucgccgcaaug

SEQ ID NO: 3721126 - RNA, 14 nt, Salmonella enterica enterica serovar Typhi Ty2
gacucauggacaaa

SEQ ID NO: 3721127 - RNA, 16 nt, Salmonella enterica enterica serovar Typhi Ty2
gacucauggacaaaaa

SEQ ID NO: 3721128 - RNA, 22 nt, Salmonella enterica enterica serovar Typhi Ty2
gacucauggacaaaaaaggaaa

SEQ ID NO: 3721129 - RNA, 22 nt, Salmonella enterica enterica serovar Typhi Ty2
gacucccaggcgcgcagcugcc

SEQ ID NO: 3721130 - RNA, 22 nt, Salmonella enterica enterica serovar Typhi Ty2
gacuccggauagagaucuuccg

SEQ ID NO: 3721131 - RNA, 13 nt, Salmonella enterica enterica serovar Typhi Ty2
gacuccggcagca

SEQ ID NO: 3721132 - RNA, 14 nt, Salmonella enterica enterica serovar Typhi Ty2
gacuccggcagcau

SEQ ID NO: 3721133 - RNA, 10 nt, Salmonella enterica enterica serovar Typhi Ty2
gacuccguca

SEQ ID NO: 3721134 - RNA, 19 nt, Salmonella enterica enterica serovar Typhi Ty2
gacuccucaaccgacgcga

SEQ ID NO: 3721135 - RNA, 18 nt, Salmonella enterica enterica serovar Typhi Ty2
gacucgcuacgcucgccc

SEQ ID NO: 3721136 - RNA, 15 nt, Salmonella enterica enterica serovar Typhi Ty2
gacucugacgccggu

SEQ ID NO: 3721137 - RNA, 15 nt, Salmonella enterica enterica serovar Typhi Ty2
gacucuguuauauau

SEQ ID NO: 3721138 - RNA, 19 nt, Salmonella enterica enterica serovar Typhi Ty2
gacucuucggcuuccggca

SEQ ID NO: 3721139 - RNA, 13 nt, Salmonella enterica enterica serovar Typhi Ty2
gacucuuguuucu

SEQ ID NO: 3721140 - RNA, 18 nt, Salmonella enterica enterica serovar Typhi Ty2
gacugaaaaucaaaaaca

SEQ ID NO: 3721141 - RNA, 21 nt, Salmonella enterica enterica serovar Typhi Ty2
gacugaacauagccaucggcc

SEQ ID NO: 3721142 - RNA, 14 nt, Salmonella enterica enterica serovar Typhi Ty2
gacugacaaugacg

SEQ ID NO: 3721143 - RNA, 16 nt, Salmonella enterica enterica serovar Typhi Ty2
gacugauaccgcguuu

SEQ ID NO: 3721144 - RNA, 24 nt, Salmonella enterica enterica serovar Typhi Ty2
gacugauaccgcguuugcgcaaca

SEQ ID NO: 3721145 - RNA, 19 nt, Salmonella enterica enterica serovar Typhi Ty2
gacugaucccacuuaggca

SEQ ID NO: 3721146 - RNA, 16 nt, Salmonella enterica enterica serovar Typhi Ty2
gacugaugcuggcgcc

SEQ ID NO: 3721147 - RNA, 17 nt, Salmonella enterica enterica serovar Typhi Ty2
gacugauuuaucaccca

SEQ ID NO: 3721148 - RNA, 14 nt, Salmonella enterica enterica serovar Typhi Ty2
gacugccagguaau

SEQ ID NO: 3721149 - RNA, 14 nt, Salmonella enterica enterica serovar Typhi Ty2
gacugccgcagacc

SEQ ID NO: 3721150 - RNA, 19 nt, Salmonella enterica enterica serovar Typhi Ty2
gacugccuaacuggaaaaa

SEQ ID NO: 3721151 - RNA, 12 nt, Salmonella enterica enterica serovar Typhi Ty2
gacugcggccug

SEQ ID NO: 3721152 - RNA, 15 nt, Salmonella enterica enterica serovar Typhi Ty2
gacuggaacaggcca

SEQ ID NO: 3721153 - RNA, 21 nt, Salmonella enterica enterica serovar Typhi Ty2
gacuggcgaccgccaccaucc

SEQ ID NO: 3721154 - RNA, 21 nt, Salmonella enterica enterica serovar Typhi Ty2
gacuggcuaaacaauuugccc

SEQ ID NO: 3721155 - RNA, 10 nt, Salmonella enterica enterica serovar Typhi Ty2
gacuggcuga

SEQ ID NO: 3721156 - RNA, 19 nt, Salmonella enterica enterica serovar Typhi Ty2
gacugggucgauguaguug

SEQ ID NO: 3721157 - RNA, 14 nt, Salmonella enterica enterica serovar Typhi Ty2
gacuggucgcccgg

SEQ ID NO: 3721158 - RNA, 19 nt, Salmonella enterica enterica serovar Typhi Ty2
gagaucgugcauccggacg

SEQ ID NO: 3721159 - RNA, 21 nt, Salmonella enterica enterica serovar Typhi Ty2
gagaucguuauuaaacagaca

SEQ ID NO: 3721160 - RNA, 14 nt, Salmonella enterica enterica serovar Typhi Ty2
gagaugcaggccaa

SEQ ID NO: 3721161 - RNA, 20 nt, Salmonella enterica enterica serovar Typhi Ty2
gagauuacugcgugcuggcg

SEQ ID NO: 3721162 - RNA, 15 nt, Salmonella enterica enterica serovar Typhi Ty2
gagauucaauaaugu

SEQ ID NO: 3721163 - RNA, 14 nt, Salmonella enterica enterica serovar Typhi Ty2
gagauucugcaggc

SEQ ID NO: 3721164 - RNA, 17 nt, Salmonella enterica enterica serovar Typhi Ty2
gagcaaaaccagacgcc

SEQ ID NO: 3721165 - RNA, 20 nt, Salmonella enterica enterica serovar Typhi Ty2
gagcaaauacuggaaaaaac

SEQ ID NO: 3721166 - RNA, 22 nt, Salmonella enterica enterica serovar Typhi Ty2
gagcaaauacuggaaaaaacgg

SEQ ID NO: 3721167 - RNA, 15 nt, Salmonella enterica enterica serovar Typhi Ty2
gagcaacuggcaaua

SEQ ID NO: 3721168 - RNA, 15 nt, Salmonella enterica enterica serovar Typhi Ty2
gagcaagcgcauugc

SEQ ID NO: 3721169 - RNA, 19 nt, Salmonella enterica enterica serovar Typhi Ty2
gagcacaccauaucuuuca

SEQ ID NO: 3721170 - RNA, 23 nt, Salmonella enterica enterica serovar Typhi Ty2
gagcacguaggccugauaagcgc

SEQ ID NO: 3721171 - RNA, 13 nt, Salmonella enterica enterica serovar Typhi Ty2
gagcacugcccag

SEQ ID NO: 3721172 - RNA, 16 nt, Salmonella enterica enterica serovar Typhi Ty2
gagcacugcccaggac

SEQ ID NO: 3721173 - RNA, 22 nt, Salmonella enterica enterica serovar Typhi Ty2
gagcacuuuuuccuccugcgga

SEQ ID NO: 3721174 - RNA, 17 nt, Salmonella enterica enterica serovar Typhi Ty2
gagcagaacaaguucuu

SEQ ID NO: 3721175 - RNA, 17 nt, Salmonella enterica enterica serovar Typhi Ty2
gagcagaaguaaauccg

SEQ ID NO: 3721176 - RNA, 21 nt, Salmonella enterica enterica serovar Typhi Ty2
gagcagacuguaaaucugccg

SEQ ID NO: 3721177 - RNA, 14 nt, Salmonella enterica enterica serovar Typhi Ty2
gagcaggaaaaguc

SEQ ID NO: 3721178 - RNA, 17 nt, Salmonella enterica enterica serovar Typhi Ty2
gagcaggacgcgcgcga

SEQ ID NO: 3721179 - RNA, 11 nt, Salmonella enterica enterica serovar Typhi Ty2
gagcaggccag

SEQ ID NO: 3721180 - RNA, 18 nt, Salmonella enterica enterica serovar Typhi Ty2
gagcagguuacucuucca

SEQ ID NO: 3721181 - RNA, 15 nt, Salmonella enterica enterica serovar Typhi Ty2
gagcaguucagcagc

SEQ ID NO: 3721182 - RNA, 16 nt, Salmonella enterica enterica serovar Typhi Ty2
gagcaguucagcagca

SEQ ID NO: 3721183 - RNA, 21 nt, Salmonella enterica enterica serovar Typhi Ty2
gagcaguuuuacguggacgcc

SEQ ID NO: 3721184 - RNA, 23 nt, Salmonella enterica enterica serovar Typhi Ty2
gagcauaucgacggucaggcugu

SEQ ID NO: 3721185 - RNA, 20 nt, Salmonella enterica enterica serovar Typhi Ty2
gagcaucaucugccauuucu

SEQ ID NO: 3721186 - RNA, 15 nt, Salmonella enterica enterica serovar Typhi Ty2
gagccaaacacuucc

SEQ ID NO: 3721187 - RNA, 15 nt, Salmonella enterica enterica serovar Typhi Ty2
gagccacaggaaccg

SEQ ID NO: 3721188 - RNA, 14 nt, Salmonella enterica enterica serovar Typhi Ty2
gagccacuauccag

SEQ ID NO: 3721189 - RNA, 22 nt, Salmonella enterica enterica serovar Typhi Ty2
gagccacuauccagucagcguu

SEQ ID NO: 3721190 - RNA, 15 nt, Salmonella enterica enterica serovar Typhi Ty2
gagccauuaaugcag

SEQ ID NO: 3721191 - RNA, 13 nt, Salmonella enterica enterica serovar Typhi Ty2
gagcccaguagcc

SEQ ID NO: 3721192 - RNA, 18 nt, Salmonella enterica enterica serovar Typhi Ty2
gagccgaaauccaccagc

SEQ ID NO: 3721193 - RNA, 15 nt, Salmonella enterica enterica serovar Typhi Ty2
gagccgauauccgga

SEQ ID NO: 3721194 - RNA, 21 nt, Salmonella enterica enterica serovar Typhi Ty2
gagccuaaaacauuaaucgcc

SEQ ID NO: 3721195 - RNA, 22 nt, Salmonella enterica enterica serovar Typhi Ty2
gagccuuacaggcgcaucagaa

SEQ ID NO: 3721196 - RNA, 20 nt, Salmonella enterica enterica serovar Typhi Ty2
gagcgaacaguacggucagg

SEQ ID NO: 3721197 - RNA, 21 nt, Salmonella enterica enterica serovar Typhi Ty2
gagcgaaggggcgggcagcag

SEQ ID NO: 3721198 - RNA, 15 nt, Salmonella enterica enterica serovar Typhi Ty2
gagcgacgcccugcc

SEQ ID NO: 3721199 - RNA, 16 nt, Salmonella enterica enterica serovar Typhi Ty2
gagcgacgcccugccc

SEQ ID NO: 3721200 - RNA, 20 nt, Salmonella enterica enterica serovar Typhi Ty2
gagcgaguacguaaugugaa

SEQ ID NO: 3721201 - RNA, 23 nt, Salmonella enterica enterica serovar Typhi Ty2
gagcgaguacguaaugugaaaaa

SEQ ID NO: 3721202 - RNA, 13 nt, Salmonella enterica enterica serovar Typhi Ty2
gagcgcaaacauc

SEQ ID NO: 3721203 - RNA, 22 nt, Salmonella enterica enterica serovar Typhi Ty2
gagcgcauacgcuguccaguca

SEQ ID NO: 3721204 - RNA, 14 nt, Salmonella enterica enterica serovar Typhi Ty2
gagcgcauccggca

SEQ ID NO: 3721205 - RNA, 15 nt, Salmonella enterica enterica serovar Typhi Ty2
gagcgcauccggcca

SEQ ID NO: 3721206 - RNA, 13 nt, Salmonella enterica enterica serovar Typhi Ty2
gagcgccaaaaag

SEQ ID NO: 3721207 - RNA, 17 nt, Salmonella enterica enterica serovar Typhi Ty2
gagcgccagcaacagcg

SEQ ID NO: 3721208 - RNA, 13 nt, Salmonella enterica enterica serovar Typhi Ty2
gagcgccagcccc

SEQ ID NO: 3721209 - RNA, 15 nt, Salmonella enterica enterica serovar Typhi Ty2
gagcgcgaaaucaaa

SEQ ID NO: 3721210 - RNA, 15 nt, Salmonella enterica enterica serovar Typhi Ty2
gagcgcgauaaccgg

SEQ ID NO: 3721211 - RNA, 12 nt, Salmonella enterica enterica serovar Typhi Ty2
gagcgcgcuggc

SEQ ID NO: 3721212 - RNA, 13 nt, Salmonella enterica enterica serovar Typhi Ty2
gagcgcgcuggca

SEQ ID NO: 3721213 - RNA, 15 nt, Salmonella enterica enterica serovar Typhi Ty2
gagcgcgucagcgcc

SEQ ID NO: 3721214 - RNA, 13 nt, Salmonella enterica enterica serovar Typhi Ty2
gagcgcguccaga

SEQ ID NO: 3721215 - RNA, 13 nt, Salmonella enterica enterica serovar Typhi Ty2
gagcgcuugcugc

SEQ ID NO: 3721216 - RNA, 13 nt, Salmonella enterica enterica serovar Typhi Ty2
gagcggaacgcgu

SEQ ID NO: 3721217 - RNA, 20 nt, Salmonella enterica enterica serovar Typhi Ty2
gagcggagagagcgcuucca

SEQ ID NO: 3721218 - RNA, 22 nt, Salmonella enterica enterica serovar Typhi Ty2
gagcggcgacuagucgcccgcu

SEQ ID NO: 3721219 - RNA, 21 nt, Salmonella enterica enterica serovar Typhi Ty2
gagcggcuacgccugauaagc

SEQ ID NO: 3721220 - RNA, 14 nt, Salmonella enterica enterica serovar Typhi Ty2
gagcggcucaucca

SEQ ID NO: 3721221 - RNA, 14 nt, Salmonella enterica enterica serovar Typhi Ty2
gagcgggccgucag

SEQ ID NO: 3721222 - RNA, 20 nt, Salmonella enterica enterica serovar Typhi Ty2
gagcgggccguggccaggaa

SEQ ID NO: 3721223 - RNA, 15 nt, Salmonella enterica enterica serovar Typhi Ty2
gagcggucaggccag

SEQ ID NO: 3721224 - RNA, 20 nt, Salmonella enterica enterica serovar Typhi Ty2
gagcguaaugguggcaaccu

SEQ ID NO: 3721225 - RNA, 19 nt, Salmonella enterica enterica serovar Typhi Ty2
gagcguagaccgcccagga

SEQ ID NO: 3721226 - RNA, 21 nt, Salmonella enterica enterica serovar Typhi Ty2
gagcguuacgggaacagaauu

SEQ ID NO: 3721227 - RNA, 18 nt, Salmonella enterica enterica serovar Typhi Ty2
gagcuaaucacccacuuc

SEQ ID NO: 3721228 - RNA, 12 nt, Salmonella enterica enterica serovar Typhi Ty2
gagcucagucca

SEQ ID NO: 3721229 - RNA, 18 nt, Salmonella enterica enterica serovar Typhi Ty2
gagcucccgguucgccgc

SEQ ID NO: 3721230 - RNA, 16 nt, Salmonella enterica enterica serovar Typhi Ty2
gagcucuaccagacca

SEQ ID NO: 3721231 - RNA, 12 nt, Salmonella enterica enterica serovar Typhi Ty2
gagcugcugcuu

SEQ ID NO: 3721232 - RNA, 18 nt, Salmonella enterica enterica serovar Typhi Ty2
gagcugugguucguucaa

SEQ ID NO: 3721233 - RNA, 18 nt, Salmonella enterica enterica serovar Typhi Ty2
gagcuuugacgacccgcu

SEQ ID NO: 3721234 - RNA, 16 nt, Salmonella enterica enterica serovar Typhi Ty2
gagcuuuuuuuugcau

SEQ ID NO: 3721235 - RNA, 13 nt, Salmonella enterica enterica serovar Typhi Ty2
gaggaaaccuuuc

SEQ ID NO: 3721236 - RNA, 14 nt, Salmonella enterica enterica serovar Typhi Ty2
gaggaauucuccac

SEQ ID NO: 3721237 - RNA, 15 nt, Salmonella enterica enterica serovar Typhi Ty2
gaggacagugaaacg

SEQ ID NO: 3721238 - RNA, 18 nt, Salmonella enterica enterica serovar Typhi Ty2
gaggacagugaaacgggu

SEQ ID NO: 3721239 - RNA, 19 nt, Salmonella enterica enterica serovar Typhi Ty2
gaggacuguacaagaaggg

SEQ ID NO: 3721240 - RNA, 22 nt, Salmonella enterica enterica serovar Typhi Ty2
gauaaaccaacagccgccuguu

SEQ ID NO: 3721241 - RNA, 15 nt, Salmonella enterica enterica serovar Typhi Ty2
gauaaaccaggcagc

SEQ ID NO: 3721242 - RNA, 22 nt, Salmonella enterica enterica serovar Typhi Ty2
gauaaacggcuuuaguucagca

SEQ ID NO: 3721243 - RNA, 18 nt, Salmonella enterica enterica serovar Typhi Ty2
gauaaacgggaaguaagg

SEQ ID NO: 3721244 - RNA, 23 nt, Salmonella enterica enterica serovar Typhi Ty2
gauaaacguagcgucaucaggcg

SEQ ID NO: 3721245 - RNA, 19 nt, Salmonella enterica enterica serovar Typhi Ty2
gauaaacugacaucccccu

SEQ ID NO: 3721246 - RNA, 20 nt, Salmonella enterica enterica serovar Typhi Ty2
gauaaagaccggcacaaccg

SEQ ID NO: 3721247 - RNA, 14 nt, Salmonella enterica enterica serovar Typhi Ty2
gauaaagcagcgac

SEQ ID NO: 3721248 - RNA, 15 nt, Salmonella enterica enterica serovar Typhi Ty2
gauaaagcagcgaca

SEQ ID NO: 3721249 - RNA, 14 nt, Salmonella enterica enterica serovar Typhi Ty2
gauaaagcgaauaa

SEQ ID NO: 3721250 - RNA, 20 nt, Salmonella enterica enterica serovar Typhi Ty2
gauaaagcgaccgaucauca

SEQ ID NO: 3721251 - RNA, 18 nt, Salmonella enterica enterica serovar Typhi Ty2
gauaaagcugacgcgccu

SEQ ID NO: 3721252 - RNA, 19 nt, Salmonella enterica enterica serovar Typhi Ty2
gauaaagcugaguaaggac

SEQ ID NO: 3721253 - RNA, 17 nt, Salmonella enterica enterica serovar Typhi Ty2
gauaaagcuuucaucuu

SEQ ID NO: 3721254 - RNA, 16 nt, Salmonella enterica enterica serovar Typhi Ty2
gauaaagugacgaggc

SEQ ID NO: 3721255 - RNA, 22 nt, Salmonella enterica enterica serovar Typhi Ty2
gauaaaguuagcguuauggaag

SEQ ID NO: 3721256 - RNA, 12 nt, Salmonella enterica enterica serovar Typhi Ty2
gauaaaucagcc

SEQ ID NO: 3721257 - RNA, 20 nt, Salmonella enterica enterica serovar Typhi Ty2
gauaacaccgcauggcuggc

SEQ ID NO: 3721258 - RNA, 19 nt, Salmonella enterica enterica serovar Typhi Ty2
gauaacaguauuuguucag

SEQ ID NO: 3721259 - RNA, 11 nt, Salmonella enterica enterica serovar Typhi Ty2
gauaaccagaa

SEQ ID NO: 3721260 - RNA, 20 nt, Salmonella enterica enterica serovar Typhi Ty2
gauaaccccguucgacaacg

SEQ ID NO: 3721261 - RNA, 14 nt, Salmonella enterica enterica serovar Typhi Ty2
gauaaccgccgcca

SEQ ID NO: 3721262 - RNA, 19 nt, Salmonella enterica enterica serovar Typhi Ty2
gauaaccgcguucauacgc

SEQ ID NO: 3721263 - RNA, 13 nt, Salmonella enterica enterica serovar Typhi Ty2
gauaaccugcugu

SEQ ID NO: 3721264 - RNA, 22 nt, Salmonella enterica enterica serovar Typhi Ty2
gauaacgcgauggccaaauaac

SEQ ID NO: 3721265 - RNA, 14 nt, Salmonella enterica enterica serovar Typhi Ty2
gauaacgcgcuggc

SEQ ID NO: 3721266 - RNA, 16 nt, Salmonella enterica enterica serovar Typhi Ty2
gauaacgcgcuggcgg

SEQ ID NO: 3721267 - RNA, 22 nt, Salmonella enterica enterica serovar Typhi Ty2
gauaacgcuaugcuuauccggc

SEQ ID NO: 3721268 - RNA, 20 nt, Salmonella enterica enterica serovar Typhi Ty2
gauaacggucgcucccuacc

SEQ ID NO: 3721269 - RNA, 11 nt, Salmonella enterica enterica serovar Typhi Ty2
gauaacgugcg

SEQ ID NO: 3721270 - RNA, 20 nt, Salmonella enterica enterica serovar Typhi Ty2
gauaacugaagguuuuuccc

SEQ ID NO: 3721271 - RNA, 23 nt, Salmonella enterica enterica serovar Typhi Ty2
gauaacugaagguuuuucccgga

SEQ ID NO: 3721272 - RNA, 23 nt, Salmonella enterica enterica serovar Typhi Ty2
gauaacuuccuuugccuuucuua

SEQ ID NO: 3721273 - RNA, 14 nt, Salmonella enterica enterica serovar Typhi Ty2
gauaacuuucgggu

SEQ ID NO: 3721274 - RNA, 14 nt, Salmonella enterica enterica serovar Typhi Ty2
gauaagacgcuacg

SEQ ID NO: 3721275 - RNA, 22 nt, Salmonella enterica enterica serovar Typhi Ty2
gauaagacugauauccauuggg

SEQ ID NO: 3721276 - RNA, 23 nt, Salmonella enterica enterica serovar Typhi Ty2
gauaagcaacgcgccauccggca

SEQ ID NO: 3721277 - RNA, 16 nt, Salmonella enterica enterica serovar Typhi Ty2
gauaagcaagcgccau

SEQ ID NO: 3721278 - RNA, 14 nt, Salmonella enterica enterica serovar Typhi Ty2
gauaagcacaggcc

SEQ ID NO: 3721279 - RNA, 16 nt, Salmonella enterica enterica serovar Typhi Ty2
gauaagcauagcgcca

SEQ ID NO: 3721280 - RNA, 17 nt, Salmonella enterica enterica serovar Typhi Ty2
gauaagccgcguccggc

SEQ ID NO: 3721281 - RNA, 20 nt, Salmonella enterica enterica serovar Typhi Ty2
gauaagcgaagcgccaucag

SEQ ID NO: 3721282 - RNA, 23 nt, Salmonella enterica enterica serovar Typhi Ty2
gauaagcgaagcgucauccggca

SEQ ID NO: 3721283 - RNA, 19 nt, Salmonella enterica enterica serovar Typhi Ty2
gauaagcgcagcgcaucag

SEQ ID NO: 3721284 - RNA, 22 nt, Salmonella enterica enterica serovar Typhi Ty2
gauaagcgcagcgcaucaggca

SEQ ID NO: 3721285 - RNA, 23 nt, Salmonella enterica enterica serovar Typhi Ty2
gauaagcgcagcgccaucaggca

SEQ ID NO: 3721286 - RNA, 20 nt, Salmonella enterica enterica serovar Typhi Ty2
gauaagcgcagcgucaucag

SEQ ID NO: 3721287 - RNA, 22 nt, Salmonella enterica enterica serovar Typhi Ty2
gauaagcguagcgcauccggca

SEQ ID NO: 3721288 - RNA, 20 nt, Salmonella enterica enterica serovar Typhi Ty2
gauaagcguagcgccaucag

SEQ ID NO: 3721289 - RNA, 23 nt, Salmonella enterica enterica serovar Typhi Ty2
gauaagcguagcgccaucaggca

SEQ ID NO: 3721290 - RNA, 23 nt, Salmonella enterica enterica serovar Typhi Ty2
gauaagcgugagcgcauccggca

SEQ ID NO: 3721291 - RNA, 20 nt, Salmonella enterica enterica serovar Typhi Ty2
gauaagcgugcgccauccgg

SEQ ID NO: 3721292 - RNA, 21 nt, Salmonella enterica enterica serovar Typhi Ty2
gauaagcguuagcgucauccg

SEQ ID NO: 3721293 - RNA, 19 nt, Salmonella enterica enterica serovar Typhi Ty2
gauaagcuaguaaagaaau

SEQ ID NO: 3721294 - RNA, 14 nt, Salmonella enterica enterica serovar Typhi Ty2
gauaaggccacgcc

SEQ ID NO: 3721295 - RNA, 16 nt, Salmonella enterica enterica serovar Typhi Ty2
gauaaggcgugagcca

SEQ ID NO: 3721296 - RNA, 16 nt, Salmonella enterica enterica serovar Typhi Ty2
gauaaggcguucacgc

SEQ ID NO: 3721297 - RNA, 21 nt, Salmonella enterica enterica serovar Typhi Ty2
gauaaggcguucacgccgcca

SEQ ID NO: 3721298 - RNA, 22 nt, Salmonella enterica enterica serovar Typhi Ty2
gauaagguaacgcgaaaaaaga

SEQ ID NO: 3721299 - RNA, 22 nt, Salmonella enterica enterica serovar Typhi Ty2
gauaaggucgcuauccagcagu

SEQ ID NO: 3721300 - RNA, 23 nt, Salmonella enterica enterica serovar Typhi Ty2
gauaagucccggaccgauugacu

SEQ ID NO: 3721301 - RNA, 21 nt, Salmonella enterica enterica serovar Typhi Ty2
gauaaguccuaacaccugcca

SEQ ID NO: 3721302 - RNA, 16 nt, Salmonella enterica enterica serovar Typhi Ty2
gauaauaagacgccag

SEQ ID NO: 3721303 - RNA, 14 nt, Salmonella enterica enterica serovar Typhi Ty2
gauaauaaucauau

SEQ ID NO: 3721304 - RNA, 17 nt, Salmonella enterica enterica serovar Typhi Ty2
gauaauaccucaaaugc

SEQ ID NO: 3721305 - RNA, 14 nt, Salmonella enterica enterica serovar Typhi Ty2
gauaauacgcgcga

SEQ ID NO: 3721306 - RNA, 17 nt, Salmonella enterica enterica serovar Typhi Ty2
gauaauagccucauccc

SEQ ID NO: 3721307 - RNA, 17 nt, Salmonella enterica enterica serovar Typhi Ty2
gauaauaucgucaccag

SEQ ID NO: 3721308 - RNA, 20 nt, Salmonella enterica enterica serovar Typhi Ty2
gauaaucaacaaugucgccu

SEQ ID NO: 3721309 - RNA, 13 nt, Salmonella enterica enterica serovar Typhi Ty2
gauaaucaccagc

SEQ ID NO: 3721310 - RNA, 18 nt, Salmonella enterica enterica serovar Typhi Ty2
gauaaucgccgccagcuc

SEQ ID NO: 3721311 - RNA, 20 nt, Salmonella enterica enterica serovar Typhi Ty2
gauaaucgcgucuacgucag

SEQ ID NO: 3721312 - RNA, 21 nt, Salmonella enterica enterica serovar Typhi Ty2
gauaaucgguagcacuuuaaa

SEQ ID NO: 3721313 - RNA, 20 nt, Salmonella enterica enterica serovar Typhi Ty2
gauaaugaagcauaaaaaga

SEQ ID NO: 3721314 - RNA, 15 nt, Salmonella enterica enterica serovar Typhi Ty2
gauaaugacauccag

SEQ ID NO: 3721315 - RNA, 18 nt, Salmonella enterica enterica serovar Typhi Ty2
gauaaugccgcuggcgua

SEQ ID NO: 3721316 - RNA, 20 nt, Salmonella enterica enterica serovar Typhi Ty2
gauaauggcgccgauaacac

SEQ ID NO: 3721317 - RNA, 23 nt, Salmonella enterica enterica serovar Typhi Ty2
gauaauguauuaucgaugcgcca

SEQ ID NO: 3721318 - RNA, 20 nt, Salmonella enterica enterica serovar Typhi Ty2
gauaauguuggauuauacau

SEQ ID NO: 3721319 - RNA, 21 nt, Salmonella enterica enterica serovar Typhi Ty2
gauaauuaaugcgacgcccaa

SEQ ID NO: 3721320 - RNA, 16 nt, Salmonella enterica enterica serovar Typhi Ty2
gauaauucccccagua

SEQ ID NO: 3721321 - RNA, 20 nt, Salmonella enterica enterica serovar Typhi Ty2
gauauccaccaccugauucu

SEQ ID NO: 3721322 - RNA, 19 nt, Salmonella enterica enterica serovar Typhi Ty2
gauauccagcaccucauca

SEQ ID NO: 3721323 - RNA, 18 nt, Salmonella enterica enterica serovar Typhi Ty2
gauauccgcgcucaacac

SEQ ID NO: 3721324 - RNA, 22 nt, Salmonella enterica enterica serovar Typhi Ty2
gauauccgcgcucaacacauaa

SEQ ID NO: 3721325 - RNA, 23 nt, Salmonella enterica enterica serovar Typhi Ty2
gauaucuuccagcgcguccagcc

SEQ ID NO: 3721326 - RNA, 23 nt, Salmonella enterica enterica serovar Typhi Ty2
gauaucuuuauucgcuuguuuca

SEQ ID NO: 3721327 - RNA, 14 nt, Salmonella enterica enterica serovar Typhi Ty2
gauaugaauaauuu

SEQ ID NO: 3721328 - RNA, 23 nt, Salmonella enterica enterica serovar Typhi Ty2
gauaugaauaauuucggcggcgc

SEQ ID NO: 3721329 - RNA, 18 nt, Salmonella enterica enterica serovar Typhi Ty2
gauaugaccaguacaggc

SEQ ID NO: 3721330 - RNA, 23 nt, Salmonella enterica enterica serovar Typhi Ty2
gauaugaugcgccccgcuucccg

SEQ ID NO: 3721331 - RNA, 14 nt, Salmonella enterica enterica serovar Typhi Ty2
gauaugcagcagcc

SEQ ID NO: 3721332 - RNA, 18 nt, Salmonella enterica enterica serovar Typhi Ty2
gauaugcgacgaaagcgg

SEQ ID NO: 3721333 - RNA, 19 nt, Salmonella enterica enterica serovar Typhi Ty2
gauaugcgacgaaagcggc

SEQ ID NO: 3721334 - RNA, 18 nt, Salmonella enterica enterica serovar Typhi Ty2
gauaugcuugccggaugc

SEQ ID NO: 3721335 - RNA, 17 nt, Salmonella enterica enterica serovar Typhi Ty2
gauauggaugcgcugcu

SEQ ID NO: 3721336 - RNA, 14 nt, Salmonella enterica enterica serovar Typhi Ty2
gauauggcggcggc

SEQ ID NO: 3721337 - RNA, 20 nt, Salmonella enterica enterica serovar Typhi Ty2
gauauguauuuguucucgag

SEQ ID NO: 3721338 - RNA, 13 nt, Salmonella enterica enterica serovar Typhi Ty2
gauauucaucgcc

SEQ ID NO: 3721339 - RNA, 13 nt, Salmonella enterica enterica serovar Typhi Ty2
gauauuccauaca

SEQ ID NO: 3721340 - RNA, 18 nt, Salmonella enterica enterica serovar Typhi Ty2
gauauucccguuccagcu

SEQ ID NO: 3721341 - RNA, 12 nt, Salmonella enterica enterica serovar Typhi Ty2
gauauuccgcgc

SEQ ID NO: 3721342 - RNA, 15 nt, Salmonella enterica enterica serovar Typhi Ty2
gauauucgccugucu

SEQ ID NO: 3721343 - RNA, 15 nt, Salmonella enterica enterica serovar Typhi Ty2
gauauucugcacgca

SEQ ID NO: 3721344 - RNA, 20 nt, Salmonella enterica enterica serovar Typhi Ty2
gauauugugcauacugauuu

SEQ ID NO: 3721345 - RNA, 22 nt, Salmonella enterica enterica serovar Typhi Ty2
gauauuguguuuaccucauaua

SEQ ID NO: 3721346 - RNA, 22 nt, Salmonella enterica enterica serovar Typhi Ty2
gauauuuauuauuuccagguua

SEQ ID NO: 3721347 - RNA, 19 nt, Salmonella enterica enterica serovar Typhi Ty2
gauauuucgccuaucaugc

SEQ ID NO: 3721348 - RNA, 21 nt, Salmonella enterica enterica serovar Typhi Ty2
gauauuuuguuuuaaauucaa

SEQ ID NO: 3721349 - RNA, 18 nt, Salmonella enterica enterica serovar Typhi Ty2
gaucaauaaaauuaucca

SEQ ID NO: 3721350 - RNA, 21 nt, Salmonella enterica enterica serovar Typhi Ty2
gaucaauaaaauuauccaguu

SEQ ID NO: 3721351 - RNA, 14 nt, Salmonella enterica enterica serovar Typhi Ty2
gaucaccagcccuu

SEQ ID NO: 3721352 - RNA, 17 nt, Salmonella enterica enterica serovar Typhi Ty2
gaucaccaucuucacau

SEQ ID NO: 3721353 - RNA, 17 nt, Salmonella enterica enterica serovar Typhi Ty2
gaucacccacaccacag

SEQ ID NO: 3721354 - RNA, 16 nt, Salmonella enterica enterica serovar Typhi Ty2
gaucacccacaucagc

SEQ ID NO: 3721355 - RNA, 21 nt, Salmonella enterica enterica serovar Typhi Ty2
gaucaccugaaugcaaagaag

SEQ ID NO: 3721356 - RNA, 15 nt, Salmonella enterica enterica serovar Typhi Ty2
gaucacgccagcgcu

SEQ ID NO: 3721357 - RNA, 19 nt, Salmonella enterica enterica serovar Typhi Ty2
gaucacgccguccagcacc

SEQ ID NO: 3721358 - RNA, 14 nt, Salmonella enterica enterica serovar Typhi Ty2
gaucacggugguga

SEQ ID NO: 3721359 - RNA, 12 nt, Salmonella enterica enterica serovar Typhi Ty2
gaucacuuguuu

SEQ ID NO: 3721360 - RNA, 21 nt, Salmonella enterica enterica serovar Typhi Ty2
gaucagaaauucgcagcgcag

SEQ ID NO: 3721361 - RNA, 22 nt, Salmonella enterica enterica serovar Typhi Ty2
gaucagaaauucgcagcgcagg

SEQ ID NO: 3721362 - RNA, 15 nt, Salmonella enterica enterica serovar Typhi Ty2
gaucagaccaucggc

SEQ ID NO: 3721363 - RNA, 16 nt, Salmonella enterica enterica serovar Typhi Ty2
gaucagaccaucggcc

SEQ ID NO: 3721364 - RNA, 21 nt, Salmonella enterica enterica serovar Typhi Ty2
gaucagaccaucggccgcuau

SEQ ID NO: 3721365 - RNA, 19 nt, Salmonella enterica enterica serovar Typhi Ty2
gaucagacgcaucaggaac

SEQ ID NO: 3721366 - RNA, 20 nt, Salmonella enterica enterica serovar Typhi Ty2
gaucagauauuccagcgaca

SEQ ID NO: 3721367 - RNA, 15 nt, Salmonella enterica enterica serovar Typhi Ty2
gaucagcacgcgccg

SEQ ID NO: 3721368 - RNA, 18 nt, Salmonella enterica enterica serovar Typhi Ty2
gaucagcgcgcuccagac

SEQ ID NO: 3721369 - RNA, 17 nt, Salmonella enterica enterica serovar Typhi Ty2
gaucaggaaaucuucca

SEQ ID NO: 3721370 - RNA, 21 nt, Salmonella enterica enterica serovar Typhi Ty2
gaucaggcguuagccgccauc

SEQ ID NO: 3721371 - RNA, 18 nt, Salmonella enterica enterica serovar Typhi Ty2
gaucaguggcgccgcaau

SEQ ID NO: 3721372 - RNA, 14 nt, Salmonella enterica enterica serovar Typhi Ty2
gaucaguuccggau

SEQ ID NO: 3721373 - RNA, 21 nt, Salmonella enterica enterica serovar Typhi Ty2
gaucauaccggcagcagugag

SEQ ID NO: 3721374 - RNA, 19 nt, Salmonella enterica enterica serovar Typhi Ty2
gaucaucccgagauuguca

SEQ ID NO: 3721375 - RNA, 22 nt, Salmonella enterica enterica serovar Typhi Ty2
gaucauccggguuaaaccagcu

SEQ ID NO: 3721376 - RNA, 13 nt, Salmonella enterica enterica serovar Typhi Ty2
gaucaucuucacu

SEQ ID NO: 3721377 - RNA, 23 nt, Salmonella enterica enterica serovar Typhi Ty2
gaucaucuucacuucacaaacaa

SEQ ID NO: 3721378 - RNA, 17 nt, Salmonella enterica enterica serovar Typhi Ty2
gaucaugaaaaauauaa

SEQ ID NO: 3721379 - RNA, 19 nt, Salmonella enterica enterica serovar Typhi Ty2
gaucaugaggaugagcguu

SEQ ID NO: 3721380 - RNA, 21 nt, Salmonella enterica enterica serovar Typhi Ty2
gaucaugagucgcgcgcgcca

SEQ ID NO: 3721381 - RNA, 15 nt, Salmonella enterica enterica serovar Typhi Ty2
gaucaugccgcccag

SEQ ID NO: 3721382 - RNA, 20 nt, Salmonella enterica enterica serovar Typhi Ty2
gaucaugccgcccaggccau

SEQ ID NO: 3721383 - RNA, 19 nt, Salmonella enterica enterica serovar Typhi Ty2
gaucaugcguccgcccaga

SEQ ID NO: 3721384 - RNA, 23 nt, Salmonella enterica enterica serovar Typhi Ty2
gauccaacacaucgacaugcaga

SEQ ID NO: 3721385 - RNA, 16 nt, Salmonella enterica enterica serovar Typhi Ty2
gauccaacacggcgcu

SEQ ID NO: 3721386 - RNA, 22 nt, Salmonella enterica enterica serovar Typhi Ty2
gauccaccaaguauuugaguuc

SEQ ID NO: 3721387 - RNA, 16 nt, Salmonella enterica enterica serovar Typhi Ty2
gauccaccaccagcau

SEQ ID NO: 3721388 - RNA, 18 nt, Salmonella enterica enterica serovar Typhi Ty2
gauccagcgauugacggu

SEQ ID NO: 3721389 - RNA, 13 nt, Salmonella enterica enterica serovar Typhi Ty2
gauccagcgggcc

SEQ ID NO: 3721390 - RNA, 13 nt, Salmonella enterica enterica serovar Typhi Ty2
gauccagcucuuc

SEQ ID NO: 3721391 - RNA, 16 nt, Salmonella enterica enterica serovar Typhi Ty2
gauccaggucuuccgc

SEQ ID NO: 3721392 - RNA, 20 nt, Salmonella enterica enterica serovar Typhi Ty2
gauccaucgguucucugcca

SEQ ID NO: 3721393 - RNA, 21 nt, Salmonella enterica enterica serovar Typhi Ty2
gauccaucgguucucugccau

SEQ ID NO: 3721394 - RNA, 11 nt, Salmonella enterica enterica serovar Typhi Ty2
gaucccaccag

SEQ ID NO: 3721395 - RNA, 16 nt, Salmonella enterica enterica serovar Typhi Ty2
gaucccaggccggcau

SEQ ID NO: 3721396 - RNA, 19 nt, Salmonella enterica enterica serovar Typhi Ty2
gauccccaacgacagcacu

SEQ ID NO: 3721397 - RNA, 13 nt, Salmonella enterica enterica serovar Typhi Ty2
gaucccccagaau

SEQ ID NO: 3721398 - RNA, 20 nt, Salmonella enterica enterica serovar Typhi Ty2
gauccccucuuccaucagcc

SEQ ID NO: 3721399 - RNA, 14 nt, Salmonella enterica enterica serovar Typhi Ty2
gaucccgacucuga

SEQ ID NO: 3721400 - RNA, 16 nt, Salmonella enterica enterica serovar Typhi Ty2
gaucccggccuucgaa

SEQ ID NO: 3721401 - RNA, 19 nt, Salmonella enterica enterica serovar Typhi Ty2
gaucccuaauaaaauaacu

SEQ ID NO: 3721402 - RNA, 19 nt, Salmonella enterica enterica serovar Typhi Ty2
gauccgacaugaugccaaa

SEQ ID NO: 3721403 - RNA, 19 nt, Salmonella enterica enterica serovar Typhi Ty2
gaugacucauuaaaaaaac

SEQ ID NO: 3721404 - RNA, 17 nt, Salmonella enterica enterica serovar Typhi Ty2
gaugacucucggccuau

SEQ ID NO: 3721405 - RNA, 19 nt, Salmonella enterica enterica serovar Typhi Ty2
gaugagauccgggcuggca

SEQ ID NO: 3721406 - RNA, 15 nt, Salmonella enterica enterica serovar Typhi Ty2
gaugagcaggccagg

SEQ ID NO: 3721407 - RNA, 13 nt, Salmonella enterica enterica serovar Typhi Ty2
gaugagcgcgaaa

SEQ ID NO: 3721408 - RNA, 22 nt, Salmonella enterica enterica serovar Typhi Ty2
gaugaggaccguuugugccggg

SEQ ID NO: 3721409 - RNA, 19 nt, Salmonella enterica enterica serovar Typhi Ty2
gaugaggcgcagccgccau

SEQ ID NO: 3721410 - RNA, 22 nt, Salmonella enterica enterica serovar Typhi Ty2
gaugaucgucgcgaucgcgcca

SEQ ID NO: 3721411 - RNA, 12 nt, Salmonella enterica enterica serovar Typhi Ty2
gaugaucuucau

SEQ ID NO: 3721412 - RNA, 13 nt, Salmonella enterica enterica serovar Typhi Ty2
gaugaucuucaua

SEQ ID NO: 3721413 - RNA, 22 nt, Salmonella enterica enterica serovar Typhi Ty2
gaugaugcguuuguuggagauc

SEQ ID NO: 3721414 - RNA, 13 nt, Salmonella enterica enterica serovar Typhi Ty2
gaugauggcggcu

SEQ ID NO: 3721415 - RNA, 14 nt, Salmonella enterica enterica serovar Typhi Ty2
gaugauguacaggu

SEQ ID NO: 3721416 - RNA, 23 nt, Salmonella enterica enterica serovar Typhi Ty2
gaugauguuugugaccccggccu

SEQ ID NO: 3721417 - RNA, 16 nt, Salmonella enterica enterica serovar Typhi Ty2
gaugauuauuguuaaa

SEQ ID NO: 3721418 - RNA, 14 nt, Salmonella enterica enterica serovar Typhi Ty2
gaugauucacccuc

SEQ ID NO: 3721419 - RNA, 19 nt, Salmonella enterica enterica serovar Typhi Ty2
gaugauuggccuccaccgu

SEQ ID NO: 3721420 - RNA, 13 nt, Salmonella enterica enterica serovar Typhi Ty2
gaugcaaauguca

SEQ ID NO: 3721421 - RNA, 11 nt, Salmonella enterica enterica serovar Typhi Ty2
gaugcagcacc

SEQ ID NO: 3721422 - RNA, 20 nt, Salmonella enterica enterica serovar Typhi Ty2
gaugcaggccaagcagcgcc

SEQ ID NO: 3721423 - RNA, 15 nt, Salmonella enterica enterica serovar Typhi Ty2
gaugcauaaaaaaac

SEQ ID NO: 3721424 - RNA, 13 nt, Salmonella enterica enterica serovar Typhi Ty2
gaugcauuugauu

SEQ ID NO: 3721425 - RNA, 23 nt, Salmonella enterica enterica serovar Typhi Ty2
gaugccaaacaucgcucgcgcca

SEQ ID NO: 3721426 - RNA, 21 nt, Salmonella enterica enterica serovar Typhi Ty2
gaugcccaccugaaaaagggu

SEQ ID NO: 3721427 - RNA, 19 nt, Salmonella enterica enterica serovar Typhi Ty2
gaugcccagguuagcagcc

SEQ ID NO: 3721428 - RNA, 21 nt, Salmonella enterica enterica serovar Typhi Ty2
gaugccccaucucuuucagaa

SEQ ID NO: 3721429 - RNA, 15 nt, Salmonella enterica enterica serovar Typhi Ty2
gaugcccguaaagcu

SEQ ID NO: 3721430 - RNA, 18 nt, Salmonella enterica enterica serovar Typhi Ty2
gaugccgaucaccagcgc

SEQ ID NO: 3721431 - RNA, 18 nt, Salmonella enterica enterica serovar Typhi Ty2
gaugccgccgacaaccag

SEQ ID NO: 3721432 - RNA, 19 nt, Salmonella enterica enterica serovar Typhi Ty2
gaugccgccgcaacgcgca

SEQ ID NO: 3721433 - RNA, 17 nt, Salmonella enterica enterica serovar Typhi Ty2
gaugccgcuucgccacu

SEQ ID NO: 3721434 - RNA, 16 nt, Salmonella enterica enterica serovar Typhi Ty2
gaugccgugaggcuga

SEQ ID NO: 3721435 - RNA, 15 nt, Salmonella enterica enterica serovar Typhi Ty2
gaugcgaaucuucau

SEQ ID NO: 3721436 - RNA, 15 nt, Salmonella enterica enterica serovar Typhi Ty2
gaugcgacucggugc

SEQ ID NO: 3721437 - RNA, 13 nt, Salmonella enterica enterica serovar Typhi Ty2
gaugcgccaguac

SEQ ID NO: 3721438 - RNA, 18 nt, Salmonella enterica enterica serovar Typhi Ty2
gaugcgccaguucagcgu

SEQ ID NO: 3721439 - RNA, 16 nt, Salmonella enterica enterica serovar Typhi Ty2
gaugcgccauccacca

SEQ ID NO: 3721440 - RNA, 14 nt, Salmonella enterica enterica serovar Typhi Ty2
gaugcgccauccca

SEQ ID NO: 3721441 - RNA, 13 nt, Salmonella enterica enterica serovar Typhi Ty2
gaugcgccuguaa

SEQ ID NO: 3721442 - RNA, 21 nt, Salmonella enterica enterica serovar Typhi Ty2
gaugcgccugucuccagcgcc

SEQ ID NO: 3721443 - RNA, 22 nt, Salmonella enterica enterica serovar Typhi Ty2
gaugcgcguuuagcgccagcag

SEQ ID NO: 3721444 - RNA, 16 nt, Salmonella enterica enterica serovar Typhi Ty2
gaugcgcugcgcgcga

SEQ ID NO: 3721445 - RNA, 14 nt, Salmonella enterica enterica serovar Typhi Ty2
gaugcgcugcuaaa

SEQ ID NO: 3721446 - RNA, 14 nt, Salmonella enterica enterica serovar Typhi Ty2
gaugcggaagagaa

SEQ ID NO: 3721447 - RNA, 20 nt, Salmonella enterica enterica serovar Typhi Ty2
gaugcggcgccaacgcgcua

SEQ ID NO: 3721448 - RNA, 22 nt, Salmonella enterica enterica serovar Typhi Ty2
gaugcggcuagcgccuuauccg

SEQ ID NO: 3721449 - RNA, 18 nt, Salmonella enterica enterica serovar Typhi Ty2
gaugcgggccgacaaaaa

SEQ ID NO: 3721450 - RNA, 17 nt, Salmonella enterica enterica serovar Typhi Ty2
gaugcguaauccggccu

SEQ ID NO: 3721451 - RNA, 20 nt, Salmonella enterica enterica serovar Typhi Ty2
gaugcguaccgcuaucgcca

SEQ ID NO: 3721452 - RNA, 14 nt, Salmonella enterica enterica serovar Typhi Ty2
gaugcguucaaaga

SEQ ID NO: 3721453 - RNA, 22 nt, Salmonella enterica enterica serovar Typhi Ty2
gaugcuaaccucuauaguaaau

SEQ ID NO: 3721454 - RNA, 21 nt, Salmonella enterica enterica serovar Typhi Ty2
gaugcuaucgcggauaagccc

SEQ ID NO: 3721455 - RNA, 22 nt, Salmonella enterica enterica serovar Typhi Ty2
gaugcucgccgucggcagacug

SEQ ID NO: 3721456 - RNA, 15 nt, Salmonella enterica enterica serovar Typhi Ty2
gaugcucgcucauca

SEQ ID NO: 3721457 - RNA, 18 nt, Salmonella enterica enterica serovar Typhi Ty2
gaugcugaauagccagcc

SEQ ID NO: 3721458 - RNA, 19 nt, Salmonella enterica enterica serovar Typhi Ty2
gaugcugauguccgcagcc

SEQ ID NO: 3721459 - RNA, 18 nt, Salmonella enterica enterica serovar Typhi Ty2
gaugcugauuaaugauuu

SEQ ID NO: 3721460 - RNA, 21 nt, Salmonella enterica enterica serovar Typhi Ty2
gaugcugcgcauccgcggcgc

SEQ ID NO: 3721461 - RNA, 22 nt, Salmonella enterica enterica serovar Typhi Ty2
gaugcugguuuuagcuuauccc

SEQ ID NO: 3721462 - RNA, 21 nt, Salmonella enterica enterica serovar Typhi Ty2
gaugcugucuuagugaaagac

SEQ ID NO: 3721463 - RNA, 15 nt, Salmonella enterica enterica serovar Typhi Ty2
gauggaacagacgcc

SEQ ID NO: 3721464 - RNA, 18 nt, Salmonella enterica enterica serovar Typhi Ty2
gauggacaauccgcgaau

SEQ ID NO: 3721465 - RNA, 19 nt, Salmonella enterica enterica serovar Typhi Ty2
gauggacggauuggcgcuc

SEQ ID NO: 3721466 - RNA, 15 nt, Salmonella enterica enterica serovar Typhi Ty2
gauggauaaccugcc

SEQ ID NO: 3721467 - RNA, 19 nt, Salmonella enterica enterica serovar Typhi Ty2
gauggcacgauaaccagau

SEQ ID NO: 3721468 - RNA, 20 nt, Salmonella enterica enterica serovar Typhi Ty2
gauggcacugcgcuuauccg

SEQ ID NO: 3721469 - RNA, 17 nt, Salmonella enterica enterica serovar Typhi Ty2
gauggccaaauaaccca

SEQ ID NO: 3721470 - RNA, 17 nt, Salmonella enterica enterica serovar Typhi Ty2
gauggccaaugaugcgc

SEQ ID NO: 3721471 - RNA, 16 nt, Salmonella enterica enterica serovar Typhi Ty2
gauggccagcaccagc

SEQ ID NO: 3721472 - RNA, 13 nt, Salmonella enterica enterica serovar Typhi Ty2
gauggccucauca

SEQ ID NO: 3721473 - RNA, 22 nt, Salmonella enterica enterica serovar Typhi Ty2
gauggcgacuaccucuuauccg

SEQ ID NO: 3721474 - RNA, 19 nt, Salmonella enterica enterica serovar Typhi Ty2
gauggcgagaagcugggcg

SEQ ID NO: 3721475 - RNA, 19 nt, Salmonella enterica enterica serovar Typhi Ty2
gauggcgcgacgcuuauca

SEQ ID NO: 3721476 - RNA, 13 nt, Salmonella enterica enterica serovar Typhi Ty2
gauggcgcgcuua

SEQ ID NO: 3721477 - RNA, 17 nt, Salmonella enterica enterica serovar Typhi Ty2
gauggcgcgcuuaucug

SEQ ID NO: 3721478 - RNA, 18 nt, Salmonella enterica enterica serovar Typhi Ty2
gauggcgcuaagccagcc

SEQ ID NO: 3721479 - RNA, 20 nt, Salmonella enterica enterica serovar Typhi Ty2
gauggcgcuacgcuuaucag

SEQ ID NO: 3721480 - RNA, 18 nt, Salmonella enterica enterica serovar Typhi Ty2
gauggcgcuagcuuaucg

SEQ ID NO: 3721481 - RNA, 15 nt, Salmonella enterica enterica serovar Typhi Ty2
gauggcgcuccugaa

SEQ ID NO: 3721482 - RNA, 17 nt, Salmonella enterica enterica serovar Typhi Ty2
gauggcgcuccugaauc

SEQ ID NO: 3721483 - RNA, 20 nt, Salmonella enterica enterica serovar Typhi Ty2
gauggcgcugcgcuuaccca

SEQ ID NO: 3721484 - RNA, 17 nt, Salmonella enterica enterica serovar Typhi Ty2
gauggcgcugcgcuuau

SEQ ID NO: 3721485 - RNA, 17 nt, Salmonella enterica enterica serovar Typhi Ty2
gauucgcuacugcaucu

SEQ ID NO: 3721486 - RNA, 14 nt, Salmonella enterica enterica serovar Typhi Ty2
gauucggacucaua

SEQ ID NO: 3721487 - RNA, 18 nt, Salmonella enterica enterica serovar Typhi Ty2
gauucggacucauacuug

SEQ ID NO: 3721488 - RNA, 13 nt, Salmonella enterica enterica serovar Typhi Ty2
gauucuacugguu

SEQ ID NO: 3721489 - RNA, 22 nt, Salmonella enterica enterica serovar Typhi Ty2
gauucuaucuguuuuaauuccu

SEQ ID NO: 3721490 - RNA, 20 nt, Salmonella enterica enterica serovar Typhi Ty2
gauucucuaacgucagcgcc

SEQ ID NO: 3721491 - RNA, 15 nt, Salmonella enterica enterica serovar Typhi Ty2
gauucugcaggccaa

SEQ ID NO: 3721492 - RNA, 15 nt, Salmonella enterica enterica serovar Typhi Ty2
gauucugccaguuca

SEQ ID NO: 3721493 - RNA, 18 nt, Salmonella enterica enterica serovar Typhi Ty2
gauucuggcgaguuucac

SEQ ID NO: 3721494 - RNA, 15 nt, Salmonella enterica enterica serovar Typhi Ty2
gauugaaacgaaaac

SEQ ID NO: 3721495 - RNA, 16 nt, Salmonella enterica enterica serovar Typhi Ty2
gauugagacaaauaac

SEQ ID NO: 3721496 - RNA, 20 nt, Salmonella enterica enterica serovar Typhi Ty2
gauugaggcggguaauuugc

SEQ ID NO: 3721497 - RNA, 21 nt, Salmonella enterica enterica serovar Typhi Ty2
gauugaggcggguaauuugcg

SEQ ID NO: 3721498 - RNA, 21 nt, Salmonella enterica enterica serovar Typhi Ty2
gauugagggggaggcggcgag

SEQ ID NO: 3721499 - RNA, 20 nt, Salmonella enterica enterica serovar Typhi Ty2
gauugauuuauucacuggca

SEQ ID NO: 3721500 - RNA, 22 nt, Salmonella enterica enterica serovar Typhi Ty2
gauugcauaucgcuaaaccaaa

SEQ ID NO: 3721501 - RNA, 22 nt, Salmonella enterica enterica serovar Typhi Ty2
gauugccgccaucuuuacccug

SEQ ID NO: 3721502 - RNA, 17 nt, Salmonella enterica enterica serovar Typhi Ty2
gauugccggaagcggac

SEQ ID NO: 3721503 - RNA, 19 nt, Salmonella enterica enterica serovar Typhi Ty2
gauuggcugugacaauuca

SEQ ID NO: 3721504 - RNA, 20 nt, Salmonella enterica enterica serovar Typhi Ty2
gauugucacaccggcggagu

SEQ ID NO: 3721505 - RNA, 18 nt, Salmonella enterica enterica serovar Typhi Ty2
gauugucuuaaauaugaa

SEQ ID NO: 3721506 - RNA, 23 nt, Salmonella enterica enterica serovar Typhi Ty2
gauuguuucggauaauucugacu

SEQ ID NO: 3721507 - RNA, 18 nt, Salmonella enterica enterica serovar Typhi Ty2
gauuuaaaacaagcagua

SEQ ID NO: 3721508 - RNA, 22 nt, Salmonella enterica enterica serovar Typhi Ty2
gauuuagguucuggcgccgcaa

SEQ ID NO: 3721509 - RNA, 14 nt, Salmonella enterica enterica serovar Typhi Ty2
gauuuaucuucucu

SEQ ID NO: 3721510 - RNA, 22 nt, Salmonella enterica enterica serovar Typhi Ty2
gauuuaucuucucuaucagcgc

SEQ ID NO: 3721511 - RNA, 21 nt, Salmonella enterica enterica serovar Typhi Ty2
gauuuauguaccgucaucgcc

SEQ ID NO: 3721512 - RNA, 18 nt, Salmonella enterica enterica serovar Typhi Ty2
gauuuauuuugaauuuuu

SEQ ID NO: 3721513 - RNA, 14 nt, Salmonella enterica enterica serovar Typhi Ty2
gauuucaucaggcu

SEQ ID NO: 3721514 - RNA, 14 nt, Salmonella enterica enterica serovar Typhi Ty2
gauuucauccucuu

SEQ ID NO: 3721515 - RNA, 22 nt, Salmonella enterica enterica serovar Typhi Ty2
gauuucaugcggugcaugaaua

SEQ ID NO: 3721516 - RNA, 19 nt, Salmonella enterica enterica serovar Typhi Ty2
gauuuccagcgaauaauga

SEQ ID NO: 3721517 - RNA, 13 nt, Salmonella enterica enterica serovar Typhi Ty2
gauuuccagcgcc

SEQ ID NO: 3721518 - RNA, 20 nt, Salmonella enterica enterica serovar Typhi Ty2
gauuucgacgauaaaaaaag

SEQ ID NO: 3721519 - RNA, 15 nt, Salmonella enterica enterica serovar Typhi Ty2
gauuucuuaauuccu

SEQ ID NO: 3721520 - RNA, 21 nt, Salmonella enterica enterica serovar Typhi Ty2
gauuucuugagcggcaucacu

SEQ ID NO: 3721521 - RNA, 17 nt, Salmonella enterica enterica serovar Typhi Ty2
gauuugcgcucgcgcca

SEQ ID NO: 3721522 - RNA, 13 nt, Salmonella enterica enterica serovar Typhi Ty2
gauuugcggcaau

SEQ ID NO: 3721523 - RNA, 23 nt, Salmonella enterica enterica serovar Typhi Ty2
gauuugcugcugcucgcuaugaa

SEQ ID NO: 3721524 - RNA, 21 nt, Salmonella enterica enterica serovar Typhi Ty2
gauuuggucagucggauaaac

SEQ ID NO: 3721525 - RNA, 12 nt, Salmonella enterica enterica serovar Typhi Ty2
gauuuguuaucu

SEQ ID NO: 3721526 - RNA, 20 nt, Salmonella enterica enterica serovar Typhi Ty2
gauuuguuuuuuauauuuuu

SEQ ID NO: 3721527 - RNA, 12 nt, Salmonella enterica enterica serovar Typhi Ty2
gauuuuaaauug

SEQ ID NO: 3721528 - RNA, 21 nt, Salmonella enterica enterica serovar Typhi Ty2
gauuuuaagcauccaggaagu

SEQ ID NO: 3721529 - RNA, 19 nt, Salmonella enterica enterica serovar Typhi Ty2
gauuuuagcgcaucgcucc

SEQ ID NO: 3721530 - RNA, 20 nt, Salmonella enterica enterica serovar Typhi Ty2
gauuuucccuucugaaauga

SEQ ID NO: 3721531 - RNA, 17 nt, Salmonella enterica enterica serovar Typhi Ty2
gauuuuccguuaagcug

SEQ ID NO: 3721532 - RNA, 20 nt, Salmonella enterica enterica serovar Typhi Ty2
gauuuucuuauuacaagaaa

SEQ ID NO: 3721533 - RNA, 13 nt, Salmonella enterica enterica serovar Typhi Ty2
gauuuugaaggug

SEQ ID NO: 3721534 - RNA, 15 nt, Salmonella enterica enterica serovar Typhi Ty2
gauuuugagcacugu

SEQ ID NO: 3721535 - RNA, 15 nt, Salmonella enterica enterica serovar Typhi Ty2
gauuuugcguuacug

SEQ ID NO: 3721536 - RNA, 13 nt, Salmonella enterica enterica serovar Typhi Ty2
gauuuuguuaugc

SEQ ID NO: 3721537 - RNA, 16 nt, Salmonella enterica enterica serovar Typhi Ty2
gauuuuuaaaauguuu

SEQ ID NO: 3721538 - RNA, 20 nt, Salmonella enterica enterica serovar Typhi Ty2
gauuuuucaucuucaguaag

SEQ ID NO: 3721539 - RNA, 13 nt, Salmonella enterica enterica serovar Typhi Ty2
gauuuuuuugcug

SEQ ID NO: 3721540 - RNA, 14 nt, Salmonella enterica enterica serovar Typhi Ty2
gauuuuuuugcugg

SEQ ID NO: 3721541 - RNA, 19 nt, Salmonella enterica enterica serovar Typhi Ty2
gcaaaaacaccuaacccac

SEQ ID NO: 3721542 - RNA, 15 nt, Salmonella enterica enterica serovar Typhi Ty2
gcaaaaauaggcuuu

SEQ ID NO: 3721543 - RNA, 18 nt, Salmonella enterica enterica serovar Typhi Ty2
gcaaaaccagacgccgau

SEQ ID NO: 3721544 - RNA, 18 nt, Salmonella enterica enterica serovar Typhi Ty2
gcaaaaccuucauaaaua

SEQ ID NO: 3721545 - RNA, 15 nt, Salmonella enterica enterica serovar Typhi Ty2
gcaaaacgccgcaga

SEQ ID NO: 3721546 - RNA, 17 nt, Salmonella enterica enterica serovar Typhi Ty2
gcaaaacgggcggcggc

SEQ ID NO: 3721547 - RNA, 20 nt, Salmonella enterica enterica serovar Typhi Ty2
gcaaaacuaaacccggccug

SEQ ID NO: 3721548 - RNA, 12 nt, Salmonella enterica enterica serovar Typhi Ty2
gcaaaagaaaaa

SEQ ID NO: 3721549 - RNA, 13 nt, Salmonella enterica enterica serovar Typhi Ty2
gcaaaagaaaaaa

SEQ ID NO: 3721550 - RNA, 22 nt, Salmonella enterica enterica serovar Typhi Ty2
gcaaaagaggcuaauuaucugc

SEQ ID NO: 3721551 - RNA, 18 nt, Salmonella enterica enterica serovar Typhi Ty2
gcaaaagcgguaauaacu

SEQ ID NO: 3721552 - RNA, 17 nt, Salmonella enterica enterica serovar Typhi Ty2
gcaaaauaccggcagcg

SEQ ID NO: 3721553 - RNA, 23 nt, Salmonella enterica enterica serovar Typhi Ty2
gcaaaauaguucagcgcagagug

SEQ ID NO: 3721554 - RNA, 15 nt, Salmonella enterica enterica serovar Typhi Ty2
gcaaaauauauaauu

SEQ ID NO: 3721555 - RNA, 14 nt, Salmonella enterica enterica serovar Typhi Ty2
gcaaaaugcuucuu

SEQ ID NO: 3721556 - RNA, 19 nt, Salmonella enterica enterica serovar Typhi Ty2
gcaaaauggcaauugcgcc

SEQ ID NO: 3721557 - RNA, 13 nt, Salmonella enterica enterica serovar Typhi Ty2
gcaaaauuacuuc

SEQ ID NO: 3721558 - RNA, 15 nt, Salmonella enterica enterica serovar Typhi Ty2
gcaaaauucacacca

SEQ ID NO: 3721559 - RNA, 16 nt, Salmonella enterica enterica serovar Typhi Ty2
gcaaaauuccggcuga

SEQ ID NO: 3721560 - RNA, 20 nt, Salmonella enterica enterica serovar Typhi Ty2
gcaaacacaaucacgcccag

SEQ ID NO: 3721561 - RNA, 18 nt, Salmonella enterica enterica serovar Typhi Ty2
gcaaacaccucagccacc

SEQ ID NO: 3721562 - RNA, 16 nt, Salmonella enterica enterica serovar Typhi Ty2
gcaaacagagcgccgg

SEQ ID NO: 3721563 - RNA, 18 nt, Salmonella enterica enterica serovar Typhi Ty2
gcaaacagagcgccggca

SEQ ID NO: 3721564 - RNA, 14 nt, Salmonella enterica enterica serovar Typhi Ty2
gcaaacagcacgcc

SEQ ID NO: 3721565 - RNA, 17 nt, Salmonella enterica enterica serovar Typhi Ty2
gcaaacaguacgcccgc

SEQ ID NO: 3721566 - RNA, 12 nt, Salmonella enterica enterica serovar Typhi Ty2
gcaaacaucccc

SEQ ID NO: 3721567 - RNA, 15 nt, Salmonella enterica enterica serovar Typhi Ty2
gcaacggccagcgca

SEQ ID NO: 3721568 - RNA, 17 nt, Salmonella enterica enterica serovar Typhi Ty2
gcaacggccagcgcagg

SEQ ID NO: 3721569 - RNA, 19 nt, Salmonella enterica enterica serovar Typhi Ty2
gcaacggcgaggugcuggu

SEQ ID NO: 3721570 - RNA, 14 nt, Salmonella enterica enterica serovar Typhi Ty2
gcaacggcgcuaag

SEQ ID NO: 3721571 - RNA, 16 nt, Salmonella enterica enterica serovar Typhi Ty2
gcaacgggcaaugcca

SEQ ID NO: 3721572 - RNA, 15 nt, Salmonella enterica enterica serovar Typhi Ty2
gcaacgggcagucug

SEQ ID NO: 3721573 - RNA, 21 nt, Salmonella enterica enterica serovar Typhi Ty2
gcaacggguuagacucagcga

SEQ ID NO: 3721574 - RNA, 22 nt, Salmonella enterica enterica serovar Typhi Ty2
gcaacguaaucccgccagccuu

SEQ ID NO: 3721575 - RNA, 15 nt, Salmonella enterica enterica serovar Typhi Ty2
gcaacguccgcagcc

SEQ ID NO: 3721576 - RNA, 18 nt, Salmonella enterica enterica serovar Typhi Ty2
gcaacgugaacugcgccu

SEQ ID NO: 3721577 - RNA, 22 nt, Salmonella enterica enterica serovar Typhi Ty2
gcaacguucagcucgauccggc

SEQ ID NO: 3721578 - RNA, 20 nt, Salmonella enterica enterica serovar Typhi Ty2
gcaacguuucuuucaucaga

SEQ ID NO: 3721579 - RNA, 21 nt, Salmonella enterica enterica serovar Typhi Ty2
gcaacguuucuuucaucagau

SEQ ID NO: 3721580 - RNA, 18 nt, Salmonella enterica enterica serovar Typhi Ty2
gcaacguuuguaacagca

SEQ ID NO: 3721581 - RNA, 17 nt, Salmonella enterica enterica serovar Typhi Ty2
gcaacugauuaaucugc

SEQ ID NO: 3721582 - RNA, 19 nt, Salmonella enterica enterica serovar Typhi Ty2
gcaacugauuaaucugccg

SEQ ID NO: 3721583 - RNA, 17 nt, Salmonella enterica enterica serovar Typhi Ty2
gcaacugccggcuuacc

SEQ ID NO: 3721584 - RNA, 19 nt, Salmonella enterica enterica serovar Typhi Ty2
gcaacugccggcuuaccag

SEQ ID NO: 3721585 - RNA, 11 nt, Salmonella enterica enterica serovar Typhi Ty2
gcaacugcgcc

SEQ ID NO: 3721586 - RNA, 19 nt, Salmonella enterica enterica serovar Typhi Ty2
gcaacugcugcgcgugcug

SEQ ID NO: 3721587 - RNA, 15 nt, Salmonella enterica enterica serovar Typhi Ty2
gcaacuggcaauagc

SEQ ID NO: 3721588 - RNA, 21 nt, Salmonella enterica enterica serovar Typhi Ty2
gcaacuguuuuaccaaaucaa

SEQ ID NO: 3721589 - RNA, 21 nt, Salmonella enterica enterica serovar Typhi Ty2
gcaacuuacgcccuauccggc

SEQ ID NO: 3721590 - RNA, 15 nt, Salmonella enterica enterica serovar Typhi Ty2
gcaacuuagugucca

SEQ ID NO: 3721591 - RNA, 17 nt, Salmonella enterica enterica serovar Typhi Ty2
gcaacuucaccucaguc

SEQ ID NO: 3721592 - RNA, 14 nt, Salmonella enterica enterica serovar Typhi Ty2
gcaagaaacaucau

SEQ ID NO: 3721593 - RNA, 17 nt, Salmonella enterica enterica serovar Typhi Ty2
gcaagaaccgcuuuucc

SEQ ID NO: 3721594 - RNA, 19 nt, Salmonella enterica enterica serovar Typhi Ty2
gcaagaaccgcuuuuccug

SEQ ID NO: 3721595 - RNA, 13 nt, Salmonella enterica enterica serovar Typhi Ty2
gcaagaaguuccg

SEQ ID NO: 3721596 - RNA, 19 nt, Salmonella enterica enterica serovar Typhi Ty2
gcaagaaucacgccgauga

SEQ ID NO: 3721597 - RNA, 20 nt, Salmonella enterica enterica serovar Typhi Ty2
gcaagaauuauuucaggaau

SEQ ID NO: 3721598 - RNA, 18 nt, Salmonella enterica enterica serovar Typhi Ty2
gcaagacccgaaccugcg

SEQ ID NO: 3721599 - RNA, 14 nt, Salmonella enterica enterica serovar Typhi Ty2
gcaagaccuauccg

SEQ ID NO: 3721600 - RNA, 14 nt, Salmonella enterica enterica serovar Typhi Ty2
gcaagagaaauaac

SEQ ID NO: 3721601 - RNA, 16 nt, Salmonella enterica enterica serovar Typhi Ty2
gcaagauuucaaaacc

SEQ ID NO: 3721602 - RNA, 17 nt, Salmonella enterica enterica serovar Typhi Ty2
gcaagcauaaaaaacau

SEQ ID NO: 3721603 - RNA, 22 nt, Salmonella enterica enterica serovar Typhi Ty2
gcaagcaucugauauaucuuca

SEQ ID NO: 3721604 - RNA, 19 nt, Salmonella enterica enterica serovar Typhi Ty2
gcaagccgaacucuuccac

SEQ ID NO: 3721605 - RNA, 18 nt, Salmonella enterica enterica serovar Typhi Ty2
gcaagcggcugucaucaa

SEQ ID NO: 3721606 - RNA, 15 nt, Salmonella enterica enterica serovar Typhi Ty2
gcaagcucagcggca

SEQ ID NO: 3721607 - RNA, 17 nt, Salmonella enterica enterica serovar Typhi Ty2
gcaaggucugcgcccac

SEQ ID NO: 3721608 - RNA, 14 nt, Salmonella enterica enterica serovar Typhi Ty2
gcaaguauacuuau

SEQ ID NO: 3721609 - RNA, 14 nt, Salmonella enterica enterica serovar Typhi Ty2
gcaagucaccauca

SEQ ID NO: 3721610 - RNA, 19 nt, Salmonella enterica enterica serovar Typhi Ty2
gcaaguucuuguuucaucg

SEQ ID NO: 3721611 - RNA, 18 nt, Salmonella enterica enterica serovar Typhi Ty2
gcaaguugcgccacugcc

SEQ ID NO: 3721612 - RNA, 19 nt, Salmonella enterica enterica serovar Typhi Ty2
gcaauaaaaauaucauuaa

SEQ ID NO: 3721613 - RNA, 14 nt, Salmonella enterica enterica serovar Typhi Ty2
gcaauaaaaggaau

SEQ ID NO: 3721614 - RNA, 24 nt, Salmonella enterica enterica serovar Typhi Ty2
gcaauaaacuaaguaaggaggaau

SEQ ID NO: 3721615 - RNA, 22 nt, Salmonella enterica enterica serovar Typhi Ty2
gcaauaaacucccgcauauauu

SEQ ID NO: 3721616 - RNA, 18 nt, Salmonella enterica enterica serovar Typhi Ty2
gcaauaaagcagggcggc

SEQ ID NO: 3721617 - RNA, 17 nt, Salmonella enterica enterica serovar Typhi Ty2
gcaauaacaccggcggc

SEQ ID NO: 3721618 - RNA, 13 nt, Salmonella enterica enterica serovar Typhi Ty2
gcaauaauccgcu

SEQ ID NO: 3721619 - RNA, 16 nt, Salmonella enterica enterica serovar Typhi Ty2
gcaauaauccgcuaac

SEQ ID NO: 3721620 - RNA, 18 nt, Salmonella enterica enterica serovar Typhi Ty2
gcaauacagcccgccagc

SEQ ID NO: 3721621 - RNA, 21 nt, Salmonella enterica enterica serovar Typhi Ty2
gcaauaccacgcccgccgcca

SEQ ID NO: 3721622 - RNA, 14 nt, Salmonella enterica enterica serovar Typhi Ty2
gcaauaccuguaaa

SEQ ID NO: 3721623 - RNA, 19 nt, Salmonella enterica enterica serovar Typhi Ty2
gcaauacuguaagccucgc

SEQ ID NO: 3721624 - RNA, 17 nt, Salmonella enterica enterica serovar Typhi Ty2
gcaauagaguaaugaca

SEQ ID NO: 3721625 - RNA, 16 nt, Salmonella enterica enterica serovar Typhi Ty2
gcaauaucgaugccag

SEQ ID NO: 3721626 - RNA, 18 nt, Salmonella enterica enterica serovar Typhi Ty2
gcaauaugcggcgccauc

SEQ ID NO: 3721627 - RNA, 24 nt, Salmonella enterica enterica serovar Typhi Ty2
gcaauaugucuuaaacagcgauca

SEQ ID NO: 3721628 - RNA, 20 nt, Salmonella enterica enterica serovar Typhi Ty2
gcaauauuacaaagcaguaa

SEQ ID NO: 3721629 - RNA, 23 nt, Salmonella enterica enterica serovar Typhi Ty2
gcaauauucaugccagaagcaaa

SEQ ID NO: 3721630 - RNA, 17 nt, Salmonella enterica enterica serovar Typhi Ty2
gcaauauuguuaaccag

SEQ ID NO: 3721631 - RNA, 20 nt, Salmonella enterica enterica serovar Typhi Ty2
gcaauauuguuaaccaggcc

SEQ ID NO: 3721632 - RNA, 21 nt, Salmonella enterica enterica serovar Typhi Ty2
gcaaucaauacagagauauua

SEQ ID NO: 3721633 - RNA, 17 nt, Salmonella enterica enterica serovar Typhi Ty2
gcaaucacaagcuguuu

SEQ ID NO: 3721634 - RNA, 15 nt, Salmonella enterica enterica serovar Typhi Ty2
gcaaucaccugcauc

SEQ ID NO: 3721635 - RNA, 15 nt, Salmonella enterica enterica serovar Typhi Ty2
gcaaucacgcguuau

SEQ ID NO: 3721636 - RNA, 16 nt, Salmonella enterica enterica serovar Typhi Ty2
gcaaucacuuccgccu

SEQ ID NO: 3721637 - RNA, 17 nt, Salmonella enterica enterica serovar Typhi Ty2
gcaaucacuuccgccuc

SEQ ID NO: 3721638 - RNA, 19 nt, Salmonella enterica enterica serovar Typhi Ty2
gcaaucacuuccgccucgc

SEQ ID NO: 3721639 - RNA, 13 nt, Salmonella enterica enterica serovar Typhi Ty2
gcaaucagcagcc

SEQ ID NO: 3721640 - RNA, 21 nt, Salmonella enterica enterica serovar Typhi Ty2
gcaaucaguacgcgcgcggcg

SEQ ID NO: 3721641 - RNA, 12 nt, Salmonella enterica enterica serovar Typhi Ty2
gcaaucaucaga

SEQ ID NO: 3721642 - RNA, 15 nt, Salmonella enterica enterica serovar Typhi Ty2
gcaaucaucagaccg

SEQ ID NO: 3721643 - RNA, 14 nt, Salmonella enterica enterica serovar Typhi Ty2
gcaaucaugacaga

SEQ ID NO: 3721644 - RNA, 21 nt, Salmonella enterica enterica serovar Typhi Ty2
gcaaucgacguugaucgccau

SEQ ID NO: 3721645 - RNA, 20 nt, Salmonella enterica enterica serovar Typhi Ty2
gcaaucgccugcaacgcuuu

SEQ ID NO: 3721646 - RNA, 20 nt, Salmonella enterica enterica serovar Typhi Ty2
gcaaucgcuuccagcgccgg

SEQ ID NO: 3721647 - RNA, 15 nt, Salmonella enterica enterica serovar Typhi Ty2
gcaaucggcuuugac

SEQ ID NO: 3721648 - RNA, 15 nt, Salmonella enterica enterica serovar Typhi Ty2
gcaaucucacugccc

SEQ ID NO: 3721649 - RNA, 20 nt, Salmonella enterica enterica serovar Typhi Ty2
gcagaaaaagcccccaucac

SEQ ID NO: 3721650 - RNA, 15 nt, Salmonella enterica enterica serovar Typhi Ty2
gcagaaaggugaaaa

SEQ ID NO: 3721651 - RNA, 22 nt, Salmonella enterica enterica serovar Typhi Ty2
gcagaacaaacagaccgccaug

SEQ ID NO: 3721652 - RNA, 15 nt, Salmonella enterica enterica serovar Typhi Ty2
gcagaacggcgacgg

SEQ ID NO: 3721653 - RNA, 14 nt, Salmonella enterica enterica serovar Typhi Ty2
gcagaagcagaccg

SEQ ID NO: 3721654 - RNA, 17 nt, Salmonella enterica enterica serovar Typhi Ty2
gcagaaguaaauccggc

SEQ ID NO: 3721655 - RNA, 20 nt, Salmonella enterica enterica serovar Typhi Ty2
gcagaauauuuuucucagcc

SEQ ID NO: 3721656 - RNA, 18 nt, Salmonella enterica enterica serovar Typhi Ty2
gcagaauuaacucaucac

SEQ ID NO: 3721657 - RNA, 19 nt, Salmonella enterica enterica serovar Typhi Ty2
gcagaauuaacucaucaca

SEQ ID NO: 3721658 - RNA, 22 nt, Salmonella enterica enterica serovar Typhi Ty2
gcagaauuaacucaucacagcc

SEQ ID NO: 3721659 - RNA, 16 nt, Salmonella enterica enterica serovar Typhi Ty2
gcagacaauaaacggu

SEQ ID NO: 3721660 - RNA, 20 nt, Salmonella enterica enterica serovar Typhi Ty2
gcagacaauuuccgccgcca

SEQ ID NO: 3721661 - RNA, 19 nt, Salmonella enterica enterica serovar Typhi Ty2
gcagacaauuuucuucaug

SEQ ID NO: 3721662 - RNA, 14 nt, Salmonella enterica enterica serovar Typhi Ty2
gcagacacugccac

SEQ ID NO: 3721663 - RNA, 15 nt, Salmonella enterica enterica serovar Typhi Ty2
gcagacacugccacc

SEQ ID NO: 3721664 - RNA, 18 nt, Salmonella enterica enterica serovar Typhi Ty2
gcagacagccgaucaggc

SEQ ID NO: 3721665 - RNA, 21 nt, Salmonella enterica enterica serovar Typhi Ty2
gcagacaguggccaucuucca

SEQ ID NO: 3721666 - RNA, 17 nt, Salmonella enterica enterica serovar Typhi Ty2
gcagacauauuuucucu

SEQ ID NO: 3721667 - RNA, 13 nt, Salmonella enterica enterica serovar Typhi Ty2
gcagacaucgcgc

SEQ ID NO: 3721668 - RNA, 22 nt, Salmonella enterica enterica serovar Typhi Ty2
gcagacaugaccgcacagcaga

SEQ ID NO: 3721669 - RNA, 17 nt, Salmonella enterica enterica serovar Typhi Ty2
gcagaccggaugauggc

SEQ ID NO: 3721670 - RNA, 14 nt, Salmonella enterica enterica serovar Typhi Ty2
gcagaccggcagcc

SEQ ID NO: 3721671 - RNA, 19 nt, Salmonella enterica enterica serovar Typhi Ty2
gcagaccggcagccugccg

SEQ ID NO: 3721672 - RNA, 20 nt, Salmonella enterica enterica serovar Typhi Ty2
gcagaccuguucuguaggcu

SEQ ID NO: 3721673 - RNA, 19 nt, Salmonella enterica enterica serovar Typhi Ty2
gcagacgcucgacgaagcc

SEQ ID NO: 3721674 - RNA, 16 nt, Salmonella enterica enterica serovar Typhi Ty2
gcagacggagaugauc

SEQ ID NO: 3721675 - RNA, 20 nt, Salmonella enterica enterica serovar Typhi Ty2
gcagacgugcaauaucgcgg

SEQ ID NO: 3721676 - RNA, 18 nt, Salmonella enterica enterica serovar Typhi Ty2
gcagacuaaaaagcgcgu

SEQ ID NO: 3721677 - RNA, 19 nt, Salmonella enterica enterica serovar Typhi Ty2
gcagacugguaaccuguuc

SEQ ID NO: 3721678 - RNA, 19 nt, Salmonella enterica enterica serovar Typhi Ty2
gcagacuguaaaucugccg

SEQ ID NO: 3721679 - RNA, 15 nt, Salmonella enterica enterica serovar Typhi Ty2
gcagacuuucugaca

SEQ ID NO: 3721680 - RNA, 18 nt, Salmonella enterica enterica serovar Typhi Ty2
gcagacuuucugacaggu

SEQ ID NO: 3721681 - RNA, 20 nt, Salmonella enterica enterica serovar Typhi Ty2
gcagacuuucugacaggucg

SEQ ID NO: 3721682 - RNA, 13 nt, Salmonella enterica enterica serovar Typhi Ty2
gcagagcccagcg

SEQ ID NO: 3721683 - RNA, 16 nt, Salmonella enterica enterica serovar Typhi Ty2
gcagagcccagcgcga

SEQ ID NO: 3721684 - RNA, 23 nt, Salmonella enterica enterica serovar Typhi Ty2
gcagagcgaacaguacggucagg

SEQ ID NO: 3721685 - RNA, 20 nt, Salmonella enterica enterica serovar Typhi Ty2
gcagagcgcgcucugccuuu

SEQ ID NO: 3721686 - RNA, 23 nt, Salmonella enterica enterica serovar Typhi Ty2
gcagaguacgucgccuuccugca

SEQ ID NO: 3721687 - RNA, 22 nt, Salmonella enterica enterica serovar Typhi Ty2
gcagaguaugcugcuaaagcac

SEQ ID NO: 3721688 - RNA, 15 nt, Salmonella enterica enterica serovar Typhi Ty2
gcagauaaaccacgc

SEQ ID NO: 3721689 - RNA, 14 nt, Salmonella enterica enterica serovar Typhi Ty2
gcagauaacaggca

SEQ ID NO: 3721690 - RNA, 15 nt, Salmonella enterica enterica serovar Typhi Ty2
gcagauaacuuccuu

SEQ ID NO: 3721691 - RNA, 13 nt, Salmonella enterica enterica serovar Typhi Ty2
gcagauaccagcc

SEQ ID NO: 3721692 - RNA, 19 nt, Salmonella enterica enterica serovar Typhi Ty2
gcagauaccgaccgugaga

SEQ ID NO: 3721693 - RNA, 14 nt, Salmonella enterica enterica serovar Typhi Ty2
gcagauacgcguca

SEQ ID NO: 3721694 - RNA, 23 nt, Salmonella enterica enterica serovar Typhi Ty2
gcagauagcccgccagcaccagc

SEQ ID NO: 3721695 - RNA, 21 nt, Salmonella enterica enterica serovar Typhi Ty2
gcagaucaagcgggggcgccu

SEQ ID NO: 3721696 - RNA, 13 nt, Salmonella enterica enterica serovar Typhi Ty2
gcagauccaucgc

SEQ ID NO: 3721697 - RNA, 16 nt, Salmonella enterica enterica serovar Typhi Ty2
gcagauccaucgccug

SEQ ID NO: 3721698 - RNA, 22 nt, Salmonella enterica enterica serovar Typhi Ty2
gcagaucccagguaaccgcuaa

SEQ ID NO: 3721699 - RNA, 14 nt, Salmonella enterica enterica serovar Typhi Ty2
gcagaucgccugga

SEQ ID NO: 3721700 - RNA, 18 nt, Salmonella enterica enterica serovar Typhi Ty2
gcagaucgcgggcaauca

SEQ ID NO: 3721701 - RNA, 21 nt, Salmonella enterica enterica serovar Typhi Ty2
gcagaucggccuguuuuucug

SEQ ID NO: 3721702 - RNA, 18 nt, Salmonella enterica enterica serovar Typhi Ty2
gcagaucugucgccauga

SEQ ID NO: 3721703 - RNA, 22 nt, Salmonella enterica enterica serovar Typhi Ty2
gcagaucuuuuugcuccugcgc

SEQ ID NO: 3721704 - RNA, 20 nt, Salmonella enterica enterica serovar Typhi Ty2
gcagaugaacggcaagaccu

SEQ ID NO: 3721705 - RNA, 22 nt, Salmonella enterica enterica serovar Typhi Ty2
gcagaugcccgcagaucugucg

SEQ ID NO: 3721706 - RNA, 17 nt, Salmonella enterica enterica serovar Typhi Ty2
gcagaugcucaggcaac

SEQ ID NO: 3721707 - RNA, 17 nt, Salmonella enterica enterica serovar Typhi Ty2
gcagaugguauaaauca

SEQ ID NO: 3721708 - RNA, 21 nt, Salmonella enterica enterica serovar Typhi Ty2
gcagaugguauaaaucacgcu

SEQ ID NO: 3721709 - RNA, 13 nt, Salmonella enterica enterica serovar Typhi Ty2
gcagauuuuuauc

SEQ ID NO: 3721710 - RNA, 23 nt, Salmonella enterica enterica serovar Typhi Ty2
gcagcaaaccgauaaucaccagc

SEQ ID NO: 3721711 - RNA, 16 nt, Salmonella enterica enterica serovar Typhi Ty2
gcagcaaacgccauag

SEQ ID NO: 3721712 - RNA, 17 nt, Salmonella enterica enterica serovar Typhi Ty2
gcagcaaacgccauagc

SEQ ID NO: 3721713 - RNA, 18 nt, Salmonella enterica enterica serovar Typhi Ty2
gcagcaaaucagcuacuu

SEQ ID NO: 3721714 - RNA, 14 nt, Salmonella enterica enterica serovar Typhi Ty2
gcagcaacccugcc

SEQ ID NO: 3721715 - RNA, 15 nt, Salmonella enterica enterica serovar Typhi Ty2
gcagcaacccugccg

SEQ ID NO: 3721716 - RNA, 17 nt, Salmonella enterica enterica serovar Typhi Ty2
gcagcaacgucucgaca

SEQ ID NO: 3721717 - RNA, 14 nt, Salmonella enterica enterica serovar Typhi Ty2
gcagcaagaacaga

SEQ ID NO: 3721718 - RNA, 17 nt, Salmonella enterica enterica serovar Typhi Ty2
gcagcaagaauaccacu

SEQ ID NO: 3721719 - RNA, 16 nt, Salmonella enterica enterica serovar Typhi Ty2
gcagcaagcggcuguc

SEQ ID NO: 3721720 - RNA, 15 nt, Salmonella enterica enterica serovar Typhi Ty2
gcagcaauacgcccg

SEQ ID NO: 3721721 - RNA, 22 nt, Salmonella enterica enterica serovar Typhi Ty2
gcagcaauaguugucagaccuu

SEQ ID NO: 3721722 - RNA, 23 nt, Salmonella enterica enterica serovar Typhi Ty2
gcagcaaucagguauuuccugcu

SEQ ID NO: 3721723 - RNA, 16 nt, Salmonella enterica enterica serovar Typhi Ty2
gcagcaaugugcgcca

SEQ ID NO: 3721724 - RNA, 20 nt, Salmonella enterica enterica serovar Typhi Ty2
gcagcaaugugcgccagaau

SEQ ID NO: 3721725 - RNA, 17 nt, Salmonella enterica enterica serovar Typhi Ty2
gcagcacaugcaauuug

SEQ ID NO: 3721726 - RNA, 20 nt, Salmonella enterica enterica serovar Typhi Ty2
gcagcaccagauauuuuucc

SEQ ID NO: 3721727 - RNA, 15 nt, Salmonella enterica enterica serovar Typhi Ty2
gcagcaccgccgcga

SEQ ID NO: 3721728 - RNA, 18 nt, Salmonella enterica enterica serovar Typhi Ty2
gcagcaccucaauaugaa

SEQ ID NO: 3721729 - RNA, 20 nt, Salmonella enterica enterica serovar Typhi Ty2
gcagcaccucaauaugaaau

SEQ ID NO: 3721730 - RNA, 21 nt, Salmonella enterica enterica serovar Typhi Ty2
gcagcaccucgguauguccug

SEQ ID NO: 3721731 - RNA, 14 nt, Salmonella enterica enterica serovar Typhi Ty2
gcagcacguccaga

SEQ ID NO: 3721732 - RNA, 14 nt, Salmonella enterica enterica serovar Typhi Ty2
gcagcacugcuuaa

SEQ ID NO: 3721733 - RNA, 18 nt, Salmonella enterica enterica serovar Typhi Ty2
gcagcagaaucaggcaca

SEQ ID NO: 3721734 - RNA, 12 nt, Salmonella enterica enterica serovar Typhi Ty2
gcagcagcuuca

SEQ ID NO: 3721735 - RNA, 18 nt, Salmonella enterica enterica serovar Typhi Ty2
gcagcaguuccccgccgc

SEQ ID NO: 3721736 - RNA, 15 nt, Salmonella enterica enterica serovar Typhi Ty2
gcagcaguucuucgc

SEQ ID NO: 3721737 - RNA, 15 nt, Salmonella enterica enterica serovar Typhi Ty2
gcagcaucccggcaa

SEQ ID NO: 3721738 - RNA, 14 nt, Salmonella enterica enterica serovar Typhi Ty2
gcagcaucgccauc

SEQ ID NO: 3721739 - RNA, 14 nt, Salmonella enterica enterica serovar Typhi Ty2
gcagcaugauaucg

SEQ ID NO: 3721740 - RNA, 14 nt, Salmonella enterica enterica serovar Typhi Ty2
gcagccaacaacag

SEQ ID NO: 3721741 - RNA, 18 nt, Salmonella enterica enterica serovar Typhi Ty2
gcagccaacaacaggccg

SEQ ID NO: 3721742 - RNA, 19 nt, Salmonella enterica enterica serovar Typhi Ty2
gcagccaacaacaggccgc

SEQ ID NO: 3721743 - RNA, 17 nt, Salmonella enterica enterica serovar Typhi Ty2
gcagccaacgccgccau

SEQ ID NO: 3721744 - RNA, 18 nt, Salmonella enterica enterica serovar Typhi Ty2
gcagccaacgccgccaua

SEQ ID NO: 3721745 - RNA, 21 nt, Salmonella enterica enterica serovar Typhi Ty2
gcagccacccuggcauaugga

SEQ ID NO: 3721746 - RNA, 13 nt, Salmonella enterica enterica serovar Typhi Ty2
gcagccacucccg

SEQ ID NO: 3721747 - RNA, 17 nt, Salmonella enterica enterica serovar Typhi Ty2
gcagccaggcaaagccc

SEQ ID NO: 3721748 - RNA, 19 nt, Salmonella enterica enterica serovar Typhi Ty2
gcagccaggcaaagcccca

SEQ ID NO: 3721749 - RNA, 21 nt, Salmonella enterica enterica serovar Typhi Ty2
gcagccaggcaaagccccagu

SEQ ID NO: 3721750 - RNA, 13 nt, Salmonella enterica enterica serovar Typhi Ty2
gcagccaggccau

SEQ ID NO: 3721751 - RNA, 21 nt, Salmonella enterica enterica serovar Typhi Ty2
gcagccaguuguucgauaacc

SEQ ID NO: 3721752 - RNA, 13 nt, Salmonella enterica enterica serovar Typhi Ty2
gcagccccggcau

SEQ ID NO: 3721753 - RNA, 21 nt, Salmonella enterica enterica serovar Typhi Ty2
gcagccccggcauccaguucc

SEQ ID NO: 3721754 - RNA, 12 nt, Salmonella enterica enterica serovar Typhi Ty2
gcagccgccacc

SEQ ID NO: 3721755 - RNA, 14 nt, Salmonella enterica enterica serovar Typhi Ty2
gcagccgccaccac

SEQ ID NO: 3721756 - RNA, 17 nt, Salmonella enterica enterica serovar Typhi Ty2
gcagccgccauccggca

SEQ ID NO: 3721757 - RNA, 15 nt, Salmonella enterica enterica serovar Typhi Ty2
gcagccgggccagac

SEQ ID NO: 3721758 - RNA, 17 nt, Salmonella enterica enterica serovar Typhi Ty2
gcagccucguccugcaa

SEQ ID NO: 3721759 - RNA, 16 nt, Salmonella enterica enterica serovar Typhi Ty2
gcagcgaaaauccagu

SEQ ID NO: 3721760 - RNA, 17 nt, Salmonella enterica enterica serovar Typhi Ty2
gcagcgacgcauugaga

SEQ ID NO: 3721761 - RNA, 17 nt, Salmonella enterica enterica serovar Typhi Ty2
gcagcgacuucaggcgu

SEQ ID NO: 3721762 - RNA, 16 nt, Salmonella enterica enterica serovar Typhi Ty2
gcagcgagcaccgauc

SEQ ID NO: 3721763 - RNA, 20 nt, Salmonella enterica enterica serovar Typhi Ty2
gcagcgaggugauaaucagc

SEQ ID NO: 3721764 - RNA, 15 nt, Salmonella enterica enterica serovar Typhi Ty2
gcagcgauagacugu

SEQ ID NO: 3721765 - RNA, 14 nt, Salmonella enterica enterica serovar Typhi Ty2
gcagcgauauagcg

SEQ ID NO: 3721766 - RNA, 14 nt, Salmonella enterica enterica serovar Typhi Ty2
gcagcgcaucaggc

SEQ ID NO: 3721767 - RNA, 21 nt, Salmonella enterica enterica serovar Typhi Ty2
gcagcgccaccgggcaacaca

SEQ ID NO: 3721768 - RNA, 15 nt, Salmonella enterica enterica serovar Typhi Ty2
gcagcgccagugacg

SEQ ID NO: 3721769 - RNA, 15 nt, Salmonella enterica enterica serovar Typhi Ty2
gcagcgccaucaggc

SEQ ID NO: 3721770 - RNA, 18 nt, Salmonella enterica enterica serovar Typhi Ty2
gcagcgccaucaggcccc

SEQ ID NO: 3721771 - RNA, 15 nt, Salmonella enterica enterica serovar Typhi Ty2
gcagcgccauccggc

SEQ ID NO: 3721772 - RNA, 18 nt, Salmonella enterica enterica serovar Typhi Ty2
gcagcgcccagccaaagc

SEQ ID NO: 3721773 - RNA, 13 nt, Salmonella enterica enterica serovar Typhi Ty2
gcagcgccgccug

SEQ ID NO: 3721774 - RNA, 15 nt, Salmonella enterica enterica serovar Typhi Ty2
gcagcgccuucgcuu

SEQ ID NO: 3721775 - RNA, 17 nt, Salmonella enterica enterica serovar Typhi Ty2
gcagcgcgacauagagc

SEQ ID NO: 3721776 - RNA, 14 nt, Salmonella enterica enterica serovar Typhi Ty2
gcagcgcgauacgc

SEQ ID NO: 3721777 - RNA, 15 nt, Salmonella enterica enterica serovar Typhi Ty2
gcagcgcgauggcgu

SEQ ID NO: 3721778 - RNA, 18 nt, Salmonella enterica enterica serovar Typhi Ty2
gcagcgcgcgacccagcg

SEQ ID NO: 3721779 - RNA, 15 nt, Salmonella enterica enterica serovar Typhi Ty2
gcagcgcggcacaca

SEQ ID NO: 3721780 - RNA, 14 nt, Salmonella enterica enterica serovar Typhi Ty2
gcagcgcggccugc

SEQ ID NO: 3721781 - RNA, 17 nt, Salmonella enterica enterica serovar Typhi Ty2
gcagcgcugaaucgcaa

SEQ ID NO: 3721782 - RNA, 14 nt, Salmonella enterica enterica serovar Typhi Ty2
gcagcgcuuucacc

SEQ ID NO: 3721783 - RNA, 13 nt, Salmonella enterica enterica serovar Typhi Ty2
gcagcggcgguua

SEQ ID NO: 3721784 - RNA, 20 nt, Salmonella enterica enterica serovar Typhi Ty2
gcagcggcguaucuuccagc

SEQ ID NO: 3721785 - RNA, 16 nt, Salmonella enterica enterica serovar Typhi Ty2
gcagcguaauacaggc

SEQ ID NO: 3721786 - RNA, 18 nt, Salmonella enterica enterica serovar Typhi Ty2
gcagcguaauagucugcu

SEQ ID NO: 3721787 - RNA, 19 nt, Salmonella enterica enterica serovar Typhi Ty2
gcagcguauugagcuggau

SEQ ID NO: 3721788 - RNA, 19 nt, Salmonella enterica enterica serovar Typhi Ty2
gcagcgucagcccaagcug

SEQ ID NO: 3721789 - RNA, 15 nt, Salmonella enterica enterica serovar Typhi Ty2
gcagcgucaucaggc

SEQ ID NO: 3721790 - RNA, 15 nt, Salmonella enterica enterica serovar Typhi Ty2
gcagcguccgccauc

SEQ ID NO: 3721791 - RNA, 22 nt, Salmonella enterica enterica serovar Typhi Ty2
gcagcgucugcccuccugaaua

SEQ ID NO: 3721792 - RNA, 19 nt, Salmonella enterica enterica serovar Typhi Ty2
gcagcgugccuucaaauau

SEQ ID NO: 3721793 - RNA, 19 nt, Salmonella enterica enterica serovar Typhi Ty2
gcagcguugcuuuguaugu

SEQ ID NO: 3721794 - RNA, 20 nt, Salmonella enterica enterica serovar Typhi Ty2
gcagcucaucaauaaggguc

SEQ ID NO: 3721795 - RNA, 21 nt, Salmonella enterica enterica serovar Typhi Ty2
gcagcuccuuuuaauaaagaa

SEQ ID NO: 3721796 - RNA, 22 nt, Salmonella enterica enterica serovar Typhi Ty2
gcagcuccuuuuaauaaagaaa

SEQ ID NO: 3721797 - RNA, 13 nt, Salmonella enterica enterica serovar Typhi Ty2
gcagcucugccug

SEQ ID NO: 3721798 - RNA, 22 nt, Salmonella enterica enterica serovar Typhi Ty2
gcagcucugccuguagcagcgc

SEQ ID NO: 3721799 - RNA, 22 nt, Salmonella enterica enterica serovar Typhi Ty2
gcagcugcuguaugauuucacc

SEQ ID NO: 3721800 - RNA, 15 nt, Salmonella enterica enterica serovar Typhi Ty2
gcagcuuaaagccaa

SEQ ID NO: 3721801 - RNA, 15 nt, Salmonella enterica enterica serovar Typhi Ty2
gcagcuuaucuuuuu

SEQ ID NO: 3721802 - RNA, 14 nt, Salmonella enterica enterica serovar Typhi Ty2
gcagcuuauuccag

SEQ ID NO: 3721803 - RNA, 17 nt, Salmonella enterica enterica serovar Typhi Ty2
gcagcuucagcaucauc

SEQ ID NO: 3721804 - RNA, 19 nt, Salmonella enterica enterica serovar Typhi Ty2
gcagcuucagcaucaucuc

SEQ ID NO: 3721805 - RNA, 12 nt, Salmonella enterica enterica serovar Typhi Ty2
gcagcuuccagc

SEQ ID NO: 3721806 - RNA, 18 nt, Salmonella enterica enterica serovar Typhi Ty2
gcagcuugguagcgcaac

SEQ ID NO: 3721807 - RNA, 19 nt, Salmonella enterica enterica serovar Typhi Ty2
gcaggaaauccagcagaau

SEQ ID NO: 3721808 - RNA, 14 nt, Salmonella enterica enterica serovar Typhi Ty2
gcaggaacagauac

SEQ ID NO: 3721809 - RNA, 15 nt, Salmonella enterica enterica serovar Typhi Ty2
gcaggaacggcagga

SEQ ID NO: 3721810 - RNA, 16 nt, Salmonella enterica enterica serovar Typhi Ty2
gcaggaaggaauuaug

SEQ ID NO: 3721811 - RNA, 18 nt, Salmonella enterica enterica serovar Typhi Ty2
gcaggaaggcgugcagcg

SEQ ID NO: 3721812 - RNA, 15 nt, Salmonella enterica enterica serovar Typhi Ty2
gcaggaaguuuucug

SEQ ID NO: 3721813 - RNA, 15 nt, Salmonella enterica enterica serovar Typhi Ty2
gcaggacaaccccua

SEQ ID NO: 3721814 - RNA, 18 nt, Salmonella enterica enterica serovar Typhi Ty2
gcaguggcauguucccau

SEQ ID NO: 3721815 - RNA, 17 nt, Salmonella enterica enterica serovar Typhi Ty2
gcaguguaucgaagauc

SEQ ID NO: 3721816 - RNA, 18 nt, Salmonella enterica enterica serovar Typhi Ty2
gcaguguaucguugucgc

SEQ ID NO: 3721817 - RNA, 13 nt, Salmonella enterica enterica serovar Typhi Ty2
gcaguucagcagc

SEQ ID NO: 3721818 - RNA, 22 nt, Salmonella enterica enterica serovar Typhi Ty2
gcaguucagucgggaucgccag

SEQ ID NO: 3721819 - RNA, 21 nt, Salmonella enterica enterica serovar Typhi Ty2
gcaguucaucuucccgcagau

SEQ ID NO: 3721820 - RNA, 24 nt, Salmonella enterica enterica serovar Typhi Ty2
gcaguucugaagcuaaccgcgcaa

SEQ ID NO: 3721821 - RNA, 21 nt, Salmonella enterica enterica serovar Typhi Ty2
gcaguucuucgccguuaucgg

SEQ ID NO: 3721822 - RNA, 17 nt, Salmonella enterica enterica serovar Typhi Ty2
gcaguugcagcguacgg

SEQ ID NO: 3721823 - RNA, 18 nt, Salmonella enterica enterica serovar Typhi Ty2
gcaguugggcgcgcgacu

SEQ ID NO: 3721824 - RNA, 22 nt, Salmonella enterica enterica serovar Typhi Ty2
gcaguuugcgaaaagccggaau

SEQ ID NO: 3721825 - RNA, 17 nt, Salmonella enterica enterica serovar Typhi Ty2
gcaguuugguaauacua

SEQ ID NO: 3721826 - RNA, 15 nt, Salmonella enterica enterica serovar Typhi Ty2
gcaguuuuuauccuc

SEQ ID NO: 3721827 - RNA, 17 nt, Salmonella enterica enterica serovar Typhi Ty2
gcauaaaaaacaucaug

SEQ ID NO: 3721828 - RNA, 14 nt, Salmonella enterica enterica serovar Typhi Ty2
gcauaaaaaagagg

SEQ ID NO: 3721829 - RNA, 15 nt, Salmonella enterica enterica serovar Typhi Ty2
gcauaaaaaaugaga

SEQ ID NO: 3721830 - RNA, 19 nt, Salmonella enterica enterica serovar Typhi Ty2
gcauaaaaaaugagaaagg

SEQ ID NO: 3721831 - RNA, 19 nt, Salmonella enterica enterica serovar Typhi Ty2
gcauaaaaccgccgcccau

SEQ ID NO: 3721832 - RNA, 22 nt, Salmonella enterica enterica serovar Typhi Ty2
gcauaaaccggcggccuaccag

SEQ ID NO: 3721833 - RNA, 15 nt, Salmonella enterica enterica serovar Typhi Ty2
gcauaaagaacgugu

SEQ ID NO: 3721834 - RNA, 13 nt, Salmonella enterica enterica serovar Typhi Ty2
gcauaaauaaugc

SEQ ID NO: 3721835 - RNA, 13 nt, Salmonella enterica enterica serovar Typhi Ty2
gcauaaauaucug

SEQ ID NO: 3721836 - RNA, 23 nt, Salmonella enterica enterica serovar Typhi Ty2
gcauaaaugccuuauccggccug

SEQ ID NO: 3721837 - RNA, 17 nt, Salmonella enterica enterica serovar Typhi Ty2
gcauaaauuggcucaga

SEQ ID NO: 3721838 - RNA, 19 nt, Salmonella enterica enterica serovar Typhi Ty2
gcauaaccgcgcguaaauc

SEQ ID NO: 3721839 - RNA, 12 nt, Salmonella enterica enterica serovar Typhi Ty2
gcauaagccuca

SEQ ID NO: 3721840 - RNA, 15 nt, Salmonella enterica enterica serovar Typhi Ty2
gcauaauauccagga

SEQ ID NO: 3721841 - RNA, 13 nt, Salmonella enterica enterica serovar Typhi Ty2
gcauaauaugcaa

SEQ ID NO: 3721842 - RNA, 16 nt, Salmonella enterica enterica serovar Typhi Ty2
gcauaauaugcaacac

SEQ ID NO: 3721843 - RNA, 22 nt, Salmonella enterica enterica serovar Typhi Ty2
gcauaauaugcaacacgccgaa

SEQ ID NO: 3721844 - RNA, 22 nt, Salmonella enterica enterica serovar Typhi Ty2
gcauaauccagcaggugcggac

SEQ ID NO: 3721845 - RNA, 19 nt, Salmonella enterica enterica serovar Typhi Ty2
gcauaaugacguccaggcc

SEQ ID NO: 3721846 - RNA, 20 nt, Salmonella enterica enterica serovar Typhi Ty2
gcauaauuguggaaauaaga

SEQ ID NO: 3721847 - RNA, 22 nt, Salmonella enterica enterica serovar Typhi Ty2
gcauacacgccgggcacgcuga

SEQ ID NO: 3721848 - RNA, 23 nt, Salmonella enterica enterica serovar Typhi Ty2
gcauacagcgauaaccgccgccg

SEQ ID NO: 3721849 - RNA, 19 nt, Salmonella enterica enterica serovar Typhi Ty2
gcauacaggucuuuccgac

SEQ ID NO: 3721850 - RNA, 23 nt, Salmonella enterica enterica serovar Typhi Ty2
gcauaccaaguuuggcaaucaaa

SEQ ID NO: 3721851 - RNA, 13 nt, Salmonella enterica enterica serovar Typhi Ty2
gcauaccgcccaa

SEQ ID NO: 3721852 - RNA, 17 nt, Salmonella enterica enterica serovar Typhi Ty2
gcauaccgcccagaacg

SEQ ID NO: 3721853 - RNA, 18 nt, Salmonella enterica enterica serovar Typhi Ty2
gcauaccgcccagaacgg

SEQ ID NO: 3721854 - RNA, 15 nt, Salmonella enterica enterica serovar Typhi Ty2
gcauaccggccacga

SEQ ID NO: 3721855 - RNA, 23 nt, Salmonella enterica enterica serovar Typhi Ty2
gcauaccggccacgagcugucac

SEQ ID NO: 3721856 - RNA, 13 nt, Salmonella enterica enterica serovar Typhi Ty2
gcauaccuucaca

SEQ ID NO: 3721857 - RNA, 16 nt, Salmonella enterica enterica serovar Typhi Ty2
gcauacgacaucgcca

SEQ ID NO: 3721858 - RNA, 15 nt, Salmonella enterica enterica serovar Typhi Ty2
gcauacgucugcgcu

SEQ ID NO: 3721859 - RNA, 14 nt, Salmonella enterica enterica serovar Typhi Ty2
gcauacguuucacc

SEQ ID NO: 3721860 - RNA, 16 nt, Salmonella enterica enterica serovar Typhi Ty2
gcauacguuucaccag

SEQ ID NO: 3721861 - RNA, 15 nt, Salmonella enterica enterica serovar Typhi Ty2
gcauacuaccgcugc

SEQ ID NO: 3721862 - RNA, 19 nt, Salmonella enterica enterica serovar Typhi Ty2
gcauacucacgaauaagaa

SEQ ID NO: 3721863 - RNA, 20 nt, Salmonella enterica enterica serovar Typhi Ty2
gcauacucuccuccauaccu

SEQ ID NO: 3721864 - RNA, 16 nt, Salmonella enterica enterica serovar Typhi Ty2
gcauacugcgaugcgc

SEQ ID NO: 3721865 - RNA, 17 nt, Salmonella enterica enterica serovar Typhi Ty2
gcauagaauuucagggu

SEQ ID NO: 3721866 - RNA, 18 nt, Salmonella enterica enterica serovar Typhi Ty2
gcauagcgccuucaggca

SEQ ID NO: 3721867 - RNA, 19 nt, Salmonella enterica enterica serovar Typhi Ty2
gcauagcuggcguagccag

SEQ ID NO: 3721868 - RNA, 16 nt, Salmonella enterica enterica serovar Typhi Ty2
gcauagcuguuccgca

SEQ ID NO: 3721869 - RNA, 22 nt, Salmonella enterica enterica serovar Typhi Ty2
gcauaggcuuugcugagcgcga

SEQ ID NO: 3721870 - RNA, 17 nt, Salmonella enterica enterica serovar Typhi Ty2
gcauauacucacugaau

SEQ ID NO: 3721871 - RNA, 17 nt, Salmonella enterica enterica serovar Typhi Ty2
gcauauagugcgugaca

SEQ ID NO: 3721872 - RNA, 14 nt, Salmonella enterica enterica serovar Typhi Ty2
gcauauccagcgcc

SEQ ID NO: 3721873 - RNA, 15 nt, Salmonella enterica enterica serovar Typhi Ty2
gcauauccagcgccu

SEQ ID NO: 3721874 - RNA, 14 nt, Salmonella enterica enterica serovar Typhi Ty2
gcauaucgccauac

SEQ ID NO: 3721875 - RNA, 16 nt, Salmonella enterica enterica serovar Typhi Ty2
gcauaugcacagcgcu

SEQ ID NO: 3721876 - RNA, 22 nt, Salmonella enterica enterica serovar Typhi Ty2
gcauauucauaucgaagcccag

SEQ ID NO: 3721877 - RNA, 17 nt, Salmonella enterica enterica serovar Typhi Ty2
gcauauuuuucauucgc

SEQ ID NO: 3721878 - RNA, 18 nt, Salmonella enterica enterica serovar Typhi Ty2
gcaucaaacuucguuacu

SEQ ID NO: 3721879 - RNA, 13 nt, Salmonella enterica enterica serovar Typhi Ty2
gcaucaaacuuuu

SEQ ID NO: 3721880 - RNA, 13 nt, Salmonella enterica enterica serovar Typhi Ty2
gcaucaaauaccu

SEQ ID NO: 3721881 - RNA, 22 nt, Salmonella enterica enterica serovar Typhi Ty2
gcaucaacguuguccagcggcc

SEQ ID NO: 3721882 - RNA, 22 nt, Salmonella enterica enterica serovar Typhi Ty2
gcaucaagcugcuggcgagcag

SEQ ID NO: 3721883 - RNA, 23 nt, Salmonella enterica enterica serovar Typhi Ty2
gcaucaagcugcuggcgagcagg

SEQ ID NO: 3721884 - RNA, 17 nt, Salmonella enterica enterica serovar Typhi Ty2
gcaucaauaaaaucacc

SEQ ID NO: 3721885 - RNA, 20 nt, Salmonella enterica enterica serovar Typhi Ty2
gcaucaauggcgucaaacag

SEQ ID NO: 3721886 - RNA, 17 nt, Salmonella enterica enterica serovar Typhi Ty2
gcaucacaaugaccucu

SEQ ID NO: 3721887 - RNA, 18 nt, Salmonella enterica enterica serovar Typhi Ty2
gcaucacaucaaagcccc

SEQ ID NO: 3721888 - RNA, 12 nt, Salmonella enterica enterica serovar Typhi Ty2
gcaucaccggau

SEQ ID NO: 3721889 - RNA, 18 nt, Salmonella enterica enterica serovar Typhi Ty2
gcaucaccggaucgccga

SEQ ID NO: 3721890 - RNA, 16 nt, Salmonella enterica enterica serovar Typhi Ty2
gcaucagaacaaacuu

SEQ ID NO: 3721891 - RNA, 16 nt, Salmonella enterica enterica serovar Typhi Ty2
gcaucagacuacuuuu

SEQ ID NO: 3721892 - RNA, 17 nt, Salmonella enterica enterica serovar Typhi Ty2
gcaucagacuacuuuua

SEQ ID NO: 3721893 - RNA, 16 nt, Salmonella enterica enterica serovar Typhi Ty2
gcaucagacuguuacg

SEQ ID NO: 3721894 - RNA, 22 nt, Salmonella enterica enterica serovar Typhi Ty2
gcaucaggaaauccuggauacg

SEQ ID NO: 3721895 - RNA, 15 nt, Salmonella enterica enterica serovar Typhi Ty2
gcaucauauucgcag

SEQ ID NO: 3721896 - RNA, 22 nt, Salmonella enterica enterica serovar Typhi Ty2
gcauguuugccugagcgcgaac

SEQ ID NO: 3721897 - RNA, 17 nt, Salmonella enterica enterica serovar Typhi Ty2
gcauuaacguccauacc

SEQ ID NO: 3721898 - RNA, 14 nt, Salmonella enterica enterica serovar Typhi Ty2
gcauuaagcugaua

SEQ ID NO: 3721899 - RNA, 13 nt, Salmonella enterica enterica serovar Typhi Ty2
gcauuaauuucuu

SEQ ID NO: 3721900 - RNA, 15 nt, Salmonella enterica enterica serovar Typhi Ty2
gcauuaauuucuugc

SEQ ID NO: 3721901 - RNA, 18 nt, Salmonella enterica enterica serovar Typhi Ty2
gcauuacccccgccauaa

SEQ ID NO: 3721902 - RNA, 17 nt, Salmonella enterica enterica serovar Typhi Ty2
gcauuagcgccaccgag

SEQ ID NO: 3721903 - RNA, 11 nt, Salmonella enterica enterica serovar Typhi Ty2
gcauuauaaau

SEQ ID NO: 3721904 - RNA, 20 nt, Salmonella enterica enterica serovar Typhi Ty2
gcauuauacgccuauuuucu

SEQ ID NO: 3721905 - RNA, 17 nt, Salmonella enterica enterica serovar Typhi Ty2
gcauuaucgaugcguau

SEQ ID NO: 3721906 - RNA, 18 nt, Salmonella enterica enterica serovar Typhi Ty2
gcauuaugggcgugcuga

SEQ ID NO: 3721907 - RNA, 12 nt, Salmonella enterica enterica serovar Typhi Ty2
gcauucacgcca

SEQ ID NO: 3721908 - RNA, 14 nt, Salmonella enterica enterica serovar Typhi Ty2
gcauucagccagcu

SEQ ID NO: 3721909 - RNA, 16 nt, Salmonella enterica enterica serovar Typhi Ty2
gcauuccccaucgcga

SEQ ID NO: 3721910 - RNA, 14 nt, Salmonella enterica enterica serovar Typhi Ty2
gcauucuaaauccu

SEQ ID NO: 3721911 - RNA, 20 nt, Salmonella enterica enterica serovar Typhi Ty2
gcauucuuugcuuuguaaag

SEQ ID NO: 3721912 - RNA, 23 nt, Salmonella enterica enterica serovar Typhi Ty2
gcauucuuugcuuuguaaagcgc

SEQ ID NO: 3721913 - RNA, 20 nt, Salmonella enterica enterica serovar Typhi Ty2
gcauugagacaugccgccag

SEQ ID NO: 3721914 - RNA, 18 nt, Salmonella enterica enterica serovar Typhi Ty2
gcauugggauggauaaau

SEQ ID NO: 3721915 - RNA, 16 nt, Salmonella enterica enterica serovar Typhi Ty2
gcauuguuaauccaga

SEQ ID NO: 3721916 - RNA, 14 nt, Salmonella enterica enterica serovar Typhi Ty2
gcauuuaggucuug

SEQ ID NO: 3721917 - RNA, 18 nt, Salmonella enterica enterica serovar Typhi Ty2
gcauuucaagcaggcgau

SEQ ID NO: 3721918 - RNA, 16 nt, Salmonella enterica enterica serovar Typhi Ty2
gcauuucaaucgccac

SEQ ID NO: 3721919 - RNA, 13 nt, Salmonella enterica enterica serovar Typhi Ty2
gcauuuccagcug

SEQ ID NO: 3721920 - RNA, 12 nt, Salmonella enterica enterica serovar Typhi Ty2
gcauuucuucaa

SEQ ID NO: 3721921 - RNA, 22 nt, Salmonella enterica enterica serovar Typhi Ty2
gcauuugcgucguuaacugcau

SEQ ID NO: 3721922 - RNA, 20 nt, Salmonella enterica enterica serovar Typhi Ty2
gcauuugucgcuguuaaucu

SEQ ID NO: 3721923 - RNA, 17 nt, Salmonella enterica enterica serovar Typhi Ty2
gcauuuucuuauuuauu

SEQ ID NO: 3721924 - RNA, 19 nt, Salmonella enterica enterica serovar Typhi Ty2
gcauuuuuaucaucugcau

SEQ ID NO: 3721925 - RNA, 13 nt, Salmonella enterica enterica serovar Typhi Ty2
gccaaaaccacag

SEQ ID NO: 3721926 - RNA, 18 nt, Salmonella enterica enterica serovar Typhi Ty2
gccaaaaccacagugacc

SEQ ID NO: 3721927 - RNA, 22 nt, Salmonella enterica enterica serovar Typhi Ty2
gccaaaacccaccagcagggca

SEQ ID NO: 3721928 - RNA, 13 nt, Salmonella enterica enterica serovar Typhi Ty2
gccaaaaccgcuc

SEQ ID NO: 3721929 - RNA, 16 nt, Salmonella enterica enterica serovar Typhi Ty2
gccaaaagaggcagca

SEQ ID NO: 3721930 - RNA, 14 nt, Salmonella enterica enterica serovar Typhi Ty2
gccaaaccacugau

SEQ ID NO: 3721931 - RNA, 14 nt, Salmonella enterica enterica serovar Typhi Ty2
gccaaaccagaccc

SEQ ID NO: 3721932 - RNA, 22 nt, Salmonella enterica enterica serovar Typhi Ty2
gccaaacccugcgccgcaaagg

SEQ ID NO: 3721933 - RNA, 15 nt, Salmonella enterica enterica serovar Typhi Ty2
gccaaacguggcggc

SEQ ID NO: 3721934 - RNA, 23 nt, Salmonella enterica enterica serovar Typhi Ty2
gccaaacuccaccugaucgccaa

SEQ ID NO: 3721935 - RNA, 22 nt, Salmonella enterica enterica serovar Typhi Ty2
gccaaacuggcaaauaaaauag

SEQ ID NO: 3721936 - RNA, 15 nt, Salmonella enterica enterica serovar Typhi Ty2
gccaaagaaacgcug

SEQ ID NO: 3721937 - RNA, 20 nt, Salmonella enterica enterica serovar Typhi Ty2
gccaaagaaacgcugaucua

SEQ ID NO: 3721938 - RNA, 13 nt, Salmonella enterica enterica serovar Typhi Ty2
gccaaagauuagc

SEQ ID NO: 3721939 - RNA, 23 nt, Salmonella enterica enterica serovar Typhi Ty2
gccaaagauuagccccagcgcca

SEQ ID NO: 3721940 - RNA, 22 nt, Salmonella enterica enterica serovar Typhi Ty2
gccaaagcuggauaucacgcgc

SEQ ID NO: 3721941 - RNA, 12 nt, Salmonella enterica enterica serovar Typhi Ty2
gccaaagggagc

SEQ ID NO: 3721942 - RNA, 17 nt, Salmonella enterica enterica serovar Typhi Ty2
gccaaagggagcagacu

SEQ ID NO: 3721943 - RNA, 18 nt, Salmonella enterica enterica serovar Typhi Ty2
gccaaaguuaaucagcgc

SEQ ID NO: 3721944 - RNA, 21 nt, Salmonella enterica enterica serovar Typhi Ty2
gccaaaguuaaucagcgccgu

SEQ ID NO: 3721945 - RNA, 16 nt, Salmonella enterica enterica serovar Typhi Ty2
gccaaauagcgccaga

SEQ ID NO: 3721946 - RNA, 15 nt, Salmonella enterica enterica serovar Typhi Ty2
gccaaaucagcagga

SEQ ID NO: 3721947 - RNA, 18 nt, Salmonella enterica enterica serovar Typhi Ty2
gccaaaucuguucugucc

SEQ ID NO: 3721948 - RNA, 11 nt, Salmonella enterica enterica serovar Typhi Ty2
gccaaauguau

SEQ ID NO: 3721949 - RNA, 21 nt, Salmonella enterica enterica serovar Typhi Ty2
gccaaauuuucaaccacggau

SEQ ID NO: 3721950 - RNA, 15 nt, Salmonella enterica enterica serovar Typhi Ty2
gccaacaacaggccg

SEQ ID NO: 3721951 - RNA, 19 nt, Salmonella enterica enterica serovar Typhi Ty2
gccaacaacaggccgccga

SEQ ID NO: 3721952 - RNA, 18 nt, Salmonella enterica enterica serovar Typhi Ty2
gccaaccgccacaauauc

SEQ ID NO: 3721953 - RNA, 19 nt, Salmonella enterica enterica serovar Typhi Ty2
gccaaccgugagcgcgccg

SEQ ID NO: 3721954 - RNA, 21 nt, Salmonella enterica enterica serovar Typhi Ty2
gccaaccgugagcgcgccgca

SEQ ID NO: 3721955 - RNA, 18 nt, Salmonella enterica enterica serovar Typhi Ty2
gccaacgagaauaagacc

SEQ ID NO: 3721956 - RNA, 21 nt, Salmonella enterica enterica serovar Typhi Ty2
gccaacgauacagcacggcag

SEQ ID NO: 3721957 - RNA, 13 nt, Salmonella enterica enterica serovar Typhi Ty2
gccaacgccaaca

SEQ ID NO: 3721958 - RNA, 16 nt, Salmonella enterica enterica serovar Typhi Ty2
gccaacgccggcaaca

SEQ ID NO: 3721959 - RNA, 17 nt, Salmonella enterica enterica serovar Typhi Ty2
gccaacguccgccguca

SEQ ID NO: 3721960 - RNA, 18 nt, Salmonella enterica enterica serovar Typhi Ty2
gccaacuuuuugcgcaau

SEQ ID NO: 3721961 - RNA, 22 nt, Salmonella enterica enterica serovar Typhi Ty2
gccaagaaugaaacaagcggcg

SEQ ID NO: 3721962 - RNA, 24 nt, Salmonella enterica enterica serovar Typhi Ty2
gccaagcgccuguucaacaugcug

SEQ ID NO: 3721963 - RNA, 12 nt, Salmonella enterica enterica serovar Typhi Ty2
gccaagcgcggc

SEQ ID NO: 3721964 - RNA, 22 nt, Salmonella enterica enterica serovar Typhi Ty2
gccaagcggcaucucgccaaac

SEQ ID NO: 3721965 - RNA, 16 nt, Salmonella enterica enterica serovar Typhi Ty2
gccaagcugcagaauc

SEQ ID NO: 3721966 - RNA, 21 nt, Salmonella enterica enterica serovar Typhi Ty2
gccaaguaauaaagagaacga

SEQ ID NO: 3721967 - RNA, 19 nt, Salmonella enterica enterica serovar Typhi Ty2
gccaauaauuaguuuuacc

SEQ ID NO: 3721968 - RNA, 15 nt, Salmonella enterica enterica serovar Typhi Ty2
gccaauaggggcgga

SEQ ID NO: 3721969 - RNA, 18 nt, Salmonella enterica enterica serovar Typhi Ty2
gccaauauugacguuaaa

SEQ ID NO: 3721970 - RNA, 16 nt, Salmonella enterica enterica serovar Typhi Ty2
gccaaucaccgccagc

SEQ ID NO: 3721971 - RNA, 23 nt, Salmonella enterica enterica serovar Typhi Ty2
gccaauccagaauaccagaauca

SEQ ID NO: 3721972 - RNA, 12 nt, Salmonella enterica enterica serovar Typhi Ty2
gccaauccugca

SEQ ID NO: 3721973 - RNA, 22 nt, Salmonella enterica enterica serovar Typhi Ty2
gccaauccugcacccgccuuac

SEQ ID NO: 3721974 - RNA, 14 nt, Salmonella enterica enterica serovar Typhi Ty2
gccaaucgccgccg

SEQ ID NO: 3721975 - RNA, 18 nt, Salmonella enterica enterica serovar Typhi Ty2
gccaaucgccgccgccag

SEQ ID NO: 3721976 - RNA, 21 nt, Salmonella enterica enterica serovar Typhi Ty2
gccaaucggcgucuugccgca

SEQ ID NO: 3721977 - RNA, 15 nt, Salmonella enterica enterica serovar Typhi Ty2
gccaaugaaauaauu

SEQ ID NO: 3721978 - RNA, 20 nt, Salmonella enterica enterica serovar Typhi Ty2
gccacgucacgcaacaggcc

SEQ ID NO: 3721979 - RNA, 20 nt, Salmonella enterica enterica serovar Typhi Ty2
gccacguucuuccagaacgc

SEQ ID NO: 3721980 - RNA, 18 nt, Salmonella enterica enterica serovar Typhi Ty2
gccacucuggcgacgcca

SEQ ID NO: 3721981 - RNA, 13 nt, Salmonella enterica enterica serovar Typhi Ty2
gccacugcgccau

SEQ ID NO: 3721982 - RNA, 11 nt, Salmonella enterica enterica serovar Typhi Ty2
gccacuggccu

SEQ ID NO: 3721983 - RNA, 18 nt, Salmonella enterica enterica serovar Typhi Ty2
gccacuucacuggcggca

SEQ ID NO: 3721984 - RNA, 22 nt, Salmonella enterica enterica serovar Typhi Ty2
gccacuucacuggcggcaagcu

SEQ ID NO: 3721985 - RNA, 16 nt, Salmonella enterica enterica serovar Typhi Ty2
gccacuuccagcgcgc

SEQ ID NO: 3721986 - RNA, 21 nt, Salmonella enterica enterica serovar Typhi Ty2
gccacuuccagcgcgccguca

SEQ ID NO: 3721987 - RNA, 14 nt, Salmonella enterica enterica serovar Typhi Ty2
gccacuucuuccag

SEQ ID NO: 3721988 - RNA, 18 nt, Salmonella enterica enterica serovar Typhi Ty2
gccacuucuuccagcggc

SEQ ID NO: 3721989 - RNA, 20 nt, Salmonella enterica enterica serovar Typhi Ty2
gccacuucuuccagcggcag

SEQ ID NO: 3721990 - RNA, 16 nt, Salmonella enterica enterica serovar Typhi Ty2
gccacuugaaguauga

SEQ ID NO: 3721991 - RNA, 17 nt, Salmonella enterica enterica serovar Typhi Ty2
gccagaaaucgcucaug

SEQ ID NO: 3721992 - RNA, 22 nt, Salmonella enterica enterica serovar Typhi Ty2
gccagaagagaauggccagcac

SEQ ID NO: 3721993 - RNA, 21 nt, Salmonella enterica enterica serovar Typhi Ty2
gccagaauacaccgccuagcg

SEQ ID NO: 3721994 - RNA, 17 nt, Salmonella enterica enterica serovar Typhi Ty2
gccagaaucaccucuuu

SEQ ID NO: 3721995 - RNA, 18 nt, Salmonella enterica enterica serovar Typhi Ty2
gccagaaugccagcgccg

SEQ ID NO: 3721996 - RNA, 19 nt, Salmonella enterica enterica serovar Typhi Ty2
gccagacagauaacaccag

SEQ ID NO: 3721997 - RNA, 22 nt, Salmonella enterica enterica serovar Typhi Ty2
gccagacagcccuauaacagcg

SEQ ID NO: 3721998 - RNA, 17 nt, Salmonella enterica enterica serovar Typhi Ty2
gccagacccagcgcuaa

SEQ ID NO: 3721999 - RNA, 21 nt, Salmonella enterica enterica serovar Typhi Ty2
gccagaccccaguaauccggc

SEQ ID NO: 3722000 - RNA, 16 nt, Salmonella enterica enterica serovar Typhi Ty2
gccagaccgaaaagcc

SEQ ID NO: 3722001 - RNA, 18 nt, Salmonella enterica enterica serovar Typhi Ty2
gccagaccgcuuaacucc

SEQ ID NO: 3722002 - RNA, 16 nt, Salmonella enterica enterica serovar Typhi Ty2
gccagacgccagccac

SEQ ID NO: 3722003 - RNA, 14 nt, Salmonella enterica enterica serovar Typhi Ty2
gccagacgcgcagc

SEQ ID NO: 3722004 - RNA, 20 nt, Salmonella enterica enterica serovar Typhi Ty2
gccagacggcgcccagccug

SEQ ID NO: 3722005 - RNA, 18 nt, Salmonella enterica enterica serovar Typhi Ty2
gccagacucgcuucacgc

SEQ ID NO: 3722006 - RNA, 19 nt, Salmonella enterica enterica serovar Typhi Ty2
gccagagagaugccgccgg

SEQ ID NO: 3722007 - RNA, 14 nt, Salmonella enterica enterica serovar Typhi Ty2
gccagagagcguuu

SEQ ID NO: 3722008 - RNA, 13 nt, Salmonella enterica enterica serovar Typhi Ty2
gccagagcgcgcu

SEQ ID NO: 3722009 - RNA, 19 nt, Salmonella enterica enterica serovar Typhi Ty2
gccagaggcagcacaucaa

SEQ ID NO: 3722010 - RNA, 14 nt, Salmonella enterica enterica serovar Typhi Ty2
gccagauaaagcag

SEQ ID NO: 3722011 - RNA, 17 nt, Salmonella enterica enterica serovar Typhi Ty2
gccagauaaucgccgcc

SEQ ID NO: 3722012 - RNA, 21 nt, Salmonella enterica enterica serovar Typhi Ty2
gccagauaaucgccgccagcu

SEQ ID NO: 3722013 - RNA, 22 nt, Salmonella enterica enterica serovar Typhi Ty2
gccagaugaaacugcauaucgc

SEQ ID NO: 3722014 - RNA, 19 nt, Salmonella enterica enterica serovar Typhi Ty2
gccagauggauaaccugcc

SEQ ID NO: 3722015 - RNA, 21 nt, Salmonella enterica enterica serovar Typhi Ty2
gccagauggauaaccugccgg

SEQ ID NO: 3722016 - RNA, 19 nt, Salmonella enterica enterica serovar Typhi Ty2
gccagaugguaagcauagc

SEQ ID NO: 3722017 - RNA, 22 nt, Salmonella enterica enterica serovar Typhi Ty2
gccagcaaaaucaccaucacga

SEQ ID NO: 3722018 - RNA, 13 nt, Salmonella enterica enterica serovar Typhi Ty2
gccagcaaacugg

SEQ ID NO: 3722019 - RNA, 16 nt, Salmonella enterica enterica serovar Typhi Ty2
gccagcaacccaccug

SEQ ID NO: 3722020 - RNA, 18 nt, Salmonella enterica enterica serovar Typhi Ty2
gccagcaacgcccagaua

SEQ ID NO: 3722021 - RNA, 16 nt, Salmonella enterica enterica serovar Typhi Ty2
gccagcaacgcgcuaa

SEQ ID NO: 3722022 - RNA, 20 nt, Salmonella enterica enterica serovar Typhi Ty2
gccagcaacguuaaggccgc

SEQ ID NO: 3722023 - RNA, 17 nt, Salmonella enterica enterica serovar Typhi Ty2
gccagcaaggcaagaaa

SEQ ID NO: 3722024 - RNA, 16 nt, Salmonella enterica enterica serovar Typhi Ty2
gccagcaaugccgccg

SEQ ID NO: 3722025 - RNA, 19 nt, Salmonella enterica enterica serovar Typhi Ty2
gccagcaaugccgccgcca

SEQ ID NO: 3722026 - RNA, 14 nt, Salmonella enterica enterica serovar Typhi Ty2
gccagcaccagcag

SEQ ID NO: 3722027 - RNA, 15 nt, Salmonella enterica enterica serovar Typhi Ty2
gccagcaccagcagc

SEQ ID NO: 3722028 - RNA, 19 nt, Salmonella enterica enterica serovar Typhi Ty2
gccagcaccagcagcgcau

SEQ ID NO: 3722029 - RNA, 15 nt, Salmonella enterica enterica serovar Typhi Ty2
gccagcaccagcagu

SEQ ID NO: 3722030 - RNA, 16 nt, Salmonella enterica enterica serovar Typhi Ty2
gccagcaccagcauua

SEQ ID NO: 3722031 - RNA, 17 nt, Salmonella enterica enterica serovar Typhi Ty2
gccagcaccugauagug

SEQ ID NO: 3722032 - RNA, 21 nt, Salmonella enterica enterica serovar Typhi Ty2
gccagcacgaggguaauggcu

SEQ ID NO: 3722033 - RNA, 17 nt, Salmonella enterica enterica serovar Typhi Ty2
gccagcagagcgaacag

SEQ ID NO: 3722034 - RNA, 14 nt, Salmonella enterica enterica serovar Typhi Ty2
gccagcagcauaaa

SEQ ID NO: 3722035 - RNA, 13 nt, Salmonella enterica enterica serovar Typhi Ty2
gccagcagcgcac

SEQ ID NO: 3722036 - RNA, 18 nt, Salmonella enterica enterica serovar Typhi Ty2
gccagcagcgcaucaucc

SEQ ID NO: 3722037 - RNA, 19 nt, Salmonella enterica enterica serovar Typhi Ty2
gccagcagcucaacggcag

SEQ ID NO: 3722038 - RNA, 18 nt, Salmonella enterica enterica serovar Typhi Ty2
gccagcagggucaggaac

SEQ ID NO: 3722039 - RNA, 16 nt, Salmonella enterica enterica serovar Typhi Ty2
gccagcagguuaaaca

SEQ ID NO: 3722040 - RNA, 11 nt, Salmonella enterica enterica serovar Typhi Ty2
gccagcaguug

SEQ ID NO: 3722041 - RNA, 23 nt, Salmonella enterica enterica serovar Typhi Ty2
gccagcaguuuuucaaucuuagc

SEQ ID NO: 3722042 - RNA, 15 nt, Salmonella enterica enterica serovar Typhi Ty2
gccagcauacagcuu

SEQ ID NO: 3722043 - RNA, 16 nt, Salmonella enterica enterica serovar Typhi Ty2
gccagcauaccgccca

SEQ ID NO: 3722044 - RNA, 23 nt, Salmonella enterica enterica serovar Typhi Ty2
gccagcauaugcacacgcagcug

SEQ ID NO: 3722045 - RNA, 21 nt, Salmonella enterica enterica serovar Typhi Ty2
gccagcaucaugggcucauca

SEQ ID NO: 3722046 - RNA, 16 nt, Salmonella enterica enterica serovar Typhi Ty2
gccagcaugguuaaaa

SEQ ID NO: 3722047 - RNA, 16 nt, Salmonella enterica enterica serovar Typhi Ty2
gccagcauuuccagcu

SEQ ID NO: 3722048 - RNA, 18 nt, Salmonella enterica enterica serovar Typhi Ty2
gccagcauuuccagcugg

SEQ ID NO: 3722049 - RNA, 19 nt, Salmonella enterica enterica serovar Typhi Ty2
gccagccagucgccaggca

SEQ ID NO: 3722050 - RNA, 16 nt, Salmonella enterica enterica serovar Typhi Ty2
gccagccauccccaua

SEQ ID NO: 3722051 - RNA, 23 nt, Salmonella enterica enterica serovar Typhi Ty2
gccagccauggcccaaaagguag

SEQ ID NO: 3722052 - RNA, 16 nt, Salmonella enterica enterica serovar Typhi Ty2
gccagccauucaccac

SEQ ID NO: 3722053 - RNA, 14 nt, Salmonella enterica enterica serovar Typhi Ty2
gccagccccagccc

SEQ ID NO: 3722054 - RNA, 22 nt, Salmonella enterica enterica serovar Typhi Ty2
gccagcccgacuaccggcacca

SEQ ID NO: 3722055 - RNA, 21 nt, Salmonella enterica enterica serovar Typhi Ty2
gccagcccucuucuucuuccg

SEQ ID NO: 3722056 - RNA, 22 nt, Salmonella enterica enterica serovar Typhi Ty2
gccagccgacgcucuuccucaa

SEQ ID NO: 3722057 - RNA, 18 nt, Salmonella enterica enterica serovar Typhi Ty2
gccagccgccaaaaauau

SEQ ID NO: 3722058 - RNA, 14 nt, Salmonella enterica enterica serovar Typhi Ty2
gccagccgccgccg

SEQ ID NO: 3722059 - RNA, 21 nt, Salmonella enterica enterica serovar Typhi Ty2
gccagccgcucugcuguuccu

SEQ ID NO: 3722060 - RNA, 18 nt, Salmonella enterica enterica serovar Typhi Ty2
gccaguaucgcgccgcca

SEQ ID NO: 3722061 - RNA, 13 nt, Salmonella enterica enterica serovar Typhi Ty2
gccagucaucgcc

SEQ ID NO: 3722062 - RNA, 17 nt, Salmonella enterica enterica serovar Typhi Ty2
gccagucgccaggcaag

SEQ ID NO: 3722063 - RNA, 21 nt, Salmonella enterica enterica serovar Typhi Ty2
gccagugcgauaccggccgcc

SEQ ID NO: 3722064 - RNA, 22 nt, Salmonella enterica enterica serovar Typhi Ty2
gccagugcgauaccggccgccc

SEQ ID NO: 3722065 - RNA, 20 nt, Salmonella enterica enterica serovar Typhi Ty2
gccagugggcgucaaaaucc

SEQ ID NO: 3722066 - RNA, 21 nt, Salmonella enterica enterica serovar Typhi Ty2
gccagugggcgucaaaauccc

SEQ ID NO: 3722067 - RNA, 18 nt, Salmonella enterica enterica serovar Typhi Ty2
gccaguuagcgaucgcgc

SEQ ID NO: 3722068 - RNA, 17 nt, Salmonella enterica enterica serovar Typhi Ty2
gccaguuaucaggacau

SEQ ID NO: 3722069 - RNA, 22 nt, Salmonella enterica enterica serovar Typhi Ty2
gccaguuauuaaucaagcccag

SEQ ID NO: 3722070 - RNA, 22 nt, Salmonella enterica enterica serovar Typhi Ty2
gccaguucacgccgccgccgac

SEQ ID NO: 3722071 - RNA, 19 nt, Salmonella enterica enterica serovar Typhi Ty2
gccaguucauucgccacca

SEQ ID NO: 3722072 - RNA, 14 nt, Salmonella enterica enterica serovar Typhi Ty2
gccaguucgccggc

SEQ ID NO: 3722073 - RNA, 18 nt, Salmonella enterica enterica serovar Typhi Ty2
gccaguugcgcaggguau

SEQ ID NO: 3722074 - RNA, 21 nt, Salmonella enterica enterica serovar Typhi Ty2
gccaguuguccgcuggucagc

SEQ ID NO: 3722075 - RNA, 12 nt, Salmonella enterica enterica serovar Typhi Ty2
gccaguuuacgc

SEQ ID NO: 3722076 - RNA, 17 nt, Salmonella enterica enterica serovar Typhi Ty2
gccaguuuagggaucau

SEQ ID NO: 3722077 - RNA, 15 nt, Salmonella enterica enterica serovar Typhi Ty2
gccaguuuccugacc

SEQ ID NO: 3722078 - RNA, 12 nt, Salmonella enterica enterica serovar Typhi Ty2
gccaguuucucu

SEQ ID NO: 3722079 - RNA, 15 nt, Salmonella enterica enterica serovar Typhi Ty2
gccaguuuguaacca

SEQ ID NO: 3722080 - RNA, 14 nt, Salmonella enterica enterica serovar Typhi Ty2
gccaguuuuccgcc

SEQ ID NO: 3722081 - RNA, 15 nt, Salmonella enterica enterica serovar Typhi Ty2
gccaguuuuccgccu

SEQ ID NO: 3722082 - RNA, 16 nt, Salmonella enterica enterica serovar Typhi Ty2
gccaguuuuccgccug

SEQ ID NO: 3722083 - RNA, 20 nt, Salmonella enterica enterica serovar Typhi Ty2
gccaguuuucgacauauuug

SEQ ID NO: 3722084 - RNA, 19 nt, Salmonella enterica enterica serovar Typhi Ty2
gccauaaaaacaauaaaua

SEQ ID NO: 3722085 - RNA, 18 nt, Salmonella enterica enterica serovar Typhi Ty2
gccauaaaacgggcaaac

SEQ ID NO: 3722086 - RNA, 21 nt, Salmonella enterica enterica serovar Typhi Ty2
gccauaaaccccgauaaacca

SEQ ID NO: 3722087 - RNA, 18 nt, Salmonella enterica enterica serovar Typhi Ty2
gccauaaagcuguaccug

SEQ ID NO: 3722088 - RNA, 21 nt, Salmonella enterica enterica serovar Typhi Ty2
gccauaacggcuguccauccg

SEQ ID NO: 3722089 - RNA, 14 nt, Salmonella enterica enterica serovar Typhi Ty2
gccauaauacuuaa

SEQ ID NO: 3722090 - RNA, 23 nt, Salmonella enterica enterica serovar Typhi Ty2
gccauaaucaguacugcgcccgc

SEQ ID NO: 3722091 - RNA, 17 nt, Salmonella enterica enterica serovar Typhi Ty2
gccauaaucgcuuuuuc

SEQ ID NO: 3722092 - RNA, 19 nt, Salmonella enterica enterica serovar Typhi Ty2
gccauaaucgcuuuuuccu

SEQ ID NO: 3722093 - RNA, 22 nt, Salmonella enterica enterica serovar Typhi Ty2
gccauaaugcacaauacgccga

SEQ ID NO: 3722094 - RNA, 22 nt, Salmonella enterica enterica serovar Typhi Ty2
gccauacagguuuuaaucguuu

SEQ ID NO: 3722095 - RNA, 13 nt, Salmonella enterica enterica serovar Typhi Ty2
gccauacgcccac

SEQ ID NO: 3722096 - RNA, 17 nt, Salmonella enterica enterica serovar Typhi Ty2
gccauacuuacugcugu

SEQ ID NO: 3722097 - RNA, 13 nt, Salmonella enterica enterica serovar Typhi Ty2
gccauagcgggca

SEQ ID NO: 3722098 - RNA, 22 nt, Salmonella enterica enterica serovar Typhi Ty2
gccauaguuugcucaggcuccg

SEQ ID NO: 3722099 - RNA, 14 nt, Salmonella enterica enterica serovar Typhi Ty2
gccauauacgccac

SEQ ID NO: 3722100 - RNA, 20 nt, Salmonella enterica enterica serovar Typhi Ty2
gccauauacgccacggccag

SEQ ID NO: 3722101 - RNA, 20 nt, Salmonella enterica enterica serovar Typhi Ty2
gccauauauuuacugaauaa

SEQ ID NO: 3722102 - RNA, 21 nt, Salmonella enterica enterica serovar Typhi Ty2
gccauaucaccgcugacugaa

SEQ ID NO: 3722103 - RNA, 15 nt, Salmonella enterica enterica serovar Typhi Ty2
gccauauccagccag

SEQ ID NO: 3722104 - RNA, 18 nt, Salmonella enterica enterica serovar Typhi Ty2
gccauaucggcacugcuu

SEQ ID NO: 3722105 - RNA, 18 nt, Salmonella enterica enterica serovar Typhi Ty2
gccauauggcauucgcag

SEQ ID NO: 3722106 - RNA, 21 nt, Salmonella enterica enterica serovar Typhi Ty2
gccauauggcauucgcagagg

SEQ ID NO: 3722107 - RNA, 19 nt, Salmonella enterica enterica serovar Typhi Ty2
gccauauucaacgaaugcc

SEQ ID NO: 3722108 - RNA, 19 nt, Salmonella enterica enterica serovar Typhi Ty2
gccauauuguucaguuuca

SEQ ID NO: 3722109 - RNA, 23 nt, Salmonella enterica enterica serovar Typhi Ty2
gccauauuuaacauagcuaccgc

SEQ ID NO: 3722110 - RNA, 18 nt, Salmonella enterica enterica serovar Typhi Ty2
gccauauuuaccuuuucc

SEQ ID NO: 3722111 - RNA, 19 nt, Salmonella enterica enterica serovar Typhi Ty2
gccauauuuuuucaggaag

SEQ ID NO: 3722112 - RNA, 17 nt, Salmonella enterica enterica serovar Typhi Ty2
gccaucagcaaaauacc

SEQ ID NO: 3722113 - RNA, 22 nt, Salmonella enterica enterica serovar Typhi Ty2
gccaucagcaaaauaccggcag

SEQ ID NO: 3722114 - RNA, 15 nt, Salmonella enterica enterica serovar Typhi Ty2
gccaucaggaaauuc

SEQ ID NO: 3722115 - RNA, 18 nt, Salmonella enterica enterica serovar Typhi Ty2
gccaucaggcaaucuuua

SEQ ID NO: 3722116 - RNA, 14 nt, Salmonella enterica enterica serovar Typhi Ty2
gccaucaggcaauu

SEQ ID NO: 3722117 - RNA, 19 nt, Salmonella enterica enterica serovar Typhi Ty2
gccaucaggcaugccaaac

SEQ ID NO: 3722118 - RNA, 19 nt, Salmonella enterica enterica serovar Typhi Ty2
gccaucaggccccccuugu

SEQ ID NO: 3722119 - RNA, 23 nt, Salmonella enterica enterica serovar Typhi Ty2
gccaucaggccccccuuguuauc

SEQ ID NO: 3722120 - RNA, 21 nt, Salmonella enterica enterica serovar Typhi Ty2
gccaucaguaaaggaugccac

SEQ ID NO: 3722121 - RNA, 14 nt, Salmonella enterica enterica serovar Typhi Ty2
gccaucaugcccac

SEQ ID NO: 3722122 - RNA, 19 nt, Salmonella enterica enterica serovar Typhi Ty2
gccaucauuaauuuacuga

SEQ ID NO: 3722123 - RNA, 19 nt, Salmonella enterica enterica serovar Typhi Ty2
gccauccacggccccgggc

SEQ ID NO: 3722124 - RNA, 19 nt, Salmonella enterica enterica serovar Typhi Ty2
gccauccaucuccggcauc

SEQ ID NO: 3722125 - RNA, 19 nt, Salmonella enterica enterica serovar Typhi Ty2
gccaucccaugcaccaguc

SEQ ID NO: 3722126 - RNA, 14 nt, Salmonella enterica enterica serovar Typhi Ty2
gccaucccggcgac

SEQ ID NO: 3722127 - RNA, 16 nt, Salmonella enterica enterica serovar Typhi Ty2
gccaucccugacaaua

SEQ ID NO: 3722128 - RNA, 17 nt, Salmonella enterica enterica serovar Typhi Ty2
gccauccgacaaccggc

SEQ ID NO: 3722129 - RNA, 11 nt, Salmonella enterica enterica serovar Typhi Ty2
gccauccggca

SEQ ID NO: 3722130 - RNA, 16 nt, Salmonella enterica enterica serovar Typhi Ty2
gccauccggcaacaaa

SEQ ID NO: 3722131 - RNA, 16 nt, Salmonella enterica enterica serovar Typhi Ty2
gccauccggcaauuaa

SEQ ID NO: 3722132 - RNA, 20 nt, Salmonella enterica enterica serovar Typhi Ty2
gccauccggcacuacagcgu

SEQ ID NO: 3722133 - RNA, 23 nt, Salmonella enterica enterica serovar Typhi Ty2
gccauccggcacuacagcguuaa

SEQ ID NO: 3722134 - RNA, 13 nt, Salmonella enterica enterica serovar Typhi Ty2
gccauccggcauu

SEQ ID NO: 3722135 - RNA, 11 nt, Salmonella enterica enterica serovar Typhi Ty2
gccauccggcc

SEQ ID NO: 3722136 - RNA, 14 nt, Salmonella enterica enterica serovar Typhi Ty2
gccauccucacgca

SEQ ID NO: 3722137 - RNA, 18 nt, Salmonella enterica enterica serovar Typhi Ty2
gccauccugaguauaaaa

SEQ ID NO: 3722138 - RNA, 12 nt, Salmonella enterica enterica serovar Typhi Ty2
gccauccugccg

SEQ ID NO: 3722139 - RNA, 17 nt, Salmonella enterica enterica serovar Typhi Ty2
gccauccugccgcacca

SEQ ID NO: 3722140 - RNA, 19 nt, Salmonella enterica enterica serovar Typhi Ty2
gccauccugccgcaccagu

SEQ ID NO: 3722141 - RNA, 13 nt, Salmonella enterica enterica serovar Typhi Ty2
gccauccugcgug

SEQ ID NO: 3722142 - RNA, 12 nt, Salmonella enterica enterica serovar Typhi Ty2
gcccaccgcaua

SEQ ID NO: 3722143 - RNA, 12 nt, Salmonella enterica enterica serovar Typhi Ty2
gcccaccgccaa

SEQ ID NO: 3722144 - RNA, 18 nt, Salmonella enterica enterica serovar Typhi Ty2
gcccaccgcgcgcgcggc

SEQ ID NO: 3722145 - RNA, 22 nt, Salmonella enterica enterica serovar Typhi Ty2
gcccaccggagcggcguccgcc

SEQ ID NO: 3722146 - RNA, 19 nt, Salmonella enterica enterica serovar Typhi Ty2
gcccaccggcgagcgcgau

SEQ ID NO: 3722147 - RNA, 20 nt, Salmonella enterica enterica serovar Typhi Ty2
gcccacgcaaaauggccugc

SEQ ID NO: 3722148 - RNA, 13 nt, Salmonella enterica enterica serovar Typhi Ty2
gcccacgcccaga

SEQ ID NO: 3722149 - RNA, 22 nt, Salmonella enterica enterica serovar Typhi Ty2
gcccacuccggcgugaacgccu

SEQ ID NO: 3722150 - RNA, 22 nt, Salmonella enterica enterica serovar Typhi Ty2
gcccagauaacgcaucagacug

SEQ ID NO: 3722151 - RNA, 19 nt, Salmonella enterica enterica serovar Typhi Ty2
gcccagcaacacagccagc

SEQ ID NO: 3722152 - RNA, 20 nt, Salmonella enterica enterica serovar Typhi Ty2
gcccagcacuaacagcagca

SEQ ID NO: 3722153 - RNA, 14 nt, Salmonella enterica enterica serovar Typhi Ty2
gcccagcagcagaa

SEQ ID NO: 3722154 - RNA, 16 nt, Salmonella enterica enterica serovar Typhi Ty2
gcccagccaaagcgcc

SEQ ID NO: 3722155 - RNA, 14 nt, Salmonella enterica enterica serovar Typhi Ty2
gcccagcccggaaa

SEQ ID NO: 3722156 - RNA, 16 nt, Salmonella enterica enterica serovar Typhi Ty2
gcccagccugccugcc

SEQ ID NO: 3722157 - RNA, 11 nt, Salmonella enterica enterica serovar Typhi Ty2
gcccagcgccg

SEQ ID NO: 3722158 - RNA, 14 nt, Salmonella enterica enterica serovar Typhi Ty2
gcccagcgccgaga

SEQ ID NO: 3722159 - RNA, 21 nt, Salmonella enterica enterica serovar Typhi Ty2
gcccagcgcgauacgcagcac

SEQ ID NO: 3722160 - RNA, 23 nt, Salmonella enterica enterica serovar Typhi Ty2
gcccagcgcgauacgcagcaccg

SEQ ID NO: 3722161 - RNA, 15 nt, Salmonella enterica enterica serovar Typhi Ty2
gcccagcgcggccca

SEQ ID NO: 3722162 - RNA, 15 nt, Salmonella enterica enterica serovar Typhi Ty2
gcccagcgcgguggc

SEQ ID NO: 3722163 - RNA, 15 nt, Salmonella enterica enterica serovar Typhi Ty2
gcccagcuauuuuuc

SEQ ID NO: 3722164 - RNA, 22 nt, Salmonella enterica enterica serovar Typhi Ty2
gcccagcucaugauagggcagc

SEQ ID NO: 3722165 - RNA, 16 nt, Salmonella enterica enterica serovar Typhi Ty2
gcccaggcaucgacgc

SEQ ID NO: 3722166 - RNA, 23 nt, Salmonella enterica enterica serovar Typhi Ty2
gcccaggccaaaaccacagugac

SEQ ID NO: 3722167 - RNA, 18 nt, Salmonella enterica enterica serovar Typhi Ty2
gcccaggccaugcgccgc

SEQ ID NO: 3722168 - RNA, 22 nt, Salmonella enterica enterica serovar Typhi Ty2
gcccaggccugaugagcgcagc

SEQ ID NO: 3722169 - RNA, 14 nt, Salmonella enterica enterica serovar Typhi Ty2
gcccaggcggcggg

SEQ ID NO: 3722170 - RNA, 22 nt, Salmonella enterica enterica serovar Typhi Ty2
gcccaggcggguagucccagga

SEQ ID NO: 3722171 - RNA, 23 nt, Salmonella enterica enterica serovar Typhi Ty2
gcccaggcggguagucccaggau

SEQ ID NO: 3722172 - RNA, 12 nt, Salmonella enterica enterica serovar Typhi Ty2
gcccaggucgcc

SEQ ID NO: 3722173 - RNA, 16 nt, Salmonella enterica enterica serovar Typhi Ty2
gcccagguuagcagcc

SEQ ID NO: 3722174 - RNA, 21 nt, Salmonella enterica enterica serovar Typhi Ty2
gcccagguuagcagccacaca

SEQ ID NO: 3722175 - RNA, 13 nt, Salmonella enterica enterica serovar Typhi Ty2
gcccagugcccga

SEQ ID NO: 3722176 - RNA, 13 nt, Salmonella enterica enterica serovar Typhi Ty2
gcccauaaagaaa

SEQ ID NO: 3722177 - RNA, 11 nt, Salmonella enterica enterica serovar Typhi Ty2
gcccauaucca

SEQ ID NO: 3722178 - RNA, 15 nt, Salmonella enterica enterica serovar Typhi Ty2
gcccauauccagcuc

SEQ ID NO: 3722179 - RNA, 16 nt, Salmonella enterica enterica serovar Typhi Ty2
gcccauauucuuugcg

SEQ ID NO: 3722180 - RNA, 12 nt, Salmonella enterica enterica serovar Typhi Ty2
gcccaucagcgc

SEQ ID NO: 3722181 - RNA, 18 nt, Salmonella enterica enterica serovar Typhi Ty2
gcccaucagcgccagccc

SEQ ID NO: 3722182 - RNA, 19 nt, Salmonella enterica enterica serovar Typhi Ty2
gcccaucagcgccagcccu

SEQ ID NO: 3722183 - RNA, 20 nt, Salmonella enterica enterica serovar Typhi Ty2
gcccaucagcgccagcccug

SEQ ID NO: 3722184 - RNA, 13 nt, Salmonella enterica enterica serovar Typhi Ty2
gcccauccagcac

SEQ ID NO: 3722185 - RNA, 13 nt, Salmonella enterica enterica serovar Typhi Ty2
gcccauccgucag

SEQ ID NO: 3722186 - RNA, 15 nt, Salmonella enterica enterica serovar Typhi Ty2
gcccauccgucagga

SEQ ID NO: 3722187 - RNA, 14 nt, Salmonella enterica enterica serovar Typhi Ty2
gcccaucgccacag

SEQ ID NO: 3722188 - RNA, 15 nt, Salmonella enterica enterica serovar Typhi Ty2
gcccaucgccacagc

SEQ ID NO: 3722189 - RNA, 16 nt, Salmonella enterica enterica serovar Typhi Ty2
gcccaucgcgccauga

SEQ ID NO: 3722190 - RNA, 19 nt, Salmonella enterica enterica serovar Typhi Ty2
gcccaugauggugaacaga

SEQ ID NO: 3722191 - RNA, 21 nt, Salmonella enterica enterica serovar Typhi Ty2
gcccaugauggugaacagaau

SEQ ID NO: 3722192 - RNA, 17 nt, Salmonella enterica enterica serovar Typhi Ty2
gcccauggaugcgccgc

SEQ ID NO: 3722193 - RNA, 17 nt, Salmonella enterica enterica serovar Typhi Ty2
gcccauggcaggcagca

SEQ ID NO: 3722194 - RNA, 16 nt, Salmonella enterica enterica serovar Typhi Ty2
gcccauuauugaucuc

SEQ ID NO: 3722195 - RNA, 19 nt, Salmonella enterica enterica serovar Typhi Ty2
gcccauuauugaucucuuc

SEQ ID NO: 3722196 - RNA, 15 nt, Salmonella enterica enterica serovar Typhi Ty2
gcccauucaacgggc

SEQ ID NO: 3722197 - RNA, 15 nt, Salmonella enterica enterica serovar Typhi Ty2
gcccauuccgccaac

SEQ ID NO: 3722198 - RNA, 15 nt, Salmonella enterica enterica serovar Typhi Ty2
gcccauugaaaucgc

SEQ ID NO: 3722199 - RNA, 17 nt, Salmonella enterica enterica serovar Typhi Ty2
gccccacacggccacca

SEQ ID NO: 3722200 - RNA, 12 nt, Salmonella enterica enterica serovar Typhi Ty2
gccccaccgcca

SEQ ID NO: 3722201 - RNA, 14 nt, Salmonella enterica enterica serovar Typhi Ty2
gccccaccgccaga

SEQ ID NO: 3722202 - RNA, 11 nt, Salmonella enterica enterica serovar Typhi Ty2
gccccacuggc

SEQ ID NO: 3722203 - RNA, 13 nt, Salmonella enterica enterica serovar Typhi Ty2
gccccagacgccc

SEQ ID NO: 3722204 - RNA, 18 nt, Salmonella enterica enterica serovar Typhi Ty2
gccccagauacgcacggu

SEQ ID NO: 3722205 - RNA, 14 nt, Salmonella enterica enterica serovar Typhi Ty2
gccccagcacaauc

SEQ ID NO: 3722206 - RNA, 12 nt, Salmonella enterica enterica serovar Typhi Ty2
gccccagcacca

SEQ ID NO: 3722207 - RNA, 16 nt, Salmonella enterica enterica serovar Typhi Ty2
gccccagcaccagagc

SEQ ID NO: 3722208 - RNA, 18 nt, Salmonella enterica enterica serovar Typhi Ty2
gccccagcaugagccagc

SEQ ID NO: 3722209 - RNA, 20 nt, Salmonella enterica enterica serovar Typhi Ty2
gccccagcaugagccagccc

SEQ ID NO: 3722210 - RNA, 21 nt, Salmonella enterica enterica serovar Typhi Ty2
gccccagcaugagccagcccu

SEQ ID NO: 3722211 - RNA, 17 nt, Salmonella enterica enterica serovar Typhi Ty2
gccccagcccugugccg

SEQ ID NO: 3722212 - RNA, 11 nt, Salmonella enterica enterica serovar Typhi Ty2
gccccagcgcc

SEQ ID NO: 3722213 - RNA, 12 nt, Salmonella enterica enterica serovar Typhi Ty2
gccccagcgcca

SEQ ID NO: 3722214 - RNA, 14 nt, Salmonella enterica enterica serovar Typhi Ty2
gccccagcgccagc

SEQ ID NO: 3722215 - RNA, 21 nt, Salmonella enterica enterica serovar Typhi Ty2
gccccagcgccagcugcguca

SEQ ID NO: 3722216 - RNA, 16 nt, Salmonella enterica enterica serovar Typhi Ty2
gccccauguggccagc

SEQ ID NO: 3722217 - RNA, 20 nt, Salmonella enterica enterica serovar Typhi Ty2
gccccauguucaguucaacc

SEQ ID NO: 3722218 - RNA, 15 nt, Salmonella enterica enterica serovar Typhi Ty2
gcccccaugccgccu

SEQ ID NO: 3722219 - RNA, 19 nt, Salmonella enterica enterica serovar Typhi Ty2
gcccccaugccgccugccg

SEQ ID NO: 3722220 - RNA, 17 nt, Salmonella enterica enterica serovar Typhi Ty2
gcccccgaucacggcga

SEQ ID NO: 3722221 - RNA, 16 nt, Salmonella enterica enterica serovar Typhi Ty2
gcccccggccauagcg

SEQ ID NO: 3722222 - RNA, 13 nt, Salmonella enterica enterica serovar Typhi Ty2
gcccccucggcag

SEQ ID NO: 3722223 - RNA, 17 nt, Salmonella enterica enterica serovar Typhi Ty2
gccccgccacagccgca

SEQ ID NO: 3722224 - RNA, 12 nt, Salmonella enterica enterica serovar Typhi Ty2
gccccggcggcg

SEQ ID NO: 3722225 - RNA, 14 nt, Salmonella enterica enterica serovar Typhi Ty2
gcccuaucgcugcg

SEQ ID NO: 3722226 - RNA, 18 nt, Salmonella enterica enterica serovar Typhi Ty2
gcccuccagcuccgcgua

SEQ ID NO: 3722227 - RNA, 14 nt, Salmonella enterica enterica serovar Typhi Ty2
gcccucgccagcaa

SEQ ID NO: 3722228 - RNA, 23 nt, Salmonella enterica enterica serovar Typhi Ty2
gcccucuaagcgcucaaauaaug

SEQ ID NO: 3722229 - RNA, 19 nt, Salmonella enterica enterica serovar Typhi Ty2
gcccucuuccagcgccaaa

SEQ ID NO: 3722230 - RNA, 19 nt, Salmonella enterica enterica serovar Typhi Ty2
gcccucuuuaucaaacaaa

SEQ ID NO: 3722231 - RNA, 16 nt, Salmonella enterica enterica serovar Typhi Ty2
gcccucuuuuagcaau

SEQ ID NO: 3722232 - RNA, 16 nt, Salmonella enterica enterica serovar Typhi Ty2
gcccugaagggcggcu

SEQ ID NO: 3722233 - RNA, 22 nt, Salmonella enterica enterica serovar Typhi Ty2
gcccugacgccgcuguuuucac

SEQ ID NO: 3722234 - RNA, 16 nt, Salmonella enterica enterica serovar Typhi Ty2
gcccugauggcgcgcc

SEQ ID NO: 3722235 - RNA, 13 nt, Salmonella enterica enterica serovar Typhi Ty2
gcccugcaaagca

SEQ ID NO: 3722236 - RNA, 14 nt, Salmonella enterica enterica serovar Typhi Ty2
gcccugcccgccag

SEQ ID NO: 3722237 - RNA, 18 nt, Salmonella enterica enterica serovar Typhi Ty2
gcccugccggaaaaugcg

SEQ ID NO: 3722238 - RNA, 20 nt, Salmonella enterica enterica serovar Typhi Ty2
gcccugcgccagcauggcgu

SEQ ID NO: 3722239 - RNA, 17 nt, Salmonella enterica enterica serovar Typhi Ty2
gcccugcgccucaagcg

SEQ ID NO: 3722240 - RNA, 22 nt, Salmonella enterica enterica serovar Typhi Ty2
gcccugcgguagcuccagacag

SEQ ID NO: 3722241 - RNA, 17 nt, Salmonella enterica enterica serovar Typhi Ty2
gcccuggcgggaaacag

SEQ ID NO: 3722242 - RNA, 20 nt, Salmonella enterica enterica serovar Typhi Ty2
gcccuggcuguccuugcgcc

SEQ ID NO: 3722243 - RNA, 20 nt, Salmonella enterica enterica serovar Typhi Ty2
gcccuggguugcccaaaugc

SEQ ID NO: 3722244 - RNA, 18 nt, Salmonella enterica enterica serovar Typhi Ty2
gcccuguaacagaauuaa

SEQ ID NO: 3722245 - RNA, 13 nt, Salmonella enterica enterica serovar Typhi Ty2
gcccugugccgcu

SEQ ID NO: 3722246 - RNA, 16 nt, Salmonella enterica enterica serovar Typhi Ty2
gcccuucaucuuccag

SEQ ID NO: 3722247 - RNA, 14 nt, Salmonella enterica enterica serovar Typhi Ty2
gcccuuccagcagc

SEQ ID NO: 3722248 - RNA, 15 nt, Salmonella enterica enterica serovar Typhi Ty2
gcccuuccagcagcc

SEQ ID NO: 3722249 - RNA, 20 nt, Salmonella enterica enterica serovar Typhi Ty2
gcccuucgaccgucagcagc

SEQ ID NO: 3722250 - RNA, 21 nt, Salmonella enterica enterica serovar Typhi Ty2
gcccuugaucggguuuuccug

SEQ ID NO: 3722251 - RNA, 13 nt, Salmonella enterica enterica serovar Typhi Ty2
gcccuuucuucaa

SEQ ID NO: 3722252 - RNA, 18 nt, Salmonella enterica enterica serovar Typhi Ty2
gcccuuuuccagaaaacc

SEQ ID NO: 3722253 - RNA, 22 nt, Salmonella enterica enterica serovar Typhi Ty2
gcccuuuuugcauucgcuccuc

SEQ ID NO: 3722254 - RNA, 19 nt, Salmonella enterica enterica serovar Typhi Ty2
gcccuuuuuuguugugaua

SEQ ID NO: 3722255 - RNA, 12 nt, Salmonella enterica enterica serovar Typhi Ty2
gccgaaagcgau

SEQ ID NO: 3722256 - RNA, 18 nt, Salmonella enterica enterica serovar Typhi Ty2
gccgaaagcgaucacauu

SEQ ID NO: 3722257 - RNA, 19 nt, Salmonella enterica enterica serovar Typhi Ty2
gccgaacaacacggcggcc

SEQ ID NO: 3722258 - RNA, 21 nt, Salmonella enterica enterica serovar Typhi Ty2
gccgaacaacacggcggccau

SEQ ID NO: 3722259 - RNA, 12 nt, Salmonella enterica enterica serovar Typhi Ty2
gccgaacagacg

SEQ ID NO: 3722260 - RNA, 15 nt, Salmonella enterica enterica serovar Typhi Ty2
gccgaagcaggcgga

SEQ ID NO: 3722261 - RNA, 17 nt, Salmonella enterica enterica serovar Typhi Ty2
gccgaaggaagauagcg

SEQ ID NO: 3722262 - RNA, 20 nt, Salmonella enterica enterica serovar Typhi Ty2
gccgaaguucauaaauguac

SEQ ID NO: 3722263 - RNA, 22 nt, Salmonella enterica enterica serovar Typhi Ty2
gccgaauagcugauaaacagcu

SEQ ID NO: 3722264 - RNA, 19 nt, Salmonella enterica enterica serovar Typhi Ty2
gccgaauauugcgccacgc

SEQ ID NO: 3722265 - RNA, 21 nt, Salmonella enterica enterica serovar Typhi Ty2
gccgaauucguuacccgauac

SEQ ID NO: 3722266 - RNA, 14 nt, Salmonella enterica enterica serovar Typhi Ty2
gccgacaaccagcg

SEQ ID NO: 3722267 - RNA, 17 nt, Salmonella enterica enterica serovar Typhi Ty2
gccgacacaguaaaaaa

SEQ ID NO: 3722268 - RNA, 19 nt, Salmonella enterica enterica serovar Typhi Ty2
gccgacauagcugaacaau

SEQ ID NO: 3722269 - RNA, 21 nt, Salmonella enterica enterica serovar Typhi Ty2
gccgacaucacgcaaaugcag

SEQ ID NO: 3722270 - RNA, 19 nt, Salmonella enterica enterica serovar Typhi Ty2
gccgacaugcuccugcauc

SEQ ID NO: 3722271 - RNA, 22 nt, Salmonella enterica enterica serovar Typhi Ty2
gccgacaugguuaaccaccagc

SEQ ID NO: 3722272 - RNA, 16 nt, Salmonella enterica enterica serovar Typhi Ty2
gccgaccaaugacgcu

SEQ ID NO: 3722273 - RNA, 17 nt, Salmonella enterica enterica serovar Typhi Ty2
gccgaccaccauccggc

SEQ ID NO: 3722274 - RNA, 17 nt, Salmonella enterica enterica serovar Typhi Ty2
gccgaccaccgcccugu

SEQ ID NO: 3722275 - RNA, 22 nt, Salmonella enterica enterica serovar Typhi Ty2
gccgaccacuucaacgccgcgc

SEQ ID NO: 3722276 - RNA, 19 nt, Salmonella enterica enterica serovar Typhi Ty2
gccgacccccuccuuguaa

SEQ ID NO: 3722277 - RNA, 16 nt, Salmonella enterica enterica serovar Typhi Ty2
gccgaccgccagcaga

SEQ ID NO: 3722278 - RNA, 17 nt, Salmonella enterica enterica serovar Typhi Ty2
gccgaccgccagcagag

SEQ ID NO: 3722279 - RNA, 14 nt, Salmonella enterica enterica serovar Typhi Ty2
gccgaccuggcggu

SEQ ID NO: 3722280 - RNA, 16 nt, Salmonella enterica enterica serovar Typhi Ty2
gccgacgauuugcgcu

SEQ ID NO: 3722281 - RNA, 16 nt, Salmonella enterica enterica serovar Typhi Ty2
gccgacgccacccagc

SEQ ID NO: 3722282 - RNA, 21 nt, Salmonella enterica enterica serovar Typhi Ty2
gccgacgccacccagcgaacu

SEQ ID NO: 3722283 - RNA, 18 nt, Salmonella enterica enterica serovar Typhi Ty2
gccgacucacgcagcgcu

SEQ ID NO: 3722284 - RNA, 15 nt, Salmonella enterica enterica serovar Typhi Ty2
gccgacucgcgcaau

SEQ ID NO: 3722285 - RNA, 22 nt, Salmonella enterica enterica serovar Typhi Ty2
gccgacuuuacggccuagcugc

SEQ ID NO: 3722286 - RNA, 22 nt, Salmonella enterica enterica serovar Typhi Ty2
gccgagacgcugcacacgcugg

SEQ ID NO: 3722287 - RNA, 18 nt, Salmonella enterica enterica serovar Typhi Ty2
gccgagaguccagcgcca

SEQ ID NO: 3722288 - RNA, 20 nt, Salmonella enterica enterica serovar Typhi Ty2
gccgagaguccagcgccagc

SEQ ID NO: 3722289 - RNA, 18 nt, Salmonella enterica enterica serovar Typhi Ty2
gccgagcauuuccgcagc

SEQ ID NO: 3722290 - RNA, 19 nt, Salmonella enterica enterica serovar Typhi Ty2
gccgagcauuuccgcagcc

SEQ ID NO: 3722291 - RNA, 20 nt, Salmonella enterica enterica serovar Typhi Ty2
gccgagcauuuccgcagcca

SEQ ID NO: 3722292 - RNA, 16 nt, Salmonella enterica enterica serovar Typhi Ty2
gccgaggcauucagcc

SEQ ID NO: 3722293 - RNA, 21 nt, Salmonella enterica enterica serovar Typhi Ty2
gccgaguagcugagcgucagg

SEQ ID NO: 3722294 - RNA, 23 nt, Salmonella enterica enterica serovar Typhi Ty2
gccgaguccgaggcgaaacggcg

SEQ ID NO: 3722295 - RNA, 20 nt, Salmonella enterica enterica serovar Typhi Ty2
gccgagucgguuuuauuaac

SEQ ID NO: 3722296 - RNA, 18 nt, Salmonella enterica enterica serovar Typhi Ty2
gccgaguggaaucagcca

SEQ ID NO: 3722297 - RNA, 17 nt, Salmonella enterica enterica serovar Typhi Ty2
gccgauaaccagcgcgc

SEQ ID NO: 3722298 - RNA, 22 nt, Salmonella enterica enterica serovar Typhi Ty2
gccgauaaccagcgcgccgcca

SEQ ID NO: 3722299 - RNA, 14 nt, Salmonella enterica enterica serovar Typhi Ty2
gccgauaccggcaa

SEQ ID NO: 3722300 - RNA, 19 nt, Salmonella enterica enterica serovar Typhi Ty2
gccgauauggccguuuuca

SEQ ID NO: 3722301 - RNA, 16 nt, Salmonella enterica enterica serovar Typhi Ty2
gccgauauugccuuca

SEQ ID NO: 3722302 - RNA, 19 nt, Salmonella enterica enterica serovar Typhi Ty2
gccgauauugcggccuucc

SEQ ID NO: 3722303 - RNA, 20 nt, Salmonella enterica enterica serovar Typhi Ty2
gccgauauugcggccuuccu

SEQ ID NO: 3722304 - RNA, 22 nt, Salmonella enterica enterica serovar Typhi Ty2
gccgauauugcggccuuccuga

SEQ ID NO: 3722305 - RNA, 16 nt, Salmonella enterica enterica serovar Typhi Ty2
gccgaucaccagcgca

SEQ ID NO: 3722306 - RNA, 17 nt, Salmonella enterica enterica serovar Typhi Ty2
gccgccugaugcuggca

SEQ ID NO: 3722307 - RNA, 15 nt, Salmonella enterica enterica serovar Typhi Ty2
gccgccugcgccaac

SEQ ID NO: 3722308 - RNA, 13 nt, Salmonella enterica enterica serovar Typhi Ty2
gccgccuggccug

SEQ ID NO: 3722309 - RNA, 22 nt, Salmonella enterica enterica serovar Typhi Ty2
gccgcgaacguucaaaaucaaa

SEQ ID NO: 3722310 - RNA, 22 nt, Salmonella enterica enterica serovar Typhi Ty2
gccgcgaagcguuccgccacua

SEQ ID NO: 3722311 - RNA, 22 nt, Salmonella enterica enterica serovar Typhi Ty2
gccgcgaauaaaggcgcuguug

SEQ ID NO: 3722312 - RNA, 14 nt, Salmonella enterica enterica serovar Typhi Ty2
gccgcgaccagcag

SEQ ID NO: 3722313 - RNA, 20 nt, Salmonella enterica enterica serovar Typhi Ty2
gccgcgagaacuuccgccac

SEQ ID NO: 3722314 - RNA, 23 nt, Salmonella enterica enterica serovar Typhi Ty2
gccgcgauacauugucgcagcgc

SEQ ID NO: 3722315 - RNA, 20 nt, Salmonella enterica enterica serovar Typhi Ty2
gccgcgauguuugcucgcca

SEQ ID NO: 3722316 - RNA, 20 nt, Salmonella enterica enterica serovar Typhi Ty2
gccgcgcaguuucuuaccua

SEQ ID NO: 3722317 - RNA, 13 nt, Salmonella enterica enterica serovar Typhi Ty2
gccgcgcccagca

SEQ ID NO: 3722318 - RNA, 16 nt, Salmonella enterica enterica serovar Typhi Ty2
gccgcgcccagcgccg

SEQ ID NO: 3722319 - RNA, 17 nt, Salmonella enterica enterica serovar Typhi Ty2
gccgcgcccuaacaggc

SEQ ID NO: 3722320 - RNA, 14 nt, Salmonella enterica enterica serovar Typhi Ty2
gccgcgcccugcgg

SEQ ID NO: 3722321 - RNA, 17 nt, Salmonella enterica enterica serovar Typhi Ty2
gccgcgccgacauagcu

SEQ ID NO: 3722322 - RNA, 19 nt, Salmonella enterica enterica serovar Typhi Ty2
gccgcgcgaucaaucacgc

SEQ ID NO: 3722323 - RNA, 15 nt, Salmonella enterica enterica serovar Typhi Ty2
gccgcgcgccgccuc

SEQ ID NO: 3722324 - RNA, 22 nt, Salmonella enterica enterica serovar Typhi Ty2
gccgcgcuaucaaaaugcaccg

SEQ ID NO: 3722325 - RNA, 12 nt, Salmonella enterica enterica serovar Typhi Ty2
gccgcgcugauc

SEQ ID NO: 3722326 - RNA, 18 nt, Salmonella enterica enterica serovar Typhi Ty2
gccgcgcuuucaguaaua

SEQ ID NO: 3722327 - RNA, 15 nt, Salmonella enterica enterica serovar Typhi Ty2
gccgcggcgcuggcc

SEQ ID NO: 3722328 - RNA, 23 nt, Salmonella enterica enterica serovar Typhi Ty2
gccgcguaaucuucgcggcugcc

SEQ ID NO: 3722329 - RNA, 18 nt, Salmonella enterica enterica serovar Typhi Ty2
gccgcgucccgaccagga

SEQ ID NO: 3722330 - RNA, 13 nt, Salmonella enterica enterica serovar Typhi Ty2
gccgcgugcucgc

SEQ ID NO: 3722331 - RNA, 17 nt, Salmonella enterica enterica serovar Typhi Ty2
gccgcgugcucgcggcg

SEQ ID NO: 3722332 - RNA, 16 nt, Salmonella enterica enterica serovar Typhi Ty2
gccgcguuucucgccg

SEQ ID NO: 3722333 - RNA, 15 nt, Salmonella enterica enterica serovar Typhi Ty2
gccgcguuuuagcaa

SEQ ID NO: 3722334 - RNA, 19 nt, Salmonella enterica enterica serovar Typhi Ty2
gccgcuaaaacacccgcaa

SEQ ID NO: 3722335 - RNA, 21 nt, Salmonella enterica enterica serovar Typhi Ty2
gccgcuacguaauucaugcaa

SEQ ID NO: 3722336 - RNA, 16 nt, Salmonella enterica enterica serovar Typhi Ty2
gccgcuagcggcggcc

SEQ ID NO: 3722337 - RNA, 18 nt, Salmonella enterica enterica serovar Typhi Ty2
gccgcuagcugcagcgcu

SEQ ID NO: 3722338 - RNA, 21 nt, Salmonella enterica enterica serovar Typhi Ty2
gccgcuaucgaccagcaccug

SEQ ID NO: 3722339 - RNA, 15 nt, Salmonella enterica enterica serovar Typhi Ty2
gccgcuaucugcucc

SEQ ID NO: 3722340 - RNA, 20 nt, Salmonella enterica enterica serovar Typhi Ty2
gccgcuaucugcuccgccag

SEQ ID NO: 3722341 - RNA, 14 nt, Salmonella enterica enterica serovar Typhi Ty2
gccgcucacaaccg

SEQ ID NO: 3722342 - RNA, 13 nt, Salmonella enterica enterica serovar Typhi Ty2
gccgcucacguuc

SEQ ID NO: 3722343 - RNA, 19 nt, Salmonella enterica enterica serovar Typhi Ty2
gccgcucaggguaaucacc

SEQ ID NO: 3722344 - RNA, 19 nt, Salmonella enterica enterica serovar Typhi Ty2
gccgcucaucaccagcagc

SEQ ID NO: 3722345 - RNA, 14 nt, Salmonella enterica enterica serovar Typhi Ty2
gccgcucccgcaug

SEQ ID NO: 3722346 - RNA, 23 nt, Salmonella enterica enterica serovar Typhi Ty2
gccgcuccggguuuucaauaauc

SEQ ID NO: 3722347 - RNA, 23 nt, Salmonella enterica enterica serovar Typhi Ty2
gccgcucucuucgugacccgcca

SEQ ID NO: 3722348 - RNA, 20 nt, Salmonella enterica enterica serovar Typhi Ty2
gccgcugauguuuugcgccg

SEQ ID NO: 3722349 - RNA, 22 nt, Salmonella enterica enterica serovar Typhi Ty2
gccgcuggauaauugcucugcc

SEQ ID NO: 3722350 - RNA, 17 nt, Salmonella enterica enterica serovar Typhi Ty2
gccgcuggcgaccagcc

SEQ ID NO: 3722351 - RNA, 15 nt, Salmonella enterica enterica serovar Typhi Ty2
gccgcuggcgaugga

SEQ ID NO: 3722352 - RNA, 14 nt, Salmonella enterica enterica serovar Typhi Ty2
gccgcuggcgucuu

SEQ ID NO: 3722353 - RNA, 18 nt, Salmonella enterica enterica serovar Typhi Ty2
gccgcugggauucggcaa

SEQ ID NO: 3722354 - RNA, 21 nt, Salmonella enterica enterica serovar Typhi Ty2
gccgcuggugcuacgggcgcu

SEQ ID NO: 3722355 - RNA, 16 nt, Salmonella enterica enterica serovar Typhi Ty2
gccgcugucgccagaa

SEQ ID NO: 3722356 - RNA, 19 nt, Salmonella enterica enterica serovar Typhi Ty2
gccgcuuacugugccgccg

SEQ ID NO: 3722357 - RNA, 15 nt, Salmonella enterica enterica serovar Typhi Ty2
gccgcuuauccggcc

SEQ ID NO: 3722358 - RNA, 17 nt, Salmonella enterica enterica serovar Typhi Ty2
gccgcuuccggcaggua

SEQ ID NO: 3722359 - RNA, 15 nt, Salmonella enterica enterica serovar Typhi Ty2
gccgcuucgccacuc

SEQ ID NO: 3722360 - RNA, 21 nt, Salmonella enterica enterica serovar Typhi Ty2
gccgcuuuaaucaccauggcg

SEQ ID NO: 3722361 - RNA, 15 nt, Salmonella enterica enterica serovar Typhi Ty2
gccgcuuuaccgccu

SEQ ID NO: 3722362 - RNA, 16 nt, Salmonella enterica enterica serovar Typhi Ty2
gccgcuuuccgccgca

SEQ ID NO: 3722363 - RNA, 20 nt, Salmonella enterica enterica serovar Typhi Ty2
gccgcuuugcgaacagcgca

SEQ ID NO: 3722364 - RNA, 16 nt, Salmonella enterica enterica serovar Typhi Ty2
gccgcuuuugccgcga

SEQ ID NO: 3722365 - RNA, 20 nt, Salmonella enterica enterica serovar Typhi Ty2
gccggaaaaaaugggcugga

SEQ ID NO: 3722366 - RNA, 19 nt, Salmonella enterica enterica serovar Typhi Ty2
gccggaaaagcgcuggcug

SEQ ID NO: 3722367 - RNA, 17 nt, Salmonella enterica enterica serovar Typhi Ty2
gccggaaagaauaaucg

SEQ ID NO: 3722368 - RNA, 21 nt, Salmonella enterica enterica serovar Typhi Ty2
gccggaaagacggcagcgcca

SEQ ID NO: 3722369 - RNA, 23 nt, Salmonella enterica enterica serovar Typhi Ty2
gccggaaaggauauaagcgccau

SEQ ID NO: 3722370 - RNA, 21 nt, Salmonella enterica enterica serovar Typhi Ty2
gccggaaagggugcccgccug

SEQ ID NO: 3722371 - RNA, 16 nt, Salmonella enterica enterica serovar Typhi Ty2
gccggaaaucacccaa

SEQ ID NO: 3722372 - RNA, 19 nt, Salmonella enterica enterica serovar Typhi Ty2
gccggaaauuugcagcgcu

SEQ ID NO: 3722373 - RNA, 23 nt, Salmonella enterica enterica serovar Typhi Ty2
gccggaagacguuuacaccgcca

SEQ ID NO: 3722374 - RNA, 22 nt, Salmonella enterica enterica serovar Typhi Ty2
gccggaaucgcgauccagcccc

SEQ ID NO: 3722375 - RNA, 23 nt, Salmonella enterica enterica serovar Typhi Ty2
gccggaaucgcgauccagcccca

SEQ ID NO: 3722376 - RNA, 14 nt, Salmonella enterica enterica serovar Typhi Ty2
gccggacaggcgac

SEQ ID NO: 3722377 - RNA, 17 nt, Salmonella enterica enterica serovar Typhi Ty2
gccggacaggcgacgcc

SEQ ID NO: 3722378 - RNA, 16 nt, Salmonella enterica enterica serovar Typhi Ty2
gccggacgccacgcuc

SEQ ID NO: 3722379 - RNA, 21 nt, Salmonella enterica enterica serovar Typhi Ty2
gccggacguaccuugccgaau

SEQ ID NO: 3722380 - RNA, 13 nt, Salmonella enterica enterica serovar Typhi Ty2
gccggacuccagc

SEQ ID NO: 3722381 - RNA, 22 nt, Salmonella enterica enterica serovar Typhi Ty2
gccggagagcggauaauccgcc

SEQ ID NO: 3722382 - RNA, 12 nt, Salmonella enterica enterica serovar Typhi Ty2
gccggagagggg

SEQ ID NO: 3722383 - RNA, 19 nt, Salmonella enterica enterica serovar Typhi Ty2
gccggagaguucauaacgc

SEQ ID NO: 3722384 - RNA, 17 nt, Salmonella enterica enterica serovar Typhi Ty2
gccggagaucugucgcc

SEQ ID NO: 3722385 - RNA, 16 nt, Salmonella enterica enterica serovar Typhi Ty2
gccggagcugauacgg

SEQ ID NO: 3722386 - RNA, 17 nt, Salmonella enterica enterica serovar Typhi Ty2
gccggaggauauuuauu

SEQ ID NO: 3722387 - RNA, 18 nt, Salmonella enterica enterica serovar Typhi Ty2
gccggagggcgaacuggc

SEQ ID NO: 3722388 - RNA, 13 nt, Salmonella enterica enterica serovar Typhi Ty2
gccguaggagaua

SEQ ID NO: 3722389 - RNA, 16 nt, Salmonella enterica enterica serovar Typhi Ty2
gccguauaauccagcu

SEQ ID NO: 3722390 - RNA, 16 nt, Salmonella enterica enterica serovar Typhi Ty2
gccguauucuuaccca

SEQ ID NO: 3722391 - RNA, 22 nt, Salmonella enterica enterica serovar Typhi Ty2
gccguauuucacuuuugccggu

SEQ ID NO: 3722392 - RNA, 22 nt, Salmonella enterica enterica serovar Typhi Ty2
gccgucaacacgcagacccagg

SEQ ID NO: 3722393 - RNA, 15 nt, Salmonella enterica enterica serovar Typhi Ty2
gccgucacagagagc

SEQ ID NO: 3722394 - RNA, 17 nt, Salmonella enterica enterica serovar Typhi Ty2
gccgucacagagagcgu

SEQ ID NO: 3722395 - RNA, 15 nt, Salmonella enterica enterica serovar Typhi Ty2
gccgucacaggcggc

SEQ ID NO: 3722396 - RNA, 21 nt, Salmonella enterica enterica serovar Typhi Ty2
gccgucagacaggccugguua

SEQ ID NO: 3722397 - RNA, 21 nt, Salmonella enterica enterica serovar Typhi Ty2
gccgucaggcuacccgcaaua

SEQ ID NO: 3722398 - RNA, 18 nt, Salmonella enterica enterica serovar Typhi Ty2
gccgucaggcuugccgcg

SEQ ID NO: 3722399 - RNA, 14 nt, Salmonella enterica enterica serovar Typhi Ty2
gccgucauccgcgu

SEQ ID NO: 3722400 - RNA, 15 nt, Salmonella enterica enterica serovar Typhi Ty2
gccgucauccgcgua

SEQ ID NO: 3722401 - RNA, 20 nt, Salmonella enterica enterica serovar Typhi Ty2
gccgucauccgcguaaucgc

SEQ ID NO: 3722402 - RNA, 22 nt, Salmonella enterica enterica serovar Typhi Ty2
gccgucauggcaaacgaaccca

SEQ ID NO: 3722403 - RNA, 12 nt, Salmonella enterica enterica serovar Typhi Ty2
gccgucccagcg

SEQ ID NO: 3722404 - RNA, 15 nt, Salmonella enterica enterica serovar Typhi Ty2
gccgucgacaaagcc

SEQ ID NO: 3722405 - RNA, 16 nt, Salmonella enterica enterica serovar Typhi Ty2
gccgucgaugauggcg

SEQ ID NO: 3722406 - RNA, 20 nt, Salmonella enterica enterica serovar Typhi Ty2
gccgucgaugauggcggcua

SEQ ID NO: 3722407 - RNA, 18 nt, Salmonella enterica enterica serovar Typhi Ty2
gccgucgccgaauaccac

SEQ ID NO: 3722408 - RNA, 13 nt, Salmonella enterica enterica serovar Typhi Ty2
gccgucgcuauca

SEQ ID NO: 3722409 - RNA, 15 nt, Salmonella enterica enterica serovar Typhi Ty2
gccgucguacucacc

SEQ ID NO: 3722410 - RNA, 19 nt, Salmonella enterica enterica serovar Typhi Ty2
gccgucgucaccgccgcgc

SEQ ID NO: 3722411 - RNA, 17 nt, Salmonella enterica enterica serovar Typhi Ty2
gccgucguucagccagc

SEQ ID NO: 3722412 - RNA, 18 nt, Salmonella enterica enterica serovar Typhi Ty2
gccgucucuuucauggaa

SEQ ID NO: 3722413 - RNA, 16 nt, Salmonella enterica enterica serovar Typhi Ty2
gccgugaaauauccuc

SEQ ID NO: 3722414 - RNA, 17 nt, Salmonella enterica enterica serovar Typhi Ty2
gccgugaauuucugcug

SEQ ID NO: 3722415 - RNA, 22 nt, Salmonella enterica enterica serovar Typhi Ty2
gccgugacuguucacauccagc

SEQ ID NO: 3722416 - RNA, 18 nt, Salmonella enterica enterica serovar Typhi Ty2
gccgugauagcaggcacu

SEQ ID NO: 3722417 - RNA, 13 nt, Salmonella enterica enterica serovar Typhi Ty2
gccgugaucccaa

SEQ ID NO: 3722418 - RNA, 12 nt, Salmonella enterica enterica serovar Typhi Ty2
gccgugauucau

SEQ ID NO: 3722419 - RNA, 18 nt, Salmonella enterica enterica serovar Typhi Ty2
gccgugcacuucugcggu

SEQ ID NO: 3722420 - RNA, 21 nt, Salmonella enterica enterica serovar Typhi Ty2
gccgugcccagcaucccgcug

SEQ ID NO: 3722421 - RNA, 15 nt, Salmonella enterica enterica serovar Typhi Ty2
gccgugccuggcgcu

SEQ ID NO: 3722422 - RNA, 18 nt, Salmonella enterica enterica serovar Typhi Ty2
gccgugccuggcgcuggg

SEQ ID NO: 3722423 - RNA, 21 nt, Salmonella enterica enterica serovar Typhi Ty2
gccgugcguuuugugcggccu

SEQ ID NO: 3722424 - RNA, 15 nt, Salmonella enterica enterica serovar Typhi Ty2
gccguggaacgugcc

SEQ ID NO: 3722425 - RNA, 22 nt, Salmonella enterica enterica serovar Typhi Ty2
gccguggaccguauagcccaga

SEQ ID NO: 3722426 - RNA, 21 nt, Salmonella enterica enterica serovar Typhi Ty2
gccguggcggugacuuccuga

SEQ ID NO: 3722427 - RNA, 16 nt, Salmonella enterica enterica serovar Typhi Ty2
gccguguucuuaccca

SEQ ID NO: 3722428 - RNA, 18 nt, Salmonella enterica enterica serovar Typhi Ty2
gccguguucuuacccacu

SEQ ID NO: 3722429 - RNA, 19 nt, Salmonella enterica enterica serovar Typhi Ty2
gccguuaaucgauaagcca

SEQ ID NO: 3722430 - RNA, 19 nt, Salmonella enterica enterica serovar Typhi Ty2
gccguuaaucuggccuacg

SEQ ID NO: 3722431 - RNA, 20 nt, Salmonella enterica enterica serovar Typhi Ty2
gccguuaaucuggccuacgg

SEQ ID NO: 3722432 - RNA, 13 nt, Salmonella enterica enterica serovar Typhi Ty2
gccguuacuguuu

SEQ ID NO: 3722433 - RNA, 16 nt, Salmonella enterica enterica serovar Typhi Ty2
gccguuaucggccugc

SEQ ID NO: 3722434 - RNA, 18 nt, Salmonella enterica enterica serovar Typhi Ty2
gccguuauugucaugcua

SEQ ID NO: 3722435 - RNA, 13 nt, Salmonella enterica enterica serovar Typhi Ty2
gccguucaaacgg

SEQ ID NO: 3722436 - RNA, 20 nt, Salmonella enterica enterica serovar Typhi Ty2
gccguucauucgccccagca

SEQ ID NO: 3722437 - RNA, 22 nt, Salmonella enterica enterica serovar Typhi Ty2
gccguucauucgccccagcaua

SEQ ID NO: 3722438 - RNA, 14 nt, Salmonella enterica enterica serovar Typhi Ty2
gccguuccauucca

SEQ ID NO: 3722439 - RNA, 16 nt, Salmonella enterica enterica serovar Typhi Ty2
gccguuccguucgcgu

SEQ ID NO: 3722440 - RNA, 18 nt, Salmonella enterica enterica serovar Typhi Ty2
gccguuccguucgcguca

SEQ ID NO: 3722441 - RNA, 15 nt, Salmonella enterica enterica serovar Typhi Ty2
gccguugucauggcg

SEQ ID NO: 3722442 - RNA, 23 nt, Salmonella enterica enterica serovar Typhi Ty2
gccguuguucucaagcguucuca

SEQ ID NO: 3722443 - RNA, 13 nt, Salmonella enterica enterica serovar Typhi Ty2
gccguuucaaccc

SEQ ID NO: 3722444 - RNA, 18 nt, Salmonella enterica enterica serovar Typhi Ty2
gccguuuuagguucuuca

SEQ ID NO: 3722445 - RNA, 19 nt, Salmonella enterica enterica serovar Typhi Ty2
gccguuuuagguucuucaa

SEQ ID NO: 3722446 - RNA, 18 nt, Salmonella enterica enterica serovar Typhi Ty2
gccguuuuggcagcgccc

SEQ ID NO: 3722447 - RNA, 18 nt, Salmonella enterica enterica serovar Typhi Ty2
gccguuuuuaacgccggc

SEQ ID NO: 3722448 - RNA, 20 nt, Salmonella enterica enterica serovar Typhi Ty2
gccguuuuuaacgccggcaa

SEQ ID NO: 3722449 - RNA, 13 nt, Salmonella enterica enterica serovar Typhi Ty2
gccuaaaaaugag

SEQ ID NO: 3722450 - RNA, 14 nt, Salmonella enterica enterica serovar Typhi Ty2
gccuaaagaaaaac

SEQ ID NO: 3722451 - RNA, 13 nt, Salmonella enterica enterica serovar Typhi Ty2
gccuaaauguucc

SEQ ID NO: 3722452 - RNA, 14 nt, Salmonella enterica enterica serovar Typhi Ty2
gccuaaauuuaacu

SEQ ID NO: 3722453 - RNA, 14 nt, Salmonella enterica enterica serovar Typhi Ty2
gccuaacagcgccg

SEQ ID NO: 3722454 - RNA, 15 nt, Salmonella enterica enterica serovar Typhi Ty2
gccuaacagcgccgc

SEQ ID NO: 3722455 - RNA, 15 nt, Salmonella enterica enterica serovar Typhi Ty2
gccuaacgccagcau

SEQ ID NO: 3722456 - RNA, 16 nt, Salmonella enterica enterica serovar Typhi Ty2
gccuaagaccagcacc

SEQ ID NO: 3722457 - RNA, 18 nt, Salmonella enterica enterica serovar Typhi Ty2
gccuaagcccaccaucag

SEQ ID NO: 3722458 - RNA, 18 nt, Salmonella enterica enterica serovar Typhi Ty2
gccuacaaaaucgcccag

SEQ ID NO: 3722459 - RNA, 22 nt, Salmonella enterica enterica serovar Typhi Ty2
gccuacaaaaucgcccaggccu

SEQ ID NO: 3722460 - RNA, 12 nt, Salmonella enterica enterica serovar Typhi Ty2
gccuacaaagcc

SEQ ID NO: 3722461 - RNA, 18 nt, Salmonella enterica enterica serovar Typhi Ty2
gccuacaaggcauucagg

SEQ ID NO: 3722462 - RNA, 20 nt, Salmonella enterica enterica serovar Typhi Ty2
gccuacacucugcgcgcgau

SEQ ID NO: 3722463 - RNA, 16 nt, Salmonella enterica enterica serovar Typhi Ty2
gccuacagaacugcac

SEQ ID NO: 3722464 - RNA, 22 nt, Salmonella enterica enterica serovar Typhi Ty2
gccuacagaacugcacgaaaug

SEQ ID NO: 3722465 - RNA, 13 nt, Salmonella enterica enterica serovar Typhi Ty2
gccuacauccggc

SEQ ID NO: 3722466 - RNA, 14 nt, Salmonella enterica enterica serovar Typhi Ty2
gccuacauccggcu

SEQ ID NO: 3722467 - RNA, 14 nt, Salmonella enterica enterica serovar Typhi Ty2
gccuaccagcacau

SEQ ID NO: 3722468 - RNA, 19 nt, Salmonella enterica enterica serovar Typhi Ty2
gccuaccagcgcuauccag

SEQ ID NO: 3722469 - RNA, 14 nt, Salmonella enterica enterica serovar Typhi Ty2
gccuaccaucgcgc

SEQ ID NO: 3722470 - RNA, 20 nt, Salmonella enterica enterica serovar Typhi Ty2
gccugaugcgccgccuuggc

SEQ ID NO: 3722471 - RNA, 24 nt, Salmonella enterica enterica serovar Typhi Ty2
gccugaugcgcguuuagcgccagc

SEQ ID NO: 3722472 - RNA, 16 nt, Salmonella enterica enterica serovar Typhi Ty2
gccugaugcugcgcau

SEQ ID NO: 3722473 - RNA, 11 nt, Salmonella enterica enterica serovar Typhi Ty2
gccugauggcg

SEQ ID NO: 3722474 - RNA, 21 nt, Salmonella enterica enterica serovar Typhi Ty2
gccugauggcgcuacgccauc

SEQ ID NO: 3722475 - RNA, 14 nt, Salmonella enterica enterica serovar Typhi Ty2
gccugauucauucc

SEQ ID NO: 3722476 - RNA, 14 nt, Salmonella enterica enterica serovar Typhi Ty2
gccugcacauugca

SEQ ID NO: 3722477 - RNA, 16 nt, Salmonella enterica enterica serovar Typhi Ty2
gccugcauacguuuca

SEQ ID NO: 3722478 - RNA, 21 nt, Salmonella enterica enterica serovar Typhi Ty2
gccugcauacguuucaccagc

SEQ ID NO: 3722479 - RNA, 20 nt, Salmonella enterica enterica serovar Typhi Ty2
gccugcaucaccucagaauu

SEQ ID NO: 3722480 - RNA, 17 nt, Salmonella enterica enterica serovar Typhi Ty2
gccugcauuugcuggcg

SEQ ID NO: 3722481 - RNA, 14 nt, Salmonella enterica enterica serovar Typhi Ty2
gccugccaaccggc

SEQ ID NO: 3722482 - RNA, 21 nt, Salmonella enterica enterica serovar Typhi Ty2
gccugccagauccaacacauc

SEQ ID NO: 3722483 - RNA, 20 nt, Salmonella enterica enterica serovar Typhi Ty2
gccugccagcaacccaccug

SEQ ID NO: 3722484 - RNA, 13 nt, Salmonella enterica enterica serovar Typhi Ty2
gccugccagcgcu

SEQ ID NO: 3722485 - RNA, 13 nt, Salmonella enterica enterica serovar Typhi Ty2
gccugccauagca

SEQ ID NO: 3722486 - RNA, 18 nt, Salmonella enterica enterica serovar Typhi Ty2
gccugccauagcaucacc

SEQ ID NO: 3722487 - RNA, 12 nt, Salmonella enterica enterica serovar Typhi Ty2
gccugcccaucu

SEQ ID NO: 3722488 - RNA, 14 nt, Salmonella enterica enterica serovar Typhi Ty2
gccugccgcgcccg

SEQ ID NO: 3722489 - RNA, 19 nt, Salmonella enterica enterica serovar Typhi Ty2
gccugccgggccugcggcg

SEQ ID NO: 3722490 - RNA, 23 nt, Salmonella enterica enterica serovar Typhi Ty2
gccugccguaaacaggcaggccc

SEQ ID NO: 3722491 - RNA, 15 nt, Salmonella enterica enterica serovar Typhi Ty2
gccugccguccugau

SEQ ID NO: 3722492 - RNA, 21 nt, Salmonella enterica enterica serovar Typhi Ty2
gccugccgucgcggcuuucag

SEQ ID NO: 3722493 - RNA, 15 nt, Salmonella enterica enterica serovar Typhi Ty2
gccugccguuuuuaa

SEQ ID NO: 3722494 - RNA, 15 nt, Salmonella enterica enterica serovar Typhi Ty2
gccugccugaagcgc

SEQ ID NO: 3722495 - RNA, 15 nt, Salmonella enterica enterica serovar Typhi Ty2
gccugcgccagcgcc

SEQ ID NO: 3722496 - RNA, 21 nt, Salmonella enterica enterica serovar Typhi Ty2
gccugcgcggcaauuuccgcu

SEQ ID NO: 3722497 - RNA, 21 nt, Salmonella enterica enterica serovar Typhi Ty2
gccugcgcuggaaucauccac

SEQ ID NO: 3722498 - RNA, 21 nt, Salmonella enterica enterica serovar Typhi Ty2
gccugcgcuuacggccaugga

SEQ ID NO: 3722499 - RNA, 22 nt, Salmonella enterica enterica serovar Typhi Ty2
gccugcgguauauucccccugc

SEQ ID NO: 3722500 - RNA, 15 nt, Salmonella enterica enterica serovar Typhi Ty2
gccugcgucgcccca

SEQ ID NO: 3722501 - RNA, 17 nt, Salmonella enterica enterica serovar Typhi Ty2
gccugcguugcuauggc

SEQ ID NO: 3722502 - RNA, 18 nt, Salmonella enterica enterica serovar Typhi Ty2
gccugcguugcuauggca

SEQ ID NO: 3722503 - RNA, 19 nt, Salmonella enterica enterica serovar Typhi Ty2
gccugcucaauacuuuccg

SEQ ID NO: 3722504 - RNA, 15 nt, Salmonella enterica enterica serovar Typhi Ty2
gccugcucaucaggu

SEQ ID NO: 3722505 - RNA, 17 nt, Salmonella enterica enterica serovar Typhi Ty2
gccugcuggaaaggccg

SEQ ID NO: 3722506 - RNA, 18 nt, Salmonella enterica enterica serovar Typhi Ty2
gccugcuggaaaggccgc

SEQ ID NO: 3722507 - RNA, 15 nt, Salmonella enterica enterica serovar Typhi Ty2
gccugcuguaaaaua

SEQ ID NO: 3722508 - RNA, 22 nt, Salmonella enterica enterica serovar Typhi Ty2
gccugcuguacuuuugcuucca

SEQ ID NO: 3722509 - RNA, 21 nt, Salmonella enterica enterica serovar Typhi Ty2
gccuggaaagggaaugcgccg

SEQ ID NO: 3722510 - RNA, 20 nt, Salmonella enterica enterica serovar Typhi Ty2
gccuggagagcagcgccagc

SEQ ID NO: 3722511 - RNA, 18 nt, Salmonella enterica enterica serovar Typhi Ty2
gccuggagaucagcaugg

SEQ ID NO: 3722512 - RNA, 15 nt, Salmonella enterica enterica serovar Typhi Ty2
gccuggcauggugca

SEQ ID NO: 3722513 - RNA, 19 nt, Salmonella enterica enterica serovar Typhi Ty2
gccuggcauggugcagccg

SEQ ID NO: 3722514 - RNA, 22 nt, Salmonella enterica enterica serovar Typhi Ty2
gccuggcauggugcagccgcca

SEQ ID NO: 3722515 - RNA, 13 nt, Salmonella enterica enterica serovar Typhi Ty2
gccuggcccguuc

SEQ ID NO: 3722516 - RNA, 22 nt, Salmonella enterica enterica serovar Typhi Ty2
gccuggcgauguucuugccgcc

SEQ ID NO: 3722517 - RNA, 14 nt, Salmonella enterica enterica serovar Typhi Ty2
gccuggcgcagcgc

SEQ ID NO: 3722518 - RNA, 21 nt, Salmonella enterica enterica serovar Typhi Ty2
gccuggcgguaugaaagccau

SEQ ID NO: 3722519 - RNA, 16 nt, Salmonella enterica enterica serovar Typhi Ty2
gccuggcugagaaaaa

SEQ ID NO: 3722520 - RNA, 18 nt, Salmonella enterica enterica serovar Typhi Ty2
gccuggcuuguuacugca

SEQ ID NO: 3722521 - RNA, 20 nt, Salmonella enterica enterica serovar Typhi Ty2
gccugguaagcguagcgcca

SEQ ID NO: 3722522 - RNA, 22 nt, Salmonella enterica enterica serovar Typhi Ty2
gccuggugcccaaccugcgcag

SEQ ID NO: 3722523 - RNA, 21 nt, Salmonella enterica enterica serovar Typhi Ty2
gccugguuaacaauauugcgc

SEQ ID NO: 3722524 - RNA, 19 nt, Salmonella enterica enterica serovar Typhi Ty2
gccuguaaaacaacccccg

SEQ ID NO: 3722525 - RNA, 14 nt, Salmonella enterica enterica serovar Typhi Ty2
gccuguaaaccgcc

SEQ ID NO: 3722526 - RNA, 16 nt, Salmonella enterica enterica serovar Typhi Ty2
gccuguaaacguuccu

SEQ ID NO: 3722527 - RNA, 19 nt, Salmonella enterica enterica serovar Typhi Ty2
gccuguaaacguuccugcc

SEQ ID NO: 3722528 - RNA, 17 nt, Salmonella enterica enterica serovar Typhi Ty2
gccuguaaggcucucuu

SEQ ID NO: 3722529 - RNA, 17 nt, Salmonella enterica enterica serovar Typhi Ty2
gccuguaauggcgcucu

SEQ ID NO: 3722530 - RNA, 22 nt, Salmonella enterica enterica serovar Typhi Ty2
gccuguaauggcgcucuuuucc

SEQ ID NO: 3722531 - RNA, 16 nt, Salmonella enterica enterica serovar Typhi Ty2
gccuguacuugcgccg

SEQ ID NO: 3722532 - RNA, 24 nt, Salmonella enterica enterica serovar Typhi Ty2
gccuguaguacaugccauccggcg

SEQ ID NO: 3722533 - RNA, 17 nt, Salmonella enterica enterica serovar Typhi Ty2
gccugucgggccuacag

SEQ ID NO: 3722534 - RNA, 13 nt, Salmonella enterica enterica serovar Typhi Ty2
gccugucggucuu

SEQ ID NO: 3722535 - RNA, 15 nt, Salmonella enterica enterica serovar Typhi Ty2
gccugucuauuguuu

SEQ ID NO: 3722536 - RNA, 18 nt, Salmonella enterica enterica serovar Typhi Ty2
gccugucuccucagcagg

SEQ ID NO: 3722537 - RNA, 21 nt, Salmonella enterica enterica serovar Typhi Ty2
gccugugacguuaacgcagca

SEQ ID NO: 3722538 - RNA, 21 nt, Salmonella enterica enterica serovar Typhi Ty2
gccugugcuuucgccaccagc

SEQ ID NO: 3722539 - RNA, 15 nt, Salmonella enterica enterica serovar Typhi Ty2
gccuguuagggcgcg

SEQ ID NO: 3722540 - RNA, 13 nt, Salmonella enterica enterica serovar Typhi Ty2
gccuguuauucaa

SEQ ID NO: 3722541 - RNA, 16 nt, Salmonella enterica enterica serovar Typhi Ty2
gccuguuauucaauuc

SEQ ID NO: 3722542 - RNA, 18 nt, Salmonella enterica enterica serovar Typhi Ty2
gccuguucuucaguaauu

SEQ ID NO: 3722543 - RNA, 19 nt, Salmonella enterica enterica serovar Typhi Ty2
gccuguucuucaguaauuu

SEQ ID NO: 3722544 - RNA, 16 nt, Salmonella enterica enterica serovar Typhi Ty2
gccuguugacgcgcau

SEQ ID NO: 3722545 - RNA, 14 nt, Salmonella enterica enterica serovar Typhi Ty2
gccuguugauuacg

SEQ ID NO: 3722546 - RNA, 19 nt, Salmonella enterica enterica serovar Typhi Ty2
gccuguugcgggccagcag

SEQ ID NO: 3722547 - RNA, 16 nt, Salmonella enterica enterica serovar Typhi Ty2
gccuguuuaagcuuuu

SEQ ID NO: 3722548 - RNA, 15 nt, Salmonella enterica enterica serovar Typhi Ty2
gccuguuuauauucu

SEQ ID NO: 3722549 - RNA, 19 nt, Salmonella enterica enterica serovar Typhi Ty2
gccuguuugucgguuccag

SEQ ID NO: 3722550 - RNA, 14 nt, Salmonella enterica enterica serovar Typhi Ty2
gccuuacaggcgca

SEQ ID NO: 3722551 - RNA, 23 nt, Salmonella enterica enterica serovar Typhi Ty2
gccuuacaggcgcaucagaaaaa

SEQ ID NO: 3722552 - RNA, 20 nt, Salmonella enterica enterica serovar Typhi Ty2
gcgaacggcuuuccagcagc

SEQ ID NO: 3722553 - RNA, 21 nt, Salmonella enterica enterica serovar Typhi Ty2
gcgaacggcuuuccagcagcc

SEQ ID NO: 3722554 - RNA, 14 nt, Salmonella enterica enterica serovar Typhi Ty2
gcgaacuacaggcg

SEQ ID NO: 3722555 - RNA, 23 nt, Salmonella enterica enterica serovar Typhi Ty2
gcgaacugcacucggauguacug

SEQ ID NO: 3722556 - RNA, 20 nt, Salmonella enterica enterica serovar Typhi Ty2
gcgaacuucauccacgccga

SEQ ID NO: 3722557 - RNA, 19 nt, Salmonella enterica enterica serovar Typhi Ty2
gcgaagaucguuauccagc

SEQ ID NO: 3722558 - RNA, 22 nt, Salmonella enterica enterica serovar Typhi Ty2
gcgaagaucguuauccagcagc

SEQ ID NO: 3722559 - RNA, 18 nt, Salmonella enterica enterica serovar Typhi Ty2
gcgaagauuaacccgguc

SEQ ID NO: 3722560 - RNA, 17 nt, Salmonella enterica enterica serovar Typhi Ty2
gcgaagcgccaucaggc

SEQ ID NO: 3722561 - RNA, 19 nt, Salmonella enterica enterica serovar Typhi Ty2
gcgaagcgccgucggcauc

SEQ ID NO: 3722562 - RNA, 19 nt, Salmonella enterica enterica serovar Typhi Ty2
gcgaagcgcgcagcgcuga

SEQ ID NO: 3722563 - RNA, 16 nt, Salmonella enterica enterica serovar Typhi Ty2
gcgaagcgcuccggca

SEQ ID NO: 3722564 - RNA, 15 nt, Salmonella enterica enterica serovar Typhi Ty2
gcgaagcggcgcuau

SEQ ID NO: 3722565 - RNA, 18 nt, Salmonella enterica enterica serovar Typhi Ty2
gcgaagcgucauccggca

SEQ ID NO: 3722566 - RNA, 20 nt, Salmonella enterica enterica serovar Typhi Ty2
gcgaaggggcgggcagcagc

SEQ ID NO: 3722567 - RNA, 23 nt, Salmonella enterica enterica serovar Typhi Ty2
gcgaaguagauuacgaaugugca

SEQ ID NO: 3722568 - RNA, 16 nt, Salmonella enterica enterica serovar Typhi Ty2
gcgaagugcagcguuu

SEQ ID NO: 3722569 - RNA, 19 nt, Salmonella enterica enterica serovar Typhi Ty2
gcgaauaaaauucagcgca

SEQ ID NO: 3722570 - RNA, 18 nt, Salmonella enterica enterica serovar Typhi Ty2
gcgaauaacauaauauuc

SEQ ID NO: 3722571 - RNA, 17 nt, Salmonella enterica enterica serovar Typhi Ty2
gcgaauaacaucauccg

SEQ ID NO: 3722572 - RNA, 20 nt, Salmonella enterica enterica serovar Typhi Ty2
gcgaauaaucaaccauacau

SEQ ID NO: 3722573 - RNA, 20 nt, Salmonella enterica enterica serovar Typhi Ty2
gcgaauaaucccggcgccaa

SEQ ID NO: 3722574 - RNA, 14 nt, Salmonella enterica enterica serovar Typhi Ty2
gcgaauaccuuccc

SEQ ID NO: 3722575 - RNA, 17 nt, Salmonella enterica enterica serovar Typhi Ty2
gcgaauaccuuucggca

SEQ ID NO: 3722576 - RNA, 15 nt, Salmonella enterica enterica serovar Typhi Ty2
gcgaauacgggaucg

SEQ ID NO: 3722577 - RNA, 15 nt, Salmonella enterica enterica serovar Typhi Ty2
gcgaauagcgcgcua

SEQ ID NO: 3722578 - RNA, 20 nt, Salmonella enterica enterica serovar Typhi Ty2
gcgaauagugauaccagucg

SEQ ID NO: 3722579 - RNA, 22 nt, Salmonella enterica enterica serovar Typhi Ty2
gcgaaucacauccgccagcgcc

SEQ ID NO: 3722580 - RNA, 17 nt, Salmonella enterica enterica serovar Typhi Ty2
gcgaauccagaucgccc

SEQ ID NO: 3722581 - RNA, 15 nt, Salmonella enterica enterica serovar Typhi Ty2
gcgaauccgccauag

SEQ ID NO: 3722582 - RNA, 15 nt, Salmonella enterica enterica serovar Typhi Ty2
gcgaauccggcggcu

SEQ ID NO: 3722583 - RNA, 15 nt, Salmonella enterica enterica serovar Typhi Ty2
gcgaaucuaccagau

SEQ ID NO: 3722584 - RNA, 20 nt, Salmonella enterica enterica serovar Typhi Ty2
gcgaaugcaaccggaacuca

SEQ ID NO: 3722585 - RNA, 15 nt, Salmonella enterica enterica serovar Typhi Ty2
gcgaaugcaggccga

SEQ ID NO: 3722586 - RNA, 12 nt, Salmonella enterica enterica serovar Typhi Ty2
gcgaaugcgcgc

SEQ ID NO: 3722587 - RNA, 20 nt, Salmonella enterica enterica serovar Typhi Ty2
gcgaauugccgucgccggaa

SEQ ID NO: 3722588 - RNA, 18 nt, Salmonella enterica enterica serovar Typhi Ty2
gcgaauuucaaucgccag

SEQ ID NO: 3722589 - RNA, 16 nt, Salmonella enterica enterica serovar Typhi Ty2
gcgaauuuccugccag

SEQ ID NO: 3722590 - RNA, 20 nt, Salmonella enterica enterica serovar Typhi Ty2
gcgaauuuuauuaagcaggc

SEQ ID NO: 3722591 - RNA, 22 nt, Salmonella enterica enterica serovar Typhi Ty2
gcgaauuuuauuaagcaggccg

SEQ ID NO: 3722592 - RNA, 19 nt, Salmonella enterica enterica serovar Typhi Ty2
gcgacaacaaguccaagua

SEQ ID NO: 3722593 - RNA, 19 nt, Salmonella enterica enterica serovar Typhi Ty2
gcgacaacgccaucagccg

SEQ ID NO: 3722594 - RNA, 18 nt, Salmonella enterica enterica serovar Typhi Ty2
gcgacaacgcuuccggcg

SEQ ID NO: 3722595 - RNA, 10 nt, Salmonella enterica enterica serovar Typhi Ty2
gcgacaagaa

SEQ ID NO: 3722596 - RNA, 17 nt, Salmonella enterica enterica serovar Typhi Ty2
gcgacaagcaguaugac

SEQ ID NO: 3722597 - RNA, 19 nt, Salmonella enterica enterica serovar Typhi Ty2
gcgacaagcaguaugaccc

SEQ ID NO: 3722598 - RNA, 18 nt, Salmonella enterica enterica serovar Typhi Ty2
gcgacacaacggcacaac

SEQ ID NO: 3722599 - RNA, 15 nt, Salmonella enterica enterica serovar Typhi Ty2
gcgacaccagcgucg

SEQ ID NO: 3722600 - RNA, 20 nt, Salmonella enterica enterica serovar Typhi Ty2
gcgacacgcgcgcugcgccu

SEQ ID NO: 3722601 - RNA, 16 nt, Salmonella enterica enterica serovar Typhi Ty2
gcgacacuccgcgcau

SEQ ID NO: 3722602 - RNA, 15 nt, Salmonella enterica enterica serovar Typhi Ty2
gcgacagcccggcgu

SEQ ID NO: 3722603 - RNA, 18 nt, Salmonella enterica enterica serovar Typhi Ty2
gcgacagcgcuauccggc

SEQ ID NO: 3722604 - RNA, 21 nt, Salmonella enterica enterica serovar Typhi Ty2
gcgacaggcgcuuaucgccgu

SEQ ID NO: 3722605 - RNA, 15 nt, Salmonella enterica enterica serovar Typhi Ty2
gcgacaguaguauca

SEQ ID NO: 3722606 - RNA, 21 nt, Salmonella enterica enterica serovar Typhi Ty2
gcgacagucgcagagcccagc

SEQ ID NO: 3722607 - RNA, 12 nt, Salmonella enterica enterica serovar Typhi Ty2
gcgacaucagcc

SEQ ID NO: 3722608 - RNA, 14 nt, Salmonella enterica enterica serovar Typhi Ty2
gcgacaucccagac

SEQ ID NO: 3722609 - RNA, 20 nt, Salmonella enterica enterica serovar Typhi Ty2
gcgacaucguuuccagcgaa

SEQ ID NO: 3722610 - RNA, 21 nt, Salmonella enterica enterica serovar Typhi Ty2
gcgacauggcgguaaucgcgc

SEQ ID NO: 3722611 - RNA, 14 nt, Salmonella enterica enterica serovar Typhi Ty2
gcgaccacccgcga

SEQ ID NO: 3722612 - RNA, 16 nt, Salmonella enterica enterica serovar Typhi Ty2
gcgaccagcagcauca

SEQ ID NO: 3722613 - RNA, 21 nt, Salmonella enterica enterica serovar Typhi Ty2
gcgaccagcagcgcggcguac

SEQ ID NO: 3722614 - RNA, 18 nt, Salmonella enterica enterica serovar Typhi Ty2
gcgaccagcgucagccag

SEQ ID NO: 3722615 - RNA, 18 nt, Salmonella enterica enterica serovar Typhi Ty2
gcgaccaguuauucggca

SEQ ID NO: 3722616 - RNA, 21 nt, Salmonella enterica enterica serovar Typhi Ty2
gcgaccaguuauucggcauau

SEQ ID NO: 3722617 - RNA, 20 nt, Salmonella enterica enterica serovar Typhi Ty2
gcgaccaguucaccggcggc

SEQ ID NO: 3722618 - RNA, 20 nt, Salmonella enterica enterica serovar Typhi Ty2
gcgacccauaacgggaagcc

SEQ ID NO: 3722619 - RNA, 22 nt, Salmonella enterica enterica serovar Typhi Ty2
gcgaccgccaccauccggcgcu

SEQ ID NO: 3722620 - RNA, 16 nt, Salmonella enterica enterica serovar Typhi Ty2
gcgaccgccgcugguc

SEQ ID NO: 3722621 - RNA, 19 nt, Salmonella enterica enterica serovar Typhi Ty2
gcgaccgcgccacggccaa

SEQ ID NO: 3722622 - RNA, 17 nt, Salmonella enterica enterica serovar Typhi Ty2
gcgaccgcuucgcuggc

SEQ ID NO: 3722623 - RNA, 13 nt, Salmonella enterica enterica serovar Typhi Ty2
gcgaccggcagcc

SEQ ID NO: 3722624 - RNA, 23 nt, Salmonella enterica enterica serovar Typhi Ty2
gcgaccggcucgcuguucgccag

SEQ ID NO: 3722625 - RNA, 15 nt, Salmonella enterica enterica serovar Typhi Ty2
gcgaccucaucaaac

SEQ ID NO: 3722626 - RNA, 17 nt, Salmonella enterica enterica serovar Typhi Ty2
gcgaccuuaccggcgac

SEQ ID NO: 3722627 - RNA, 19 nt, Salmonella enterica enterica serovar Typhi Ty2
gcgaccuucacgccgccaa

SEQ ID NO: 3722628 - RNA, 13 nt, Salmonella enterica enterica serovar Typhi Ty2
gcgaccuucuccc

SEQ ID NO: 3722629 - RNA, 16 nt, Salmonella enterica enterica serovar Typhi Ty2
gcgacgacacggcgca

SEQ ID NO: 3722630 - RNA, 18 nt, Salmonella enterica enterica serovar Typhi Ty2
gcgacgacacggcgcaga

SEQ ID NO: 3722631 - RNA, 19 nt, Salmonella enterica enterica serovar Typhi Ty2
gcgacgacgccagccagcc

SEQ ID NO: 3722632 - RNA, 19 nt, Salmonella enterica enterica serovar Typhi Ty2
gcgacgacgcuguuuaugc

SEQ ID NO: 3722633 - RNA, 20 nt, Salmonella enterica enterica serovar Typhi Ty2
gcgacgauaaaucgguucau

SEQ ID NO: 3722634 - RNA, 21 nt, Salmonella enterica enterica serovar Typhi Ty2
gcgauaauagaaccgaauaac

SEQ ID NO: 3722635 - RNA, 19 nt, Salmonella enterica enterica serovar Typhi Ty2
gcgauaaucaacucuccuu

SEQ ID NO: 3722636 - RNA, 17 nt, Salmonella enterica enterica serovar Typhi Ty2
gcgauaccgugacugac

SEQ ID NO: 3722637 - RNA, 18 nt, Salmonella enterica enterica serovar Typhi Ty2
gcgauaccgugacugacc

SEQ ID NO: 3722638 - RNA, 19 nt, Salmonella enterica enterica serovar Typhi Ty2
gcgauaccgugacugacca

SEQ ID NO: 3722639 - RNA, 20 nt, Salmonella enterica enterica serovar Typhi Ty2
gcgauaccgugacugaccaa

SEQ ID NO: 3722640 - RNA, 15 nt, Salmonella enterica enterica serovar Typhi Ty2
gcgauacucucgcag

SEQ ID NO: 3722641 - RNA, 19 nt, Salmonella enterica enterica serovar Typhi Ty2
gcgauacucucgcagcgaa

SEQ ID NO: 3722642 - RNA, 17 nt, Salmonella enterica enterica serovar Typhi Ty2
gcgauagaccacgccau

SEQ ID NO: 3722643 - RNA, 21 nt, Salmonella enterica enterica serovar Typhi Ty2
gcgauagagaccgcuuuagcc

SEQ ID NO: 3722644 - RNA, 16 nt, Salmonella enterica enterica serovar Typhi Ty2
gcgauagcccggcaug

SEQ ID NO: 3722645 - RNA, 13 nt, Salmonella enterica enterica serovar Typhi Ty2
gcgauagcugcug

SEQ ID NO: 3722646 - RNA, 16 nt, Salmonella enterica enterica serovar Typhi Ty2
gcgauaggccucgacc

SEQ ID NO: 3722647 - RNA, 21 nt, Salmonella enterica enterica serovar Typhi Ty2
gcgauaucaacgucuugccgu

SEQ ID NO: 3722648 - RNA, 14 nt, Salmonella enterica enterica serovar Typhi Ty2
gcgauaucaaucac

SEQ ID NO: 3722649 - RNA, 13 nt, Salmonella enterica enterica serovar Typhi Ty2
gcgauaucugccg

SEQ ID NO: 3722650 - RNA, 23 nt, Salmonella enterica enterica serovar Typhi Ty2
gcgauauuucuccgcccauccag

SEQ ID NO: 3722651 - RNA, 19 nt, Salmonella enterica enterica serovar Typhi Ty2
gcgaucaccacgcgaauac

SEQ ID NO: 3722652 - RNA, 16 nt, Salmonella enterica enterica serovar Typhi Ty2
gcgaucacuaccgcca

SEQ ID NO: 3722653 - RNA, 19 nt, Salmonella enterica enterica serovar Typhi Ty2
gcgaucagacgcugguugu

SEQ ID NO: 3722654 - RNA, 13 nt, Salmonella enterica enterica serovar Typhi Ty2
gcgaucagcgcca

SEQ ID NO: 3722655 - RNA, 15 nt, Salmonella enterica enterica serovar Typhi Ty2
gcgaucagcgccacc

SEQ ID NO: 3722656 - RNA, 17 nt, Salmonella enterica enterica serovar Typhi Ty2
gcgaucagcgccaccac

SEQ ID NO: 3722657 - RNA, 22 nt, Salmonella enterica enterica serovar Typhi Ty2
gcgaucagcucuucgcucugaa

SEQ ID NO: 3722658 - RNA, 15 nt, Salmonella enterica enterica serovar Typhi Ty2
gcgaucaggcgucag

SEQ ID NO: 3722659 - RNA, 21 nt, Salmonella enterica enterica serovar Typhi Ty2
gcgauccacaaucgucgugcc

SEQ ID NO: 3722660 - RNA, 22 nt, Salmonella enterica enterica serovar Typhi Ty2
gcgauccacaaucgucgugccu

SEQ ID NO: 3722661 - RNA, 17 nt, Salmonella enterica enterica serovar Typhi Ty2
gcgauccaggucuuccg

SEQ ID NO: 3722662 - RNA, 21 nt, Salmonella enterica enterica serovar Typhi Ty2
gcgauccaggucuuccgccgg

SEQ ID NO: 3722663 - RNA, 22 nt, Salmonella enterica enterica serovar Typhi Ty2
gcgaucccaguugaucggccag

SEQ ID NO: 3722664 - RNA, 14 nt, Salmonella enterica enterica serovar Typhi Ty2
gcgaucccggccuu

SEQ ID NO: 3722665 - RNA, 11 nt, Salmonella enterica enterica serovar Typhi Ty2
gcgaucgccag

SEQ ID NO: 3722666 - RNA, 21 nt, Salmonella enterica enterica serovar Typhi Ty2
gcgaucgccgucguucagcca

SEQ ID NO: 3722667 - RNA, 22 nt, Salmonella enterica enterica serovar Typhi Ty2
gcgaucgccgucguucagccag

SEQ ID NO: 3722668 - RNA, 14 nt, Salmonella enterica enterica serovar Typhi Ty2
gcgaucgcgccagc

SEQ ID NO: 3722669 - RNA, 20 nt, Salmonella enterica enterica serovar Typhi Ty2
gcgaucgcgccggucgccag

SEQ ID NO: 3722670 - RNA, 15 nt, Salmonella enterica enterica serovar Typhi Ty2
gcgaucuggcggcga

SEQ ID NO: 3722671 - RNA, 17 nt, Salmonella enterica enterica serovar Typhi Ty2
gcgaugaccaucaaaua

SEQ ID NO: 3722672 - RNA, 21 nt, Salmonella enterica enterica serovar Typhi Ty2
gcgaugaccaucaaauaauac

SEQ ID NO: 3722673 - RNA, 20 nt, Salmonella enterica enterica serovar Typhi Ty2
gcgaugacggcgcguuaucg

SEQ ID NO: 3722674 - RNA, 16 nt, Salmonella enterica enterica serovar Typhi Ty2
gcgaugagauccgggc

SEQ ID NO: 3722675 - RNA, 23 nt, Salmonella enterica enterica serovar Typhi Ty2
gcgaugaguaaaauuuuuuucau

SEQ ID NO: 3722676 - RNA, 19 nt, Salmonella enterica enterica serovar Typhi Ty2
gcgaugccuuauccggccu

SEQ ID NO: 3722677 - RNA, 21 nt, Salmonella enterica enterica serovar Typhi Ty2
gcgauggaagcguuacuggcc

SEQ ID NO: 3722678 - RNA, 18 nt, Salmonella enterica enterica serovar Typhi Ty2
gcgauggggcaagcucag

SEQ ID NO: 3722679 - RNA, 11 nt, Salmonella enterica enterica serovar Typhi Ty2
gcgaugguagg

SEQ ID NO: 3722680 - RNA, 16 nt, Salmonella enterica enterica serovar Typhi Ty2
gcgauggugcggcgca

SEQ ID NO: 3722681 - RNA, 19 nt, Salmonella enterica enterica serovar Typhi Ty2
gcgauguauuuauccacgc

SEQ ID NO: 3722682 - RNA, 15 nt, Salmonella enterica enterica serovar Typhi Ty2
gcgauguccgguccg

SEQ ID NO: 3722683 - RNA, 16 nt, Salmonella enterica enterica serovar Typhi Ty2
gcgauguccgguccgg

SEQ ID NO: 3722684 - RNA, 20 nt, Salmonella enterica enterica serovar Typhi Ty2
gcgaugugcccgagugacug

SEQ ID NO: 3722685 - RNA, 15 nt, Salmonella enterica enterica serovar Typhi Ty2
gcgauguucuugccg

SEQ ID NO: 3722686 - RNA, 16 nt, Salmonella enterica enterica serovar Typhi Ty2
gcgauguuggguuucg

SEQ ID NO: 3722687 - RNA, 19 nt, Salmonella enterica enterica serovar Typhi Ty2
gcgauguuuacugcggcgc

SEQ ID NO: 3722688 - RNA, 16 nt, Salmonella enterica enterica serovar Typhi Ty2
gcgauguuuauugaaa

SEQ ID NO: 3722689 - RNA, 21 nt, Salmonella enterica enterica serovar Typhi Ty2
gcgauuaacgcauagauauaa

SEQ ID NO: 3722690 - RNA, 13 nt, Salmonella enterica enterica serovar Typhi Ty2
gcgauuacgccag

SEQ ID NO: 3722691 - RNA, 20 nt, Salmonella enterica enterica serovar Typhi Ty2
gcgauuagcuggcugcgcgg

SEQ ID NO: 3722692 - RNA, 18 nt, Salmonella enterica enterica serovar Typhi Ty2
gcgauugauucaccgaca

SEQ ID NO: 3722693 - RNA, 15 nt, Salmonella enterica enterica serovar Typhi Ty2
gcgauugcgccagac

SEQ ID NO: 3722694 - RNA, 19 nt, Salmonella enterica enterica serovar Typhi Ty2
gcgauuuauagagcagcac

SEQ ID NO: 3722695 - RNA, 21 nt, Salmonella enterica enterica serovar Typhi Ty2
gcgauuuauccaccgccagac

SEQ ID NO: 3722696 - RNA, 16 nt, Salmonella enterica enterica serovar Typhi Ty2
gcgauuuccuguguua

SEQ ID NO: 3722697 - RNA, 18 nt, Salmonella enterica enterica serovar Typhi Ty2
gcgauuuguccgcugcug

SEQ ID NO: 3722698 - RNA, 14 nt, Salmonella enterica enterica serovar Typhi Ty2
gcgauuuucagcac

SEQ ID NO: 3722699 - RNA, 17 nt, Salmonella enterica enterica serovar Typhi Ty2
gcgauuuucagcaccuu

SEQ ID NO: 3722700 - RNA, 13 nt, Salmonella enterica enterica serovar Typhi Ty2
gcgauuuucucgc

SEQ ID NO: 3722701 - RNA, 15 nt, Salmonella enterica enterica serovar Typhi Ty2
gcgauuuuuacgcca

SEQ ID NO: 3722702 - RNA, 13 nt, Salmonella enterica enterica serovar Typhi Ty2
gcgcaaaagcgcg

SEQ ID NO: 3722703 - RNA, 16 nt, Salmonella enterica enterica serovar Typhi Ty2
gcgcaaaagcgcgccc

SEQ ID NO: 3722704 - RNA, 15 nt, Salmonella enterica enterica serovar Typhi Ty2
gcgcaaacaacccgg

SEQ ID NO: 3722705 - RNA, 21 nt, Salmonella enterica enterica serovar Typhi Ty2
gcgcaaacaguacgcccgccu

SEQ ID NO: 3722706 - RNA, 18 nt, Salmonella enterica enterica serovar Typhi Ty2
gcgcaaacgcgugcuggu

SEQ ID NO: 3722707 - RNA, 14 nt, Salmonella enterica enterica serovar Typhi Ty2
gcgcaaacguaacc

SEQ ID NO: 3722708 - RNA, 18 nt, Salmonella enterica enterica serovar Typhi Ty2
gcgcaaacuaccgggccu

SEQ ID NO: 3722709 - RNA, 22 nt, Salmonella enterica enterica serovar Typhi Ty2
gcgcaaacuucacauuuuuauc

SEQ ID NO: 3722710 - RNA, 21 nt, Salmonella enterica enterica serovar Typhi Ty2
gcgcaaagcaauguaaaacug

SEQ ID NO: 3722711 - RNA, 12 nt, Salmonella enterica enterica serovar Typhi Ty2
gcgcaaauauua

SEQ ID NO: 3722712 - RNA, 14 nt, Salmonella enterica enterica serovar Typhi Ty2
gcgcaaaucgccau

SEQ ID NO: 3722713 - RNA, 18 nt, Salmonella enterica enterica serovar Typhi Ty2
gcgcaaccgacgggcgcu

SEQ ID NO: 3722714 - RNA, 15 nt, Salmonella enterica enterica serovar Typhi Ty2
gcgcaaccgcaucac

SEQ ID NO: 3722715 - RNA, 17 nt, Salmonella enterica enterica serovar Typhi Ty2
gcgcaaccgcaucacgc

SEQ ID NO: 3722716 - RNA, 14 nt, Salmonella enterica enterica serovar Typhi Ty2
gcgccaaucaccgc

SEQ ID NO: 3722717 - RNA, 21 nt, Salmonella enterica enterica serovar Typhi Ty2
gcgccaaucaccgccagcaac

SEQ ID NO: 3722718 - RNA, 22 nt, Salmonella enterica enterica serovar Typhi Ty2
gcgccaaugcgaaaauacuccc

SEQ ID NO: 3722719 - RNA, 20 nt, Salmonella enterica enterica serovar Typhi Ty2
gcgccaauggcgaucuuuug

SEQ ID NO: 3722720 - RNA, 13 nt, Salmonella enterica enterica serovar Typhi Ty2
gcgccaccacuga

SEQ ID NO: 3722721 - RNA, 21 nt, Salmonella enterica enterica serovar Typhi Ty2
gcgccaccgggcaacacacgc

SEQ ID NO: 3722722 - RNA, 22 nt, Salmonella enterica enterica serovar Typhi Ty2
gcgccaccgggcaacacacgcu

SEQ ID NO: 3722723 - RNA, 18 nt, Salmonella enterica enterica serovar Typhi Ty2
gcgccaccugcacggcgu

SEQ ID NO: 3722724 - RNA, 23 nt, Salmonella enterica enterica serovar Typhi Ty2
gcgccaccuuaaucgacuucaug

SEQ ID NO: 3722725 - RNA, 13 nt, Salmonella enterica enterica serovar Typhi Ty2
gcgccacgccacc

SEQ ID NO: 3722726 - RNA, 19 nt, Salmonella enterica enterica serovar Typhi Ty2
gcgccacgccaccgggccg

SEQ ID NO: 3722727 - RNA, 18 nt, Salmonella enterica enterica serovar Typhi Ty2
gcgccacgcgaugcaacc

SEQ ID NO: 3722728 - RNA, 21 nt, Salmonella enterica enterica serovar Typhi Ty2
gcgccacgcgaugcaaccccu

SEQ ID NO: 3722729 - RNA, 18 nt, Salmonella enterica enterica serovar Typhi Ty2
gcgccacgcgccagccgu

SEQ ID NO: 3722730 - RNA, 16 nt, Salmonella enterica enterica serovar Typhi Ty2
gcgccacgcgccaggu

SEQ ID NO: 3722731 - RNA, 15 nt, Salmonella enterica enterica serovar Typhi Ty2
gcgccacuuccagcg

SEQ ID NO: 3722732 - RNA, 16 nt, Salmonella enterica enterica serovar Typhi Ty2
gcgccacuuccagcgc

SEQ ID NO: 3722733 - RNA, 17 nt, Salmonella enterica enterica serovar Typhi Ty2
gcgccacuuuuccggca

SEQ ID NO: 3722734 - RNA, 14 nt, Salmonella enterica enterica serovar Typhi Ty2
gcgccagacgcgca

SEQ ID NO: 3722735 - RNA, 18 nt, Salmonella enterica enterica serovar Typhi Ty2
gcgccagagaucgcacua

SEQ ID NO: 3722736 - RNA, 13 nt, Salmonella enterica enterica serovar Typhi Ty2
gcgccagaggcgu

SEQ ID NO: 3722737 - RNA, 14 nt, Salmonella enterica enterica serovar Typhi Ty2
gcgccagaucaggc

SEQ ID NO: 3722738 - RNA, 21 nt, Salmonella enterica enterica serovar Typhi Ty2
gcgccagcaacagcguaccuu

SEQ ID NO: 3722739 - RNA, 14 nt, Salmonella enterica enterica serovar Typhi Ty2
gcgccagcaguggg

SEQ ID NO: 3722740 - RNA, 12 nt, Salmonella enterica enterica serovar Typhi Ty2
gcgccagccagc

SEQ ID NO: 3722741 - RNA, 13 nt, Salmonella enterica enterica serovar Typhi Ty2
gcgccagccagcu

SEQ ID NO: 3722742 - RNA, 15 nt, Salmonella enterica enterica serovar Typhi Ty2
gcgccagcccggcga

SEQ ID NO: 3722743 - RNA, 15 nt, Salmonella enterica enterica serovar Typhi Ty2
gcgccagcccugcga

SEQ ID NO: 3722744 - RNA, 21 nt, Salmonella enterica enterica serovar Typhi Ty2
gcgccagccgcgccaucuccu

SEQ ID NO: 3722745 - RNA, 23 nt, Salmonella enterica enterica serovar Typhi Ty2
gcgccagccgucaaacaucgcgc

SEQ ID NO: 3722746 - RNA, 14 nt, Salmonella enterica enterica serovar Typhi Ty2
gcgccagccuuccc

SEQ ID NO: 3722747 - RNA, 13 nt, Salmonella enterica enterica serovar Typhi Ty2
gcgccagcgccac

SEQ ID NO: 3722748 - RNA, 15 nt, Salmonella enterica enterica serovar Typhi Ty2
gcgccagcgccgccu

SEQ ID NO: 3722749 - RNA, 16 nt, Salmonella enterica enterica serovar Typhi Ty2
gcgccagcgccgccuc

SEQ ID NO: 3722750 - RNA, 18 nt, Salmonella enterica enterica serovar Typhi Ty2
gcgccagcgcuacccgcu

SEQ ID NO: 3722751 - RNA, 23 nt, Salmonella enterica enterica serovar Typhi Ty2
gcgccagcggauugccauacacg

SEQ ID NO: 3722752 - RNA, 14 nt, Salmonella enterica enterica serovar Typhi Ty2
gcgccagcggcggc

SEQ ID NO: 3722753 - RNA, 15 nt, Salmonella enterica enterica serovar Typhi Ty2
gcgccagcggcugcu

SEQ ID NO: 3722754 - RNA, 19 nt, Salmonella enterica enterica serovar Typhi Ty2
gcgccagcguaaucggcag

SEQ ID NO: 3722755 - RNA, 21 nt, Salmonella enterica enterica serovar Typhi Ty2
gcgccagcgugcuaagcugga

SEQ ID NO: 3722756 - RNA, 22 nt, Salmonella enterica enterica serovar Typhi Ty2
gcgccagcucaucgggcgaagc

SEQ ID NO: 3722757 - RNA, 22 nt, Salmonella enterica enterica serovar Typhi Ty2
gcgccagcuccauagaaaucag

SEQ ID NO: 3722758 - RNA, 15 nt, Salmonella enterica enterica serovar Typhi Ty2
gcgccagcugcguca

SEQ ID NO: 3722759 - RNA, 22 nt, Salmonella enterica enterica serovar Typhi Ty2
gcgccagcugcgucaugucguu

SEQ ID NO: 3722760 - RNA, 13 nt, Salmonella enterica enterica serovar Typhi Ty2
gcgccaggaaacu

SEQ ID NO: 3722761 - RNA, 17 nt, Salmonella enterica enterica serovar Typhi Ty2
gcgccaggccauugcug

SEQ ID NO: 3722762 - RNA, 13 nt, Salmonella enterica enterica serovar Typhi Ty2
gcgccagguauac

SEQ ID NO: 3722763 - RNA, 15 nt, Salmonella enterica enterica serovar Typhi Ty2
gcgccaggugacgaa

SEQ ID NO: 3722764 - RNA, 16 nt, Salmonella enterica enterica serovar Typhi Ty2
gcgccaguaaucggcg

SEQ ID NO: 3722765 - RNA, 17 nt, Salmonella enterica enterica serovar Typhi Ty2
gcgccaguaaucggcgc

SEQ ID NO: 3722766 - RNA, 20 nt, Salmonella enterica enterica serovar Typhi Ty2
gcgccaguaaugccgugccg

SEQ ID NO: 3722767 - RNA, 16 nt, Salmonella enterica enterica serovar Typhi Ty2
gcgccagugacgccag

SEQ ID NO: 3722768 - RNA, 23 nt, Salmonella enterica enterica serovar Typhi Ty2
gcgccaguuggcguaccaucagc

SEQ ID NO: 3722769 - RNA, 14 nt, Salmonella enterica enterica serovar Typhi Ty2
gcgccaguuuuucc

SEQ ID NO: 3722770 - RNA, 12 nt, Salmonella enterica enterica serovar Typhi Ty2
gcgccauaaaaa

SEQ ID NO: 3722771 - RNA, 19 nt, Salmonella enterica enterica serovar Typhi Ty2
gcgccauacuuacugcugu

SEQ ID NO: 3722772 - RNA, 16 nt, Salmonella enterica enterica serovar Typhi Ty2
gcgccauauccgcaga

SEQ ID NO: 3722773 - RNA, 18 nt, Salmonella enterica enterica serovar Typhi Ty2
gcgccaucagacucucaa

SEQ ID NO: 3722774 - RNA, 12 nt, Salmonella enterica enterica serovar Typhi Ty2
gcgccaucaggc

SEQ ID NO: 3722775 - RNA, 14 nt, Salmonella enterica enterica serovar Typhi Ty2
gcgccaucaggcau

SEQ ID NO: 3722776 - RNA, 13 nt, Salmonella enterica enterica serovar Typhi Ty2
gcgccaucaggcu

SEQ ID NO: 3722777 - RNA, 16 nt, Salmonella enterica enterica serovar Typhi Ty2
gcgccauccaccaggc

SEQ ID NO: 3722778 - RNA, 14 nt, Salmonella enterica enterica serovar Typhi Ty2
gcgccauccacggc

SEQ ID NO: 3722779 - RNA, 23 nt, Salmonella enterica enterica serovar Typhi Ty2
gcgccaucccaugcaccaguccc

SEQ ID NO: 3722780 - RNA, 12 nt, Salmonella enterica enterica serovar Typhi Ty2
gcgccauccggc

SEQ ID NO: 3722781 - RNA, 13 nt, Salmonella enterica enterica serovar Typhi Ty2
gcgccauccggca

SEQ ID NO: 3722782 - RNA, 20 nt, Salmonella enterica enterica serovar Typhi Ty2
gcgccauccggcacgccauc

SEQ ID NO: 3722783 - RNA, 12 nt, Salmonella enterica enterica serovar Typhi Ty2
gcgccaucggcu

SEQ ID NO: 3722784 - RNA, 23 nt, Salmonella enterica enterica serovar Typhi Ty2
gcgccaugaucgauagcgacggc

SEQ ID NO: 3722785 - RNA, 18 nt, Salmonella enterica enterica serovar Typhi Ty2
gcgccaugauucaucccg

SEQ ID NO: 3722786 - RNA, 19 nt, Salmonella enterica enterica serovar Typhi Ty2
gcgccaugcggaaucacgc

SEQ ID NO: 3722787 - RNA, 21 nt, Salmonella enterica enterica serovar Typhi Ty2
gcgccauguucauaccggaua

SEQ ID NO: 3722788 - RNA, 23 nt, Salmonella enterica enterica serovar Typhi Ty2
gcgcccacgcgcggcaucauuua

SEQ ID NO: 3722789 - RNA, 13 nt, Salmonella enterica enterica serovar Typhi Ty2
gcgcccagcagca

SEQ ID NO: 3722790 - RNA, 16 nt, Salmonella enterica enterica serovar Typhi Ty2
gcgcccagcagcagaa

SEQ ID NO: 3722791 - RNA, 13 nt, Salmonella enterica enterica serovar Typhi Ty2
gcgcccaggccaa

SEQ ID NO: 3722792 - RNA, 12 nt, Salmonella enterica enterica serovar Typhi Ty2
gcgccccagcac

SEQ ID NO: 3722793 - RNA, 13 nt, Salmonella enterica enterica serovar Typhi Ty2
gcgccccagcaca

SEQ ID NO: 3722794 - RNA, 21 nt, Salmonella enterica enterica serovar Typhi Ty2
gcgccccagcacaaucccggc

SEQ ID NO: 3722795 - RNA, 23 nt, Salmonella enterica enterica serovar Typhi Ty2
gcgccccagcaugagccagcccu

SEQ ID NO: 3722796 - RNA, 12 nt, Salmonella enterica enterica serovar Typhi Ty2
gcgccccgccgc

SEQ ID NO: 3722797 - RNA, 13 nt, Salmonella enterica enterica serovar Typhi Ty2
gcgccccggcggc

SEQ ID NO: 3722798 - RNA, 15 nt, Salmonella enterica enterica serovar Typhi Ty2
gcgccuuuccggccu

SEQ ID NO: 3722799 - RNA, 20 nt, Salmonella enterica enterica serovar Typhi Ty2
gcgccuuucgauaacccgcu

SEQ ID NO: 3722800 - RNA, 17 nt, Salmonella enterica enterica serovar Typhi Ty2
gcgcgaaaaauaggaug

SEQ ID NO: 3722801 - RNA, 16 nt, Salmonella enterica enterica serovar Typhi Ty2
gcgcgaaaagaaacug

SEQ ID NO: 3722802 - RNA, 19 nt, Salmonella enterica enterica serovar Typhi Ty2
gcgcgaaacgcacccgcgc

SEQ ID NO: 3722803 - RNA, 22 nt, Salmonella enterica enterica serovar Typhi Ty2
gcgcgaacgccuuauccggccu

SEQ ID NO: 3722804 - RNA, 19 nt, Salmonella enterica enterica serovar Typhi Ty2
gcgcgaaucgacaauccgc

SEQ ID NO: 3722805 - RNA, 18 nt, Salmonella enterica enterica serovar Typhi Ty2
gcgcgaauuugccccaga

SEQ ID NO: 3722806 - RNA, 22 nt, Salmonella enterica enterica serovar Typhi Ty2
gcgcgacaauauucacgcgaau

SEQ ID NO: 3722807 - RNA, 22 nt, Salmonella enterica enterica serovar Typhi Ty2
gcgcgacauccgcuuuugguuu

SEQ ID NO: 3722808 - RNA, 16 nt, Salmonella enterica enterica serovar Typhi Ty2
gcgcgaccaggaaacc

SEQ ID NO: 3722809 - RNA, 14 nt, Salmonella enterica enterica serovar Typhi Ty2
gcgcgagagucaag

SEQ ID NO: 3722810 - RNA, 18 nt, Salmonella enterica enterica serovar Typhi Ty2
gcgcgaggcauaccgccc

SEQ ID NO: 3722811 - RNA, 17 nt, Salmonella enterica enterica serovar Typhi Ty2
gcgcgauacgcgacggc

SEQ ID NO: 3722812 - RNA, 16 nt, Salmonella enterica enterica serovar Typhi Ty2
gcgcgaucaaucacgc

SEQ ID NO: 3722813 - RNA, 20 nt, Salmonella enterica enterica serovar Typhi Ty2
gcgcgaucgccccgaccagg

SEQ ID NO: 3722814 - RNA, 20 nt, Salmonella enterica enterica serovar Typhi Ty2
gcgcgaucucuuuggccagu

SEQ ID NO: 3722815 - RNA, 17 nt, Salmonella enterica enterica serovar Typhi Ty2
gcgcgauuuucucgcua

SEQ ID NO: 3722816 - RNA, 22 nt, Salmonella enterica enterica serovar Typhi Ty2
gcgcgcacaacgugcaaaacag

SEQ ID NO: 3722817 - RNA, 15 nt, Salmonella enterica enterica serovar Typhi Ty2
gcgcgcacgcgggcc

SEQ ID NO: 3722818 - RNA, 15 nt, Salmonella enterica enterica serovar Typhi Ty2
gcgcgcacguucagg

SEQ ID NO: 3722819 - RNA, 19 nt, Salmonella enterica enterica serovar Typhi Ty2
gcgcgcagaccacgaauca

SEQ ID NO: 3722820 - RNA, 21 nt, Salmonella enterica enterica serovar Typhi Ty2
gcgcgcagaccacgaaucagg

SEQ ID NO: 3722821 - RNA, 22 nt, Salmonella enterica enterica serovar Typhi Ty2
gcgcgcaucgggccguccggca

SEQ ID NO: 3722822 - RNA, 23 nt, Salmonella enterica enterica serovar Typhi Ty2
gcgcgccaaaguuaaucagcgcc

SEQ ID NO: 3722823 - RNA, 19 nt, Salmonella enterica enterica serovar Typhi Ty2
gcgcgccaauggccgcccc

SEQ ID NO: 3722824 - RNA, 13 nt, Salmonella enterica enterica serovar Typhi Ty2
gcgcgccagcgau

SEQ ID NO: 3722825 - RNA, 20 nt, Salmonella enterica enterica serovar Typhi Ty2
gcgcgccagcgauuccguca

SEQ ID NO: 3722826 - RNA, 12 nt, Salmonella enterica enterica serovar Typhi Ty2
gcgcgccagcgc

SEQ ID NO: 3722827 - RNA, 20 nt, Salmonella enterica enterica serovar Typhi Ty2
gcgcgccaguaaucggcgcg

SEQ ID NO: 3722828 - RNA, 22 nt, Salmonella enterica enterica serovar Typhi Ty2
gcgcgccaucgucccaucgucg

SEQ ID NO: 3722829 - RNA, 13 nt, Salmonella enterica enterica serovar Typhi Ty2
gcgcgccaugaga

SEQ ID NO: 3722830 - RNA, 21 nt, Salmonella enterica enterica serovar Typhi Ty2
gcgcgcccaguccuuccggcg

SEQ ID NO: 3722831 - RNA, 15 nt, Salmonella enterica enterica serovar Typhi Ty2
gcgcgcccgacgcgc

SEQ ID NO: 3722832 - RNA, 12 nt, Salmonella enterica enterica serovar Typhi Ty2
gcgcgccgcagc

SEQ ID NO: 3722833 - RNA, 13 nt, Salmonella enterica enterica serovar Typhi Ty2
gcgcgccgcagcg

SEQ ID NO: 3722834 - RNA, 13 nt, Salmonella enterica enterica serovar Typhi Ty2
gcgcgccgccaac

SEQ ID NO: 3722835 - RNA, 12 nt, Salmonella enterica enterica serovar Typhi Ty2
gcgcgccgccug

SEQ ID NO: 3722836 - RNA, 15 nt, Salmonella enterica enterica serovar Typhi Ty2
gcgcgccguaaacaa

SEQ ID NO: 3722837 - RNA, 17 nt, Salmonella enterica enterica serovar Typhi Ty2
gcgcgccuuccagcaau

SEQ ID NO: 3722838 - RNA, 20 nt, Salmonella enterica enterica serovar Typhi Ty2
gcgcgccuucgaaccgggua

SEQ ID NO: 3722839 - RNA, 21 nt, Salmonella enterica enterica serovar Typhi Ty2
gcgcgcgauacccaccucguu

SEQ ID NO: 3722840 - RNA, 14 nt, Salmonella enterica enterica serovar Typhi Ty2
gcgcgcgaugcugc

SEQ ID NO: 3722841 - RNA, 18 nt, Salmonella enterica enterica serovar Typhi Ty2
gcgcgcgaugguaggccu

SEQ ID NO: 3722842 - RNA, 14 nt, Salmonella enterica enterica serovar Typhi Ty2
gcgcgcgcaaagcg

SEQ ID NO: 3722843 - RNA, 13 nt, Salmonella enterica enterica serovar Typhi Ty2
gcgcgcgggcgau

SEQ ID NO: 3722844 - RNA, 16 nt, Salmonella enterica enterica serovar Typhi Ty2
gcgcgcugagcggcuc

SEQ ID NO: 3722845 - RNA, 15 nt, Salmonella enterica enterica serovar Typhi Ty2
gcgcgcugccgcccu

SEQ ID NO: 3722846 - RNA, 17 nt, Salmonella enterica enterica serovar Typhi Ty2
gcgcgcuugcauugcuc

SEQ ID NO: 3722847 - RNA, 18 nt, Salmonella enterica enterica serovar Typhi Ty2
gcgcgcuuucaccgccuc

SEQ ID NO: 3722848 - RNA, 22 nt, Salmonella enterica enterica serovar Typhi Ty2
gcgcgcuuuccacaaucccggc

SEQ ID NO: 3722849 - RNA, 19 nt, Salmonella enterica enterica serovar Typhi Ty2
gcgcggauauggcggcggc

SEQ ID NO: 3722850 - RNA, 13 nt, Salmonella enterica enterica serovar Typhi Ty2
gcgcggcagaccg

SEQ ID NO: 3722851 - RNA, 23 nt, Salmonella enterica enterica serovar Typhi Ty2
gcgcggcaggccuuucggcagcg

SEQ ID NO: 3722852 - RNA, 19 nt, Salmonella enterica enterica serovar Typhi Ty2
gcgcggcaguucaggcucg

SEQ ID NO: 3722853 - RNA, 16 nt, Salmonella enterica enterica serovar Typhi Ty2
gcgcggcaucauuuac

SEQ ID NO: 3722854 - RNA, 17 nt, Salmonella enterica enterica serovar Typhi Ty2
gcgcggcaucgccgccc

SEQ ID NO: 3722855 - RNA, 20 nt, Salmonella enterica enterica serovar Typhi Ty2
gcgcggcaucgccgcccagu

SEQ ID NO: 3722856 - RNA, 21 nt, Salmonella enterica enterica serovar Typhi Ty2
gcgcggcaucgccgcccagug

SEQ ID NO: 3722857 - RNA, 13 nt, Salmonella enterica enterica serovar Typhi Ty2
gcgcggccagcgc

SEQ ID NO: 3722858 - RNA, 19 nt, Salmonella enterica enterica serovar Typhi Ty2
gcgcggcccauucaacggg

SEQ ID NO: 3722859 - RNA, 14 nt, Salmonella enterica enterica serovar Typhi Ty2
gcgcggccccauca

SEQ ID NO: 3722860 - RNA, 20 nt, Salmonella enterica enterica serovar Typhi Ty2
gcgcggccuuugccuucgcc

SEQ ID NO: 3722861 - RNA, 17 nt, Salmonella enterica enterica serovar Typhi Ty2
gcgcggcgaaauaggcc

SEQ ID NO: 3722862 - RNA, 18 nt, Salmonella enterica enterica serovar Typhi Ty2
gcgcggcgaaauaggccg

SEQ ID NO: 3722863 - RNA, 10 nt, Salmonella enterica enterica serovar Typhi Ty2
gcgcggcgga

SEQ ID NO: 3722864 - RNA, 18 nt, Salmonella enterica enterica serovar Typhi Ty2
gcgcggcggguugaugau

SEQ ID NO: 3722865 - RNA, 14 nt, Salmonella enterica enterica serovar Typhi Ty2
gcgcggcguucugc

SEQ ID NO: 3722866 - RNA, 19 nt, Salmonella enterica enterica serovar Typhi Ty2
gcgcggcuaccggacugcu

SEQ ID NO: 3722867 - RNA, 21 nt, Salmonella enterica enterica serovar Typhi Ty2
gcgcgggauaucgcuggucgg

SEQ ID NO: 3722868 - RNA, 15 nt, Salmonella enterica enterica serovar Typhi Ty2
gcgcggggaacacag

SEQ ID NO: 3722869 - RNA, 20 nt, Salmonella enterica enterica serovar Typhi Ty2
gcgcggucauucguacguuu

SEQ ID NO: 3722870 - RNA, 17 nt, Salmonella enterica enterica serovar Typhi Ty2
gcgcgguccacaggccg

SEQ ID NO: 3722871 - RNA, 18 nt, Salmonella enterica enterica serovar Typhi Ty2
gcgcggucgcuucgccuu

SEQ ID NO: 3722872 - RNA, 17 nt, Salmonella enterica enterica serovar Typhi Ty2
gcgcgguuuauccccgc

SEQ ID NO: 3722873 - RNA, 21 nt, Salmonella enterica enterica serovar Typhi Ty2
gcgcguaaauccuccaucaug

SEQ ID NO: 3722874 - RNA, 15 nt, Salmonella enterica enterica serovar Typhi Ty2
gcgcguaauuccgca

SEQ ID NO: 3722875 - RNA, 20 nt, Salmonella enterica enterica serovar Typhi Ty2
gcgcgucacaacagccggaa

SEQ ID NO: 3722876 - RNA, 22 nt, Salmonella enterica enterica serovar Typhi Ty2
gcgcgucacaauaucgagauga

SEQ ID NO: 3722877 - RNA, 15 nt, Salmonella enterica enterica serovar Typhi Ty2
gcgcgucagcgccuc

SEQ ID NO: 3722878 - RNA, 16 nt, Salmonella enterica enterica serovar Typhi Ty2
gcgcguccacggcggg

SEQ ID NO: 3722879 - RNA, 12 nt, Salmonella enterica enterica serovar Typhi Ty2
gcgcguccagac

SEQ ID NO: 3722880 - RNA, 17 nt, Salmonella enterica enterica serovar Typhi Ty2
gcgcugucaccagcagc

SEQ ID NO: 3722881 - RNA, 16 nt, Salmonella enterica enterica serovar Typhi Ty2
gcgcugucagugaaaa

SEQ ID NO: 3722882 - RNA, 12 nt, Salmonella enterica enterica serovar Typhi Ty2
gcgcugucgccg

SEQ ID NO: 3722883 - RNA, 13 nt, Salmonella enterica enterica serovar Typhi Ty2
gcgcugucugccg

SEQ ID NO: 3722884 - RNA, 23 nt, Salmonella enterica enterica serovar Typhi Ty2
gcgcugugcuaucaggccuacaa

SEQ ID NO: 3722885 - RNA, 17 nt, Salmonella enterica enterica serovar Typhi Ty2
gcgcuguggucgucugg

SEQ ID NO: 3722886 - RNA, 18 nt, Salmonella enterica enterica serovar Typhi Ty2
gcgcuguguccgccugcu

SEQ ID NO: 3722887 - RNA, 19 nt, Salmonella enterica enterica serovar Typhi Ty2
gcgcuguguccgccugcug

SEQ ID NO: 3722888 - RNA, 18 nt, Salmonella enterica enterica serovar Typhi Ty2
gcgcuguucuugcugcug

SEQ ID NO: 3722889 - RNA, 22 nt, Salmonella enterica enterica serovar Typhi Ty2
gcgcuguucuugcugcugcuga

SEQ ID NO: 3722890 - RNA, 13 nt, Salmonella enterica enterica serovar Typhi Ty2
gcgcuguuguucc

SEQ ID NO: 3722891 - RNA, 23 nt, Salmonella enterica enterica serovar Typhi Ty2
gcgcuguuuauccacaggcgacu

SEQ ID NO: 3722892 - RNA, 18 nt, Salmonella enterica enterica serovar Typhi Ty2
gcgcuguuuuuacgccau

SEQ ID NO: 3722893 - RNA, 19 nt, Salmonella enterica enterica serovar Typhi Ty2
gcgcuuaccgggccuacaa

SEQ ID NO: 3722894 - RNA, 20 nt, Salmonella enterica enterica serovar Typhi Ty2
gcgcuuaccgggccuacagg

SEQ ID NO: 3722895 - RNA, 22 nt, Salmonella enterica enterica serovar Typhi Ty2
gcgcuuaucgccguaaccgccu

SEQ ID NO: 3722896 - RNA, 17 nt, Salmonella enterica enterica serovar Typhi Ty2
gcgcuuccagacuacgg

SEQ ID NO: 3722897 - RNA, 14 nt, Salmonella enterica enterica serovar Typhi Ty2
gcgcuuccagcaug

SEQ ID NO: 3722898 - RNA, 15 nt, Salmonella enterica enterica serovar Typhi Ty2
gcgcuucgccugccg

SEQ ID NO: 3722899 - RNA, 16 nt, Salmonella enterica enterica serovar Typhi Ty2
gcgcuucgccugccgg

SEQ ID NO: 3722900 - RNA, 19 nt, Salmonella enterica enterica serovar Typhi Ty2
gcgcuucgcuugcccggcc

SEQ ID NO: 3722901 - RNA, 17 nt, Salmonella enterica enterica serovar Typhi Ty2
gcgcuucguuuuccgca

SEQ ID NO: 3722902 - RNA, 15 nt, Salmonella enterica enterica serovar Typhi Ty2
gcgcuugcauugcuc

SEQ ID NO: 3722903 - RNA, 22 nt, Salmonella enterica enterica serovar Typhi Ty2
gcgcuugccuuuacuguugccu

SEQ ID NO: 3722904 - RNA, 17 nt, Salmonella enterica enterica serovar Typhi Ty2
gcgcuugcgccgccauc

SEQ ID NO: 3722905 - RNA, 16 nt, Salmonella enterica enterica serovar Typhi Ty2
gcgcuuguaaauugcg

SEQ ID NO: 3722906 - RNA, 16 nt, Salmonella enterica enterica serovar Typhi Ty2
gcgcuuuacaugacgc

SEQ ID NO: 3722907 - RNA, 17 nt, Salmonella enterica enterica serovar Typhi Ty2
gcgcuuucaaucgucag

SEQ ID NO: 3722908 - RNA, 21 nt, Salmonella enterica enterica serovar Typhi Ty2
gcgcuuuccagucccugaaga

SEQ ID NO: 3722909 - RNA, 16 nt, Salmonella enterica enterica serovar Typhi Ty2
gcgcuuugacaucggg

SEQ ID NO: 3722910 - RNA, 23 nt, Salmonella enterica enterica serovar Typhi Ty2
gcgcuuuuaauugcgcaucaagc

SEQ ID NO: 3722911 - RNA, 14 nt, Salmonella enterica enterica serovar Typhi Ty2
gcgcuuuuccagca

SEQ ID NO: 3722912 - RNA, 14 nt, Salmonella enterica enterica serovar Typhi Ty2
gcgcuuuugccgcg

SEQ ID NO: 3722913 - RNA, 24 nt, Salmonella enterica enterica serovar Typhi Ty2
gcgcuuuuggcggccagcguguca

SEQ ID NO: 3722914 - RNA, 14 nt, Salmonella enterica enterica serovar Typhi Ty2
gcgcuuuuucacga

SEQ ID NO: 3722915 - RNA, 20 nt, Salmonella enterica enterica serovar Typhi Ty2
gcgcuuuuuuuacgccugaa

SEQ ID NO: 3722916 - RNA, 20 nt, Salmonella enterica enterica serovar Typhi Ty2
gcggaaaggacguucuucuc

SEQ ID NO: 3722917 - RNA, 21 nt, Salmonella enterica enterica serovar Typhi Ty2
gcggaaaggacguucuucucc

SEQ ID NO: 3722918 - RNA, 19 nt, Salmonella enterica enterica serovar Typhi Ty2
gcggaaauuagcccgcuuc

SEQ ID NO: 3722919 - RNA, 13 nt, Salmonella enterica enterica serovar Typhi Ty2
gcggaacaccagc

SEQ ID NO: 3722920 - RNA, 13 nt, Salmonella enterica enterica serovar Typhi Ty2
gcggaaccauuuu

SEQ ID NO: 3722921 - RNA, 15 nt, Salmonella enterica enterica serovar Typhi Ty2
gcggaaccuguccug

SEQ ID NO: 3722922 - RNA, 13 nt, Salmonella enterica enterica serovar Typhi Ty2
gcggaagaggcgc

SEQ ID NO: 3722923 - RNA, 14 nt, Salmonella enterica enterica serovar Typhi Ty2
gcggaagaggcgcc

SEQ ID NO: 3722924 - RNA, 23 nt, Salmonella enterica enterica serovar Typhi Ty2
gcggaagaggcgccuggcaccau

SEQ ID NO: 3722925 - RNA, 23 nt, Salmonella enterica enterica serovar Typhi Ty2
gcggaagggauucccauccgugc

SEQ ID NO: 3722926 - RNA, 22 nt, Salmonella enterica enterica serovar Typhi Ty2
gcggaauaaucagucgcagcgg

SEQ ID NO: 3722927 - RNA, 21 nt, Salmonella enterica enterica serovar Typhi Ty2
gcggaauccaucccccugccg

SEQ ID NO: 3722928 - RNA, 16 nt, Salmonella enterica enterica serovar Typhi Ty2
gcggaaucgcuuccug

SEQ ID NO: 3722929 - RNA, 20 nt, Salmonella enterica enterica serovar Typhi Ty2
gcggaaucgucacagacccc

SEQ ID NO: 3722930 - RNA, 17 nt, Salmonella enterica enterica serovar Typhi Ty2
gcggaaucuccggcgaa

SEQ ID NO: 3722931 - RNA, 20 nt, Salmonella enterica enterica serovar Typhi Ty2
gcggaaugaccugagcgugc

SEQ ID NO: 3722932 - RNA, 19 nt, Salmonella enterica enterica serovar Typhi Ty2
gcggaauggcgggcgcagg

SEQ ID NO: 3722933 - RNA, 21 nt, Salmonella enterica enterica serovar Typhi Ty2
gcggaauucccacaucgcgau

SEQ ID NO: 3722934 - RNA, 16 nt, Salmonella enterica enterica serovar Typhi Ty2
gcggaauuucaggaag

SEQ ID NO: 3722935 - RNA, 12 nt, Salmonella enterica enterica serovar Typhi Ty2
gcggacagcggc

SEQ ID NO: 3722936 - RNA, 14 nt, Salmonella enterica enterica serovar Typhi Ty2
gcggacaugguaau

SEQ ID NO: 3722937 - RNA, 17 nt, Salmonella enterica enterica serovar Typhi Ty2
gcggaccagcgugcgcu

SEQ ID NO: 3722938 - RNA, 13 nt, Salmonella enterica enterica serovar Typhi Ty2
gcggacgcagcuc

SEQ ID NO: 3722939 - RNA, 13 nt, Salmonella enterica enterica serovar Typhi Ty2
gcggacgggcggu

SEQ ID NO: 3722940 - RNA, 21 nt, Salmonella enterica enterica serovar Typhi Ty2
gcggacguagcggcgccggga

SEQ ID NO: 3722941 - RNA, 14 nt, Salmonella enterica enterica serovar Typhi Ty2
gcggacugccuaac

SEQ ID NO: 3722942 - RNA, 17 nt, Salmonella enterica enterica serovar Typhi Ty2
gcggagaagacgccgcc

SEQ ID NO: 3722943 - RNA, 20 nt, Salmonella enterica enterica serovar Typhi Ty2
gcggagagaucgacagcgcg

SEQ ID NO: 3722944 - RNA, 20 nt, Salmonella enterica enterica serovar Typhi Ty2
gcggagauacccuuaugaua

SEQ ID NO: 3722945 - RNA, 16 nt, Salmonella enterica enterica serovar Typhi Ty2
gcggagaucgcucccg

SEQ ID NO: 3722946 - RNA, 17 nt, Salmonella enterica enterica serovar Typhi Ty2
gcggagaucgcucccgc

SEQ ID NO: 3722947 - RNA, 16 nt, Salmonella enterica enterica serovar Typhi Ty2
gcggagccucuuccug

SEQ ID NO: 3722948 - RNA, 19 nt, Salmonella enterica enterica serovar Typhi Ty2
gcggauaagcgcagcgcca

SEQ ID NO: 3722949 - RNA, 18 nt, Salmonella enterica enterica serovar Typhi Ty2
gcggauacagcggcgcgc

SEQ ID NO: 3722950 - RNA, 15 nt, Salmonella enterica enterica serovar Typhi Ty2
gcggauaugcagcag

SEQ ID NO: 3722951 - RNA, 16 nt, Salmonella enterica enterica serovar Typhi Ty2
gcggaucagcaaacga

SEQ ID NO: 3722952 - RNA, 20 nt, Salmonella enterica enterica serovar Typhi Ty2
gcggaucgugauaacgcgau

SEQ ID NO: 3722953 - RNA, 21 nt, Salmonella enterica enterica serovar Typhi Ty2
gcggaugcgccauccaccagg

SEQ ID NO: 3722954 - RNA, 22 nt, Salmonella enterica enterica serovar Typhi Ty2
gcggaugcgccauccaccaggc

SEQ ID NO: 3722955 - RNA, 12 nt, Salmonella enterica enterica serovar Typhi Ty2
gcggauggcgcu

SEQ ID NO: 3722956 - RNA, 19 nt, Salmonella enterica enterica serovar Typhi Ty2
gcggaugucggucaucagg

SEQ ID NO: 3722957 - RNA, 17 nt, Salmonella enterica enterica serovar Typhi Ty2
gcggauuaagcgaaucc

SEQ ID NO: 3722958 - RNA, 19 nt, Salmonella enterica enterica serovar Typhi Ty2
gcggauuccaguagcgcgc

SEQ ID NO: 3722959 - RNA, 14 nt, Salmonella enterica enterica serovar Typhi Ty2
gcggauucuccagg

SEQ ID NO: 3722960 - RNA, 17 nt, Salmonella enterica enterica serovar Typhi Ty2
gcggauugauuuuucug

SEQ ID NO: 3722961 - RNA, 18 nt, Salmonella enterica enterica serovar Typhi Ty2
gcggauugccauacacgc

SEQ ID NO: 3722962 - RNA, 15 nt, Salmonella enterica enterica serovar Typhi Ty2
gcggcguccgccagc

SEQ ID NO: 3722963 - RNA, 16 nt, Salmonella enterica enterica serovar Typhi Ty2
gcggcgugaccgccuu

SEQ ID NO: 3722964 - RNA, 17 nt, Salmonella enterica enterica serovar Typhi Ty2
gcggcgugaccgccuua

SEQ ID NO: 3722965 - RNA, 20 nt, Salmonella enterica enterica serovar Typhi Ty2
gcggcgugaugccagccaua

SEQ ID NO: 3722966 - RNA, 20 nt, Salmonella enterica enterica serovar Typhi Ty2
gcggcguggaaccgccggag

SEQ ID NO: 3722967 - RNA, 14 nt, Salmonella enterica enterica serovar Typhi Ty2
gcggcguucaaaac

SEQ ID NO: 3722968 - RNA, 19 nt, Salmonella enterica enterica serovar Typhi Ty2
gcggcuacgccugauaagc

SEQ ID NO: 3722969 - RNA, 14 nt, Salmonella enterica enterica serovar Typhi Ty2
gcggcuacugccag

SEQ ID NO: 3722970 - RNA, 23 nt, Salmonella enterica enterica serovar Typhi Ty2
gcggcuacugccagcgucgcuga

SEQ ID NO: 3722971 - RNA, 21 nt, Salmonella enterica enterica serovar Typhi Ty2
gcggcuauugucugauggcgc

SEQ ID NO: 3722972 - RNA, 14 nt, Salmonella enterica enterica serovar Typhi Ty2
gcggcucaccagcu

SEQ ID NO: 3722973 - RNA, 14 nt, Salmonella enterica enterica serovar Typhi Ty2
gcggcucauccagc

SEQ ID NO: 3722974 - RNA, 16 nt, Salmonella enterica enterica serovar Typhi Ty2
gcggcucauccagcaa

SEQ ID NO: 3722975 - RNA, 16 nt, Salmonella enterica enterica serovar Typhi Ty2
gcggcugacacucauc

SEQ ID NO: 3722976 - RNA, 22 nt, Salmonella enterica enterica serovar Typhi Ty2
gcggcugcgccuuauccggcgu

SEQ ID NO: 3722977 - RNA, 16 nt, Salmonella enterica enterica serovar Typhi Ty2
gcggcuguguccgcca

SEQ ID NO: 3722978 - RNA, 18 nt, Salmonella enterica enterica serovar Typhi Ty2
gcggcuguguccgccaug

SEQ ID NO: 3722979 - RNA, 14 nt, Salmonella enterica enterica serovar Typhi Ty2
gcggcuuacccuga

SEQ ID NO: 3722980 - RNA, 12 nt, Salmonella enterica enterica serovar Typhi Ty2
gcggcuuauccg

SEQ ID NO: 3722981 - RNA, 15 nt, Salmonella enterica enterica serovar Typhi Ty2
gcggcuucacgccau

SEQ ID NO: 3722982 - RNA, 19 nt, Salmonella enterica enterica serovar Typhi Ty2
gcggcuucgccagauccgg

SEQ ID NO: 3722983 - RNA, 22 nt, Salmonella enterica enterica serovar Typhi Ty2
gcggcuugaguuuuccgccauu

SEQ ID NO: 3722984 - RNA, 22 nt, Salmonella enterica enterica serovar Typhi Ty2
gcggcuugucauccugcucauc

SEQ ID NO: 3722985 - RNA, 20 nt, Salmonella enterica enterica serovar Typhi Ty2
gcggcuuuaaugccgccgua

SEQ ID NO: 3722986 - RNA, 13 nt, Salmonella enterica enterica serovar Typhi Ty2
gcggcuuucagca

SEQ ID NO: 3722987 - RNA, 13 nt, Salmonella enterica enterica serovar Typhi Ty2
gcggcuuuuucau

SEQ ID NO: 3722988 - RNA, 17 nt, Salmonella enterica enterica serovar Typhi Ty2
gcggcuuuuucaucauc

SEQ ID NO: 3722989 - RNA, 18 nt, Salmonella enterica enterica serovar Typhi Ty2
gcgggaaauaccauccgc

SEQ ID NO: 3722990 - RNA, 14 nt, Salmonella enterica enterica serovar Typhi Ty2
gcgggaaugcgcgc

SEQ ID NO: 3722991 - RNA, 16 nt, Salmonella enterica enterica serovar Typhi Ty2
gcgggacgcugcgcgg

SEQ ID NO: 3722992 - RNA, 21 nt, Salmonella enterica enterica serovar Typhi Ty2
gcgggagauggcguggccaag

SEQ ID NO: 3722993 - RNA, 20 nt, Salmonella enterica enterica serovar Typhi Ty2
gcgggauaucccacucuuca

SEQ ID NO: 3722994 - RNA, 17 nt, Salmonella enterica enterica serovar Typhi Ty2
gcgggaucugcgccauu

SEQ ID NO: 3722995 - RNA, 23 nt, Salmonella enterica enterica serovar Typhi Ty2
gcgggcaaugccaccagcgccau

SEQ ID NO: 3722996 - RNA, 16 nt, Salmonella enterica enterica serovar Typhi Ty2
gcgggcaauggcgcuc

SEQ ID NO: 3722997 - RNA, 19 nt, Salmonella enterica enterica serovar Typhi Ty2
gcgggcagaaaaaucagca

SEQ ID NO: 3722998 - RNA, 20 nt, Salmonella enterica enterica serovar Typhi Ty2
gcgggcaggucgucuucuug

SEQ ID NO: 3722999 - RNA, 13 nt, Salmonella enterica enterica serovar Typhi Ty2
gcgggccgucagg

SEQ ID NO: 3723000 - RNA, 20 nt, Salmonella enterica enterica serovar Typhi Ty2
gcgggcgauagagaccgcuu

SEQ ID NO: 3723001 - RNA, 18 nt, Salmonella enterica enterica serovar Typhi Ty2
gcgggcguauagccaggc

SEQ ID NO: 3723002 - RNA, 19 nt, Salmonella enterica enterica serovar Typhi Ty2
gcgggcguauagccaggca

SEQ ID NO: 3723003 - RNA, 23 nt, Salmonella enterica enterica serovar Typhi Ty2
gcgggcguugcugcacgucgcgc

SEQ ID NO: 3723004 - RNA, 19 nt, Salmonella enterica enterica serovar Typhi Ty2
gcgggcguuugcgcgcgcc

SEQ ID NO: 3723005 - RNA, 13 nt, Salmonella enterica enterica serovar Typhi Ty2
gcgggcugaaauc

SEQ ID NO: 3723006 - RNA, 16 nt, Salmonella enterica enterica serovar Typhi Ty2
gcgggcuuauccccau

SEQ ID NO: 3723007 - RNA, 17 nt, Salmonella enterica enterica serovar Typhi Ty2
gcggggauaaucagcag

SEQ ID NO: 3723008 - RNA, 19 nt, Salmonella enterica enterica serovar Typhi Ty2
gcggggauaaucagcagcg

SEQ ID NO: 3723009 - RNA, 22 nt, Salmonella enterica enterica serovar Typhi Ty2
gcggggcaacagauacggcgcg

SEQ ID NO: 3723010 - RNA, 13 nt, Salmonella enterica enterica serovar Typhi Ty2
gcggguaaacaga

SEQ ID NO: 3723011 - RNA, 23 nt, Salmonella enterica enterica serovar Typhi Ty2
gcggguaaacucacccaggcgau

SEQ ID NO: 3723012 - RNA, 14 nt, Salmonella enterica enterica serovar Typhi Ty2
gcgggugaugacgc

SEQ ID NO: 3723013 - RNA, 15 nt, Salmonella enterica enterica serovar Typhi Ty2
gcggguucccccacu

SEQ ID NO: 3723014 - RNA, 21 nt, Salmonella enterica enterica serovar Typhi Ty2
gcgguaaaaucugucucaucg

SEQ ID NO: 3723015 - RNA, 19 nt, Salmonella enterica enterica serovar Typhi Ty2
gcgguaaacaccaccgguu

SEQ ID NO: 3723016 - RNA, 13 nt, Salmonella enterica enterica serovar Typhi Ty2
gcgguaagcuguu

SEQ ID NO: 3723017 - RNA, 14 nt, Salmonella enterica enterica serovar Typhi Ty2
gcgguaauaacuga

SEQ ID NO: 3723018 - RNA, 13 nt, Salmonella enterica enterica serovar Typhi Ty2
gcgguaaucgcgc

SEQ ID NO: 3723019 - RNA, 16 nt, Salmonella enterica enterica serovar Typhi Ty2
gcgguacgaccggauu

SEQ ID NO: 3723020 - RNA, 18 nt, Salmonella enterica enterica serovar Typhi Ty2
gcgguacgccgccauccg

SEQ ID NO: 3723021 - RNA, 20 nt, Salmonella enterica enterica serovar Typhi Ty2
gcgguacucuuuuuccgcga

SEQ ID NO: 3723022 - RNA, 13 nt, Salmonella enterica enterica serovar Typhi Ty2
gcgguagcgccga

SEQ ID NO: 3723023 - RNA, 14 nt, Salmonella enterica enterica serovar Typhi Ty2
gcgguauaucacgc

SEQ ID NO: 3723024 - RNA, 16 nt, Salmonella enterica enterica serovar Typhi Ty2
gcgguauaucacgcca

SEQ ID NO: 3723025 - RNA, 13 nt, Salmonella enterica enterica serovar Typhi Ty2
gcgguaucaaugc

SEQ ID NO: 3723026 - RNA, 23 nt, Salmonella enterica enterica serovar Typhi Ty2
gcgguaucaaugcgacagcgaca

SEQ ID NO: 3723027 - RNA, 23 nt, Salmonella enterica enterica serovar Typhi Ty2
gcgguaugcaccucuuuaugcgg

SEQ ID NO: 3723028 - RNA, 16 nt, Salmonella enterica enterica serovar Typhi Ty2
gcgguauuucgccgcc

SEQ ID NO: 3723029 - RNA, 20 nt, Salmonella enterica enterica serovar Typhi Ty2
gcggucaaaagcugcauccg

SEQ ID NO: 3723030 - RNA, 16 nt, Salmonella enterica enterica serovar Typhi Ty2
gcggucacaggcauac

SEQ ID NO: 3723031 - RNA, 17 nt, Salmonella enterica enterica serovar Typhi Ty2
gcggucaccuucggucc

SEQ ID NO: 3723032 - RNA, 14 nt, Salmonella enterica enterica serovar Typhi Ty2
gcggucagcggcgc

SEQ ID NO: 3723033 - RNA, 13 nt, Salmonella enterica enterica serovar Typhi Ty2
gcggucagcuuuu

SEQ ID NO: 3723034 - RNA, 15 nt, Salmonella enterica enterica serovar Typhi Ty2
gcggucagggcuuac

SEQ ID NO: 3723035 - RNA, 19 nt, Salmonella enterica enterica serovar Typhi Ty2
gcggucaugcuggcgauga

SEQ ID NO: 3723036 - RNA, 19 nt, Salmonella enterica enterica serovar Typhi Ty2
gcggucgacagccacacgc

SEQ ID NO: 3723037 - RNA, 23 nt, Salmonella enterica enterica serovar Typhi Ty2
gcggucgauuuugccuucaauuc

SEQ ID NO: 3723038 - RNA, 14 nt, Salmonella enterica enterica serovar Typhi Ty2
gcggucgccgcaug

SEQ ID NO: 3723039 - RNA, 16 nt, Salmonella enterica enterica serovar Typhi Ty2
gcggucgcugauaauc

SEQ ID NO: 3723040 - RNA, 16 nt, Salmonella enterica enterica serovar Typhi Ty2
gcggucggcaggcggu

SEQ ID NO: 3723041 - RNA, 12 nt, Salmonella enterica enterica serovar Typhi Ty2
gcggucuucacu

SEQ ID NO: 3723042 - RNA, 15 nt, Salmonella enterica enterica serovar Typhi Ty2
gcggugaaacuguuu

SEQ ID NO: 3723043 - RNA, 20 nt, Salmonella enterica enterica serovar Typhi Ty2
gcggugaaaggcuugcagga

SEQ ID NO: 3723044 - RNA, 18 nt, Salmonella enterica enterica serovar Typhi Ty2
gcgucaggaacgcggcgc

SEQ ID NO: 3723045 - RNA, 16 nt, Salmonella enterica enterica serovar Typhi Ty2
gcgucaggcuguuguu

SEQ ID NO: 3723046 - RNA, 14 nt, Salmonella enterica enterica serovar Typhi Ty2
gcgucauaaugccc

SEQ ID NO: 3723047 - RNA, 19 nt, Salmonella enterica enterica serovar Typhi Ty2
gcgucauaguuuuccagcc

SEQ ID NO: 3723048 - RNA, 20 nt, Salmonella enterica enterica serovar Typhi Ty2
gcgucaucauugcgccaaga

SEQ ID NO: 3723049 - RNA, 22 nt, Salmonella enterica enterica serovar Typhi Ty2
gcgucauccaguguuaagaaga

SEQ ID NO: 3723050 - RNA, 13 nt, Salmonella enterica enterica serovar Typhi Ty2
gcgucauccggca

SEQ ID NO: 3723051 - RNA, 14 nt, Salmonella enterica enterica serovar Typhi Ty2
gcgucauccugcag

SEQ ID NO: 3723052 - RNA, 15 nt, Salmonella enterica enterica serovar Typhi Ty2
gcgucauccugcagg

SEQ ID NO: 3723053 - RNA, 22 nt, Salmonella enterica enterica serovar Typhi Ty2
gcgucaucgacauuaacaaugc

SEQ ID NO: 3723054 - RNA, 17 nt, Salmonella enterica enterica serovar Typhi Ty2
gcgucaucggcgcgcug

SEQ ID NO: 3723055 - RNA, 19 nt, Salmonella enterica enterica serovar Typhi Ty2
gcgucaucggcgcgcuggc

SEQ ID NO: 3723056 - RNA, 20 nt, Salmonella enterica enterica serovar Typhi Ty2
gcgucaucggcgcgcuggcg

SEQ ID NO: 3723057 - RNA, 20 nt, Salmonella enterica enterica serovar Typhi Ty2
gcgucauggcuaaucgccac

SEQ ID NO: 3723058 - RNA, 18 nt, Salmonella enterica enterica serovar Typhi Ty2
gcguccaacuggcuuuca

SEQ ID NO: 3723059 - RNA, 22 nt, Salmonella enterica enterica serovar Typhi Ty2
gcguccaguacuuucuuuugau

SEQ ID NO: 3723060 - RNA, 20 nt, Salmonella enterica enterica serovar Typhi Ty2
gcguccaugaccaccagcgc

SEQ ID NO: 3723061 - RNA, 17 nt, Salmonella enterica enterica serovar Typhi Ty2
gcgucccggcagugcau

SEQ ID NO: 3723062 - RNA, 20 nt, Salmonella enterica enterica serovar Typhi Ty2
gcgucccucuccagggcaac

SEQ ID NO: 3723063 - RNA, 15 nt, Salmonella enterica enterica serovar Typhi Ty2
gcguccgccaucgcc

SEQ ID NO: 3723064 - RNA, 18 nt, Salmonella enterica enterica serovar Typhi Ty2
gcguccguucugauacuc

SEQ ID NO: 3723065 - RNA, 16 nt, Salmonella enterica enterica serovar Typhi Ty2
gcgucgaaugacgcgc

SEQ ID NO: 3723066 - RNA, 12 nt, Salmonella enterica enterica serovar Typhi Ty2
gcgucgaccaua

SEQ ID NO: 3723067 - RNA, 14 nt, Salmonella enterica enterica serovar Typhi Ty2
gcgucgcagugcgc

SEQ ID NO: 3723068 - RNA, 14 nt, Salmonella enterica enterica serovar Typhi Ty2
gcgucgcauccggc

SEQ ID NO: 3723069 - RNA, 12 nt, Salmonella enterica enterica serovar Typhi Ty2
gcgucgccagac

SEQ ID NO: 3723070 - RNA, 14 nt, Salmonella enterica enterica serovar Typhi Ty2
gcgucgccagcaac

SEQ ID NO: 3723071 - RNA, 16 nt, Salmonella enterica enterica serovar Typhi Ty2
gcgucgccauaaagcu

SEQ ID NO: 3723072 - RNA, 15 nt, Salmonella enterica enterica serovar Typhi Ty2
gcgucgccaucaggc

SEQ ID NO: 3723073 - RNA, 19 nt, Salmonella enterica enterica serovar Typhi Ty2
gcgucgccccaaucgccag

SEQ ID NO: 3723074 - RNA, 18 nt, Salmonella enterica enterica serovar Typhi Ty2
gcgucgcggcaauagcga

SEQ ID NO: 3723075 - RNA, 17 nt, Salmonella enterica enterica serovar Typhi Ty2
gcgucgcguaccagcgc

SEQ ID NO: 3723076 - RNA, 16 nt, Salmonella enterica enterica serovar Typhi Ty2
gcgucgcguucagcgc

SEQ ID NO: 3723077 - RNA, 16 nt, Salmonella enterica enterica serovar Typhi Ty2
gcgucgcuucguucug

SEQ ID NO: 3723078 - RNA, 17 nt, Salmonella enterica enterica serovar Typhi Ty2
gcgucggacauuuuguu

SEQ ID NO: 3723079 - RNA, 17 nt, Salmonella enterica enterica serovar Typhi Ty2
gcgucggcaccauuccc

SEQ ID NO: 3723080 - RNA, 18 nt, Salmonella enterica enterica serovar Typhi Ty2
gcgucgguuauagacgcc

SEQ ID NO: 3723081 - RNA, 23 nt, Salmonella enterica enterica serovar Typhi Ty2
gcgucgucauagcguugauaugc

SEQ ID NO: 3723082 - RNA, 18 nt, Salmonella enterica enterica serovar Typhi Ty2
gcgucguucacgucgcga

SEQ ID NO: 3723083 - RNA, 15 nt, Salmonella enterica enterica serovar Typhi Ty2
gcgucucaagcuuuu

SEQ ID NO: 3723084 - RNA, 22 nt, Salmonella enterica enterica serovar Typhi Ty2
gcgucucacuuuucgggugaga

SEQ ID NO: 3723085 - RNA, 21 nt, Salmonella enterica enterica serovar Typhi Ty2
gcgucucagauggaaaaaaag

SEQ ID NO: 3723086 - RNA, 17 nt, Salmonella enterica enterica serovar Typhi Ty2
gcgucucagcaggcggc

SEQ ID NO: 3723087 - RNA, 17 nt, Salmonella enterica enterica serovar Typhi Ty2
gcgucucaucaaaaagg

SEQ ID NO: 3723088 - RNA, 21 nt, Salmonella enterica enterica serovar Typhi Ty2
gcgucucucccucaaccaggg

SEQ ID NO: 3723089 - RNA, 16 nt, Salmonella enterica enterica serovar Typhi Ty2
gcgucugaaugacgcc

SEQ ID NO: 3723090 - RNA, 13 nt, Salmonella enterica enterica serovar Typhi Ty2
gcgucugaguuaa

SEQ ID NO: 3723091 - RNA, 19 nt, Salmonella enterica enterica serovar Typhi Ty2
gcgucugaguuaaugccau

SEQ ID NO: 3723092 - RNA, 16 nt, Salmonella enterica enterica serovar Typhi Ty2
gcgucuuauccggccu

SEQ ID NO: 3723093 - RNA, 14 nt, Salmonella enterica enterica serovar Typhi Ty2
gcgucuucaucagc

SEQ ID NO: 3723094 - RNA, 23 nt, Salmonella enterica enterica serovar Typhi Ty2
gcgucuuuuagucacuccaggcg

SEQ ID NO: 3723095 - RNA, 14 nt, Salmonella enterica enterica serovar Typhi Ty2
gcgugaauaaaaua

SEQ ID NO: 3723096 - RNA, 13 nt, Salmonella enterica enterica serovar Typhi Ty2
gcgugacccagac

SEQ ID NO: 3723097 - RNA, 14 nt, Salmonella enterica enterica serovar Typhi Ty2
gcgugaccgguaag

SEQ ID NO: 3723098 - RNA, 17 nt, Salmonella enterica enterica serovar Typhi Ty2
gcgugacgaccggcacg

SEQ ID NO: 3723099 - RNA, 18 nt, Salmonella enterica enterica serovar Typhi Ty2
gcgugacgacuaccgccg

SEQ ID NO: 3723100 - RNA, 20 nt, Salmonella enterica enterica serovar Typhi Ty2
gcgugacgccaagcagcggc

SEQ ID NO: 3723101 - RNA, 21 nt, Salmonella enterica enterica serovar Typhi Ty2
gcgugacgccaagcagcggcg

SEQ ID NO: 3723102 - RNA, 17 nt, Salmonella enterica enterica serovar Typhi Ty2
gcgugauaauuccccca

SEQ ID NO: 3723103 - RNA, 23 nt, Salmonella enterica enterica serovar Typhi Ty2
gcgugauaauucccccauccgcg

SEQ ID NO: 3723104 - RNA, 21 nt, Salmonella enterica enterica serovar Typhi Ty2
gcgugauccacagcguaggcc

SEQ ID NO: 3723105 - RNA, 21 nt, Salmonella enterica enterica serovar Typhi Ty2
gcgugaugcgauccagcgggc

SEQ ID NO: 3723106 - RNA, 15 nt, Salmonella enterica enterica serovar Typhi Ty2
gcgugcccaguaauu

SEQ ID NO: 3723107 - RNA, 18 nt, Salmonella enterica enterica serovar Typhi Ty2
gcgugcgaauuucggcaa

SEQ ID NO: 3723108 - RNA, 17 nt, Salmonella enterica enterica serovar Typhi Ty2
gcgugcgccauccggcg

SEQ ID NO: 3723109 - RNA, 19 nt, Salmonella enterica enterica serovar Typhi Ty2
gcgugcgcugcggccagac

SEQ ID NO: 3723110 - RNA, 17 nt, Salmonella enterica enterica serovar Typhi Ty2
gcgugcggacguagggc

SEQ ID NO: 3723111 - RNA, 16 nt, Salmonella enterica enterica serovar Typhi Ty2
gcgugcgguuuuccug

SEQ ID NO: 3723112 - RNA, 19 nt, Salmonella enterica enterica serovar Typhi Ty2
gcgugcguucauggcgcga

SEQ ID NO: 3723113 - RNA, 21 nt, Salmonella enterica enterica serovar Typhi Ty2
gcgugcuaagcuggauaccgc

SEQ ID NO: 3723114 - RNA, 17 nt, Salmonella enterica enterica serovar Typhi Ty2
gcgugcugacggagcug

SEQ ID NO: 3723115 - RNA, 13 nt, Salmonella enterica enterica serovar Typhi Ty2
gcgugcuggcggc

SEQ ID NO: 3723116 - RNA, 18 nt, Salmonella enterica enterica serovar Typhi Ty2
gcgugcuucaacggugcu

SEQ ID NO: 3723117 - RNA, 20 nt, Salmonella enterica enterica serovar Typhi Ty2
gcguggcaucuuaucaggcc

SEQ ID NO: 3723118 - RNA, 21 nt, Salmonella enterica enterica serovar Typhi Ty2
gcguggcaucuuaucaggccu

SEQ ID NO: 3723119 - RNA, 22 nt, Salmonella enterica enterica serovar Typhi Ty2
gcgugguaucgcgacagcgcug

SEQ ID NO: 3723120 - RNA, 20 nt, Salmonella enterica enterica serovar Typhi Ty2
gcguggucauuaggcguaau

SEQ ID NO: 3723121 - RNA, 21 nt, Salmonella enterica enterica serovar Typhi Ty2
gcgugguggauauccagcaua

SEQ ID NO: 3723122 - RNA, 23 nt, Salmonella enterica enterica serovar Typhi Ty2
gcguggugucucgucgccagggc

SEQ ID NO: 3723123 - RNA, 24 nt, Salmonella enterica enterica serovar Typhi Ty2
gcguggugucucgucgccagggcg

SEQ ID NO: 3723124 - RNA, 19 nt, Salmonella enterica enterica serovar Typhi Ty2
gcguguaacugcaaacgcg

SEQ ID NO: 3723125 - RNA, 15 nt, Salmonella enterica enterica serovar Typhi Ty2
gcguguaaucgccgu

SEQ ID NO: 3723126 - RNA, 23 nt, Salmonella enterica enterica serovar Typhi Ty2
gcuaagcguuacggaaaaaauac

SEQ ID NO: 3723127 - RNA, 12 nt, Salmonella enterica enterica serovar Typhi Ty2
gcuaauaauucu

SEQ ID NO: 3723128 - RNA, 17 nt, Salmonella enterica enterica serovar Typhi Ty2
gcuaauaguuagccuga

SEQ ID NO: 3723129 - RNA, 20 nt, Salmonella enterica enterica serovar Typhi Ty2
gcuaauaugaauuauuuucu

SEQ ID NO: 3723130 - RNA, 18 nt, Salmonella enterica enterica serovar Typhi Ty2
gcuaauccccccuuuuuu

SEQ ID NO: 3723131 - RNA, 21 nt, Salmonella enterica enterica serovar Typhi Ty2
gcuaaucgugauaaauugcug

SEQ ID NO: 3723132 - RNA, 21 nt, Salmonella enterica enterica serovar Typhi Ty2
gcuaaugcccggcgcggcauc

SEQ ID NO: 3723133 - RNA, 16 nt, Salmonella enterica enterica serovar Typhi Ty2
gcuaauggcuuauugg

SEQ ID NO: 3723134 - RNA, 11 nt, Salmonella enterica enterica serovar Typhi Ty2
gcuaauguacg

SEQ ID NO: 3723135 - RNA, 16 nt, Salmonella enterica enterica serovar Typhi Ty2
gcuaauuggcuuaccu

SEQ ID NO: 3723136 - RNA, 19 nt, Salmonella enterica enterica serovar Typhi Ty2
gcuacacgcgaauagccag

SEQ ID NO: 3723137 - RNA, 20 nt, Salmonella enterica enterica serovar Typhi Ty2
gcuacagacaucuuugccaa

SEQ ID NO: 3723138 - RNA, 22 nt, Salmonella enterica enterica serovar Typhi Ty2
gcuacauccgccagccgccauu

SEQ ID NO: 3723139 - RNA, 18 nt, Salmonella enterica enterica serovar Typhi Ty2
gcuaccagcgcggcgcca

SEQ ID NO: 3723140 - RNA, 21 nt, Salmonella enterica enterica serovar Typhi Ty2
gcuaccagcgcggcgccagua

SEQ ID NO: 3723141 - RNA, 17 nt, Salmonella enterica enterica serovar Typhi Ty2
gcuaccaggcaaagcuc

SEQ ID NO: 3723142 - RNA, 17 nt, Salmonella enterica enterica serovar Typhi Ty2
gcuacccgcaauaccaa

SEQ ID NO: 3723143 - RNA, 16 nt, Salmonella enterica enterica serovar Typhi Ty2
gcuacccgcugacgcu

SEQ ID NO: 3723144 - RNA, 19 nt, Salmonella enterica enterica serovar Typhi Ty2
gcuaccgccacuuugcuuu

SEQ ID NO: 3723145 - RNA, 16 nt, Salmonella enterica enterica serovar Typhi Ty2
gcuaccgggcaaacau

SEQ ID NO: 3723146 - RNA, 16 nt, Salmonella enterica enterica serovar Typhi Ty2
gcuaccguccaaauca

SEQ ID NO: 3723147 - RNA, 14 nt, Salmonella enterica enterica serovar Typhi Ty2
gcuacgcagcggcg

SEQ ID NO: 3723148 - RNA, 16 nt, Salmonella enterica enterica serovar Typhi Ty2
gcuacgccuuauccgg

SEQ ID NO: 3723149 - RNA, 18 nt, Salmonella enterica enterica serovar Typhi Ty2
gcuacgccuuauccggcc

SEQ ID NO: 3723150 - RNA, 20 nt, Salmonella enterica enterica serovar Typhi Ty2
gcuacgccuuauccggccua

SEQ ID NO: 3723151 - RNA, 21 nt, Salmonella enterica enterica serovar Typhi Ty2
gcuacgccuuauccggccuac

SEQ ID NO: 3723152 - RNA, 14 nt, Salmonella enterica enterica serovar Typhi Ty2
gcuacgcgucgcca

SEQ ID NO: 3723153 - RNA, 22 nt, Salmonella enterica enterica serovar Typhi Ty2
gcuacgcugcgcguucugcucc

SEQ ID NO: 3723154 - RNA, 19 nt, Salmonella enterica enterica serovar Typhi Ty2
gcuacgcuuaucaggccua

SEQ ID NO: 3723155 - RNA, 20 nt, Salmonella enterica enterica serovar Typhi Ty2
gcuacgcuuaucaggccuac

SEQ ID NO: 3723156 - RNA, 16 nt, Salmonella enterica enterica serovar Typhi Ty2
gcuacgcuuauccggc

SEQ ID NO: 3723157 - RNA, 20 nt, Salmonella enterica enterica serovar Typhi Ty2
gcuacggaguucgccgccgg

SEQ ID NO: 3723158 - RNA, 17 nt, Salmonella enterica enterica serovar Typhi Ty2
gcuacgggccgcggcgg

SEQ ID NO: 3723159 - RNA, 19 nt, Salmonella enterica enterica serovar Typhi Ty2
gcuacguuuaucuggcuua

SEQ ID NO: 3723160 - RNA, 14 nt, Salmonella enterica enterica serovar Typhi Ty2
gcuacuggcaaaug

SEQ ID NO: 3723161 - RNA, 17 nt, Salmonella enterica enterica serovar Typhi Ty2
gcuagcgccuuauccgg

SEQ ID NO: 3723162 - RNA, 16 nt, Salmonella enterica enterica serovar Typhi Ty2
gcuaggaacagugaca

SEQ ID NO: 3723163 - RNA, 14 nt, Salmonella enterica enterica serovar Typhi Ty2
gcuauaaaguuccc

SEQ ID NO: 3723164 - RNA, 23 nt, Salmonella enterica enterica serovar Typhi Ty2
gcuauaaaguucccaugcuucca

SEQ ID NO: 3723165 - RNA, 19 nt, Salmonella enterica enterica serovar Typhi Ty2
gcuauaaucacagggguca

SEQ ID NO: 3723166 - RNA, 21 nt, Salmonella enterica enterica serovar Typhi Ty2
gcuauaccaggguucgcuggc

SEQ ID NO: 3723167 - RNA, 16 nt, Salmonella enterica enterica serovar Typhi Ty2
gcuauaccgcccgcgc

SEQ ID NO: 3723168 - RNA, 14 nt, Salmonella enterica enterica serovar Typhi Ty2
gcuauacgcggcgu

SEQ ID NO: 3723169 - RNA, 22 nt, Salmonella enterica enterica serovar Typhi Ty2
gcuauagccgcguuugaguagc

SEQ ID NO: 3723170 - RNA, 22 nt, Salmonella enterica enterica serovar Typhi Ty2
gcuauaguggauggcccacugu

SEQ ID NO: 3723171 - RNA, 14 nt, Salmonella enterica enterica serovar Typhi Ty2
gcuauauugcugcg

SEQ ID NO: 3723172 - RNA, 22 nt, Salmonella enterica enterica serovar Typhi Ty2
gcuaucaacgccuccaggcuac

SEQ ID NO: 3723173 - RNA, 20 nt, Salmonella enterica enterica serovar Typhi Ty2
gcuaucacacauaucgccag

SEQ ID NO: 3723174 - RNA, 20 nt, Salmonella enterica enterica serovar Typhi Ty2
gcuaucaggaagaacacgcc

SEQ ID NO: 3723175 - RNA, 16 nt, Salmonella enterica enterica serovar Typhi Ty2
gcuaucaggcacugaa

SEQ ID NO: 3723176 - RNA, 18 nt, Salmonella enterica enterica serovar Typhi Ty2
gcuauccacgcagacgcc

SEQ ID NO: 3723177 - RNA, 17 nt, Salmonella enterica enterica serovar Typhi Ty2
gcuauccagcaguaaau

SEQ ID NO: 3723178 - RNA, 19 nt, Salmonella enterica enterica serovar Typhi Ty2
gcuauccagcaguaaauaa

SEQ ID NO: 3723179 - RNA, 15 nt, Salmonella enterica enterica serovar Typhi Ty2
gcuauccaucgccgc

SEQ ID NO: 3723180 - RNA, 20 nt, Salmonella enterica enterica serovar Typhi Ty2
gcuauccaucgccgcgccgu

SEQ ID NO: 3723181 - RNA, 14 nt, Salmonella enterica enterica serovar Typhi Ty2
gcuaucccaggcgg

SEQ ID NO: 3723182 - RNA, 20 nt, Salmonella enterica enterica serovar Typhi Ty2
gcuaucccaggcggagaaau

SEQ ID NO: 3723183 - RNA, 12 nt, Salmonella enterica enterica serovar Typhi Ty2
gcuauccccauu

SEQ ID NO: 3723184 - RNA, 14 nt, Salmonella enterica enterica serovar Typhi Ty2
gcuauccgccgcca

SEQ ID NO: 3723185 - RNA, 16 nt, Salmonella enterica enterica serovar Typhi Ty2
gcuauccggcaucaca

SEQ ID NO: 3723186 - RNA, 14 nt, Salmonella enterica enterica serovar Typhi Ty2
gcuaucgaccagca

SEQ ID NO: 3723187 - RNA, 23 nt, Salmonella enterica enterica serovar Typhi Ty2
gcuaucgcccaaauaguccagca

SEQ ID NO: 3723188 - RNA, 19 nt, Salmonella enterica enterica serovar Typhi Ty2
gcuaucgcuuuaacgcugc

SEQ ID NO: 3723189 - RNA, 23 nt, Salmonella enterica enterica serovar Typhi Ty2
gcuaucggaaacuauccuggccu

SEQ ID NO: 3723190 - RNA, 22 nt, Salmonella enterica enterica serovar Typhi Ty2
gcuaucggcgggguuuaacgag

SEQ ID NO: 3723191 - RNA, 21 nt, Salmonella enterica enterica serovar Typhi Ty2
gcuaucgggcguuaaaaguac

SEQ ID NO: 3723192 - RNA, 22 nt, Salmonella enterica enterica serovar Typhi Ty2
gcuaucucuuccagcgucucca

SEQ ID NO: 3723193 - RNA, 16 nt, Salmonella enterica enterica serovar Typhi Ty2
gcuaucugacagccaa

SEQ ID NO: 3723194 - RNA, 23 nt, Salmonella enterica enterica serovar Typhi Ty2
gcuaucugcuccgccagcaaugc

SEQ ID NO: 3723195 - RNA, 18 nt, Salmonella enterica enterica serovar Typhi Ty2
gcuaucuuuaugucagua

SEQ ID NO: 3723196 - RNA, 11 nt, Salmonella enterica enterica serovar Typhi Ty2
gcuaugaagac

SEQ ID NO: 3723197 - RNA, 17 nt, Salmonella enterica enterica serovar Typhi Ty2
gcuaugaagcuggagcc

SEQ ID NO: 3723198 - RNA, 16 nt, Salmonella enterica enterica serovar Typhi Ty2
gcuaugcgcuccagga

SEQ ID NO: 3723199 - RNA, 20 nt, Salmonella enterica enterica serovar Typhi Ty2
gcuaugcggcguuaauggcc

SEQ ID NO: 3723200 - RNA, 21 nt, Salmonella enterica enterica serovar Typhi Ty2
gcuaugcuuaccaucuggccu

SEQ ID NO: 3723201 - RNA, 16 nt, Salmonella enterica enterica serovar Typhi Ty2
gcuauggcaacaaagc

SEQ ID NO: 3723202 - RNA, 17 nt, Salmonella enterica enterica serovar Typhi Ty2
gcuauggcaacaaagcc

SEQ ID NO: 3723203 - RNA, 21 nt, Salmonella enterica enterica serovar Typhi Ty2
gcuauggccguuuacgagcca

SEQ ID NO: 3723204 - RNA, 22 nt, Salmonella enterica enterica serovar Typhi Ty2
gcuauuaaucugugagcacagg

SEQ ID NO: 3723205 - RNA, 14 nt, Salmonella enterica enterica serovar Typhi Ty2
gcuauuaccaguaa

SEQ ID NO: 3723206 - RNA, 13 nt, Salmonella enterica enterica serovar Typhi Ty2
gcuauucaugccg

SEQ ID NO: 3723207 - RNA, 19 nt, Salmonella enterica enterica serovar Typhi Ty2
gcuccauagaaaucagcag

SEQ ID NO: 3723208 - RNA, 19 nt, Salmonella enterica enterica serovar Typhi Ty2
gcuccaucacgguaaaccu

SEQ ID NO: 3723209 - RNA, 15 nt, Salmonella enterica enterica serovar Typhi Ty2
gcuccauccaccagc

SEQ ID NO: 3723210 - RNA, 18 nt, Salmonella enterica enterica serovar Typhi Ty2
gcuccauccaccagcccc

SEQ ID NO: 3723211 - RNA, 15 nt, Salmonella enterica enterica serovar Typhi Ty2
gcuccaucuccggca

SEQ ID NO: 3723212 - RNA, 20 nt, Salmonella enterica enterica serovar Typhi Ty2
gcuccaugcugucgucgaca

SEQ ID NO: 3723213 - RNA, 20 nt, Salmonella enterica enterica serovar Typhi Ty2
gcuccaugucuugcuaucaa

SEQ ID NO: 3723214 - RNA, 18 nt, Salmonella enterica enterica serovar Typhi Ty2
gcucccagaaucguggcu

SEQ ID NO: 3723215 - RNA, 13 nt, Salmonella enterica enterica serovar Typhi Ty2
gcuccccaacagg

SEQ ID NO: 3723216 - RNA, 18 nt, Salmonella enterica enterica serovar Typhi Ty2
gcuccccguuccaccgcc

SEQ ID NO: 3723217 - RNA, 15 nt, Salmonella enterica enterica serovar Typhi Ty2
gcucccgcagccacu

SEQ ID NO: 3723218 - RNA, 18 nt, Salmonella enterica enterica serovar Typhi Ty2
gcucccgcagccacuccc

SEQ ID NO: 3723219 - RNA, 20 nt, Salmonella enterica enterica serovar Typhi Ty2
gcucccgcauggacaaggau

SEQ ID NO: 3723220 - RNA, 21 nt, Salmonella enterica enterica serovar Typhi Ty2
gcucccuuauacaggcgcagg

SEQ ID NO: 3723221 - RNA, 19 nt, Salmonella enterica enterica serovar Typhi Ty2
gcuccgaauaauccuuccc

SEQ ID NO: 3723222 - RNA, 20 nt, Salmonella enterica enterica serovar Typhi Ty2
gcuccgaauaauccuucccg

SEQ ID NO: 3723223 - RNA, 22 nt, Salmonella enterica enterica serovar Typhi Ty2
gcuccgagacucaaagaaaaca

SEQ ID NO: 3723224 - RNA, 12 nt, Salmonella enterica enterica serovar Typhi Ty2
gcuccgcacggu

SEQ ID NO: 3723225 - RNA, 22 nt, Salmonella enterica enterica serovar Typhi Ty2
gcuccgccagcaaugccgccgc

SEQ ID NO: 3723226 - RNA, 20 nt, Salmonella enterica enterica serovar Typhi Ty2
gcuccguucccucgacaauu

SEQ ID NO: 3723227 - RNA, 13 nt, Salmonella enterica enterica serovar Typhi Ty2
gcuccucgcgaau

SEQ ID NO: 3723228 - RNA, 13 nt, Salmonella enterica enterica serovar Typhi Ty2
gcuccugccagau

SEQ ID NO: 3723229 - RNA, 16 nt, Salmonella enterica enterica serovar Typhi Ty2
gcuccugcgccggacg

SEQ ID NO: 3723230 - RNA, 15 nt, Salmonella enterica enterica serovar Typhi Ty2
gcuccugcgggcuua

SEQ ID NO: 3723231 - RNA, 22 nt, Salmonella enterica enterica serovar Typhi Ty2
gcuccugcgguacggccagcgc

SEQ ID NO: 3723232 - RNA, 16 nt, Salmonella enterica enterica serovar Typhi Ty2
gcuccugguccguaac

SEQ ID NO: 3723233 - RNA, 17 nt, Salmonella enterica enterica serovar Typhi Ty2
gcuccugucaggcgagc

SEQ ID NO: 3723234 - RNA, 20 nt, Salmonella enterica enterica serovar Typhi Ty2
gcucgacguccagcgcguga

SEQ ID NO: 3723235 - RNA, 16 nt, Salmonella enterica enterica serovar Typhi Ty2
gcucgaguucuucacg

SEQ ID NO: 3723236 - RNA, 19 nt, Salmonella enterica enterica serovar Typhi Ty2
gcucgaucccgacccauac

SEQ ID NO: 3723237 - RNA, 18 nt, Salmonella enterica enterica serovar Typhi Ty2
gcucgcaggccauaaaac

SEQ ID NO: 3723238 - RNA, 13 nt, Salmonella enterica enterica serovar Typhi Ty2
gcucgccagcgcu

SEQ ID NO: 3723239 - RNA, 22 nt, Salmonella enterica enterica serovar Typhi Ty2
gcucgccagcgcugucagugaa

SEQ ID NO: 3723240 - RNA, 16 nt, Salmonella enterica enterica serovar Typhi Ty2
gcucgcccaucacuac

SEQ ID NO: 3723241 - RNA, 20 nt, Salmonella enterica enterica serovar Typhi Ty2
gcucgccgaccggcgcgccg

SEQ ID NO: 3723242 - RNA, 19 nt, Salmonella enterica enterica serovar Typhi Ty2
gcucgccguuuuuuaaccg

SEQ ID NO: 3723243 - RNA, 21 nt, Salmonella enterica enterica serovar Typhi Ty2
gcucgcgacgcagacccgcaa

SEQ ID NO: 3723244 - RNA, 23 nt, Salmonella enterica enterica serovar Typhi Ty2
gcucgcgauccucauacagcccg

SEQ ID NO: 3723245 - RNA, 23 nt, Salmonella enterica enterica serovar Typhi Ty2
gcucgcggcagauaucgcugacc

SEQ ID NO: 3723246 - RNA, 13 nt, Salmonella enterica enterica serovar Typhi Ty2
gcucgcggcggac

SEQ ID NO: 3723247 - RNA, 18 nt, Salmonella enterica enterica serovar Typhi Ty2
gcucgcuaccuuuuuuca

SEQ ID NO: 3723248 - RNA, 21 nt, Salmonella enterica enterica serovar Typhi Ty2
gcucgcucaucaguuugcgau

SEQ ID NO: 3723249 - RNA, 21 nt, Salmonella enterica enterica serovar Typhi Ty2
gcucgcuguagcgccaaccgg

SEQ ID NO: 3723250 - RNA, 19 nt, Salmonella enterica enterica serovar Typhi Ty2
gcucgcuuacgcggcgcgc

SEQ ID NO: 3723251 - RNA, 15 nt, Salmonella enterica enterica serovar Typhi Ty2
gcucgcuuugccgcc

SEQ ID NO: 3723252 - RNA, 17 nt, Salmonella enterica enterica serovar Typhi Ty2
gcucggccaucuggcgu

SEQ ID NO: 3723253 - RNA, 15 nt, Salmonella enterica enterica serovar Typhi Ty2
gcucgguaaaaaguu

SEQ ID NO: 3723254 - RNA, 13 nt, Salmonella enterica enterica serovar Typhi Ty2
gcucgguggcggu

SEQ ID NO: 3723255 - RNA, 23 nt, Salmonella enterica enterica serovar Typhi Ty2
gcucgucaaacaguucagacacc

SEQ ID NO: 3723256 - RNA, 14 nt, Salmonella enterica enterica serovar Typhi Ty2
gcucgucggcggaa

SEQ ID NO: 3723257 - RNA, 14 nt, Salmonella enterica enterica serovar Typhi Ty2
gcucuaaaaaggaa

SEQ ID NO: 3723258 - RNA, 14 nt, Salmonella enterica enterica serovar Typhi Ty2
gcucuaucaccgcc

SEQ ID NO: 3723259 - RNA, 20 nt, Salmonella enterica enterica serovar Typhi Ty2
gcucuaucgccgcccgcaug

SEQ ID NO: 3723260 - RNA, 14 nt, Salmonella enterica enterica serovar Typhi Ty2
gcucuauuccaacu

SEQ ID NO: 3723261 - RNA, 16 nt, Salmonella enterica enterica serovar Typhi Ty2
gcucucccagcugagc

SEQ ID NO: 3723262 - RNA, 19 nt, Salmonella enterica enterica serovar Typhi Ty2
gcucucccagcugagcuaa

SEQ ID NO: 3723263 - RNA, 22 nt, Salmonella enterica enterica serovar Typhi Ty2
gcucuccggcacauucaccacg

SEQ ID NO: 3723264 - RNA, 22 nt, Salmonella enterica enterica serovar Typhi Ty2
gcucuccuccaaagguauggag

SEQ ID NO: 3723265 - RNA, 16 nt, Salmonella enterica enterica serovar Typhi Ty2
gcucuccuggcauggc

SEQ ID NO: 3723266 - RNA, 20 nt, Salmonella enterica enterica serovar Typhi Ty2
gcucucucaaacuauuuuua

SEQ ID NO: 3723267 - RNA, 21 nt, Salmonella enterica enterica serovar Typhi Ty2
gcucucuucgugacccgccag

SEQ ID NO: 3723268 - RNA, 19 nt, Salmonella enterica enterica serovar Typhi Ty2
gcucucuuucaccagcgcc

SEQ ID NO: 3723269 - RNA, 19 nt, Salmonella enterica enterica serovar Typhi Ty2
gcucugccaguagcugcuc

SEQ ID NO: 3723270 - RNA, 15 nt, Salmonella enterica enterica serovar Typhi Ty2
gcucugcuguuccuu

SEQ ID NO: 3723271 - RNA, 23 nt, Salmonella enterica enterica serovar Typhi Ty2
gcucuguggggggaacggcagac

SEQ ID NO: 3723272 - RNA, 17 nt, Salmonella enterica enterica serovar Typhi Ty2
gcucuucuucgcucucg

SEQ ID NO: 3723273 - RNA, 16 nt, Salmonella enterica enterica serovar Typhi Ty2
gcucuuuacauaaugu

SEQ ID NO: 3723274 - RNA, 13 nt, Salmonella enterica enterica serovar Typhi Ty2
gcucuuucaacug

SEQ ID NO: 3723275 - RNA, 16 nt, Salmonella enterica enterica serovar Typhi Ty2
gcucuuuucaggcgcu

SEQ ID NO: 3723276 - RNA, 18 nt, Salmonella enterica enterica serovar Typhi Ty2
gcucuuuuccacggcgcu

SEQ ID NO: 3723277 - RNA, 19 nt, Salmonella enterica enterica serovar Typhi Ty2
gcugaaaaucaaaucggcg

SEQ ID NO: 3723278 - RNA, 17 nt, Salmonella enterica enterica serovar Typhi Ty2
gcugaaauuuccgcuuc

SEQ ID NO: 3723279 - RNA, 11 nt, Salmonella enterica enterica serovar Typhi Ty2
gcugaaccacc

SEQ ID NO: 3723280 - RNA, 22 nt, Salmonella enterica enterica serovar Typhi Ty2
gcugaagccugcuucaccgcgc

SEQ ID NO: 3723281 - RNA, 18 nt, Salmonella enterica enterica serovar Typhi Ty2
gcugaagcuugaaccggg

SEQ ID NO: 3723282 - RNA, 12 nt, Salmonella enterica enterica serovar Typhi Ty2
gcugaauaaccc

SEQ ID NO: 3723283 - RNA, 13 nt, Salmonella enterica enterica serovar Typhi Ty2
gcugaauaacccc

SEQ ID NO: 3723284 - RNA, 19 nt, Salmonella enterica enterica serovar Typhi Ty2
gcugaauaaugccuuccug

SEQ ID NO: 3723285 - RNA, 17 nt, Salmonella enterica enterica serovar Typhi Ty2
gcugaauagccagcccc

SEQ ID NO: 3723286 - RNA, 12 nt, Salmonella enterica enterica serovar Typhi Ty2
gcugaauguucu

SEQ ID NO: 3723287 - RNA, 23 nt, Salmonella enterica enterica serovar Typhi Ty2
gcugacaacacauccgcagcgaa

SEQ ID NO: 3723288 - RNA, 16 nt, Salmonella enterica enterica serovar Typhi Ty2
gcugacaaucagcaca

SEQ ID NO: 3723289 - RNA, 17 nt, Salmonella enterica enterica serovar Typhi Ty2
gcugccuuauccggccu

SEQ ID NO: 3723290 - RNA, 13 nt, Salmonella enterica enterica serovar Typhi Ty2
gcugcgacaacaa

SEQ ID NO: 3723291 - RNA, 15 nt, Salmonella enterica enterica serovar Typhi Ty2
gcugcgacagcgaac

SEQ ID NO: 3723292 - RNA, 13 nt, Salmonella enterica enterica serovar Typhi Ty2
gcugcgcauccgc

SEQ ID NO: 3723293 - RNA, 15 nt, Salmonella enterica enterica serovar Typhi Ty2
gcugcgcauccgcgg

SEQ ID NO: 3723294 - RNA, 12 nt, Salmonella enterica enterica serovar Typhi Ty2
gcugcgccgcgc

SEQ ID NO: 3723295 - RNA, 22 nt, Salmonella enterica enterica serovar Typhi Ty2
gcugcgccugaaaggcacgcuc

SEQ ID NO: 3723296 - RNA, 17 nt, Salmonella enterica enterica serovar Typhi Ty2
gcugcgccuuauccggc

SEQ ID NO: 3723297 - RNA, 18 nt, Salmonella enterica enterica serovar Typhi Ty2
gcugcgccuuauccggcg

SEQ ID NO: 3723298 - RNA, 17 nt, Salmonella enterica enterica serovar Typhi Ty2
gcugcgcuuaucaggcc

SEQ ID NO: 3723299 - RNA, 19 nt, Salmonella enterica enterica serovar Typhi Ty2
gcugcgcuuaucaggccua

SEQ ID NO: 3723300 - RNA, 20 nt, Salmonella enterica enterica serovar Typhi Ty2
gcugcgcuuaucaggccuac

SEQ ID NO: 3723301 - RNA, 17 nt, Salmonella enterica enterica serovar Typhi Ty2
gcugcgcuuauccgcuc

SEQ ID NO: 3723302 - RNA, 16 nt, Salmonella enterica enterica serovar Typhi Ty2
gcugcgcuuauccggc

SEQ ID NO: 3723303 - RNA, 11 nt, Salmonella enterica enterica serovar Typhi Ty2
gcugcggauga

SEQ ID NO: 3723304 - RNA, 23 nt, Salmonella enterica enterica serovar Typhi Ty2
gcugcggcguuccccaauguuca

SEQ ID NO: 3723305 - RNA, 17 nt, Salmonella enterica enterica serovar Typhi Ty2
gcugcgguuuacgccau

SEQ ID NO: 3723306 - RNA, 23 nt, Salmonella enterica enterica serovar Typhi Ty2
gcugcgucacgcguucgaccguu

SEQ ID NO: 3723307 - RNA, 14 nt, Salmonella enterica enterica serovar Typhi Ty2
gcugcgucagcgcu

SEQ ID NO: 3723308 - RNA, 17 nt, Salmonella enterica enterica serovar Typhi Ty2
gcugcuauuuugcgcuu

SEQ ID NO: 3723309 - RNA, 21 nt, Salmonella enterica enterica serovar Typhi Ty2
gcugcucauuuaugcgcuggg

SEQ ID NO: 3723310 - RNA, 12 nt, Salmonella enterica enterica serovar Typhi Ty2
gcugcucccuca

SEQ ID NO: 3723311 - RNA, 18 nt, Salmonella enterica enterica serovar Typhi Ty2
gcugcucggguaaggcau

SEQ ID NO: 3723312 - RNA, 13 nt, Salmonella enterica enterica serovar Typhi Ty2
gcugcucuccuug

SEQ ID NO: 3723313 - RNA, 22 nt, Salmonella enterica enterica serovar Typhi Ty2
gcugcugaccuuaauccagcag

SEQ ID NO: 3723314 - RNA, 23 nt, Salmonella enterica enterica serovar Typhi Ty2
gcugcugaccuuaauccagcagu

SEQ ID NO: 3723315 - RNA, 11 nt, Salmonella enterica enterica serovar Typhi Ty2
gcugcugaugg

SEQ ID NO: 3723316 - RNA, 19 nt, Salmonella enterica enterica serovar Typhi Ty2
gcugcuggccuuccagaua

SEQ ID NO: 3723317 - RNA, 21 nt, Salmonella enterica enterica serovar Typhi Ty2
gcugcuggcgagcaggaaaag

SEQ ID NO: 3723318 - RNA, 22 nt, Salmonella enterica enterica serovar Typhi Ty2
gcugcuguaacagacgcaggcc

SEQ ID NO: 3723319 - RNA, 21 nt, Salmonella enterica enterica serovar Typhi Ty2
gcugcuguuuuugaaaaugug

SEQ ID NO: 3723320 - RNA, 22 nt, Salmonella enterica enterica serovar Typhi Ty2
gcugcuugcuuuucaucaccau

SEQ ID NO: 3723321 - RNA, 19 nt, Salmonella enterica enterica serovar Typhi Ty2
gcugcuuuuugagcggcac

SEQ ID NO: 3723322 - RNA, 19 nt, Salmonella enterica enterica serovar Typhi Ty2
gcuggacauguuccgcccc

SEQ ID NO: 3723323 - RNA, 23 nt, Salmonella enterica enterica serovar Typhi Ty2
gcuggacauguuccgccccgccu

SEQ ID NO: 3723324 - RNA, 21 nt, Salmonella enterica enterica serovar Typhi Ty2
gcuggagccuguuccagcugc

SEQ ID NO: 3723325 - RNA, 20 nt, Salmonella enterica enterica serovar Typhi Ty2
gcuggauaauugcucugcca

SEQ ID NO: 3723326 - RNA, 16 nt, Salmonella enterica enterica serovar Typhi Ty2
gcuggauaccgcgcca

SEQ ID NO: 3723327 - RNA, 15 nt, Salmonella enterica enterica serovar Typhi Ty2
gcuggaugcgcaaau

SEQ ID NO: 3723328 - RNA, 18 nt, Salmonella enterica enterica serovar Typhi Ty2
gcuggcaaaacgcaucca

SEQ ID NO: 3723329 - RNA, 20 nt, Salmonella enterica enterica serovar Typhi Ty2
gcuggcaaaacgcauccagc

SEQ ID NO: 3723330 - RNA, 20 nt, Salmonella enterica enterica serovar Typhi Ty2
gcuggcacgcgaugucggga

SEQ ID NO: 3723331 - RNA, 15 nt, Salmonella enterica enterica serovar Typhi Ty2
gcuggcacguucucg

SEQ ID NO: 3723332 - RNA, 14 nt, Salmonella enterica enterica serovar Typhi Ty2
gcuggcacuggcag

SEQ ID NO: 3723333 - RNA, 14 nt, Salmonella enterica enterica serovar Typhi Ty2
gcuggcagcggcug

SEQ ID NO: 3723334 - RNA, 14 nt, Salmonella enterica enterica serovar Typhi Ty2
gcuggcagggggag

SEQ ID NO: 3723335 - RNA, 18 nt, Salmonella enterica enterica serovar Typhi Ty2
gcuggcaguuugcgcuga

SEQ ID NO: 3723336 - RNA, 16 nt, Salmonella enterica enterica serovar Typhi Ty2
gcuggcauaaccgcag

SEQ ID NO: 3723337 - RNA, 20 nt, Salmonella enterica enterica serovar Typhi Ty2
gcuggcauaaccgcagcgcg

SEQ ID NO: 3723338 - RNA, 19 nt, Salmonella enterica enterica serovar Typhi Ty2
gcuggccaaacugcggaau

SEQ ID NO: 3723339 - RNA, 15 nt, Salmonella enterica enterica serovar Typhi Ty2
gcuggccgucaugga

SEQ ID NO: 3723340 - RNA, 20 nt, Salmonella enterica enterica serovar Typhi Ty2
gcuggccuaucuguucgcag

SEQ ID NO: 3723341 - RNA, 16 nt, Salmonella enterica enterica serovar Typhi Ty2
gcuggccuucuccacu

SEQ ID NO: 3723342 - RNA, 17 nt, Salmonella enterica enterica serovar Typhi Ty2
gcuggcgaaccaccagc

SEQ ID NO: 3723343 - RNA, 16 nt, Salmonella enterica enterica serovar Typhi Ty2
gcuggcgaauccggga

SEQ ID NO: 3723344 - RNA, 15 nt, Salmonella enterica enterica serovar Typhi Ty2
gcuggcgaaucgcau

SEQ ID NO: 3723345 - RNA, 15 nt, Salmonella enterica enterica serovar Typhi Ty2
gcuggcgacggcggu

SEQ ID NO: 3723346 - RNA, 17 nt, Salmonella enterica enterica serovar Typhi Ty2
gcuggcgauauccgugc

SEQ ID NO: 3723347 - RNA, 23 nt, Salmonella enterica enterica serovar Typhi Ty2
gcuggcgauauccgugccgccgc

SEQ ID NO: 3723348 - RNA, 15 nt, Salmonella enterica enterica serovar Typhi Ty2
gcuggcgcaacuggc

SEQ ID NO: 3723349 - RNA, 13 nt, Salmonella enterica enterica serovar Typhi Ty2
gcuggcgccgcaa

SEQ ID NO: 3723350 - RNA, 12 nt, Salmonella enterica enterica serovar Typhi Ty2
gcuggcgcgcua

SEQ ID NO: 3723351 - RNA, 19 nt, Salmonella enterica enterica serovar Typhi Ty2
gcuggcgcggggaacacuc

SEQ ID NO: 3723352 - RNA, 18 nt, Salmonella enterica enterica serovar Typhi Ty2
gcuggcgcugacgacacu

SEQ ID NO: 3723353 - RNA, 14 nt, Salmonella enterica enterica serovar Typhi Ty2
gcuggcgcuguccu

SEQ ID NO: 3723354 - RNA, 19 nt, Salmonella enterica enterica serovar Typhi Ty2
gcuggcgggguucgggcag

SEQ ID NO: 3723355 - RNA, 14 nt, Salmonella enterica enterica serovar Typhi Ty2
gcuggcggucggga

SEQ ID NO: 3723356 - RNA, 20 nt, Salmonella enterica enterica serovar Typhi Ty2
gcuggcggucgggaacgcug

SEQ ID NO: 3723357 - RNA, 15 nt, Salmonella enterica enterica serovar Typhi Ty2
gcuggcguacgccau

SEQ ID NO: 3723358 - RNA, 21 nt, Salmonella enterica enterica serovar Typhi Ty2
gcuggcgucuguccggcgcuc

SEQ ID NO: 3723359 - RNA, 10 nt, Salmonella enterica enterica serovar Typhi Ty2
gcuggcuggc

SEQ ID NO: 3723360 - RNA, 15 nt, Salmonella enterica enterica serovar Typhi Ty2
gcuggcuggcguuga

SEQ ID NO: 3723361 - RNA, 15 nt, Salmonella enterica enterica serovar Typhi Ty2
gcuggcuuaacucac

SEQ ID NO: 3723362 - RNA, 17 nt, Salmonella enterica enterica serovar Typhi Ty2
gcugggauauuacagau

SEQ ID NO: 3723363 - RNA, 17 nt, Salmonella enterica enterica serovar Typhi Ty2
gcugggaugaccugaaa

SEQ ID NO: 3723364 - RNA, 16 nt, Salmonella enterica enterica serovar Typhi Ty2
gcugggccgggccuga

SEQ ID NO: 3723365 - RNA, 15 nt, Salmonella enterica enterica serovar Typhi Ty2
gcugggccugcuccg

SEQ ID NO: 3723366 - RNA, 14 nt, Salmonella enterica enterica serovar Typhi Ty2
gcugggcgaggcca

SEQ ID NO: 3723367 - RNA, 22 nt, Salmonella enterica enterica serovar Typhi Ty2
gcugggcuuuauccugaccgcu

SEQ ID NO: 3723368 - RNA, 23 nt, Salmonella enterica enterica serovar Typhi Ty2
gcuggggcgcguuucauuaagcc

SEQ ID NO: 3723369 - RNA, 17 nt, Salmonella enterica enterica serovar Typhi Ty2
gcuggguuaacgcgcca

SEQ ID NO: 3723370 - RNA, 20 nt, Salmonella enterica enterica serovar Typhi Ty2
gcuggguugauaccggagga

SEQ ID NO: 3723371 - RNA, 23 nt, Salmonella enterica enterica serovar Typhi Ty2
gcuuaacccugccguuugcgcca

SEQ ID NO: 3723372 - RNA, 19 nt, Salmonella enterica enterica serovar Typhi Ty2
gcuuaagcuuugcaccacu

SEQ ID NO: 3723373 - RNA, 21 nt, Salmonella enterica enterica serovar Typhi Ty2
gcuuaauaauaagcggccuau

SEQ ID NO: 3723374 - RNA, 21 nt, Salmonella enterica enterica serovar Typhi Ty2
gcuuaauacgcagaucuuuuu

SEQ ID NO: 3723375 - RNA, 21 nt, Salmonella enterica enterica serovar Typhi Ty2
gcuuaaucaccagcgcauuga

SEQ ID NO: 3723376 - RNA, 16 nt, Salmonella enterica enterica serovar Typhi Ty2
gcuuaaucgagagcgg

SEQ ID NO: 3723377 - RNA, 18 nt, Salmonella enterica enterica serovar Typhi Ty2
gcuuaauggcgucaauca

SEQ ID NO: 3723378 - RNA, 15 nt, Salmonella enterica enterica serovar Typhi Ty2
gcuuacaauuuaucu

SEQ ID NO: 3723379 - RNA, 17 nt, Salmonella enterica enterica serovar Typhi Ty2
gcuuacaauuuaucugc

SEQ ID NO: 3723380 - RNA, 18 nt, Salmonella enterica enterica serovar Typhi Ty2
gcuuacaauuuaucugcg

SEQ ID NO: 3723381 - RNA, 18 nt, Salmonella enterica enterica serovar Typhi Ty2
gcuuacacagacugcuug

SEQ ID NO: 3723382 - RNA, 17 nt, Salmonella enterica enterica serovar Typhi Ty2
gcuuacaggcacgccug

SEQ ID NO: 3723383 - RNA, 20 nt, Salmonella enterica enterica serovar Typhi Ty2
gcuuacaucgccauccggca

SEQ ID NO: 3723384 - RNA, 22 nt, Salmonella enterica enterica serovar Typhi Ty2
gcuuacauuucaggcaaaaaaa

SEQ ID NO: 3723385 - RNA, 13 nt, Salmonella enterica enterica serovar Typhi Ty2
gcuuaccagaccg

SEQ ID NO: 3723386 - RNA, 14 nt, Salmonella enterica enterica serovar Typhi Ty2
gcuuaccagaccgg

SEQ ID NO: 3723387 - RNA, 13 nt, Salmonella enterica enterica serovar Typhi Ty2
gcuuacccagucu

SEQ ID NO: 3723388 - RNA, 17 nt, Salmonella enterica enterica serovar Typhi Ty2
gcuuaccgggccugcgu

SEQ ID NO: 3723389 - RNA, 20 nt, Salmonella enterica enterica serovar Typhi Ty2
gcuuacgcuuacccggccua

SEQ ID NO: 3723390 - RNA, 15 nt, Salmonella enterica enterica serovar Typhi Ty2
gcuuacggccaugga

SEQ ID NO: 3723391 - RNA, 23 nt, Salmonella enterica enterica serovar Typhi Ty2
gcuuacggccauggaacauccuc

SEQ ID NO: 3723392 - RNA, 15 nt, Salmonella enterica enterica serovar Typhi Ty2
gcuuacggcuauucc

SEQ ID NO: 3723393 - RNA, 21 nt, Salmonella enterica enterica serovar Typhi Ty2
gcuuacuuuccaaaauccagg

SEQ ID NO: 3723394 - RNA, 16 nt, Salmonella enterica enterica serovar Typhi Ty2
gcuuacuuuuagaauu

SEQ ID NO: 3723395 - RNA, 21 nt, Salmonella enterica enterica serovar Typhi Ty2
gcuuacuuuuagaauuaucug

SEQ ID NO: 3723396 - RNA, 22 nt, Salmonella enterica enterica serovar Typhi Ty2
gcuuagaacucacgcucaagau

SEQ ID NO: 3723397 - RNA, 21 nt, Salmonella enterica enterica serovar Typhi Ty2
gcuuagaucguaucggcuggc

SEQ ID NO: 3723398 - RNA, 14 nt, Salmonella enterica enterica serovar Typhi Ty2
gcuuagcgccagau

SEQ ID NO: 3723399 - RNA, 17 nt, Salmonella enterica enterica serovar Typhi Ty2
gcuuagcucaucagccu

SEQ ID NO: 3723400 - RNA, 22 nt, Salmonella enterica enterica serovar Typhi Ty2
gcuuagcuguaauucaugcugu

SEQ ID NO: 3723401 - RNA, 12 nt, Salmonella enterica enterica serovar Typhi Ty2
gcuuagcuuccc

SEQ ID NO: 3723402 - RNA, 17 nt, Salmonella enterica enterica serovar Typhi Ty2
gcuuaggauucgccauu

SEQ ID NO: 3723403 - RNA, 16 nt, Salmonella enterica enterica serovar Typhi Ty2
gcuuaguaaccccagg

SEQ ID NO: 3723404 - RNA, 18 nt, Salmonella enterica enterica serovar Typhi Ty2
gcuuauaacccugucugc

SEQ ID NO: 3723405 - RNA, 18 nt, Salmonella enterica enterica serovar Typhi Ty2
gcuuaucaggccuacaau

SEQ ID NO: 3723406 - RNA, 22 nt, Salmonella enterica enterica serovar Typhi Ty2
gcuuaucaggccuacauuuuua

SEQ ID NO: 3723407 - RNA, 18 nt, Salmonella enterica enterica serovar Typhi Ty2
gcuuaucaggccuaccag

SEQ ID NO: 3723408 - RNA, 17 nt, Salmonella enterica enterica serovar Typhi Ty2
gcuuaucaggccuacgc

SEQ ID NO: 3723409 - RNA, 21 nt, Salmonella enterica enterica serovar Typhi Ty2
gcuuaucaguccccacauuac

SEQ ID NO: 3723410 - RNA, 12 nt, Salmonella enterica enterica serovar Typhi Ty2
gcuuauccggcc

SEQ ID NO: 3723411 - RNA, 16 nt, Salmonella enterica enterica serovar Typhi Ty2
gcuuauccggccuaca

SEQ ID NO: 3723412 - RNA, 17 nt, Salmonella enterica enterica serovar Typhi Ty2
gcuuauccggccuacag

SEQ ID NO: 3723413 - RNA, 18 nt, Salmonella enterica enterica serovar Typhi Ty2
gcuuauccggccuacaga

SEQ ID NO: 3723414 - RNA, 16 nt, Salmonella enterica enterica serovar Typhi Ty2
gcuuauccggccuacg

SEQ ID NO: 3723415 - RNA, 17 nt, Salmonella enterica enterica serovar Typhi Ty2
gcuuauccggccuacga

SEQ ID NO: 3723416 - RNA, 19 nt, Salmonella enterica enterica serovar Typhi Ty2
gcuuauccggccuacgcuu

SEQ ID NO: 3723417 - RNA, 17 nt, Salmonella enterica enterica serovar Typhi Ty2
gcuuauccggccuacgg

SEQ ID NO: 3723418 - RNA, 18 nt, Salmonella enterica enterica serovar Typhi Ty2
gcuuauccggccugcaca

SEQ ID NO: 3723419 - RNA, 15 nt, Salmonella enterica enterica serovar Typhi Ty2
gcuuaucgauaucug

SEQ ID NO: 3723420 - RNA, 20 nt, Salmonella enterica enterica serovar Typhi Ty2
gcuuaucgauaucugccugc

SEQ ID NO: 3723421 - RNA, 23 nt, Salmonella enterica enterica serovar Typhi Ty2
gcuuaucgauaucugccugcaga

SEQ ID NO: 3723422 - RNA, 18 nt, Salmonella enterica enterica serovar Typhi Ty2
gcuuaucugaccaugcca

SEQ ID NO: 3723423 - RNA, 20 nt, Salmonella enterica enterica serovar Typhi Ty2
gcuuaucugaguaucgcuuu

SEQ ID NO: 3723424 - RNA, 21 nt, Salmonella enterica enterica serovar Typhi Ty2
gcuuaucugcugcuggguuga

SEQ ID NO: 3723425 - RNA, 21 nt, Salmonella enterica enterica serovar Typhi Ty2
gcuuauuagaggcguaaguaa

SEQ ID NO: 3723426 - RNA, 14 nt, Salmonella enterica enterica serovar Typhi Ty2
gcuucaacagcggc

SEQ ID NO: 3723427 - RNA, 14 nt, Salmonella enterica enterica serovar Typhi Ty2
gcuucaaccuccug

SEQ ID NO: 3723428 - RNA, 22 nt, Salmonella enterica enterica serovar Typhi Ty2
gcuucaauaaguuagcuuuuuu

SEQ ID NO: 3723429 - RNA, 21 nt, Salmonella enterica enterica serovar Typhi Ty2
gcuucaaucgucguuccgcca

SEQ ID NO: 3723430 - RNA, 18 nt, Salmonella enterica enterica serovar Typhi Ty2
gcuucaccgauuuaaaau

SEQ ID NO: 3723431 - RNA, 15 nt, Salmonella enterica enterica serovar Typhi Ty2
gcuucaccgccagag

SEQ ID NO: 3723432 - RNA, 16 nt, Salmonella enterica enterica serovar Typhi Ty2
gcuucaccgccagagc

SEQ ID NO: 3723433 - RNA, 19 nt, Salmonella enterica enterica serovar Typhi Ty2
gcuucaccgccagagcacg

SEQ ID NO: 3723434 - RNA, 20 nt, Salmonella enterica enterica serovar Typhi Ty2
gcuucaccggcgugcgcuua

SEQ ID NO: 3723435 - RNA, 19 nt, Salmonella enterica enterica serovar Typhi Ty2
gcuucacgaagcggguuuu

SEQ ID NO: 3723436 - RNA, 17 nt, Salmonella enterica enterica serovar Typhi Ty2
gcuucacgagcggucag

SEQ ID NO: 3723437 - RNA, 23 nt, Salmonella enterica enterica serovar Typhi Ty2
gcuucacgagcggucaggccagc

SEQ ID NO: 3723438 - RNA, 11 nt, Salmonella enterica enterica serovar Typhi Ty2
gcuucacgcca

SEQ ID NO: 3723439 - RNA, 14 nt, Salmonella enterica enterica serovar Typhi Ty2
gcuucacgccacag

SEQ ID NO: 3723440 - RNA, 22 nt, Salmonella enterica enterica serovar Typhi Ty2
gcuucacgcgcuguaacuucac

SEQ ID NO: 3723441 - RNA, 16 nt, Salmonella enterica enterica serovar Typhi Ty2
gcuucacgucagcgac

SEQ ID NO: 3723442 - RNA, 20 nt, Salmonella enterica enterica serovar Typhi Ty2
gcuucacgucagcgaccauu

SEQ ID NO: 3723443 - RNA, 18 nt, Salmonella enterica enterica serovar Typhi Ty2
gcuucacguuuuccaggu

SEQ ID NO: 3723444 - RNA, 21 nt, Salmonella enterica enterica serovar Typhi Ty2
gcuucagaaagcagguuuuga

SEQ ID NO: 3723445 - RNA, 22 nt, Salmonella enterica enterica serovar Typhi Ty2
gcuucagcaaacggcuggauaa

SEQ ID NO: 3723446 - RNA, 19 nt, Salmonella enterica enterica serovar Typhi Ty2
gcuucagccugugcaacca

SEQ ID NO: 3723447 - RNA, 12 nt, Salmonella enterica enterica serovar Typhi Ty2
gcuucagcgaca

SEQ ID NO: 3723448 - RNA, 16 nt, Salmonella enterica enterica serovar Typhi Ty2
gcuucagcggcgcguu

SEQ ID NO: 3723449 - RNA, 22 nt, Salmonella enterica enterica serovar Typhi Ty2
gcuucaggauuuacugagcgcc

SEQ ID NO: 3723450 - RNA, 21 nt, Salmonella enterica enterica serovar Typhi Ty2
gcuucaggcucaucagcgcca

SEQ ID NO: 3723451 - RNA, 17 nt, Salmonella enterica enterica serovar Typhi Ty2
gcuucaucaccaucgcc

SEQ ID NO: 3723452 - RNA, 17 nt, Salmonella enterica enterica serovar Typhi Ty2
gcuuuaauaccgguggc

SEQ ID NO: 3723453 - RNA, 14 nt, Salmonella enterica enterica serovar Typhi Ty2
gcuuuaauauucau

SEQ ID NO: 3723454 - RNA, 17 nt, Salmonella enterica enterica serovar Typhi Ty2
gcuuuaaucaccauggc

SEQ ID NO: 3723455 - RNA, 20 nt, Salmonella enterica enterica serovar Typhi Ty2
gcuuuaaucaguucauagcc

SEQ ID NO: 3723456 - RNA, 14 nt, Salmonella enterica enterica serovar Typhi Ty2
gcuuuacagcgacg

SEQ ID NO: 3723457 - RNA, 15 nt, Salmonella enterica enterica serovar Typhi Ty2
gcuuuaccgggccua

SEQ ID NO: 3723458 - RNA, 12 nt, Salmonella enterica enterica serovar Typhi Ty2
gcuuuagcuuua

SEQ ID NO: 3723459 - RNA, 15 nt, Salmonella enterica enterica serovar Typhi Ty2
gcuuuagggcuuccu

SEQ ID NO: 3723460 - RNA, 16 nt, Salmonella enterica enterica serovar Typhi Ty2
gcuuuaggguaucauu

SEQ ID NO: 3723461 - RNA, 22 nt, Salmonella enterica enterica serovar Typhi Ty2
gcuuuaugcagucgguagcuuu

SEQ ID NO: 3723462 - RNA, 16 nt, Salmonella enterica enterica serovar Typhi Ty2
gcuuuauucugucgcc

SEQ ID NO: 3723463 - RNA, 16 nt, Salmonella enterica enterica serovar Typhi Ty2
gcuuucaauaaaucaa

SEQ ID NO: 3723464 - RNA, 18 nt, Salmonella enterica enterica serovar Typhi Ty2
gcuuucacgccauuggca

SEQ ID NO: 3723465 - RNA, 17 nt, Salmonella enterica enterica serovar Typhi Ty2
gcuuucagauuagccag

SEQ ID NO: 3723466 - RNA, 19 nt, Salmonella enterica enterica serovar Typhi Ty2
gcuuucaguaauaauauaa

SEQ ID NO: 3723467 - RNA, 22 nt, Salmonella enterica enterica serovar Typhi Ty2
gcuuucaucauaucuucccgau

SEQ ID NO: 3723468 - RNA, 17 nt, Salmonella enterica enterica serovar Typhi Ty2
gcuuuccacguucccgg

SEQ ID NO: 3723469 - RNA, 17 nt, Salmonella enterica enterica serovar Typhi Ty2
gcuuuccagccaugcca

SEQ ID NO: 3723470 - RNA, 22 nt, Salmonella enterica enterica serovar Typhi Ty2
gcuuucccguuucagccccuug

SEQ ID NO: 3723471 - RNA, 13 nt, Salmonella enterica enterica serovar Typhi Ty2
gcuuuccgccaug

SEQ ID NO: 3723472 - RNA, 21 nt, Salmonella enterica enterica serovar Typhi Ty2
gcuuuccgccaugaaaaaaac

SEQ ID NO: 3723473 - RNA, 14 nt, Salmonella enterica enterica serovar Typhi Ty2
gcuuuccgccgccg

SEQ ID NO: 3723474 - RNA, 19 nt, Salmonella enterica enterica serovar Typhi Ty2
gcuuuccggcgcuuccugc

SEQ ID NO: 3723475 - RNA, 22 nt, Salmonella enterica enterica serovar Typhi Ty2
gcuuuccggcgcuuccugcagu

SEQ ID NO: 3723476 - RNA, 14 nt, Salmonella enterica enterica serovar Typhi Ty2
gcuuuccgggguga

SEQ ID NO: 3723477 - RNA, 19 nt, Salmonella enterica enterica serovar Typhi Ty2
gcuuuccguuaccucaaaa

SEQ ID NO: 3723478 - RNA, 12 nt, Salmonella enterica enterica serovar Typhi Ty2
gcuuucucaccc

SEQ ID NO: 3723479 - RNA, 20 nt, Salmonella enterica enterica serovar Typhi Ty2
gcuuucugaauuucacgcuu

SEQ ID NO: 3723480 - RNA, 15 nt, Salmonella enterica enterica serovar Typhi Ty2
gcuuucugagccgcc

SEQ ID NO: 3723481 - RNA, 13 nt, Salmonella enterica enterica serovar Typhi Ty2
gcuuucuggauga

SEQ ID NO: 3723482 - RNA, 14 nt, Salmonella enterica enterica serovar Typhi Ty2
gcuuucuguugaua

SEQ ID NO: 3723483 - RNA, 14 nt, Salmonella enterica enterica serovar Typhi Ty2
gcuuucuucguuag

SEQ ID NO: 3723484 - RNA, 14 nt, Salmonella enterica enterica serovar Typhi Ty2
gcuuucuucuucac

SEQ ID NO: 3723485 - RNA, 17 nt, Salmonella enterica enterica serovar Typhi Ty2
gcuuucuucuucacgac

SEQ ID NO: 3723486 - RNA, 19 nt, Salmonella enterica enterica serovar Typhi Ty2
gcuuugauauagggcuuga

SEQ ID NO: 3723487 - RNA, 15 nt, Salmonella enterica enterica serovar Typhi Ty2
gcuuugcgccacuuc

SEQ ID NO: 3723488 - RNA, 16 nt, Salmonella enterica enterica serovar Typhi Ty2
gcuuugcgccaucggg

SEQ ID NO: 3723489 - RNA, 17 nt, Salmonella enterica enterica serovar Typhi Ty2
gcuuugcuuauccggcc

SEQ ID NO: 3723490 - RNA, 18 nt, Salmonella enterica enterica serovar Typhi Ty2
gcuuugcuuauccggccu

SEQ ID NO: 3723491 - RNA, 14 nt, Salmonella enterica enterica serovar Typhi Ty2
gcuuuggcaggccu

SEQ ID NO: 3723492 - RNA, 22 nt, Salmonella enterica enterica serovar Typhi Ty2
gcuuuguagcauaaucaggccc

SEQ ID NO: 3723493 - RNA, 17 nt, Salmonella enterica enterica serovar Typhi Ty2
gcuuuuaaaacuucccg

SEQ ID NO: 3723494 - RNA, 23 nt, Salmonella enterica enterica serovar Typhi Ty2
gcuuuuaucggcgucgcggcaau

SEQ ID NO: 3723495 - RNA, 20 nt, Salmonella enterica enterica serovar Typhi Ty2
gcuuuuauguuacccagccu

SEQ ID NO: 3723496 - RNA, 12 nt, Salmonella enterica enterica serovar Typhi Ty2
gcuuuucaggcu

SEQ ID NO: 3723497 - RNA, 17 nt, Salmonella enterica enterica serovar Typhi Ty2
gcuuuucaugaaacucg

SEQ ID NO: 3723498 - RNA, 22 nt, Salmonella enterica enterica serovar Typhi Ty2
gcuuuucaugacgcucuccucc

SEQ ID NO: 3723499 - RNA, 21 nt, Salmonella enterica enterica serovar Typhi Ty2
gcuuuugaauuugaaggacug

SEQ ID NO: 3723500 - RNA, 15 nt, Salmonella enterica enterica serovar Typhi Ty2
gcuuuuggcgucguu

SEQ ID NO: 3723501 - RNA, 20 nt, Salmonella enterica enterica serovar Typhi Ty2
gcuuuugguuuuucaaccac

SEQ ID NO: 3723502 - RNA, 15 nt, Salmonella enterica enterica serovar Typhi Ty2
gcuuuuuaaauacug

SEQ ID NO: 3723503 - RNA, 18 nt, Salmonella enterica enterica serovar Typhi Ty2
gcuuuuuacucucuuucu

SEQ ID NO: 3723504 - RNA, 13 nt, Salmonella enterica enterica serovar Typhi Ty2
gcuuuuucaucau

SEQ ID NO: 3723505 - RNA, 17 nt, Salmonella enterica enterica serovar Typhi Ty2
gcuuuuuuauuguuucu

SEQ ID NO: 3723506 - RNA, 19 nt, Salmonella enterica enterica serovar Typhi Ty2
gcuuuuuucucugcuuucg

SEQ ID NO: 3723507 - RNA, 22 nt, Salmonella enterica enterica serovar Typhi Ty2
gcuuuuuucucugcuuucggug

SEQ ID NO: 3723508 - RNA, 13 nt, Salmonella enterica enterica serovar Typhi Ty2
ggaaaaaaagaau

SEQ ID NO: 3723509 - RNA, 14 nt, Salmonella enterica enterica serovar Typhi Ty2
ggaaaaaaagaaua

SEQ ID NO: 3723510 - RNA, 22 nt, Salmonella enterica enterica serovar Typhi Ty2
ggaaaaaagcgcccagcgccgg

SEQ ID NO: 3723511 - RNA, 23 nt, Salmonella enterica enterica serovar Typhi Ty2
ggaaaaaagcgcccagcgccgga

SEQ ID NO: 3723512 - RNA, 19 nt, Salmonella enterica enterica serovar Typhi Ty2
ggaaaaaaugggcuggaaa

SEQ ID NO: 3723513 - RNA, 13 nt, Salmonella enterica enterica serovar Typhi Ty2
ggaaaaauaagag

SEQ ID NO: 3723514 - RNA, 13 nt, Salmonella enterica enterica serovar Typhi Ty2
ggaaaacagcgcc

SEQ ID NO: 3723515 - RNA, 17 nt, Salmonella enterica enterica serovar Typhi Ty2
ggaaaacagcgccggca

SEQ ID NO: 3723516 - RNA, 16 nt, Salmonella enterica enterica serovar Typhi Ty2
ggaaaaccccaucccg

SEQ ID NO: 3723517 - RNA, 20 nt, Salmonella enterica enterica serovar Typhi Ty2
ggaaaacgcgcugauaccgu

SEQ ID NO: 3723518 - RNA, 22 nt, Salmonella enterica enterica serovar Typhi Ty2
ggaaaacggccagugaaauaaa

SEQ ID NO: 3723519 - RNA, 14 nt, Salmonella enterica enterica serovar Typhi Ty2
ggaaaacuccagca

SEQ ID NO: 3723520 - RNA, 15 nt, Salmonella enterica enterica serovar Typhi Ty2
ggaaaagcuguagca

SEQ ID NO: 3723521 - RNA, 13 nt, Salmonella enterica enterica serovar Typhi Ty2
ggaaaauaauaau

SEQ ID NO: 3723522 - RNA, 18 nt, Salmonella enterica enterica serovar Typhi Ty2
ggaaaauauucagcacau

SEQ ID NO: 3723523 - RNA, 22 nt, Salmonella enterica enterica serovar Typhi Ty2
ggaaaaugaugacucauuaaaa

SEQ ID NO: 3723524 - RNA, 16 nt, Salmonella enterica enterica serovar Typhi Ty2
ggaaacccgcucgccc

SEQ ID NO: 3723525 - RNA, 21 nt, Salmonella enterica enterica serovar Typhi Ty2
ggaaaccgucguuacccuccu

SEQ ID NO: 3723526 - RNA, 23 nt, Salmonella enterica enterica serovar Typhi Ty2
ggaaaccuuucuucucuucuuca

SEQ ID NO: 3723527 - RNA, 16 nt, Salmonella enterica enterica serovar Typhi Ty2
ggaaacgcgccggaag

SEQ ID NO: 3723528 - RNA, 16 nt, Salmonella enterica enterica serovar Typhi Ty2
ggaaacuccagcggca

SEQ ID NO: 3723529 - RNA, 24 nt, Salmonella enterica enterica serovar Typhi Ty2
ggaaagaaacgccgcgcaaagcaa

SEQ ID NO: 3723530 - RNA, 14 nt, Salmonella enterica enterica serovar Typhi Ty2
ggaaagccccuacc

SEQ ID NO: 3723531 - RNA, 22 nt, Salmonella enterica enterica serovar Typhi Ty2
ggaaagccccuaccgaggcagg

SEQ ID NO: 3723532 - RNA, 13 nt, Salmonella enterica enterica serovar Typhi Ty2
ggaaaggcagaga

SEQ ID NO: 3723533 - RNA, 21 nt, Salmonella enterica enterica serovar Typhi Ty2
ggaaaguaccaaaacagaaaa

SEQ ID NO: 3723534 - RNA, 21 nt, Salmonella enterica enterica serovar Typhi Ty2
ggacgccagucuuugcaggag

SEQ ID NO: 3723535 - RNA, 15 nt, Salmonella enterica enterica serovar Typhi Ty2
ggacgccguccaggc

SEQ ID NO: 3723536 - RNA, 13 nt, Salmonella enterica enterica serovar Typhi Ty2
ggacggcaucagg

SEQ ID NO: 3723537 - RNA, 21 nt, Salmonella enterica enterica serovar Typhi Ty2
ggacggcuaauaugccaggcu

SEQ ID NO: 3723538 - RNA, 19 nt, Salmonella enterica enterica serovar Typhi Ty2
ggacgggauacggcgagac

SEQ ID NO: 3723539 - RNA, 20 nt, Salmonella enterica enterica serovar Typhi Ty2
ggacggguauuacugauaaa

SEQ ID NO: 3723540 - RNA, 22 nt, Salmonella enterica enterica serovar Typhi Ty2
ggacguagggcugccaucaggc

SEQ ID NO: 3723541 - RNA, 13 nt, Salmonella enterica enterica serovar Typhi Ty2
ggacgucaugccg

SEQ ID NO: 3723542 - RNA, 17 nt, Salmonella enterica enterica serovar Typhi Ty2
ggacgucaugccgccac

SEQ ID NO: 3723543 - RNA, 21 nt, Salmonella enterica enterica serovar Typhi Ty2
ggacguggguuucaauauagc

SEQ ID NO: 3723544 - RNA, 17 nt, Salmonella enterica enterica serovar Typhi Ty2
ggacuauaggcaaugau

SEQ ID NO: 3723545 - RNA, 21 nt, Salmonella enterica enterica serovar Typhi Ty2
ggacucaccguuacaaauagc

SEQ ID NO: 3723546 - RNA, 12 nt, Salmonella enterica enterica serovar Typhi Ty2
ggacucaggccu

SEQ ID NO: 3723547 - RNA, 14 nt, Salmonella enterica enterica serovar Typhi Ty2
ggacuccaggcaac

SEQ ID NO: 3723548 - RNA, 18 nt, Salmonella enterica enterica serovar Typhi Ty2
ggacuccugacgcugaga

SEQ ID NO: 3723549 - RNA, 21 nt, Salmonella enterica enterica serovar Typhi Ty2
ggacuggagguacauugccag

SEQ ID NO: 3723550 - RNA, 13 nt, Salmonella enterica enterica serovar Typhi Ty2
ggacugggcugau

SEQ ID NO: 3723551 - RNA, 12 nt, Salmonella enterica enterica serovar Typhi Ty2
ggacuggugcau

SEQ ID NO: 3723552 - RNA, 20 nt, Salmonella enterica enterica serovar Typhi Ty2
ggacuuuaucuuuaccaggg

SEQ ID NO: 3723553 - RNA, 17 nt, Salmonella enterica enterica serovar Typhi Ty2
ggagaaaacgcggccug

SEQ ID NO: 3723554 - RNA, 21 nt, Salmonella enterica enterica serovar Typhi Ty2
ggagaaaacgcggccuggaag

SEQ ID NO: 3723555 - RNA, 14 nt, Salmonella enterica enterica serovar Typhi Ty2
ggagaacggcacaa

SEQ ID NO: 3723556 - RNA, 22 nt, Salmonella enterica enterica serovar Typhi Ty2
ggagaacgguucauccagcagc

SEQ ID NO: 3723557 - RNA, 21 nt, Salmonella enterica enterica serovar Typhi Ty2
ggagacggccacccaucccca

SEQ ID NO: 3723558 - RNA, 13 nt, Salmonella enterica enterica serovar Typhi Ty2
ggagagcaguccu

SEQ ID NO: 3723559 - RNA, 20 nt, Salmonella enterica enterica serovar Typhi Ty2
ggagagcggauaauccgcca

SEQ ID NO: 3723560 - RNA, 21 nt, Salmonella enterica enterica serovar Typhi Ty2
ggagagcggauaauccgccac

SEQ ID NO: 3723561 - RNA, 22 nt, Salmonella enterica enterica serovar Typhi Ty2
ggagagguuagcgcagggggga

SEQ ID NO: 3723562 - RNA, 13 nt, Salmonella enterica enterica serovar Typhi Ty2
ggagaguuuugcc

SEQ ID NO: 3723563 - RNA, 16 nt, Salmonella enterica enterica serovar Typhi Ty2
ggagauauggcgggga

SEQ ID NO: 3723564 - RNA, 13 nt, Salmonella enterica enterica serovar Typhi Ty2
ggagaucagcaug

SEQ ID NO: 3723565 - RNA, 17 nt, Salmonella enterica enterica serovar Typhi Ty2
ggagauuaacagcgcga

SEQ ID NO: 3723566 - RNA, 17 nt, Salmonella enterica enterica serovar Typhi Ty2
ggagauuucauccucuu

SEQ ID NO: 3723567 - RNA, 20 nt, Salmonella enterica enterica serovar Typhi Ty2
ggagcaaaauagcauucgcg

SEQ ID NO: 3723568 - RNA, 19 nt, Salmonella enterica enterica serovar Typhi Ty2
ggagcagacuguaaaucug

SEQ ID NO: 3723569 - RNA, 21 nt, Salmonella enterica enterica serovar Typhi Ty2
ggagccaguuuucgacauauu

SEQ ID NO: 3723570 - RNA, 11 nt, Salmonella enterica enterica serovar Typhi Ty2
ggagcccagua

SEQ ID NO: 3723571 - RNA, 18 nt, Salmonella enterica enterica serovar Typhi Ty2
ggagccgccuggccuguc

SEQ ID NO: 3723572 - RNA, 22 nt, Salmonella enterica enterica serovar Typhi Ty2
ggagcgugcucauuugcggcgu

SEQ ID NO: 3723573 - RNA, 15 nt, Salmonella enterica enterica serovar Typhi Ty2
ggaggcagugaaauc

SEQ ID NO: 3723574 - RNA, 16 nt, Salmonella enterica enterica serovar Typhi Ty2
ggaggcgcguuuacug

SEQ ID NO: 3723575 - RNA, 19 nt, Salmonella enterica enterica serovar Typhi Ty2
ggagggguuuucgccagca

SEQ ID NO: 3723576 - RNA, 19 nt, Salmonella enterica enterica serovar Typhi Ty2
ggagguauccuccugccag

SEQ ID NO: 3723577 - RNA, 23 nt, Salmonella enterica enterica serovar Typhi Ty2
ggagguauccuccugccaggcgc

SEQ ID NO: 3723578 - RNA, 14 nt, Salmonella enterica enterica serovar Typhi Ty2
ggaggugcucuccc

SEQ ID NO: 3723579 - RNA, 23 nt, Salmonella enterica enterica serovar Typhi Ty2
ggaggugcugguggugggcggca

SEQ ID NO: 3723580 - RNA, 14 nt, Salmonella enterica enterica serovar Typhi Ty2
ggagguucaccacc

SEQ ID NO: 3723581 - RNA, 22 nt, Salmonella enterica enterica serovar Typhi Ty2
ggagguucaccaccacccagug

SEQ ID NO: 3723582 - RNA, 22 nt, Salmonella enterica enterica serovar Typhi Ty2
ggagucaugaaugucauugccg

SEQ ID NO: 3723583 - RNA, 13 nt, Salmonella enterica enterica serovar Typhi Ty2
ggagucugaaaau

SEQ ID NO: 3723584 - RNA, 13 nt, Salmonella enterica enterica serovar Typhi Ty2
ggagugcgcggcg

SEQ ID NO: 3723585 - RNA, 20 nt, Salmonella enterica enterica serovar Typhi Ty2
ggaguggguaccucaugccg

SEQ ID NO: 3723586 - RNA, 15 nt, Salmonella enterica enterica serovar Typhi Ty2
ggauaaaaucgccaa

SEQ ID NO: 3723587 - RNA, 23 nt, Salmonella enterica enterica serovar Typhi Ty2
ggauaaagccaauggugcucagc

SEQ ID NO: 3723588 - RNA, 16 nt, Salmonella enterica enterica serovar Typhi Ty2
ggauaaccuucgggca

SEQ ID NO: 3723589 - RNA, 21 nt, Salmonella enterica enterica serovar Typhi Ty2
ggauaaccuuuaacagauggc

SEQ ID NO: 3723590 - RNA, 15 nt, Salmonella enterica enterica serovar Typhi Ty2
ggauaacggcgcaaa

SEQ ID NO: 3723591 - RNA, 19 nt, Salmonella enterica enterica serovar Typhi Ty2
ggauaacggcgcaaagaca

SEQ ID NO: 3723592 - RNA, 17 nt, Salmonella enterica enterica serovar Typhi Ty2
ggauaacguucuuuuga

SEQ ID NO: 3723593 - RNA, 20 nt, Salmonella enterica enterica serovar Typhi Ty2
ggauaagauagcaggcgauu

SEQ ID NO: 3723594 - RNA, 18 nt, Salmonella enterica enterica serovar Typhi Ty2
ggauaagcaacgcgccau

SEQ ID NO: 3723595 - RNA, 19 nt, Salmonella enterica enterica serovar Typhi Ty2
ggauaagcauuagcgccau

SEQ ID NO: 3723596 - RNA, 19 nt, Salmonella enterica enterica serovar Typhi Ty2
ggauaagcccggcggaggc

SEQ ID NO: 3723597 - RNA, 21 nt, Salmonella enterica enterica serovar Typhi Ty2
ggauaagcgaugcgcggaugc

SEQ ID NO: 3723598 - RNA, 13 nt, Salmonella enterica enterica serovar Typhi Ty2
ggauaagcguagc

SEQ ID NO: 3723599 - RNA, 23 nt, Salmonella enterica enterica serovar Typhi Ty2
ggauaaggcauuuaugccgccau

SEQ ID NO: 3723600 - RNA, 22 nt, Salmonella enterica enterica serovar Typhi Ty2
ggauaaggcauuucgccgccau

SEQ ID NO: 3723601 - RNA, 21 nt, Salmonella enterica enterica serovar Typhi Ty2
ggauaaggccacgccgccauc

SEQ ID NO: 3723602 - RNA, 20 nt, Salmonella enterica enterica serovar Typhi Ty2
ggauaaggcgcuugcgccau

SEQ ID NO: 3723603 - RNA, 20 nt, Salmonella enterica enterica serovar Typhi Ty2
ggauaaggcggagccgccau

SEQ ID NO: 3723604 - RNA, 15 nt, Salmonella enterica enterica serovar Typhi Ty2
ggauaaggcgugagc

SEQ ID NO: 3723605 - RNA, 17 nt, Salmonella enterica enterica serovar Typhi Ty2
ggauaaggcguuuacgc

SEQ ID NO: 3723606 - RNA, 20 nt, Salmonella enterica enterica serovar Typhi Ty2
ggauaaggcguuuacgcugc

SEQ ID NO: 3723607 - RNA, 17 nt, Salmonella enterica enterica serovar Typhi Ty2
ggauaagguguuuacgc

SEQ ID NO: 3723608 - RNA, 16 nt, Salmonella enterica enterica serovar Typhi Ty2
ggauaauccgccacuu

SEQ ID NO: 3723609 - RNA, 14 nt, Salmonella enterica enterica serovar Typhi Ty2
ggauacagcgccgc

SEQ ID NO: 3723610 - RNA, 16 nt, Salmonella enterica enterica serovar Typhi Ty2
ggauacccagccacau

SEQ ID NO: 3723611 - RNA, 15 nt, Salmonella enterica enterica serovar Typhi Ty2
ggauaccgcgccagc

SEQ ID NO: 3723612 - RNA, 15 nt, Salmonella enterica enterica serovar Typhi Ty2
ggauacguucauccu

SEQ ID NO: 3723613 - RNA, 18 nt, Salmonella enterica enterica serovar Typhi Ty2
ggauacguucauccuccu

SEQ ID NO: 3723614 - RNA, 23 nt, Salmonella enterica enterica serovar Typhi Ty2
ggauacguuccagcagcgcauca

SEQ ID NO: 3723615 - RNA, 17 nt, Salmonella enterica enterica serovar Typhi Ty2
ggauagagaucuuccgc

SEQ ID NO: 3723616 - RNA, 23 nt, Salmonella enterica enterica serovar Typhi Ty2
ggcaacagccauuuuaaaaauau

SEQ ID NO: 3723617 - RNA, 14 nt, Salmonella enterica enterica serovar Typhi Ty2
ggcaacauaaauaa

SEQ ID NO: 3723618 - RNA, 16 nt, Salmonella enterica enterica serovar Typhi Ty2
ggcaaccaccagcagu

SEQ ID NO: 3723619 - RNA, 19 nt, Salmonella enterica enterica serovar Typhi Ty2
ggcaacccuuuggccacca

SEQ ID NO: 3723620 - RNA, 17 nt, Salmonella enterica enterica serovar Typhi Ty2
ggcaaccuucgacgagg

SEQ ID NO: 3723621 - RNA, 18 nt, Salmonella enterica enterica serovar Typhi Ty2
ggcaacgacccgaagggc

SEQ ID NO: 3723622 - RNA, 13 nt, Salmonella enterica enterica serovar Typhi Ty2
ggcaacgccagag

SEQ ID NO: 3723623 - RNA, 20 nt, Salmonella enterica enterica serovar Typhi Ty2
ggcaacgccagagcgucuca

SEQ ID NO: 3723624 - RNA, 16 nt, Salmonella enterica enterica serovar Typhi Ty2
ggcaacgccgccagcu

SEQ ID NO: 3723625 - RNA, 23 nt, Salmonella enterica enterica serovar Typhi Ty2
ggcaacgccggggacuuucgaac

SEQ ID NO: 3723626 - RNA, 23 nt, Salmonella enterica enterica serovar Typhi Ty2
ggcaacgccguacuccagcccau

SEQ ID NO: 3723627 - RNA, 16 nt, Salmonella enterica enterica serovar Typhi Ty2
ggcaacggccagcgca

SEQ ID NO: 3723628 - RNA, 20 nt, Salmonella enterica enterica serovar Typhi Ty2
ggcaacggccagcgcaggcu

SEQ ID NO: 3723629 - RNA, 16 nt, Salmonella enterica enterica serovar Typhi Ty2
ggcaacggcgacaaga

SEQ ID NO: 3723630 - RNA, 23 nt, Salmonella enterica enterica serovar Typhi Ty2
ggcaacgggacggcggccagcau

SEQ ID NO: 3723631 - RNA, 15 nt, Salmonella enterica enterica serovar Typhi Ty2
ggcaagaauuaaaua

SEQ ID NO: 3723632 - RNA, 17 nt, Salmonella enterica enterica serovar Typhi Ty2
ggcaagaauuucaauca

SEQ ID NO: 3723633 - RNA, 17 nt, Salmonella enterica enterica serovar Typhi Ty2
ggcaagaugcccgucgg

SEQ ID NO: 3723634 - RNA, 13 nt, Salmonella enterica enterica serovar Typhi Ty2
ggcaagccagcau

SEQ ID NO: 3723635 - RNA, 15 nt, Salmonella enterica enterica serovar Typhi Ty2
ggcaagcgaagcgcu

SEQ ID NO: 3723636 - RNA, 20 nt, Salmonella enterica enterica serovar Typhi Ty2
ggcaagcuggcgaaucgcau

SEQ ID NO: 3723637 - RNA, 20 nt, Salmonella enterica enterica serovar Typhi Ty2
ggcaaggcggcaagaaagug

SEQ ID NO: 3723638 - RNA, 12 nt, Salmonella enterica enterica serovar Typhi Ty2
ggcaauaaacuc

SEQ ID NO: 3723639 - RNA, 18 nt, Salmonella enterica enterica serovar Typhi Ty2
ggcaauagccuuuaucgg

SEQ ID NO: 3723640 - RNA, 21 nt, Salmonella enterica enterica serovar Typhi Ty2
ggcaauauccuccggcguaaa

SEQ ID NO: 3723641 - RNA, 19 nt, Salmonella enterica enterica serovar Typhi Ty2
ggcaauaugcuguuuaugg

SEQ ID NO: 3723642 - RNA, 22 nt, Salmonella enterica enterica serovar Typhi Ty2
ggcaaucauaccgucagauucu

SEQ ID NO: 3723643 - RNA, 18 nt, Salmonella enterica enterica serovar Typhi Ty2
ggcaauccauuaauggcg

SEQ ID NO: 3723644 - RNA, 22 nt, Salmonella enterica enterica serovar Typhi Ty2
ggcaaucgacguugaucgccau

SEQ ID NO: 3723645 - RNA, 17 nt, Salmonella enterica enterica serovar Typhi Ty2
ggcaaucgccugcaacg

SEQ ID NO: 3723646 - RNA, 20 nt, Salmonella enterica enterica serovar Typhi Ty2
ggcaaucgcuuccagcgccg

SEQ ID NO: 3723647 - RNA, 22 nt, Salmonella enterica enterica serovar Typhi Ty2
ggcaaugauuagauagauauuu

SEQ ID NO: 3723648 - RNA, 23 nt, Salmonella enterica enterica serovar Typhi Ty2
ggcaauggccagaugaaacugca

SEQ ID NO: 3723649 - RNA, 23 nt, Salmonella enterica enterica serovar Typhi Ty2
ggcaauuaacauuucacgauacu

SEQ ID NO: 3723650 - RNA, 23 nt, Salmonella enterica enterica serovar Typhi Ty2
ggcaauucaaucacuugaagccu

SEQ ID NO: 3723651 - RNA, 12 nt, Salmonella enterica enterica serovar Typhi Ty2
ggcaauuuccgc

SEQ ID NO: 3723652 - RNA, 18 nt, Salmonella enterica enterica serovar Typhi Ty2
ggcaauuugauagcgcca

SEQ ID NO: 3723653 - RNA, 19 nt, Salmonella enterica enterica serovar Typhi Ty2
ggcacaaccuggcuugccg

SEQ ID NO: 3723654 - RNA, 14 nt, Salmonella enterica enterica serovar Typhi Ty2
ggcacaauagcgcu

SEQ ID NO: 3723655 - RNA, 13 nt, Salmonella enterica enterica serovar Typhi Ty2
ggcacacagcacu

SEQ ID NO: 3723656 - RNA, 14 nt, Salmonella enterica enterica serovar Typhi Ty2
ggcacacagcacua

SEQ ID NO: 3723657 - RNA, 23 nt, Salmonella enterica enterica serovar Typhi Ty2
ggcacacaggccgccgggucagc

SEQ ID NO: 3723658 - RNA, 12 nt, Salmonella enterica enterica serovar Typhi Ty2
ggcaccacguca

SEQ ID NO: 3723659 - RNA, 12 nt, Salmonella enterica enterica serovar Typhi Ty2
ggcaccagcaau

SEQ ID NO: 3723660 - RNA, 22 nt, Salmonella enterica enterica serovar Typhi Ty2
ggcaccauaauuuccguagcga

SEQ ID NO: 3723661 - RNA, 21 nt, Salmonella enterica enterica serovar Typhi Ty2
ggcaccggaaccggcaucggg

SEQ ID NO: 3723662 - RNA, 15 nt, Salmonella enterica enterica serovar Typhi Ty2
ggcaccucguccaga

SEQ ID NO: 3723663 - RNA, 13 nt, Salmonella enterica enterica serovar Typhi Ty2
ggcacgccaaaau

SEQ ID NO: 3723664 - RNA, 14 nt, Salmonella enterica enterica serovar Typhi Ty2
ggcacgccaucgcc

SEQ ID NO: 3723665 - RNA, 18 nt, Salmonella enterica enterica serovar Typhi Ty2
ggcacggucaaucaucag

SEQ ID NO: 3723666 - RNA, 24 nt, Salmonella enterica enterica serovar Typhi Ty2
ggcacguuaaacaccucaccggcu

SEQ ID NO: 3723667 - RNA, 18 nt, Salmonella enterica enterica serovar Typhi Ty2
ggcacuacgguccaguug

SEQ ID NO: 3723668 - RNA, 22 nt, Salmonella enterica enterica serovar Typhi Ty2
ggcacucaccucuuccgccagg

SEQ ID NO: 3723669 - RNA, 20 nt, Salmonella enterica enterica serovar Typhi Ty2
ggcacugacucuuccgggcg

SEQ ID NO: 3723670 - RNA, 23 nt, Salmonella enterica enterica serovar Typhi Ty2
ggcacugcgcuuauccggccuac

SEQ ID NO: 3723671 - RNA, 21 nt, Salmonella enterica enterica serovar Typhi Ty2
ggcagaaaaaguagaaaaggu

SEQ ID NO: 3723672 - RNA, 18 nt, Salmonella enterica enterica serovar Typhi Ty2
ggcagaaaaaucagcauu

SEQ ID NO: 3723673 - RNA, 11 nt, Salmonella enterica enterica serovar Typhi Ty2
ggcagaauaaa

SEQ ID NO: 3723674 - RNA, 22 nt, Salmonella enterica enterica serovar Typhi Ty2
ggcagaauuaacucaucacagc

SEQ ID NO: 3723675 - RNA, 12 nt, Salmonella enterica enterica serovar Typhi Ty2
ggcagacagcca

SEQ ID NO: 3723676 - RNA, 13 nt, Salmonella enterica enterica serovar Typhi Ty2
ggcagacagccau

SEQ ID NO: 3723677 - RNA, 15 nt, Salmonella enterica enterica serovar Typhi Ty2
ggcagacaucgccgu

SEQ ID NO: 3723678 - RNA, 14 nt, Salmonella enterica enterica serovar Typhi Ty2
ggcagacggcuggg

SEQ ID NO: 3723679 - RNA, 12 nt, Salmonella enterica enterica serovar Typhi Ty2
ggcagagcgcgc

SEQ ID NO: 3723680 - RNA, 17 nt, Salmonella enterica enterica serovar Typhi Ty2
ggcagaguccagcggca

SEQ ID NO: 3723681 - RNA, 11 nt, Salmonella enterica enterica serovar Typhi Ty2
ggcagauaucg

SEQ ID NO: 3723682 - RNA, 14 nt, Salmonella enterica enterica serovar Typhi Ty2
ggcagauaugcggg

SEQ ID NO: 3723683 - RNA, 13 nt, Salmonella enterica enterica serovar Typhi Ty2
ggcagauucuucu

SEQ ID NO: 3723684 - RNA, 20 nt, Salmonella enterica enterica serovar Typhi Ty2
ggcagcaauacgcccgcccg

SEQ ID NO: 3723685 - RNA, 19 nt, Salmonella enterica enterica serovar Typhi Ty2
ggcagcacaaucagcgcgg

SEQ ID NO: 3723686 - RNA, 18 nt, Salmonella enterica enterica serovar Typhi Ty2
ggcagcacccggcccggc

SEQ ID NO: 3723687 - RNA, 23 nt, Salmonella enterica enterica serovar Typhi Ty2
ggcagcaccggaacagaagccug

SEQ ID NO: 3723688 - RNA, 12 nt, Salmonella enterica enterica serovar Typhi Ty2
ggcagccaggca

SEQ ID NO: 3723689 - RNA, 23 nt, Salmonella enterica enterica serovar Typhi Ty2
ggcagccaugcuauucagcaguu

SEQ ID NO: 3723690 - RNA, 18 nt, Salmonella enterica enterica serovar Typhi Ty2
ggcagccauucggcugcc

SEQ ID NO: 3723691 - RNA, 14 nt, Salmonella enterica enterica serovar Typhi Ty2
ggcagccgccacca

SEQ ID NO: 3723692 - RNA, 16 nt, Salmonella enterica enterica serovar Typhi Ty2
ggcagccgccaccaca

SEQ ID NO: 3723693 - RNA, 15 nt, Salmonella enterica enterica serovar Typhi Ty2
ggcagccucaggccu

SEQ ID NO: 3723694 - RNA, 12 nt, Salmonella enterica enterica serovar Typhi Ty2
ggcagcgaaagc

SEQ ID NO: 3723695 - RNA, 21 nt, Salmonella enterica enterica serovar Typhi Ty2
ggcagcgcaacgcuuaauccc

SEQ ID NO: 3723696 - RNA, 15 nt, Salmonella enterica enterica serovar Typhi Ty2
ggcagcgccagcggu

SEQ ID NO: 3723697 - RNA, 19 nt, Salmonella enterica enterica serovar Typhi Ty2
ggcagcgcgaacaggcugg

SEQ ID NO: 3723698 - RNA, 20 nt, Salmonella enterica enterica serovar Typhi Ty2
ggccagcgaaaaccagcgcc

SEQ ID NO: 3723699 - RNA, 21 nt, Salmonella enterica enterica serovar Typhi Ty2
ggccagcgaaaaccagcgccg

SEQ ID NO: 3723700 - RNA, 17 nt, Salmonella enterica enterica serovar Typhi Ty2
ggccagcguaccugcgg

SEQ ID NO: 3723701 - RNA, 20 nt, Salmonella enterica enterica serovar Typhi Ty2
ggccagcguggaugaacuca

SEQ ID NO: 3723702 - RNA, 12 nt, Salmonella enterica enterica serovar Typhi Ty2
ggccagcuccgc

SEQ ID NO: 3723703 - RNA, 21 nt, Salmonella enterica enterica serovar Typhi Ty2
ggccaggcacguuaaacaccu

SEQ ID NO: 3723704 - RNA, 16 nt, Salmonella enterica enterica serovar Typhi Ty2
ggccaggcauugauaa

SEQ ID NO: 3723705 - RNA, 13 nt, Salmonella enterica enterica serovar Typhi Ty2
ggccagggcaggc

SEQ ID NO: 3723706 - RNA, 20 nt, Salmonella enterica enterica serovar Typhi Ty2
ggccagggcaggcagugaac

SEQ ID NO: 3723707 - RNA, 16 nt, Salmonella enterica enterica serovar Typhi Ty2
ggccaguagcgggggc

SEQ ID NO: 3723708 - RNA, 19 nt, Salmonella enterica enterica serovar Typhi Ty2
ggccaguagcgggggccgg

SEQ ID NO: 3723709 - RNA, 15 nt, Salmonella enterica enterica serovar Typhi Ty2
ggccagucgcagaug

SEQ ID NO: 3723710 - RNA, 14 nt, Salmonella enterica enterica serovar Typhi Ty2
ggccagugccaagc

SEQ ID NO: 3723711 - RNA, 16 nt, Salmonella enterica enterica serovar Typhi Ty2
ggccagugccaagcaa

SEQ ID NO: 3723712 - RNA, 23 nt, Salmonella enterica enterica serovar Typhi Ty2
ggccagugguaaaaaagucacuu

SEQ ID NO: 3723713 - RNA, 17 nt, Salmonella enterica enterica serovar Typhi Ty2
ggccaguuguucuuuca

SEQ ID NO: 3723714 - RNA, 18 nt, Salmonella enterica enterica serovar Typhi Ty2
ggccaguuguucuuucac

SEQ ID NO: 3723715 - RNA, 21 nt, Salmonella enterica enterica serovar Typhi Ty2
ggccaucgacgaaauggugug

SEQ ID NO: 3723716 - RNA, 22 nt, Salmonella enterica enterica serovar Typhi Ty2
ggccaucgccgcagagaauaac

SEQ ID NO: 3723717 - RNA, 15 nt, Salmonella enterica enterica serovar Typhi Ty2
ggccaucuggcguug

SEQ ID NO: 3723718 - RNA, 17 nt, Salmonella enterica enterica serovar Typhi Ty2
ggccaucuuccagcauc

SEQ ID NO: 3723719 - RNA, 18 nt, Salmonella enterica enterica serovar Typhi Ty2
ggccaucuuccagcauca

SEQ ID NO: 3723720 - RNA, 21 nt, Salmonella enterica enterica serovar Typhi Ty2
ggccaucuuccagcaucagca

SEQ ID NO: 3723721 - RNA, 18 nt, Salmonella enterica enterica serovar Typhi Ty2
ggccaugaucgccgccau

SEQ ID NO: 3723722 - RNA, 23 nt, Salmonella enterica enterica serovar Typhi Ty2
ggccaugaucgccgccaucggcg

SEQ ID NO: 3723723 - RNA, 17 nt, Salmonella enterica enterica serovar Typhi Ty2
ggccauuaacacacaau

SEQ ID NO: 3723724 - RNA, 19 nt, Salmonella enterica enterica serovar Typhi Ty2
ggccauuaagcuucgugag

SEQ ID NO: 3723725 - RNA, 17 nt, Salmonella enterica enterica serovar Typhi Ty2
ggccauugaagucccuu

SEQ ID NO: 3723726 - RNA, 18 nt, Salmonella enterica enterica serovar Typhi Ty2
ggccauuuucggcguugc

SEQ ID NO: 3723727 - RNA, 13 nt, Salmonella enterica enterica serovar Typhi Ty2
ggcccaaacgaug

SEQ ID NO: 3723728 - RNA, 16 nt, Salmonella enterica enterica serovar Typhi Ty2
ggcccacgcgcagaga

SEQ ID NO: 3723729 - RNA, 17 nt, Salmonella enterica enterica serovar Typhi Ty2
ggcccagcgcgguggcg

SEQ ID NO: 3723730 - RNA, 20 nt, Salmonella enterica enterica serovar Typhi Ty2
ggcccagcuaaaccacggaa

SEQ ID NO: 3723731 - RNA, 21 nt, Salmonella enterica enterica serovar Typhi Ty2
ggcccagcuuaguaaccccag

SEQ ID NO: 3723732 - RNA, 21 nt, Salmonella enterica enterica serovar Typhi Ty2
ggcccaggccauuaaccuugc

SEQ ID NO: 3723733 - RNA, 18 nt, Salmonella enterica enterica serovar Typhi Ty2
ggcccauaaacaggucac

SEQ ID NO: 3723734 - RNA, 15 nt, Salmonella enterica enterica serovar Typhi Ty2
ggccccaauuugcug

SEQ ID NO: 3723735 - RNA, 14 nt, Salmonella enterica enterica serovar Typhi Ty2
ggcccccuguucca

SEQ ID NO: 3723736 - RNA, 23 nt, Salmonella enterica enterica serovar Typhi Ty2
ggcccccuguuccagggcuucca

SEQ ID NO: 3723737 - RNA, 18 nt, Salmonella enterica enterica serovar Typhi Ty2
ggcccgacauguucgaac

SEQ ID NO: 3723738 - RNA, 15 nt, Salmonella enterica enterica serovar Typhi Ty2
ggcccggguaaugcu

SEQ ID NO: 3723739 - RNA, 22 nt, Salmonella enterica enterica serovar Typhi Ty2
ggcccgguaagcacaacgcauu

SEQ ID NO: 3723740 - RNA, 18 nt, Salmonella enterica enterica serovar Typhi Ty2
ggcccgguaagcgcagcg

SEQ ID NO: 3723741 - RNA, 21 nt, Salmonella enterica enterica serovar Typhi Ty2
ggcccgguaagcgcuagcgcc

SEQ ID NO: 3723742 - RNA, 16 nt, Salmonella enterica enterica serovar Typhi Ty2
ggcccguaucgcucag

SEQ ID NO: 3723743 - RNA, 17 nt, Salmonella enterica enterica serovar Typhi Ty2
ggcccuaacgggcucgu

SEQ ID NO: 3723744 - RNA, 20 nt, Salmonella enterica enterica serovar Typhi Ty2
ggccgaauaagccaggcacc

SEQ ID NO: 3723745 - RNA, 14 nt, Salmonella enterica enterica serovar Typhi Ty2
ggccgacaaaaauu

SEQ ID NO: 3723746 - RNA, 15 nt, Salmonella enterica enterica serovar Typhi Ty2
ggccgacacaacaug

SEQ ID NO: 3723747 - RNA, 15 nt, Salmonella enterica enterica serovar Typhi Ty2
ggccgacaggcggcc

SEQ ID NO: 3723748 - RNA, 19 nt, Salmonella enterica enterica serovar Typhi Ty2
ggccgagaguccagcgcca

SEQ ID NO: 3723749 - RNA, 20 nt, Salmonella enterica enterica serovar Typhi Ty2
ggccgaguaauccauagcca

SEQ ID NO: 3723750 - RNA, 13 nt, Salmonella enterica enterica serovar Typhi Ty2
ggccgccagcaac

SEQ ID NO: 3723751 - RNA, 22 nt, Salmonella enterica enterica serovar Typhi Ty2
ggccgccagcgugacccagaca

SEQ ID NO: 3723752 - RNA, 17 nt, Salmonella enterica enterica serovar Typhi Ty2
ggccgcccggacccgcu

SEQ ID NO: 3723753 - RNA, 15 nt, Salmonella enterica enterica serovar Typhi Ty2
ggccgccgcaaaagc

SEQ ID NO: 3723754 - RNA, 16 nt, Salmonella enterica enterica serovar Typhi Ty2
ggccgccgcacaggcg

SEQ ID NO: 3723755 - RNA, 14 nt, Salmonella enterica enterica serovar Typhi Ty2
ggccgcggcuguaa

SEQ ID NO: 3723756 - RNA, 20 nt, Salmonella enterica enterica serovar Typhi Ty2
ggccgcgugcucgcggcgga

SEQ ID NO: 3723757 - RNA, 16 nt, Salmonella enterica enterica serovar Typhi Ty2
ggccgcuauccucgcc

SEQ ID NO: 3723758 - RNA, 12 nt, Salmonella enterica enterica serovar Typhi Ty2
ggccgcucgccu

SEQ ID NO: 3723759 - RNA, 23 nt, Salmonella enterica enterica serovar Typhi Ty2
ggccgcuuaauaauaagcggccu

SEQ ID NO: 3723760 - RNA, 20 nt, Salmonella enterica enterica serovar Typhi Ty2
ggccgcuuacugugccgccg

SEQ ID NO: 3723761 - RNA, 23 nt, Salmonella enterica enterica serovar Typhi Ty2
ggccggaaaggauauaagcgcca

SEQ ID NO: 3723762 - RNA, 18 nt, Salmonella enterica enterica serovar Typhi Ty2
ggccggaauacguaauac

SEQ ID NO: 3723763 - RNA, 20 nt, Salmonella enterica enterica serovar Typhi Ty2
ggccggauaagcauagcguu

SEQ ID NO: 3723764 - RNA, 21 nt, Salmonella enterica enterica serovar Typhi Ty2
ggccggauaagcgcagcgcca

SEQ ID NO: 3723765 - RNA, 21 nt, Salmonella enterica enterica serovar Typhi Ty2
ggccggauaagcgcagcguca

SEQ ID NO: 3723766 - RNA, 19 nt, Salmonella enterica enterica serovar Typhi Ty2
ggccggauaagcggcagcg

SEQ ID NO: 3723767 - RNA, 22 nt, Salmonella enterica enterica serovar Typhi Ty2
ggccggauaagcggcagcgcca

SEQ ID NO: 3723768 - RNA, 23 nt, Salmonella enterica enterica serovar Typhi Ty2
ggccggauaaggcgcagccgcca

SEQ ID NO: 3723769 - RNA, 14 nt, Salmonella enterica enterica serovar Typhi Ty2
ggccggaucggcgg

SEQ ID NO: 3723770 - RNA, 22 nt, Salmonella enterica enterica serovar Typhi Ty2
ggccggaugagcguuagcgcca

SEQ ID NO: 3723771 - RNA, 23 nt, Salmonella enterica enterica serovar Typhi Ty2
ggccggaugaggcgcagccgcca

SEQ ID NO: 3723772 - RNA, 19 nt, Salmonella enterica enterica serovar Typhi Ty2
ggccggcaccagccaggaa

SEQ ID NO: 3723773 - RNA, 17 nt, Salmonella enterica enterica serovar Typhi Ty2
ggccggcuucuccacca

SEQ ID NO: 3723774 - RNA, 20 nt, Salmonella enterica enterica serovar Typhi Ty2
ggccggguauaccaucggcu

SEQ ID NO: 3723775 - RNA, 22 nt, Salmonella enterica enterica serovar Typhi Ty2
ggccgguuguuuacacggcaaa

SEQ ID NO: 3723776 - RNA, 22 nt, Salmonella enterica enterica serovar Typhi Ty2
ggccgucacuuuaucacuccuu

SEQ ID NO: 3723777 - RNA, 14 nt, Salmonella enterica enterica serovar Typhi Ty2
ggccgucggcgcca

SEQ ID NO: 3723778 - RNA, 23 nt, Salmonella enterica enterica serovar Typhi Ty2
ggccguucauucgccccagcaua

SEQ ID NO: 3723779 - RNA, 15 nt, Salmonella enterica enterica serovar Typhi Ty2
ggcgagcacugccca

SEQ ID NO: 3723780 - RNA, 16 nt, Salmonella enterica enterica serovar Typhi Ty2
ggcgagcuuuucgccg

SEQ ID NO: 3723781 - RNA, 17 nt, Salmonella enterica enterica serovar Typhi Ty2
ggcgaguagcgcagcuu

SEQ ID NO: 3723782 - RNA, 17 nt, Salmonella enterica enterica serovar Typhi Ty2
ggcgaguucucgcucuu

SEQ ID NO: 3723783 - RNA, 22 nt, Salmonella enterica enterica serovar Typhi Ty2
ggcgaguuucugcucgaccguc

SEQ ID NO: 3723784 - RNA, 20 nt, Salmonella enterica enterica serovar Typhi Ty2
ggcgauaaaaauauccgcca

SEQ ID NO: 3723785 - RNA, 22 nt, Salmonella enterica enterica serovar Typhi Ty2
ggcgauaaaccaacagccgccu

SEQ ID NO: 3723786 - RNA, 23 nt, Salmonella enterica enterica serovar Typhi Ty2
ggcgauaaaccaacagccgccug

SEQ ID NO: 3723787 - RNA, 17 nt, Salmonella enterica enterica serovar Typhi Ty2
ggcgauaaaccagcccc

SEQ ID NO: 3723788 - RNA, 18 nt, Salmonella enterica enterica serovar Typhi Ty2
ggcgauaaccucucaccg

SEQ ID NO: 3723789 - RNA, 12 nt, Salmonella enterica enterica serovar Typhi Ty2
ggcgauaagguc

SEQ ID NO: 3723790 - RNA, 22 nt, Salmonella enterica enterica serovar Typhi Ty2
ggcgauaccgguacggaacguc

SEQ ID NO: 3723791 - RNA, 17 nt, Salmonella enterica enterica serovar Typhi Ty2
ggcgauacucugcccgc

SEQ ID NO: 3723792 - RNA, 21 nt, Salmonella enterica enterica serovar Typhi Ty2
ggcgauacugcuccgccggag

SEQ ID NO: 3723793 - RNA, 17 nt, Salmonella enterica enterica serovar Typhi Ty2
ggcgauagccccaguaa

SEQ ID NO: 3723794 - RNA, 16 nt, Salmonella enterica enterica serovar Typhi Ty2
ggcgauagugucgcca

SEQ ID NO: 3723795 - RNA, 16 nt, Salmonella enterica enterica serovar Typhi Ty2
ggcgaucagacgcugg

SEQ ID NO: 3723796 - RNA, 14 nt, Salmonella enterica enterica serovar Typhi Ty2
ggcgaucagcgcca

SEQ ID NO: 3723797 - RNA, 15 nt, Salmonella enterica enterica serovar Typhi Ty2
ggcgaucagcgccac

SEQ ID NO: 3723798 - RNA, 17 nt, Salmonella enterica enterica serovar Typhi Ty2
ggcgaucagcgccacca

SEQ ID NO: 3723799 - RNA, 19 nt, Salmonella enterica enterica serovar Typhi Ty2
ggcgaucagcgccaccaca

SEQ ID NO: 3723800 - RNA, 12 nt, Salmonella enterica enterica serovar Typhi Ty2
ggcgaucgcaca

SEQ ID NO: 3723801 - RNA, 19 nt, Salmonella enterica enterica serovar Typhi Ty2
ggcgaugccuuauccggcc

SEQ ID NO: 3723802 - RNA, 15 nt, Salmonella enterica enterica serovar Typhi Ty2
ggcgauggcucgccc

SEQ ID NO: 3723803 - RNA, 16 nt, Salmonella enterica enterica serovar Typhi Ty2
ggcgauguucuugccg

SEQ ID NO: 3723804 - RNA, 15 nt, Salmonella enterica enterica serovar Typhi Ty2
ggcgauguuggcgcc

SEQ ID NO: 3723805 - RNA, 21 nt, Salmonella enterica enterica serovar Typhi Ty2
ggcgauuacaacgcgaugguc

SEQ ID NO: 3723806 - RNA, 17 nt, Salmonella enterica enterica serovar Typhi Ty2
ggcgauucccgaucuuc

SEQ ID NO: 3723807 - RNA, 19 nt, Salmonella enterica enterica serovar Typhi Ty2
ggcgauuuauagagcagca

SEQ ID NO: 3723808 - RNA, 17 nt, Salmonella enterica enterica serovar Typhi Ty2
ggcgauuuccagcgccg

SEQ ID NO: 3723809 - RNA, 21 nt, Salmonella enterica enterica serovar Typhi Ty2
ggcgauuuccagcgccgcgcg

SEQ ID NO: 3723810 - RNA, 13 nt, Salmonella enterica enterica serovar Typhi Ty2
ggcgauuuucagc

SEQ ID NO: 3723811 - RNA, 18 nt, Salmonella enterica enterica serovar Typhi Ty2
ggcgauuuucauagcugg

SEQ ID NO: 3723812 - RNA, 22 nt, Salmonella enterica enterica serovar Typhi Ty2
ggcgauuuuuaggccaaacuua

SEQ ID NO: 3723813 - RNA, 22 nt, Salmonella enterica enterica serovar Typhi Ty2
ggcgcaaacgcgugcugguguc

SEQ ID NO: 3723814 - RNA, 21 nt, Salmonella enterica enterica serovar Typhi Ty2
ggcgcaaagcaauguaaaacu

SEQ ID NO: 3723815 - RNA, 21 nt, Salmonella enterica enterica serovar Typhi Ty2
ggcgcaaaggccuuauccggc

SEQ ID NO: 3723816 - RNA, 11 nt, Salmonella enterica enterica serovar Typhi Ty2
ggcgcaaaucg

SEQ ID NO: 3723817 - RNA, 17 nt, Salmonella enterica enterica serovar Typhi Ty2
ggcgcaaauggcugcga

SEQ ID NO: 3723818 - RNA, 12 nt, Salmonella enterica enterica serovar Typhi Ty2
ggcgcaaccggc

SEQ ID NO: 3723819 - RNA, 15 nt, Salmonella enterica enterica serovar Typhi Ty2
ggcgcaauaacgaua

SEQ ID NO: 3723820 - RNA, 12 nt, Salmonella enterica enterica serovar Typhi Ty2
ggcgcacauugc

SEQ ID NO: 3723821 - RNA, 19 nt, Salmonella enterica enterica serovar Typhi Ty2
ggcgcacauuuacgccagc

SEQ ID NO: 3723822 - RNA, 22 nt, Salmonella enterica enterica serovar Typhi Ty2
ggcgcacauuuacgccagccag

SEQ ID NO: 3723823 - RNA, 19 nt, Salmonella enterica enterica serovar Typhi Ty2
ggcgcacuuccucucccac

SEQ ID NO: 3723824 - RNA, 14 nt, Salmonella enterica enterica serovar Typhi Ty2
ggcgcagagugagc

SEQ ID NO: 3723825 - RNA, 17 nt, Salmonella enterica enterica serovar Typhi Ty2
ggcgcagcauacgcugc

SEQ ID NO: 3723826 - RNA, 22 nt, Salmonella enterica enterica serovar Typhi Ty2
ggcgcagcgaaacugcgcgccg

SEQ ID NO: 3723827 - RNA, 14 nt, Salmonella enterica enterica serovar Typhi Ty2
ggcgcagcgcggga

SEQ ID NO: 3723828 - RNA, 11 nt, Salmonella enterica enterica serovar Typhi Ty2
ggcgcaggcaa

SEQ ID NO: 3723829 - RNA, 20 nt, Salmonella enterica enterica serovar Typhi Ty2
ggcgcaggcauuaaaaaaac

SEQ ID NO: 3723830 - RNA, 22 nt, Salmonella enterica enterica serovar Typhi Ty2
ggcgcaguccagaugcgccaga

SEQ ID NO: 3723831 - RNA, 14 nt, Salmonella enterica enterica serovar Typhi Ty2
ggcgcaguggcggg

SEQ ID NO: 3723832 - RNA, 18 nt, Salmonella enterica enterica serovar Typhi Ty2
ggcgcaguucgccgccag

SEQ ID NO: 3723833 - RNA, 20 nt, Salmonella enterica enterica serovar Typhi Ty2
ggcgcaguucgccgccagga

SEQ ID NO: 3723834 - RNA, 14 nt, Salmonella enterica enterica serovar Typhi Ty2
ggcgcaguuuacgc

SEQ ID NO: 3723835 - RNA, 21 nt, Salmonella enterica enterica serovar Typhi Ty2
ggcgcaguuuacgcagcgccu

SEQ ID NO: 3723836 - RNA, 14 nt, Salmonella enterica enterica serovar Typhi Ty2
ggcgcauaucgccc

SEQ ID NO: 3723837 - RNA, 15 nt, Salmonella enterica enterica serovar Typhi Ty2
ggcgcauaucgcccu

SEQ ID NO: 3723838 - RNA, 15 nt, Salmonella enterica enterica serovar Typhi Ty2
ggcgcaucagaaaaa

SEQ ID NO: 3723839 - RNA, 19 nt, Salmonella enterica enterica serovar Typhi Ty2
ggcgcauucucugucgccg

SEQ ID NO: 3723840 - RNA, 16 nt, Salmonella enterica enterica serovar Typhi Ty2
ggcgccaaucaccgcc

SEQ ID NO: 3723841 - RNA, 17 nt, Salmonella enterica enterica serovar Typhi Ty2
ggcgccaaucaccgcca

SEQ ID NO: 3723842 - RNA, 23 nt, Salmonella enterica enterica serovar Typhi Ty2
ggcgccagagagcguuucuacgc

SEQ ID NO: 3723843 - RNA, 17 nt, Salmonella enterica enterica serovar Typhi Ty2
ggcgccagcucaucggg

SEQ ID NO: 3723844 - RNA, 11 nt, Salmonella enterica enterica serovar Typhi Ty2
ggcgccaguac

SEQ ID NO: 3723845 - RNA, 14 nt, Salmonella enterica enterica serovar Typhi Ty2
ggcgccaucaccau

SEQ ID NO: 3723846 - RNA, 14 nt, Salmonella enterica enterica serovar Typhi Ty2
ggcgccaucgccuc

SEQ ID NO: 3723847 - RNA, 22 nt, Salmonella enterica enterica serovar Typhi Ty2
ggcgccaucgccuccagacugg

SEQ ID NO: 3723848 - RNA, 18 nt, Salmonella enterica enterica serovar Typhi Ty2
ggcgccauuggcucggcg

SEQ ID NO: 3723849 - RNA, 21 nt, Salmonella enterica enterica serovar Typhi Ty2
ggcgccauuggcucggcguca

SEQ ID NO: 3723850 - RNA, 15 nt, Salmonella enterica enterica serovar Typhi Ty2
ggcgcccauccgccc

SEQ ID NO: 3723851 - RNA, 22 nt, Salmonella enterica enterica serovar Typhi Ty2
ggcgcccauuucguuaaugcug

SEQ ID NO: 3723852 - RNA, 15 nt, Salmonella enterica enterica serovar Typhi Ty2
ggcgccgaucauccc

SEQ ID NO: 3723853 - RNA, 19 nt, Salmonella enterica enterica serovar Typhi Ty2
ggcgccggagucgacggcg

SEQ ID NO: 3723854 - RNA, 12 nt, Salmonella enterica enterica serovar Typhi Ty2
ggcgccggcgcg

SEQ ID NO: 3723855 - RNA, 15 nt, Salmonella enterica enterica serovar Typhi Ty2
ggcgccggggcagca

SEQ ID NO: 3723856 - RNA, 16 nt, Salmonella enterica enterica serovar Typhi Ty2
ggcgccggggcagcaa

SEQ ID NO: 3723857 - RNA, 17 nt, Salmonella enterica enterica serovar Typhi Ty2
ggcgccggggcagcaau

SEQ ID NO: 3723858 - RNA, 13 nt, Salmonella enterica enterica serovar Typhi Ty2
ggcgccuuguccg

SEQ ID NO: 3723859 - RNA, 14 nt, Salmonella enterica enterica serovar Typhi Ty2
ggcgccuuguccgg

SEQ ID NO: 3723860 - RNA, 18 nt, Salmonella enterica enterica serovar Typhi Ty2
ggcgcgaaaacagcuggc

SEQ ID NO: 3723861 - RNA, 15 nt, Salmonella enterica enterica serovar Typhi Ty2
ggcgguauuauccgc

SEQ ID NO: 3723862 - RNA, 15 nt, Salmonella enterica enterica serovar Typhi Ty2
ggcggucgggaacgc

SEQ ID NO: 3723863 - RNA, 18 nt, Salmonella enterica enterica serovar Typhi Ty2
ggcgguuauccgccagcg

SEQ ID NO: 3723864 - RNA, 22 nt, Salmonella enterica enterica serovar Typhi Ty2
ggcgguucccgggcgcucgcuu

SEQ ID NO: 3723865 - RNA, 18 nt, Salmonella enterica enterica serovar Typhi Ty2
ggcgguuugacggcugca

SEQ ID NO: 3723866 - RNA, 17 nt, Salmonella enterica enterica serovar Typhi Ty2
ggcguaaaaaggcgcau

SEQ ID NO: 3723867 - RNA, 13 nt, Salmonella enterica enterica serovar Typhi Ty2
ggcguaaaacugg

SEQ ID NO: 3723868 - RNA, 21 nt, Salmonella enterica enterica serovar Typhi Ty2
ggcguaaaagcgauaaagaca

SEQ ID NO: 3723869 - RNA, 14 nt, Salmonella enterica enterica serovar Typhi Ty2
ggcguaaaucaggc

SEQ ID NO: 3723870 - RNA, 21 nt, Salmonella enterica enterica serovar Typhi Ty2
ggcguaaaugugcgccagccu

SEQ ID NO: 3723871 - RNA, 13 nt, Salmonella enterica enterica serovar Typhi Ty2
ggcguaagaaaag

SEQ ID NO: 3723872 - RNA, 16 nt, Salmonella enterica enterica serovar Typhi Ty2
ggcguaagaucgcggg

SEQ ID NO: 3723873 - RNA, 23 nt, Salmonella enterica enterica serovar Typhi Ty2
ggcguaauaugaauauccgccgc

SEQ ID NO: 3723874 - RNA, 15 nt, Salmonella enterica enterica serovar Typhi Ty2
ggcguaauggcggga

SEQ ID NO: 3723875 - RNA, 12 nt, Salmonella enterica enterica serovar Typhi Ty2
ggcguaccgccu

SEQ ID NO: 3723876 - RNA, 13 nt, Salmonella enterica enterica serovar Typhi Ty2
ggcguagauauuc

SEQ ID NO: 3723877 - RNA, 17 nt, Salmonella enterica enterica serovar Typhi Ty2
ggcguagccgccgagcg

SEQ ID NO: 3723878 - RNA, 17 nt, Salmonella enterica enterica serovar Typhi Ty2
ggcguauagccaggcag

SEQ ID NO: 3723879 - RNA, 19 nt, Salmonella enterica enterica serovar Typhi Ty2
ggcguauagccaggcagau

SEQ ID NO: 3723880 - RNA, 13 nt, Salmonella enterica enterica serovar Typhi Ty2
ggcguauagccgc

SEQ ID NO: 3723881 - RNA, 15 nt, Salmonella enterica enterica serovar Typhi Ty2
ggcguauucggcaua

SEQ ID NO: 3723882 - RNA, 14 nt, Salmonella enterica enterica serovar Typhi Ty2
ggcgucaaaauccc

SEQ ID NO: 3723883 - RNA, 14 nt, Salmonella enterica enterica serovar Typhi Ty2
ggcgucaaacagcu

SEQ ID NO: 3723884 - RNA, 17 nt, Salmonella enterica enterica serovar Typhi Ty2
ggcgucaaacagcuuaa

SEQ ID NO: 3723885 - RNA, 20 nt, Salmonella enterica enterica serovar Typhi Ty2
ggcgucaccaccgcaggcag

SEQ ID NO: 3723886 - RNA, 20 nt, Salmonella enterica enterica serovar Typhi Ty2
ggcgucacccgccggcagca

SEQ ID NO: 3723887 - RNA, 17 nt, Salmonella enterica enterica serovar Typhi Ty2
ggcgucagcauggugug

SEQ ID NO: 3723888 - RNA, 22 nt, Salmonella enterica enterica serovar Typhi Ty2
ggcgucauagccgcgcgucagc

SEQ ID NO: 3723889 - RNA, 15 nt, Salmonella enterica enterica serovar Typhi Ty2
ggcgucauccugcag

SEQ ID NO: 3723890 - RNA, 13 nt, Salmonella enterica enterica serovar Typhi Ty2
ggcgucaucggcg

SEQ ID NO: 3723891 - RNA, 12 nt, Salmonella enterica enterica serovar Typhi Ty2
ggcgucaucggg

SEQ ID NO: 3723892 - RNA, 15 nt, Salmonella enterica enterica serovar Typhi Ty2
ggcgucgcggcaaua

SEQ ID NO: 3723893 - RNA, 21 nt, Salmonella enterica enterica serovar Typhi Ty2
ggcgucgguuauagacgccgg

SEQ ID NO: 3723894 - RNA, 15 nt, Salmonella enterica enterica serovar Typhi Ty2
ggcgucgucaucgcg

SEQ ID NO: 3723895 - RNA, 21 nt, Salmonella enterica enterica serovar Typhi Ty2
ggcgucgugcugggcgcgccu

SEQ ID NO: 3723896 - RNA, 14 nt, Salmonella enterica enterica serovar Typhi Ty2
ggcgugacgcgcca

SEQ ID NO: 3723897 - RNA, 21 nt, Salmonella enterica enterica serovar Typhi Ty2
ggcgugccguccugugcuuug

SEQ ID NO: 3723898 - RNA, 13 nt, Salmonella enterica enterica serovar Typhi Ty2
ggcguggugucuc

SEQ ID NO: 3723899 - RNA, 17 nt, Salmonella enterica enterica serovar Typhi Ty2
ggcguggugucucgucg

SEQ ID NO: 3723900 - RNA, 20 nt, Salmonella enterica enterica serovar Typhi Ty2
ggcguguagccaaucagccc

SEQ ID NO: 3723901 - RNA, 21 nt, Salmonella enterica enterica serovar Typhi Ty2
ggcgugucaucaaaaucgggc

SEQ ID NO: 3723902 - RNA, 17 nt, Salmonella enterica enterica serovar Typhi Ty2
ggcgugucgccggggcg

SEQ ID NO: 3723903 - RNA, 13 nt, Salmonella enterica enterica serovar Typhi Ty2
ggcguguggcugu

SEQ ID NO: 3723904 - RNA, 23 nt, Salmonella enterica enterica serovar Typhi Ty2
ggcguuaaugcgcgcuucuucau

SEQ ID NO: 3723905 - RNA, 14 nt, Salmonella enterica enterica serovar Typhi Ty2
ggcguuacgcgcca

SEQ ID NO: 3723906 - RNA, 23 nt, Salmonella enterica enterica serovar Typhi Ty2
ggcguuacuccgcgguagagcgc

SEQ ID NO: 3723907 - RNA, 12 nt, Salmonella enterica enterica serovar Typhi Ty2
ggcguuccgcac

SEQ ID NO: 3723908 - RNA, 21 nt, Salmonella enterica enterica serovar Typhi Ty2
ggcguuccgcacauaaucacc

SEQ ID NO: 3723909 - RNA, 14 nt, Salmonella enterica enterica serovar Typhi Ty2
ggcguuccuuauca

SEQ ID NO: 3723910 - RNA, 20 nt, Salmonella enterica enterica serovar Typhi Ty2
ggcguugcgccgccaggcau

SEQ ID NO: 3723911 - RNA, 21 nt, Salmonella enterica enterica serovar Typhi Ty2
ggcguugcgccgccaggcaug

SEQ ID NO: 3723912 - RNA, 20 nt, Salmonella enterica enterica serovar Typhi Ty2
ggcguuguaagguuaagccu

SEQ ID NO: 3723913 - RNA, 19 nt, Salmonella enterica enterica serovar Typhi Ty2
ggcguuuauauaaaaauag

SEQ ID NO: 3723914 - RNA, 18 nt, Salmonella enterica enterica serovar Typhi Ty2
ggcguuucaacaaacuca

SEQ ID NO: 3723915 - RNA, 20 nt, Salmonella enterica enterica serovar Typhi Ty2
ggcguuuucauuagccgcca

SEQ ID NO: 3723916 - RNA, 21 nt, Salmonella enterica enterica serovar Typhi Ty2
ggcuaaccuguaucugcugac

SEQ ID NO: 3723917 - RNA, 13 nt, Salmonella enterica enterica serovar Typhi Ty2
ggcuaaucgccac

SEQ ID NO: 3723918 - RNA, 13 nt, Salmonella enterica enterica serovar Typhi Ty2
ggcuacccagaca

SEQ ID NO: 3723919 - RNA, 20 nt, Salmonella enterica enterica serovar Typhi Ty2
ggcuacccagacaagcacau

SEQ ID NO: 3723920 - RNA, 12 nt, Salmonella enterica enterica serovar Typhi Ty2
ggcuacccauga

SEQ ID NO: 3723921 - RNA, 15 nt, Salmonella enterica enterica serovar Typhi Ty2
ggcuaucaauguuua

SEQ ID NO: 3723922 - RNA, 15 nt, Salmonella enterica enterica serovar Typhi Ty2
ggcuaugaagagaaa

SEQ ID NO: 3723923 - RNA, 19 nt, Salmonella enterica enterica serovar Typhi Ty2
ggcuaugaagagaaacaua

SEQ ID NO: 3723924 - RNA, 21 nt, Salmonella enterica enterica serovar Typhi Ty2
ggcuaugaagcuggagccaca

SEQ ID NO: 3723925 - RNA, 16 nt, Salmonella enterica enterica serovar Typhi Ty2
ggcucaaacggccugc

SEQ ID NO: 3723926 - RNA, 22 nt, Salmonella enterica enterica serovar Typhi Ty2
ggcucaaacggccugcgcugga

SEQ ID NO: 3723927 - RNA, 12 nt, Salmonella enterica enterica serovar Typhi Ty2
ggcucagcauag

SEQ ID NO: 3723928 - RNA, 13 nt, Salmonella enterica enterica serovar Typhi Ty2
ggcucaucaaaca

SEQ ID NO: 3723929 - RNA, 20 nt, Salmonella enterica enterica serovar Typhi Ty2
ggcucaucaaacagcggcac

SEQ ID NO: 3723930 - RNA, 15 nt, Salmonella enterica enterica serovar Typhi Ty2
ggcucaucagcgcca

SEQ ID NO: 3723931 - RNA, 23 nt, Salmonella enterica enterica serovar Typhi Ty2
ggcucauuuuauccaacagcgca

SEQ ID NO: 3723932 - RNA, 13 nt, Salmonella enterica enterica serovar Typhi Ty2
ggcuccaaguauu

SEQ ID NO: 3723933 - RNA, 19 nt, Salmonella enterica enterica serovar Typhi Ty2
ggcucccacucuuccagca

SEQ ID NO: 3723934 - RNA, 20 nt, Salmonella enterica enterica serovar Typhi Ty2
ggcuccuguugguuauacgg

SEQ ID NO: 3723935 - RNA, 15 nt, Salmonella enterica enterica serovar Typhi Ty2
ggcuccuuuuuugua

SEQ ID NO: 3723936 - RNA, 13 nt, Salmonella enterica enterica serovar Typhi Ty2
ggcucguuuuugu

SEQ ID NO: 3723937 - RNA, 13 nt, Salmonella enterica enterica serovar Typhi Ty2
ggcucuaaaaagg

SEQ ID NO: 3723938 - RNA, 22 nt, Salmonella enterica enterica serovar Typhi Ty2
ggcucuguuuacguagcaaaua

SEQ ID NO: 3723939 - RNA, 15 nt, Salmonella enterica enterica serovar Typhi Ty2
ggcugaaagcgccuu

SEQ ID NO: 3723940 - RNA, 16 nt, Salmonella enterica enterica serovar Typhi Ty2
ggcugaaaucacgcca

SEQ ID NO: 3723941 - RNA, 16 nt, Salmonella enterica enterica serovar Typhi Ty2
ggcugaacgccaggcc

SEQ ID NO: 3723942 - RNA, 12 nt, Salmonella enterica enterica serovar Typhi Ty2
ggcugaagcccc

SEQ ID NO: 3723943 - RNA, 23 nt, Salmonella enterica enterica serovar Typhi Ty2
gggaguaguguaauaccacugcc

SEQ ID NO: 3723944 - RNA, 19 nt, Salmonella enterica enterica serovar Typhi Ty2
gggauaaagaucuuuacgc

SEQ ID NO: 3723945 - RNA, 19 nt, Salmonella enterica enterica serovar Typhi Ty2
gggauaacgauucccgccg

SEQ ID NO: 3723946 - RNA, 18 nt, Salmonella enterica enterica serovar Typhi Ty2
gggauaaugacauccaga

SEQ ID NO: 3723947 - RNA, 13 nt, Salmonella enterica enterica serovar Typhi Ty2
gggauauaaaauu

SEQ ID NO: 3723948 - RNA, 20 nt, Salmonella enterica enterica serovar Typhi Ty2
gggauauuuccgcgauuugc

SEQ ID NO: 3723949 - RNA, 18 nt, Salmonella enterica enterica serovar Typhi Ty2
gggaucaauuuugcucuc

SEQ ID NO: 3723950 - RNA, 16 nt, Salmonella enterica enterica serovar Typhi Ty2
gggaucgguuuauccc

SEQ ID NO: 3723951 - RNA, 16 nt, Salmonella enterica enterica serovar Typhi Ty2
gggaucuucaaugaac

SEQ ID NO: 3723952 - RNA, 15 nt, Salmonella enterica enterica serovar Typhi Ty2
gggaucuuuuucagc

SEQ ID NO: 3723953 - RNA, 16 nt, Salmonella enterica enterica serovar Typhi Ty2
gggaugguuaaauuca

SEQ ID NO: 3723954 - RNA, 17 nt, Salmonella enterica enterica serovar Typhi Ty2
gggauguugccacaggc

SEQ ID NO: 3723955 - RNA, 20 nt, Salmonella enterica enterica serovar Typhi Ty2
gggauugcaaaaaacacugg

SEQ ID NO: 3723956 - RNA, 19 nt, Salmonella enterica enterica serovar Typhi Ty2
gggauuuccuggcaguuca

SEQ ID NO: 3723957 - RNA, 21 nt, Salmonella enterica enterica serovar Typhi Ty2
gggauuucuucccuugccgcc

SEQ ID NO: 3723958 - RNA, 16 nt, Salmonella enterica enterica serovar Typhi Ty2
gggauuugaugcccaa

SEQ ID NO: 3723959 - RNA, 13 nt, Salmonella enterica enterica serovar Typhi Ty2
gggcaaaaaacgg

SEQ ID NO: 3723960 - RNA, 23 nt, Salmonella enterica enterica serovar Typhi Ty2
gggcaacaaacauaagcaaaucc

SEQ ID NO: 3723961 - RNA, 24 nt, Salmonella enterica enterica serovar Typhi Ty2
gggcaacccggcuaaaugacgcgc

SEQ ID NO: 3723962 - RNA, 13 nt, Salmonella enterica enterica serovar Typhi Ty2
gggcaagcucagc

SEQ ID NO: 3723963 - RNA, 20 nt, Salmonella enterica enterica serovar Typhi Ty2
gggcaauccauuaauggcgc

SEQ ID NO: 3723964 - RNA, 12 nt, Salmonella enterica enterica serovar Typhi Ty2
gggcagaaaaau

SEQ ID NO: 3723965 - RNA, 20 nt, Salmonella enterica enterica serovar Typhi Ty2
gggcagaaacguaccugaga

SEQ ID NO: 3723966 - RNA, 20 nt, Salmonella enterica enterica serovar Typhi Ty2
gggcagacauucgcgcacgg

SEQ ID NO: 3723967 - RNA, 14 nt, Salmonella enterica enterica serovar Typhi Ty2
gggcagacuuucug

SEQ ID NO: 3723968 - RNA, 16 nt, Salmonella enterica enterica serovar Typhi Ty2
gggcagcagcaggcug

SEQ ID NO: 3723969 - RNA, 22 nt, Salmonella enterica enterica serovar Typhi Ty2
gggcagcaucucgauuacagcg

SEQ ID NO: 3723970 - RNA, 12 nt, Salmonella enterica enterica serovar Typhi Ty2
gggcaggcgugu

SEQ ID NO: 3723971 - RNA, 18 nt, Salmonella enterica enterica serovar Typhi Ty2
gggcaucccgucccacca

SEQ ID NO: 3723972 - RNA, 15 nt, Salmonella enterica enterica serovar Typhi Ty2
gggcauggcucuccg

SEQ ID NO: 3723973 - RNA, 23 nt, Salmonella enterica enterica serovar Typhi Ty2
gggccagaaguagcagagaaaag

SEQ ID NO: 3723974 - RNA, 14 nt, Salmonella enterica enterica serovar Typhi Ty2
gggccagcagccag

SEQ ID NO: 3723975 - RNA, 17 nt, Salmonella enterica enterica serovar Typhi Ty2
gggccagcucuuuucug

SEQ ID NO: 3723976 - RNA, 24 nt, Salmonella enterica enterica serovar Typhi Ty2
gggccaguuuccugacccgcucgu

SEQ ID NO: 3723977 - RNA, 20 nt, Salmonella enterica enterica serovar Typhi Ty2
gggccauacacucaaccaac

SEQ ID NO: 3723978 - RNA, 14 nt, Salmonella enterica enterica serovar Typhi Ty2
gggccgacaggcgg

SEQ ID NO: 3723979 - RNA, 23 nt, Salmonella enterica enterica serovar Typhi Ty2
gggccuacagguacagaugcugu

SEQ ID NO: 3723980 - RNA, 23 nt, Salmonella enterica enterica serovar Typhi Ty2
gggccuacgagauaaaaacgggu

SEQ ID NO: 3723981 - RNA, 21 nt, Salmonella enterica enterica serovar Typhi Ty2
gggccuacggauucgcugcug

SEQ ID NO: 3723982 - RNA, 15 nt, Salmonella enterica enterica serovar Typhi Ty2
gggcgaacuggcggu

SEQ ID NO: 3723983 - RNA, 23 nt, Salmonella enterica enterica serovar Typhi Ty2
gggcgagauguuuuaccaguaca

SEQ ID NO: 3723984 - RNA, 15 nt, Salmonella enterica enterica serovar Typhi Ty2
gggcgauaaaccagc

SEQ ID NO: 3723985 - RNA, 13 nt, Salmonella enterica enterica serovar Typhi Ty2
gggcgaugcgcga

SEQ ID NO: 3723986 - RNA, 13 nt, Salmonella enterica enterica serovar Typhi Ty2
gggcgcacagcgc

SEQ ID NO: 3723987 - RNA, 15 nt, Salmonella enterica enterica serovar Typhi Ty2
gggcgcacagcgcca

SEQ ID NO: 3723988 - RNA, 15 nt, Salmonella enterica enterica serovar Typhi Ty2
gggcgcaugaggccu

SEQ ID NO: 3723989 - RNA, 16 nt, Salmonella enterica enterica serovar Typhi Ty2
gggcgcggcugguaag

SEQ ID NO: 3723990 - RNA, 13 nt, Salmonella enterica enterica serovar Typhi Ty2
gggcgcugauuuu

SEQ ID NO: 3723991 - RNA, 12 nt, Salmonella enterica enterica serovar Typhi Ty2
gggcgcuggcgu

SEQ ID NO: 3723992 - RNA, 15 nt, Salmonella enterica enterica serovar Typhi Ty2
gggcgggcagcagca

SEQ ID NO: 3723993 - RNA, 15 nt, Salmonella enterica enterica serovar Typhi Ty2
gggcgugacgcgcca

SEQ ID NO: 3723994 - RNA, 17 nt, Salmonella enterica enterica serovar Typhi Ty2
gggcguuuguuguagcc

SEQ ID NO: 3723995 - RNA, 16 nt, Salmonella enterica enterica serovar Typhi Ty2
gggcuaaagcaucggg

SEQ ID NO: 3723996 - RNA, 19 nt, Salmonella enterica enterica serovar Typhi Ty2
gggcuaaaugcccacggcg

SEQ ID NO: 3723997 - RNA, 22 nt, Salmonella enterica enterica serovar Typhi Ty2
gggcucauuuuauccaacagcg

SEQ ID NO: 3723998 - RNA, 22 nt, Salmonella enterica enterica serovar Typhi Ty2
gggcugauuuuuuugcuggccg

SEQ ID NO: 3723999 - RNA, 19 nt, Salmonella enterica enterica serovar Typhi Ty2
gggcugcacgccaucggcu

SEQ ID NO: 3724000 - RNA, 15 nt, Salmonella enterica enterica serovar Typhi Ty2
gggcugccaucaggc

SEQ ID NO: 3724001 - RNA, 13 nt, Salmonella enterica enterica serovar Typhi Ty2
gggcugcggcaaa

SEQ ID NO: 3724002 - RNA, 12 nt, Salmonella enterica enterica serovar Typhi Ty2
gggcuuaaucag

SEQ ID NO: 3724003 - RNA, 15 nt, Salmonella enterica enterica serovar Typhi Ty2
gggcuuaaugcgcac

SEQ ID NO: 3724004 - RNA, 20 nt, Salmonella enterica enterica serovar Typhi Ty2
gggcuuccucgccaccggca

SEQ ID NO: 3724005 - RNA, 23 nt, Salmonella enterica enterica serovar Typhi Ty2
gggcuuucccguuucagccccuu

SEQ ID NO: 3724006 - RNA, 15 nt, Salmonella enterica enterica serovar Typhi Ty2
gggcuuuuagccgcg

SEQ ID NO: 3724007 - RNA, 23 nt, Salmonella enterica enterica serovar Typhi Ty2
ggggaacacuaaaacaccgguug

SEQ ID NO: 3724008 - RNA, 22 nt, Salmonella enterica enterica serovar Typhi Ty2
ggggaacggcagacagccgcgg

SEQ ID NO: 3724009 - RNA, 16 nt, Salmonella enterica enterica serovar Typhi Ty2
ggggauaaccagaaaa

SEQ ID NO: 3724010 - RNA, 15 nt, Salmonella enterica enterica serovar Typhi Ty2
ggggauucugccauc

SEQ ID NO: 3724011 - RNA, 16 nt, Salmonella enterica enterica serovar Typhi Ty2
ggggcaagcucuucgg

SEQ ID NO: 3724012 - RNA, 18 nt, Salmonella enterica enterica serovar Typhi Ty2
ggggccacaggcggcaug

SEQ ID NO: 3724013 - RNA, 14 nt, Salmonella enterica enterica serovar Typhi Ty2
ggggccgggaaaga

SEQ ID NO: 3724014 - RNA, 14 nt, Salmonella enterica enterica serovar Typhi Ty2
ggggcgacagcccc

SEQ ID NO: 3724015 - RNA, 13 nt, Salmonella enterica enterica serovar Typhi Ty2
ggggcgaccggcu

SEQ ID NO: 3724016 - RNA, 14 nt, Salmonella enterica enterica serovar Typhi Ty2
ggggcuccugcgcc

SEQ ID NO: 3724017 - RNA, 18 nt, Salmonella enterica enterica serovar Typhi Ty2
ggggcuuugugccgcaca

SEQ ID NO: 3724018 - RNA, 21 nt, Salmonella enterica enterica serovar Typhi Ty2
gggggaaaugagaaaaggaag

SEQ ID NO: 3724019 - RNA, 17 nt, Salmonella enterica enterica serovar Typhi Ty2
gggggaacggcagacag

SEQ ID NO: 3724020 - RNA, 12 nt, Salmonella enterica enterica serovar Typhi Ty2
ggggugaaacag

SEQ ID NO: 3724021 - RNA, 22 nt, Salmonella enterica enterica serovar Typhi Ty2
gggguucaauagcacaucagcc

SEQ ID NO: 3724022 - RNA, 16 nt, Salmonella enterica enterica serovar Typhi Ty2
gggguucagaccagaa

SEQ ID NO: 3724023 - RNA, 21 nt, Salmonella enterica enterica serovar Typhi Ty2
ggguaaauagacuguugaaag

SEQ ID NO: 3724024 - RNA, 14 nt, Salmonella enterica enterica serovar Typhi Ty2
ggguaaauccgcga

SEQ ID NO: 3724025 - RNA, 21 nt, Salmonella enterica enterica serovar Typhi Ty2
gguagucaaauuccagcaaug

SEQ ID NO: 3724026 - RNA, 14 nt, Salmonella enterica enterica serovar Typhi Ty2
gguagucacggaga

SEQ ID NO: 3724027 - RNA, 15 nt, Salmonella enterica enterica serovar Typhi Ty2
gguaguccaaauaag

SEQ ID NO: 3724028 - RNA, 19 nt, Salmonella enterica enterica serovar Typhi Ty2
gguauagaauacuuccugc

SEQ ID NO: 3724029 - RNA, 21 nt, Salmonella enterica enterica serovar Typhi Ty2
gguauauaaaucaaaagugca

SEQ ID NO: 3724030 - RNA, 14 nt, Salmonella enterica enterica serovar Typhi Ty2
gguauccagcagaa

SEQ ID NO: 3724031 - RNA, 14 nt, Salmonella enterica enterica serovar Typhi Ty2
gguauccuccugcc

SEQ ID NO: 3724032 - RNA, 14 nt, Salmonella enterica enterica serovar Typhi Ty2
gguauccugaacca

SEQ ID NO: 3724033 - RNA, 18 nt, Salmonella enterica enterica serovar Typhi Ty2
gguaucuaacccgcucag

SEQ ID NO: 3724034 - RNA, 22 nt, Salmonella enterica enterica serovar Typhi Ty2
gguaucugggcggcaaaauuga

SEQ ID NO: 3724035 - RNA, 12 nt, Salmonella enterica enterica serovar Typhi Ty2
gguaugaaacau

SEQ ID NO: 3724036 - RNA, 16 nt, Salmonella enterica enterica serovar Typhi Ty2
gguaugaaacauauau

SEQ ID NO: 3724037 - RNA, 19 nt, Salmonella enterica enterica serovar Typhi Ty2
gguaugccuuccagaaaua

SEQ ID NO: 3724038 - RNA, 16 nt, Salmonella enterica enterica serovar Typhi Ty2
gguauguuugucgacc

SEQ ID NO: 3724039 - RNA, 14 nt, Salmonella enterica enterica serovar Typhi Ty2
gguauuauccgccg

SEQ ID NO: 3724040 - RNA, 23 nt, Salmonella enterica enterica serovar Typhi Ty2
gguauucaacgccaucuuccuca

SEQ ID NO: 3724041 - RNA, 18 nt, Salmonella enterica enterica serovar Typhi Ty2
gguauucaccaaaaggca

SEQ ID NO: 3724042 - RNA, 23 nt, Salmonella enterica enterica serovar Typhi Ty2
gguauugaauccggguuccugca

SEQ ID NO: 3724043 - RNA, 15 nt, Salmonella enterica enterica serovar Typhi Ty2
gguauugcuuucaau

SEQ ID NO: 3724044 - RNA, 17 nt, Salmonella enterica enterica serovar Typhi Ty2
gguauuuauccagcagg

SEQ ID NO: 3724045 - RNA, 18 nt, Salmonella enterica enterica serovar Typhi Ty2
gguauuucugaaaaaccg

SEQ ID NO: 3724046 - RNA, 20 nt, Salmonella enterica enterica serovar Typhi Ty2
ggucaaaaaagcgacgcugu

SEQ ID NO: 3724047 - RNA, 14 nt, Salmonella enterica enterica serovar Typhi Ty2
ggucaacaggcuga

SEQ ID NO: 3724048 - RNA, 17 nt, Salmonella enterica enterica serovar Typhi Ty2
ggucaacgcgccgccaa

SEQ ID NO: 3724049 - RNA, 19 nt, Salmonella enterica enterica serovar Typhi Ty2
ggucaauaagauauccugc

SEQ ID NO: 3724050 - RNA, 13 nt, Salmonella enterica enterica serovar Typhi Ty2
ggucaaucaucag

SEQ ID NO: 3724051 - RNA, 21 nt, Salmonella enterica enterica serovar Typhi Ty2
ggucacaucgcccugauggcg

SEQ ID NO: 3724052 - RNA, 15 nt, Salmonella enterica enterica serovar Typhi Ty2
ggucagaaauccgcg

SEQ ID NO: 3724053 - RNA, 19 nt, Salmonella enterica enterica serovar Typhi Ty2
ggucagcaacgccuccagc

SEQ ID NO: 3724054 - RNA, 17 nt, Salmonella enterica enterica serovar Typhi Ty2
ggucagcauuucaucca

SEQ ID NO: 3724055 - RNA, 23 nt, Salmonella enterica enterica serovar Typhi Ty2
ggucagcauuucauccauuaaac

SEQ ID NO: 3724056 - RNA, 13 nt, Salmonella enterica enterica serovar Typhi Ty2
ggucaggcuaaau

SEQ ID NO: 3724057 - RNA, 20 nt, Salmonella enterica enterica serovar Typhi Ty2
ggucaggcugcggacauuaa

SEQ ID NO: 3724058 - RNA, 15 nt, Salmonella enterica enterica serovar Typhi Ty2
ggucaguacgcgcgu

SEQ ID NO: 3724059 - RNA, 19 nt, Salmonella enterica enterica serovar Typhi Ty2
ggucauacugugcgugaug

SEQ ID NO: 3724060 - RNA, 19 nt, Salmonella enterica enterica serovar Typhi Ty2
ggucaucaccuccagcacg

SEQ ID NO: 3724061 - RNA, 21 nt, Salmonella enterica enterica serovar Typhi Ty2
ggucaucgaaggcaucuucag

SEQ ID NO: 3724062 - RNA, 11 nt, Salmonella enterica enterica serovar Typhi Ty2
ggucaucggcg

SEQ ID NO: 3724063 - RNA, 17 nt, Salmonella enterica enterica serovar Typhi Ty2
ggucauuauucaggccu

SEQ ID NO: 3724064 - RNA, 21 nt, Salmonella enterica enterica serovar Typhi Ty2
gguccggcgcuaaccagcgcu

SEQ ID NO: 3724065 - RNA, 23 nt, Salmonella enterica enterica serovar Typhi Ty2
gguccucugauaagucccggacc

SEQ ID NO: 3724066 - RNA, 19 nt, Salmonella enterica enterica serovar Typhi Ty2
ggucgacagccacacgcca

SEQ ID NO: 3724067 - RNA, 21 nt, Salmonella enterica enterica serovar Typhi Ty2
ggucgacguuguccggcgacc

SEQ ID NO: 3724068 - RNA, 18 nt, Salmonella enterica enterica serovar Typhi Ty2
ggucgagcuuuugcugcg

SEQ ID NO: 3724069 - RNA, 18 nt, Salmonella enterica enterica serovar Typhi Ty2
ggucgcgacggccagcau

SEQ ID NO: 3724070 - RNA, 22 nt, Salmonella enterica enterica serovar Typhi Ty2
ggucgcgccaaaagaggcagca

SEQ ID NO: 3724071 - RNA, 14 nt, Salmonella enterica enterica serovar Typhi Ty2
ggucgcggucggcc

SEQ ID NO: 3724072 - RNA, 14 nt, Salmonella enterica enterica serovar Typhi Ty2
ggucgcuauccagc

SEQ ID NO: 3724073 - RNA, 16 nt, Salmonella enterica enterica serovar Typhi Ty2
ggucgcuauccagcag

SEQ ID NO: 3724074 - RNA, 15 nt, Salmonella enterica enterica serovar Typhi Ty2
ggucgcucuggucga

SEQ ID NO: 3724075 - RNA, 23 nt, Salmonella enterica enterica serovar Typhi Ty2
ggucgcuuuuugcgccagcgcca

SEQ ID NO: 3724076 - RNA, 22 nt, Salmonella enterica enterica serovar Typhi Ty2
ggucggcguugcgcccaggcca

SEQ ID NO: 3724077 - RNA, 16 nt, Salmonella enterica enterica serovar Typhi Ty2
ggucgggcaggcuucc

SEQ ID NO: 3724078 - RNA, 17 nt, Salmonella enterica enterica serovar Typhi Ty2
ggucguaaugagcacuu

SEQ ID NO: 3724079 - RNA, 19 nt, Salmonella enterica enterica serovar Typhi Ty2
ggucguacuaaagagcgcc

SEQ ID NO: 3724080 - RNA, 13 nt, Salmonella enterica enterica serovar Typhi Ty2
ggucgucagccgu

SEQ ID NO: 3724081 - RNA, 19 nt, Salmonella enterica enterica serovar Typhi Ty2
ggucgucugaaagcgacuc

SEQ ID NO: 3724082 - RNA, 22 nt, Salmonella enterica enterica serovar Typhi Ty2
ggucgucuggaguacgggcaga

SEQ ID NO: 3724083 - RNA, 15 nt, Salmonella enterica enterica serovar Typhi Ty2
ggucgucuucuugcg

SEQ ID NO: 3724084 - RNA, 19 nt, Salmonella enterica enterica serovar Typhi Ty2
ggucucauagcgccccagu

SEQ ID NO: 3724085 - RNA, 17 nt, Salmonella enterica enterica serovar Typhi Ty2
ggucuccaucagacguu

SEQ ID NO: 3724086 - RNA, 21 nt, Salmonella enterica enterica serovar Typhi Ty2
ggucuccgccuggaacccagg

SEQ ID NO: 3724087 - RNA, 21 nt, Salmonella enterica enterica serovar Typhi Ty2
ggucugauaagcgcagcgcca

SEQ ID NO: 3724088 - RNA, 23 nt, Salmonella enterica enterica serovar Typhi Ty2
ggucugcauucaggccucugcuu

SEQ ID NO: 3724089 - RNA, 19 nt, Salmonella enterica enterica serovar Typhi Ty2
ggucugcgcgccgcaggcc

SEQ ID NO: 3724090 - RNA, 22 nt, Salmonella enterica enterica serovar Typhi Ty2
ggucuggauuacaaaaauagac

SEQ ID NO: 3724091 - RNA, 20 nt, Salmonella enterica enterica serovar Typhi Ty2
ggucuguaugacaacauaaa

SEQ ID NO: 3724092 - RNA, 13 nt, Salmonella enterica enterica serovar Typhi Ty2
ggucuugauggcg

SEQ ID NO: 3724093 - RNA, 13 nt, Salmonella enterica enterica serovar Typhi Ty2
ggucuuuuucgca

SEQ ID NO: 3724094 - RNA, 22 nt, Salmonella enterica enterica serovar Typhi Ty2
ggugaaaaaagccggacgggcg

SEQ ID NO: 3724095 - RNA, 16 nt, Salmonella enterica enterica serovar Typhi Ty2
ggugaaaaaucauuau

SEQ ID NO: 3724096 - RNA, 19 nt, Salmonella enterica enterica serovar Typhi Ty2
ggugaaaaaucauuaucac

SEQ ID NO: 3724097 - RNA, 12 nt, Salmonella enterica enterica serovar Typhi Ty2
ggugaagacgcu

SEQ ID NO: 3724098 - RNA, 20 nt, Salmonella enterica enterica serovar Typhi Ty2
ggugaaggcaaaacaccaua

SEQ ID NO: 3724099 - RNA, 22 nt, Salmonella enterica enterica serovar Typhi Ty2
ggugacgaagaucgcguacagc

SEQ ID NO: 3724100 - RNA, 16 nt, Salmonella enterica enterica serovar Typhi Ty2
ggugacggaaaccagc

SEQ ID NO: 3724101 - RNA, 20 nt, Salmonella enterica enterica serovar Typhi Ty2
ggugacggcaacggcgacaa

SEQ ID NO: 3724102 - RNA, 23 nt, Salmonella enterica enterica serovar Typhi Ty2
ggugagaucgguaauuuccacgc

SEQ ID NO: 3724103 - RNA, 12 nt, Salmonella enterica enterica serovar Typhi Ty2
ggugagcgccgc

SEQ ID NO: 3724104 - RNA, 21 nt, Salmonella enterica enterica serovar Typhi Ty2
ggugagcucauccagcguuuc

SEQ ID NO: 3724105 - RNA, 19 nt, Salmonella enterica enterica serovar Typhi Ty2
ggugagcuccagcccgccg

SEQ ID NO: 3724106 - RNA, 22 nt, Salmonella enterica enterica serovar Typhi Ty2
ggugagcuccagcccgccgccc

SEQ ID NO: 3724107 - RNA, 18 nt, Salmonella enterica enterica serovar Typhi Ty2
gguuucgauagcaggcac

SEQ ID NO: 3724108 - RNA, 19 nt, Salmonella enterica enterica serovar Typhi Ty2
gguuucguggcgcuguucu

SEQ ID NO: 3724109 - RNA, 14 nt, Salmonella enterica enterica serovar Typhi Ty2
gguuucuucgcugg

SEQ ID NO: 3724110 - RNA, 11 nt, Salmonella enterica enterica serovar Typhi Ty2
gguuucuuuuu

SEQ ID NO: 3724111 - RNA, 14 nt, Salmonella enterica enterica serovar Typhi Ty2
gguuugcagcagag

SEQ ID NO: 3724112 - RNA, 17 nt, Salmonella enterica enterica serovar Typhi Ty2
gguuuggacuaccggua

SEQ ID NO: 3724113 - RNA, 23 nt, Salmonella enterica enterica serovar Typhi Ty2
gguuugucgcuuuucacggucaa

SEQ ID NO: 3724114 - RNA, 20 nt, Salmonella enterica enterica serovar Typhi Ty2
gguuugugucguaguggcau

SEQ ID NO: 3724115 - RNA, 16 nt, Salmonella enterica enterica serovar Typhi Ty2
gguuuuuaagcugccc

SEQ ID NO: 3724116 - RNA, 15 nt, Salmonella enterica enterica serovar Typhi Ty2
gguuuuuauggaagg

SEQ ID NO: 3724117 - RNA, 12 nt, Salmonella enterica enterica serovar Typhi Ty2
gguuuuuuaaug

SEQ ID NO: 3724118 - RNA, 19 nt, Salmonella enterica enterica serovar Typhi Ty2
gguuuuuuuauaacauaaa

SEQ ID NO: 3724119 - RNA, 13 nt, Salmonella enterica enterica serovar Typhi Ty2
guaaaaaaaccgu

SEQ ID NO: 3724120 - RNA, 22 nt, Salmonella enterica enterica serovar Typhi Ty2
guaaaaaaaccguaucacugua

SEQ ID NO: 3724121 - RNA, 13 nt, Salmonella enterica enterica serovar Typhi Ty2
guaaaaaaauaaa

SEQ ID NO: 3724122 - RNA, 16 nt, Salmonella enterica enterica serovar Typhi Ty2
guaaaaacccuuucau

SEQ ID NO: 3724123 - RNA, 12 nt, Salmonella enterica enterica serovar Typhi Ty2
guaaaaagcuga

SEQ ID NO: 3724124 - RNA, 20 nt, Salmonella enterica enterica serovar Typhi Ty2
guaaaaaguugacguaacgc

SEQ ID NO: 3724125 - RNA, 13 nt, Salmonella enterica enterica serovar Typhi Ty2
guaaaaccagaua

SEQ ID NO: 3724126 - RNA, 16 nt, Salmonella enterica enterica serovar Typhi Ty2
guaaaaccgacuauca

SEQ ID NO: 3724127 - RNA, 13 nt, Salmonella enterica enterica serovar Typhi Ty2
guaaaaccggcac

SEQ ID NO: 3724128 - RNA, 20 nt, Salmonella enterica enterica serovar Typhi Ty2
guaaaacuggcuaucgccgu

SEQ ID NO: 3724129 - RNA, 15 nt, Salmonella enterica enterica serovar Typhi Ty2
guaaaaucaacagca

SEQ ID NO: 3724130 - RNA, 16 nt, Salmonella enterica enterica serovar Typhi Ty2
guaaaaucaacagcaa

SEQ ID NO: 3724131 - RNA, 21 nt, Salmonella enterica enterica serovar Typhi Ty2
guaaaauccggcaggcagccg

SEQ ID NO: 3724132 - RNA, 17 nt, Salmonella enterica enterica serovar Typhi Ty2
guaaaauccuuuuucau

SEQ ID NO: 3724133 - RNA, 21 nt, Salmonella enterica enterica serovar Typhi Ty2
guaaacaauggaacuaucaau

SEQ ID NO: 3724134 - RNA, 13 nt, Salmonella enterica enterica serovar Typhi Ty2
guaaacagaugcu

SEQ ID NO: 3724135 - RNA, 15 nt, Salmonella enterica enterica serovar Typhi Ty2
guaaacaggcaggcc

SEQ ID NO: 3724136 - RNA, 14 nt, Salmonella enterica enterica serovar Typhi Ty2
guaaaccaggccag

SEQ ID NO: 3724137 - RNA, 16 nt, Salmonella enterica enterica serovar Typhi Ty2
guaaaccauuucuccu

SEQ ID NO: 3724138 - RNA, 21 nt, Salmonella enterica enterica serovar Typhi Ty2
guaaacccgauucugccaguu

SEQ ID NO: 3724139 - RNA, 15 nt, Salmonella enterica enterica serovar Typhi Ty2
guaaacgcgaccagc

SEQ ID NO: 3724140 - RNA, 15 nt, Salmonella enterica enterica serovar Typhi Ty2
guaaacggaaccaaa

SEQ ID NO: 3724141 - RNA, 23 nt, Salmonella enterica enterica serovar Typhi Ty2
guaaacgugcuggauggcagaca

SEQ ID NO: 3724142 - RNA, 19 nt, Salmonella enterica enterica serovar Typhi Ty2
guaaacucacccaggcgau

SEQ ID NO: 3724143 - RNA, 19 nt, Salmonella enterica enterica serovar Typhi Ty2
guaaagaaauuuaaagaua

SEQ ID NO: 3724144 - RNA, 22 nt, Salmonella enterica enterica serovar Typhi Ty2
guaaagacaccguucuggcugc

SEQ ID NO: 3724145 - RNA, 18 nt, Salmonella enterica enterica serovar Typhi Ty2
guaaagaccgggcgcggu

SEQ ID NO: 3724146 - RNA, 23 nt, Salmonella enterica enterica serovar Typhi Ty2
guaaagauuaauaauugagcgca

SEQ ID NO: 3724147 - RNA, 14 nt, Salmonella enterica enterica serovar Typhi Ty2
guaaagcauggcug

SEQ ID NO: 3724148 - RNA, 19 nt, Salmonella enterica enterica serovar Typhi Ty2
guaaaggcguagaucucua

SEQ ID NO: 3724149 - RNA, 16 nt, Salmonella enterica enterica serovar Typhi Ty2
guaaaggggagcccag

SEQ ID NO: 3724150 - RNA, 16 nt, Salmonella enterica enterica serovar Typhi Ty2
guaaaguuauucacgu

SEQ ID NO: 3724151 - RNA, 13 nt, Salmonella enterica enterica serovar Typhi Ty2
guaaauacccagg

SEQ ID NO: 3724152 - RNA, 15 nt, Salmonella enterica enterica serovar Typhi Ty2
guaaauagaaaauaa

SEQ ID NO: 3724153 - RNA, 22 nt, Salmonella enterica enterica serovar Typhi Ty2
guaaauagaaaauaauucuuaa

SEQ ID NO: 3724154 - RNA, 13 nt, Salmonella enterica enterica serovar Typhi Ty2
guaaauagcccgg

SEQ ID NO: 3724155 - RNA, 15 nt, Salmonella enterica enterica serovar Typhi Ty2
guaaauauugauuaa

SEQ ID NO: 3724156 - RNA, 20 nt, Salmonella enterica enterica serovar Typhi Ty2
guaaaucaggccaagcaaca

SEQ ID NO: 3724157 - RNA, 16 nt, Salmonella enterica enterica serovar Typhi Ty2
guaaauccaauagacu

SEQ ID NO: 3724158 - RNA, 14 nt, Salmonella enterica enterica serovar Typhi Ty2
guaaauccgcgaug

SEQ ID NO: 3724159 - RNA, 21 nt, Salmonella enterica enterica serovar Typhi Ty2
guaaaucgcgagccuucaaca

SEQ ID NO: 3724160 - RNA, 16 nt, Salmonella enterica enterica serovar Typhi Ty2
guaaaugacgccagac

SEQ ID NO: 3724161 - RNA, 19 nt, Salmonella enterica enterica serovar Typhi Ty2
guaaaugccuuauccggcc

SEQ ID NO: 3724162 - RNA, 17 nt, Salmonella enterica enterica serovar Typhi Ty2
guaaauuccuuguuuua

SEQ ID NO: 3724163 - RNA, 21 nt, Salmonella enterica enterica serovar Typhi Ty2
guaaauucucuauacugcuga

SEQ ID NO: 3724164 - RNA, 23 nt, Salmonella enterica enterica serovar Typhi Ty2
guaaauugaguggacaucgccau

SEQ ID NO: 3724165 - RNA, 20 nt, Salmonella enterica enterica serovar Typhi Ty2
guaaauuuaucgaucuccau

SEQ ID NO: 3724166 - RNA, 13 nt, Salmonella enterica enterica serovar Typhi Ty2
guaaauuuauggu

SEQ ID NO: 3724167 - RNA, 16 nt, Salmonella enterica enterica serovar Typhi Ty2
guaaauuuaugguucc

SEQ ID NO: 3724168 - RNA, 20 nt, Salmonella enterica enterica serovar Typhi Ty2
guaaauuucaacccgaucgc

SEQ ID NO: 3724169 - RNA, 13 nt, Salmonella enterica enterica serovar Typhi Ty2
guaacaaccagaa

SEQ ID NO: 3724170 - RNA, 18 nt, Salmonella enterica enterica serovar Typhi Ty2
guaacaacuguuuuucac

SEQ ID NO: 3724171 - RNA, 22 nt, Salmonella enterica enterica serovar Typhi Ty2
guaacagacgcaucuuuuuccc

SEQ ID NO: 3724172 - RNA, 13 nt, Salmonella enterica enterica serovar Typhi Ty2
guaacagcgguau

SEQ ID NO: 3724173 - RNA, 16 nt, Salmonella enterica enterica serovar Typhi Ty2
guaacaggcaccagcg

SEQ ID NO: 3724174 - RNA, 17 nt, Salmonella enterica enterica serovar Typhi Ty2
guaacaucaaguacagc

SEQ ID NO: 3724175 - RNA, 23 nt, Salmonella enterica enterica serovar Typhi Ty2
guaaccccauacaguaguuuuca

SEQ ID NO: 3724176 - RNA, 17 nt, Salmonella enterica enterica serovar Typhi Ty2
guaaccccugcccgcga

SEQ ID NO: 3724177 - RNA, 15 nt, Salmonella enterica enterica serovar Typhi Ty2
guaacccgccgccau

SEQ ID NO: 3724178 - RNA, 23 nt, Salmonella enterica enterica serovar Typhi Ty2
guaaccgaacuggguaugcagug

SEQ ID NO: 3724179 - RNA, 14 nt, Salmonella enterica enterica serovar Typhi Ty2
guaaccgccacagc

SEQ ID NO: 3724180 - RNA, 16 nt, Salmonella enterica enterica serovar Typhi Ty2
guaaccuauuuuacaa

SEQ ID NO: 3724181 - RNA, 18 nt, Salmonella enterica enterica serovar Typhi Ty2
guaaccuauuuuacaaaa

SEQ ID NO: 3724182 - RNA, 20 nt, Salmonella enterica enterica serovar Typhi Ty2
guaaccuuucaccuuacccg

SEQ ID NO: 3724183 - RNA, 16 nt, Salmonella enterica enterica serovar Typhi Ty2
guaaccuuuuuauggc

SEQ ID NO: 3724184 - RNA, 16 nt, Salmonella enterica enterica serovar Typhi Ty2
guaacgauaaaaugca

SEQ ID NO: 3724185 - RNA, 14 nt, Salmonella enterica enterica serovar Typhi Ty2
guaacgcacuuuuc

SEQ ID NO: 3724186 - RNA, 14 nt, Salmonella enterica enterica serovar Typhi Ty2
guaacgccuccacc

SEQ ID NO: 3724187 - RNA, 21 nt, Salmonella enterica enterica serovar Typhi Ty2
guaacgccuggcgcauuuuaa

SEQ ID NO: 3724188 - RNA, 17 nt, Salmonella enterica enterica serovar Typhi Ty2
guaacggaaaagcauug

SEQ ID NO: 3724189 - RNA, 19 nt, Salmonella enterica enterica serovar Typhi Ty2
guacaagagccgccgccau

SEQ ID NO: 3724190 - RNA, 15 nt, Salmonella enterica enterica serovar Typhi Ty2
guacaauggcaggca

SEQ ID NO: 3724191 - RNA, 17 nt, Salmonella enterica enterica serovar Typhi Ty2
guacacauaugggaaga

SEQ ID NO: 3724192 - RNA, 19 nt, Salmonella enterica enterica serovar Typhi Ty2
guacaccaguacaucuuca

SEQ ID NO: 3724193 - RNA, 19 nt, Salmonella enterica enterica serovar Typhi Ty2
guacaccugcaacuccugg

SEQ ID NO: 3724194 - RNA, 15 nt, Salmonella enterica enterica serovar Typhi Ty2
guacacgaaauagcg

SEQ ID NO: 3724195 - RNA, 14 nt, Salmonella enterica enterica serovar Typhi Ty2
guacacgcagucca

SEQ ID NO: 3724196 - RNA, 20 nt, Salmonella enterica enterica serovar Typhi Ty2
guacacuucagccagacgcu

SEQ ID NO: 3724197 - RNA, 23 nt, Salmonella enterica enterica serovar Typhi Ty2
guacacuucauccggcguugcgc

SEQ ID NO: 3724198 - RNA, 16 nt, Salmonella enterica enterica serovar Typhi Ty2
guacagacaucaucga

SEQ ID NO: 3724199 - RNA, 17 nt, Salmonella enterica enterica serovar Typhi Ty2
guacagcaauaaaagga

SEQ ID NO: 3724200 - RNA, 17 nt, Salmonella enterica enterica serovar Typhi Ty2
guacagccuaaaaaacc

SEQ ID NO: 3724201 - RNA, 23 nt, Salmonella enterica enterica serovar Typhi Ty2
guacagcuuaaucaccagcgcau

SEQ ID NO: 3724202 - RNA, 17 nt, Salmonella enterica enterica serovar Typhi Ty2
guacauaacagcagcag

SEQ ID NO: 3724203 - RNA, 23 nt, Salmonella enterica enterica serovar Typhi Ty2
guacauauacugucuuguggaac

SEQ ID NO: 3724204 - RNA, 11 nt, Salmonella enterica enterica serovar Typhi Ty2
guacauaucca

SEQ ID NO: 3724205 - RNA, 13 nt, Salmonella enterica enterica serovar Typhi Ty2
guacaucauuggc

SEQ ID NO: 3724206 - RNA, 16 nt, Salmonella enterica enterica serovar Typhi Ty2
guacaucgcgcugacc

SEQ ID NO: 3724207 - RNA, 13 nt, Salmonella enterica enterica serovar Typhi Ty2
guacaugaauaau

SEQ ID NO: 3724208 - RNA, 20 nt, Salmonella enterica enterica serovar Typhi Ty2
guacauguccagaucuucac

SEQ ID NO: 3724209 - RNA, 16 nt, Salmonella enterica enterica serovar Typhi Ty2
guacauuauugcacau

SEQ ID NO: 3724210 - RNA, 12 nt, Salmonella enterica enterica serovar Typhi Ty2
guaccaaacagc

SEQ ID NO: 3724211 - RNA, 16 nt, Salmonella enterica enterica serovar Typhi Ty2
guaccaauacccagcg

SEQ ID NO: 3724212 - RNA, 18 nt, Salmonella enterica enterica serovar Typhi Ty2
guaccacgccgcacacag

SEQ ID NO: 3724213 - RNA, 13 nt, Salmonella enterica enterica serovar Typhi Ty2
guaccacguuauc

SEQ ID NO: 3724214 - RNA, 18 nt, Salmonella enterica enterica serovar Typhi Ty2
guaccagaaugcccugcu

SEQ ID NO: 3724215 - RNA, 16 nt, Salmonella enterica enterica serovar Typhi Ty2
guaccagcgcccgagc

SEQ ID NO: 3724216 - RNA, 14 nt, Salmonella enterica enterica serovar Typhi Ty2
guaccagcgcgaac

SEQ ID NO: 3724217 - RNA, 23 nt, Salmonella enterica enterica serovar Typhi Ty2
guaccauaccggugcgccccagc

SEQ ID NO: 3724218 - RNA, 21 nt, Salmonella enterica enterica serovar Typhi Ty2
guaccauugagcuuucuucca

SEQ ID NO: 3724219 - RNA, 15 nt, Salmonella enterica enterica serovar Typhi Ty2
guaccccgccugacg

SEQ ID NO: 3724220 - RNA, 15 nt, Salmonella enterica enterica serovar Typhi Ty2
guacccgccgcuggc

SEQ ID NO: 3724221 - RNA, 18 nt, Salmonella enterica enterica serovar Typhi Ty2
guaccgaacagccaggcu

SEQ ID NO: 3724222 - RNA, 16 nt, Salmonella enterica enterica serovar Typhi Ty2
guaccgccgccgggcc

SEQ ID NO: 3724223 - RNA, 20 nt, Salmonella enterica enterica serovar Typhi Ty2
guaccgccuuguccggccua

SEQ ID NO: 3724224 - RNA, 15 nt, Salmonella enterica enterica serovar Typhi Ty2
guaccgcguccugac

SEQ ID NO: 3724225 - RNA, 17 nt, Salmonella enterica enterica serovar Typhi Ty2
guaccgcuacgcaggcc

SEQ ID NO: 3724226 - RNA, 19 nt, Salmonella enterica enterica serovar Typhi Ty2
guaccgcuaucgccaaacu

SEQ ID NO: 3724227 - RNA, 18 nt, Salmonella enterica enterica serovar Typhi Ty2
guaccgcuugggccaccu

SEQ ID NO: 3724228 - RNA, 23 nt, Salmonella enterica enterica serovar Typhi Ty2
guaccggcaggacaaucauaaua

SEQ ID NO: 3724229 - RNA, 23 nt, Salmonella enterica enterica serovar Typhi Ty2
guaccgggcaggaaaagacuacu

SEQ ID NO: 3724230 - RNA, 21 nt, Salmonella enterica enterica serovar Typhi Ty2
guaccgggccuccuuuccugu

SEQ ID NO: 3724231 - RNA, 12 nt, Salmonella enterica enterica serovar Typhi Ty2
guaccucaugcc

SEQ ID NO: 3724232 - RNA, 18 nt, Salmonella enterica enterica serovar Typhi Ty2
guaccucuugcuggguua

SEQ ID NO: 3724233 - RNA, 17 nt, Salmonella enterica enterica serovar Typhi Ty2
guaccugaagccauccu

SEQ ID NO: 3724234 - RNA, 20 nt, Salmonella enterica enterica serovar Typhi Ty2
guaccugcggcaauggcuca

SEQ ID NO: 3724235 - RNA, 20 nt, Salmonella enterica enterica serovar Typhi Ty2
guaccuuuaucuugaccuga

SEQ ID NO: 3724236 - RNA, 22 nt, Salmonella enterica enterica serovar Typhi Ty2
guaccuuucucuuucccaggcc

SEQ ID NO: 3724237 - RNA, 22 nt, Salmonella enterica enterica serovar Typhi Ty2
guacgacacccgauacacgccg

SEQ ID NO: 3724238 - RNA, 14 nt, Salmonella enterica enterica serovar Typhi Ty2
guacgcaggaggga

SEQ ID NO: 3724239 - RNA, 22 nt, Salmonella enterica enterica serovar Typhi Ty2
guacgcaggcgacuggcguccg

SEQ ID NO: 3724240 - RNA, 16 nt, Salmonella enterica enterica serovar Typhi Ty2
guacgccaaguacgcc

SEQ ID NO: 3724241 - RNA, 12 nt, Salmonella enterica enterica serovar Typhi Ty2
guacgcccagcc

SEQ ID NO: 3724242 - RNA, 21 nt, Salmonella enterica enterica serovar Typhi Ty2
guacgcccgugacgccaggca

SEQ ID NO: 3724243 - RNA, 16 nt, Salmonella enterica enterica serovar Typhi Ty2
guacgccuaaaugaac

SEQ ID NO: 3724244 - RNA, 17 nt, Salmonella enterica enterica serovar Typhi Ty2
guacgcgacugaucagg

SEQ ID NO: 3724245 - RNA, 20 nt, Salmonella enterica enterica serovar Typhi Ty2
guacgcgucugaaugacgcc

SEQ ID NO: 3724246 - RNA, 14 nt, Salmonella enterica enterica serovar Typhi Ty2
guacggauauuggc

SEQ ID NO: 3724247 - RNA, 14 nt, Salmonella enterica enterica serovar Typhi Ty2
guacggcauggcgu

SEQ ID NO: 3724248 - RNA, 15 nt, Salmonella enterica enterica serovar Typhi Ty2
guacggcauggcguc

SEQ ID NO: 3724249 - RNA, 14 nt, Salmonella enterica enterica serovar Typhi Ty2
guacggccaccagg

SEQ ID NO: 3724250 - RNA, 18 nt, Salmonella enterica enterica serovar Typhi Ty2
guacggccaccaggccug

SEQ ID NO: 3724251 - RNA, 15 nt, Salmonella enterica enterica serovar Typhi Ty2
guacggcgucagcca

SEQ ID NO: 3724252 - RNA, 19 nt, Salmonella enterica enterica serovar Typhi Ty2
guacggcuuucuuucucca

SEQ ID NO: 3724253 - RNA, 18 nt, Salmonella enterica enterica serovar Typhi Ty2
guacguaaugugaaaaac

SEQ ID NO: 3724254 - RNA, 16 nt, Salmonella enterica enterica serovar Typhi Ty2
guacuauuaccgcauc

SEQ ID NO: 3724255 - RNA, 18 nt, Salmonella enterica enterica serovar Typhi Ty2
guacucaccaguccggca

SEQ ID NO: 3724256 - RNA, 20 nt, Salmonella enterica enterica serovar Typhi Ty2
guacuccccuuuuuucuguu

SEQ ID NO: 3724257 - RNA, 22 nt, Salmonella enterica enterica serovar Typhi Ty2
guacucggcuacgaaccgagcg

SEQ ID NO: 3724258 - RNA, 14 nt, Salmonella enterica enterica serovar Typhi Ty2
guacugcuggcgcg

SEQ ID NO: 3724259 - RNA, 22 nt, Salmonella enterica enterica serovar Typhi Ty2
guacuggaucaccugaaugcaa

SEQ ID NO: 3724260 - RNA, 22 nt, Salmonella enterica enterica serovar Typhi Ty2
guacuucagcauacaggucuuu

SEQ ID NO: 3724261 - RNA, 16 nt, Salmonella enterica enterica serovar Typhi Ty2
guacuuucaaauagcu

SEQ ID NO: 3724262 - RNA, 13 nt, Salmonella enterica enterica serovar Typhi Ty2
guacuuucacuac

SEQ ID NO: 3724263 - RNA, 15 nt, Salmonella enterica enterica serovar Typhi Ty2
guacuuucuacaaau

SEQ ID NO: 3724264 - RNA, 21 nt, Salmonella enterica enterica serovar Typhi Ty2
guacuuucuacaaauguuguc

SEQ ID NO: 3724265 - RNA, 13 nt, Salmonella enterica enterica serovar Typhi Ty2
guacuuuucaucc

SEQ ID NO: 3724266 - RNA, 17 nt, Salmonella enterica enterica serovar Typhi Ty2
guacuuuugcuuccagu

SEQ ID NO: 3724267 - RNA, 24 nt, Salmonella enterica enterica serovar Typhi Ty2
guagaacguauuauuauuacgcau

SEQ ID NO: 3724268 - RNA, 22 nt, Salmonella enterica enterica serovar Typhi Ty2
guagacccggcauugaaacgca

SEQ ID NO: 3724269 - RNA, 23 nt, Salmonella enterica enterica serovar Typhi Ty2
guagaccgcccaggauaucgcgg

SEQ ID NO: 3724270 - RNA, 13 nt, Salmonella enterica enterica serovar Typhi Ty2
guagacucaggcg

SEQ ID NO: 3724271 - RNA, 15 nt, Salmonella enterica enterica serovar Typhi Ty2
guauccagcaacagu

SEQ ID NO: 3724272 - RNA, 14 nt, Salmonella enterica enterica serovar Typhi Ty2
guauccagcggcaa

SEQ ID NO: 3724273 - RNA, 16 nt, Salmonella enterica enterica serovar Typhi Ty2
guauccauaauuuucc

SEQ ID NO: 3724274 - RNA, 12 nt, Salmonella enterica enterica serovar Typhi Ty2
guaucccaaacg

SEQ ID NO: 3724275 - RNA, 19 nt, Salmonella enterica enterica serovar Typhi Ty2
guauccccagucuuccugc

SEQ ID NO: 3724276 - RNA, 13 nt, Salmonella enterica enterica serovar Typhi Ty2
guaucccgccagc

SEQ ID NO: 3724277 - RNA, 16 nt, Salmonella enterica enterica serovar Typhi Ty2
guaucccgccagcggc

SEQ ID NO: 3724278 - RNA, 17 nt, Salmonella enterica enterica serovar Typhi Ty2
guaucccgccagcggcg

SEQ ID NO: 3724279 - RNA, 20 nt, Salmonella enterica enterica serovar Typhi Ty2
guaucccgccagcggcgcca

SEQ ID NO: 3724280 - RNA, 19 nt, Salmonella enterica enterica serovar Typhi Ty2
guauccggccugcagggaa

SEQ ID NO: 3724281 - RNA, 16 nt, Salmonella enterica enterica serovar Typhi Ty2
guauccggucaauaca

SEQ ID NO: 3724282 - RNA, 15 nt, Salmonella enterica enterica serovar Typhi Ty2
guauccguacuuucu

SEQ ID NO: 3724283 - RNA, 13 nt, Salmonella enterica enterica serovar Typhi Ty2
guauccuccugcc

SEQ ID NO: 3724284 - RNA, 14 nt, Salmonella enterica enterica serovar Typhi Ty2
guauccuuccagcc

SEQ ID NO: 3724285 - RNA, 16 nt, Salmonella enterica enterica serovar Typhi Ty2
guaucgcgacagcgcu

SEQ ID NO: 3724286 - RNA, 19 nt, Salmonella enterica enterica serovar Typhi Ty2
guaucgucaauacgcgaca

SEQ ID NO: 3724287 - RNA, 22 nt, Salmonella enterica enterica serovar Typhi Ty2
guaucugucccagccuuccugg

SEQ ID NO: 3724288 - RNA, 11 nt, Salmonella enterica enterica serovar Typhi Ty2
guaucuuccag

SEQ ID NO: 3724289 - RNA, 22 nt, Salmonella enterica enterica serovar Typhi Ty2
guaucuucgccguauucuuacc

SEQ ID NO: 3724290 - RNA, 19 nt, Salmonella enterica enterica serovar Typhi Ty2
guaugacacccguguguua

SEQ ID NO: 3724291 - RNA, 17 nt, Salmonella enterica enterica serovar Typhi Ty2
guaugacguggccagca

SEQ ID NO: 3724292 - RNA, 16 nt, Salmonella enterica enterica serovar Typhi Ty2
guaugcaccguuauuc

SEQ ID NO: 3724293 - RNA, 14 nt, Salmonella enterica enterica serovar Typhi Ty2
guaugcagccaggc

SEQ ID NO: 3724294 - RNA, 15 nt, Salmonella enterica enterica serovar Typhi Ty2
guaugcagccaggcc

SEQ ID NO: 3724295 - RNA, 17 nt, Salmonella enterica enterica serovar Typhi Ty2
guaugcagccaggccau

SEQ ID NO: 3724296 - RNA, 16 nt, Salmonella enterica enterica serovar Typhi Ty2
guaugcagugggccgg

SEQ ID NO: 3724297 - RNA, 16 nt, Salmonella enterica enterica serovar Typhi Ty2
guaugcggucaaaagc

SEQ ID NO: 3724298 - RNA, 22 nt, Salmonella enterica enterica serovar Typhi Ty2
guauguuaggguagaaaaaggu

SEQ ID NO: 3724299 - RNA, 17 nt, Salmonella enterica enterica serovar Typhi Ty2
guauuaacgcuuugcca

SEQ ID NO: 3724300 - RNA, 16 nt, Salmonella enterica enterica serovar Typhi Ty2
guauuaaggcagccau

SEQ ID NO: 3724301 - RNA, 20 nt, Salmonella enterica enterica serovar Typhi Ty2
guauuacaaguaauaaaaua

SEQ ID NO: 3724302 - RNA, 21 nt, Salmonella enterica enterica serovar Typhi Ty2
guauuacaaguaauaaaauaa

SEQ ID NO: 3724303 - RNA, 22 nt, Salmonella enterica enterica serovar Typhi Ty2
guauuacaaguaauaaaauaau

SEQ ID NO: 3724304 - RNA, 23 nt, Salmonella enterica enterica serovar Typhi Ty2
guauuacaugccguuaauaaugu

SEQ ID NO: 3724305 - RNA, 19 nt, Salmonella enterica enterica serovar Typhi Ty2
guauuaccgcucguuaauc

SEQ ID NO: 3724306 - RNA, 22 nt, Salmonella enterica enterica serovar Typhi Ty2
guauuaccuugcuuaucagaua

SEQ ID NO: 3724307 - RNA, 23 nt, Salmonella enterica enterica serovar Typhi Ty2
guauucaacgccaucuuccucac

SEQ ID NO: 3724308 - RNA, 15 nt, Salmonella enterica enterica serovar Typhi Ty2
guauucauaccuuua

SEQ ID NO: 3724309 - RNA, 16 nt, Salmonella enterica enterica serovar Typhi Ty2
guauucggaauaaugu

SEQ ID NO: 3724310 - RNA, 16 nt, Salmonella enterica enterica serovar Typhi Ty2
guauucggcuuaccca

SEQ ID NO: 3724311 - RNA, 18 nt, Salmonella enterica enterica serovar Typhi Ty2
guauucgguggaaaccgc

SEQ ID NO: 3724312 - RNA, 20 nt, Salmonella enterica enterica serovar Typhi Ty2
guauucugcgccagccagcu

SEQ ID NO: 3724313 - RNA, 14 nt, Salmonella enterica enterica serovar Typhi Ty2
guauugaagcgaua

SEQ ID NO: 3724314 - RNA, 12 nt, Salmonella enterica enterica serovar Typhi Ty2
guauugauuuuu

SEQ ID NO: 3724315 - RNA, 16 nt, Salmonella enterica enterica serovar Typhi Ty2
guauugauuuuuaaaa

SEQ ID NO: 3724316 - RNA, 15 nt, Salmonella enterica enterica serovar Typhi Ty2
guauugcaccuggga

SEQ ID NO: 3724317 - RNA, 21 nt, Salmonella enterica enterica serovar Typhi Ty2
guauugccggauaagacgcag

SEQ ID NO: 3724318 - RNA, 16 nt, Salmonella enterica enterica serovar Typhi Ty2
guauugcuuucaauuu

SEQ ID NO: 3724319 - RNA, 12 nt, Salmonella enterica enterica serovar Typhi Ty2
guauugugcuua

SEQ ID NO: 3724320 - RNA, 13 nt, Salmonella enterica enterica serovar Typhi Ty2
guauuuauccagc

SEQ ID NO: 3724321 - RNA, 17 nt, Salmonella enterica enterica serovar Typhi Ty2
guauuucacuuuugccg

SEQ ID NO: 3724322 - RNA, 23 nt, Salmonella enterica enterica serovar Typhi Ty2
guauuucgacuuucuucggauua

SEQ ID NO: 3724323 - RNA, 16 nt, Salmonella enterica enterica serovar Typhi Ty2
guauuucgcagcgguc

SEQ ID NO: 3724324 - RNA, 18 nt, Salmonella enterica enterica serovar Typhi Ty2
guauuucgcagcggucag

SEQ ID NO: 3724325 - RNA, 17 nt, Salmonella enterica enterica serovar Typhi Ty2
guauuucugaaaaaccg

SEQ ID NO: 3724326 - RNA, 18 nt, Salmonella enterica enterica serovar Typhi Ty2
guauuucugaaaaaccgu

SEQ ID NO: 3724327 - RNA, 11 nt, Salmonella enterica enterica serovar Typhi Ty2
guauuuuauuu

SEQ ID NO: 3724328 - RNA, 16 nt, Salmonella enterica enterica serovar Typhi Ty2
guauuuuuuagcgcca

SEQ ID NO: 3724329 - RNA, 19 nt, Salmonella enterica enterica serovar Typhi Ty2
gucaaaaaguugucuuccu

SEQ ID NO: 3724330 - RNA, 11 nt, Salmonella enterica enterica serovar Typhi Ty2
gucaaaaauaa

SEQ ID NO: 3724331 - RNA, 20 nt, Salmonella enterica enterica serovar Typhi Ty2
gucaaaaccaaacagcgaca

SEQ ID NO: 3724332 - RNA, 14 nt, Salmonella enterica enterica serovar Typhi Ty2
gucaaaacuuauuu

SEQ ID NO: 3724333 - RNA, 22 nt, Salmonella enterica enterica serovar Typhi Ty2
gucaaaacuuauuuuauuuuua

SEQ ID NO: 3724334 - RNA, 19 nt, Salmonella enterica enterica serovar Typhi Ty2
gucaaacaguucagacacc

SEQ ID NO: 3724335 - RNA, 22 nt, Salmonella enterica enterica serovar Typhi Ty2
gucaaacaguuccugugcggaa

SEQ ID NO: 3724336 - RNA, 13 nt, Salmonella enterica enterica serovar Typhi Ty2
gucaaacgcuauc

SEQ ID NO: 3724337 - RNA, 23 nt, Salmonella enterica enterica serovar Typhi Ty2
gucaaagaaaacuuucauuucac

SEQ ID NO: 3724338 - RNA, 17 nt, Salmonella enterica enterica serovar Typhi Ty2
gucaaauagagaaaaua

SEQ ID NO: 3724339 - RNA, 13 nt, Salmonella enterica enterica serovar Typhi Ty2
gucaacaggcuga

SEQ ID NO: 3724340 - RNA, 22 nt, Salmonella enterica enterica serovar Typhi Ty2
gucaacauagcuauauuuagcc

SEQ ID NO: 3724341 - RNA, 13 nt, Salmonella enterica enterica serovar Typhi Ty2
gucaacaucaucc

SEQ ID NO: 3724342 - RNA, 23 nt, Salmonella enterica enterica serovar Typhi Ty2
gucaacgcacuguaacgcacugg

SEQ ID NO: 3724343 - RNA, 13 nt, Salmonella enterica enterica serovar Typhi Ty2
gucaacgccaagc

SEQ ID NO: 3724344 - RNA, 16 nt, Salmonella enterica enterica serovar Typhi Ty2
gucaacgccaagcgcg

SEQ ID NO: 3724345 - RNA, 18 nt, Salmonella enterica enterica serovar Typhi Ty2
gucaacgguaaaauggcu

SEQ ID NO: 3724346 - RNA, 21 nt, Salmonella enterica enterica serovar Typhi Ty2
gucaacguccaguucguucug

SEQ ID NO: 3724347 - RNA, 18 nt, Salmonella enterica enterica serovar Typhi Ty2
gucaacguuaacugcugc

SEQ ID NO: 3724348 - RNA, 16 nt, Salmonella enterica enterica serovar Typhi Ty2
gucaacucgcacagua

SEQ ID NO: 3724349 - RNA, 17 nt, Salmonella enterica enterica serovar Typhi Ty2
gucaacugcucuaccaa

SEQ ID NO: 3724350 - RNA, 18 nt, Salmonella enterica enterica serovar Typhi Ty2
gucaauaaagacuggccc

SEQ ID NO: 3724351 - RNA, 13 nt, Salmonella enterica enterica serovar Typhi Ty2
gucaauaaagccg

SEQ ID NO: 3724352 - RNA, 20 nt, Salmonella enterica enterica serovar Typhi Ty2
gucaauaagauauccugcuu

SEQ ID NO: 3724353 - RNA, 22 nt, Salmonella enterica enterica serovar Typhi Ty2
gucaucaaaaucaucgccacga

SEQ ID NO: 3724354 - RNA, 15 nt, Salmonella enterica enterica serovar Typhi Ty2
gucaucaaaaucggg

SEQ ID NO: 3724355 - RNA, 16 nt, Salmonella enterica enterica serovar Typhi Ty2
gucaucaccuccagca

SEQ ID NO: 3724356 - RNA, 18 nt, Salmonella enterica enterica serovar Typhi Ty2
gucaucaucaaguaccgu

SEQ ID NO: 3724357 - RNA, 15 nt, Salmonella enterica enterica serovar Typhi Ty2
gucaucauuacaggc

SEQ ID NO: 3724358 - RNA, 18 nt, Salmonella enterica enterica serovar Typhi Ty2
gucaucauuacaggcgaa

SEQ ID NO: 3724359 - RNA, 17 nt, Salmonella enterica enterica serovar Typhi Ty2
gucaucccgaaccuggu

SEQ ID NO: 3724360 - RNA, 22 nt, Salmonella enterica enterica serovar Typhi Ty2
gucaucccgguuucccgcguga

SEQ ID NO: 3724361 - RNA, 11 nt, Salmonella enterica enterica serovar Typhi Ty2
gucauccgcgu

SEQ ID NO: 3724362 - RNA, 18 nt, Salmonella enterica enterica serovar Typhi Ty2
gucauccgcguaaucgcg

SEQ ID NO: 3724363 - RNA, 16 nt, Salmonella enterica enterica serovar Typhi Ty2
gucauccggcaagcgc

SEQ ID NO: 3724364 - RNA, 16 nt, Salmonella enterica enterica serovar Typhi Ty2
gucauccgguucaccc

SEQ ID NO: 3724365 - RNA, 17 nt, Salmonella enterica enterica serovar Typhi Ty2
gucauccgguucaccca

SEQ ID NO: 3724366 - RNA, 18 nt, Salmonella enterica enterica serovar Typhi Ty2
gucauccugcaggcggca

SEQ ID NO: 3724367 - RNA, 21 nt, Salmonella enterica enterica serovar Typhi Ty2
gucaucgaaggcaucuucaga

SEQ ID NO: 3724368 - RNA, 16 nt, Salmonella enterica enterica serovar Typhi Ty2
gucaucgcaaauucug

SEQ ID NO: 3724369 - RNA, 16 nt, Salmonella enterica enterica serovar Typhi Ty2
gucaucgccuucaucc

SEQ ID NO: 3724370 - RNA, 20 nt, Salmonella enterica enterica serovar Typhi Ty2
gucaucgcggaaagcaaugu

SEQ ID NO: 3724371 - RNA, 23 nt, Salmonella enterica enterica serovar Typhi Ty2
gucaucgcggaaagcaaugucgc

SEQ ID NO: 3724372 - RNA, 18 nt, Salmonella enterica enterica serovar Typhi Ty2
gucaucggcuuuuuucaa

SEQ ID NO: 3724373 - RNA, 21 nt, Salmonella enterica enterica serovar Typhi Ty2
gucaucggcuuuuuucaacca

SEQ ID NO: 3724374 - RNA, 14 nt, Salmonella enterica enterica serovar Typhi Ty2
gucaucugccaguu

SEQ ID NO: 3724375 - RNA, 17 nt, Salmonella enterica enterica serovar Typhi Ty2
gucaugacgcuggaagu

SEQ ID NO: 3724376 - RNA, 18 nt, Salmonella enterica enterica serovar Typhi Ty2
gucaugauguuugucuuu

SEQ ID NO: 3724377 - RNA, 22 nt, Salmonella enterica enterica serovar Typhi Ty2
gucaugccuucauagagaaguc

SEQ ID NO: 3724378 - RNA, 15 nt, Salmonella enterica enterica serovar Typhi Ty2
gucaugcuaaaacag

SEQ ID NO: 3724379 - RNA, 17 nt, Salmonella enterica enterica serovar Typhi Ty2
gucaugcuaaaacagau

SEQ ID NO: 3724380 - RNA, 22 nt, Salmonella enterica enterica serovar Typhi Ty2
gucaugcuucaccucagcaaaa

SEQ ID NO: 3724381 - RNA, 13 nt, Salmonella enterica enterica serovar Typhi Ty2
gucaugguaaaac

SEQ ID NO: 3724382 - RNA, 15 nt, Salmonella enterica enterica serovar Typhi Ty2
gucauguccagggca

SEQ ID NO: 3724383 - RNA, 23 nt, Salmonella enterica enterica serovar Typhi Ty2
gucauguccagggcauucauugu

SEQ ID NO: 3724384 - RNA, 20 nt, Salmonella enterica enterica serovar Typhi Ty2
gucauuaacgaggcgcuugc

SEQ ID NO: 3724385 - RNA, 19 nt, Salmonella enterica enterica serovar Typhi Ty2
gucauuacgguauuuauca

SEQ ID NO: 3724386 - RNA, 14 nt, Salmonella enterica enterica serovar Typhi Ty2
gucauugacagcaa

SEQ ID NO: 3724387 - RNA, 15 nt, Salmonella enterica enterica serovar Typhi Ty2
gucauuguaaaaccg

SEQ ID NO: 3724388 - RNA, 14 nt, Salmonella enterica enterica serovar Typhi Ty2
gucauuuauuuucg

SEQ ID NO: 3724389 - RNA, 18 nt, Salmonella enterica enterica serovar Typhi Ty2
gucauuugaaucugcggu

SEQ ID NO: 3724390 - RNA, 17 nt, Salmonella enterica enterica serovar Typhi Ty2
gucauuuucuuucauca

SEQ ID NO: 3724391 - RNA, 17 nt, Salmonella enterica enterica serovar Typhi Ty2
guccaacuuguuuccug

SEQ ID NO: 3724392 - RNA, 16 nt, Salmonella enterica enterica serovar Typhi Ty2
guccacacaggccugc

SEQ ID NO: 3724393 - RNA, 17 nt, Salmonella enterica enterica serovar Typhi Ty2
guccacauccagcgcca

SEQ ID NO: 3724394 - RNA, 21 nt, Salmonella enterica enterica serovar Typhi Ty2
guccacauccagcgccagcgc

SEQ ID NO: 3724395 - RNA, 24 nt, Salmonella enterica enterica serovar Typhi Ty2
guccacauccagcgccagcgccac

SEQ ID NO: 3724396 - RNA, 15 nt, Salmonella enterica enterica serovar Typhi Ty2
guccacgacaauauc

SEQ ID NO: 3724397 - RNA, 16 nt, Salmonella enterica enterica serovar Typhi Ty2
guccacgcgagcugcc

SEQ ID NO: 3724398 - RNA, 20 nt, Salmonella enterica enterica serovar Typhi Ty2
guccacguucaaaucgauga

SEQ ID NO: 3724399 - RNA, 22 nt, Salmonella enterica enterica serovar Typhi Ty2
guccagaggaucuggacgccaa

SEQ ID NO: 3724400 - RNA, 15 nt, Salmonella enterica enterica serovar Typhi Ty2
guccagaugcugggc

SEQ ID NO: 3724401 - RNA, 21 nt, Salmonella enterica enterica serovar Typhi Ty2
guccagauuacgcauggucaa

SEQ ID NO: 3724402 - RNA, 22 nt, Salmonella enterica enterica serovar Typhi Ty2
guccagauugagacaaauaacu

SEQ ID NO: 3724403 - RNA, 20 nt, Salmonella enterica enterica serovar Typhi Ty2
guccagcgcggguucuuucc

SEQ ID NO: 3724404 - RNA, 13 nt, Salmonella enterica enterica serovar Typhi Ty2
guccagcgcguga

SEQ ID NO: 3724405 - RNA, 14 nt, Salmonella enterica enterica serovar Typhi Ty2
guccaggucaucac

SEQ ID NO: 3724406 - RNA, 16 nt, Salmonella enterica enterica serovar Typhi Ty2
guccaguucguucugc

SEQ ID NO: 3724407 - RNA, 19 nt, Salmonella enterica enterica serovar Typhi Ty2
guccauauucaguuuuacg

SEQ ID NO: 3724408 - RNA, 21 nt, Salmonella enterica enterica serovar Typhi Ty2
guccaucaggcuuugcgccau

SEQ ID NO: 3724409 - RNA, 17 nt, Salmonella enterica enterica serovar Typhi Ty2
guccaugacgaccacag

SEQ ID NO: 3724410 - RNA, 18 nt, Salmonella enterica enterica serovar Typhi Ty2
guccauuacgcaguacgc

SEQ ID NO: 3724411 - RNA, 21 nt, Salmonella enterica enterica serovar Typhi Ty2
guccauuacucucauguucaa

SEQ ID NO: 3724412 - RNA, 18 nt, Salmonella enterica enterica serovar Typhi Ty2
guccauugcgagaaaaaa

SEQ ID NO: 3724413 - RNA, 14 nt, Salmonella enterica enterica serovar Typhi Ty2
guccauuuuccuau

SEQ ID NO: 3724414 - RNA, 16 nt, Salmonella enterica enterica serovar Typhi Ty2
guccauuuuuuaucug

SEQ ID NO: 3724415 - RNA, 19 nt, Salmonella enterica enterica serovar Typhi Ty2
guccauuuuuuaucugaca

SEQ ID NO: 3724416 - RNA, 16 nt, Salmonella enterica enterica serovar Typhi Ty2
gucccagccuuccugg

SEQ ID NO: 3724417 - RNA, 21 nt, Salmonella enterica enterica serovar Typhi Ty2
gucccaggauaguacugacca

SEQ ID NO: 3724418 - RNA, 16 nt, Salmonella enterica enterica serovar Typhi Ty2
gucccagugucaacug

SEQ ID NO: 3724419 - RNA, 21 nt, Salmonella enterica enterica serovar Typhi Ty2
gucccaucguaacgccgucga

SEQ ID NO: 3724420 - RNA, 23 nt, Salmonella enterica enterica serovar Typhi Ty2
gucccaucguaacgccgucgaca

SEQ ID NO: 3724421 - RNA, 19 nt, Salmonella enterica enterica serovar Typhi Ty2
guccccagcguaccacgcc

SEQ ID NO: 3724422 - RNA, 22 nt, Salmonella enterica enterica serovar Typhi Ty2
guccccucaaacaggcugucug

SEQ ID NO: 3724423 - RNA, 13 nt, Salmonella enterica enterica serovar Typhi Ty2
gucccggcagugc

SEQ ID NO: 3724424 - RNA, 20 nt, Salmonella enterica enterica serovar Typhi Ty2
gucccggcgucauacugcca

SEQ ID NO: 3724425 - RNA, 17 nt, Salmonella enterica enterica serovar Typhi Ty2
gucccucuccagggcaa

SEQ ID NO: 3724426 - RNA, 19 nt, Salmonella enterica enterica serovar Typhi Ty2
gucccugauguagcugggu

SEQ ID NO: 3724427 - RNA, 15 nt, Salmonella enterica enterica serovar Typhi Ty2
guccgcacgccugca

SEQ ID NO: 3724428 - RNA, 15 nt, Salmonella enterica enterica serovar Typhi Ty2
guccgccagaugcac

SEQ ID NO: 3724429 - RNA, 17 nt, Salmonella enterica enterica serovar Typhi Ty2
guccgccuaccagcaca

SEQ ID NO: 3724430 - RNA, 21 nt, Salmonella enterica enterica serovar Typhi Ty2
guccgccuaccagcacaugau

SEQ ID NO: 3724431 - RNA, 15 nt, Salmonella enterica enterica serovar Typhi Ty2
guccggaucucgcca

SEQ ID NO: 3724432 - RNA, 19 nt, Salmonella enterica enterica serovar Typhi Ty2
guccggcgaaaaccgagca

SEQ ID NO: 3724433 - RNA, 17 nt, Salmonella enterica enterica serovar Typhi Ty2
guccggcgcuaaccagc

SEQ ID NO: 3724434 - RNA, 18 nt, Salmonella enterica enterica serovar Typhi Ty2
guccgguauugauuagcu

SEQ ID NO: 3724435 - RNA, 17 nt, Salmonella enterica enterica serovar Typhi Ty2
gucgcugauugccgcca

SEQ ID NO: 3724436 - RNA, 20 nt, Salmonella enterica enterica serovar Typhi Ty2
gucgcugcgcucaucaggcc

SEQ ID NO: 3724437 - RNA, 22 nt, Salmonella enterica enterica serovar Typhi Ty2
gucggaaaucuguuccagcgag

SEQ ID NO: 3724438 - RNA, 22 nt, Salmonella enterica enterica serovar Typhi Ty2
gucggaaccggcaauauccgga

SEQ ID NO: 3724439 - RNA, 14 nt, Salmonella enterica enterica serovar Typhi Ty2
gucggacagcgaca

SEQ ID NO: 3724440 - RNA, 14 nt, Salmonella enterica enterica serovar Typhi Ty2
gucggagccaauaa

SEQ ID NO: 3724441 - RNA, 19 nt, Salmonella enterica enterica serovar Typhi Ty2
gucggcaccgaauguuccg

SEQ ID NO: 3724442 - RNA, 13 nt, Salmonella enterica enterica serovar Typhi Ty2
gucggcagacugg

SEQ ID NO: 3724443 - RNA, 12 nt, Salmonella enterica enterica serovar Typhi Ty2
gucggcagcgag

SEQ ID NO: 3724444 - RNA, 19 nt, Salmonella enterica enterica serovar Typhi Ty2
gucggcgauauagcgcuga

SEQ ID NO: 3724445 - RNA, 18 nt, Salmonella enterica enterica serovar Typhi Ty2
gucggcgauugucaucau

SEQ ID NO: 3724446 - RNA, 22 nt, Salmonella enterica enterica serovar Typhi Ty2
gucggcgcaaccauuaccgcua

SEQ ID NO: 3724447 - RNA, 18 nt, Salmonella enterica enterica serovar Typhi Ty2
gucggcgcaguucgccgc

SEQ ID NO: 3724448 - RNA, 12 nt, Salmonella enterica enterica serovar Typhi Ty2
gucggcgccauc

SEQ ID NO: 3724449 - RNA, 15 nt, Salmonella enterica enterica serovar Typhi Ty2
gucggcuuuuguucc

SEQ ID NO: 3724450 - RNA, 13 nt, Salmonella enterica enterica serovar Typhi Ty2
gucgggaauugcc

SEQ ID NO: 3724451 - RNA, 15 nt, Salmonella enterica enterica serovar Typhi Ty2
gucgguuccagcgug

SEQ ID NO: 3724452 - RNA, 18 nt, Salmonella enterica enterica serovar Typhi Ty2
gucgguuucauaacgcac

SEQ ID NO: 3724453 - RNA, 16 nt, Salmonella enterica enterica serovar Typhi Ty2
gucguaaaacugcacc

SEQ ID NO: 3724454 - RNA, 17 nt, Salmonella enterica enterica serovar Typhi Ty2
gucguaaaacugcacca

SEQ ID NO: 3724455 - RNA, 16 nt, Salmonella enterica enterica serovar Typhi Ty2
gucguaaauuccugca

SEQ ID NO: 3724456 - RNA, 22 nt, Salmonella enterica enterica serovar Typhi Ty2
gucguaccggcgcucagccaga

SEQ ID NO: 3724457 - RNA, 22 nt, Salmonella enterica enterica serovar Typhi Ty2
gucguaccguuaaucgauuuuc

SEQ ID NO: 3724458 - RNA, 17 nt, Salmonella enterica enterica serovar Typhi Ty2
gucguacucuaggcgcu

SEQ ID NO: 3724459 - RNA, 18 nt, Salmonella enterica enterica serovar Typhi Ty2
gucguauucuugcuaccg

SEQ ID NO: 3724460 - RNA, 16 nt, Salmonella enterica enterica serovar Typhi Ty2
gucgucauaucgaugg

SEQ ID NO: 3724461 - RNA, 13 nt, Salmonella enterica enterica serovar Typhi Ty2
gucguccacucuu

SEQ ID NO: 3724462 - RNA, 13 nt, Salmonella enterica enterica serovar Typhi Ty2
gucguccccugga

SEQ ID NO: 3724463 - RNA, 20 nt, Salmonella enterica enterica serovar Typhi Ty2
gucgucccgcgaguacgcac

SEQ ID NO: 3724464 - RNA, 17 nt, Salmonella enterica enterica serovar Typhi Ty2
gucguccucaggccgga

SEQ ID NO: 3724465 - RNA, 18 nt, Salmonella enterica enterica serovar Typhi Ty2
gucguccucaggccggau

SEQ ID NO: 3724466 - RNA, 18 nt, Salmonella enterica enterica serovar Typhi Ty2
gucgugcaaccgccugca

SEQ ID NO: 3724467 - RNA, 14 nt, Salmonella enterica enterica serovar Typhi Ty2
gucgugccuuccgc

SEQ ID NO: 3724468 - RNA, 15 nt, Salmonella enterica enterica serovar Typhi Ty2
gucguggguucgaau

SEQ ID NO: 3724469 - RNA, 13 nt, Salmonella enterica enterica serovar Typhi Ty2
gucguucacguaa

SEQ ID NO: 3724470 - RNA, 19 nt, Salmonella enterica enterica serovar Typhi Ty2
gucguuguaguuaucgccg

SEQ ID NO: 3724471 - RNA, 19 nt, Salmonella enterica enterica serovar Typhi Ty2
gucguuuucacuuguucaa

SEQ ID NO: 3724472 - RNA, 20 nt, Salmonella enterica enterica serovar Typhi Ty2
gucuaauugacggccaccau

SEQ ID NO: 3724473 - RNA, 19 nt, Salmonella enterica enterica serovar Typhi Ty2
gucuacccgguguaaaaaa

SEQ ID NO: 3724474 - RNA, 20 nt, Salmonella enterica enterica serovar Typhi Ty2
gucuacccgguguaaaaaau

SEQ ID NO: 3724475 - RNA, 17 nt, Salmonella enterica enterica serovar Typhi Ty2
gucuauugccuaaauaa

SEQ ID NO: 3724476 - RNA, 11 nt, Salmonella enterica enterica serovar Typhi Ty2
gucuauuuauu

SEQ ID NO: 3724477 - RNA, 16 nt, Salmonella enterica enterica serovar Typhi Ty2
gucucaaucgcaaauu

SEQ ID NO: 3724478 - RNA, 13 nt, Salmonella enterica enterica serovar Typhi Ty2
gucucauccggca

SEQ ID NO: 3724479 - RNA, 21 nt, Salmonella enterica enterica serovar Typhi Ty2
gucucauuguguacauccaga

SEQ ID NO: 3724480 - RNA, 16 nt, Salmonella enterica enterica serovar Typhi Ty2
gucucccaaaugaaaa

SEQ ID NO: 3724481 - RNA, 17 nt, Salmonella enterica enterica serovar Typhi Ty2
gucucccaaaugaaaaa

SEQ ID NO: 3724482 - RNA, 13 nt, Salmonella enterica enterica serovar Typhi Ty2
gucucccuccugc

SEQ ID NO: 3724483 - RNA, 18 nt, Salmonella enterica enterica serovar Typhi Ty2
gucuccggcgcgccgcug

SEQ ID NO: 3724484 - RNA, 15 nt, Salmonella enterica enterica serovar Typhi Ty2
gucuccucaugccuc

SEQ ID NO: 3724485 - RNA, 19 nt, Salmonella enterica enterica serovar Typhi Ty2
gucuccucgccagcuaccg

SEQ ID NO: 3724486 - RNA, 22 nt, Salmonella enterica enterica serovar Typhi Ty2
gucucgcccgggucgaucaauc

SEQ ID NO: 3724487 - RNA, 15 nt, Salmonella enterica enterica serovar Typhi Ty2
gucucuacuacauau

SEQ ID NO: 3724488 - RNA, 13 nt, Salmonella enterica enterica serovar Typhi Ty2
gucucucccucaa

SEQ ID NO: 3724489 - RNA, 19 nt, Salmonella enterica enterica serovar Typhi Ty2
gucucucgugcaggccgga

SEQ ID NO: 3724490 - RNA, 17 nt, Salmonella enterica enterica serovar Typhi Ty2
gucucugagaucaaaca

SEQ ID NO: 3724491 - RNA, 23 nt, Salmonella enterica enterica serovar Typhi Ty2
gucucuuuagaaaaagaaaccuc

SEQ ID NO: 3724492 - RNA, 16 nt, Salmonella enterica enterica serovar Typhi Ty2
gucucuuuauugaaaa

SEQ ID NO: 3724493 - RNA, 13 nt, Salmonella enterica enterica serovar Typhi Ty2
gucugaaaauaau

SEQ ID NO: 3724494 - RNA, 18 nt, Salmonella enterica enterica serovar Typhi Ty2
gucugaagaaguucuucu

SEQ ID NO: 3724495 - RNA, 20 nt, Salmonella enterica enterica serovar Typhi Ty2
gucugaaggcguaugaauga

SEQ ID NO: 3724496 - RNA, 23 nt, Salmonella enterica enterica serovar Typhi Ty2
gucugaaucagugcaucuucacu

SEQ ID NO: 3724497 - RNA, 20 nt, Salmonella enterica enterica serovar Typhi Ty2
gucugacaacuauugcugcc

SEQ ID NO: 3724498 - RNA, 13 nt, Salmonella enterica enterica serovar Typhi Ty2
gucugaccgggcg

SEQ ID NO: 3724499 - RNA, 15 nt, Salmonella enterica enterica serovar Typhi Ty2
gucugagcaggcggu

SEQ ID NO: 3724500 - RNA, 22 nt, Salmonella enterica enterica serovar Typhi Ty2
gucugauaagcgcagcgccauc

SEQ ID NO: 3724501 - RNA, 15 nt, Salmonella enterica enterica serovar Typhi Ty2
gucugcaagagaaau

SEQ ID NO: 3724502 - RNA, 19 nt, Salmonella enterica enterica serovar Typhi Ty2
gucugccaugccuuugacu

SEQ ID NO: 3724503 - RNA, 20 nt, Salmonella enterica enterica serovar Typhi Ty2
gucugcccggcaaccugagc

SEQ ID NO: 3724504 - RNA, 14 nt, Salmonella enterica enterica serovar Typhi Ty2
gucugcgcgcuggu

SEQ ID NO: 3724505 - RNA, 22 nt, Salmonella enterica enterica serovar Typhi Ty2
gucugcgcugggccgggccuga

SEQ ID NO: 3724506 - RNA, 12 nt, Salmonella enterica enterica serovar Typhi Ty2
gucugcucagaa

SEQ ID NO: 3724507 - RNA, 23 nt, Salmonella enterica enterica serovar Typhi Ty2
gucugcugggcgauuucacgaau

SEQ ID NO: 3724508 - RNA, 15 nt, Salmonella enterica enterica serovar Typhi Ty2
gucugcuucgucugg

SEQ ID NO: 3724509 - RNA, 17 nt, Salmonella enterica enterica serovar Typhi Ty2
gucuggauaccccgcac

SEQ ID NO: 3724510 - RNA, 20 nt, Salmonella enterica enterica serovar Typhi Ty2
gucuggcagcggcaguaaau

SEQ ID NO: 3724511 - RNA, 19 nt, Salmonella enterica enterica serovar Typhi Ty2
gucuggcgugccgggcugg

SEQ ID NO: 3724512 - RNA, 20 nt, Salmonella enterica enterica serovar Typhi Ty2
gucuggcgugccgggcuggc

SEQ ID NO: 3724513 - RNA, 13 nt, Salmonella enterica enterica serovar Typhi Ty2
gucuggggaacaa

SEQ ID NO: 3724514 - RNA, 19 nt, Salmonella enterica enterica serovar Typhi Ty2
gucugguacggccaccagg

SEQ ID NO: 3724515 - RNA, 20 nt, Salmonella enterica enterica serovar Typhi Ty2
gucugguacggccaccaggc

SEQ ID NO: 3724516 - RNA, 15 nt, Salmonella enterica enterica serovar Typhi Ty2
gucuggugauccagc

SEQ ID NO: 3724517 - RNA, 12 nt, Salmonella enterica enterica serovar Typhi Ty2
uuacguaacugc

SEQ ID NO: 3724518 - RNA, 19 nt, Salmonella enterica enterica serovar Typhi Ty2
uuacguuaaguucaaggau

SEQ ID NO: 3724519 - RNA, 15 nt, Salmonella enterica enterica serovar Typhi Ty2
uuacguugauuauca

SEQ ID NO: 3724520 - RNA, 15 nt, Salmonella enterica enterica serovar Typhi Ty2
uuacuaauaaauauu

SEQ ID NO: 3724521 - RNA, 12 nt, Salmonella enterica enterica serovar Typhi Ty2
uuacuauuuuuc

SEQ ID NO: 3724522 - RNA, 14 nt, Salmonella enterica enterica serovar Typhi Ty2
uuacuauuuuucac

SEQ ID NO: 3724523 - RNA, 22 nt, Salmonella enterica enterica serovar Typhi Ty2
uuacucccgucgccuguuucug

SEQ ID NO: 3724524 - RNA, 14 nt, Salmonella enterica enterica serovar Typhi Ty2
uuacucucuuucug

SEQ ID NO: 3724525 - RNA, 12 nt, Salmonella enterica enterica serovar Typhi Ty2
uuacucuuccac

SEQ ID NO: 3724526 - RNA, 14 nt, Salmonella enterica enterica serovar Typhi Ty2
uuacucuuccacca

SEQ ID NO: 3724527 - RNA, 15 nt, Salmonella enterica enterica serovar Typhi Ty2
uuacucuuccugcug

SEQ ID NO: 3724528 - RNA, 15 nt, Salmonella enterica enterica serovar Typhi Ty2
uuacugacaauaagu

SEQ ID NO: 3724529 - RNA, 20 nt, Salmonella enterica enterica serovar Typhi Ty2
uuacugacgccauucauucc

SEQ ID NO: 3724530 - RNA, 16 nt, Salmonella enterica enterica serovar Typhi Ty2
uuacugaugccagccg

SEQ ID NO: 3724531 - RNA, 23 nt, Salmonella enterica enterica serovar Typhi Ty2
uuacugcuuugaucacccacacc

SEQ ID NO: 3724532 - RNA, 16 nt, Salmonella enterica enterica serovar Typhi Ty2
uuacuggcgacgaccg

SEQ ID NO: 3724533 - RNA, 19 nt, Salmonella enterica enterica serovar Typhi Ty2
uuacugucgcccgcaacca

SEQ ID NO: 3724534 - RNA, 14 nt, Salmonella enterica enterica serovar Typhi Ty2
uuacugugccgccg

SEQ ID NO: 3724535 - RNA, 17 nt, Salmonella enterica enterica serovar Typhi Ty2
uuacugugccgccggug

SEQ ID NO: 3724536 - RNA, 15 nt, Salmonella enterica enterica serovar Typhi Ty2
uuacuucacguaauc

SEQ ID NO: 3724537 - RNA, 18 nt, Salmonella enterica enterica serovar Typhi Ty2
uuacuuucaaaauacugg

SEQ ID NO: 3724538 - RNA, 13 nt, Salmonella enterica enterica serovar Typhi Ty2
uuacuuucauucc

SEQ ID NO: 3724539 - RNA, 13 nt, Salmonella enterica enterica serovar Typhi Ty2
uuacuuugcgccc

SEQ ID NO: 3724540 - RNA, 17 nt, Salmonella enterica enterica serovar Typhi Ty2
uuacuuuuuuaaauguu

SEQ ID NO: 3724541 - RNA, 16 nt, Salmonella enterica enterica serovar Typhi Ty2
uuagaaaguggcauau

SEQ ID NO: 3724542 - RNA, 13 nt, Salmonella enterica enterica serovar Typhi Ty2
uuagacucagcga

SEQ ID NO: 3724543 - RNA, 16 nt, Salmonella enterica enterica serovar Typhi Ty2
uuagagaguaaaaccg

SEQ ID NO: 3724544 - RNA, 13 nt, Salmonella enterica enterica serovar Typhi Ty2
uuagagccuaucc

SEQ ID NO: 3724545 - RNA, 14 nt, Salmonella enterica enterica serovar Typhi Ty2
uuagcaaaaaugcc

SEQ ID NO: 3724546 - RNA, 19 nt, Salmonella enterica enterica serovar Typhi Ty2
uuagcaauugccauaaaaa

SEQ ID NO: 3724547 - RNA, 16 nt, Salmonella enterica enterica serovar Typhi Ty2
uuagcacagcucuaau

SEQ ID NO: 3724548 - RNA, 19 nt, Salmonella enterica enterica serovar Typhi Ty2
uuagcacauuuuuaucagg

SEQ ID NO: 3724549 - RNA, 22 nt, Salmonella enterica enterica serovar Typhi Ty2
uuagcacccaccaucacuucca

SEQ ID NO: 3724550 - RNA, 15 nt, Salmonella enterica enterica serovar Typhi Ty2
uuagcaugacaauaa

SEQ ID NO: 3724551 - RNA, 17 nt, Salmonella enterica enterica serovar Typhi Ty2
uuagcccaaaaggcuca

SEQ ID NO: 3724552 - RNA, 18 nt, Salmonella enterica enterica serovar Typhi Ty2
uuagccuguuauucaauu

SEQ ID NO: 3724553 - RNA, 13 nt, Salmonella enterica enterica serovar Typhi Ty2
uuagcgaaacagu

SEQ ID NO: 3724554 - RNA, 16 nt, Salmonella enterica enterica serovar Typhi Ty2
uuagcgaacguccagc

SEQ ID NO: 3724555 - RNA, 17 nt, Salmonella enterica enterica serovar Typhi Ty2
uuagcgguacucuuuuu

SEQ ID NO: 3724556 - RNA, 12 nt, Salmonella enterica enterica serovar Typhi Ty2
uuagcuuccagc

SEQ ID NO: 3724557 - RNA, 14 nt, Salmonella enterica enterica serovar Typhi Ty2
uuagcuuuuuacuc

SEQ ID NO: 3724558 - RNA, 19 nt, Salmonella enterica enterica serovar Typhi Ty2
uuagcuuuuuacucucuuu

SEQ ID NO: 3724559 - RNA, 20 nt, Salmonella enterica enterica serovar Typhi Ty2
uuagcuuuuuuaugcuguag

SEQ ID NO: 3724560 - RNA, 22 nt, Salmonella enterica enterica serovar Typhi Ty2
uuaggaaugcccagcucagcuu

SEQ ID NO: 3724561 - RNA, 17 nt, Salmonella enterica enterica serovar Typhi Ty2
uuaggcacuaccaccuc

SEQ ID NO: 3724562 - RNA, 23 nt, Salmonella enterica enterica serovar Typhi Ty2
uuaggcggcuucacgccauccag

SEQ ID NO: 3724563 - RNA, 15 nt, Salmonella enterica enterica serovar Typhi Ty2
uuaggcguaauuauu

SEQ ID NO: 3724564 - RNA, 15 nt, Salmonella enterica enterica serovar Typhi Ty2
uuagggcgcggcugg

SEQ ID NO: 3724565 - RNA, 19 nt, Salmonella enterica enterica serovar Typhi Ty2
uuaggguagaaaaagguaa

SEQ ID NO: 3724566 - RNA, 18 nt, Salmonella enterica enterica serovar Typhi Ty2
uuaggguaucauuuccac

SEQ ID NO: 3724567 - RNA, 13 nt, Salmonella enterica enterica serovar Typhi Ty2
uuaguaacuuaca

SEQ ID NO: 3724568 - RNA, 19 nt, Salmonella enterica enterica serovar Typhi Ty2
uuaguaccgaacagccagg

SEQ ID NO: 3724569 - RNA, 20 nt, Salmonella enterica enterica serovar Typhi Ty2
uuaguaccgaacagccaggc

SEQ ID NO: 3724570 - RNA, 22 nt, Salmonella enterica enterica serovar Typhi Ty2
uuaguaccgaacagccaggcuu

SEQ ID NO: 3724571 - RNA, 21 nt, Salmonella enterica enterica serovar Typhi Ty2
uuaguacgcaaggaaauauua

SEQ ID NO: 3724572 - RNA, 20 nt, Salmonella enterica enterica serovar Typhi Ty2
uuaguccgucggggauggcg

SEQ ID NO: 3724573 - RNA, 21 nt, Salmonella enterica enterica serovar Typhi Ty2
uuagucuccugccaaugaaau

SEQ ID NO: 3724574 - RNA, 16 nt, Salmonella enterica enterica serovar Typhi Ty2
uuagugacguuaucug

SEQ ID NO: 3724575 - RNA, 12 nt, Salmonella enterica enterica serovar Typhi Ty2
uuagugccgcca

SEQ ID NO: 3724576 - RNA, 15 nt, Salmonella enterica enterica serovar Typhi Ty2
uuagugcucagcuug

SEQ ID NO: 3724577 - RNA, 12 nt, Salmonella enterica enterica serovar Typhi Ty2
uuaguucaaguu

SEQ ID NO: 3724578 - RNA, 20 nt, Salmonella enterica enterica serovar Typhi Ty2
uuaguucaaguuuagaaaaa

SEQ ID NO: 3724579 - RNA, 13 nt, Salmonella enterica enterica serovar Typhi Ty2
uuauaaaauaacg

SEQ ID NO: 3724580 - RNA, 23 nt, Salmonella enterica enterica serovar Typhi Ty2
uuauaaauaaaguguuaucaugu

SEQ ID NO: 3724581 - RNA, 21 nt, Salmonella enterica enterica serovar Typhi Ty2
uuauaaauccccgccgccauc

SEQ ID NO: 3724582 - RNA, 14 nt, Salmonella enterica enterica serovar Typhi Ty2
uuauaaauuuuuua

SEQ ID NO: 3724583 - RNA, 22 nt, Salmonella enterica enterica serovar Typhi Ty2
uuauaacuaaacucaucuuuau

SEQ ID NO: 3724584 - RNA, 13 nt, Salmonella enterica enterica serovar Typhi Ty2
uuauaagcgccaa

SEQ ID NO: 3724585 - RNA, 17 nt, Salmonella enterica enterica serovar Typhi Ty2
uuauaagcuuuaaccac

SEQ ID NO: 3724586 - RNA, 22 nt, Salmonella enterica enterica serovar Typhi Ty2
uuauaaggccugccguccugau

SEQ ID NO: 3724587 - RNA, 18 nt, Salmonella enterica enterica serovar Typhi Ty2
uuauacaccgggaaaagc

SEQ ID NO: 3724588 - RNA, 15 nt, Salmonella enterica enterica serovar Typhi Ty2
uuauacacucaacca

SEQ ID NO: 3724589 - RNA, 15 nt, Salmonella enterica enterica serovar Typhi Ty2
uuauacucaaaaaau

SEQ ID NO: 3724590 - RNA, 11 nt, Salmonella enterica enterica serovar Typhi Ty2
uuauacugaua

SEQ ID NO: 3724591 - RNA, 15 nt, Salmonella enterica enterica serovar Typhi Ty2
uuauacugauaaacu

SEQ ID NO: 3724592 - RNA, 20 nt, Salmonella enterica enterica serovar Typhi Ty2
uuauagcaaacccucaucgg

SEQ ID NO: 3724593 - RNA, 20 nt, Salmonella enterica enterica serovar Typhi Ty2
uuauagcuggcuuuauauaa

SEQ ID NO: 3724594 - RNA, 13 nt, Salmonella enterica enterica serovar Typhi Ty2
uuauaguccacuu

SEQ ID NO: 3724595 - RNA, 14 nt, Salmonella enterica enterica serovar Typhi Ty2
uuauauaaaaauag

SEQ ID NO: 3724596 - RNA, 13 nt, Salmonella enterica enterica serovar Typhi Ty2
uuauauagucuua

SEQ ID NO: 3724597 - RNA, 17 nt, Salmonella enterica enterica serovar Typhi Ty2
uuauauagucuuaauuu

SEQ ID NO: 3724598 - RNA, 21 nt, Salmonella enterica enterica serovar Typhi Ty2
uuauaucaggcaaaaaucguc

SEQ ID NO: 3724599 - RNA, 16 nt, Salmonella enterica enterica serovar Typhi Ty2
uuauauuacuggcuau

SEQ ID NO: 3724600 - RNA, 15 nt, Salmonella enterica enterica serovar Typhi Ty2
uugcgcccaggccaa

SEQ ID NO: 3724601 - RNA, 20 nt, Salmonella enterica enterica serovar Typhi Ty2
uugcgccgacggaacccagc

SEQ ID NO: 3724602 - RNA, 21 nt, Salmonella enterica enterica serovar Typhi Ty2
uugcgccgugccuggcgcugg

SEQ ID NO: 3724603 - RNA, 23 nt, Salmonella enterica enterica serovar Typhi Ty2
uugcgccuuuccggccugaaugc

SEQ ID NO: 3724604 - RNA, 17 nt, Salmonella enterica enterica serovar Typhi Ty2
uugcgcgaggucgagcu

SEQ ID NO: 3724605 - RNA, 20 nt, Salmonella enterica enterica serovar Typhi Ty2
uugcgcgguuaacagccgcu

SEQ ID NO: 3724606 - RNA, 14 nt, Salmonella enterica enterica serovar Typhi Ty2
uugcgcucugccag

SEQ ID NO: 3724607 - RNA, 20 nt, Salmonella enterica enterica serovar Typhi Ty2
uugcggaauacacgaacaca

SEQ ID NO: 3724608 - RNA, 13 nt, Salmonella enterica enterica serovar Typhi Ty2
uugcggaugaccg

SEQ ID NO: 3724609 - RNA, 15 nt, Salmonella enterica enterica serovar Typhi Ty2
uugcguaagcagcug

SEQ ID NO: 3724610 - RNA, 14 nt, Salmonella enterica enterica serovar Typhi Ty2
uugcguccauuaag

SEQ ID NO: 3724611 - RNA, 22 nt, Salmonella enterica enterica serovar Typhi Ty2
uugcgucguuaacugcauuaca

SEQ ID NO: 3724612 - RNA, 15 nt, Salmonella enterica enterica serovar Typhi Ty2
uugcgucguuccguc

SEQ ID NO: 3724613 - RNA, 15 nt, Salmonella enterica enterica serovar Typhi Ty2
uugcgugucaucaaa

SEQ ID NO: 3724614 - RNA, 17 nt, Salmonella enterica enterica serovar Typhi Ty2
uugcuauagcccacgca

SEQ ID NO: 3724615 - RNA, 23 nt, Salmonella enterica enterica serovar Typhi Ty2
uugcucaacuggaugacugaauu

SEQ ID NO: 3724616 - RNA, 22 nt, Salmonella enterica enterica serovar Typhi Ty2
uugcucacccauuuuauccucu

SEQ ID NO: 3724617 - RNA, 24 nt, Salmonella enterica enterica serovar Typhi Ty2
uugcucacggcgauaccaguaaua

SEQ ID NO: 3724618 - RNA, 23 nt, Salmonella enterica enterica serovar Typhi Ty2
uugcuccagcagcgccaguuuuu

SEQ ID NO: 3724619 - RNA, 19 nt, Salmonella enterica enterica serovar Typhi Ty2
uugcucgcggcgugaugcc

SEQ ID NO: 3724620 - RNA, 14 nt, Salmonella enterica enterica serovar Typhi Ty2
uugcucugccagcg

SEQ ID NO: 3724621 - RNA, 18 nt, Salmonella enterica enterica serovar Typhi Ty2
uugcugaaucugcggcug

SEQ ID NO: 3724622 - RNA, 14 nt, Salmonella enterica enterica serovar Typhi Ty2
uugcugacaucgcg

SEQ ID NO: 3724623 - RNA, 14 nt, Salmonella enterica enterica serovar Typhi Ty2
uugcugauaaucaa

SEQ ID NO: 3724624 - RNA, 16 nt, Salmonella enterica enterica serovar Typhi Ty2
uugcugcgcaggggcu

SEQ ID NO: 3724625 - RNA, 14 nt, Salmonella enterica enterica serovar Typhi Ty2
uugcugcuauguaa

SEQ ID NO: 3724626 - RNA, 21 nt, Salmonella enterica enterica serovar Typhi Ty2
uugcugcugcggaucgucucu

SEQ ID NO: 3724627 - RNA, 21 nt, Salmonella enterica enterica serovar Typhi Ty2
uugcuggagcaggugcggcug

SEQ ID NO: 3724628 - RNA, 14 nt, Salmonella enterica enterica serovar Typhi Ty2
uugcuggauucucu

SEQ ID NO: 3724629 - RNA, 18 nt, Salmonella enterica enterica serovar Typhi Ty2
uugcuggcaagaaccgcu

SEQ ID NO: 3724630 - RNA, 20 nt, Salmonella enterica enterica serovar Typhi Ty2
uugcuggcgugaaccgguaa

SEQ ID NO: 3724631 - RNA, 17 nt, Salmonella enterica enterica serovar Typhi Ty2
uugcugguagacaaaca

SEQ ID NO: 3724632 - RNA, 17 nt, Salmonella enterica enterica serovar Typhi Ty2
uugcugucgcgcaauac

SEQ ID NO: 3724633 - RNA, 17 nt, Salmonella enterica enterica serovar Typhi Ty2
uugcuguuaauuucccg

SEQ ID NO: 3724634 - RNA, 20 nt, Salmonella enterica enterica serovar Typhi Ty2
uugcuguuagaaucucugac

SEQ ID NO: 3724635 - RNA, 17 nt, Salmonella enterica enterica serovar Typhi Ty2
uugcuguuuuauuuccu

SEQ ID NO: 3724636 - RNA, 16 nt, Salmonella enterica enterica serovar Typhi Ty2
uugcuuaccuuguucu

SEQ ID NO: 3724637 - RNA, 18 nt, Salmonella enterica enterica serovar Typhi Ty2
uugcuuauccggccuaca

SEQ ID NO: 3724638 - RNA, 14 nt, Salmonella enterica enterica serovar Typhi Ty2
uugcuucgccaucu

SEQ ID NO: 3724639 - RNA, 17 nt, Salmonella enterica enterica serovar Typhi Ty2
uugcuucguuaccggug

SEQ ID NO: 3724640 - RNA, 22 nt, Salmonella enterica enterica serovar Typhi Ty2
uugcuucuguccuuucugcugc

SEQ ID NO: 3724641 - RNA, 18 nt, Salmonella enterica enterica serovar Typhi Ty2
uugcuuucaauuuccgca

SEQ ID NO: 3724642 - RNA, 14 nt, Salmonella enterica enterica serovar Typhi Ty2
uugcuuucuugaau

SEQ ID NO: 3724643 - RNA, 17 nt, Salmonella enterica enterica serovar Typhi Ty2
uugcuuugcggcauaac

SEQ ID NO: 3724644 - RNA, 22 nt, Salmonella enterica enterica serovar Typhi Ty2
uuggaaaaccccaucccggcaa

SEQ ID NO: 3724645 - RNA, 18 nt, Salmonella enterica enterica serovar Typhi Ty2
uuggaaacuaugcaaaac

SEQ ID NO: 3724646 - RNA, 17 nt, Salmonella enterica enterica serovar Typhi Ty2
uuggacggaaucucgca

SEQ ID NO: 3724647 - RNA, 13 nt, Salmonella enterica enterica serovar Typhi Ty2
uuggaucggcaaa

SEQ ID NO: 3724648 - RNA, 19 nt, Salmonella enterica enterica serovar Typhi Ty2
uuggaugaaccauaucaaa

SEQ ID NO: 3724649 - RNA, 15 nt, Salmonella enterica enterica serovar Typhi Ty2
uuggcaaaaaaggcc

SEQ ID NO: 3724650 - RNA, 20 nt, Salmonella enterica enterica serovar Typhi Ty2
uuggcaaaaaaggccagacu

SEQ ID NO: 3724651 - RNA, 12 nt, Salmonella enterica enterica serovar Typhi Ty2
uuggcaaauccg

SEQ ID NO: 3724652 - RNA, 22 nt, Salmonella enterica enterica serovar Typhi Ty2
uuggcaacccguaccuccagcg

SEQ ID NO: 3724653 - RNA, 17 nt, Salmonella enterica enterica serovar Typhi Ty2
uuggcaacgucuugcca

SEQ ID NO: 3724654 - RNA, 15 nt, Salmonella enterica enterica serovar Typhi Ty2
uuggcaaucaaaucc

SEQ ID NO: 3724655 - RNA, 14 nt, Salmonella enterica enterica serovar Typhi Ty2
uuggcaaucacaag

SEQ ID NO: 3724656 - RNA, 17 nt, Salmonella enterica enterica serovar Typhi Ty2
uuggcaaucagcggcaa

SEQ ID NO: 3724657 - RNA, 12 nt, Salmonella enterica enterica serovar Typhi Ty2
uuggcaauuaaa

SEQ ID NO: 3724658 - RNA, 19 nt, Salmonella enterica enterica serovar Typhi Ty2
uuggcagaacgaccacauu

SEQ ID NO: 3724659 - RNA, 21 nt, Salmonella enterica enterica serovar Typhi Ty2
uuggcagccccugaaauaaca

SEQ ID NO: 3724660 - RNA, 22 nt, Salmonella enterica enterica serovar Typhi Ty2
uuggcagccccugaaauaacag

SEQ ID NO: 3724661 - RNA, 14 nt, Salmonella enterica enterica serovar Typhi Ty2
uuggcaucugcaau

SEQ ID NO: 3724662 - RNA, 14 nt, Salmonella enterica enterica serovar Typhi Ty2
uuggcaucugucau

SEQ ID NO: 3724663 - RNA, 22 nt, Salmonella enterica enterica serovar Typhi Ty2
uuggccagcguggaugaacuca

SEQ ID NO: 3724664 - RNA, 20 nt, Salmonella enterica enterica serovar Typhi Ty2
uuggccggcuucuccaccau

SEQ ID NO: 3724665 - RNA, 18 nt, Salmonella enterica enterica serovar Typhi Ty2
uuggcgaauaaucaacca

SEQ ID NO: 3724666 - RNA, 18 nt, Salmonella enterica enterica serovar Typhi Ty2
uuggcgacgaacacggcg

SEQ ID NO: 3724667 - RNA, 14 nt, Salmonella enterica enterica serovar Typhi Ty2
uuggcgaucacaau

SEQ ID NO: 3724668 - RNA, 19 nt, Salmonella enterica enterica serovar Typhi Ty2
uuggcgaucacaauuacgc

SEQ ID NO: 3724669 - RNA, 17 nt, Salmonella enterica enterica serovar Typhi Ty2
uuggcgccaaaaccgcu

SEQ ID NO: 3724670 - RNA, 22 nt, Salmonella enterica enterica serovar Typhi Ty2
uuggcgccaaaaccgcucacgg

SEQ ID NO: 3724671 - RNA, 13 nt, Salmonella enterica enterica serovar Typhi Ty2
uuggcgcugccgg

SEQ ID NO: 3724672 - RNA, 14 nt, Salmonella enterica enterica serovar Typhi Ty2
uuggcgcuggguac

SEQ ID NO: 3724673 - RNA, 14 nt, Salmonella enterica enterica serovar Typhi Ty2
uuggcgugacggcg

SEQ ID NO: 3724674 - RNA, 13 nt, Salmonella enterica enterica serovar Typhi Ty2
uuggcuccaguac

SEQ ID NO: 3724675 - RNA, 22 nt, Salmonella enterica enterica serovar Typhi Ty2
uuggcuccaguaccgggcagga

SEQ ID NO: 3724676 - RNA, 21 nt, Salmonella enterica enterica serovar Typhi Ty2
uuggcucgauuccugacgcac

SEQ ID NO: 3724677 - RNA, 17 nt, Salmonella enterica enterica serovar Typhi Ty2
uuggcuuuguaaauauu

SEQ ID NO: 3724678 - RNA, 18 nt, Salmonella enterica enterica serovar Typhi Ty2
uugggaauuagcgaauca

SEQ ID NO: 3724679 - RNA, 18 nt, Salmonella enterica enterica serovar Typhi Ty2
uugggauuacuuccgguu

SEQ ID NO: 3724680 - RNA, 20 nt, Salmonella enterica enterica serovar Typhi Ty2
uugggcgcaacagucagcuc

SEQ ID NO: 3724681 - RNA, 23 nt, Salmonella enterica enterica serovar Typhi Ty2
uugggcgcgaaacugcugccgca

SEQ ID NO: 3724682 - RNA, 20 nt, Salmonella enterica enterica serovar Typhi Ty2
uuggggaaccuggcagaaag

SEQ ID NO: 3724683 - RNA, 20 nt, Salmonella enterica enterica serovar Typhi Ty2
uuggugauuaacagcgccau

SEQ ID NO: 3724684 - RNA, 16 nt, Salmonella enterica enterica serovar Typhi Ty2
uuggugggugaugacg

SEQ ID NO: 3724685 - RNA, 22 nt, Salmonella enterica enterica serovar Typhi Ty2
uugguguaacagcaacaucuau

SEQ ID NO: 3724686 - RNA, 18 nt, Salmonella enterica enterica serovar Typhi Ty2
uugguuuaaacucugcaa

SEQ ID NO: 3724687 - RNA, 20 nt, Salmonella enterica enterica serovar Typhi Ty2
uugguuucgccuaagcccac

SEQ ID NO: 3724688 - RNA, 11 nt, Salmonella enterica enterica serovar Typhi Ty2
uugguuuugcc

SEQ ID NO: 3724689 - RNA, 15 nt, Salmonella enterica enterica serovar Typhi Ty2
uugguuuugccauuc

SEQ ID NO: 3724690 - RNA, 19 nt, Salmonella enterica enterica serovar Typhi Ty2
uuguaaaaccgacuaucag

SEQ ID NO: 3724691 - RNA, 16 nt, Salmonella enterica enterica serovar Typhi Ty2
uuguaaagaaauuuaa

SEQ ID NO: 3724692 - RNA, 16 nt, Salmonella enterica enterica serovar Typhi Ty2
uuguacagcaauaaaa

SEQ ID NO: 3724693 - RNA, 20 nt, Salmonella enterica enterica serovar Typhi Ty2
uuguacagcaauaaaaggaa

SEQ ID NO: 3724694 - RNA, 15 nt, Salmonella enterica enterica serovar Typhi Ty2
uuguacagcuugccg

SEQ ID NO: 3724695 - RNA, 17 nt, Salmonella enterica enterica serovar Typhi Ty2
uuguacagcuugccguc

SEQ ID NO: 3724696 - RNA, 18 nt, Salmonella enterica enterica serovar Typhi Ty2
uuguacggcggcauuaaa

SEQ ID NO: 3724697 - RNA, 23 nt, Salmonella enterica enterica serovar Typhi Ty2
uuguacggcggcauuaaagccgc

SEQ ID NO: 3724698 - RNA, 20 nt, Salmonella enterica enterica serovar Typhi Ty2
uuguaggccggauaaggcgu

SEQ ID NO: 3724699 - RNA, 17 nt, Salmonella enterica enterica serovar Typhi Ty2
uuguaggcuuccagaag

SEQ ID NO: 3724700 - RNA, 15 nt, Salmonella enterica enterica serovar Typhi Ty2
uugucaaaaauagca

SEQ ID NO: 3724701 - RNA, 23 nt, Salmonella enterica enterica serovar Typhi Ty2
uugucagcugaacagucccacca

SEQ ID NO: 3724702 - RNA, 16 nt, Salmonella enterica enterica serovar Typhi Ty2
uugucaggcagaaaua

SEQ ID NO: 3724703 - RNA, 17 nt, Salmonella enterica enterica serovar Typhi Ty2
uugucagucugguacuc

SEQ ID NO: 3724704 - RNA, 16 nt, Salmonella enterica enterica serovar Typhi Ty2
uugucaucagaucaug

SEQ ID NO: 3724705 - RNA, 17 nt, Salmonella enterica enterica serovar Typhi Ty2
uugucaucagucucaaa

SEQ ID NO: 3724706 - RNA, 17 nt, Salmonella enterica enterica serovar Typhi Ty2
uugucauccugcucauc

SEQ ID NO: 3724707 - RNA, 22 nt, Salmonella enterica enterica serovar Typhi Ty2
uugucaugcuaaaacagauaac

SEQ ID NO: 3724708 - RNA, 17 nt, Salmonella enterica enterica serovar Typhi Ty2
uuguccagcggccauga

SEQ ID NO: 3724709 - RNA, 17 nt, Salmonella enterica enterica serovar Typhi Ty2
uuguccauaaaaugaug

SEQ ID NO: 3724710 - RNA, 15 nt, Salmonella enterica enterica serovar Typhi Ty2
uugucgcccugcaau

SEQ ID NO: 3724711 - RNA, 19 nt, Salmonella enterica enterica serovar Typhi Ty2
uugucguucacguaaucgc

SEQ ID NO: 3724712 - RNA, 17 nt, Salmonella enterica enterica serovar Typhi Ty2
uugucucaaaaaauauc

SEQ ID NO: 3724713 - RNA, 20 nt, Salmonella enterica enterica serovar Typhi Ty2
uugucucaaaaaauaucucu

SEQ ID NO: 3724714 - RNA, 15 nt, Salmonella enterica enterica serovar Typhi Ty2
uugucuccucaugcc

SEQ ID NO: 3724715 - RNA, 13 nt, Salmonella enterica enterica serovar Typhi Ty2
uugucuuaaauau

SEQ ID NO: 3724716 - RNA, 14 nt, Salmonella enterica enterica serovar Typhi Ty2
uugucuucuuagua

SEQ ID NO: 3724717 - RNA, 16 nt, Salmonella enterica enterica serovar Typhi Ty2
uugugagaaaagcaga

SEQ ID NO: 3724718 - RNA, 15 nt, Salmonella enterica enterica serovar Typhi Ty2
uugugaguucauaaa

SEQ ID NO: 3724719 - RNA, 23 nt, Salmonella enterica enterica serovar Typhi Ty2
uugugcauuccaggugucacuca

SEQ ID NO: 3724720 - RNA, 21 nt, Salmonella enterica enterica serovar Typhi Ty2
uugugcccgcgaucgcuucca

SEQ ID NO: 3724721 - RNA, 23 nt, Salmonella enterica enterica serovar Typhi Ty2
uugugccgacaucgcucccggca

SEQ ID NO: 3724722 - RNA, 12 nt, Salmonella enterica enterica serovar Typhi Ty2
uugugcuuuagc

SEQ ID NO: 3724723 - RNA, 15 nt, Salmonella enterica enterica serovar Typhi Ty2
uuguggcgaccagca

SEQ ID NO: 3724724 - RNA, 17 nt, Salmonella enterica enterica serovar Typhi Ty2
uuguggcgaccagcaga

SEQ ID NO: 3724725 - RNA, 13 nt, Salmonella enterica enterica serovar Typhi Ty2
uuguguaaucuuu

SEQ ID NO: 3724726 - RNA, 23 nt, Salmonella enterica enterica serovar Typhi Ty2
uuguucaauagagcgcagcaaaa

SEQ ID NO: 3724727 - RNA, 15 nt, Salmonella enterica enterica serovar Typhi Ty2
uuguucagugccauc

SEQ ID NO: 3724728 - RNA, 13 nt, Salmonella enterica enterica serovar Typhi Ty2
uuguucauaucga

SEQ ID NO: 3724729 - RNA, 15 nt, Salmonella enterica enterica serovar Typhi Ty2
uuguucgcuucuucu

SEQ ID NO: 3724730 - RNA, 18 nt, Salmonella enterica enterica serovar Typhi Ty2
uuguucgucuuuugaaua

SEQ ID NO: 3724731 - RNA, 19 nt, Salmonella enterica enterica serovar Typhi Ty2
uuguucuuucaccauuaag

SEQ ID NO: 3724732 - RNA, 23 nt, Salmonella enterica enterica serovar Typhi Ty2
uuguugccgcccguuuuuuccag

SEQ ID NO: 3724733 - RNA, 20 nt, Salmonella enterica enterica serovar Typhi Ty2
uuguuguuaauuugauuuau

SEQ ID NO: 3724734 - RNA, 13 nt, Salmonella enterica enterica serovar Typhi Ty2
uuguuuaccccag

SEQ ID NO: 3724735 - RNA, 17 nt, Salmonella enterica enterica serovar Typhi Ty2
uuguuuauccugcaaau

SEQ ID NO: 3724736 - RNA, 21 nt, Salmonella enterica enterica serovar Typhi Ty2
uuuaaaaagcugcauaaugcg

SEQ ID NO: 3724737 - RNA, 15 nt, Salmonella enterica enterica serovar Typhi Ty2
uuuaaaacauaucca

SEQ ID NO: 3724738 - RNA, 23 nt, Salmonella enterica enterica serovar Typhi Ty2
uuuaaaacuucccgcgcagugca

SEQ ID NO: 3724739 - RNA, 13 nt, Salmonella enterica enterica serovar Typhi Ty2
uuuaaaaucaacg

SEQ ID NO: 3724740 - RNA, 16 nt, Salmonella enterica enterica serovar Typhi Ty2
uuuaaaauccggcugc

SEQ ID NO: 3724741 - RNA, 13 nt, Salmonella enterica enterica serovar Typhi Ty2
uuuaaacaacaua

SEQ ID NO: 3724742 - RNA, 22 nt, Salmonella enterica enterica serovar Typhi Ty2
uuuaaaccaugcgagaucggca

SEQ ID NO: 3724743 - RNA, 19 nt, Salmonella enterica enterica serovar Typhi Ty2
uuuaaacuuauccgccauc

SEQ ID NO: 3724744 - RNA, 16 nt, Salmonella enterica enterica serovar Typhi Ty2
uuuaaauuguuauacc

SEQ ID NO: 3724745 - RNA, 21 nt, Salmonella enterica enterica serovar Typhi Ty2
uuuaacaaauuaaauccugaa

SEQ ID NO: 3724746 - RNA, 17 nt, Salmonella enterica enterica serovar Typhi Ty2
uuuaacaauuuaucaga

SEQ ID NO: 3724747 - RNA, 15 nt, Salmonella enterica enterica serovar Typhi Ty2
uuuaacgauuucccc

SEQ ID NO: 3724748 - RNA, 18 nt, Salmonella enterica enterica serovar Typhi Ty2
uuuaagccgauugaauaa

SEQ ID NO: 3724749 - RNA, 20 nt, Salmonella enterica enterica serovar Typhi Ty2
uuuaagcuuaaugauaauug

SEQ ID NO: 3724750 - RNA, 19 nt, Salmonella enterica enterica serovar Typhi Ty2
uuuaaggcggcaaagauaa

SEQ ID NO: 3724751 - RNA, 18 nt, Salmonella enterica enterica serovar Typhi Ty2
uuuaauaccgcguaaaaa

SEQ ID NO: 3724752 - RNA, 21 nt, Salmonella enterica enterica serovar Typhi Ty2
uuuaauacgcugucgaugaua

SEQ ID NO: 3724753 - RNA, 20 nt, Salmonella enterica enterica serovar Typhi Ty2
uuuaauauaugaaccaagau

SEQ ID NO: 3724754 - RNA, 15 nt, Salmonella enterica enterica serovar Typhi Ty2
uuuaaucgcccugcg

SEQ ID NO: 3724755 - RNA, 23 nt, Salmonella enterica enterica serovar Typhi Ty2
uuuaauuccaccagcuuaucuga

SEQ ID NO: 3724756 - RNA, 23 nt, Salmonella enterica enterica serovar Typhi Ty2
uuuacaaccguggcguuuucauu

SEQ ID NO: 3724757 - RNA, 23 nt, Salmonella enterica enterica serovar Typhi Ty2
uuuacacggugugaucaccgccc

SEQ ID NO: 3724758 - RNA, 23 nt, Salmonella enterica enterica serovar Typhi Ty2
uuuaccagugcuaaaauuauaca

SEQ ID NO: 3724759 - RNA, 22 nt, Salmonella enterica enterica serovar Typhi Ty2
uuuaccauuacgcuauaaaguu

SEQ ID NO: 3724760 - RNA, 13 nt, Salmonella enterica enterica serovar Typhi Ty2
uuuaccauucagc

SEQ ID NO: 3724761 - RNA, 19 nt, Salmonella enterica enterica serovar Typhi Ty2
uuuaccggaugggcagaua

SEQ ID NO: 3724762 - RNA, 14 nt, Salmonella enterica enterica serovar Typhi Ty2
uuuaccggugcgga

SEQ ID NO: 3724763 - RNA, 16 nt, Salmonella enterica enterica serovar Typhi Ty2
uuuaccucacggugac

SEQ ID NO: 3724764 - RNA, 17 nt, Salmonella enterica enterica serovar Typhi Ty2
uuuaccuguuuaucuga

SEQ ID NO: 3724765 - RNA, 14 nt, Salmonella enterica enterica serovar Typhi Ty2
uuuaccuuuuccuc

SEQ ID NO: 3724766 - RNA, 21 nt, Salmonella enterica enterica serovar Typhi Ty2
uuuacgauacguuuaaaauga

SEQ ID NO: 3724767 - RNA, 20 nt, Salmonella enterica enterica serovar Typhi Ty2
uuuacgcagauaacuuccuu

SEQ ID NO: 3724768 - RNA, 13 nt, Salmonella enterica enterica serovar Typhi Ty2
uuuacgcugcucc

SEQ ID NO: 3724769 - RNA, 20 nt, Salmonella enterica enterica serovar Typhi Ty2
uuuacggcccuaccauuacc

SEQ ID NO: 3724770 - RNA, 16 nt, Salmonella enterica enterica serovar Typhi Ty2
uuuacgguuggccauu

SEQ ID NO: 3724771 - RNA, 17 nt, Salmonella enterica enterica serovar Typhi Ty2
uuuacuauugccgauaa

SEQ ID NO: 3724772 - RNA, 18 nt, Salmonella enterica enterica serovar Typhi Ty2
uuuacuccauucccagcu

SEQ ID NO: 3724773 - RNA, 15 nt, Salmonella enterica enterica serovar Typhi Ty2
uuuacucucuuucug

SEQ ID NO: 3724774 - RNA, 20 nt, Salmonella enterica enterica serovar Typhi Ty2
uuuacugaauaacagcacca

SEQ ID NO: 3724775 - RNA, 14 nt, Salmonella enterica enterica serovar Typhi Ty2
uuuacugacaauaa

SEQ ID NO: 3724776 - RNA, 12 nt, Salmonella enterica enterica serovar Typhi Ty2
uuuacugauaaa

SEQ ID NO: 3724777 - RNA, 14 nt, Salmonella enterica enterica serovar Typhi Ty2
uuuacugaugccag

SEQ ID NO: 3724778 - RNA, 20 nt, Salmonella enterica enterica serovar Typhi Ty2
uuuacugauuagccuguugg

SEQ ID NO: 3724779 - RNA, 20 nt, Salmonella enterica enterica serovar Typhi Ty2
uuuacugcgaaggcuacugc

SEQ ID NO: 3724780 - RNA, 23 nt, Salmonella enterica enterica serovar Typhi Ty2
uuuacuucuucaggcuugucgcg

SEQ ID NO: 3724781 - RNA, 12 nt, Salmonella enterica enterica serovar Typhi Ty2
uuuacuuucauu

SEQ ID NO: 3724782 - RNA, 13 nt, Salmonella enterica enterica serovar Typhi Ty2
uuuagaauuaucu

SEQ ID NO: 3724783 - RNA, 17 nt, Salmonella enterica enterica serovar Typhi Ty2
uuuagaauuaucugaaa

SEQ ID NO: 3724784 - RNA, 18 nt, Salmonella enterica enterica serovar Typhi Ty2
uuuagccaucccggcgac

SEQ ID NO: 3724785 - RNA, 23 nt, Salmonella enterica enterica serovar Typhi Ty2
uuuagccugcgcguaaauuucac

SEQ ID NO: 3724786 - RNA, 16 nt, Salmonella enterica enterica serovar Typhi Ty2
uuuagcgccagcagca

SEQ ID NO: 3724787 - RNA, 14 nt, Salmonella enterica enterica serovar Typhi Ty2
uuuagcguuggcgu

SEQ ID NO: 3724788 - RNA, 20 nt, Salmonella enterica enterica serovar Typhi Ty2
uuuagcguuucaucggugua

SEQ ID NO: 3724789 - RNA, 13 nt, Salmonella enterica enterica serovar Typhi Ty2
uuuagugcucagc

SEQ ID NO: 3724790 - RNA, 21 nt, Salmonella enterica enterica serovar Typhi Ty2
uuuaguucagcauauuucuaa

SEQ ID NO: 3724791 - RNA, 13 nt, Salmonella enterica enterica serovar Typhi Ty2
uuuauaaaguaaa

SEQ ID NO: 3724792 - RNA, 23 nt, Salmonella enterica enterica serovar Typhi Ty2
uuuauaacauaaauaguauuagu

SEQ ID NO: 3724793 - RNA, 19 nt, Salmonella enterica enterica serovar Typhi Ty2
uuuauaacuaaacucaucu

SEQ ID NO: 3724794 - RNA, 13 nt, Salmonella enterica enterica serovar Typhi Ty2
uuuauaagccgau

SEQ ID NO: 3724795 - RNA, 15 nt, Salmonella enterica enterica serovar Typhi Ty2
uuuauauuuuuaagg

SEQ ID NO: 3724796 - RNA, 20 nt, Salmonella enterica enterica serovar Typhi Ty2
uuuaucaacaaauuccggca

SEQ ID NO: 3724797 - RNA, 14 nt, Salmonella enterica enterica serovar Typhi Ty2
uuuaucagaccugu

SEQ ID NO: 3724798 - RNA, 12 nt, Salmonella enterica enterica serovar Typhi Ty2
uuuaucaggccu

SEQ ID NO: 3724799 - RNA, 11 nt, Salmonella enterica enterica serovar Typhi Ty2
uuuauccagua

SEQ ID NO: 3724800 - RNA, 22 nt, Salmonella enterica enterica serovar Typhi Ty2
uuuauccccgcuggcgcgggga

SEQ ID NO: 3724801 - RNA, 22 nt, Salmonella enterica enterica serovar Typhi Ty2
uuuauccccgcuggugcgggga

SEQ ID NO: 3724802 - RNA, 23 nt, Salmonella enterica enterica serovar Typhi Ty2
uuuauccggauggaacgcaucca

SEQ ID NO: 3724803 - RNA, 18 nt, Salmonella enterica enterica serovar Typhi Ty2
uuuauccggcgccauagu

SEQ ID NO: 3724804 - RNA, 17 nt, Salmonella enterica enterica serovar Typhi Ty2
uuuaucggcgucgcggc

SEQ ID NO: 3724805 - RNA, 15 nt, Salmonella enterica enterica serovar Typhi Ty2
uuuaucgggcuguug

SEQ ID NO: 3724806 - RNA, 15 nt, Salmonella enterica enterica serovar Typhi Ty2
uuuaucuauuucuua

SEQ ID NO: 3724807 - RNA, 17 nt, Salmonella enterica enterica serovar Typhi Ty2
uuuaucugcccuuucuu

SEQ ID NO: 3724808 - RNA, 21 nt, Salmonella enterica enterica serovar Typhi Ty2
uuuaucugcgugaugcaucag

SEQ ID NO: 3724809 - RNA, 22 nt, Salmonella enterica enterica serovar Typhi Ty2
uuuaucuuuaaauuucagggcu

SEQ ID NO: 3724810 - RNA, 22 nt, Salmonella enterica enterica serovar Typhi Ty2
uuuaugcacgccgggaauuauu

SEQ ID NO: 3724811 - RNA, 22 nt, Salmonella enterica enterica serovar Typhi Ty2
uuuaugcagccgauaguccgga

SEQ ID NO: 3724812 - RNA, 20 nt, Salmonella enterica enterica serovar Typhi Ty2
uuuaugcaguuccguugcaa

SEQ ID NO: 3724813 - RNA, 15 nt, Salmonella enterica enterica serovar Typhi Ty2
uuuaugcguuauaga

SEQ ID NO: 3724814 - RNA, 15 nt, Salmonella enterica enterica serovar Typhi Ty2
uuuauggcacaucag

SEQ ID NO: 3724815 - RNA, 18 nt, Salmonella enterica enterica serovar Typhi Ty2
uuuauuaccugguauuau

SEQ ID NO: 3724816 - RNA, 12 nt, Salmonella enterica enterica serovar Typhi Ty2
uuuauuaucuga

SEQ ID NO: 3724817 - RNA, 13 nt, Salmonella enterica enterica serovar Typhi Ty2
uuuauuauuucca

SEQ ID NO: 3724818 - RNA, 15 nt, Salmonella enterica enterica serovar Typhi Ty2
uuuauucgcuuguuu

SEQ ID NO: 3724819 - RNA, 12 nt, Salmonella enterica enterica serovar Typhi Ty2
uuuauugccgcu

SEQ ID NO: 3724820 - RNA, 18 nt, Salmonella enterica enterica serovar Typhi Ty2
uuuauuuaggauuugucu

SEQ ID NO: 3724821 - RNA, 16 nt, Salmonella enterica enterica serovar Typhi Ty2
uuucaaaaaagagaag

SEQ ID NO: 3724822 - RNA, 22 nt, Salmonella enterica enterica serovar Typhi Ty2
uuucaaaaccgaccccgcucag

SEQ ID NO: 3724823 - RNA, 13 nt, Salmonella enterica enterica serovar Typhi Ty2
uuucaaauagcug

SEQ ID NO: 3724824 - RNA, 19 nt, Salmonella enterica enterica serovar Typhi Ty2
uuucaaauuucugauguga

SEQ ID NO: 3724825 - RNA, 17 nt, Salmonella enterica enterica serovar Typhi Ty2
uuucaaccacggauaag

SEQ ID NO: 3724826 - RNA, 22 nt, Salmonella enterica enterica serovar Typhi Ty2
uuucaacggauugugaaauucg

SEQ ID NO: 3724827 - RNA, 15 nt, Salmonella enterica enterica serovar Typhi Ty2
uuucaacugccccuu

SEQ ID NO: 3724828 - RNA, 12 nt, Salmonella enterica enterica serovar Typhi Ty2
uuucaacuggcu

SEQ ID NO: 3724829 - RNA, 13 nt, Salmonella enterica enterica serovar Typhi Ty2
uuucaacuuccac

SEQ ID NO: 3724830 - RNA, 19 nt, Salmonella enterica enterica serovar Typhi Ty2
uuucaacuuccgcguuagg

SEQ ID NO: 3724831 - RNA, 21 nt, Salmonella enterica enterica serovar Typhi Ty2
uuucaauaaucccuucuuuua

SEQ ID NO: 3724832 - RNA, 23 nt, Salmonella enterica enterica serovar Typhi Ty2
uuucaauaauggcgcgaaaacag

SEQ ID NO: 3724833 - RNA, 18 nt, Salmonella enterica enterica serovar Typhi Ty2
uuucaauacuccacaguu

SEQ ID NO: 3724834 - RNA, 20 nt, Salmonella enterica enterica serovar Typhi Ty2
uuucaauccuucuucugaaa

SEQ ID NO: 3724835 - RNA, 16 nt, Salmonella enterica enterica serovar Typhi Ty2
uuucaaucgccaccac

SEQ ID NO: 3724836 - RNA, 18 nt, Salmonella enterica enterica serovar Typhi Ty2
uuucaauguaauuacccu

SEQ ID NO: 3724837 - RNA, 23 nt, Salmonella enterica enterica serovar Typhi Ty2
uuucaauuccgcaggagagccag

SEQ ID NO: 3724838 - RNA, 14 nt, Salmonella enterica enterica serovar Typhi Ty2
uuucaauuuccagu

SEQ ID NO: 3724839 - RNA, 18 nt, Salmonella enterica enterica serovar Typhi Ty2
uuucaauuugugagauaa

SEQ ID NO: 3724840 - RNA, 19 nt, Salmonella enterica enterica serovar Typhi Ty2
uuucaccguggcaucauca

SEQ ID NO: 3724841 - RNA, 19 nt, Salmonella enterica enterica serovar Typhi Ty2
uuucaccuggaugcugccu

SEQ ID NO: 3724842 - RNA, 18 nt, Salmonella enterica enterica serovar Typhi Ty2
uuucacgccauugccagg

SEQ ID NO: 3724843 - RNA, 21 nt, Salmonella enterica enterica serovar Typhi Ty2
uuucacgccuuuugacgcuuc

SEQ ID NO: 3724844 - RNA, 17 nt, Salmonella enterica enterica serovar Typhi Ty2
uuucacucuuugccgau

SEQ ID NO: 3724845 - RNA, 22 nt, Salmonella enterica enterica serovar Typhi Ty2
uuucacugcgugaugcugcagg

SEQ ID NO: 3724846 - RNA, 15 nt, Salmonella enterica enterica serovar Typhi Ty2
uuucacuuaucccug

SEQ ID NO: 3724847 - RNA, 15 nt, Salmonella enterica enterica serovar Typhi Ty2
uuucagaauaauguu

SEQ ID NO: 3724848 - RNA, 18 nt, Salmonella enterica enterica serovar Typhi Ty2
uuucagaggucaggauuu

SEQ ID NO: 3724849 - RNA, 22 nt, Salmonella enterica enterica serovar Typhi Ty2
uuucagaggucaggauuuucgc

SEQ ID NO: 3724850 - RNA, 23 nt, Salmonella enterica enterica serovar Typhi Ty2
uuucagaucgccgccgguaacga

SEQ ID NO: 3724851 - RNA, 18 nt, Salmonella enterica enterica serovar Typhi Ty2
uuucagaucggcaaaagu

SEQ ID NO: 3724852 - RNA, 18 nt, Salmonella enterica enterica serovar Typhi Ty2
uuucagaucgguaaaagc

SEQ ID NO: 3724853 - RNA, 14 nt, Salmonella enterica enterica serovar Typhi Ty2
uuucagcagugcaa

SEQ ID NO: 3724854 - RNA, 15 nt, Salmonella enterica enterica serovar Typhi Ty2
uuucagcauccuccg

SEQ ID NO: 3724855 - RNA, 12 nt, Salmonella enterica enterica serovar Typhi Ty2
uuucagcgccag

SEQ ID NO: 3724856 - RNA, 16 nt, Salmonella enterica enterica serovar Typhi Ty2
uuucagcggcagcucu

SEQ ID NO: 3724857 - RNA, 20 nt, Salmonella enterica enterica serovar Typhi Ty2
uuucagcggcagcucugccu

SEQ ID NO: 3724858 - RNA, 22 nt, Salmonella enterica enterica serovar Typhi Ty2
uuucagcggcagcucugccugu

SEQ ID NO: 3724859 - RNA, 18 nt, Salmonella enterica enterica serovar Typhi Ty2
uuucagcucgcaggccau

SEQ ID NO: 3724860 - RNA, 23 nt, Salmonella enterica enterica serovar Typhi Ty2
uuucagcucgcaggccauaaaac

SEQ ID NO: 3724861 - RNA, 12 nt, Salmonella enterica enterica serovar Typhi Ty2
uuucagggcuua

SEQ ID NO: 3724862 - RNA, 11 nt, Salmonella enterica enterica serovar Typhi Ty2
uuucaggucau

SEQ ID NO: 3724863 - RNA, 18 nt, Salmonella enterica enterica serovar Typhi Ty2
uuucaguaauaauauaaa

SEQ ID NO: 3724864 - RNA, 12 nt, Salmonella enterica enterica serovar Typhi Ty2
uuucauaacgca

SEQ ID NO: 3724865 - RNA, 16 nt, Salmonella enterica enterica serovar Typhi Ty2
uuucauaaugugugua

SEQ ID NO: 3724866 - RNA, 15 nt, Salmonella enterica enterica serovar Typhi Ty2
uuucauagaaccacu

SEQ ID NO: 3724867 - RNA, 20 nt, Salmonella enterica enterica serovar Typhi Ty2
uuucauaugcgggguuugca

SEQ ID NO: 3724868 - RNA, 18 nt, Salmonella enterica enterica serovar Typhi Ty2
uuucaucaaacggauaag

SEQ ID NO: 3724869 - RNA, 19 nt, Salmonella enterica enterica serovar Typhi Ty2
uuucaucaagccauugcgc

SEQ ID NO: 3724870 - RNA, 12 nt, Salmonella enterica enterica serovar Typhi Ty2
uuucaucaccau

SEQ ID NO: 3724871 - RNA, 24 nt, Salmonella enterica enterica serovar Typhi Ty2
uuucaucgagcgugucagugccau

SEQ ID NO: 3724872 - RNA, 16 nt, Salmonella enterica enterica serovar Typhi Ty2
uuucaucgccuuaacu

SEQ ID NO: 3724873 - RNA, 16 nt, Salmonella enterica enterica serovar Typhi Ty2
uuucaucuccgauaaa

SEQ ID NO: 3724874 - RNA, 19 nt, Salmonella enterica enterica serovar Typhi Ty2
uuucaucuccgauaaauaa

SEQ ID NO: 3724875 - RNA, 15 nt, Salmonella enterica enterica serovar Typhi Ty2
uuucaugauauucug

SEQ ID NO: 3724876 - RNA, 16 nt, Salmonella enterica enterica serovar Typhi Ty2
uuucaugccauacucc

SEQ ID NO: 3724877 - RNA, 21 nt, Salmonella enterica enterica serovar Typhi Ty2
uuucauggucaucgcaaauuc

SEQ ID NO: 3724878 - RNA, 22 nt, Salmonella enterica enterica serovar Typhi Ty2
uuucauggucaucgcaaauucu

SEQ ID NO: 3724879 - RNA, 16 nt, Salmonella enterica enterica serovar Typhi Ty2
uuucauguaaaugacg

SEQ ID NO: 3724880 - RNA, 14 nt, Salmonella enterica enterica serovar Typhi Ty2
uuucauuacgcuuc

SEQ ID NO: 3724881 - RNA, 14 nt, Salmonella enterica enterica serovar Typhi Ty2
uuucauuagccgcc

SEQ ID NO: 3724882 - RNA, 14 nt, Salmonella enterica enterica serovar Typhi Ty2
uuucauucagaccc

SEQ ID NO: 3724883 - RNA, 20 nt, Salmonella enterica enterica serovar Typhi Ty2
uuucauucagggaaucagcg

SEQ ID NO: 3724884 - RNA, 16 nt, Salmonella enterica enterica serovar Typhi Ty2
uuucauuucugccugc

SEQ ID NO: 3724885 - RNA, 13 nt, Salmonella enterica enterica serovar Typhi Ty2
uuuccaaaaucca

SEQ ID NO: 3724886 - RNA, 23 nt, Salmonella enterica enterica serovar Typhi Ty2
uuuccaaaauccagggaaaccau

SEQ ID NO: 3724887 - RNA, 21 nt, Salmonella enterica enterica serovar Typhi Ty2
uuuccaaagcgaagcugcugu

SEQ ID NO: 3724888 - RNA, 17 nt, Salmonella enterica enterica serovar Typhi Ty2
uuuccacaaucccggca

SEQ ID NO: 3724889 - RNA, 21 nt, Salmonella enterica enterica serovar Typhi Ty2
uuuccacacaggaguucauca

SEQ ID NO: 3724890 - RNA, 23 nt, Salmonella enterica enterica serovar Typhi Ty2
uuuccagcacgaccuuuucuuca

SEQ ID NO: 3724891 - RNA, 22 nt, Salmonella enterica enterica serovar Typhi Ty2
uuuccagcacgcccauauccag

SEQ ID NO: 3724892 - RNA, 16 nt, Salmonella enterica enterica serovar Typhi Ty2
uuuccagcaucgacca

SEQ ID NO: 3724893 - RNA, 16 nt, Salmonella enterica enterica serovar Typhi Ty2
uuuccaggugcugcca

SEQ ID NO: 3724894 - RNA, 21 nt, Salmonella enterica enterica serovar Typhi Ty2
uuuccagucccugaagaaaag

SEQ ID NO: 3724895 - RNA, 13 nt, Salmonella enterica enterica serovar Typhi Ty2
uuuccagugccag

SEQ ID NO: 3724896 - RNA, 20 nt, Salmonella enterica enterica serovar Typhi Ty2
uuuccaguguuguucucuga

SEQ ID NO: 3724897 - RNA, 20 nt, Salmonella enterica enterica serovar Typhi Ty2
uuuccaguucuggcugcgcu

SEQ ID NO: 3724898 - RNA, 19 nt, Salmonella enterica enterica serovar Typhi Ty2
uuuccaguugcggcaucag

SEQ ID NO: 3724899 - RNA, 20 nt, Salmonella enterica enterica serovar Typhi Ty2
uuuccaguugcggcaucaga

SEQ ID NO: 3724900 - RNA, 22 nt, Salmonella enterica enterica serovar Typhi Ty2
uuuccauacauuuuuguaauaa

SEQ ID NO: 3724901 - RNA, 11 nt, Salmonella enterica enterica serovar Typhi Ty2
uuuccauauuu

SEQ ID NO: 3724902 - RNA, 12 nt, Salmonella enterica enterica serovar Typhi Ty2
uuuccaucgccg

SEQ ID NO: 3724903 - RNA, 15 nt, Salmonella enterica enterica serovar Typhi Ty2
uuuccauucguucug

SEQ ID NO: 3724904 - RNA, 13 nt, Salmonella enterica enterica serovar Typhi Ty2
uuuccauuuuuca

SEQ ID NO: 3724905 - RNA, 15 nt, Salmonella enterica enterica serovar Typhi Ty2
uuucccaagucacgc

SEQ ID NO: 3724906 - RNA, 13 nt, Salmonella enterica enterica serovar Typhi Ty2
uuucccaguggcg

SEQ ID NO: 3724907 - RNA, 15 nt, Salmonella enterica enterica serovar Typhi Ty2
uuuccccgacggccu

SEQ ID NO: 3724908 - RNA, 18 nt, Salmonella enterica enterica serovar Typhi Ty2
uuucccucauauuuguau

SEQ ID NO: 3724909 - RNA, 20 nt, Salmonella enterica enterica serovar Typhi Ty2
uuucccugaugauagcgcca

SEQ ID NO: 3724910 - RNA, 18 nt, Salmonella enterica enterica serovar Typhi Ty2
uuucccuuuuuaaaauga

SEQ ID NO: 3724911 - RNA, 17 nt, Salmonella enterica enterica serovar Typhi Ty2
uuuccgcaucguuauca

SEQ ID NO: 3724912 - RNA, 17 nt, Salmonella enterica enterica serovar Typhi Ty2
uuuccgccaugaaaaaa

SEQ ID NO: 3724913 - RNA, 18 nt, Salmonella enterica enterica serovar Typhi Ty2
uuuccgcgagagaaaaaa

SEQ ID NO: 3724914 - RNA, 18 nt, Salmonella enterica enterica serovar Typhi Ty2
uuuccgcuagggcaucag

SEQ ID NO: 3724915 - RNA, 20 nt, Salmonella enterica enterica serovar Typhi Ty2
uuuccgcuaucuguugcgcc

SEQ ID NO: 3724916 - RNA, 18 nt, Salmonella enterica enterica serovar Typhi Ty2
uuuccgcuuuuccugcca

SEQ ID NO: 3724917 - RNA, 14 nt, Salmonella enterica enterica serovar Typhi Ty2
uuuccggaaugaga

SEQ ID NO: 3724918 - RNA, 19 nt, Salmonella enterica enterica serovar Typhi Ty2
uuuccggcagcgcauaagc

SEQ ID NO: 3724919 - RNA, 21 nt, Salmonella enterica enterica serovar Typhi Ty2
uuuccgggauguuaauuucau

SEQ ID NO: 3724920 - RNA, 23 nt, Salmonella enterica enterica serovar Typhi Ty2
uuuccggucgcgcaaucgguaaa

SEQ ID NO: 3724921 - RNA, 17 nt, Salmonella enterica enterica serovar Typhi Ty2
uuuccguauugcaaugc

SEQ ID NO: 3724922 - RNA, 16 nt, Salmonella enterica enterica serovar Typhi Ty2
uuuccguccaccuggc

SEQ ID NO: 3724923 - RNA, 22 nt, Salmonella enterica enterica serovar Typhi Ty2
uuuccucccauacccagguuug

SEQ ID NO: 3724924 - RNA, 13 nt, Salmonella enterica enterica serovar Typhi Ty2
uuuccugaaaaaa

SEQ ID NO: 3724925 - RNA, 23 nt, Salmonella enterica enterica serovar Typhi Ty2
uuuccugaucaaucaacucuuua

SEQ ID NO: 3724926 - RNA, 19 nt, Salmonella enterica enterica serovar Typhi Ty2
uuuccugaugauauuucuu

SEQ ID NO: 3724927 - RNA, 23 nt, Salmonella enterica enterica serovar Typhi Ty2
uuuccugcauuaacggcaacagu

SEQ ID NO: 3724928 - RNA, 18 nt, Salmonella enterica enterica serovar Typhi Ty2
uuuccugccuucugaaag

SEQ ID NO: 3724929 - RNA, 16 nt, Salmonella enterica enterica serovar Typhi Ty2
uuuccugcugccaucg

SEQ ID NO: 3724930 - RNA, 19 nt, Salmonella enterica enterica serovar Typhi Ty2
uuucgaacgcuagcucaac

SEQ ID NO: 3724931 - RNA, 20 nt, Salmonella enterica enterica serovar Typhi Ty2
uuucgaagccgaccaccauc

SEQ ID NO: 3724932 - RNA, 23 nt, Salmonella enterica enterica serovar Typhi Ty2
uuucgaccgcaggcucuuuuucu

SEQ ID NO: 3724933 - RNA, 22 nt, Salmonella enterica enterica serovar Typhi Ty2
uuucgacgacaacgcccacauc

SEQ ID NO: 3724934 - RNA, 16 nt, Salmonella enterica enterica serovar Typhi Ty2
uuucgaugaaaaagag

SEQ ID NO: 3724935 - RNA, 15 nt, Salmonella enterica enterica serovar Typhi Ty2
uuucgcaaacugauc

SEQ ID NO: 3724936 - RNA, 12 nt, Salmonella enterica enterica serovar Typhi Ty2
uuucgccagcau

SEQ ID NO: 3724937 - RNA, 17 nt, Salmonella enterica enterica serovar Typhi Ty2
uuucgccccacuggccc

SEQ ID NO: 3724938 - RNA, 19 nt, Salmonella enterica enterica serovar Typhi Ty2
uuucgcccggcgccagcuc

SEQ ID NO: 3724939 - RNA, 15 nt, Salmonella enterica enterica serovar Typhi Ty2
uuucgcccucgccac

SEQ ID NO: 3724940 - RNA, 20 nt, Salmonella enterica enterica serovar Typhi Ty2
uuucgccguaaaacaacagc

SEQ ID NO: 3724941 - RNA, 19 nt, Salmonella enterica enterica serovar Typhi Ty2
uuucgcgaauaaucuguuu

SEQ ID NO: 3724942 - RNA, 16 nt, Salmonella enterica enterica serovar Typhi Ty2
uuucgcucgcuuugcc

SEQ ID NO: 3724943 - RNA, 24 nt, Salmonella enterica enterica serovar Typhi Ty2
uuucguaaaauauauauuuucuca

SEQ ID NO: 3724944 - RNA, 17 nt, Salmonella enterica enterica serovar Typhi Ty2
uuucguacauguccaga

SEQ ID NO: 3724945 - RNA, 13 nt, Salmonella enterica enterica serovar Typhi Ty2
uuucuacaaaugu

SEQ ID NO: 3724946 - RNA, 23 nt, Salmonella enterica enterica serovar Typhi Ty2
uuucuacaccuucuucgccaacu

SEQ ID NO: 3724947 - RNA, 16 nt, Salmonella enterica enterica serovar Typhi Ty2
uuucuacuacaacugu

SEQ ID NO: 3724948 - RNA, 19 nt, Salmonella enterica enterica serovar Typhi Ty2
uuucuagggauaacaguau

SEQ ID NO: 3724949 - RNA, 18 nt, Salmonella enterica enterica serovar Typhi Ty2
uuucuaucagguaacaua

SEQ ID NO: 3724950 - RNA, 13 nt, Salmonella enterica enterica serovar Typhi Ty2
uuucuaucccuuc

SEQ ID NO: 3724951 - RNA, 16 nt, Salmonella enterica enterica serovar Typhi Ty2
uuucuaucguuauaua

SEQ ID NO: 3724952 - RNA, 16 nt, Salmonella enterica enterica serovar Typhi Ty2
uuucucaaacacuucu

SEQ ID NO: 3724953 - RNA, 11 nt, Salmonella enterica enterica serovar Typhi Ty2
uuucucagcca

SEQ ID NO: 3724954 - RNA, 14 nt, Salmonella enterica enterica serovar Typhi Ty2
uuucuccguuguug

SEQ ID NO: 3724955 - RNA, 16 nt, Salmonella enterica enterica serovar Typhi Ty2
uuucuccugauuaauc

SEQ ID NO: 3724956 - RNA, 11 nt, Salmonella enterica enterica serovar Typhi Ty2
uuucuccugcg

SEQ ID NO: 3724957 - RNA, 15 nt, Salmonella enterica enterica serovar Typhi Ty2
uuucuccugcggccu

SEQ ID NO: 3724958 - RNA, 14 nt, Salmonella enterica enterica serovar Typhi Ty2
uuucucgccgccau

SEQ ID NO: 3724959 - RNA, 16 nt, Salmonella enterica enterica serovar Typhi Ty2
uuucucguguagccag

SEQ ID NO: 3724960 - RNA, 12 nt, Salmonella enterica enterica serovar Typhi Ty2
uuucucuucuuu

SEQ ID NO: 3724961 - RNA, 14 nt, Salmonella enterica enterica serovar Typhi Ty2
uuucugaauagaaa

SEQ ID NO: 3724962 - RNA, 19 nt, Salmonella enterica enterica serovar Typhi Ty2
uuucugacagugaugaauc

SEQ ID NO: 3724963 - RNA, 18 nt, Salmonella enterica enterica serovar Typhi Ty2
uuucugacguaacuuauc

SEQ ID NO: 3724964 - RNA, 20 nt, Salmonella enterica enterica serovar Typhi Ty2
uuucugauaacgcaggcgau

SEQ ID NO: 3724965 - RNA, 21 nt, Salmonella enterica enterica serovar Typhi Ty2
uuucugauagcccuauucgug

SEQ ID NO: 3724966 - RNA, 20 nt, Salmonella enterica enterica serovar Typhi Ty2
uuucugccagguuccccaau

SEQ ID NO: 3724967 - RNA, 15 nt, Salmonella enterica enterica serovar Typhi Ty2
uuucugcgcgauguu

SEQ ID NO: 3724968 - RNA, 12 nt, Salmonella enterica enterica serovar Typhi Ty2
uuucugcugcca

SEQ ID NO: 3724969 - RNA, 14 nt, Salmonella enterica enterica serovar Typhi Ty2
uuucugcugccagc

SEQ ID NO: 3724970 - RNA, 17 nt, Salmonella enterica enterica serovar Typhi Ty2
uuucuggcaacagccau

SEQ ID NO: 3724971 - RNA, 17 nt, Salmonella enterica enterica serovar Typhi Ty2
uuucuggcgaugugccc

SEQ ID NO: 3724972 - RNA, 17 nt, Salmonella enterica enterica serovar Typhi Ty2
uuucuguaauuugaaau

SEQ ID NO: 3724973 - RNA, 20 nt, Salmonella enterica enterica serovar Typhi Ty2
uuucuguguugcucaaaaaa

SEQ ID NO: 3724974 - RNA, 18 nt, Salmonella enterica enterica serovar Typhi Ty2
uuucuuaauaugcugccu

SEQ ID NO: 3724975 - RNA, 13 nt, Salmonella enterica enterica serovar Typhi Ty2
uuucuuaauuccu

SEQ ID NO: 3724976 - RNA, 17 nt, Salmonella enterica enterica serovar Typhi Ty2
uuucuuauuacaagaaa

SEQ ID NO: 3724977 - RNA, 21 nt, Salmonella enterica enterica serovar Typhi Ty2
uuucuucaagcguuuccagag

SEQ ID NO: 3724978 - RNA, 19 nt, Salmonella enterica enterica serovar Typhi Ty2
uuucuucuggccauuucau

SEQ ID NO: 3724979 - RNA, 11 nt, Salmonella enterica enterica serovar Typhi Ty2
uuucuucuuca

SEQ ID NO: 3724980 - RNA, 21 nt, Salmonella enterica enterica serovar Typhi Ty2
uuucuugccacuggccuccca

SEQ ID NO: 3724981 - RNA, 18 nt, Salmonella enterica enterica serovar Typhi Ty2
uuucuugcucagcgaccg

SEQ ID NO: 3724982 - RNA, 19 nt, Salmonella enterica enterica serovar Typhi Ty2
uuucuuguuccugcacccg

SEQ ID NO: 3724983 - RNA, 17 nt, Salmonella enterica enterica serovar Typhi Ty2
uuucuuucagcucuuca

SEQ ID NO: 3724984 - RNA, 14 nt, Salmonella enterica enterica serovar Typhi Ty2
uuucuuucaucaaa

SEQ ID NO: 3724985 - RNA, 13 nt, Salmonella enterica enterica serovar Typhi Ty2
uuucuuucaucag

SEQ ID NO: 3724986 - RNA, 17 nt, Salmonella enterica enterica serovar Typhi Ty2
uuucuuugcgaaacauc

SEQ ID NO: 3724987 - RNA, 18 nt, Salmonella enterica enterica serovar Typhi Ty2
uuugaacgagucuuacca

SEQ ID NO: 3724988 - RNA, 14 nt, Salmonella enterica enterica serovar Typhi Ty2
uuugaaguguuccu

SEQ ID NO: 3724989 - RNA, 22 nt, Salmonella enterica enterica serovar Typhi Ty2
uuugaccauuaccauuccucac

SEQ ID NO: 3724990 - RNA, 13 nt, Salmonella enterica enterica serovar Typhi Ty2
uuugaccucgccu

SEQ ID NO: 3724991 - RNA, 20 nt, Salmonella enterica enterica serovar Typhi Ty2
uuugacgacaaacuccagcu

SEQ ID NO: 3724992 - RNA, 22 nt, Salmonella enterica enterica serovar Typhi Ty2
uuugacugaaauuacgccauaa

SEQ ID NO: 3724993 - RNA, 22 nt, Salmonella enterica enterica serovar Typhi Ty2
uuugagcaucaaacuuuuaaau

SEQ ID NO: 3724994 - RNA, 12 nt, Salmonella enterica enterica serovar Typhi Ty2
uuugaggaaacc

SEQ ID NO: 3724995 - RNA, 18 nt, Salmonella enterica enterica serovar Typhi Ty2
uuugaggaaaccuuucuu

SEQ ID NO: 3724996 - RNA, 19 nt, Salmonella enterica enterica serovar Typhi Ty2
uuugagguaugucgaauau

SEQ ID NO: 3724997 - RNA, 17 nt, Salmonella enterica enterica serovar Typhi Ty2
uuugagucgcauccagu

SEQ ID NO: 3724998 - RNA, 17 nt, Salmonella enterica enterica serovar Typhi Ty2
uuugauaaacugcgcca

SEQ ID NO: 3724999 - RNA, 22 nt, Salmonella enterica enterica serovar Typhi Ty2
uuugauaaacugcgccauguuc

SEQ ID NO: 3725000 - RNA, 15 nt, Salmonella enterica enterica serovar Typhi Ty2
uuugauaagagaaaa

SEQ ID NO: 3725001 - RNA, 14 nt, Salmonella enterica enterica serovar Typhi Ty2
uuugauacucugcu

SEQ ID NO: 3725002 - RNA, 21 nt, Salmonella enterica enterica serovar Typhi Ty2
uuugauagacguaaugaucag

SEQ ID NO: 3725003 - RNA, 22 nt, Salmonella enterica enterica serovar Typhi Ty2
uuugauagacguaaugaucaga

SEQ ID NO: 3725004 - RNA, 19 nt, Salmonella enterica enterica serovar Typhi Ty2
uuugauccguuucagaaag

SEQ ID NO: 3725005 - RNA, 21 nt, Salmonella enterica enterica serovar Typhi Ty2
uuugauguccggcgcguucau

SEQ ID NO: 3725006 - RNA, 21 nt, Salmonella enterica enterica serovar Typhi Ty2
uuugcaccaucaacgccggug

SEQ ID NO: 3725007 - RNA, 17 nt, Salmonella enterica enterica serovar Typhi Ty2
uuugcaccgcuaaaaaa

SEQ ID NO: 3725008 - RNA, 19 nt, Salmonella enterica enterica serovar Typhi Ty2
uuugcaccgcuaaaaaaca

SEQ ID NO: 3725009 - RNA, 12 nt, Salmonella enterica enterica serovar Typhi Ty2
uuugcagauccu

SEQ ID NO: 3725010 - RNA, 13 nt, Salmonella enterica enterica serovar Typhi Ty2
uuugcauaaauaa

SEQ ID NO: 3725011 - RNA, 18 nt, Salmonella enterica enterica serovar Typhi Ty2
uuugccagacgggccagg

SEQ ID NO: 3725012 - RNA, 14 nt, Salmonella enterica enterica serovar Typhi Ty2
uuugccagcaccag

SEQ ID NO: 3725013 - RNA, 12 nt, Salmonella enterica enterica serovar Typhi Ty2
uuugccauaucu

SEQ ID NO: 3725014 - RNA, 15 nt, Salmonella enterica enterica serovar Typhi Ty2
uuugcccagcgcugg

SEQ ID NO: 3725015 - RNA, 22 nt, Salmonella enterica enterica serovar Typhi Ty2
uuugccccagauacgcacggug

SEQ ID NO: 3725016 - RNA, 21 nt, Salmonella enterica enterica serovar Typhi Ty2
uuugccccauuguucuuucau

SEQ ID NO: 3725017 - RNA, 15 nt, Salmonella enterica enterica serovar Typhi Ty2
uuugccuuucuuauu

SEQ ID NO: 3725018 - RNA, 19 nt, Salmonella enterica enterica serovar Typhi Ty2
uuugccuuuugacagcaca

SEQ ID NO: 3725019 - RNA, 13 nt, Salmonella enterica enterica serovar Typhi Ty2
uuugcgacaucag

SEQ ID NO: 3725020 - RNA, 22 nt, Salmonella enterica enterica serovar Typhi Ty2
uuugcgcccgcucuuauugcuc

SEQ ID NO: 3725021 - RNA, 15 nt, Salmonella enterica enterica serovar Typhi Ty2
uuugcgccuuccagu

SEQ ID NO: 3725022 - RNA, 10 nt, Salmonella enterica enterica serovar Typhi Ty2
uuugcgcgcg

SEQ ID NO: 3725023 - RNA, 11 nt, Salmonella enterica enterica serovar Typhi Ty2
uuugcgcggcu

SEQ ID NO: 3725024 - RNA, 19 nt, Salmonella enterica enterica serovar Typhi Ty2
uuugcgcgguccacaggcc

SEQ ID NO: 3725025 - RNA, 22 nt, Salmonella enterica enterica serovar Typhi Ty2
uuugcggacuagacagccucuc

SEQ ID NO: 3725026 - RNA, 22 nt, Salmonella enterica enterica serovar Typhi Ty2
uuugcggcguccaguacuuucu

SEQ ID NO: 3725027 - RNA, 16 nt, Salmonella enterica enterica serovar Typhi Ty2
uuugcguaaaaaacau

SEQ ID NO: 3725028 - RNA, 18 nt, Salmonella enterica enterica serovar Typhi Ty2
uuugcgucguuaacugca

SEQ ID NO: 3725029 - RNA, 18 nt, Salmonella enterica enterica serovar Typhi Ty2
uuugcgucguuccgucag

SEQ ID NO: 3725030 - RNA, 16 nt, Salmonella enterica enterica serovar Typhi Ty2
uuugcucaauuuuuuu

SEQ ID NO: 3725031 - RNA, 12 nt, Salmonella enterica enterica serovar Typhi Ty2
uuugcuccagaa

SEQ ID NO: 3725032 - RNA, 12 nt, Salmonella enterica enterica serovar Typhi Ty2
uuugcucgccau

SEQ ID NO: 3725033 - RNA, 19 nt, Salmonella enterica enterica serovar Typhi Ty2
uuugcugacaaucugcugg

SEQ ID NO: 3725034 - RNA, 22 nt, Salmonella enterica enterica serovar Typhi Ty2
uuugcugguugucucaaaaaau

SEQ ID NO: 3725035 - RNA, 18 nt, Salmonella enterica enterica serovar Typhi Ty2
uuugcuguuuuauuuccu

SEQ ID NO: 3725036 - RNA, 19 nt, Salmonella enterica enterica serovar Typhi Ty2
uuugcuguuuuauuuccuc

SEQ ID NO: 3725037 - RNA, 17 nt, Salmonella enterica enterica serovar Typhi Ty2
uuugcuguuuuuuguug

SEQ ID NO: 3725038 - RNA, 15 nt, Salmonella enterica enterica serovar Typhi Ty2
uuugcuuauccggcc

SEQ ID NO: 3725039 - RNA, 20 nt, Salmonella enterica enterica serovar Typhi Ty2
uuugcuucaauaaguuagcu

SEQ ID NO: 3725040 - RNA, 21 nt, Salmonella enterica enterica serovar Typhi Ty2
uuugcuucaauaaguuagcuu

SEQ ID NO: 3725041 - RNA, 14 nt, Salmonella enterica enterica serovar Typhi Ty2
uuugcuucucgccu

SEQ ID NO: 3725042 - RNA, 18 nt, Salmonella enterica enterica serovar Typhi Ty2
uuugcuuuaauauucauu

SEQ ID NO: 3725043 - RNA, 15 nt, Salmonella enterica enterica serovar Typhi Ty2
uuugcuuuauuuguu

SEQ ID NO: 3725044 - RNA, 24 nt, Salmonella enterica enterica serovar Typhi Ty2
uuuggcaucaaaguuauuuaccac

SEQ ID NO: 3725045 - RNA, 18 nt, Salmonella enterica enterica serovar Typhi Ty2
uuuggcgaauaaucaacc

SEQ ID NO: 3725046 - RNA, 21 nt, Salmonella enterica enterica serovar Typhi Ty2
uuuggcggcaagaucauccgg

SEQ ID NO: 3725047 - RNA, 17 nt, Salmonella enterica enterica serovar Typhi Ty2
uuuggcgggcuuauccc

SEQ ID NO: 3725048 - RNA, 18 nt, Salmonella enterica enterica serovar Typhi Ty2
uuugggcagauaucggaa

SEQ ID NO: 3725049 - RNA, 20 nt, Salmonella enterica enterica serovar Typhi Ty2
uuuggguaaauaccaggcac

SEQ ID NO: 3725050 - RNA, 20 nt, Salmonella enterica enterica serovar Typhi Ty2
uuuggucggagccaauaauc

SEQ ID NO: 3725051 - RNA, 21 nt, Salmonella enterica enterica serovar Typhi Ty2
uuuggucggcguaacccagug

SEQ ID NO: 3725052 - RNA, 19 nt, Salmonella enterica enterica serovar Typhi Ty2
uuugguuagggaucaucuu

SEQ ID NO: 3725053 - RNA, 19 nt, Salmonella enterica enterica serovar Typhi Ty2
uuuguaaaauacauucucu

SEQ ID NO: 3725054 - RNA, 14 nt, Salmonella enterica enterica serovar Typhi Ty2
uuuguaacauauuu

SEQ ID NO: 3725055 - RNA, 18 nt, Salmonella enterica enterica serovar Typhi Ty2
uuuguaacauauuuuuau

SEQ ID NO: 3725056 - RNA, 15 nt, Salmonella enterica enterica serovar Typhi Ty2
uuuguacagcuugcc

SEQ ID NO: 3725057 - RNA, 22 nt, Salmonella enterica enterica serovar Typhi Ty2
uuuguauugcgcgucacaagcu

SEQ ID NO: 3725058 - RNA, 22 nt, Salmonella enterica enterica serovar Typhi Ty2
uuugucaucagaucaugaggau

SEQ ID NO: 3725059 - RNA, 14 nt, Salmonella enterica enterica serovar Typhi Ty2
uuuguccgcugcug

SEQ ID NO: 3725060 - RNA, 18 nt, Salmonella enterica enterica serovar Typhi Ty2
uuugucgcuguuaaucuc

SEQ ID NO: 3725061 - RNA, 17 nt, Salmonella enterica enterica serovar Typhi Ty2
uuugucgucaugcgcca

SEQ ID NO: 3725062 - RNA, 17 nt, Salmonella enterica enterica serovar Typhi Ty2
uuugucuccucaugccu

SEQ ID NO: 3725063 - RNA, 13 nt, Salmonella enterica enterica serovar Typhi Ty2
uuugugaguucau

SEQ ID NO: 3725064 - RNA, 18 nt, Salmonella enterica enterica serovar Typhi Ty2
uuugugaguucauaaaag

SEQ ID NO: 3725065 - RNA, 13 nt, Salmonella enterica enterica serovar Typhi Ty2
uuugugugcagga

SEQ ID NO: 3725066 - RNA, 22 nt, Salmonella enterica enterica serovar Typhi Ty2
uuuguugaucugguucacagau

SEQ ID NO: 3725067 - RNA, 15 nt, Salmonella enterica enterica serovar Typhi Ty2
uuuguugccuucgau

SEQ ID NO: 3725068 - RNA, 12 nt, Salmonella enterica enterica serovar Typhi Ty2
uuuguuuaaaaa

SEQ ID NO: 3725069 - RNA, 18 nt, Salmonella enterica enterica serovar Typhi Ty2
uuuguuuaucauccugac

SEQ ID NO: 3725070 - RNA, 18 nt, Salmonella enterica enterica serovar Typhi Ty2
uuuguuuuccagauucuc

SEQ ID NO: 3725071 - RNA, 12 nt, Salmonella enterica enterica serovar Typhi Ty2
uuuuaaaaauaa

SEQ ID NO: 3725072 - RNA, 21 nt, Salmonella enterica enterica serovar Typhi Ty2
uuuuaaaauguuuuuguuguu

SEQ ID NO: 3725073 - RNA, 16 nt, Salmonella enterica enterica serovar Typhi Ty2
uuuuaaacgccugauc

SEQ ID NO: 3725074 - RNA, 18 nt, Salmonella enterica enterica serovar Typhi Ty2
uuuuaagcauccaggaag

SEQ ID NO: 3725075 - RNA, 22 nt, Salmonella enterica enterica serovar Typhi Ty2
uuuuaauguccagcagugucug

SEQ ID NO: 3725076 - RNA, 19 nt, Salmonella enterica enterica serovar Typhi Ty2
uuuuaauuuuuaugucauu

SEQ ID NO: 3725077 - RNA, 13 nt, Salmonella enterica enterica serovar Typhi Ty2
uuuuacacugaag

SEQ ID NO: 3725078 - RNA, 18 nt, Salmonella enterica enterica serovar Typhi Ty2
uuuuacaggcacuuacuc

SEQ ID NO: 3725079 - RNA, 20 nt, Salmonella enterica enterica serovar Typhi Ty2
uuuuaccaguacaauuucug

SEQ ID NO: 3725080 - RNA, 19 nt, Salmonella enterica enterica serovar Typhi Ty2
uuuuacugcguaaucuuuu

SEQ ID NO: 3725081 - RNA, 18 nt, Salmonella enterica enterica serovar Typhi Ty2
uuuuacuuaaaauugaau

SEQ ID NO: 3725082 - RNA, 16 nt, Salmonella enterica enterica serovar Typhi Ty2
uuuuacuuuuuuaaau

SEQ ID NO: 3725083 - RNA, 20 nt, Salmonella enterica enterica serovar Typhi Ty2
uuuuagcaauaacucaauag

SEQ ID NO: 3725084 - RNA, 20 nt, Salmonella enterica enterica serovar Typhi Ty2
uuuuagcuuaaaaaauccug

SEQ ID NO: 3725085 - RNA, 13 nt, Salmonella enterica enterica serovar Typhi Ty2
uuuuauaacauaa

SEQ ID NO: 3725086 - RNA, 13 nt, Salmonella enterica enterica serovar Typhi Ty2
uuuuauacauccu

SEQ ID NO: 3725087 - RNA, 20 nt, Salmonella enterica enterica serovar Typhi Ty2
uuuuauauguugaauauuca

SEQ ID NO: 3725088 - RNA, 22 nt, Salmonella enterica enterica serovar Typhi Ty2
uuuuauauguugaauauucaau

SEQ ID NO: 3725089 - RNA, 13 nt, Salmonella enterica enterica serovar Typhi Ty2
uuuuauauuuuua

SEQ ID NO: 3725090 - RNA, 17 nt, Salmonella enterica enterica serovar Typhi Ty2
uuuuaucaggccugccu

SEQ ID NO: 3725091 - RNA, 20 nt, Salmonella enterica enterica serovar Typhi Ty2
uuuuaucgacagauuuugca

SEQ ID NO: 3725092 - RNA, 16 nt, Salmonella enterica enterica serovar Typhi Ty2
uuuuaucgauaauauc

SEQ ID NO: 3725093 - RNA, 16 nt, Salmonella enterica enterica serovar Typhi Ty2
uuuuauggcccgccag

SEQ ID NO: 3725094 - RNA, 17 nt, Salmonella enterica enterica serovar Typhi Ty2
uuuuaugucauuuauuu

SEQ ID NO: 3725095 - RNA, 16 nt, Salmonella enterica enterica serovar Typhi Ty2
uuuuauuauauuuaaa

SEQ ID NO: 3725096 - RNA, 19 nt, Salmonella enterica enterica serovar Typhi Ty2
uuuuauuuguguauuuuuu

SEQ ID NO: 3725097 - RNA, 17 nt, Salmonella enterica enterica serovar Typhi Ty2
uuuuauuuuuauauucc

SEQ ID NO: 3725098 - RNA, 12 nt, Salmonella enterica enterica serovar Typhi Ty2
uuuucaaaaaca

SEQ ID NO: 3725099 - RNA, 21 nt, Salmonella enterica enterica serovar Typhi Ty2
uuuucaaaugaucguuuuuug

SEQ ID NO: 3725100 - RNA, 19 nt, Salmonella enterica enterica serovar Typhi Ty2
uuuucaacggcaucaauaa

SEQ ID NO: 3725101 - RNA, 22 nt, Salmonella enterica enterica serovar Typhi Ty2
uuuucaauaauaaaacgacuca

SEQ ID NO: 3725102 - RNA, 12 nt, Salmonella enterica enterica serovar Typhi Ty2
uuuucaauaauc

SEQ ID NO: 3725103 - RNA, 17 nt, Salmonella enterica enterica serovar Typhi Ty2
uuuucaaugcacgccac

SEQ ID NO: 3725104 - RNA, 13 nt, Salmonella enterica enterica serovar Typhi Ty2
uuuucaccauuaa

SEQ ID NO: 3725105 - RNA, 15 nt, Salmonella enterica enterica serovar Typhi Ty2
uuuucacuaaucccc

SEQ ID NO: 3725106 - RNA, 18 nt, Salmonella enterica enterica serovar Typhi Ty2
uuuucagaggucaggauu

SEQ ID NO: 3725107 - RNA, 21 nt, Salmonella enterica enterica serovar Typhi Ty2
uuuucagauaacgaaccauca

SEQ ID NO: 3725108 - RNA, 16 nt, Salmonella enterica enterica serovar Typhi Ty2
uuuucagcaaauacag

SEQ ID NO: 3725109 - RNA, 23 nt, Salmonella enterica enterica serovar Typhi Ty2
uuuucagccugaagccagcaauc

SEQ ID NO: 3725110 - RNA, 17 nt, Salmonella enterica enterica serovar Typhi Ty2
uuuucagcgucuuucuu

SEQ ID NO: 3725111 - RNA, 12 nt, Salmonella enterica enterica serovar Typhi Ty2
uuuucaugaauc

SEQ ID NO: 3725112 - RNA, 14 nt, Salmonella enterica enterica serovar Typhi Ty2
uuuuccacaauacc

SEQ ID NO: 3725113 - RNA, 22 nt, Salmonella enterica enterica serovar Typhi Ty2
uuuuccacgcgcgcgccgauaa

SEQ ID NO: 3725114 - RNA, 11 nt, Salmonella enterica enterica serovar Typhi Ty2
uuuuccagcac

SEQ ID NO: 3725115 - RNA, 18 nt, Salmonella enterica enterica serovar Typhi Ty2
uuuuccagcguaauccgc

SEQ ID NO: 3725116 - RNA, 12 nt, Salmonella enterica enterica serovar Typhi Ty2
uuuuccagcuca

SEQ ID NO: 3725117 - RNA, 22 nt, Salmonella enterica enterica serovar Typhi Ty2
uuuuccauucacacaauuuucu

SEQ ID NO: 3725118 - RNA, 14 nt, Salmonella enterica enterica serovar Typhi Ty2
uuuucccaacugua

SEQ ID NO: 3725119 - RNA, 16 nt, Salmonella enterica enterica serovar Typhi Ty2
uuuuccugcggcuuga

SEQ ID NO: 3725120 - RNA, 19 nt, Salmonella enterica enterica serovar Typhi Ty2
uuuuccugcugccaucgcu

SEQ ID NO: 3725121 - RNA, 13 nt, Salmonella enterica enterica serovar Typhi Ty2
uuuucgaaaauuu

SEQ ID NO: 3725122 - RNA, 15 nt, Salmonella enterica enterica serovar Typhi Ty2
uuuucgaaaauuucg

SEQ ID NO: 3725123 - RNA, 22 nt, Salmonella enterica enterica serovar Typhi Ty2
uuuucgcagagucgcagcggcg

SEQ ID NO: 3725124 - RNA, 17 nt, Salmonella enterica enterica serovar Typhi Ty2
uuuucgccaguuuugca

SEQ ID NO: 3725125 - RNA, 20 nt, Salmonella enterica enterica serovar Typhi Ty2
uuuucgcccccagcacgaca

SEQ ID NO: 3725126 - RNA, 14 nt, Salmonella enterica enterica serovar Typhi Ty2
uuuucguuccagag

SEQ ID NO: 3725127 - RNA, 15 nt, Salmonella enterica enterica serovar Typhi Ty2
uuuucucaauacgau

SEQ ID NO: 3725128 - RNA, 18 nt, Salmonella enterica enterica serovar Typhi Ty2
uuuucugcgccaccagcg

SEQ ID NO: 3725129 - RNA, 13 nt, Salmonella enterica enterica serovar Typhi Ty2
uuuucugcuuucu

SEQ ID NO: 3725130 - RNA, 14 nt, Salmonella enterica enterica serovar Typhi Ty2
uuuucugcuuucuu

SEQ ID NO: 3725131 - RNA, 17 nt, Salmonella enterica enterica serovar Typhi Ty2
uuuucuguaauucuccc

SEQ ID NO: 3725132 - RNA, 11 nt, Salmonella enterica enterica serovar Typhi Ty2
uuuucuucaug

SEQ ID NO: 3725133 - RNA, 17 nt, Salmonella enterica enterica serovar Typhi Ty2
uuuugaaaucacgccac

SEQ ID NO: 3725134 - RNA, 17 nt, Salmonella enterica enterica serovar Typhi Ty2
uuuugaacauaugaagg

SEQ ID NO: 3725135 - RNA, 12 nt, Salmonella enterica enterica serovar Typhi Ty2
uuuugaauuuuu

SEQ ID NO: 3725136 - RNA, 19 nt, Salmonella enterica enterica serovar Typhi Ty2
uuuugaguuugucauccag

SEQ ID NO: 3725137 - RNA, 17 nt, Salmonella enterica enterica serovar Typhi Ty2
uuuugauaaaucagcac

SEQ ID NO: 3725138 - RNA, 20 nt, Salmonella enterica enterica serovar Typhi Ty2
uuuugauacucaucauaauc

SEQ ID NO: 3725139 - RNA, 12 nt, Salmonella enterica enterica serovar Typhi Ty2
uuuugaugaccg

SEQ ID NO: 3725140 - RNA, 22 nt, Salmonella enterica enterica serovar Typhi Ty2
uuuugcacggcaucuuuguucu

SEQ ID NO: 3725141 - RNA, 16 nt, Salmonella enterica enterica serovar Typhi Ty2
uuuugcagaauugaua

SEQ ID NO: 3725142 - RNA, 22 nt, Salmonella enterica enterica serovar Typhi Ty2
uuuugcagcaacugauucaaaa

SEQ ID NO: 3725143 - RNA, 17 nt, Salmonella enterica enterica serovar Typhi Ty2
uuuugcccgcucgcuua

SEQ ID NO: 3725144 - RNA, 20 nt, Salmonella enterica enterica serovar Typhi Ty2
uuuugccgcugucgccagaa

SEQ ID NO: 3725145 - RNA, 24 nt, Salmonella enterica enterica serovar Typhi Ty2
uuuugccggauggcacugcgcuua

SEQ ID NO: 3725146 - RNA, 19 nt, Salmonella enterica enterica serovar Typhi Ty2
uuuugccugcggauuugcu

SEQ ID NO: 3725147 - RNA, 21 nt, Salmonella enterica enterica serovar Typhi Ty2
uuuugcuacgucgccuggcau

SEQ ID NO: 3725148 - RNA, 11 nt, Salmonella enterica enterica serovar Typhi Ty2
uuuugcucagu

SEQ ID NO: 3725149 - RNA, 16 nt, Salmonella enterica enterica serovar Typhi Ty2
uuuuggggaaaauacc

SEQ ID NO: 3725150 - RNA, 15 nt, Salmonella enterica enterica serovar Typhi Ty2
uuuuggucagcucac

SEQ ID NO: 3725151 - RNA, 13 nt, Salmonella enterica enterica serovar Typhi Ty2
uuuugucaucaga

SEQ ID NO: 3725152 - RNA, 19 nt, Salmonella enterica enterica serovar Typhi Ty2
uuuugucaucgucagcaac

SEQ ID NO: 3725153 - RNA, 11 nt, Salmonella enterica enterica serovar Typhi Ty2
uuuugucaugg

SEQ ID NO: 3725154 - RNA, 17 nt, Salmonella enterica enterica serovar Typhi Ty2
uuuugucaugguaaaug

SEQ ID NO: 3725155 - RNA, 17 nt, Salmonella enterica enterica serovar Typhi Ty2
uuuugucggaauuuccg

SEQ ID NO: 3725156 - RNA, 15 nt, Salmonella enterica enterica serovar Typhi Ty2
uuuuguugauuuuau

SEQ ID NO: 3725157 - RNA, 17 nt, Salmonella enterica enterica serovar Typhi Ty2
uuuuguugugauacgcg

SEQ ID NO: 3725158 - RNA, 19 nt, Salmonella enterica enterica serovar Typhi Ty2
uuuuguuguuaauuugauu

SEQ ID NO: 3725159 - RNA, 19 nt, Salmonella enterica enterica serovar Typhi Ty2
uuuuuaaauaacuuuuaau

SEQ ID NO: 3725160 - RNA, 19 nt, Salmonella enterica enterica serovar Typhi Ty2
uuuuuaaauguuuuuucau

SEQ ID NO: 3725161 - RNA, 12 nt, Salmonella enterica enterica serovar Typhi Ty2
uuuuuaauaaua

SEQ ID NO: 3725162 - RNA, 13 nt, Salmonella enterica enterica serovar Typhi Ty2
uuuuuaauauaag

SEQ ID NO: 3725163 - RNA, 15 nt, Salmonella enterica enterica serovar Typhi Ty2
uuuuuacaaauuuaa

SEQ ID NO: 3725164 - RNA, 23 nt, Salmonella enterica enterica serovar Typhi Ty2
uuuuuaccgcauuauaaauauca

SEQ ID NO: 3725165 - RNA, 17 nt, Salmonella enterica enterica serovar Typhi Ty2
uuuuuagcgugccgacg

SEQ ID NO: 3725166 - RNA, 12 nt, Salmonella enterica enterica serovar Typhi Ty2
uuuuuauaacau

SEQ ID NO: 3725167 - RNA, 13 nt, Salmonella enterica enterica serovar Typhi Ty2
uuuuuauauaagc

SEQ ID NO: 3725168 - RNA, 21 nt, Salmonella enterica enterica serovar Typhi Ty2
uuuuuauauuccgcaggcaag

SEQ ID NO: 3725169 - RNA, 16 nt, Salmonella enterica enterica serovar Typhi Ty2
uuuuuauauucgcuca

SEQ ID NO: 3725170 - RNA, 18 nt, Salmonella enterica enterica serovar Typhi Ty2
uuuuuaugcacgcuauaa

SEQ ID NO: 3725171 - RNA, 19 nt, Salmonella enterica enterica serovar Typhi Ty2
uuuuuaugugacaaucacu

SEQ ID NO: 3725172 - RNA, 15 nt, Salmonella enterica enterica serovar Typhi Ty2
uuuuuauuuguuccu

SEQ ID NO: 3725173 - RNA, 15 nt, Salmonella enterica enterica serovar Typhi Ty2
uuuuucaauuuccag

SEQ ID NO: 3725174 - RNA, 13 nt, Salmonella enterica enterica serovar Typhi Ty2
uuuuucaccauaa

SEQ ID NO: 3725175 - RNA, 17 nt, Salmonella enterica enterica serovar Typhi Ty2
uuuuucagaauaucgcc

SEQ ID NO: 3725176 - RNA, 13 nt, Salmonella enterica enterica serovar Typhi Ty2
uuuuucagcaaau

SEQ ID NO: 3725177 - RNA, 15 nt, Salmonella enterica enterica serovar Typhi Ty2
uuuuucagcaaauac

SEQ ID NO: 3725178 - RNA, 22 nt, Salmonella enterica enterica serovar Typhi Ty2
uuuuucagcucgcaggccauaa

SEQ ID NO: 3725179 - RNA, 13 nt, Salmonella enterica enterica serovar Typhi Ty2
uuuuucauaucca

SEQ ID NO: 3725180 - RNA, 15 nt, Salmonella enterica enterica serovar Typhi Ty2
uuuuucaugcaauaa

SEQ ID NO: 3725181 - RNA, 21 nt, Salmonella enterica enterica serovar Typhi Ty2
uuuuuccagcacggcauaagc

SEQ ID NO: 3725182 - RNA, 11 nt, Salmonella enterica enterica serovar Typhi Ty2
uuuuuccagcg

SEQ ID NO: 3725183 - RNA, 12 nt, Salmonella enterica enterica serovar Typhi Ty2
uuuuuccagcuc

SEQ ID NO: 3725184 - RNA, 14 nt, Salmonella enterica enterica serovar Typhi Ty2
uuuuuccagcucag

SEQ ID NO: 3725185 - RNA, 21 nt, Salmonella enterica enterica serovar Typhi Ty2
uuuuuccagcucagaaauaaa

SEQ ID NO: 3725186 - RNA, 22 nt, Salmonella enterica enterica serovar Typhi Ty2
uuuuuccccguugcucauguua

SEQ ID NO: 3725187 - RNA, 20 nt, Salmonella enterica enterica serovar Typhi Ty2
uuuuucccgauaacguaaau

SEQ ID NO: 3725188 - RNA, 23 nt, Salmonella enterica enterica serovar Typhi Ty2
uuuuuccgccaccuguuucgcca

SEQ ID NO: 3725189 - RNA, 16 nt, Salmonella enterica enterica serovar Typhi Ty2
uuuuucgcgugccauu

SEQ ID NO: 3725190 - RNA, 20 nt, Salmonella enterica enterica serovar Typhi Ty2
uuuuucggcuggcagcggcu

SEQ ID NO: 3725191 - RNA, 21 nt, Salmonella enterica enterica serovar Typhi Ty2
uuuuucucgauaucuuccccg

SEQ ID NO: 3725192 - RNA, 22 nt, Salmonella enterica enterica serovar Typhi Ty2
uuuuucucuguccggaauaacu

SEQ ID NO: 3725193 - RNA, 12 nt, Salmonella enterica enterica serovar Typhi Ty2
uuuuucuucagu

SEQ ID NO: 3725194 - RNA, 16 nt, Salmonella enterica enterica serovar Typhi Ty2
uuuuugacuaaaguuu

SEQ ID NO: 3725195 - RNA, 18 nt, Salmonella enterica enterica serovar Typhi Ty2
uuuuugccacauuucccg

SEQ ID NO: 3725196 - RNA, 13 nt, Salmonella enterica enterica serovar Typhi Ty2
uuuuuguauuccu

SEQ ID NO: 3725197 - RNA, 19 nt, Salmonella enterica enterica serovar Typhi Ty2
uuuuuuacuuucaaaauac

SEQ ID NO: 3725198 - RNA, 16 nt, Salmonella enterica enterica serovar Typhi Ty2
uuuuuuauaacauaaa

SEQ ID NO: 3725199 - RNA, 24 nt, Salmonella enterica enterica serovar Typhi Ty2
uuuuuuaugaccguauuacaagua

SEQ ID NO: 3725200 - RNA, 12 nt, Salmonella enterica enterica serovar Typhi Ty2
uuuuuucagccu

SEQ ID NO: 3725201 - RNA, 13 nt, Salmonella enterica enterica serovar Typhi Ty2
uuuuuucaucucc

SEQ ID NO: 3725202 - RNA, 16 nt, Salmonella enterica enterica serovar Typhi Ty2
acgccaguucccacag

SEQ ID NO: 3725203 - RNA, 19 nt, Salmonella enterica enterica serovar Typhi Ty2
acgccauagcaucgacccu

SEQ ID NO: 3725204 - RNA, 14 nt, Salmonella enterica enterica serovar Typhi Ty2
acgccaucaacagc

SEQ ID NO: 3725205 - RNA, 14 nt, Salmonella enterica enterica serovar Typhi Ty2
acgccaucgacaaa

SEQ ID NO: 3725206 - RNA, 20 nt, Salmonella enterica enterica serovar Typhi Ty2
acgccaucugugccagccca

SEQ ID NO: 3725207 - RNA, 14 nt, Salmonella enterica enterica serovar Typhi Ty2
acgccaucuuccuc

SEQ ID NO: 3725208 - RNA, 16 nt, Salmonella enterica enterica serovar Typhi Ty2
acgccaucuuucuuuu

SEQ ID NO: 3725209 - RNA, 18 nt, Salmonella enterica enterica serovar Typhi Ty2
acgccaucuuucuuuucg

SEQ ID NO: 3725210 - RNA, 21 nt, Salmonella enterica enterica serovar Typhi Ty2
acgccaugacgccaagcugca

SEQ ID NO: 3725211 - RNA, 15 nt, Salmonella enterica enterica serovar Typhi Ty2
acgccaugcaaaaaa

SEQ ID NO: 3725212 - RNA, 23 nt, Salmonella enterica enterica serovar Typhi Ty2
acgccaugcucauccaacugcgc

SEQ ID NO: 3725213 - RNA, 21 nt, Salmonella enterica enterica serovar Typhi Ty2
acgccauugcgaacaucacga

SEQ ID NO: 3725214 - RNA, 21 nt, Salmonella enterica enterica serovar Typhi Ty2
acgcccacgcggcgugcgcug

SEQ ID NO: 3725215 - RNA, 22 nt, Salmonella enterica enterica serovar Typhi Ty2
acgcccacgcggcgugcgcugc

SEQ ID NO: 3725216 - RNA, 14 nt, Salmonella enterica enterica serovar Typhi Ty2
acgcccagccguga

SEQ ID NO: 3725217 - RNA, 22 nt, Salmonella enterica enterica serovar Typhi Ty2
acgcccagcgccgagaaaauca

SEQ ID NO: 3725218 - RNA, 17 nt, Salmonella enterica enterica serovar Typhi Ty2
acgcccagcuauuuuuc

SEQ ID NO: 3725219 - RNA, 21 nt, Salmonella enterica enterica serovar Typhi Ty2
acgcccaucagcaucccaccg

SEQ ID NO: 3725220 - RNA, 17 nt, Salmonella enterica enterica serovar Typhi Ty2
acgcccaugcaaccagu

SEQ ID NO: 3725221 - RNA, 16 nt, Salmonella enterica enterica serovar Typhi Ty2
acgcccauuaugccgc

SEQ ID NO: 3725222 - RNA, 18 nt, Salmonella enterica enterica serovar Typhi Ty2
acgccccaauaccacaac

SEQ ID NO: 3725223 - RNA, 16 nt, Salmonella enterica enterica serovar Typhi Ty2
acgcccccugccagcg

SEQ ID NO: 3725224 - RNA, 20 nt, Salmonella enterica enterica serovar Typhi Ty2
acgcccgaccacgcccagcu

SEQ ID NO: 3725225 - RNA, 15 nt, Salmonella enterica enterica serovar Typhi Ty2
acgcccgcauucaua

SEQ ID NO: 3725226 - RNA, 13 nt, Salmonella enterica enterica serovar Typhi Ty2
acgcccgcccgcc

SEQ ID NO: 3725227 - RNA, 17 nt, Salmonella enterica enterica serovar Typhi Ty2
acgcccgccgccagcau

SEQ ID NO: 3725228 - RNA, 18 nt, Salmonella enterica enterica serovar Typhi Ty2
acgcccgccguaacgcgc

SEQ ID NO: 3725229 - RNA, 22 nt, Salmonella enterica enterica serovar Typhi Ty2
acgcccgccguaacgcgcaucu

SEQ ID NO: 3725230 - RNA, 16 nt, Salmonella enterica enterica serovar Typhi Ty2
acgcccucaauaucuu

SEQ ID NO: 3725231 - RNA, 17 nt, Salmonella enterica enterica serovar Typhi Ty2
acgcccucaauaucuuu

SEQ ID NO: 3725232 - RNA, 16 nt, Salmonella enterica enterica serovar Typhi Ty2
acgcccugcaaagcaa

SEQ ID NO: 3725233 - RNA, 14 nt, Salmonella enterica enterica serovar Typhi Ty2
acgcccugccauuc

SEQ ID NO: 3725234 - RNA, 18 nt, Salmonella enterica enterica serovar Typhi Ty2
acgcccugcucccacagc

SEQ ID NO: 3725235 - RNA, 16 nt, Salmonella enterica enterica serovar Typhi Ty2
acgcccuucaauauca

SEQ ID NO: 3725236 - RNA, 23 nt, Salmonella enterica enterica serovar Typhi Ty2
acgcccuucacgccgaagugcgc

SEQ ID NO: 3725237 - RNA, 18 nt, Salmonella enterica enterica serovar Typhi Ty2
acgccgacgaccggcagc

SEQ ID NO: 3725238 - RNA, 17 nt, Salmonella enterica enterica serovar Typhi Ty2
acgccgacgcauccgcc

SEQ ID NO: 3725239 - RNA, 15 nt, Salmonella enterica enterica serovar Typhi Ty2
acgccgauuaaugcu

SEQ ID NO: 3725240 - RNA, 16 nt, Salmonella enterica enterica serovar Typhi Ty2
acgccgauuaaugcuc

SEQ ID NO: 3725241 - RNA, 19 nt, Salmonella enterica enterica serovar Typhi Ty2
acgccgcacacagcagaaa

SEQ ID NO: 3725242 - RNA, 18 nt, Salmonella enterica enterica serovar Typhi Ty2
acgccgccauccgacaac

SEQ ID NO: 3725243 - RNA, 17 nt, Salmonella enterica enterica serovar Typhi Ty2
acgccgccauccggcaa

SEQ ID NO: 3725244 - RNA, 17 nt, Salmonella enterica enterica serovar Typhi Ty2
acgccgccauccggcac

SEQ ID NO: 3725245 - RNA, 21 nt, Salmonella enterica enterica serovar Typhi Ty2
acgccgcccgccugagcgcgc

SEQ ID NO: 3725246 - RNA, 16 nt, Salmonella enterica enterica serovar Typhi Ty2
acgccgccgcaggcca

SEQ ID NO: 3725247 - RNA, 23 nt, Salmonella enterica enterica serovar Typhi Ty2
acgccgccgcguccuaccgccgc

SEQ ID NO: 3725248 - RNA, 20 nt, Salmonella enterica enterica serovar Typhi Ty2
acgccgcgcgugguauuaca

SEQ ID NO: 3725249 - RNA, 18 nt, Salmonella enterica enterica serovar Typhi Ty2
acgccgcgcugcggcguc

SEQ ID NO: 3725250 - RNA, 19 nt, Salmonella enterica enterica serovar Typhi Ty2
acgccgcuaucgaccagca

SEQ ID NO: 3725251 - RNA, 22 nt, Salmonella enterica enterica serovar Typhi Ty2
acgccgcuaucgaccagcaccu

SEQ ID NO: 3725252 - RNA, 22 nt, Salmonella enterica enterica serovar Typhi Ty2
acgccgcuggcggaaauaaaca

SEQ ID NO: 3725253 - RNA, 13 nt, Salmonella enterica enterica serovar Typhi Ty2
acgccggaaauca

SEQ ID NO: 3725254 - RNA, 17 nt, Salmonella enterica enterica serovar Typhi Ty2
acgccggagaccggcga

SEQ ID NO: 3725255 - RNA, 17 nt, Salmonella enterica enterica serovar Typhi Ty2
acgccggaugcgagaau

SEQ ID NO: 3725256 - RNA, 19 nt, Salmonella enterica enterica serovar Typhi Ty2
acgccggcaacacccgccg

SEQ ID NO: 3725257 - RNA, 18 nt, Salmonella enterica enterica serovar Typhi Ty2
acgccgggaaauuuuucg

SEQ ID NO: 3725258 - RNA, 22 nt, Salmonella enterica enterica serovar Typhi Ty2
acgccggggauaucaaugcgcg

SEQ ID NO: 3725259 - RNA, 15 nt, Salmonella enterica enterica serovar Typhi Ty2
acggcuggcaaugcg

SEQ ID NO: 3725260 - RNA, 18 nt, Salmonella enterica enterica serovar Typhi Ty2
acggcuggcaaugcgcug

SEQ ID NO: 3725261 - RNA, 16 nt, Salmonella enterica enterica serovar Typhi Ty2
acggcuuuccagcagc

SEQ ID NO: 3725262 - RNA, 20 nt, Salmonella enterica enterica serovar Typhi Ty2
acggcuuuccagcagccaga

SEQ ID NO: 3725263 - RNA, 14 nt, Salmonella enterica enterica serovar Typhi Ty2
acgggaaaucuccc

SEQ ID NO: 3725264 - RNA, 16 nt, Salmonella enterica enterica serovar Typhi Ty2
acgggaaggaaauuca

SEQ ID NO: 3725265 - RNA, 20 nt, Salmonella enterica enterica serovar Typhi Ty2
acgggagagcguauccagca

SEQ ID NO: 3725266 - RNA, 12 nt, Salmonella enterica enterica serovar Typhi Ty2
acgggaucgcag

SEQ ID NO: 3725267 - RNA, 12 nt, Salmonella enterica enterica serovar Typhi Ty2
acgggcaaacgc

SEQ ID NO: 3725268 - RNA, 19 nt, Salmonella enterica enterica serovar Typhi Ty2
acgggcacggucugcugac

SEQ ID NO: 3725269 - RNA, 22 nt, Salmonella enterica enterica serovar Typhi Ty2
acgggcauuguuaauccagagc

SEQ ID NO: 3725270 - RNA, 17 nt, Salmonella enterica enterica serovar Typhi Ty2
acgggccgccgcagcag

SEQ ID NO: 3725271 - RNA, 20 nt, Salmonella enterica enterica serovar Typhi Ty2
acgggcgcugucgccgcgca

SEQ ID NO: 3725272 - RNA, 22 nt, Salmonella enterica enterica serovar Typhi Ty2
acgggcggcgacagagaaugcg

SEQ ID NO: 3725273 - RNA, 11 nt, Salmonella enterica enterica serovar Typhi Ty2
acggggaacag

SEQ ID NO: 3725274 - RNA, 13 nt, Salmonella enterica enterica serovar Typhi Ty2
acggggcgcagaa

SEQ ID NO: 3725275 - RNA, 15 nt, Salmonella enterica enterica serovar Typhi Ty2
acggguuaauggcag

SEQ ID NO: 3725276 - RNA, 15 nt, Salmonella enterica enterica serovar Typhi Ty2
acgguaaaacacgcc

SEQ ID NO: 3725277 - RNA, 19 nt, Salmonella enterica enterica serovar Typhi Ty2
acgguaaacgugccacagu

SEQ ID NO: 3725278 - RNA, 23 nt, Salmonella enterica enterica serovar Typhi Ty2
acgguaacgauacccaccagcgu

SEQ ID NO: 3725279 - RNA, 21 nt, Salmonella enterica enterica serovar Typhi Ty2
acgguaagcguucgcauacgc

SEQ ID NO: 3725280 - RNA, 14 nt, Salmonella enterica enterica serovar Typhi Ty2
acgguaccugaagc

SEQ ID NO: 3725281 - RNA, 19 nt, Salmonella enterica enterica serovar Typhi Ty2
acgguacuauuaccgcauc

SEQ ID NO: 3725282 - RNA, 21 nt, Salmonella enterica enterica serovar Typhi Ty2
acgguacuauuaccgcaucga

SEQ ID NO: 3725283 - RNA, 13 nt, Salmonella enterica enterica serovar Typhi Ty2
acgguaugaaaca

SEQ ID NO: 3725284 - RNA, 21 nt, Salmonella enterica enterica serovar Typhi Ty2
acgguaugaaacauauauauc

SEQ ID NO: 3725285 - RNA, 12 nt, Salmonella enterica enterica serovar Typhi Ty2
acgguauuucca

SEQ ID NO: 3725286 - RNA, 20 nt, Salmonella enterica enterica serovar Typhi Ty2
acggucauaucgucaucggu

SEQ ID NO: 3725287 - RNA, 18 nt, Salmonella enterica enterica serovar Typhi Ty2
acgguccugauccggaau

SEQ ID NO: 3725288 - RNA, 17 nt, Salmonella enterica enterica serovar Typhi Ty2
acgguccuggccaggcu

SEQ ID NO: 3725289 - RNA, 23 nt, Salmonella enterica enterica serovar Typhi Ty2
acggucggcguaauguugcugca

SEQ ID NO: 3725290 - RNA, 18 nt, Salmonella enterica enterica serovar Typhi Ty2
acggugagcugaaagccg

SEQ ID NO: 3725291 - RNA, 16 nt, Salmonella enterica enterica serovar Typhi Ty2
acggugcuaauaccgg

SEQ ID NO: 3725292 - RNA, 16 nt, Salmonella enterica enterica serovar Typhi Ty2
acggugugccgccauc

SEQ ID NO: 3725293 - RNA, 17 nt, Salmonella enterica enterica serovar Typhi Ty2
acggugugccgccauca

SEQ ID NO: 3725294 - RNA, 20 nt, Salmonella enterica enterica serovar Typhi Ty2
acggugugccgccaucagcg

SEQ ID NO: 3725295 - RNA, 15 nt, Salmonella enterica enterica serovar Typhi Ty2
acgguguggcccagc

SEQ ID NO: 3725296 - RNA, 22 nt, Salmonella enterica enterica serovar Typhi Ty2
acgguguuuagacacauugaug

SEQ ID NO: 3725297 - RNA, 22 nt, Salmonella enterica enterica serovar Typhi Ty2
acgguuaaaaacagccagcagc

SEQ ID NO: 3725298 - RNA, 17 nt, Salmonella enterica enterica serovar Typhi Ty2
acgguuaagccgguaau

SEQ ID NO: 3725299 - RNA, 21 nt, Salmonella enterica enterica serovar Typhi Ty2
acgguuauuuuucagaucggu

SEQ ID NO: 3725300 - RNA, 22 nt, Salmonella enterica enterica serovar Typhi Ty2
acgguucauccagcagcagcac

SEQ ID NO: 3725301 - RNA, 13 nt, Salmonella enterica enterica serovar Typhi Ty2
acgguuucaacuu

SEQ ID NO: 3725302 - RNA, 18 nt, Salmonella enterica enterica serovar Typhi Ty2
acgguuucgaccagcagc

SEQ ID NO: 3725303 - RNA, 15 nt, Salmonella enterica enterica serovar Typhi Ty2
acguaaagacgacgu

SEQ ID NO: 3725304 - RNA, 22 nt, Salmonella enterica enterica serovar Typhi Ty2
acguaaagcuggccuucagguu

SEQ ID NO: 3725305 - RNA, 15 nt, Salmonella enterica enterica serovar Typhi Ty2
acguaaauauauaca

SEQ ID NO: 3725306 - RNA, 17 nt, Salmonella enterica enterica serovar Typhi Ty2
acguaaauuacuuauga

SEQ ID NO: 3725307 - RNA, 20 nt, Salmonella enterica enterica serovar Typhi Ty2
acguaaauuacuuaugauau

SEQ ID NO: 3725308 - RNA, 14 nt, Salmonella enterica enterica serovar Typhi Ty2
acguaacagacgca

SEQ ID NO: 3725309 - RNA, 16 nt, Salmonella enterica enterica serovar Typhi Ty2
acguaacaugaccugc

SEQ ID NO: 3725310 - RNA, 20 nt, Salmonella enterica enterica serovar Typhi Ty2
acguaacggaaaagcauugc

SEQ ID NO: 3725311 - RNA, 19 nt, Salmonella enterica enterica serovar Typhi Ty2
acguaacugacaauuucca

SEQ ID NO: 3725312 - RNA, 20 nt, Salmonella enterica enterica serovar Typhi Ty2
acguaacugcgguaaauaau

SEQ ID NO: 3725313 - RNA, 12 nt, Salmonella enterica enterica serovar Typhi Ty2
acguaauaccug

SEQ ID NO: 3725314 - RNA, 13 nt, Salmonella enterica enterica serovar Typhi Ty2
acguaauaccuga

SEQ ID NO: 3725315 - RNA, 13 nt, Salmonella enterica enterica serovar Typhi Ty2
acguaaugugaaa

SEQ ID NO: 3725316 - RNA, 23 nt, Salmonella enterica enterica serovar Typhi Ty2
acguaccguuggaauaaaucaca

SEQ ID NO: 3725317 - RNA, 14 nt, Salmonella enterica enterica serovar Typhi Ty2
acguagauucugau

SEQ ID NO: 3725318 - RNA, 22 nt, Salmonella enterica enterica serovar Typhi Ty2
acguagcaaagcguacaugaau

SEQ ID NO: 3725319 - RNA, 16 nt, Salmonella enterica enterica serovar Typhi Ty2
acguagcccauuguca

SEQ ID NO: 3725320 - RNA, 12 nt, Salmonella enterica enterica serovar Typhi Ty2
acguagcgcauu

SEQ ID NO: 3725321 - RNA, 14 nt, Salmonella enterica enterica serovar Typhi Ty2
acguagcgcauugc

SEQ ID NO: 3725322 - RNA, 19 nt, Salmonella enterica enterica serovar Typhi Ty2
acguagcuuauaaaucagc

SEQ ID NO: 3725323 - RNA, 16 nt, Salmonella enterica enterica serovar Typhi Ty2
acguaggccugauaag

SEQ ID NO: 3725324 - RNA, 15 nt, Salmonella enterica enterica serovar Typhi Ty2
acguaguccggcaau

SEQ ID NO: 3725325 - RNA, 21 nt, Salmonella enterica enterica serovar Typhi Ty2
acgucaaaccccucccggguc

SEQ ID NO: 3725326 - RNA, 15 nt, Salmonella enterica enterica serovar Typhi Ty2
acgucaaagcuaacg

SEQ ID NO: 3725327 - RNA, 19 nt, Salmonella enterica enterica serovar Typhi Ty2
acgucagacgaggguaaua

SEQ ID NO: 3725328 - RNA, 19 nt, Salmonella enterica enterica serovar Typhi Ty2
acgucagccgggauaauca

SEQ ID NO: 3725329 - RNA, 21 nt, Salmonella enterica enterica serovar Typhi Ty2
acgucaguacguaaccgcaaa

SEQ ID NO: 3725330 - RNA, 10 nt, Salmonella enterica enterica serovar Typhi Ty2
acgucaugcc

SEQ ID NO: 3725331 - RNA, 23 nt, Salmonella enterica enterica serovar Typhi Ty2
acgucaugccuuuuuuaccaauu

SEQ ID NO: 3725332 - RNA, 16 nt, Salmonella enterica enterica serovar Typhi Ty2
acgucauuuuuucaau

SEQ ID NO: 3725333 - RNA, 19 nt, Salmonella enterica enterica serovar Typhi Ty2
acguccauccgccgggaca

SEQ ID NO: 3725334 - RNA, 15 nt, Salmonella enterica enterica serovar Typhi Ty2
acguccauccgggua

SEQ ID NO: 3725335 - RNA, 19 nt, Salmonella enterica enterica serovar Typhi Ty2
acguccauccggguaauuu

SEQ ID NO: 3725336 - RNA, 15 nt, Salmonella enterica enterica serovar Typhi Ty2
acgucccaugacgac

SEQ ID NO: 3725337 - RNA, 20 nt, Salmonella enterica enterica serovar Typhi Ty2
acgucccgucagggcgaggc

SEQ ID NO: 3725338 - RNA, 16 nt, Salmonella enterica enterica serovar Typhi Ty2
acgucccugccacagu

SEQ ID NO: 3725339 - RNA, 18 nt, Salmonella enterica enterica serovar Typhi Ty2
acguccucuucuacacga

SEQ ID NO: 3725340 - RNA, 17 nt, Salmonella enterica enterica serovar Typhi Ty2
acguccugguuaccgcg

SEQ ID NO: 3725341 - RNA, 21 nt, Salmonella enterica enterica serovar Typhi Ty2
acuacgguugccuuucgccag

SEQ ID NO: 3725342 - RNA, 14 nt, Salmonella enterica enterica serovar Typhi Ty2
acuacguguacgcu

SEQ ID NO: 3725343 - RNA, 17 nt, Salmonella enterica enterica serovar Typhi Ty2
acuacguucaucaggca

SEQ ID NO: 3725344 - RNA, 17 nt, Salmonella enterica enterica serovar Typhi Ty2
acuacucguaaucuaaa

SEQ ID NO: 3725345 - RNA, 19 nt, Salmonella enterica enterica serovar Typhi Ty2
acuacucguaaucuaaaau

SEQ ID NO: 3725346 - RNA, 18 nt, Salmonella enterica enterica serovar Typhi Ty2
acuacugguggaauaaau

SEQ ID NO: 3725347 - RNA, 22 nt, Salmonella enterica enterica serovar Typhi Ty2
acuacugguggaauaaauauaa

SEQ ID NO: 3725348 - RNA, 14 nt, Salmonella enterica enterica serovar Typhi Ty2
acuagaauuuucac

SEQ ID NO: 3725349 - RNA, 15 nt, Salmonella enterica enterica serovar Typhi Ty2
acuagacagccucuc

SEQ ID NO: 3725350 - RNA, 22 nt, Salmonella enterica enterica serovar Typhi Ty2
acuauauguccuuuacugcgcc

SEQ ID NO: 3725351 - RNA, 18 nt, Salmonella enterica enterica serovar Typhi Ty2
acuaucaugaaugcccca

SEQ ID NO: 3725352 - RNA, 16 nt, Salmonella enterica enterica serovar Typhi Ty2
acuauccacagcgaau

SEQ ID NO: 3725353 - RNA, 16 nt, Salmonella enterica enterica serovar Typhi Ty2
acuauccuggccugau

SEQ ID NO: 3725354 - RNA, 20 nt, Salmonella enterica enterica serovar Typhi Ty2
acuauguugaugcuaaccuc

SEQ ID NO: 3725355 - RNA, 22 nt, Salmonella enterica enterica serovar Typhi Ty2
acuauucuuccccuucacucuu

SEQ ID NO: 3725356 - RNA, 19 nt, Salmonella enterica enterica serovar Typhi Ty2
acuauugccgauaauacgc

SEQ ID NO: 3725357 - RNA, 23 nt, Salmonella enterica enterica serovar Typhi Ty2
acuauuuuuccggcgucaaaaau

SEQ ID NO: 3725358 - RNA, 21 nt, Salmonella enterica enterica serovar Typhi Ty2
acucaaaauaacgcuucaccu

SEQ ID NO: 3725359 - RNA, 23 nt, Salmonella enterica enterica serovar Typhi Ty2
acucaaaccccagauuacugccc

SEQ ID NO: 3725360 - RNA, 15 nt, Salmonella enterica enterica serovar Typhi Ty2
acucaacaucauuaa

SEQ ID NO: 3725361 - RNA, 20 nt, Salmonella enterica enterica serovar Typhi Ty2
acucaaccaaccaacccaaa

SEQ ID NO: 3725362 - RNA, 21 nt, Salmonella enterica enterica serovar Typhi Ty2
acucaaccaucaaaaaaaaua

SEQ ID NO: 3725363 - RNA, 16 nt, Salmonella enterica enterica serovar Typhi Ty2
acucaagcgaauccag

SEQ ID NO: 3725364 - RNA, 17 nt, Salmonella enterica enterica serovar Typhi Ty2
acucaagcgaauccaga

SEQ ID NO: 3725365 - RNA, 17 nt, Salmonella enterica enterica serovar Typhi Ty2
acucaagguagccacgc

SEQ ID NO: 3725366 - RNA, 19 nt, Salmonella enterica enterica serovar Typhi Ty2
acucaagguagccacgccc

SEQ ID NO: 3725367 - RNA, 21 nt, Salmonella enterica enterica serovar Typhi Ty2
acucaaucauugucauuaacg

SEQ ID NO: 3725368 - RNA, 17 nt, Salmonella enterica enterica serovar Typhi Ty2
acucaccgcuaauccca

SEQ ID NO: 3725369 - RNA, 19 nt, Salmonella enterica enterica serovar Typhi Ty2
acucaccugaugcgaugaa

SEQ ID NO: 3725370 - RNA, 19 nt, Salmonella enterica enterica serovar Typhi Ty2
acucacgacuuucaccaga

SEQ ID NO: 3725371 - RNA, 15 nt, Salmonella enterica enterica serovar Typhi Ty2
acucacgguuuuuau

SEQ ID NO: 3725372 - RNA, 18 nt, Salmonella enterica enterica serovar Typhi Ty2
acucacguuccccagcac

SEQ ID NO: 3725373 - RNA, 21 nt, Salmonella enterica enterica serovar Typhi Ty2
acucacguuccccagcaccga

SEQ ID NO: 3725374 - RNA, 22 nt, Salmonella enterica enterica serovar Typhi Ty2
acucagaaaauuauuuuaaauu

SEQ ID NO: 3725375 - RNA, 15 nt, Salmonella enterica enterica serovar Typhi Ty2
acucagcacauucag

SEQ ID NO: 3725376 - RNA, 15 nt, Salmonella enterica enterica serovar Typhi Ty2
acucagcagcgcaua

SEQ ID NO: 3725377 - RNA, 15 nt, Salmonella enterica enterica serovar Typhi Ty2
acucagccagauacc

SEQ ID NO: 3725378 - RNA, 15 nt, Salmonella enterica enterica serovar Typhi Ty2
acucagcggcccaau

SEQ ID NO: 3725379 - RNA, 23 nt, Salmonella enterica enterica serovar Typhi Ty2
acucaggccuuuuuauugccaca

SEQ ID NO: 3725380 - RNA, 17 nt, Salmonella enterica enterica serovar Typhi Ty2
acucaggcgcaucugac

SEQ ID NO: 3725381 - RNA, 13 nt, Salmonella enterica enterica serovar Typhi Ty2
acucagggcaaaa

SEQ ID NO: 3725382 - RNA, 22 nt, Salmonella enterica enterica serovar Typhi Ty2
acucagggugacggaagagaga

SEQ ID NO: 3725383 - RNA, 20 nt, Salmonella enterica enterica serovar Typhi Ty2
acucaucacagccacacugc

SEQ ID NO: 3725384 - RNA, 23 nt, Salmonella enterica enterica serovar Typhi Ty2
acucaucauaauccuuauuuaau

SEQ ID NO: 3725385 - RNA, 17 nt, Salmonella enterica enterica serovar Typhi Ty2
acucaucaugauauaau

SEQ ID NO: 3725386 - RNA, 14 nt, Salmonella enterica enterica serovar Typhi Ty2
acucauccagacca

SEQ ID NO: 3725387 - RNA, 16 nt, Salmonella enterica enterica serovar Typhi Ty2
acucaucgccgcaaug

SEQ ID NO: 3725388 - RNA, 14 nt, Salmonella enterica enterica serovar Typhi Ty2
acucaucggaacag

SEQ ID NO: 3725389 - RNA, 20 nt, Salmonella enterica enterica serovar Typhi Ty2
acucaucgguuaacacauau

SEQ ID NO: 3725390 - RNA, 17 nt, Salmonella enterica enterica serovar Typhi Ty2
acucaugacuucacacu

SEQ ID NO: 3725391 - RNA, 19 nt, Salmonella enterica enterica serovar Typhi Ty2
acucaugacuucacacugu

SEQ ID NO: 3725392 - RNA, 21 nt, Salmonella enterica enterica serovar Typhi Ty2
acucauggacaaaaaaggaaa

SEQ ID NO: 3725393 - RNA, 13 nt, Salmonella enterica enterica serovar Typhi Ty2
acucauuaaaaaa

SEQ ID NO: 3725394 - RNA, 14 nt, Salmonella enterica enterica serovar Typhi Ty2
acucauuaaaaaaa

SEQ ID NO: 3725395 - RNA, 16 nt, Salmonella enterica enterica serovar Typhi Ty2
acucauuaaaaaaaca

SEQ ID NO: 3725396 - RNA, 21 nt, Salmonella enterica enterica serovar Typhi Ty2
acucauuaccggcugccgaua

SEQ ID NO: 3725397 - RNA, 11 nt, Salmonella enterica enterica serovar Typhi Ty2
acuccagcaga

SEQ ID NO: 3725398 - RNA, 12 nt, Salmonella enterica enterica serovar Typhi Ty2
acuccagcagac

SEQ ID NO: 3725399 - RNA, 15 nt, Salmonella enterica enterica serovar Typhi Ty2
acuccagcagaccgg

SEQ ID NO: 3725400 - RNA, 22 nt, Salmonella enterica enterica serovar Typhi Ty2
acuccagcagaccggcaaaaau

SEQ ID NO: 3725401 - RNA, 14 nt, Salmonella enterica enterica serovar Typhi Ty2
acuccagcagacgc

SEQ ID NO: 3725402 - RNA, 14 nt, Salmonella enterica enterica serovar Typhi Ty2
acuccagcccauca

SEQ ID NO: 3725403 - RNA, 15 nt, Salmonella enterica enterica serovar Typhi Ty2
acuccagcccaucag

SEQ ID NO: 3725404 - RNA, 21 nt, Salmonella enterica enterica serovar Typhi Ty2
acuccagcccaucagucccca

SEQ ID NO: 3725405 - RNA, 21 nt, Salmonella enterica enterica serovar Typhi Ty2
acuccagugcagaaaguguga

SEQ ID NO: 3725406 - RNA, 16 nt, Salmonella enterica enterica serovar Typhi Ty2
acuccauuaaauuacu

SEQ ID NO: 3725407 - RNA, 21 nt, Salmonella enterica enterica serovar Typhi Ty2
acuccauucccagcucuuuca

SEQ ID NO: 3725408 - RNA, 15 nt, Salmonella enterica enterica serovar Typhi Ty2
acuccauugucggca

SEQ ID NO: 3725409 - RNA, 22 nt, Salmonella enterica enterica serovar Typhi Ty2
acucccaggcgcgcagcugcca

SEQ ID NO: 3725410 - RNA, 17 nt, Salmonella enterica enterica serovar Typhi Ty2
acuccccuuuuuuacua

SEQ ID NO: 3725411 - RNA, 23 nt, Salmonella enterica enterica serovar Typhi Ty2
acucccgcacgcuggcaucaaua

SEQ ID NO: 3725412 - RNA, 18 nt, Salmonella enterica enterica serovar Typhi Ty2
acucccgucgccuguuuc

SEQ ID NO: 3725413 - RNA, 18 nt, Salmonella enterica enterica serovar Typhi Ty2
acucccugagucuugccu

SEQ ID NO: 3725414 - RNA, 19 nt, Salmonella enterica enterica serovar Typhi Ty2
acucccuggugacgcgcau

SEQ ID NO: 3725415 - RNA, 14 nt, Salmonella enterica enterica serovar Typhi Ty2
acuccgcccuaauc

SEQ ID NO: 3725416 - RNA, 22 nt, Salmonella enterica enterica serovar Typhi Ty2
acuccgccggcgcggaagggau

SEQ ID NO: 3725417 - RNA, 19 nt, Salmonella enterica enterica serovar Typhi Ty2
acuccgcgguagagcgcgg

SEQ ID NO: 3725418 - RNA, 15 nt, Salmonella enterica enterica serovar Typhi Ty2
acuccggcugcacca

SEQ ID NO: 3725419 - RNA, 19 nt, Salmonella enterica enterica serovar Typhi Ty2
acuccggugcccauuccgc

SEQ ID NO: 3725420 - RNA, 16 nt, Salmonella enterica enterica serovar Typhi Ty2
acuccgucaaagaaaa

SEQ ID NO: 3725421 - RNA, 19 nt, Salmonella enterica enterica serovar Typhi Ty2
acuccgucucuuuauugaa

SEQ ID NO: 3725422 - RNA, 15 nt, Salmonella enterica enterica serovar Typhi Ty2
acuccugcaacagaa

SEQ ID NO: 3725423 - RNA, 14 nt, Salmonella enterica enterica serovar Typhi Ty2
uguuuaccaucgcg

SEQ ID NO: 3725424 - RNA, 14 nt, Salmonella enterica enterica serovar Typhi Ty2
uguuuacgccgcca

SEQ ID NO: 3725425 - RNA, 19 nt, Salmonella enterica enterica serovar Typhi Ty2
uguuuauccccgcuggcgc

SEQ ID NO: 3725426 - RNA, 23 nt, Salmonella enterica enterica serovar Typhi Ty2
uguuuaucugaugccugaaggcg

SEQ ID NO: 3725427 - RNA, 16 nt, Salmonella enterica enterica serovar Typhi Ty2
uguuuaugacccugcg

SEQ ID NO: 3725428 - RNA, 18 nt, Salmonella enterica enterica serovar Typhi Ty2
uguuucaucgucagcucc

SEQ ID NO: 3725429 - RNA, 23 nt, Salmonella enterica enterica serovar Typhi Ty2
uguuuccauacauuuuuguaaua

SEQ ID NO: 3725430 - RNA, 19 nt, Salmonella enterica enterica serovar Typhi Ty2
uguuucgacaguuucuucu

SEQ ID NO: 3725431 - RNA, 15 nt, Salmonella enterica enterica serovar Typhi Ty2
uguuucggauaauuc

SEQ ID NO: 3725432 - RNA, 16 nt, Salmonella enterica enterica serovar Typhi Ty2
uguuucggauaauucu

SEQ ID NO: 3725433 - RNA, 10 nt, Salmonella enterica enterica serovar Typhi Ty2
uguuucugcg

SEQ ID NO: 3725434 - RNA, 12 nt, Salmonella enterica enterica serovar Typhi Ty2
uguuugaugagg

SEQ ID NO: 3725435 - RNA, 16 nt, Salmonella enterica enterica serovar Typhi Ty2
uguuugcccagcucau

SEQ ID NO: 3725436 - RNA, 15 nt, Salmonella enterica enterica serovar Typhi Ty2
uguuugcugauaaga

SEQ ID NO: 3725437 - RNA, 22 nt, Salmonella enterica enterica serovar Typhi Ty2
uguuuguuuaacugaacuuccg

SEQ ID NO: 3725438 - RNA, 14 nt, Salmonella enterica enterica serovar Typhi Ty2
uguuuuaccuguuu

SEQ ID NO: 3725439 - RNA, 18 nt, Salmonella enterica enterica serovar Typhi Ty2
uguuuuacuuuuuuaaau

SEQ ID NO: 3725440 - RNA, 20 nt, Salmonella enterica enterica serovar Typhi Ty2
uguuuuauacucaaaaaauc

SEQ ID NO: 3725441 - RNA, 16 nt, Salmonella enterica enterica serovar Typhi Ty2
uguuuuauuaccuccu

SEQ ID NO: 3725442 - RNA, 19 nt, Salmonella enterica enterica serovar Typhi Ty2
uguuuucauauguuugaua

SEQ ID NO: 3725443 - RNA, 15 nt, Salmonella enterica enterica serovar Typhi Ty2
uguuuuccagcguaa

SEQ ID NO: 3725444 - RNA, 17 nt, Salmonella enterica enterica serovar Typhi Ty2
uguuuucgagccuugcc

SEQ ID NO: 3725445 - RNA, 21 nt, Salmonella enterica enterica serovar Typhi Ty2
uguuuucgagccuugccgcaa

SEQ ID NO: 3725446 - RNA, 13 nt, Salmonella enterica enterica serovar Typhi Ty2
uguuuuuaaaaga

SEQ ID NO: 3725447 - RNA, 15 nt, Salmonella enterica enterica serovar Typhi Ty2
uguuuuuauacaucc

SEQ ID NO: 3725448 - RNA, 16 nt, Salmonella enterica enterica serovar Typhi Ty2
uguuuuuauuuuucuu

SEQ ID NO: 3725449 - RNA, 12 nt, Salmonella enterica enterica serovar Typhi Ty2
uguuuuucacua

SEQ ID NO: 3725450 - RNA, 15 nt, Salmonella enterica enterica serovar Typhi Ty2
uguuuuugaaaaugu

SEQ ID NO: 3725451 - RNA, 12 nt, Salmonella enterica enterica serovar Typhi Ty2
uguuuuugcuuu

SEQ ID NO: 3725452 - RNA, 11 nt, Salmonella enterica enterica serovar Typhi Ty2
uguuuuuucau

SEQ ID NO: 3725453 - RNA, 18 nt, Salmonella enterica enterica serovar Typhi Ty2
uuaaaaaaggcagaagaa

SEQ ID NO: 3725454 - RNA, 23 nt, Salmonella enterica enterica serovar Typhi Ty2
uuaaaaaaggcagaagaaucugc

SEQ ID NO: 3725455 - RNA, 21 nt, Salmonella enterica enterica serovar Typhi Ty2
uuaaaaaaggccgcuuaauaa

SEQ ID NO: 3725456 - RNA, 13 nt, Salmonella enterica enterica serovar Typhi Ty2
uuaaaaaauccug

SEQ ID NO: 3725457 - RNA, 13 nt, Salmonella enterica enterica serovar Typhi Ty2
uuaaaaacagcca

SEQ ID NO: 3725458 - RNA, 12 nt, Salmonella enterica enterica serovar Typhi Ty2
uuaaaaacauca

SEQ ID NO: 3725459 - RNA, 13 nt, Salmonella enterica enterica serovar Typhi Ty2
uuaaaaacaucau

SEQ ID NO: 3725460 - RNA, 18 nt, Salmonella enterica enterica serovar Typhi Ty2
uuaaaaaccaggcaaaaa

SEQ ID NO: 3725461 - RNA, 22 nt, Salmonella enterica enterica serovar Typhi Ty2
uuaaaaagcgcgggcuggccgg

SEQ ID NO: 3725462 - RNA, 17 nt, Salmonella enterica enterica serovar Typhi Ty2
uuaaaaagcugcauaau

SEQ ID NO: 3725463 - RNA, 22 nt, Salmonella enterica enterica serovar Typhi Ty2
uuaaaaauauccuguaacucau

SEQ ID NO: 3725464 - RNA, 17 nt, Salmonella enterica enterica serovar Typhi Ty2
uuaaaagggaguauuua

SEQ ID NO: 3725465 - RNA, 23 nt, Salmonella enterica enterica serovar Typhi Ty2
uuaaaauaaaugaggcuguuuuu

SEQ ID NO: 3725466 - RNA, 18 nt, Salmonella enterica enterica serovar Typhi Ty2
uuaaaaucugguggccgg

SEQ ID NO: 3725467 - RNA, 11 nt, Salmonella enterica enterica serovar Typhi Ty2
uuaaaaugacc

SEQ ID NO: 3725468 - RNA, 21 nt, Salmonella enterica enterica serovar Typhi Ty2
uuaaaaugcggggacuggaug

SEQ ID NO: 3725469 - RNA, 20 nt, Salmonella enterica enterica serovar Typhi Ty2
uuaaaauuccaauauuuauu

SEQ ID NO: 3725470 - RNA, 11 nt, Salmonella enterica enterica serovar Typhi Ty2
uuaaacaacau

SEQ ID NO: 3725471 - RNA, 13 nt, Salmonella enterica enterica serovar Typhi Ty2
uuaaacaacauau

SEQ ID NO: 3725472 - RNA, 18 nt, Salmonella enterica enterica serovar Typhi Ty2
uuaaacaacgccauaaua

SEQ ID NO: 3725473 - RNA, 12 nt, Salmonella enterica enterica serovar Typhi Ty2
uuaaacacaucc

SEQ ID NO: 3725474 - RNA, 18 nt, Salmonella enterica enterica serovar Typhi Ty2
uuaaacagcgaucacgcc

SEQ ID NO: 3725475 - RNA, 13 nt, Salmonella enterica enterica serovar Typhi Ty2
uuaaaccacaccu

SEQ ID NO: 3725476 - RNA, 19 nt, Salmonella enterica enterica serovar Typhi Ty2
uuaaacgccggauuccaga

SEQ ID NO: 3725477 - RNA, 13 nt, Salmonella enterica enterica serovar Typhi Ty2
uuaaacugccuuc

SEQ ID NO: 3725478 - RNA, 15 nt, Salmonella enterica enterica serovar Typhi Ty2
uuaaacuuucaugaa

SEQ ID NO: 3725479 - RNA, 14 nt, Salmonella enterica enterica serovar Typhi Ty2
uuaaagaaaaagaa

SEQ ID NO: 3725480 - RNA, 22 nt, Salmonella enterica enterica serovar Typhi Ty2
uuaaagacgccguuaccaaucu

SEQ ID NO: 3725481 - RNA, 19 nt, Salmonella enterica enterica serovar Typhi Ty2
uuaaagccaauccagaaua

SEQ ID NO: 3725482 - RNA, 22 nt, Salmonella enterica enterica serovar Typhi Ty2
uuaaagcgcucaagcggcacca

SEQ ID NO: 3725483 - RNA, 19 nt, Salmonella enterica enterica serovar Typhi Ty2
uuaaaguacuucacaauca

SEQ ID NO: 3725484 - RNA, 13 nt, Salmonella enterica enterica serovar Typhi Ty2
uuaaagucgcggu

SEQ ID NO: 3725485 - RNA, 21 nt, Salmonella enterica enterica serovar Typhi Ty2
uuaaaguuaguaccgaacagc

SEQ ID NO: 3725486 - RNA, 23 nt, Salmonella enterica enterica serovar Typhi Ty2
uuaaauaaauaguaaauagaaaa

SEQ ID NO: 3725487 - RNA, 18 nt, Salmonella enterica enterica serovar Typhi Ty2
uuaaauaacuuuuaauuu

SEQ ID NO: 3725488 - RNA, 14 nt, Salmonella enterica enterica serovar Typhi Ty2
uuaaaucagauaac

SEQ ID NO: 3725489 - RNA, 16 nt, Salmonella enterica enterica serovar Typhi Ty2
uuaaaucagauaacaa

SEQ ID NO: 3725490 - RNA, 16 nt, Salmonella enterica enterica serovar Typhi Ty2
uuaaaucaucauaauc

SEQ ID NO: 3725491 - RNA, 17 nt, Salmonella enterica enterica serovar Typhi Ty2
uuaaaucaucauaauca

SEQ ID NO: 3725492 - RNA, 18 nt, Salmonella enterica enterica serovar Typhi Ty2
uuaaaucgcgcaaauauu

SEQ ID NO: 3725493 - RNA, 19 nt, Salmonella enterica enterica serovar Typhi Ty2
uuaaaucgcgcaaauauua

SEQ ID NO: 3725494 - RNA, 20 nt, Salmonella enterica enterica serovar Typhi Ty2
uuaaaugccuguuuauauuc

SEQ ID NO: 3725495 - RNA, 16 nt, Salmonella enterica enterica serovar Typhi Ty2
uuaaaugcuugcuuua

SEQ ID NO: 3725496 - RNA, 22 nt, Salmonella enterica enterica serovar Typhi Ty2
uuaaauggaucgacaucuucau

SEQ ID NO: 3725497 - RNA, 19 nt, Salmonella enterica enterica serovar Typhi Ty2
uuaaauuaaugauuaaaau

SEQ ID NO: 3725498 - RNA, 20 nt, Salmonella enterica enterica serovar Typhi Ty2
uuaaauuaaugauuaaaaua

SEQ ID NO: 3725499 - RNA, 22 nt, Salmonella enterica enterica serovar Typhi Ty2
uuaaauucccagcguacaucuu

SEQ ID NO: 3725500 - RNA, 17 nt, Salmonella enterica enterica serovar Typhi Ty2
uuaaauuguuauaccgc

SEQ ID NO: 3725501 - RNA, 15 nt, Salmonella enterica enterica serovar Typhi Ty2
uuaacaaacgccagg

SEQ ID NO: 3725502 - RNA, 16 nt, Salmonella enterica enterica serovar Typhi Ty2
uuaacacauauaagua

SEQ ID NO: 3725503 - RNA, 15 nt, Salmonella enterica enterica serovar Typhi Ty2
uuaacacccggauau

SEQ ID NO: 3725504 - RNA, 19 nt, Salmonella enterica enterica serovar Typhi Ty2
uuaacagagagggaaaaaa

SEQ ID NO: 3725505 - RNA, 16 nt, Salmonella enterica enterica serovar Typhi Ty2
uuaacagauaauuaau

SEQ ID NO: 3725506 - RNA, 20 nt, Salmonella enterica enterica serovar Typhi Ty2
uuaacagcgccaucaggaaa

SEQ ID NO: 3725507 - RNA, 20 nt, Salmonella enterica enterica serovar Typhi Ty2
uuaacagcgcgaccaggaaa

SEQ ID NO: 3725508 - RNA, 16 nt, Salmonella enterica enterica serovar Typhi Ty2
uuaacaucagaaaaaa

SEQ ID NO: 3725509 - RNA, 18 nt, Salmonella enterica enterica serovar Typhi Ty2
uuaacauuuaagaaacaa

SEQ ID NO: 3725510 - RNA, 21 nt, Salmonella enterica enterica serovar Typhi Ty2
uuaacccagauaucagucugc

SEQ ID NO: 3725511 - RNA, 19 nt, Salmonella enterica enterica serovar Typhi Ty2
uuaaccugagaauauuaac

SEQ ID NO: 3725512 - RNA, 19 nt, Salmonella enterica enterica serovar Typhi Ty2
uuaacgcauguuccgcuac

SEQ ID NO: 3725513 - RNA, 11 nt, Salmonella enterica enterica serovar Typhi Ty2
uuaacgccagu

SEQ ID NO: 3725514 - RNA, 19 nt, Salmonella enterica enterica serovar Typhi Ty2
uuaacgccaugcucaucca

SEQ ID NO: 3725515 - RNA, 18 nt, Salmonella enterica enterica serovar Typhi Ty2
uuaacgccgccaucagua

SEQ ID NO: 3725516 - RNA, 22 nt, Salmonella enterica enterica serovar Typhi Ty2
uuaacgcgaauccgccauagcc

SEQ ID NO: 3725517 - RNA, 17 nt, Salmonella enterica enterica serovar Typhi Ty2
uuaacgcggccguaaua

SEQ ID NO: 3725518 - RNA, 19 nt, Salmonella enterica enterica serovar Typhi Ty2
uuaacguaggccggauaag

SEQ ID NO: 3725519 - RNA, 20 nt, Salmonella enterica enterica serovar Typhi Ty2
uuaacgucacgauggcgauu

SEQ ID NO: 3725520 - RNA, 19 nt, Salmonella enterica enterica serovar Typhi Ty2
uuaacguccauaccgguug

SEQ ID NO: 3725521 - RNA, 18 nt, Salmonella enterica enterica serovar Typhi Ty2
uuaacucuuugagcgccc

SEQ ID NO: 3725522 - RNA, 18 nt, Salmonella enterica enterica serovar Typhi Ty2
uuaacuucugcagggaaa

SEQ ID NO: 3725523 - RNA, 21 nt, Salmonella enterica enterica serovar Typhi Ty2
uuaagaacgguuggaauaauu

SEQ ID NO: 3725524 - RNA, 19 nt, Salmonella enterica enterica serovar Typhi Ty2
uuaagacagguaacugcac

SEQ ID NO: 3725525 - RNA, 23 nt, Salmonella enterica enterica serovar Typhi Ty2
uuaagcaacugauuaaucugccg

SEQ ID NO: 3725526 - RNA, 13 nt, Salmonella enterica enterica serovar Typhi Ty2
uuaagcacgccgc

SEQ ID NO: 3725527 - RNA, 18 nt, Salmonella enterica enterica serovar Typhi Ty2
uuaagccagacgcgcagc

SEQ ID NO: 3725528 - RNA, 22 nt, Salmonella enterica enterica serovar Typhi Ty2
uuaagccccucgcuaaugcccg

SEQ ID NO: 3725529 - RNA, 19 nt, Salmonella enterica enterica serovar Typhi Ty2
uuaagccgggucagccccc

SEQ ID NO: 3725530 - RNA, 15 nt, Salmonella enterica enterica serovar Typhi Ty2
uuaaggauugccgcc

SEQ ID NO: 3725531 - RNA, 15 nt, Salmonella enterica enterica serovar Typhi Ty2
uuaaggcggcaaaga

SEQ ID NO: 3725532 - RNA, 14 nt, Salmonella enterica enterica serovar Typhi Ty2
uuaagucaucuguu

SEQ ID NO: 3725533 - RNA, 21 nt, Salmonella enterica enterica serovar Typhi Ty2
uuaaguuuuacugaugccagc

SEQ ID NO: 3725534 - RNA, 15 nt, Salmonella enterica enterica serovar Typhi Ty2
uuaauaaacaaugca

SEQ ID NO: 3725535 - RNA, 23 nt, Salmonella enterica enterica serovar Typhi Ty2
uuaauaaugugccgguaagaaga

SEQ ID NO: 3725536 - RNA, 11 nt, Salmonella enterica enterica serovar Typhi Ty2
uuaauacacga

SEQ ID NO: 3725537 - RNA, 17 nt, Salmonella enterica enterica serovar Typhi Ty2
uuaauacacgauaaacc

SEQ ID NO: 3725538 - RNA, 14 nt, Salmonella enterica enterica serovar Typhi Ty2
uuaauacaucaaca

SEQ ID NO: 3725539 - RNA, 15 nt, Salmonella enterica enterica serovar Typhi Ty2
uuaauacccauagua

SEQ ID NO: 3725540 - RNA, 14 nt, Salmonella enterica enterica serovar Typhi Ty2
uuaauaccugguaa

SEQ ID NO: 3725541 - RNA, 21 nt, Salmonella enterica enterica serovar Typhi Ty2
uuaauagcguagccugcaugu

SEQ ID NO: 3725542 - RNA, 16 nt, Salmonella enterica enterica serovar Typhi Ty2
uuaaucaccagcgcau

SEQ ID NO: 3725543 - RNA, 14 nt, Salmonella enterica enterica serovar Typhi Ty2
uuaaucccaacccg

SEQ ID NO: 3725544 - RNA, 14 nt, Salmonella enterica enterica serovar Typhi Ty2
uuaaucgauuuucu

SEQ ID NO: 3725545 - RNA, 14 nt, Salmonella enterica enterica serovar Typhi Ty2
uuaaucgucauccc

SEQ ID NO: 3725546 - RNA, 14 nt, Salmonella enterica enterica serovar Typhi Ty2
uuaaucuauuuaau

SEQ ID NO: 3725547 - RNA, 21 nt, Salmonella enterica enterica serovar Typhi Ty2
uuaaucugcgcuggguuuuuc

SEQ ID NO: 3725548 - RNA, 14 nt, Salmonella enterica enterica serovar Typhi Ty2
uuaaugaaaucguc

SEQ ID NO: 3725549 - RNA, 18 nt, Salmonella enterica enterica serovar Typhi Ty2
uuaaugacuuuuuauaua

SEQ ID NO: 3725550 - RNA, 19 nt, Salmonella enterica enterica serovar Typhi Ty2
uuaaugacuuuuuauauaa

SEQ ID NO: 3725551 - RNA, 16 nt, Salmonella enterica enterica serovar Typhi Ty2
uuaaugauuaaaauaa

SEQ ID NO: 3725552 - RNA, 13 nt, Salmonella enterica enterica serovar Typhi Ty2
uuaaugauuugcu

SEQ ID NO: 3725553 - RNA, 16 nt, Salmonella enterica enterica serovar Typhi Ty2
uuaaugauuugcuuua

SEQ ID NO: 3725554 - RNA, 23 nt, Salmonella enterica enterica serovar Typhi Ty2
uuaaugcauggcagauaaaccac

SEQ ID NO: 3725555 - RNA, 15 nt, Salmonella enterica enterica serovar Typhi Ty2
uuaaugcgacgccca

SEQ ID NO: 3725556 - RNA, 21 nt, Salmonella enterica enterica serovar Typhi Ty2
uuaaugcgccccugcaggcga

SEQ ID NO: 3725557 - RNA, 23 nt, Salmonella enterica enterica serovar Typhi Ty2
uuaaugcgccccugcaggcgauc

SEQ ID NO: 3725558 - RNA, 16 nt, Salmonella enterica enterica serovar Typhi Ty2
uuaaugcucuccagca

SEQ ID NO: 3725559 - RNA, 15 nt, Salmonella enterica enterica serovar Typhi Ty2
uuaaugcucugcugu

SEQ ID NO: 3725560 - RNA, 16 nt, Salmonella enterica enterica serovar Typhi Ty2
uuaauggaggcaguga

SEQ ID NO: 3725561 - RNA, 19 nt, Salmonella enterica enterica serovar Typhi Ty2
uuaauggcagaauaaaaca

SEQ ID NO: 3725562 - RNA, 20 nt, Salmonella enterica enterica serovar Typhi Ty2
uuaauggugguugcaucauc

SEQ ID NO: 3725563 - RNA, 20 nt, Salmonella enterica enterica serovar Typhi Ty2
uuaaugucaccaucaucgau

SEQ ID NO: 3725564 - RNA, 14 nt, Salmonella enterica enterica serovar Typhi Ty2
uuaaugucaucauc

SEQ ID NO: 3725565 - RNA, 19 nt, Salmonella enterica enterica serovar Typhi Ty2
uuaauuaaaugcuugcuuu

SEQ ID NO: 3725566 - RNA, 14 nt, Salmonella enterica enterica serovar Typhi Ty2
uuaauuauacuguc

SEQ ID NO: 3725567 - RNA, 21 nt, Salmonella enterica enterica serovar Typhi Ty2
uuaauuccgcaucauucaucu

SEQ ID NO: 3725568 - RNA, 12 nt, Salmonella enterica enterica serovar Typhi Ty2
uuaauucuggca

SEQ ID NO: 3725569 - RNA, 17 nt, Salmonella enterica enterica serovar Typhi Ty2
uuaauucuggcaauaag

SEQ ID NO: 3725570 - RNA, 13 nt, Salmonella enterica enterica serovar Typhi Ty2
uuaauucuuuuaa

SEQ ID NO: 3725571 - RNA, 14 nt, Salmonella enterica enterica serovar Typhi Ty2
uuaauuguaccgau

SEQ ID NO: 3725572 - RNA, 19 nt, Salmonella enterica enterica serovar Typhi Ty2
uuaauuguaccgauuguuu

SEQ ID NO: 3725573 - RNA, 18 nt, Salmonella enterica enterica serovar Typhi Ty2
uuaauuucccgcugguug

SEQ ID NO: 3725574 - RNA, 15 nt, Salmonella enterica enterica serovar Typhi Ty2
uuaauuucuuuccaa

SEQ ID NO: 3725575 - RNA, 18 nt, Salmonella enterica enterica serovar Typhi Ty2
uuaauuugcaucaggcca

SEQ ID NO: 3725576 - RNA, 20 nt, Salmonella enterica enterica serovar Typhi Ty2
uuaauuugcuccagaagauc

SEQ ID NO: 3725577 - RNA, 16 nt, Salmonella enterica enterica serovar Typhi Ty2
uuaauuugcuguuuuu

SEQ ID NO: 3725578 - RNA, 22 nt, Salmonella enterica enterica serovar Typhi Ty2
uuacaaacaggcuuuauacagu

SEQ ID NO: 3725579 - RNA, 19 nt, Salmonella enterica enterica serovar Typhi Ty2
uuacaaaugaccucaagaa

SEQ ID NO: 3725580 - RNA, 23 nt, Salmonella enterica enterica serovar Typhi Ty2
uuacaaccgcaccggaucaauau

SEQ ID NO: 3725581 - RNA, 19 nt, Salmonella enterica enterica serovar Typhi Ty2
uuacaagugucgugaaucg

SEQ ID NO: 3725582 - RNA, 17 nt, Salmonella enterica enterica serovar Typhi Ty2
uuacaauuucgcaaaca

SEQ ID NO: 3725583 - RNA, 19 nt, Salmonella enterica enterica serovar Typhi Ty2
uuacacacccggccuauca

SEQ ID NO: 3725584 - RNA, 22 nt, Salmonella enterica enterica serovar Typhi Ty2
uuacaccucgccacauucaauu

SEQ ID NO: 3725585 - RNA, 16 nt, Salmonella enterica enterica serovar Typhi Ty2
uuacacgaucauuuca

SEQ ID NO: 3725586 - RNA, 14 nt, Salmonella enterica enterica serovar Typhi Ty2
uuacacguuccaug

SEQ ID NO: 3725587 - RNA, 18 nt, Salmonella enterica enterica serovar Typhi Ty2
uggcuucuucaacauugu

SEQ ID NO: 3725588 - RNA, 15 nt, Salmonella enterica enterica serovar Typhi Ty2
uggcuugaucaacgc

SEQ ID NO: 3725589 - RNA, 18 nt, Salmonella enterica enterica serovar Typhi Ty2
uggcuugaucaacgccgc

SEQ ID NO: 3725590 - RNA, 13 nt, Salmonella enterica enterica serovar Typhi Ty2
uggcuuucaccgu

SEQ ID NO: 3725591 - RNA, 21 nt, Salmonella enterica enterica serovar Typhi Ty2
uggcuuuccugaucaaucaac

SEQ ID NO: 3725592 - RNA, 17 nt, Salmonella enterica enterica serovar Typhi Ty2
uggcuuuuuccugccau

SEQ ID NO: 3725593 - RNA, 15 nt, Salmonella enterica enterica serovar Typhi Ty2
ugggaaacuuaucag

SEQ ID NO: 3725594 - RNA, 23 nt, Salmonella enterica enterica serovar Typhi Ty2
ugggaaucgccugaugaagcgga

SEQ ID NO: 3725595 - RNA, 18 nt, Salmonella enterica enterica serovar Typhi Ty2
ugggacauaauugcugcc

SEQ ID NO: 3725596 - RNA, 17 nt, Salmonella enterica enterica serovar Typhi Ty2
ugggauagugcugcgca

SEQ ID NO: 3725597 - RNA, 18 nt, Salmonella enterica enterica serovar Typhi Ty2
ugggauauuacagaucuu

SEQ ID NO: 3725598 - RNA, 20 nt, Salmonella enterica enterica serovar Typhi Ty2
ugggaucgacucauccagca

SEQ ID NO: 3725599 - RNA, 22 nt, Salmonella enterica enterica serovar Typhi Ty2
ugggaucuucaaugaacaauaa

SEQ ID NO: 3725600 - RNA, 14 nt, Salmonella enterica enterica serovar Typhi Ty2
ugggcaaucaucag

SEQ ID NO: 3725601 - RNA, 22 nt, Salmonella enterica enterica serovar Typhi Ty2
ugggcaggagaugaccugccca

SEQ ID NO: 3725602 - RNA, 19 nt, Salmonella enterica enterica serovar Typhi Ty2
ugggcagugcucgccaaaa

SEQ ID NO: 3725603 - RNA, 20 nt, Salmonella enterica enterica serovar Typhi Ty2
ugggcagugcucgccaaaac

SEQ ID NO: 3725604 - RNA, 17 nt, Salmonella enterica enterica serovar Typhi Ty2
ugggccagcagcgcauc

SEQ ID NO: 3725605 - RNA, 14 nt, Salmonella enterica enterica serovar Typhi Ty2
ugggcgcaacaguc

SEQ ID NO: 3725606 - RNA, 15 nt, Salmonella enterica enterica serovar Typhi Ty2
ugggcgcaacaguca

SEQ ID NO: 3725607 - RNA, 17 nt, Salmonella enterica enterica serovar Typhi Ty2
ugggcgcaacagucagc

SEQ ID NO: 3725608 - RNA, 17 nt, Salmonella enterica enterica serovar Typhi Ty2
ugggcgcacagcgccau

SEQ ID NO: 3725609 - RNA, 14 nt, Salmonella enterica enterica serovar Typhi Ty2
ugggcggcaccagc

SEQ ID NO: 3725610 - RNA, 22 nt, Salmonella enterica enterica serovar Typhi Ty2
ugggcgucuuaaugcucuccag

SEQ ID NO: 3725611 - RNA, 16 nt, Salmonella enterica enterica serovar Typhi Ty2
ugggcuaugaagagaa

SEQ ID NO: 3725612 - RNA, 17 nt, Salmonella enterica enterica serovar Typhi Ty2
ugggcucaucaaacagc

SEQ ID NO: 3725613 - RNA, 16 nt, Salmonella enterica enterica serovar Typhi Ty2
ugggcuugcuuuucuc

SEQ ID NO: 3725614 - RNA, 18 nt, Salmonella enterica enterica serovar Typhi Ty2
uggggaaaauaccgguaa

SEQ ID NO: 3725615 - RNA, 13 nt, Salmonella enterica enterica serovar Typhi Ty2
uggggaaccuggc

SEQ ID NO: 3725616 - RNA, 15 nt, Salmonella enterica enterica serovar Typhi Ty2
uggggaaccuggcag

SEQ ID NO: 3725617 - RNA, 17 nt, Salmonella enterica enterica serovar Typhi Ty2
uggggaaccuggcagaa

SEQ ID NO: 3725618 - RNA, 21 nt, Salmonella enterica enterica serovar Typhi Ty2
uggggacgcgcaaacgcuggc

SEQ ID NO: 3725619 - RNA, 20 nt, Salmonella enterica enterica serovar Typhi Ty2
uggggauaucuucgauaaga

SEQ ID NO: 3725620 - RNA, 18 nt, Salmonella enterica enterica serovar Typhi Ty2
uggggauuaucaggauga

SEQ ID NO: 3725621 - RNA, 17 nt, Salmonella enterica enterica serovar Typhi Ty2
uggguaaauaccaggca

SEQ ID NO: 3725622 - RNA, 19 nt, Salmonella enterica enterica serovar Typhi Ty2
uggguaccucaugccggcu

SEQ ID NO: 3725623 - RNA, 18 nt, Salmonella enterica enterica serovar Typhi Ty2
uggguauccacgccuggc

SEQ ID NO: 3725624 - RNA, 20 nt, Salmonella enterica enterica serovar Typhi Ty2
uggguauuuuuuagcgccaa

SEQ ID NO: 3725625 - RNA, 13 nt, Salmonella enterica enterica serovar Typhi Ty2
uggguuccaggcg

SEQ ID NO: 3725626 - RNA, 15 nt, Salmonella enterica enterica serovar Typhi Ty2
uggguuuauuuggua

SEQ ID NO: 3725627 - RNA, 14 nt, Salmonella enterica enterica serovar Typhi Ty2
uggguuuccggauc

SEQ ID NO: 3725628 - RNA, 22 nt, Salmonella enterica enterica serovar Typhi Ty2
uggguuugugucguaguggcau

SEQ ID NO: 3725629 - RNA, 15 nt, Salmonella enterica enterica serovar Typhi Ty2
ugguaaaacgcuggc

SEQ ID NO: 3725630 - RNA, 16 nt, Salmonella enterica enterica serovar Typhi Ty2
ugguaaauccaauaga

SEQ ID NO: 3725631 - RNA, 22 nt, Salmonella enterica enterica serovar Typhi Ty2
ugguaaccuguuccucacugag

SEQ ID NO: 3725632 - RNA, 15 nt, Salmonella enterica enterica serovar Typhi Ty2
ugguaacugcggcua

SEQ ID NO: 3725633 - RNA, 19 nt, Salmonella enterica enterica serovar Typhi Ty2
ugguaagagcgacucaggu

SEQ ID NO: 3725634 - RNA, 19 nt, Salmonella enterica enterica serovar Typhi Ty2
ugguaagcgccaagcggca

SEQ ID NO: 3725635 - RNA, 14 nt, Salmonella enterica enterica serovar Typhi Ty2
ugguaaggcaaaua

SEQ ID NO: 3725636 - RNA, 22 nt, Salmonella enterica enterica serovar Typhi Ty2
ugguaccggauuuagcggcagc

SEQ ID NO: 3725637 - RNA, 16 nt, Salmonella enterica enterica serovar Typhi Ty2
uguaaaaaaauaaaaa

SEQ ID NO: 3725638 - RNA, 13 nt, Salmonella enterica enterica serovar Typhi Ty2
uguaaaaaugccu

SEQ ID NO: 3725639 - RNA, 21 nt, Salmonella enterica enterica serovar Typhi Ty2
uguaaaacgguaugaaacaua

SEQ ID NO: 3725640 - RNA, 21 nt, Salmonella enterica enterica serovar Typhi Ty2
uguaaaccaggcauuuuauua

SEQ ID NO: 3725641 - RNA, 21 nt, Salmonella enterica enterica serovar Typhi Ty2
uguaaacccgauucugccagu

SEQ ID NO: 3725642 - RNA, 12 nt, Salmonella enterica enterica serovar Typhi Ty2
uguaaaccggcc

SEQ ID NO: 3725643 - RNA, 23 nt, Salmonella enterica enterica serovar Typhi Ty2
uguaaagaaugaaaaaaaaauua

SEQ ID NO: 3725644 - RNA, 18 nt, Salmonella enterica enterica serovar Typhi Ty2
uguaaaggugagcucuuu

SEQ ID NO: 3725645 - RNA, 22 nt, Salmonella enterica enterica serovar Typhi Ty2
uguaaagucggccauuuuuuua

SEQ ID NO: 3725646 - RNA, 20 nt, Salmonella enterica enterica serovar Typhi Ty2
uguaacaaugccucgauggc

SEQ ID NO: 3725647 - RNA, 16 nt, Salmonella enterica enterica serovar Typhi Ty2
uguaacauauuuuuau

SEQ ID NO: 3725648 - RNA, 16 nt, Salmonella enterica enterica serovar Typhi Ty2
uguaaccaaagcacca

SEQ ID NO: 3725649 - RNA, 13 nt, Salmonella enterica enterica serovar Typhi Ty2
uguaaccaacaaa

SEQ ID NO: 3725650 - RNA, 20 nt, Salmonella enterica enterica serovar Typhi Ty2
uguaaccaccugggugagcg

SEQ ID NO: 3725651 - RNA, 15 nt, Salmonella enterica enterica serovar Typhi Ty2
uguaacccgccgcca

SEQ ID NO: 3725652 - RNA, 16 nt, Salmonella enterica enterica serovar Typhi Ty2
uguaaccuuaaaaggc

SEQ ID NO: 3725653 - RNA, 22 nt, Salmonella enterica enterica serovar Typhi Ty2
uguaacgaguugcggcaacgug

SEQ ID NO: 3725654 - RNA, 19 nt, Salmonella enterica enterica serovar Typhi Ty2
uguaacuucggccagcgag

SEQ ID NO: 3725655 - RNA, 23 nt, Salmonella enterica enterica serovar Typhi Ty2
uguaagaggcauaaaaaaaagcc

SEQ ID NO: 3725656 - RNA, 21 nt, Salmonella enterica enterica serovar Typhi Ty2
uguaagggaggugcucuccca

SEQ ID NO: 3725657 - RNA, 23 nt, Salmonella enterica enterica serovar Typhi Ty2
uguaauaccacugcccgccgcca

SEQ ID NO: 3725658 - RNA, 20 nt, Salmonella enterica enterica serovar Typhi Ty2
uguaauggcgcucuuuucca

SEQ ID NO: 3725659 - RNA, 15 nt, Salmonella enterica enterica serovar Typhi Ty2
uguaauggugggaca

SEQ ID NO: 3725660 - RNA, 20 nt, Salmonella enterica enterica serovar Typhi Ty2
uguaauguuuucugccagca

SEQ ID NO: 3725661 - RNA, 18 nt, Salmonella enterica enterica serovar Typhi Ty2
uguaauucaccaaauccu

SEQ ID NO: 3725662 - RNA, 21 nt, Salmonella enterica enterica serovar Typhi Ty2
uguaauucucccaaauuuuuu

SEQ ID NO: 3725663 - RNA, 14 nt, Salmonella enterica enterica serovar Typhi Ty2
uguaauuuauaaag

SEQ ID NO: 3725664 - RNA, 22 nt, Salmonella enterica enterica serovar Typhi Ty2
uguacaaccaucacugaaccca

SEQ ID NO: 3725665 - RNA, 19 nt, Salmonella enterica enterica serovar Typhi Ty2
uguacagcaauaaaaggaa

SEQ ID NO: 3725666 - RNA, 15 nt, Salmonella enterica enterica serovar Typhi Ty2
uguacaucacauugc

SEQ ID NO: 3725667 - RNA, 22 nt, Salmonella enterica enterica serovar Typhi Ty2
uguacaucacauugccccagcc

SEQ ID NO: 3725668 - RNA, 16 nt, Salmonella enterica enterica serovar Typhi Ty2
uguacaucuacuucag

SEQ ID NO: 3725669 - RNA, 11 nt, Salmonella enterica enterica serovar Typhi Ty2
uguaccaggcc

SEQ ID NO: 3725670 - RNA, 17 nt, Salmonella enterica enterica serovar Typhi Ty2
uguaccauugucaaaaa

SEQ ID NO: 3725671 - RNA, 19 nt, Salmonella enterica enterica serovar Typhi Ty2
uguacccucgcgccaguga

SEQ ID NO: 3725672 - RNA, 20 nt, Salmonella enterica enterica serovar Typhi Ty2
uguaccggcaggugauggcg

SEQ ID NO: 3725673 - RNA, 21 nt, Salmonella enterica enterica serovar Typhi Ty2
uguaccgucccuaagccggca

SEQ ID NO: 3725674 - RNA, 20 nt, Salmonella enterica enterica serovar Typhi Ty2
uguaccugauccagcucuuc

SEQ ID NO: 3725675 - RNA, 16 nt, Salmonella enterica enterica serovar Typhi Ty2
uguacgaccgucaaac

SEQ ID NO: 3725676 - RNA, 15 nt, Salmonella enterica enterica serovar Typhi Ty2
uguacgugaagggaa

SEQ ID NO: 3725677 - RNA, 16 nt, Salmonella enterica enterica serovar Typhi Ty2
uguacgugaagggaau

SEQ ID NO: 3725678 - RNA, 16 nt, Salmonella enterica enterica serovar Typhi Ty2
uguacuugcgccgcca

SEQ ID NO: 3725679 - RNA, 16 nt, Salmonella enterica enterica serovar Typhi Ty2
uguacuuuugcuucca

SEQ ID NO: 3725680 - RNA, 21 nt, Salmonella enterica enterica serovar Typhi Ty2
uguagagauucugcaggccaa

SEQ ID NO: 3725681 - RNA, 23 nt, Salmonella enterica enterica serovar Typhi Ty2
uguagcaacccuggcgcuuuaaa

SEQ ID NO: 3725682 - RNA, 15 nt, Salmonella enterica enterica serovar Typhi Ty2
uguagcagcgccagc

SEQ ID NO: 3725683 - RNA, 13 nt, Salmonella enterica enterica serovar Typhi Ty2
uguagcgcuuugg

SEQ ID NO: 3725684 - RNA, 18 nt, Salmonella enterica enterica serovar Typhi Ty2
uguagcggcaacagcacc

SEQ ID NO: 3725685 - RNA, 15 nt, Salmonella enterica enterica serovar Typhi Ty2
uguagcuugaaagcg

SEQ ID NO: 3725686 - RNA, 16 nt, Salmonella enterica enterica serovar Typhi Ty2
uguaggcacuuuccag

SEQ ID NO: 3725687 - RNA, 20 nt, Salmonella enterica enterica serovar Typhi Ty2
uguaggcccgguaagcgcag

SEQ ID NO: 3725688 - RNA, 21 nt, Salmonella enterica enterica serovar Typhi Ty2
uguaggcccgguaagcgcuag

SEQ ID NO: 3725689 - RNA, 20 nt, Salmonella enterica enterica serovar Typhi Ty2
uguaggccgggcaagcgaag

SEQ ID NO: 3725690 - RNA, 19 nt, Salmonella enterica enterica serovar Typhi Ty2
uguaggccugauaagcgca

SEQ ID NO: 3725691 - RNA, 20 nt, Salmonella enterica enterica serovar Typhi Ty2
uguaggccugauaagcguag

SEQ ID NO: 3725692 - RNA, 15 nt, Salmonella enterica enterica serovar Typhi Ty2
uguaggcuuccagaa

SEQ ID NO: 3725693 - RNA, 20 nt, Salmonella enterica enterica serovar Typhi Ty2
uguaggcuuccagaagguag

SEQ ID NO: 3725694 - RNA, 16 nt, Salmonella enterica enterica serovar Typhi Ty2
uguagugcgauaugug

SEQ ID NO: 3725695 - RNA, 12 nt, Salmonella enterica enterica serovar Typhi Ty2
uguagugguugu

SEQ ID NO: 3725696 - RNA, 12 nt, Salmonella enterica enterica serovar Typhi Ty2
uguaguuaucgc

SEQ ID NO: 3725697 - RNA, 16 nt, Salmonella enterica enterica serovar Typhi Ty2
uguaguugccgcccug

SEQ ID NO: 3725698 - RNA, 13 nt, Salmonella enterica enterica serovar Typhi Ty2
uguauaaaauauu

SEQ ID NO: 3725699 - RNA, 14 nt, Salmonella enterica enterica serovar Typhi Ty2
uguauaaaauauuu

SEQ ID NO: 3725700 - RNA, 21 nt, Salmonella enterica enterica serovar Typhi Ty2
uguauaauccaacauuaucaa

SEQ ID NO: 3725701 - RNA, 17 nt, Salmonella enterica enterica serovar Typhi Ty2
uguauaccaaaaauaau

SEQ ID NO: 3725702 - RNA, 16 nt, Salmonella enterica enterica serovar Typhi Ty2
uguaucagcauuuaca

SEQ ID NO: 3725703 - RNA, 20 nt, Salmonella enterica enterica serovar Typhi Ty2
uguaucgcgcggauuccgcc

SEQ ID NO: 3725704 - RNA, 23 nt, Salmonella enterica enterica serovar Typhi Ty2
uguaucugcugacacccucugcg

SEQ ID NO: 3725705 - RNA, 23 nt, Salmonella enterica enterica serovar Typhi Ty2
uguaucugguggaaaagaaaaca

SEQ ID NO: 3725706 - RNA, 21 nt, Salmonella enterica enterica serovar Typhi Ty2
uguaucuucgccguguucuua

SEQ ID NO: 3725707 - RNA, 13 nt, Salmonella enterica enterica serovar Typhi Ty2
uguaucuugcuuu

SEQ ID NO: 3725708 - RNA, 13 nt, Salmonella enterica enterica serovar Typhi Ty2
uguauuaaaggau

SEQ ID NO: 3725709 - RNA, 17 nt, Salmonella enterica enterica serovar Typhi Ty2
uguauuguaauaacgaa

SEQ ID NO: 3725710 - RNA, 16 nt, Salmonella enterica enterica serovar Typhi Ty2
uguauuguucaugcaa

SEQ ID NO: 3725711 - RNA, 18 nt, Salmonella enterica enterica serovar Typhi Ty2
uguauuuaauaccuggua

SEQ ID NO: 3725712 - RNA, 18 nt, Salmonella enterica enterica serovar Typhi Ty2
uguauuugaauuuuagau

SEQ ID NO: 3725713 - RNA, 21 nt, Salmonella enterica enterica serovar Typhi Ty2
uguauuugaauuuuagauccc

SEQ ID NO: 3725714 - RNA, 17 nt, Salmonella enterica enterica serovar Typhi Ty2
ugucaaaaaaucagcaa

SEQ ID NO: 3725715 - RNA, 15 nt, Salmonella enterica enterica serovar Typhi Ty2
ugucaaauucaagcc

SEQ ID NO: 3725716 - RNA, 19 nt, Salmonella enterica enterica serovar Typhi Ty2
ugucaacaacuucaaaaua

SEQ ID NO: 3725717 - RNA, 17 nt, Salmonella enterica enterica serovar Typhi Ty2
ugucaacuuaaacguuc

SEQ ID NO: 3725718 - RNA, 15 nt, Salmonella enterica enterica serovar Typhi Ty2
ugucaauaucgacgg

SEQ ID NO: 3725719 - RNA, 13 nt, Salmonella enterica enterica serovar Typhi Ty2
ugucacaccggcg

SEQ ID NO: 3725720 - RNA, 11 nt, Salmonella enterica enterica serovar Typhi Ty2
ugucaccagca

SEQ ID NO: 3725721 - RNA, 18 nt, Salmonella enterica enterica serovar Typhi Ty2
ugucaccaucaucgauau

SEQ ID NO: 3725722 - RNA, 15 nt, Salmonella enterica enterica serovar Typhi Ty2
ugucagacaugauaa

SEQ ID NO: 3725723 - RNA, 18 nt, Salmonella enterica enterica serovar Typhi Ty2
ugucagauccuucauuca

SEQ ID NO: 3725724 - RNA, 21 nt, Salmonella enterica enterica serovar Typhi Ty2
ugucaguaucgguacgcgcgu

SEQ ID NO: 3725725 - RNA, 22 nt, Salmonella enterica enterica serovar Typhi Ty2
ugucauagucggcgccaaaguu

SEQ ID NO: 3725726 - RNA, 23 nt, Salmonella enterica enterica serovar Typhi Ty2
ugucauagucggcgccaaaguua

SEQ ID NO: 3725727 - RNA, 21 nt, Salmonella enterica enterica serovar Typhi Ty2
ugucaucaaaaucaucgccac

SEQ ID NO: 3725728 - RNA, 14 nt, Salmonella enterica enterica serovar Typhi Ty2
ugucaucagaucau

SEQ ID NO: 3725729 - RNA, 19 nt, Salmonella enterica enterica serovar Typhi Ty2
ugucaucaguaugagcgaa

SEQ ID NO: 3725730 - RNA, 21 nt, Salmonella enterica enterica serovar Typhi Ty2
ugucauccugcgcacagcaua

SEQ ID NO: 3725731 - RNA, 13 nt, Salmonella enterica enterica serovar Typhi Ty2
ugucaucggcuuu

SEQ ID NO: 3725732 - RNA, 17 nt, Salmonella enterica enterica serovar Typhi Ty2
ugucaucgucagcaacg

SEQ ID NO: 3725733 - RNA, 16 nt, Salmonella enterica enterica serovar Typhi Ty2
ugucaugcgccacgac

SEQ ID NO: 3725734 - RNA, 16 nt, Salmonella enterica enterica serovar Typhi Ty2
ugucaugcuaaaacag

SEQ ID NO: 3725735 - RNA, 17 nt, Salmonella enterica enterica serovar Typhi Ty2
ugucaugcuaaaacaga

SEQ ID NO: 3725736 - RNA, 20 nt, Salmonella enterica enterica serovar Typhi Ty2
ugucaugcuaaaacagauaa

SEQ ID NO: 3725737 - RNA, 21 nt, Salmonella enterica enterica serovar Typhi Ty2
ugucauggcgccaccagcgau

SEQ ID NO: 3725738 - RNA, 17 nt, Salmonella enterica enterica serovar Typhi Ty2
ugucaugguaaaugccg

SEQ ID NO: 3725739 - RNA, 14 nt, Salmonella enterica enterica serovar Typhi Ty2
uguccaaacuggcu

SEQ ID NO: 3725740 - RNA, 17 nt, Salmonella enterica enterica serovar Typhi Ty2
uguccaccgauuucauc

SEQ ID NO: 3725741 - RNA, 18 nt, Salmonella enterica enterica serovar Typhi Ty2
uguccacggggcggcaau

SEQ ID NO: 3725742 - RNA, 20 nt, Salmonella enterica enterica serovar Typhi Ty2
uguccaggucaucaccucca

SEQ ID NO: 3725743 - RNA, 22 nt, Salmonella enterica enterica serovar Typhi Ty2
uguccaggucaucaccuccagc

SEQ ID NO: 3725744 - RNA, 17 nt, Salmonella enterica enterica serovar Typhi Ty2
uguccaguuuuuuacuu

SEQ ID NO: 3725745 - RNA, 13 nt, Salmonella enterica enterica serovar Typhi Ty2
uguccauaaaaug

SEQ ID NO: 3725746 - RNA, 20 nt, Salmonella enterica enterica serovar Typhi Ty2
uguccaugacgaccacagcc

SEQ ID NO: 3725747 - RNA, 23 nt, Salmonella enterica enterica serovar Typhi Ty2
uguccauguuuuauacucaaaaa

SEQ ID NO: 3725748 - RNA, 17 nt, Salmonella enterica enterica serovar Typhi Ty2
uguccgcaauccccugg

SEQ ID NO: 3725749 - RNA, 22 nt, Salmonella enterica enterica serovar Typhi Ty2
uguccgcauucuugccgcaucu

SEQ ID NO: 3725750 - RNA, 20 nt, Salmonella enterica enterica serovar Typhi Ty2
uguccgcccaguaccagcac

SEQ ID NO: 3725751 - RNA, 20 nt, Salmonella enterica enterica serovar Typhi Ty2
uguccgccuuaucaggccug

SEQ ID NO: 3725752 - RNA, 13 nt, Salmonella enterica enterica serovar Typhi Ty2
uguccgcugcugu

SEQ ID NO: 3725753 - RNA, 15 nt, Salmonella enterica enterica serovar Typhi Ty2
uguccggaauaacuc

SEQ ID NO: 3725754 - RNA, 16 nt, Salmonella enterica enterica serovar Typhi Ty2
uguccggcgacuccag

SEQ ID NO: 3725755 - RNA, 19 nt, Salmonella enterica enterica serovar Typhi Ty2
uguccggcgacuccagaau

SEQ ID NO: 3725756 - RNA, 21 nt, Salmonella enterica enterica serovar Typhi Ty2
uguccggcguuuuagcgccau

SEQ ID NO: 3725757 - RNA, 22 nt, Salmonella enterica enterica serovar Typhi Ty2
uguccgguauugauuagcuuuu

SEQ ID NO: 3725758 - RNA, 16 nt, Salmonella enterica enterica serovar Typhi Ty2
uguccguuuucucaaa

SEQ ID NO: 3725759 - RNA, 18 nt, Salmonella enterica enterica serovar Typhi Ty2
uguccuacacucaauacg

SEQ ID NO: 3725760 - RNA, 15 nt, Salmonella enterica enterica serovar Typhi Ty2
uguccugcagcgcca

SEQ ID NO: 3725761 - RNA, 15 nt, Salmonella enterica enterica serovar Typhi Ty2
uguccuuuacugcgc

SEQ ID NO: 3725762 - RNA, 23 nt, Salmonella enterica enterica serovar Typhi Ty2
uguccuuuacugcgccagccugc

SEQ ID NO: 3725763 - RNA, 21 nt, Salmonella enterica enterica serovar Typhi Ty2
uguccuuuaucugcccuuucu

SEQ ID NO: 3725764 - RNA, 15 nt, Salmonella enterica enterica serovar Typhi Ty2
uguccuuucugcugc

SEQ ID NO: 3725765 - RNA, 22 nt, Salmonella enterica enterica serovar Typhi Ty2
uguccuuugcuacaccccuucu

SEQ ID NO: 3725766 - RNA, 15 nt, Salmonella enterica enterica serovar Typhi Ty2
ugucgaaaccagcau

SEQ ID NO: 3725767 - RNA, 16 nt, Salmonella enterica enterica serovar Typhi Ty2
ugucgaaaccagcaua

SEQ ID NO: 3725768 - RNA, 13 nt, Salmonella enterica enterica serovar Typhi Ty2
ugucgaauuccgc

SEQ ID NO: 3725769 - RNA, 14 nt, Salmonella enterica enterica serovar Typhi Ty2
ugucgaauuccgcc

SEQ ID NO: 3725770 - RNA, 15 nt, Salmonella enterica enterica serovar Typhi Ty2
ugucgauaaacucau

SEQ ID NO: 3725771 - RNA, 15 nt, Salmonella enterica enterica serovar Typhi Ty2
ugucgauaacagcau

SEQ ID NO: 3725772 - RNA, 21 nt, Salmonella enterica enterica serovar Typhi Ty2
ugucgaucaucagacccgcau

SEQ ID NO: 3725773 - RNA, 22 nt, Salmonella enterica enterica serovar Typhi Ty2
ugucgaugagcucguuauaagc

SEQ ID NO: 3725774 - RNA, 20 nt, Salmonella enterica enterica serovar Typhi Ty2
ugucgauuuccgguuccagc

SEQ ID NO: 3725775 - RNA, 16 nt, Salmonella enterica enterica serovar Typhi Ty2
ugucgcaaaccaccgg

SEQ ID NO: 3725776 - RNA, 21 nt, Salmonella enterica enterica serovar Typhi Ty2
ugucgccauaucuucgcgcgu

SEQ ID NO: 3725777 - RNA, 14 nt, Salmonella enterica enterica serovar Typhi Ty2
ugucgcccgcucag

SEQ ID NO: 3725778 - RNA, 17 nt, Salmonella enterica enterica serovar Typhi Ty2
ugucgccggggcgcugg

SEQ ID NO: 3725779 - RNA, 22 nt, Salmonella enterica enterica serovar Typhi Ty2
ugucgccugcuguugggcagga

SEQ ID NO: 3725780 - RNA, 23 nt, Salmonella enterica enterica serovar Typhi Ty2
ugucgccugcuguugggcaggag

SEQ ID NO: 3725781 - RNA, 21 nt, Salmonella enterica enterica serovar Typhi Ty2
ugucgcggauaugcagcagcc

SEQ ID NO: 3725782 - RNA, 17 nt, Salmonella enterica enterica serovar Typhi Ty2
ugucgcggcggcaaaag

SEQ ID NO: 3725783 - RNA, 18 nt, Salmonella enterica enterica serovar Typhi Ty2
ugucgcuggauagcacca

SEQ ID NO: 3725784 - RNA, 18 nt, Salmonella enterica enterica serovar Typhi Ty2
ugucggccugauuucuga

SEQ ID NO: 3725785 - RNA, 19 nt, Salmonella enterica enterica serovar Typhi Ty2
ugucgggcaaaaugcgucg

SEQ ID NO: 3725786 - RNA, 22 nt, Salmonella enterica enterica serovar Typhi Ty2
ugucgggccaaucggagugaau

SEQ ID NO: 3725787 - RNA, 20 nt, Salmonella enterica enterica serovar Typhi Ty2
ugucggucaggcugcggaca

SEQ ID NO: 3725788 - RNA, 12 nt, Salmonella enterica enterica serovar Typhi Ty2
ugucggucugau

SEQ ID NO: 3725789 - RNA, 15 nt, Salmonella enterica enterica serovar Typhi Ty2
ugucgucgauuuucu

SEQ ID NO: 3725790 - RNA, 22 nt, Salmonella enterica enterica serovar Typhi Ty2
ugucguuaaugcucuuaaaaug

SEQ ID NO: 3725791 - RNA, 22 nt, Salmonella enterica enterica serovar Typhi Ty2
ugucguuccacacguccauccg

SEQ ID NO: 3725792 - RNA, 16 nt, Salmonella enterica enterica serovar Typhi Ty2
ugucuauaggccugau

SEQ ID NO: 3725793 - RNA, 19 nt, Salmonella enterica enterica serovar Typhi Ty2
ugucucacccguuuucucc

SEQ ID NO: 3725794 - RNA, 13 nt, Salmonella enterica enterica serovar Typhi Ty2
ugucuccucagca

SEQ ID NO: 3725795 - RNA, 14 nt, Salmonella enterica enterica serovar Typhi Ty2
ugucuccucaugcc

SEQ ID NO: 3725796 - RNA, 13 nt, Salmonella enterica enterica serovar Typhi Ty2
ugucucuccagua

SEQ ID NO: 3725797 - RNA, 14 nt, Salmonella enterica enterica serovar Typhi Ty2
ugucugaaugaguc

SEQ ID NO: 3725798 - RNA, 22 nt, Salmonella enterica enterica serovar Typhi Ty2
ugucugccucggguggcaucug

SEQ ID NO: 3725799 - RNA, 23 nt, Salmonella enterica enterica serovar Typhi Ty2
ugucugcgcaacgcuuccaccuc

SEQ ID NO: 3725800 - RNA, 15 nt, Salmonella enterica enterica serovar Typhi Ty2
ugucuuaaagaaaaa

SEQ ID NO: 3725801 - RNA, 19 nt, Salmonella enterica enterica serovar Typhi Ty2
ugucuuaccuaacggauaa

SEQ ID NO: 3725802 - RNA, 13 nt, Salmonella enterica enterica serovar Typhi Ty2
ugucuucaucuau

SEQ ID NO: 3725803 - RNA, 13 nt, Salmonella enterica enterica serovar Typhi Ty2
ugugaauaaagga

SEQ ID NO: 3725804 - RNA, 14 nt, Salmonella enterica enterica serovar Typhi Ty2
ugugaauaaaggau

SEQ ID NO: 3725805 - RNA, 19 nt, Salmonella enterica enterica serovar Typhi Ty2
ugugaauaugaucugcaca

SEQ ID NO: 3725806 - RNA, 19 nt, Salmonella enterica enterica serovar Typhi Ty2
ugugaauaugaucugcgca

SEQ ID NO: 3725807 - RNA, 16 nt, Salmonella enterica enterica serovar Typhi Ty2
ugugaauccaggccag

SEQ ID NO: 3725808 - RNA, 14 nt, Salmonella enterica enterica serovar Typhi Ty2
ugugacggcauguc

SEQ ID NO: 3725809 - RNA, 23 nt, Salmonella enterica enterica serovar Typhi Ty2
ugugagaaaagcgaaaauaaacg

SEQ ID NO: 3725810 - RNA, 21 nt, Salmonella enterica enterica serovar Typhi Ty2
ugugagcacagguuucaggua

SEQ ID NO: 3725811 - RNA, 12 nt, Salmonella enterica enterica serovar Typhi Ty2
ugugagccauaa

SEQ ID NO: 3725812 - RNA, 15 nt, Salmonella enterica enterica serovar Typhi Ty2
ugugaguaaagagau

SEQ ID NO: 3725813 - RNA, 11 nt, Salmonella enterica enterica serovar Typhi Ty2
ugugauaaaug

SEQ ID NO: 3725814 - RNA, 14 nt, Salmonella enterica enterica serovar Typhi Ty2
ugugauaccgccug

SEQ ID NO: 3725815 - RNA, 20 nt, Salmonella enterica enterica serovar Typhi Ty2
ugugaucugguuugguaaag

SEQ ID NO: 3725816 - RNA, 22 nt, Salmonella enterica enterica serovar Typhi Ty2
ugugauugcagauaauuuugca

SEQ ID NO: 3725817 - RNA, 16 nt, Salmonella enterica enterica serovar Typhi Ty2
ugugauuuugcuggug

SEQ ID NO: 3725818 - RNA, 15 nt, Salmonella enterica enterica serovar Typhi Ty2
ugugcacagguaaac

SEQ ID NO: 3725819 - RNA, 19 nt, Salmonella enterica enterica serovar Typhi Ty2
ugugcagugacagaggaau

SEQ ID NO: 3725820 - RNA, 15 nt, Salmonella enterica enterica serovar Typhi Ty2
ugugccaauaacgcc

SEQ ID NO: 3725821 - RNA, 17 nt, Salmonella enterica enterica serovar Typhi Ty2
ugugccgaagucaaagg

SEQ ID NO: 3725822 - RNA, 16 nt, Salmonella enterica enterica serovar Typhi Ty2
ugugccgguaagaaga

SEQ ID NO: 3725823 - RNA, 15 nt, Salmonella enterica enterica serovar Typhi Ty2
ugugccgucauccag

SEQ ID NO: 3725824 - RNA, 23 nt, Salmonella enterica enterica serovar Typhi Ty2
ugugcgacaacaaugaaacgguu

SEQ ID NO: 3725825 - RNA, 16 nt, Salmonella enterica enterica serovar Typhi Ty2
ugugcucgauauauuu

SEQ ID NO: 3725826 - RNA, 19 nt, Salmonella enterica enterica serovar Typhi Ty2
ugugcucgauauauuuucc

SEQ ID NO: 3725827 - RNA, 16 nt, Salmonella enterica enterica serovar Typhi Ty2
ugugcugauugucagc

SEQ ID NO: 3725828 - RNA, 12 nt, Salmonella enterica enterica serovar Typhi Ty2
ugugcugguuga

SEQ ID NO: 3725829 - RNA, 22 nt, Salmonella enterica enterica serovar Typhi Ty2
ugugcuuaucacguagccagag

SEQ ID NO: 3725830 - RNA, 12 nt, Salmonella enterica enterica serovar Typhi Ty2
ugugcuuccagc

SEQ ID NO: 3725831 - RNA, 15 nt, Salmonella enterica enterica serovar Typhi Ty2
ugugcuuccagcucc

SEQ ID NO: 3725832 - RNA, 17 nt, Salmonella enterica enterica serovar Typhi Ty2
ugugcuuccagcuccau

SEQ ID NO: 3725833 - RNA, 11 nt, Salmonella enterica enterica serovar Typhi Ty2
ugugcuuuagc

SEQ ID NO: 3725834 - RNA, 21 nt, Salmonella enterica enterica serovar Typhi Ty2
uguggaaaacagcgccggcag

SEQ ID NO: 3725835 - RNA, 15 nt, Salmonella enterica enterica serovar Typhi Ty2
uguggagguuucuuc

SEQ ID NO: 3725836 - RNA, 14 nt, Salmonella enterica enterica serovar Typhi Ty2
uguggccaggcacg

SEQ ID NO: 3725837 - RNA, 21 nt, Salmonella enterica enterica serovar Typhi Ty2
uguggccagggcaggcaguga

SEQ ID NO: 3725838 - RNA, 17 nt, Salmonella enterica enterica serovar Typhi Ty2
uguggccugcucuacuc

SEQ ID NO: 3725839 - RNA, 13 nt, Salmonella enterica enterica serovar Typhi Ty2
uguggccugcuua

SEQ ID NO: 3725840 - RNA, 16 nt, Salmonella enterica enterica serovar Typhi Ty2
uguggcgcggccugga

SEQ ID NO: 3725841 - RNA, 19 nt, Salmonella enterica enterica serovar Typhi Ty2
uguggcuguguucauccca

SEQ ID NO: 3725842 - RNA, 19 nt, Salmonella enterica enterica serovar Typhi Ty2
ugugguguuccauugcugc

SEQ ID NO: 3725843 - RNA, 13 nt, Salmonella enterica enterica serovar Typhi Ty2
ugugguuuaaaac

SEQ ID NO: 3725844 - RNA, 21 nt, Salmonella enterica enterica serovar Typhi Ty2
uguguaauguuuucugccagc

SEQ ID NO: 3725845 - RNA, 18 nt, Salmonella enterica enterica serovar Typhi Ty2
uguguaccagcagcgcca

SEQ ID NO: 3725846 - RNA, 22 nt, Salmonella enterica enterica serovar Typhi Ty2
uguguaccagcagcgccagcga

SEQ ID NO: 3725847 - RNA, 21 nt, Salmonella enterica enterica serovar Typhi Ty2
uguguauauauugcauuuuau

SEQ ID NO: 3725848 - RNA, 14 nt, Salmonella enterica enterica serovar Typhi Ty2
ugugucaccacggg

SEQ ID NO: 3725849 - RNA, 15 nt, Salmonella enterica enterica serovar Typhi Ty2
ugugucguccaggcc

SEQ ID NO: 3725850 - RNA, 20 nt, Salmonella enterica enterica serovar Typhi Ty2
ugugugagcgcccgccgcga

SEQ ID NO: 3725851 - RNA, 24 nt, Salmonella enterica enterica serovar Typhi Ty2
uguguugcucaaaaaagaguaaag

SEQ ID NO: 3725852 - RNA, 23 nt, Salmonella enterica enterica serovar Typhi Ty2
uguuaauccagagcggauaaaua

SEQ ID NO: 3725853 - RNA, 14 nt, Salmonella enterica enterica serovar Typhi Ty2
uguuaauugucagc

SEQ ID NO: 3725854 - RNA, 21 nt, Salmonella enterica enterica serovar Typhi Ty2
uguuaauuugcaucaggccaa

SEQ ID NO: 3725855 - RNA, 12 nt, Salmonella enterica enterica serovar Typhi Ty2
uguuacccagcc

SEQ ID NO: 3725856 - RNA, 18 nt, Salmonella enterica enterica serovar Typhi Ty2
uguuacgcugguuugugu

SEQ ID NO: 3725857 - RNA, 16 nt, Salmonella enterica enterica serovar Typhi Ty2
uguuacugucggcgau

SEQ ID NO: 3725858 - RNA, 22 nt, Salmonella enterica enterica serovar Typhi Ty2
uguuagacauuccauuggccag

SEQ ID NO: 3725859 - RNA, 16 nt, Salmonella enterica enterica serovar Typhi Ty2
uguuagcaaaaaugcc

SEQ ID NO: 3725860 - RNA, 15 nt, Salmonella enterica enterica serovar Typhi Ty2
uguuaguguccuuac

SEQ ID NO: 3725861 - RNA, 14 nt, Salmonella enterica enterica serovar Typhi Ty2
uguuaguuucuauu

SEQ ID NO: 3725862 - RNA, 15 nt, Salmonella enterica enterica serovar Typhi Ty2
uguuaguuucuauua

SEQ ID NO: 3725863 - RNA, 21 nt, Salmonella enterica enterica serovar Typhi Ty2
uguuaucaugugaucuauaua

SEQ ID NO: 3725864 - RNA, 15 nt, Salmonella enterica enterica serovar Typhi Ty2
uguuauggcaggcga

SEQ ID NO: 3725865 - RNA, 21 nt, Salmonella enterica enterica serovar Typhi Ty2
uguuauuuacaaggaaagucu

SEQ ID NO: 3725866 - RNA, 13 nt, Salmonella enterica enterica serovar Typhi Ty2
uguucaacuuuuc

SEQ ID NO: 3725867 - RNA, 14 nt, Salmonella enterica enterica serovar Typhi Ty2
uguucaagcaauaa

SEQ ID NO: 3725868 - RNA, 16 nt, Salmonella enterica enterica serovar Typhi Ty2
uguucaauauuccugg

SEQ ID NO: 3725869 - RNA, 13 nt, Salmonella enterica enterica serovar Typhi Ty2
uguucacaauugu

SEQ ID NO: 3725870 - RNA, 20 nt, Salmonella enterica enterica serovar Typhi Ty2
uguucagaaaucggcagcac

SEQ ID NO: 3725871 - RNA, 18 nt, Salmonella enterica enterica serovar Typhi Ty2
uguucagauggccaauga

SEQ ID NO: 3725872 - RNA, 20 nt, Salmonella enterica enterica serovar Typhi Ty2
uguucagugccauccauauu

SEQ ID NO: 3725873 - RNA, 18 nt, Salmonella enterica enterica serovar Typhi Ty2
uguucauaaagugccagg

SEQ ID NO: 3725874 - RNA, 21 nt, Salmonella enterica enterica serovar Typhi Ty2
uguucaucaaagaaaaccacg

SEQ ID NO: 3725875 - RNA, 15 nt, Salmonella enterica enterica serovar Typhi Ty2
uguucauccauauau

SEQ ID NO: 3725876 - RNA, 22 nt, Salmonella enterica enterica serovar Typhi Ty2
uguucauccauauaucugaaua

SEQ ID NO: 3725877 - RNA, 14 nt, Salmonella enterica enterica serovar Typhi Ty2
uguuccaccugcgg

SEQ ID NO: 3725878 - RNA, 10 nt, Salmonella enterica enterica serovar Typhi Ty2
uguuccggcg

SEQ ID NO: 3725879 - RNA, 12 nt, Salmonella enterica enterica serovar Typhi Ty2
uguuccucuuuc

SEQ ID NO: 3725880 - RNA, 14 nt, Salmonella enterica enterica serovar Typhi Ty2
uguuccucuuuccc

SEQ ID NO: 3725881 - RNA, 14 nt, Salmonella enterica enterica serovar Typhi Ty2
uguuccugagcaga

SEQ ID NO: 3725882 - RNA, 22 nt, Salmonella enterica enterica serovar Typhi Ty2
uguuccuggacguggguuucaa

SEQ ID NO: 3725883 - RNA, 20 nt, Salmonella enterica enterica serovar Typhi Ty2
uguucgagggcgauuuugac

SEQ ID NO: 3725884 - RNA, 23 nt, Salmonella enterica enterica serovar Typhi Ty2
uguucgcaaccuaaccaaacaga

SEQ ID NO: 3725885 - RNA, 21 nt, Salmonella enterica enterica serovar Typhi Ty2
uguucgcuucuucuaccaccu

SEQ ID NO: 3725886 - RNA, 13 nt, Salmonella enterica enterica serovar Typhi Ty2
uguucuuccauug

SEQ ID NO: 3725887 - RNA, 13 nt, Salmonella enterica enterica serovar Typhi Ty2
uguugaccagguc

SEQ ID NO: 3725888 - RNA, 16 nt, Salmonella enterica enterica serovar Typhi Ty2
uguugacgacuuuugc

SEQ ID NO: 3725889 - RNA, 12 nt, Salmonella enterica enterica serovar Typhi Ty2
uguugacugcgc

SEQ ID NO: 3725890 - RNA, 22 nt, Salmonella enterica enterica serovar Typhi Ty2
uguugaguucccuucuccucaa

SEQ ID NO: 3725891 - RNA, 13 nt, Salmonella enterica enterica serovar Typhi Ty2
uguugauacagaa

SEQ ID NO: 3725892 - RNA, 23 nt, Salmonella enterica enterica serovar Typhi Ty2
uguugauauggugcgcuuuuggc

SEQ ID NO: 3725893 - RNA, 22 nt, Salmonella enterica enterica serovar Typhi Ty2
uguugaugauggcuccuguugg

SEQ ID NO: 3725894 - RNA, 15 nt, Salmonella enterica enterica serovar Typhi Ty2
uguugaugucacuca

SEQ ID NO: 3725895 - RNA, 20 nt, Salmonella enterica enterica serovar Typhi Ty2
uguugauugaaacucgccau

SEQ ID NO: 3725896 - RNA, 21 nt, Salmonella enterica enterica serovar Typhi Ty2
uguugcaccuguuucugcugg

SEQ ID NO: 3725897 - RNA, 14 nt, Salmonella enterica enterica serovar Typhi Ty2
uguugccgacagcg

SEQ ID NO: 3725898 - RNA, 23 nt, Salmonella enterica enterica serovar Typhi Ty2
uguugccgcccguuuuuuccagc

SEQ ID NO: 3725899 - RNA, 16 nt, Salmonella enterica enterica serovar Typhi Ty2
uguugcgcaagcacug

SEQ ID NO: 3725900 - RNA, 21 nt, Salmonella enterica enterica serovar Typhi Ty2
uguugcggaugaccgcaaacc

SEQ ID NO: 3725901 - RNA, 22 nt, Salmonella enterica enterica serovar Typhi Ty2
uguugcgggccagcagccaggc

SEQ ID NO: 3725902 - RNA, 16 nt, Salmonella enterica enterica serovar Typhi Ty2
uguugcucaaaaaaga

SEQ ID NO: 3725903 - RNA, 16 nt, Salmonella enterica enterica serovar Typhi Ty2
uguugcuccagcauca

SEQ ID NO: 3725904 - RNA, 23 nt, Salmonella enterica enterica serovar Typhi Ty2
uguuggaaaugcguggcauuaac

SEQ ID NO: 3725905 - RNA, 22 nt, Salmonella enterica enterica serovar Typhi Ty2
uguuggugcgcguugccaucgg

SEQ ID NO: 3725906 - RNA, 13 nt, Salmonella enterica enterica serovar Typhi Ty2
uguugguuuaaac

SEQ ID NO: 3725907 - RNA, 17 nt, Salmonella enterica enterica serovar Typhi Ty2
uguuguaaagaaauuua

SEQ ID NO: 3725908 - RNA, 14 nt, Salmonella enterica enterica serovar Typhi Ty2
uguuguacagcaau

SEQ ID NO: 3725909 - RNA, 22 nt, Salmonella enterica enterica serovar Typhi Ty2
uguuguacagcaauaaaaggaa

SEQ ID NO: 3725910 - RNA, 18 nt, Salmonella enterica enterica serovar Typhi Ty2
uguugucgagguuauaaa

SEQ ID NO: 3725911 - RNA, 21 nt, Salmonella enterica enterica serovar Typhi Ty2
uguuguucuuuucuuucagcu

SEQ ID NO: 3725912 - RNA, 15 nt, Salmonella enterica enterica serovar Typhi Ty2
uguuuaaaaucaacg

SEQ ID NO: 3725913 - RNA, 18 nt, Salmonella enterica enterica serovar Typhi Ty2
uguuuaauggcagaauaa

SEQ ID NO: 3725914 - RNA, 19 nt, Salmonella enterica enterica serovar Typhi Ty2
ucacccggauacgcggcac

SEQ ID NO: 3725915 - RNA, 16 nt, Salmonella enterica enterica serovar Typhi Ty2
ucacccugaauuucaa

SEQ ID NO: 3725916 - RNA, 15 nt, Salmonella enterica enterica serovar Typhi Ty2
ucaccgaccugccuu

SEQ ID NO: 3725917 - RNA, 17 nt, Salmonella enterica enterica serovar Typhi Ty2
ucaccgaugacauuacc

SEQ ID NO: 3725918 - RNA, 19 nt, Salmonella enterica enterica serovar Typhi Ty2
ucaccgcaaauucgucgcc

SEQ ID NO: 3725919 - RNA, 14 nt, Salmonella enterica enterica serovar Typhi Ty2
ucaccgcaugacaa

SEQ ID NO: 3725920 - RNA, 16 nt, Salmonella enterica enterica serovar Typhi Ty2
ucaccgccagcaacgc

SEQ ID NO: 3725921 - RNA, 21 nt, Salmonella enterica enterica serovar Typhi Ty2
ucaccgcccaaugcccccauc

SEQ ID NO: 3725922 - RNA, 19 nt, Salmonella enterica enterica serovar Typhi Ty2
ucaccggauacccagccac

SEQ ID NO: 3725923 - RNA, 15 nt, Salmonella enterica enterica serovar Typhi Ty2
ucaccggcgugcgcu

SEQ ID NO: 3725924 - RNA, 22 nt, Salmonella enterica enterica serovar Typhi Ty2
ucaccggcuguauacacuuucc

SEQ ID NO: 3725925 - RNA, 20 nt, Salmonella enterica enterica serovar Typhi Ty2
ucaccgucacugaaccugcc

SEQ ID NO: 3725926 - RNA, 18 nt, Salmonella enterica enterica serovar Typhi Ty2
ucaccguccgccaggccc

SEQ ID NO: 3725927 - RNA, 13 nt, Salmonella enterica enterica serovar Typhi Ty2
ucaccgucggacu

SEQ ID NO: 3725928 - RNA, 19 nt, Salmonella enterica enterica serovar Typhi Ty2
ucaccguggcaucaucaaa

SEQ ID NO: 3725929 - RNA, 18 nt, Salmonella enterica enterica serovar Typhi Ty2
ucaccguuuaaaaacauc

SEQ ID NO: 3725930 - RNA, 13 nt, Salmonella enterica enterica serovar Typhi Ty2
ucaccucccugca

SEQ ID NO: 3725931 - RNA, 13 nt, Salmonella enterica enterica serovar Typhi Ty2
ucaccuccgccac

SEQ ID NO: 3725932 - RNA, 19 nt, Salmonella enterica enterica serovar Typhi Ty2
ucaccucuaccggggcgcu

SEQ ID NO: 3725933 - RNA, 16 nt, Salmonella enterica enterica serovar Typhi Ty2
ucaccucuuccccggu

SEQ ID NO: 3725934 - RNA, 13 nt, Salmonella enterica enterica serovar Typhi Ty2
ucaccucuucgcu

SEQ ID NO: 3725935 - RNA, 21 nt, Salmonella enterica enterica serovar Typhi Ty2
ucaccucuucgcuguuaaccu

SEQ ID NO: 3725936 - RNA, 14 nt, Salmonella enterica enterica serovar Typhi Ty2
ucaccugauagcgg

SEQ ID NO: 3725937 - RNA, 16 nt, Salmonella enterica enterica serovar Typhi Ty2
ucaccuggaugcugcc

SEQ ID NO: 3725938 - RNA, 21 nt, Salmonella enterica enterica serovar Typhi Ty2
ucaccuggauuccuccaauuc

SEQ ID NO: 3725939 - RNA, 14 nt, Salmonella enterica enterica serovar Typhi Ty2
ucaccuguggcaga

SEQ ID NO: 3725940 - RNA, 13 nt, Salmonella enterica enterica serovar Typhi Ty2
ucaccuucgguga

SEQ ID NO: 3725941 - RNA, 17 nt, Salmonella enterica enterica serovar Typhi Ty2
ucaccuucugcgcagga

SEQ ID NO: 3725942 - RNA, 17 nt, Salmonella enterica enterica serovar Typhi Ty2
ucacgaaauaacgcacu

SEQ ID NO: 3725943 - RNA, 13 nt, Salmonella enterica enterica serovar Typhi Ty2
ucacgauagcgcc

SEQ ID NO: 3725944 - RNA, 19 nt, Salmonella enterica enterica serovar Typhi Ty2
ucacgauccgcaaauuacu

SEQ ID NO: 3725945 - RNA, 18 nt, Salmonella enterica enterica serovar Typhi Ty2
ucacgaucgagucaggcg

SEQ ID NO: 3725946 - RNA, 12 nt, Salmonella enterica enterica serovar Typhi Ty2
ucacgaucgcgg

SEQ ID NO: 3725947 - RNA, 18 nt, Salmonella enterica enterica serovar Typhi Ty2
ucacgcagugcgcgaccg

SEQ ID NO: 3725948 - RNA, 22 nt, Salmonella enterica enterica serovar Typhi Ty2
ucacgcauggcguugcugcaaa

SEQ ID NO: 3725949 - RNA, 22 nt, Salmonella enterica enterica serovar Typhi Ty2
ucacgcauugccacagccucag

SEQ ID NO: 3725950 - RNA, 14 nt, Salmonella enterica enterica serovar Typhi Ty2
ucacgccaucaggg

SEQ ID NO: 3725951 - RNA, 11 nt, Salmonella enterica enterica serovar Typhi Ty2
ucacgccaucg

SEQ ID NO: 3725952 - RNA, 21 nt, Salmonella enterica enterica serovar Typhi Ty2
ucacgccauuaucgaacugaa

SEQ ID NO: 3725953 - RNA, 22 nt, Salmonella enterica enterica serovar Typhi Ty2
ucacgcccgccgaaggcaacgc

SEQ ID NO: 3725954 - RNA, 23 nt, Salmonella enterica enterica serovar Typhi Ty2
ucacgccgugaauuucugcugcc

SEQ ID NO: 3725955 - RNA, 12 nt, Salmonella enterica enterica serovar Typhi Ty2
ucacgcggcgcg

SEQ ID NO: 3725956 - RNA, 21 nt, Salmonella enterica enterica serovar Typhi Ty2
ucacgcucaauggcgcgccag

SEQ ID NO: 3725957 - RNA, 17 nt, Salmonella enterica enterica serovar Typhi Ty2
ucacgcucuucgccaau

SEQ ID NO: 3725958 - RNA, 21 nt, Salmonella enterica enterica serovar Typhi Ty2
ucacgcugacaggauacccgg

SEQ ID NO: 3725959 - RNA, 21 nt, Salmonella enterica enterica serovar Typhi Ty2
ucacgcuggugcgcgggagau

SEQ ID NO: 3725960 - RNA, 14 nt, Salmonella enterica enterica serovar Typhi Ty2
ucacgcuuaucgcc

SEQ ID NO: 3725961 - RNA, 13 nt, Salmonella enterica enterica serovar Typhi Ty2
ucacgcuugcccg

SEQ ID NO: 3725962 - RNA, 16 nt, Salmonella enterica enterica serovar Typhi Ty2
ucacggcacgcccuuc

SEQ ID NO: 3725963 - RNA, 19 nt, Salmonella enterica enterica serovar Typhi Ty2
ucacggcaucugcggcaug

SEQ ID NO: 3725964 - RNA, 22 nt, Salmonella enterica enterica serovar Typhi Ty2
ucacgguacgcaucaccaggca

SEQ ID NO: 3725965 - RNA, 23 nt, Salmonella enterica enterica serovar Typhi Ty2
ucacgguauucguuaccagcauc

SEQ ID NO: 3725966 - RNA, 23 nt, Salmonella enterica enterica serovar Typhi Ty2
ucaggcaauaaacaucagccauu

SEQ ID NO: 3725967 - RNA, 23 nt, Salmonella enterica enterica serovar Typhi Ty2
ucaggcaaucuuuaacgcuggca

SEQ ID NO: 3725968 - RNA, 23 nt, Salmonella enterica enterica serovar Typhi Ty2
ucaggcacagaagcgccugucua

SEQ ID NO: 3725969 - RNA, 16 nt, Salmonella enterica enterica serovar Typhi Ty2
ucaggcacgugcauaa

SEQ ID NO: 3725970 - RNA, 15 nt, Salmonella enterica enterica serovar Typhi Ty2
ucaggcacuggcuua

SEQ ID NO: 3725971 - RNA, 14 nt, Salmonella enterica enterica serovar Typhi Ty2
ucaggcagaaauaa

SEQ ID NO: 3725972 - RNA, 19 nt, Salmonella enterica enterica serovar Typhi Ty2
ucaggcaguuuauccggcg

SEQ ID NO: 3725973 - RNA, 23 nt, Salmonella enterica enterica serovar Typhi Ty2
ucaggcaucaacguuguccagcg

SEQ ID NO: 3725974 - RNA, 14 nt, Salmonella enterica enterica serovar Typhi Ty2
ucaggcauccugcc

SEQ ID NO: 3725975 - RNA, 14 nt, Salmonella enterica enterica serovar Typhi Ty2
ucaggcaucugaaa

SEQ ID NO: 3725976 - RNA, 18 nt, Salmonella enterica enterica serovar Typhi Ty2
ucaggcaucugaaaugcu

SEQ ID NO: 3725977 - RNA, 21 nt, Salmonella enterica enterica serovar Typhi Ty2
ucaggcauguugcgcaaucac

SEQ ID NO: 3725978 - RNA, 13 nt, Salmonella enterica enterica serovar Typhi Ty2
ucaggccauuaac

SEQ ID NO: 3725979 - RNA, 12 nt, Salmonella enterica enterica serovar Typhi Ty2
ucaggccgccag

SEQ ID NO: 3725980 - RNA, 16 nt, Salmonella enterica enterica serovar Typhi Ty2
ucaggccgccagcaaa

SEQ ID NO: 3725981 - RNA, 21 nt, Salmonella enterica enterica serovar Typhi Ty2
ucaggccgccgcaaaagccgg

SEQ ID NO: 3725982 - RNA, 18 nt, Salmonella enterica enterica serovar Typhi Ty2
ucaggccgccgcacaggc

SEQ ID NO: 3725983 - RNA, 17 nt, Salmonella enterica enterica serovar Typhi Ty2
ucaggccuacauccggc

SEQ ID NO: 3725984 - RNA, 15 nt, Salmonella enterica enterica serovar Typhi Ty2
ucaggccugccugau

SEQ ID NO: 3725985 - RNA, 19 nt, Salmonella enterica enterica serovar Typhi Ty2
ucaggcgauagccguccau

SEQ ID NO: 3725986 - RNA, 16 nt, Salmonella enterica enterica serovar Typhi Ty2
ucaggcgcauaucgcc

SEQ ID NO: 3725987 - RNA, 16 nt, Salmonella enterica enterica serovar Typhi Ty2
ucaggcgcgcgcugug

SEQ ID NO: 3725988 - RNA, 14 nt, Salmonella enterica enterica serovar Typhi Ty2
ucaggcggauauau

SEQ ID NO: 3725989 - RNA, 15 nt, Salmonella enterica enterica serovar Typhi Ty2
ucaggcggcugcgca

SEQ ID NO: 3725990 - RNA, 16 nt, Salmonella enterica enterica serovar Typhi Ty2
ucaggcgucagcaugg

SEQ ID NO: 3725991 - RNA, 18 nt, Salmonella enterica enterica serovar Typhi Ty2
ucaggcguuagccgccau

SEQ ID NO: 3725992 - RNA, 23 nt, Salmonella enterica enterica serovar Typhi Ty2
ucaggcuaucggcgggguuuaac

SEQ ID NO: 3725993 - RNA, 18 nt, Salmonella enterica enterica serovar Typhi Ty2
ucaggcucgcaaauaauc

SEQ ID NO: 3725994 - RNA, 22 nt, Salmonella enterica enterica serovar Typhi Ty2
ucaggcucgucgccuuccagcg

SEQ ID NO: 3725995 - RNA, 16 nt, Salmonella enterica enterica serovar Typhi Ty2
ucaggcuuugcgccau

SEQ ID NO: 3725996 - RNA, 12 nt, Salmonella enterica enterica serovar Typhi Ty2
ucagggaaaaau

SEQ ID NO: 3725997 - RNA, 14 nt, Salmonella enterica enterica serovar Typhi Ty2
ucagggaaagccag

SEQ ID NO: 3725998 - RNA, 17 nt, Salmonella enterica enterica serovar Typhi Ty2
ucagggaguggguaccu

SEQ ID NO: 3725999 - RNA, 19 nt, Salmonella enterica enterica serovar Typhi Ty2
ucagggcaaaaaugaucac

SEQ ID NO: 3726000 - RNA, 14 nt, Salmonella enterica enterica serovar Typhi Ty2
ucagggcaaggcgg

SEQ ID NO: 3726001 - RNA, 18 nt, Salmonella enterica enterica serovar Typhi Ty2
ucagggguccccacggga

SEQ ID NO: 3726002 - RNA, 14 nt, Salmonella enterica enterica serovar Typhi Ty2
ucaggguaucuaac

SEQ ID NO: 3726003 - RNA, 20 nt, Salmonella enterica enterica serovar Typhi Ty2
ucagggucuuauuucuccug

SEQ ID NO: 3726004 - RNA, 19 nt, Salmonella enterica enterica serovar Typhi Ty2
ucaggguuauccuccagcc

SEQ ID NO: 3726005 - RNA, 21 nt, Salmonella enterica enterica serovar Typhi Ty2
ucaggguuauuuccgcuggcc

SEQ ID NO: 3726006 - RNA, 14 nt, Salmonella enterica enterica serovar Typhi Ty2
ucaggguugucuca

SEQ ID NO: 3726007 - RNA, 19 nt, Salmonella enterica enterica serovar Typhi Ty2
ucaggguuuucuaccgcag

SEQ ID NO: 3726008 - RNA, 22 nt, Salmonella enterica enterica serovar Typhi Ty2
ucaggguuuucuaccgcagccu

SEQ ID NO: 3726009 - RNA, 15 nt, Salmonella enterica enterica serovar Typhi Ty2
ucagguauugguaug

SEQ ID NO: 3726010 - RNA, 17 nt, Salmonella enterica enterica serovar Typhi Ty2
ucaggucgcuaaaaccc

SEQ ID NO: 3726011 - RNA, 17 nt, Salmonella enterica enterica serovar Typhi Ty2
ucagguucgaauccugu

SEQ ID NO: 3726012 - RNA, 16 nt, Salmonella enterica enterica serovar Typhi Ty2
ucagguuuucuaucgc

SEQ ID NO: 3726013 - RNA, 20 nt, Salmonella enterica enterica serovar Typhi Ty2
ucagguuuuuaagcugccca

SEQ ID NO: 3726014 - RNA, 11 nt, Salmonella enterica enterica serovar Typhi Ty2
ucagguuuuuu

SEQ ID NO: 3726015 - RNA, 21 nt, Salmonella enterica enterica serovar Typhi Ty2
ucagguuuuuugugaguucau

SEQ ID NO: 3726016 - RNA, 15 nt, Salmonella enterica enterica serovar Typhi Ty2
ucagguuuuuuucau

SEQ ID NO: 3726017 - RNA, 13 nt, Salmonella enterica enterica serovar Typhi Ty2
ucaguaagcguac

SEQ ID NO: 3726018 - RNA, 16 nt, Salmonella enterica enterica serovar Typhi Ty2
ucaguaauaauauaaa

SEQ ID NO: 3726019 - RNA, 21 nt, Salmonella enterica enterica serovar Typhi Ty2
ucaguacgcccgugacgccag

SEQ ID NO: 3726020 - RNA, 19 nt, Salmonella enterica enterica serovar Typhi Ty2
ucaguacgcuuuggcaggc

SEQ ID NO: 3726021 - RNA, 17 nt, Salmonella enterica enterica serovar Typhi Ty2
ucaguacgucgcauacu

SEQ ID NO: 3726022 - RNA, 20 nt, Salmonella enterica enterica serovar Typhi Ty2
ucaguagccgccgcaggaca

SEQ ID NO: 3726023 - RNA, 21 nt, Salmonella enterica enterica serovar Typhi Ty2
ucaguagccgccgcaggacag

SEQ ID NO: 3726024 - RNA, 23 nt, Salmonella enterica enterica serovar Typhi Ty2
ucaguagcuuuuccgcuggaaua

SEQ ID NO: 3726025 - RNA, 16 nt, Salmonella enterica enterica serovar Typhi Ty2
ucaguaugaugaccug

SEQ ID NO: 3726026 - RNA, 19 nt, Salmonella enterica enterica serovar Typhi Ty2
ucaguccccacauuacgcc

SEQ ID NO: 3726027 - RNA, 14 nt, Salmonella enterica enterica serovar Typhi Ty2
ucagugaacacccu

SEQ ID NO: 3726028 - RNA, 17 nt, Salmonella enterica enterica serovar Typhi Ty2
ucagugaacacccugcc

SEQ ID NO: 3726029 - RNA, 12 nt, Salmonella enterica enterica serovar Typhi Ty2
ucagugauaaag

SEQ ID NO: 3726030 - RNA, 22 nt, Salmonella enterica enterica serovar Typhi Ty2
ucagugauaaagcacagcccca

SEQ ID NO: 3726031 - RNA, 15 nt, Salmonella enterica enterica serovar Typhi Ty2
ucaguggaaaacagc

SEQ ID NO: 3726032 - RNA, 21 nt, Salmonella enterica enterica serovar Typhi Ty2
ucaguggaaaacagcauaaua

SEQ ID NO: 3726033 - RNA, 17 nt, Salmonella enterica enterica serovar Typhi Ty2
ucaguggcggcaaaaaa

SEQ ID NO: 3726034 - RNA, 22 nt, Salmonella enterica enterica serovar Typhi Ty2
ucaguuaacgcguaaucuucca

SEQ ID NO: 3726035 - RNA, 12 nt, Salmonella enterica enterica serovar Typhi Ty2
ucaguucagaaa

SEQ ID NO: 3726036 - RNA, 14 nt, Salmonella enterica enterica serovar Typhi Ty2
ucaguucagaaacg

SEQ ID NO: 3726037 - RNA, 16 nt, Salmonella enterica enterica serovar Typhi Ty2
ucaguucauagccgug

SEQ ID NO: 3726038 - RNA, 22 nt, Salmonella enterica enterica serovar Typhi Ty2
ucaguucgccacgaucggcaau

SEQ ID NO: 3726039 - RNA, 16 nt, Salmonella enterica enterica serovar Typhi Ty2
ucaguucggagaucag

SEQ ID NO: 3726040 - RNA, 21 nt, Salmonella enterica enterica serovar Typhi Ty2
ucaguucggagaucagcggau

SEQ ID NO: 3726041 - RNA, 15 nt, Salmonella enterica enterica serovar Typhi Ty2
ucaguuugucgguaa

SEQ ID NO: 3726042 - RNA, 23 nt, Salmonella enterica enterica serovar Typhi Ty2
ucaguuugucgguaauccccgcc

SEQ ID NO: 3726043 - RNA, 18 nt, Salmonella enterica enterica serovar Typhi Ty2
ucaguuuuggcaaucaca

SEQ ID NO: 3726044 - RNA, 22 nt, Salmonella enterica enterica serovar Typhi Ty2
ucauaaaacccguuaaauacca

SEQ ID NO: 3726045 - RNA, 21 nt, Salmonella enterica enterica serovar Typhi Ty2
ucauaaaaucaaucugcaugu

SEQ ID NO: 3726046 - RNA, 22 nt, Salmonella enterica enterica serovar Typhi Ty2
ucauaaaggcuuuaaagcaggc

SEQ ID NO: 3726047 - RNA, 17 nt, Salmonella enterica enterica serovar Typhi Ty2
ucauaaaugcugucgcc

SEQ ID NO: 3726048 - RNA, 22 nt, Salmonella enterica enterica serovar Typhi Ty2
ucaucgacauuaacaaugccuu

SEQ ID NO: 3726049 - RNA, 16 nt, Salmonella enterica enterica serovar Typhi Ty2
ucaucgccacaugcgg

SEQ ID NO: 3726050 - RNA, 13 nt, Salmonella enterica enterica serovar Typhi Ty2
ucaucgccagccc

SEQ ID NO: 3726051 - RNA, 15 nt, Salmonella enterica enterica serovar Typhi Ty2
ucaucgccuucaucc

SEQ ID NO: 3726052 - RNA, 14 nt, Salmonella enterica enterica serovar Typhi Ty2
ucaucgcgccuccc

SEQ ID NO: 3726053 - RNA, 22 nt, Salmonella enterica enterica serovar Typhi Ty2
ucaucgcggaaagcaaugucgc

SEQ ID NO: 3726054 - RNA, 18 nt, Salmonella enterica enterica serovar Typhi Ty2
ucaucgcggccagcaugg

SEQ ID NO: 3726055 - RNA, 16 nt, Salmonella enterica enterica serovar Typhi Ty2
ucaucgcuggugugca

SEQ ID NO: 3726056 - RNA, 17 nt, Salmonella enterica enterica serovar Typhi Ty2
ucaucgcuugcccagca

SEQ ID NO: 3726057 - RNA, 18 nt, Salmonella enterica enterica serovar Typhi Ty2
ucaucggucaguuugccc

SEQ ID NO: 3726058 - RNA, 20 nt, Salmonella enterica enterica serovar Typhi Ty2
ucaucggucaguuugcccca

SEQ ID NO: 3726059 - RNA, 18 nt, Salmonella enterica enterica serovar Typhi Ty2
ucaucgguguucacaauu

SEQ ID NO: 3726060 - RNA, 17 nt, Salmonella enterica enterica serovar Typhi Ty2
ucaucgguuacuccuua

SEQ ID NO: 3726061 - RNA, 14 nt, Salmonella enterica enterica serovar Typhi Ty2
ucaucguaccaaua

SEQ ID NO: 3726062 - RNA, 15 nt, Salmonella enterica enterica serovar Typhi Ty2
ucaucgucagcuccu

SEQ ID NO: 3726063 - RNA, 18 nt, Salmonella enterica enterica serovar Typhi Ty2
ucaucgugaaauuauucc

SEQ ID NO: 3726064 - RNA, 14 nt, Salmonella enterica enterica serovar Typhi Ty2
ucaucuaucugcuu

SEQ ID NO: 3726065 - RNA, 17 nt, Salmonella enterica enterica serovar Typhi Ty2
ucaucuaucugcuucug

SEQ ID NO: 3726066 - RNA, 16 nt, Salmonella enterica enterica serovar Typhi Ty2
ucaucucaagccccau

SEQ ID NO: 3726067 - RNA, 17 nt, Salmonella enterica enterica serovar Typhi Ty2
ucaucuccgauaaauaa

SEQ ID NO: 3726068 - RNA, 19 nt, Salmonella enterica enterica serovar Typhi Ty2
ucaucuccgauaaauaaga

SEQ ID NO: 3726069 - RNA, 13 nt, Salmonella enterica enterica serovar Typhi Ty2
ucaucugacugcg

SEQ ID NO: 3726070 - RNA, 16 nt, Salmonella enterica enterica serovar Typhi Ty2
ucaucugaugauuaau

SEQ ID NO: 3726071 - RNA, 17 nt, Salmonella enterica enterica serovar Typhi Ty2
ucaucuguggcaauuuu

SEQ ID NO: 3726072 - RNA, 15 nt, Salmonella enterica enterica serovar Typhi Ty2
ucaucuuccaguacc

SEQ ID NO: 3726073 - RNA, 14 nt, Salmonella enterica enterica serovar Typhi Ty2
ucaucuucccgaau

SEQ ID NO: 3726074 - RNA, 20 nt, Salmonella enterica enterica serovar Typhi Ty2
ucaucuucggcgggaucucc

SEQ ID NO: 3726075 - RNA, 17 nt, Salmonella enterica enterica serovar Typhi Ty2
ucaucuuguccucauca

SEQ ID NO: 3726076 - RNA, 14 nt, Salmonella enterica enterica serovar Typhi Ty2
ucaucuuuuaaaau

SEQ ID NO: 3726077 - RNA, 18 nt, Salmonella enterica enterica serovar Typhi Ty2
ucaucuuuuaaaaucaga

SEQ ID NO: 3726078 - RNA, 23 nt, Salmonella enterica enterica serovar Typhi Ty2
ucaugaaugccccagcgcugcug

SEQ ID NO: 3726079 - RNA, 17 nt, Salmonella enterica enterica serovar Typhi Ty2
ucaugaccgaaaucuuc

SEQ ID NO: 3726080 - RNA, 23 nt, Salmonella enterica enterica serovar Typhi Ty2
ucaugagucgcgcgcgccaguca

SEQ ID NO: 3726081 - RNA, 14 nt, Salmonella enterica enterica serovar Typhi Ty2
ucaugaucuuuccu

SEQ ID NO: 3726082 - RNA, 20 nt, Salmonella enterica enterica serovar Typhi Ty2
ucaugaucuuuccuuuuuca

SEQ ID NO: 3726083 - RNA, 23 nt, Salmonella enterica enterica serovar Typhi Ty2
ucaugaucuuuccuuuuucaggc

SEQ ID NO: 3726084 - RNA, 21 nt, Salmonella enterica enterica serovar Typhi Ty2
ucaugauuucuugagcggcau

SEQ ID NO: 3726085 - RNA, 21 nt, Salmonella enterica enterica serovar Typhi Ty2
ucaugcaacuucaccucaguc

SEQ ID NO: 3726086 - RNA, 15 nt, Salmonella enterica enterica serovar Typhi Ty2
ucaugcaagacaucu

SEQ ID NO: 3726087 - RNA, 12 nt, Salmonella enterica enterica serovar Typhi Ty2
ucaugcaauaau

SEQ ID NO: 3726088 - RNA, 16 nt, Salmonella enterica enterica serovar Typhi Ty2
ucaugcagccggcgau

SEQ ID NO: 3726089 - RNA, 18 nt, Salmonella enterica enterica serovar Typhi Ty2
ucaugcauuaaugggcga

SEQ ID NO: 3726090 - RNA, 15 nt, Salmonella enterica enterica serovar Typhi Ty2
ucaugcccggcaaac

SEQ ID NO: 3726091 - RNA, 22 nt, Salmonella enterica enterica serovar Typhi Ty2
ucaugccggcuggcaauuugau

SEQ ID NO: 3726092 - RNA, 18 nt, Salmonella enterica enterica serovar Typhi Ty2
ucaugcgagguauacgcc

SEQ ID NO: 3726093 - RNA, 18 nt, Salmonella enterica enterica serovar Typhi Ty2
ucaugcgccaggugacga

SEQ ID NO: 3726094 - RNA, 13 nt, Salmonella enterica enterica serovar Typhi Ty2
ucaugcgccgcga

SEQ ID NO: 3726095 - RNA, 15 nt, Salmonella enterica enterica serovar Typhi Ty2
ucaugcgggagcuug

SEQ ID NO: 3726096 - RNA, 16 nt, Salmonella enterica enterica serovar Typhi Ty2
ucaugcggucuucacu

SEQ ID NO: 3726097 - RNA, 15 nt, Salmonella enterica enterica serovar Typhi Ty2
ucaugcggugcauga

SEQ ID NO: 3726098 - RNA, 17 nt, Salmonella enterica enterica serovar Typhi Ty2
ucaugcgguuaaaccag

SEQ ID NO: 3726099 - RNA, 13 nt, Salmonella enterica enterica serovar Typhi Ty2
ucaugcuaaaagc

SEQ ID NO: 3726100 - RNA, 15 nt, Salmonella enterica enterica serovar Typhi Ty2
ucaugcugcaccgca

SEQ ID NO: 3726101 - RNA, 22 nt, Salmonella enterica enterica serovar Typhi Ty2
ucaugcuggcgaugaguaaaau

SEQ ID NO: 3726102 - RNA, 16 nt, Salmonella enterica enterica serovar Typhi Ty2
ucaugcuuccaaagag

SEQ ID NO: 3726103 - RNA, 20 nt, Salmonella enterica enterica serovar Typhi Ty2
ucauggacagauuuccacga

SEQ ID NO: 3726104 - RNA, 23 nt, Salmonella enterica enterica serovar Typhi Ty2
ucauggagacgaucuauguggug

SEQ ID NO: 3726105 - RNA, 12 nt, Salmonella enterica enterica serovar Typhi Ty2
ucauggcguaaa

SEQ ID NO: 3726106 - RNA, 20 nt, Salmonella enterica enterica serovar Typhi Ty2
ucauggguagccguuuaaaa

SEQ ID NO: 3726107 - RNA, 15 nt, Salmonella enterica enterica serovar Typhi Ty2
ucaugguaaaugccg

SEQ ID NO: 3726108 - RNA, 18 nt, Salmonella enterica enterica serovar Typhi Ty2
ucaugguacucaacauca

SEQ ID NO: 3726109 - RNA, 19 nt, Salmonella enterica enterica serovar Typhi Ty2
ucaugguagucaaauucca

SEQ ID NO: 3726110 - RNA, 13 nt, Salmonella enterica enterica serovar Typhi Ty2
ucaugguugaaaa

SEQ ID NO: 3726111 - RNA, 12 nt, Salmonella enterica enterica serovar Typhi Ty2
ucaugucgucau

SEQ ID NO: 3726112 - RNA, 19 nt, Salmonella enterica enterica serovar Typhi Ty2
ucauguugcggguuucuga

SEQ ID NO: 3726113 - RNA, 21 nt, Salmonella enterica enterica serovar Typhi Ty2
ucauguugcggguuucugaau

SEQ ID NO: 3726114 - RNA, 12 nt, Salmonella enterica enterica serovar Typhi Ty2
ucauuaaaaugc

SEQ ID NO: 3726115 - RNA, 18 nt, Salmonella enterica enterica serovar Typhi Ty2
ucauuaacguaggccgga

SEQ ID NO: 3726116 - RNA, 22 nt, Salmonella enterica enterica serovar Typhi Ty2
ucauuaauuuucacgcucugac

SEQ ID NO: 3726117 - RNA, 19 nt, Salmonella enterica enterica serovar Typhi Ty2
ucauuacaggcgaauagcg

SEQ ID NO: 3726118 - RNA, 14 nt, Salmonella enterica enterica serovar Typhi Ty2
ucauuaccaguuga

SEQ ID NO: 3726119 - RNA, 22 nt, Salmonella enterica enterica serovar Typhi Ty2
ucauuaccuacgcgauaaaaaa

SEQ ID NO: 3726120 - RNA, 23 nt, Salmonella enterica enterica serovar Typhi Ty2
ucauuacuggaucgcuccauucu

SEQ ID NO: 3726121 - RNA, 14 nt, Salmonella enterica enterica serovar Typhi Ty2
ucauuaucaauagc

SEQ ID NO: 3726122 - RNA, 16 nt, Salmonella enterica enterica serovar Typhi Ty2
ucauucacauuauuca

SEQ ID NO: 3726123 - RNA, 19 nt, Salmonella enterica enterica serovar Typhi Ty2
ucauucacccaauaaauaa

SEQ ID NO: 3726124 - RNA, 13 nt, Salmonella enterica enterica serovar Typhi Ty2
ucauucagcaacu

SEQ ID NO: 3726125 - RNA, 15 nt, Salmonella enterica enterica serovar Typhi Ty2
ucauucagcggcugc

SEQ ID NO: 3726126 - RNA, 18 nt, Salmonella enterica enterica serovar Typhi Ty2
ucauucgcgaauagugca

SEQ ID NO: 3726127 - RNA, 14 nt, Salmonella enterica enterica serovar Typhi Ty2
ucauucgggaugca

SEQ ID NO: 3726128 - RNA, 21 nt, Salmonella enterica enterica serovar Typhi Ty2
ucauucgggaugcauaaaaaa

SEQ ID NO: 3726129 - RNA, 20 nt, Salmonella enterica enterica serovar Typhi Ty2
ucauucgggucaaugccguc

SEQ ID NO: 3726130 - RNA, 17 nt, Salmonella enterica enterica serovar Typhi Ty2
uccagauacauggcuau

SEQ ID NO: 3726131 - RNA, 16 nt, Salmonella enterica enterica serovar Typhi Ty2
uccagauagguuaagc

SEQ ID NO: 3726132 - RNA, 16 nt, Salmonella enterica enterica serovar Typhi Ty2
uccagauauggcaaac

SEQ ID NO: 3726133 - RNA, 17 nt, Salmonella enterica enterica serovar Typhi Ty2
uccagaucgcauaaaau

SEQ ID NO: 3726134 - RNA, 12 nt, Salmonella enterica enterica serovar Typhi Ty2
uccagaucuuca

SEQ ID NO: 3726135 - RNA, 16 nt, Salmonella enterica enterica serovar Typhi Ty2
uccagaugaagcgcau

SEQ ID NO: 3726136 - RNA, 20 nt, Salmonella enterica enterica serovar Typhi Ty2
uccagaugcgccagauucau

SEQ ID NO: 3726137 - RNA, 21 nt, Salmonella enterica enterica serovar Typhi Ty2
uccagaugcgccagauucaug

SEQ ID NO: 3726138 - RNA, 17 nt, Salmonella enterica enterica serovar Typhi Ty2
uccagcaauaacaccgg

SEQ ID NO: 3726139 - RNA, 16 nt, Salmonella enterica enterica serovar Typhi Ty2
uccagcacauccucaa

SEQ ID NO: 3726140 - RNA, 17 nt, Salmonella enterica enterica serovar Typhi Ty2
uccagcacauccucaau

SEQ ID NO: 3726141 - RNA, 13 nt, Salmonella enterica enterica serovar Typhi Ty2
uccagcacgaccu

SEQ ID NO: 3726142 - RNA, 18 nt, Salmonella enterica enterica serovar Typhi Ty2
uccagcacgagcgccagc

SEQ ID NO: 3726143 - RNA, 20 nt, Salmonella enterica enterica serovar Typhi Ty2
uccagcacgagcgccagccc

SEQ ID NO: 3726144 - RNA, 14 nt, Salmonella enterica enterica serovar Typhi Ty2
uccagcacggccuu

SEQ ID NO: 3726145 - RNA, 17 nt, Salmonella enterica enterica serovar Typhi Ty2
uccagcacgguaaaccu

SEQ ID NO: 3726146 - RNA, 22 nt, Salmonella enterica enterica serovar Typhi Ty2
uccagcagacucauggacaaaa

SEQ ID NO: 3726147 - RNA, 14 nt, Salmonella enterica enterica serovar Typhi Ty2
uccagcagauuagc

SEQ ID NO: 3726148 - RNA, 22 nt, Salmonella enterica enterica serovar Typhi Ty2
uccagcagcagcaccggcuguu

SEQ ID NO: 3726149 - RNA, 11 nt, Salmonella enterica enterica serovar Typhi Ty2
uccagcagcca

SEQ ID NO: 3726150 - RNA, 13 nt, Salmonella enterica enterica serovar Typhi Ty2
uccagcagccagc

SEQ ID NO: 3726151 - RNA, 16 nt, Salmonella enterica enterica serovar Typhi Ty2
uccagcagccagccgu

SEQ ID NO: 3726152 - RNA, 18 nt, Salmonella enterica enterica serovar Typhi Ty2
uccagcagccaugccagc

SEQ ID NO: 3726153 - RNA, 13 nt, Salmonella enterica enterica serovar Typhi Ty2
uccagcagcgcau

SEQ ID NO: 3726154 - RNA, 17 nt, Salmonella enterica enterica serovar Typhi Ty2
uccagcagcucaucaau

SEQ ID NO: 3726155 - RNA, 18 nt, Salmonella enterica enterica serovar Typhi Ty2
uccagcagguggaucuga

SEQ ID NO: 3726156 - RNA, 22 nt, Salmonella enterica enterica serovar Typhi Ty2
uccagcaguucuacgcugccau

SEQ ID NO: 3726157 - RNA, 15 nt, Salmonella enterica enterica serovar Typhi Ty2
uccagcaucagcaau

SEQ ID NO: 3726158 - RNA, 13 nt, Salmonella enterica enterica serovar Typhi Ty2
uccagcauucuau

SEQ ID NO: 3726159 - RNA, 12 nt, Salmonella enterica enterica serovar Typhi Ty2
uccagccaaagu

SEQ ID NO: 3726160 - RNA, 23 nt, Salmonella enterica enterica serovar Typhi Ty2
uccagccagcguuucuggaagua

SEQ ID NO: 3726161 - RNA, 13 nt, Salmonella enterica enterica serovar Typhi Ty2
uccagccagggau

SEQ ID NO: 3726162 - RNA, 23 nt, Salmonella enterica enterica serovar Typhi Ty2
uccagccccagcgccagcugcgu

SEQ ID NO: 3726163 - RNA, 22 nt, Salmonella enterica enterica serovar Typhi Ty2
uccagccgcccuucuccgguaa

SEQ ID NO: 3726164 - RNA, 16 nt, Salmonella enterica enterica serovar Typhi Ty2
uccagcgaaccuucca

SEQ ID NO: 3726165 - RNA, 17 nt, Salmonella enterica enterica serovar Typhi Ty2
uccagcgaaccuuccau

SEQ ID NO: 3726166 - RNA, 15 nt, Salmonella enterica enterica serovar Typhi Ty2
uccagcgaauaauga

SEQ ID NO: 3726167 - RNA, 17 nt, Salmonella enterica enterica serovar Typhi Ty2
uccagcgagcaggaaua

SEQ ID NO: 3726168 - RNA, 14 nt, Salmonella enterica enterica serovar Typhi Ty2
uccagcgcaaaggg

SEQ ID NO: 3726169 - RNA, 14 nt, Salmonella enterica enterica serovar Typhi Ty2
uccagcgccagcgc

SEQ ID NO: 3726170 - RNA, 16 nt, Salmonella enterica enterica serovar Typhi Ty2
uccagcgccagcucca

SEQ ID NO: 3726171 - RNA, 15 nt, Salmonella enterica enterica serovar Typhi Ty2
uccagcgccugcugu

SEQ ID NO: 3726172 - RNA, 22 nt, Salmonella enterica enterica serovar Typhi Ty2
uccagcgccugcuguaaaauau

SEQ ID NO: 3726173 - RNA, 14 nt, Salmonella enterica enterica serovar Typhi Ty2
uccagcgcgccguc

SEQ ID NO: 3726174 - RNA, 22 nt, Salmonella enterica enterica serovar Typhi Ty2
uccagcgcguccuuauaaugcu

SEQ ID NO: 3726175 - RNA, 18 nt, Salmonella enterica enterica serovar Typhi Ty2
uccagcgcucaaucagcg

SEQ ID NO: 3726176 - RNA, 13 nt, Salmonella enterica enterica serovar Typhi Ty2
uccagcggcagga

SEQ ID NO: 3726177 - RNA, 20 nt, Salmonella enterica enterica serovar Typhi Ty2
uccagcggcaggauccccau

SEQ ID NO: 3726178 - RNA, 22 nt, Salmonella enterica enterica serovar Typhi Ty2
uccagcggccaguguacauagc

SEQ ID NO: 3726179 - RNA, 16 nt, Salmonella enterica enterica serovar Typhi Ty2
uccagcgucgggccgc

SEQ ID NO: 3726180 - RNA, 14 nt, Salmonella enterica enterica serovar Typhi Ty2
uccagcguuucucu

SEQ ID NO: 3726181 - RNA, 16 nt, Salmonella enterica enterica serovar Typhi Ty2
uccagcucauuuuuac

SEQ ID NO: 3726182 - RNA, 13 nt, Salmonella enterica enterica serovar Typhi Ty2
uccagcuccagcc

SEQ ID NO: 3726183 - RNA, 19 nt, Salmonella enterica enterica serovar Typhi Ty2
uccagcuccagccgcugcc

SEQ ID NO: 3726184 - RNA, 14 nt, Salmonella enterica enterica serovar Typhi Ty2
uccagcuccaucca

SEQ ID NO: 3726185 - RNA, 20 nt, Salmonella enterica enterica serovar Typhi Ty2
uccagcucgcgauaggccuc

SEQ ID NO: 3726186 - RNA, 14 nt, Salmonella enterica enterica serovar Typhi Ty2
uccagcucuucuuc

SEQ ID NO: 3726187 - RNA, 20 nt, Salmonella enterica enterica serovar Typhi Ty2
uccagcucuuugguccauaa

SEQ ID NO: 3726188 - RNA, 12 nt, Salmonella enterica enterica serovar Typhi Ty2
uccagcuggcug

SEQ ID NO: 3726189 - RNA, 23 nt, Salmonella enterica enterica serovar Typhi Ty2
uccagcugguauaggccaggcua

SEQ ID NO: 3726190 - RNA, 17 nt, Salmonella enterica enterica serovar Typhi Ty2
uccagcuguaccaucac

SEQ ID NO: 3726191 - RNA, 17 nt, Salmonella enterica enterica serovar Typhi Ty2
uccaggacggacauauu

SEQ ID NO: 3726192 - RNA, 20 nt, Salmonella enterica enterica serovar Typhi Ty2
uccaggccgucggcgccagc

SEQ ID NO: 3726193 - RNA, 22 nt, Salmonella enterica enterica serovar Typhi Ty2
uccaggcgaccagaugcagcaa

SEQ ID NO: 3726194 - RNA, 21 nt, Salmonella enterica enterica serovar Typhi Ty2
uccagggcugcuggccuucca

SEQ ID NO: 3726195 - RNA, 16 nt, Salmonella enterica enterica serovar Typhi Ty2
uccaggguaauuaacg

SEQ ID NO: 3726196 - RNA, 16 nt, Salmonella enterica enterica serovar Typhi Ty2
uccaggugucacucau

SEQ ID NO: 3726197 - RNA, 23 nt, Salmonella enterica enterica serovar Typhi Ty2
uccagguugugguuaaacacauc

SEQ ID NO: 3726198 - RNA, 22 nt, Salmonella enterica enterica serovar Typhi Ty2
uccagguuucuggcaacagcca

SEQ ID NO: 3726199 - RNA, 14 nt, Salmonella enterica enterica serovar Typhi Ty2
uccaguaacgcguc

SEQ ID NO: 3726200 - RNA, 24 nt, Salmonella enterica enterica serovar Typhi Ty2
uccaguaacgcguccaacuggcuu

SEQ ID NO: 3726201 - RNA, 22 nt, Salmonella enterica enterica serovar Typhi Ty2
uccaguaauucccggcaggcgu

SEQ ID NO: 3726202 - RNA, 14 nt, Salmonella enterica enterica serovar Typhi Ty2
uccaguaauuucag

SEQ ID NO: 3726203 - RNA, 15 nt, Salmonella enterica enterica serovar Typhi Ty2
uccaguaauuucagc

SEQ ID NO: 3726204 - RNA, 16 nt, Salmonella enterica enterica serovar Typhi Ty2
uccaguacuuucuuuu

SEQ ID NO: 3726205 - RNA, 14 nt, Salmonella enterica enterica serovar Typhi Ty2
uccagucagcguua

SEQ ID NO: 3726206 - RNA, 12 nt, Salmonella enterica enterica serovar Typhi Ty2
uccagucccuga

SEQ ID NO: 3726207 - RNA, 14 nt, Salmonella enterica enterica serovar Typhi Ty2
uccagucgcuccac

SEQ ID NO: 3726208 - RNA, 16 nt, Salmonella enterica enterica serovar Typhi Ty2
uccagucgcuccacca

SEQ ID NO: 3726209 - RNA, 13 nt, Salmonella enterica enterica serovar Typhi Ty2
uccagugaaaccg

SEQ ID NO: 3726210 - RNA, 15 nt, Salmonella enterica enterica serovar Typhi Ty2
uccagugcagaaagu

SEQ ID NO: 3726211 - RNA, 18 nt, Salmonella enterica enterica serovar Typhi Ty2
uccaguguuguucucuga

SEQ ID NO: 3726212 - RNA, 15 nt, Salmonella enterica enterica serovar Typhi Ty2
ucccauucacguagc

SEQ ID NO: 3726213 - RNA, 13 nt, Salmonella enterica enterica serovar Typhi Ty2
ucccauuccugca

SEQ ID NO: 3726214 - RNA, 16 nt, Salmonella enterica enterica serovar Typhi Ty2
ucccauuccugcaaga

SEQ ID NO: 3726215 - RNA, 21 nt, Salmonella enterica enterica serovar Typhi Ty2
ucccauuccugcaagaagcgu

SEQ ID NO: 3726216 - RNA, 19 nt, Salmonella enterica enterica serovar Typhi Ty2
ucccauugggccagcagcg

SEQ ID NO: 3726217 - RNA, 13 nt, Salmonella enterica enterica serovar Typhi Ty2
uccccaaacugcu

SEQ ID NO: 3726218 - RNA, 17 nt, Salmonella enterica enterica serovar Typhi Ty2
uccccaccaccgccacu

SEQ ID NO: 3726219 - RNA, 21 nt, Salmonella enterica enterica serovar Typhi Ty2
uccccacgccgaccaccagcu

SEQ ID NO: 3726220 - RNA, 22 nt, Salmonella enterica enterica serovar Typhi Ty2
uccccacgccgaccaccagcuu

SEQ ID NO: 3726221 - RNA, 17 nt, Salmonella enterica enterica serovar Typhi Ty2
uccccagaaugauaaug

SEQ ID NO: 3726222 - RNA, 16 nt, Salmonella enterica enterica serovar Typhi Ty2
uccccagcaucauguc

SEQ ID NO: 3726223 - RNA, 16 nt, Salmonella enterica enterica serovar Typhi Ty2
uccccagccagagauc

SEQ ID NO: 3726224 - RNA, 18 nt, Salmonella enterica enterica serovar Typhi Ty2
uccccagcguaccacgcc

SEQ ID NO: 3726225 - RNA, 23 nt, Salmonella enterica enterica serovar Typhi Ty2
uccccagcguaccacgccgcaca

SEQ ID NO: 3726226 - RNA, 19 nt, Salmonella enterica enterica serovar Typhi Ty2
uccccagcuaaaaacgcca

SEQ ID NO: 3726227 - RNA, 20 nt, Salmonella enterica enterica serovar Typhi Ty2
uccccagcuaaaaacgccaa

SEQ ID NO: 3726228 - RNA, 13 nt, Salmonella enterica enterica serovar Typhi Ty2
uccccauaucccg

SEQ ID NO: 3726229 - RNA, 19 nt, Salmonella enterica enterica serovar Typhi Ty2
uccccauauuccagaaagg

SEQ ID NO: 3726230 - RNA, 19 nt, Salmonella enterica enterica serovar Typhi Ty2
uccccaucaggaacaggcg

SEQ ID NO: 3726231 - RNA, 16 nt, Salmonella enterica enterica serovar Typhi Ty2
uccccaucccaaucag

SEQ ID NO: 3726232 - RNA, 15 nt, Salmonella enterica enterica serovar Typhi Ty2
uccccaucccagacc

SEQ ID NO: 3726233 - RNA, 16 nt, Salmonella enterica enterica serovar Typhi Ty2
uccccauuuuuuucag

SEQ ID NO: 3726234 - RNA, 14 nt, Salmonella enterica enterica serovar Typhi Ty2
ucccccauccgcgc

SEQ ID NO: 3726235 - RNA, 17 nt, Salmonella enterica enterica serovar Typhi Ty2
uccccccucugauuggc

SEQ ID NO: 3726236 - RNA, 21 nt, Salmonella enterica enterica serovar Typhi Ty2
ucccccuggccugcucaucag

SEQ ID NO: 3726237 - RNA, 22 nt, Salmonella enterica enterica serovar Typhi Ty2
ucccccuggccugcucaucagg

SEQ ID NO: 3726238 - RNA, 19 nt, Salmonella enterica enterica serovar Typhi Ty2
uccccgacggccucuucac

SEQ ID NO: 3726239 - RNA, 23 nt, Salmonella enterica enterica serovar Typhi Ty2
uccccgacggccucuucacgcag

SEQ ID NO: 3726240 - RNA, 20 nt, Salmonella enterica enterica serovar Typhi Ty2
uccccgccgagaaaauaccg

SEQ ID NO: 3726241 - RNA, 22 nt, Salmonella enterica enterica serovar Typhi Ty2
uccccgccgcugaggauggcgc

SEQ ID NO: 3726242 - RNA, 20 nt, Salmonella enterica enterica serovar Typhi Ty2
uccccgcuggugcggggaac

SEQ ID NO: 3726243 - RNA, 11 nt, Salmonella enterica enterica serovar Typhi Ty2
uccccggcaac

SEQ ID NO: 3726244 - RNA, 14 nt, Salmonella enterica enterica serovar Typhi Ty2
uccccggcaggcuc

SEQ ID NO: 3726245 - RNA, 20 nt, Salmonella enterica enterica serovar Typhi Ty2
uccccggcaggcucaccagc

SEQ ID NO: 3726246 - RNA, 17 nt, Salmonella enterica enterica serovar Typhi Ty2
uccccggcgaaagaaaa

SEQ ID NO: 3726247 - RNA, 14 nt, Salmonella enterica enterica serovar Typhi Ty2
uccccggcuucaca

SEQ ID NO: 3726248 - RNA, 15 nt, Salmonella enterica enterica serovar Typhi Ty2
uccccggcuuccagc

SEQ ID NO: 3726249 - RNA, 21 nt, Salmonella enterica enterica serovar Typhi Ty2
uccccggucagucccagcguu

SEQ ID NO: 3726250 - RNA, 16 nt, Salmonella enterica enterica serovar Typhi Ty2
uccccguuccaccgcc

SEQ ID NO: 3726251 - RNA, 17 nt, Salmonella enterica enterica serovar Typhi Ty2
uccccguuugcaguccg

SEQ ID NO: 3726252 - RNA, 17 nt, Salmonella enterica enterica serovar Typhi Ty2
uccccuauacgccaucu

SEQ ID NO: 3726253 - RNA, 16 nt, Salmonella enterica enterica serovar Typhi Ty2
uccccucuuccaucag

SEQ ID NO: 3726254 - RNA, 17 nt, Salmonella enterica enterica serovar Typhi Ty2
uccccucuuccaucagc

SEQ ID NO: 3726255 - RNA, 21 nt, Salmonella enterica enterica serovar Typhi Ty2
uccccucuuccaucagccagg

SEQ ID NO: 3726256 - RNA, 20 nt, Salmonella enterica enterica serovar Typhi Ty2
uccccugcgguuucuaccac

SEQ ID NO: 3726257 - RNA, 13 nt, Salmonella enterica enterica serovar Typhi Ty2
ucccgaacaugcc

SEQ ID NO: 3726258 - RNA, 12 nt, Salmonella enterica enterica serovar Typhi Ty2
ucccgaccaguu

SEQ ID NO: 3726259 - RNA, 20 nt, Salmonella enterica enterica serovar Typhi Ty2
ucccgacuuuacaccccacu

SEQ ID NO: 3726260 - RNA, 14 nt, Salmonella enterica enterica serovar Typhi Ty2
ucccgauaaugacc

SEQ ID NO: 3726261 - RNA, 17 nt, Salmonella enterica enterica serovar Typhi Ty2
ucccgauacgguugcgc

SEQ ID NO: 3726262 - RNA, 15 nt, Salmonella enterica enterica serovar Typhi Ty2
ucccgauauaaaggu

SEQ ID NO: 3726263 - RNA, 19 nt, Salmonella enterica enterica serovar Typhi Ty2
ucccgaucuucaucguuac

SEQ ID NO: 3726264 - RNA, 17 nt, Salmonella enterica enterica serovar Typhi Ty2
ucccgaugguggcgucg

SEQ ID NO: 3726265 - RNA, 20 nt, Salmonella enterica enterica serovar Typhi Ty2
ucccgcaaacuggccacagc

SEQ ID NO: 3726266 - RNA, 20 nt, Salmonella enterica enterica serovar Typhi Ty2
ucccgcacgcuggcaucaau

SEQ ID NO: 3726267 - RNA, 22 nt, Salmonella enterica enterica serovar Typhi Ty2
ucccgcacgcuggcaucaauau

SEQ ID NO: 3726268 - RNA, 11 nt, Salmonella enterica enterica serovar Typhi Ty2
ucccgccgcca

SEQ ID NO: 3726269 - RNA, 12 nt, Salmonella enterica enterica serovar Typhi Ty2
ucccgccgcgau

SEQ ID NO: 3726270 - RNA, 21 nt, Salmonella enterica enterica serovar Typhi Ty2
ucccgccgguucaauaaauca

SEQ ID NO: 3726271 - RNA, 17 nt, Salmonella enterica enterica serovar Typhi Ty2
ucccgccucggucagua

SEQ ID NO: 3726272 - RNA, 12 nt, Salmonella enterica enterica serovar Typhi Ty2
ucccgccugcug

SEQ ID NO: 3726273 - RNA, 17 nt, Salmonella enterica enterica serovar Typhi Ty2
ucccgccuugcggcgcc

SEQ ID NO: 3726274 - RNA, 16 nt, Salmonella enterica enterica serovar Typhi Ty2
ucccgcgcuucauccg

SEQ ID NO: 3726275 - RNA, 21 nt, Salmonella enterica enterica serovar Typhi Ty2
ucccgcguucgcgcaguucau

SEQ ID NO: 3726276 - RNA, 15 nt, Salmonella enterica enterica serovar Typhi Ty2
ucccgcugcggcgug

SEQ ID NO: 3726277 - RNA, 15 nt, Salmonella enterica enterica serovar Typhi Ty2
ucccgcuggcuggcg

SEQ ID NO: 3726278 - RNA, 17 nt, Salmonella enterica enterica serovar Typhi Ty2
ucccgcuggcuggcguu

SEQ ID NO: 3726279 - RNA, 21 nt, Salmonella enterica enterica serovar Typhi Ty2
ucccggaacagcggagcgaag

SEQ ID NO: 3726280 - RNA, 19 nt, Salmonella enterica enterica serovar Typhi Ty2
ucccggcaauuaccgccag

SEQ ID NO: 3726281 - RNA, 20 nt, Salmonella enterica enterica serovar Typhi Ty2
ucccggcaauuaccgccagc

SEQ ID NO: 3726282 - RNA, 14 nt, Salmonella enterica enterica serovar Typhi Ty2
ucccggcagugcau

SEQ ID NO: 3726283 - RNA, 14 nt, Salmonella enterica enterica serovar Typhi Ty2
ucccggcauuauaa

SEQ ID NO: 3726284 - RNA, 21 nt, Salmonella enterica enterica serovar Typhi Ty2
ucccggcuggguucauccagc

SEQ ID NO: 3726285 - RNA, 13 nt, Salmonella enterica enterica serovar Typhi Ty2
ucccggcuuaaau

SEQ ID NO: 3726286 - RNA, 15 nt, Salmonella enterica enterica serovar Typhi Ty2
ucccggucgcgccag

SEQ ID NO: 3726287 - RNA, 18 nt, Salmonella enterica enterica serovar Typhi Ty2
ucccgguuaucgaacagc

SEQ ID NO: 3726288 - RNA, 15 nt, Salmonella enterica enterica serovar Typhi Ty2
ucccguaaaagaaga

SEQ ID NO: 3726289 - RNA, 15 nt, Salmonella enterica enterica serovar Typhi Ty2
ucccguagcgucaac

SEQ ID NO: 3726290 - RNA, 20 nt, Salmonella enterica enterica serovar Typhi Ty2
ucccguagcgucaacacgag

SEQ ID NO: 3726291 - RNA, 16 nt, Salmonella enterica enterica serovar Typhi Ty2
ucccguaucuucaugu

SEQ ID NO: 3726292 - RNA, 13 nt, Salmonella enterica enterica serovar Typhi Ty2
ucccgucgucagc

SEQ ID NO: 3726293 - RNA, 18 nt, Salmonella enterica enterica serovar Typhi Ty2
ucccguuccagcuugaau

SEQ ID NO: 3726294 - RNA, 20 nt, Salmonella enterica enterica serovar Typhi Ty2
uccgcgggcaaaagggccau

SEQ ID NO: 3726295 - RNA, 14 nt, Salmonella enterica enterica serovar Typhi Ty2
uccgcguagcccag

SEQ ID NO: 3726296 - RNA, 20 nt, Salmonella enterica enterica serovar Typhi Ty2
uccgcguauucucaaccagc

SEQ ID NO: 3726297 - RNA, 16 nt, Salmonella enterica enterica serovar Typhi Ty2
uccgcguuuaucgcau

SEQ ID NO: 3726298 - RNA, 17 nt, Salmonella enterica enterica serovar Typhi Ty2
uccgcuagggcaucaga

SEQ ID NO: 3726299 - RNA, 18 nt, Salmonella enterica enterica serovar Typhi Ty2
uccgcuaucucuuccagc

SEQ ID NO: 3726300 - RNA, 16 nt, Salmonella enterica enterica serovar Typhi Ty2
uccgcuauuaccagua

SEQ ID NO: 3726301 - RNA, 15 nt, Salmonella enterica enterica serovar Typhi Ty2
uccgcuccacauccu

SEQ ID NO: 3726302 - RNA, 20 nt, Salmonella enterica enterica serovar Typhi Ty2
uccgcuucaccuuucgccgc

SEQ ID NO: 3726303 - RNA, 18 nt, Salmonella enterica enterica serovar Typhi Ty2
uccgcuuucuucccggca

SEQ ID NO: 3726304 - RNA, 15 nt, Salmonella enterica enterica serovar Typhi Ty2
uccgcuuuuaucggc

SEQ ID NO: 3726305 - RNA, 15 nt, Salmonella enterica enterica serovar Typhi Ty2
uccggacgcaccagc

SEQ ID NO: 3726306 - RNA, 16 nt, Salmonella enterica enterica serovar Typhi Ty2
uccggacgcaccagcc

SEQ ID NO: 3726307 - RNA, 18 nt, Salmonella enterica enterica serovar Typhi Ty2
uccggacguacccaggcg

SEQ ID NO: 3726308 - RNA, 14 nt, Salmonella enterica enterica serovar Typhi Ty2
uccggagccugugu

SEQ ID NO: 3726309 - RNA, 15 nt, Salmonella enterica enterica serovar Typhi Ty2
uccggaugccccauc

SEQ ID NO: 3726310 - RNA, 20 nt, Salmonella enterica enterica serovar Typhi Ty2
uccggaugccccaucacggg

SEQ ID NO: 3726311 - RNA, 19 nt, Salmonella enterica enterica serovar Typhi Ty2
uccggcaaacucagcggcu

SEQ ID NO: 3726312 - RNA, 21 nt, Salmonella enterica enterica serovar Typhi Ty2
uccggcaacggguuagacuca

SEQ ID NO: 3726313 - RNA, 21 nt, Salmonella enterica enterica serovar Typhi Ty2
uccggcaagucagaccagucg

SEQ ID NO: 3726314 - RNA, 13 nt, Salmonella enterica enterica serovar Typhi Ty2
uccggcacacagc

SEQ ID NO: 3726315 - RNA, 15 nt, Salmonella enterica enterica serovar Typhi Ty2
uccggcacacagcgc

SEQ ID NO: 3726316 - RNA, 17 nt, Salmonella enterica enterica serovar Typhi Ty2
uccggcacacagcgcuu

SEQ ID NO: 3726317 - RNA, 18 nt, Salmonella enterica enterica serovar Typhi Ty2
uccggcacacagcgcuuu

SEQ ID NO: 3726318 - RNA, 20 nt, Salmonella enterica enterica serovar Typhi Ty2
uccggcacauauuccggcgc

SEQ ID NO: 3726319 - RNA, 18 nt, Salmonella enterica enterica serovar Typhi Ty2
uccggcacgauaaauugc

SEQ ID NO: 3726320 - RNA, 23 nt, Salmonella enterica enterica serovar Typhi Ty2
uccggcacgauaaauugccugau

SEQ ID NO: 3726321 - RNA, 18 nt, Salmonella enterica enterica serovar Typhi Ty2
uccggcacgccaucgccu

SEQ ID NO: 3726322 - RNA, 16 nt, Salmonella enterica enterica serovar Typhi Ty2
uccggcacucuucuuc

SEQ ID NO: 3726323 - RNA, 14 nt, Salmonella enterica enterica serovar Typhi Ty2
uccggcagaaauga

SEQ ID NO: 3726324 - RNA, 17 nt, Salmonella enterica enterica serovar Typhi Ty2
uccggcagacggcuggg

SEQ ID NO: 3726325 - RNA, 12 nt, Salmonella enterica enterica serovar Typhi Ty2
uccggcaggcaa

SEQ ID NO: 3726326 - RNA, 19 nt, Salmonella enterica enterica serovar Typhi Ty2
uccggcauaaaaagccucu

SEQ ID NO: 3726327 - RNA, 21 nt, Salmonella enterica enterica serovar Typhi Ty2
uccggcaucacaucgccguuc

SEQ ID NO: 3726328 - RNA, 19 nt, Salmonella enterica enterica serovar Typhi Ty2
uccggcaucucaaggucug

SEQ ID NO: 3726329 - RNA, 12 nt, Salmonella enterica enterica serovar Typhi Ty2
uccggccagcgc

SEQ ID NO: 3726330 - RNA, 14 nt, Salmonella enterica enterica serovar Typhi Ty2
uccggccagcgcca

SEQ ID NO: 3726331 - RNA, 15 nt, Salmonella enterica enterica serovar Typhi Ty2
uccggccagcgccag

SEQ ID NO: 3726332 - RNA, 16 nt, Salmonella enterica enterica serovar Typhi Ty2
uccggccagcgccagc

SEQ ID NO: 3726333 - RNA, 17 nt, Salmonella enterica enterica serovar Typhi Ty2
uccggccagcgccagcg

SEQ ID NO: 3726334 - RNA, 19 nt, Salmonella enterica enterica serovar Typhi Ty2
uccggccagcgccagcguu

SEQ ID NO: 3726335 - RNA, 17 nt, Salmonella enterica enterica serovar Typhi Ty2
uccggccuacagacugu

SEQ ID NO: 3726336 - RNA, 18 nt, Salmonella enterica enterica serovar Typhi Ty2
uccggccuaccugagaug

SEQ ID NO: 3726337 - RNA, 23 nt, Salmonella enterica enterica serovar Typhi Ty2
uccggccuaccugagaugaaauc

SEQ ID NO: 3726338 - RNA, 20 nt, Salmonella enterica enterica serovar Typhi Ty2
uccggccuacgcgucaauua

SEQ ID NO: 3726339 - RNA, 15 nt, Salmonella enterica enterica serovar Typhi Ty2
uccggccuacucuug

SEQ ID NO: 3726340 - RNA, 14 nt, Salmonella enterica enterica serovar Typhi Ty2
uccggccugcaggc

SEQ ID NO: 3726341 - RNA, 16 nt, Salmonella enterica enterica serovar Typhi Ty2
uccggccugcaggcaa

SEQ ID NO: 3726342 - RNA, 17 nt, Salmonella enterica enterica serovar Typhi Ty2
uccggccuguaaggucu

SEQ ID NO: 3726343 - RNA, 14 nt, Salmonella enterica enterica serovar Typhi Ty2
uccggcgcaauaag

SEQ ID NO: 3726344 - RNA, 15 nt, Salmonella enterica enterica serovar Typhi Ty2
uccggcgcauccagu

SEQ ID NO: 3726345 - RNA, 23 nt, Salmonella enterica enterica serovar Typhi Ty2
uccggcggugcagguugccugau

SEQ ID NO: 3726346 - RNA, 15 nt, Salmonella enterica enterica serovar Typhi Ty2
uccggcgucgcguuc

SEQ ID NO: 3726347 - RNA, 24 nt, Salmonella enterica enterica serovar Typhi Ty2
uccggcguuucguuuagcgccugc

SEQ ID NO: 3726348 - RNA, 19 nt, Salmonella enterica enterica serovar Typhi Ty2
uccggcguuuuagcgccau

SEQ ID NO: 3726349 - RNA, 17 nt, Salmonella enterica enterica serovar Typhi Ty2
uccggcuacgguuuuaa

SEQ ID NO: 3726350 - RNA, 15 nt, Salmonella enterica enterica serovar Typhi Ty2
uccggcuaugccgga

SEQ ID NO: 3726351 - RNA, 16 nt, Salmonella enterica enterica serovar Typhi Ty2
uccggcuaugccggag

SEQ ID NO: 3726352 - RNA, 16 nt, Salmonella enterica enterica serovar Typhi Ty2
uccggcucgccguguc

SEQ ID NO: 3726353 - RNA, 18 nt, Salmonella enterica enterica serovar Typhi Ty2
uccggcugcaccagcguu

SEQ ID NO: 3726354 - RNA, 18 nt, Salmonella enterica enterica serovar Typhi Ty2
uccggcugccugccggau

SEQ ID NO: 3726355 - RNA, 23 nt, Salmonella enterica enterica serovar Typhi Ty2
uccggcuguucgacgaauggcgg

SEQ ID NO: 3726356 - RNA, 16 nt, Salmonella enterica enterica serovar Typhi Ty2
uccgggauagcacuac

SEQ ID NO: 3726357 - RNA, 16 nt, Salmonella enterica enterica serovar Typhi Ty2
uccgggauauaaaauu

SEQ ID NO: 3726358 - RNA, 19 nt, Salmonella enterica enterica serovar Typhi Ty2
uccgggcgcaccaguuccc

SEQ ID NO: 3726359 - RNA, 21 nt, Salmonella enterica enterica serovar Typhi Ty2
uccggguaacggacucaggcc

SEQ ID NO: 3726360 - RNA, 13 nt, Salmonella enterica enterica serovar Typhi Ty2
uccgguacaccaa

SEQ ID NO: 3726361 - RNA, 17 nt, Salmonella enterica enterica serovar Typhi Ty2
uccgguacaccaacuac

SEQ ID NO: 3726362 - RNA, 15 nt, Salmonella enterica enterica serovar Typhi Ty2
uccgguacgccuaaa

SEQ ID NO: 3726363 - RNA, 18 nt, Salmonella enterica enterica serovar Typhi Ty2
uccgguaucaugcugaug

SEQ ID NO: 3726364 - RNA, 17 nt, Salmonella enterica enterica serovar Typhi Ty2
uccggugaagguaauuu

SEQ ID NO: 3726365 - RNA, 18 nt, Salmonella enterica enterica serovar Typhi Ty2
uccggugaagguaauuuu

SEQ ID NO: 3726366 - RNA, 16 nt, Salmonella enterica enterica serovar Typhi Ty2
uccggugcgcaggccg

SEQ ID NO: 3726367 - RNA, 16 nt, Salmonella enterica enterica serovar Typhi Ty2
uccggugugaccagcg

SEQ ID NO: 3726368 - RNA, 19 nt, Salmonella enterica enterica serovar Typhi Ty2
uccggugugaccagcgcgu

SEQ ID NO: 3726369 - RNA, 14 nt, Salmonella enterica enterica serovar Typhi Ty2
uccgguuccagcgg

SEQ ID NO: 3726370 - RNA, 20 nt, Salmonella enterica enterica serovar Typhi Ty2
uccguaagcggcggaccagc

SEQ ID NO: 3726371 - RNA, 18 nt, Salmonella enterica enterica serovar Typhi Ty2
uccguaaucgcuuucauu

SEQ ID NO: 3726372 - RNA, 16 nt, Salmonella enterica enterica serovar Typhi Ty2
uccguagcgauaauga

SEQ ID NO: 3726373 - RNA, 18 nt, Salmonella enterica enterica serovar Typhi Ty2
uccguagcgauaaugacg

SEQ ID NO: 3726374 - RNA, 19 nt, Salmonella enterica enterica serovar Typhi Ty2
uccguauucggaauaaugu

SEQ ID NO: 3726375 - RNA, 15 nt, Salmonella enterica enterica serovar Typhi Ty2
uccgucaaagaaaac

SEQ ID NO: 3726376 - RNA, 16 nt, Salmonella enterica enterica serovar Typhi Ty2
uccugucgucaccagc

SEQ ID NO: 3726377 - RNA, 16 nt, Salmonella enterica enterica serovar Typhi Ty2
uccugugaaguaaaaa

SEQ ID NO: 3726378 - RNA, 14 nt, Salmonella enterica enterica serovar Typhi Ty2
uccugugucggcag

SEQ ID NO: 3726379 - RNA, 20 nt, Salmonella enterica enterica serovar Typhi Ty2
uccuguuuaagcccggccuu

SEQ ID NO: 3726380 - RNA, 19 nt, Salmonella enterica enterica serovar Typhi Ty2
uccuguuuuuucagcgcgc

SEQ ID NO: 3726381 - RNA, 21 nt, Salmonella enterica enterica serovar Typhi Ty2
uccuuacuucgauggccucau

SEQ ID NO: 3726382 - RNA, 17 nt, Salmonella enterica enterica serovar Typhi Ty2
uccuuauaaugcuuacg

SEQ ID NO: 3726383 - RNA, 18 nt, Salmonella enterica enterica serovar Typhi Ty2
uccuuauaaugcuuacgg

SEQ ID NO: 3726384 - RNA, 15 nt, Salmonella enterica enterica serovar Typhi Ty2
uccuuaucacauuuu

SEQ ID NO: 3726385 - RNA, 13 nt, Salmonella enterica enterica serovar Typhi Ty2
uccuuaucagacu

SEQ ID NO: 3726386 - RNA, 17 nt, Salmonella enterica enterica serovar Typhi Ty2
uccuucacaaacuucuc

SEQ ID NO: 3726387 - RNA, 13 nt, Salmonella enterica enterica serovar Typhi Ty2
uccuucauucaga

SEQ ID NO: 3726388 - RNA, 15 nt, Salmonella enterica enterica serovar Typhi Ty2
uccuucccccaccac

SEQ ID NO: 3726389 - RNA, 16 nt, Salmonella enterica enterica serovar Typhi Ty2
uccuuccgcuuuaagc

SEQ ID NO: 3726390 - RNA, 17 nt, Salmonella enterica enterica serovar Typhi Ty2
uccuucguuacuuucau

SEQ ID NO: 3726391 - RNA, 20 nt, Salmonella enterica enterica serovar Typhi Ty2
uccuucguuacuuucauaau

SEQ ID NO: 3726392 - RNA, 10 nt, Salmonella enterica enterica serovar Typhi Ty2
uccuucuucc

SEQ ID NO: 3726393 - RNA, 13 nt, Salmonella enterica enterica serovar Typhi Ty2
uccuucuuccauu

SEQ ID NO: 3726394 - RNA, 11 nt, Salmonella enterica enterica serovar Typhi Ty2
uccuucuuccg

SEQ ID NO: 3726395 - RNA, 16 nt, Salmonella enterica enterica serovar Typhi Ty2
uccuucuucgccguca

SEQ ID NO: 3726396 - RNA, 19 nt, Salmonella enterica enterica serovar Typhi Ty2
uccuugcacgccaaaaagu

SEQ ID NO: 3726397 - RNA, 14 nt, Salmonella enterica enterica serovar Typhi Ty2
uccuugcagccaga

SEQ ID NO: 3726398 - RNA, 23 nt, Salmonella enterica enterica serovar Typhi Ty2
uccuugcagccagaacucaucuu

SEQ ID NO: 3726399 - RNA, 15 nt, Salmonella enterica enterica serovar Typhi Ty2
uccuuguaggccgga

SEQ ID NO: 3726400 - RNA, 18 nt, Salmonella enterica enterica serovar Typhi Ty2
uccuuuaaucgccgugcc

SEQ ID NO: 3726401 - RNA, 21 nt, Salmonella enterica enterica serovar Typhi Ty2
uccuuuacugcgccagccugc

SEQ ID NO: 3726402 - RNA, 15 nt, Salmonella enterica enterica serovar Typhi Ty2
uccuuuaucugcccu

SEQ ID NO: 3726403 - RNA, 19 nt, Salmonella enterica enterica serovar Typhi Ty2
uccuuuaucugcccuuucu

SEQ ID NO: 3726404 - RNA, 19 nt, Salmonella enterica enterica serovar Typhi Ty2
uccuuucggacuuccugua

SEQ ID NO: 3726405 - RNA, 18 nt, Salmonella enterica enterica serovar Typhi Ty2
ucgaaacaggaaaaacau

SEQ ID NO: 3726406 - RNA, 16 nt, Salmonella enterica enterica serovar Typhi Ty2
ucgaaagagcaaauac

SEQ ID NO: 3726407 - RNA, 22 nt, Salmonella enterica enterica serovar Typhi Ty2
ucgaaagagcaaauacuggaaa

SEQ ID NO: 3726408 - RNA, 16 nt, Salmonella enterica enterica serovar Typhi Ty2
ucgaaauaaagaaagu

SEQ ID NO: 3726409 - RNA, 20 nt, Salmonella enterica enterica serovar Typhi Ty2
ucgaaaugccuuaccuggca

SEQ ID NO: 3726410 - RNA, 19 nt, Salmonella enterica enterica serovar Typhi Ty2
ucgaacagcggcaggcgga

SEQ ID NO: 3726411 - RNA, 20 nt, Salmonella enterica enterica serovar Typhi Ty2
ucgaacagguuguugauguu

SEQ ID NO: 3726412 - RNA, 14 nt, Salmonella enterica enterica serovar Typhi Ty2
ucgaacaucugcgu

SEQ ID NO: 3726413 - RNA, 11 nt, Salmonella enterica enterica serovar Typhi Ty2
ucgaacgccgc

SEQ ID NO: 3726414 - RNA, 23 nt, Salmonella enterica enterica serovar Typhi Ty2
ucgaacgccgccugcgccagcgc

SEQ ID NO: 3726415 - RNA, 19 nt, Salmonella enterica enterica serovar Typhi Ty2
ucgaacgcuuccgggcuca

SEQ ID NO: 3726416 - RNA, 19 nt, Salmonella enterica enterica serovar Typhi Ty2
ucgaacucuucgcaaccgg

SEQ ID NO: 3726417 - RNA, 15 nt, Salmonella enterica enterica serovar Typhi Ty2
ucgaagaccuggccg

SEQ ID NO: 3726418 - RNA, 21 nt, Salmonella enterica enterica serovar Typhi Ty2
ucgaauaaagacacugcugcu

SEQ ID NO: 3726419 - RNA, 17 nt, Salmonella enterica enterica serovar Typhi Ty2
ucgaaucgccucaacca

SEQ ID NO: 3726420 - RNA, 14 nt, Salmonella enterica enterica serovar Typhi Ty2
ucgaaugagaacga

SEQ ID NO: 3726421 - RNA, 15 nt, Salmonella enterica enterica serovar Typhi Ty2
ucgacaaagccgacg

SEQ ID NO: 3726422 - RNA, 14 nt, Salmonella enterica enterica serovar Typhi Ty2
ucgacaaaggcaag

SEQ ID NO: 3726423 - RNA, 16 nt, Salmonella enterica enterica serovar Typhi Ty2
ucgacaagcuaauccc

SEQ ID NO: 3726424 - RNA, 22 nt, Salmonella enterica enterica serovar Typhi Ty2
ucgacaagcuaauccccagcgc

SEQ ID NO: 3726425 - RNA, 15 nt, Salmonella enterica enterica serovar Typhi Ty2
ucgacaauccgccac

SEQ ID NO: 3726426 - RNA, 19 nt, Salmonella enterica enterica serovar Typhi Ty2
ucgacagagaauuucaccg

SEQ ID NO: 3726427 - RNA, 20 nt, Salmonella enterica enterica serovar Typhi Ty2
ucgacagccagcauuuccag

SEQ ID NO: 3726428 - RNA, 15 nt, Salmonella enterica enterica serovar Typhi Ty2
ucgacaggaguauag

SEQ ID NO: 3726429 - RNA, 14 nt, Salmonella enterica enterica serovar Typhi Ty2
ucgacaggcguaaa

SEQ ID NO: 3726430 - RNA, 22 nt, Salmonella enterica enterica serovar Typhi Ty2
ucgacaguucccggcaacagua

SEQ ID NO: 3726431 - RNA, 13 nt, Salmonella enterica enterica serovar Typhi Ty2
ucgacaucuucau

SEQ ID NO: 3726432 - RNA, 14 nt, Salmonella enterica enterica serovar Typhi Ty2
ucgacauuacccau

SEQ ID NO: 3726433 - RNA, 19 nt, Salmonella enterica enterica serovar Typhi Ty2
ucgacauuagcaucccgca

SEQ ID NO: 3726434 - RNA, 20 nt, Salmonella enterica enterica serovar Typhi Ty2
ucgaccucuucguucauccg

SEQ ID NO: 3726435 - RNA, 21 nt, Salmonella enterica enterica serovar Typhi Ty2
ucgaccugcguuaacggcuuc

SEQ ID NO: 3726436 - RNA, 17 nt, Salmonella enterica enterica serovar Typhi Ty2
ucgaccuggcgcucaau

SEQ ID NO: 3726437 - RNA, 17 nt, Salmonella enterica enterica serovar Typhi Ty2
ucgaccuucaucucuuu

SEQ ID NO: 3726438 - RNA, 13 nt, Salmonella enterica enterica serovar Typhi Ty2
ucgacgaaauggu

SEQ ID NO: 3726439 - RNA, 16 nt, Salmonella enterica enterica serovar Typhi Ty2
ucgacgaaauggugug

SEQ ID NO: 3726440 - RNA, 17 nt, Salmonella enterica enterica serovar Typhi Ty2
ucgacgauaaaaaaagu

SEQ ID NO: 3726441 - RNA, 20 nt, Salmonella enterica enterica serovar Typhi Ty2
ucgacgccgguuaguaguag

SEQ ID NO: 3726442 - RNA, 14 nt, Salmonella enterica enterica serovar Typhi Ty2
ucgacgcgcaucac

SEQ ID NO: 3726443 - RNA, 19 nt, Salmonella enterica enterica serovar Typhi Ty2
ucgacgcuauuuuucaggg

SEQ ID NO: 3726444 - RNA, 13 nt, Salmonella enterica enterica serovar Typhi Ty2
ucgacggcaaccu

SEQ ID NO: 3726445 - RNA, 21 nt, Salmonella enterica enterica serovar Typhi Ty2
ucgacgggacgaauuuccagc

SEQ ID NO: 3726446 - RNA, 20 nt, Salmonella enterica enterica serovar Typhi Ty2
ucgacguucagcauauccag

SEQ ID NO: 3726447 - RNA, 17 nt, Salmonella enterica enterica serovar Typhi Ty2
ucgacguuuuccaucac

SEQ ID NO: 3726448 - RNA, 15 nt, Salmonella enterica enterica serovar Typhi Ty2
ucgagauaaugcuca

SEQ ID NO: 3726449 - RNA, 11 nt, Salmonella enterica enterica serovar Typhi Ty2
ucgagcgcgga

SEQ ID NO: 3726450 - RNA, 16 nt, Salmonella enterica enterica serovar Typhi Ty2
ucgagcucaguccagc

SEQ ID NO: 3726451 - RNA, 15 nt, Salmonella enterica enterica serovar Typhi Ty2
ucgaggccauauuua

SEQ ID NO: 3726452 - RNA, 19 nt, Salmonella enterica enterica serovar Typhi Ty2
ucgagugucaauaagccag

SEQ ID NO: 3726453 - RNA, 20 nt, Salmonella enterica enterica serovar Typhi Ty2
ucgaguucuucacgcugaug

SEQ ID NO: 3726454 - RNA, 14 nt, Salmonella enterica enterica serovar Typhi Ty2
ucgauaaacucaug

SEQ ID NO: 3726455 - RNA, 21 nt, Salmonella enterica enterica serovar Typhi Ty2
ucgauaaagcgguuaucggca

SEQ ID NO: 3726456 - RNA, 16 nt, Salmonella enterica enterica serovar Typhi Ty2
ucgauaaccaccagcg

SEQ ID NO: 3726457 - RNA, 14 nt, Salmonella enterica enterica serovar Typhi Ty2
ucgauaaccgccga

SEQ ID NO: 3726458 - RNA, 23 nt, Salmonella enterica enterica serovar Typhi Ty2
ucgccagaucgauauccgugcgc

SEQ ID NO: 3726459 - RNA, 22 nt, Salmonella enterica enterica serovar Typhi Ty2
ucgccagaugucggcggcaggu

SEQ ID NO: 3726460 - RNA, 11 nt, Salmonella enterica enterica serovar Typhi Ty2
ucgccagcaac

SEQ ID NO: 3726461 - RNA, 18 nt, Salmonella enterica enterica serovar Typhi Ty2
ucgccagcaacgcccaga

SEQ ID NO: 3726462 - RNA, 21 nt, Salmonella enterica enterica serovar Typhi Ty2
ucgccagcaacgcccagauau

SEQ ID NO: 3726463 - RNA, 19 nt, Salmonella enterica enterica serovar Typhi Ty2
ucgccagccauucaccacu

SEQ ID NO: 3726464 - RNA, 18 nt, Salmonella enterica enterica serovar Typhi Ty2
ucgccagcccgaucaucu

SEQ ID NO: 3726465 - RNA, 19 nt, Salmonella enterica enterica serovar Typhi Ty2
ucgccagccugaacaucuu

SEQ ID NO: 3726466 - RNA, 22 nt, Salmonella enterica enterica serovar Typhi Ty2
ucgccagcgcaucgauauaagc

SEQ ID NO: 3726467 - RNA, 16 nt, Salmonella enterica enterica serovar Typhi Ty2
ucgccauaaagcugua

SEQ ID NO: 3726468 - RNA, 21 nt, Salmonella enterica enterica serovar Typhi Ty2
ucgccauaaaucagauccacg

SEQ ID NO: 3726469 - RNA, 18 nt, Salmonella enterica enterica serovar Typhi Ty2
ucgccauauguuccaccg

SEQ ID NO: 3726470 - RNA, 13 nt, Salmonella enterica enterica serovar Typhi Ty2
ucgccauccagau

SEQ ID NO: 3726471 - RNA, 20 nt, Salmonella enterica enterica serovar Typhi Ty2
ucgccauccggcaaauccuc

SEQ ID NO: 3726472 - RNA, 18 nt, Salmonella enterica enterica serovar Typhi Ty2
ucgccaucgauagcagcg

SEQ ID NO: 3726473 - RNA, 17 nt, Salmonella enterica enterica serovar Typhi Ty2
ucgccaugcaccacgac

SEQ ID NO: 3726474 - RNA, 19 nt, Salmonella enterica enterica serovar Typhi Ty2
ucgccauuaaacucaucgc

SEQ ID NO: 3726475 - RNA, 18 nt, Salmonella enterica enterica serovar Typhi Ty2
ucgccauuccaagaauga

SEQ ID NO: 3726476 - RNA, 22 nt, Salmonella enterica enterica serovar Typhi Ty2
ucgcccaaauaguccagcagcc

SEQ ID NO: 3726477 - RNA, 15 nt, Salmonella enterica enterica serovar Typhi Ty2
ucgcccacgcccaga

SEQ ID NO: 3726478 - RNA, 12 nt, Salmonella enterica enterica serovar Typhi Ty2
ucgcccagaugg

SEQ ID NO: 3726479 - RNA, 19 nt, Salmonella enterica enterica serovar Typhi Ty2
ucgcccagcacuaacagca

SEQ ID NO: 3726480 - RNA, 11 nt, Salmonella enterica enterica serovar Typhi Ty2
ucgccccacac

SEQ ID NO: 3726481 - RNA, 21 nt, Salmonella enterica enterica serovar Typhi Ty2
ucgccccguaaaccaauacgc

SEQ ID NO: 3726482 - RNA, 16 nt, Salmonella enterica enterica serovar Typhi Ty2
ucgcccgcaccgccga

SEQ ID NO: 3726483 - RNA, 18 nt, Salmonella enterica enterica serovar Typhi Ty2
ucgcccgccgcaaaaaau

SEQ ID NO: 3726484 - RNA, 22 nt, Salmonella enterica enterica serovar Typhi Ty2
ucgcccgggcgauaucacggaa

SEQ ID NO: 3726485 - RNA, 14 nt, Salmonella enterica enterica serovar Typhi Ty2
ucgcccucgccagc

SEQ ID NO: 3726486 - RNA, 14 nt, Salmonella enterica enterica serovar Typhi Ty2
ucgcccugcaauuc

SEQ ID NO: 3726487 - RNA, 14 nt, Salmonella enterica enterica serovar Typhi Ty2
ucgcccugcgucgc

SEQ ID NO: 3726488 - RNA, 19 nt, Salmonella enterica enterica serovar Typhi Ty2
ucgcccuucaucuuccagu

SEQ ID NO: 3726489 - RNA, 21 nt, Salmonella enterica enterica serovar Typhi Ty2
ucgcccuucgggccgccgcaa

SEQ ID NO: 3726490 - RNA, 15 nt, Salmonella enterica enterica serovar Typhi Ty2
ucgcccuuuucgcaa

SEQ ID NO: 3726491 - RNA, 15 nt, Salmonella enterica enterica serovar Typhi Ty2
ucgccgaagcggcag

SEQ ID NO: 3726492 - RNA, 19 nt, Salmonella enterica enterica serovar Typhi Ty2
ucgccgacaugcuccugca

SEQ ID NO: 3726493 - RNA, 18 nt, Salmonella enterica enterica serovar Typhi Ty2
ucgccgccaucggcgcgu

SEQ ID NO: 3726494 - RNA, 21 nt, Salmonella enterica enterica serovar Typhi Ty2
ucgccgcgacgcgcgagcgca

SEQ ID NO: 3726495 - RNA, 22 nt, Salmonella enterica enterica serovar Typhi Ty2
ucgccgcgauaauaauuaccac

SEQ ID NO: 3726496 - RNA, 20 nt, Salmonella enterica enterica serovar Typhi Ty2
ucgccgcgccggacuccagc

SEQ ID NO: 3726497 - RNA, 23 nt, Salmonella enterica enterica serovar Typhi Ty2
ucgccgcgccggacuccagcaac

SEQ ID NO: 3726498 - RNA, 18 nt, Salmonella enterica enterica serovar Typhi Ty2
ucgccgcgcgaagaggau

SEQ ID NO: 3726499 - RNA, 16 nt, Salmonella enterica enterica serovar Typhi Ty2
ucgccgcggcgcuggc

SEQ ID NO: 3726500 - RNA, 18 nt, Salmonella enterica enterica serovar Typhi Ty2
ucgccgcguuuaaguccc

SEQ ID NO: 3726501 - RNA, 23 nt, Salmonella enterica enterica serovar Typhi Ty2
ucgccgcugauucguuuuuacac

SEQ ID NO: 3726502 - RNA, 19 nt, Salmonella enterica enterica serovar Typhi Ty2
ucgccgcuuucugagccgc

SEQ ID NO: 3726503 - RNA, 17 nt, Salmonella enterica enterica serovar Typhi Ty2
ucgccggauggcggcga

SEQ ID NO: 3726504 - RNA, 20 nt, Salmonella enterica enterica serovar Typhi Ty2
ucgccggcagacgauagcgg

SEQ ID NO: 3726505 - RNA, 16 nt, Salmonella enterica enterica serovar Typhi Ty2
ucgccggcgucaucgg

SEQ ID NO: 3726506 - RNA, 21 nt, Salmonella enterica enterica serovar Typhi Ty2
ucgccgggaugcuuuccgguu

SEQ ID NO: 3726507 - RNA, 15 nt, Salmonella enterica enterica serovar Typhi Ty2
ucgccgggcggcgca

SEQ ID NO: 3726508 - RNA, 23 nt, Salmonella enterica enterica serovar Typhi Ty2
ucgccguaaaacaacagcggcgu

SEQ ID NO: 3726509 - RNA, 19 nt, Salmonella enterica enterica serovar Typhi Ty2
ucgccgucguucagccagc

SEQ ID NO: 3726510 - RNA, 22 nt, Salmonella enterica enterica serovar Typhi Ty2
ucgccguuaaaccguuaugaau

SEQ ID NO: 3726511 - RNA, 18 nt, Salmonella enterica enterica serovar Typhi Ty2
ucgccguuaacuggcgca

SEQ ID NO: 3726512 - RNA, 22 nt, Salmonella enterica enterica serovar Typhi Ty2
ucgccguuaacuggcgcaucug

SEQ ID NO: 3726513 - RNA, 16 nt, Salmonella enterica enterica serovar Typhi Ty2
ucgccucauucgggca

SEQ ID NO: 3726514 - RNA, 13 nt, Salmonella enterica enterica serovar Typhi Ty2
ucgccucccgcac

SEQ ID NO: 3726515 - RNA, 15 nt, Salmonella enterica enterica serovar Typhi Ty2
ucgccucccugccua

SEQ ID NO: 3726516 - RNA, 18 nt, Salmonella enterica enterica serovar Typhi Ty2
ucgccucccugccuaaag

SEQ ID NO: 3726517 - RNA, 20 nt, Salmonella enterica enterica serovar Typhi Ty2
ucgccugaaugcacugcuga

SEQ ID NO: 3726518 - RNA, 14 nt, Salmonella enterica enterica serovar Typhi Ty2
ucgccugacaggag

SEQ ID NO: 3726519 - RNA, 22 nt, Salmonella enterica enterica serovar Typhi Ty2
ucgccugauauaaucgaaucgc

SEQ ID NO: 3726520 - RNA, 16 nt, Salmonella enterica enterica serovar Typhi Ty2
ucgccugaugaccgcc

SEQ ID NO: 3726521 - RNA, 22 nt, Salmonella enterica enterica serovar Typhi Ty2
ucgccugauucaccaacugcug

SEQ ID NO: 3726522 - RNA, 20 nt, Salmonella enterica enterica serovar Typhi Ty2
ucgccugccagcgcucugca

SEQ ID NO: 3726523 - RNA, 20 nt, Salmonella enterica enterica serovar Typhi Ty2
ucgccuguaccgggcagaca

SEQ ID NO: 3726524 - RNA, 16 nt, Salmonella enterica enterica serovar Typhi Ty2
ucgccugucugucgcg

SEQ ID NO: 3726525 - RNA, 15 nt, Salmonella enterica enterica serovar Typhi Ty2
ucgccuguuucugcg

SEQ ID NO: 3726526 - RNA, 13 nt, Salmonella enterica enterica serovar Typhi Ty2
ucgccuucauccg

SEQ ID NO: 3726527 - RNA, 17 nt, Salmonella enterica enterica serovar Typhi Ty2
ucgccuucauccgcaua

SEQ ID NO: 3726528 - RNA, 15 nt, Salmonella enterica enterica serovar Typhi Ty2
ucgccuuucaccagc

SEQ ID NO: 3726529 - RNA, 16 nt, Salmonella enterica enterica serovar Typhi Ty2
ucgccuuucaccagcg

SEQ ID NO: 3726530 - RNA, 22 nt, Salmonella enterica enterica serovar Typhi Ty2
ucgcgaauagugcaggaaggcg

SEQ ID NO: 3726531 - RNA, 16 nt, Salmonella enterica enterica serovar Typhi Ty2
ucgcgacugauaccca

SEQ ID NO: 3726532 - RNA, 20 nt, Salmonella enterica enterica serovar Typhi Ty2
ucgcgagaaaauagaggaaa

SEQ ID NO: 3726533 - RNA, 19 nt, Salmonella enterica enterica serovar Typhi Ty2
ucgcgauacugccgcccau

SEQ ID NO: 3726534 - RNA, 14 nt, Salmonella enterica enterica serovar Typhi Ty2
ucgcgauccagccc

SEQ ID NO: 3726535 - RNA, 14 nt, Salmonella enterica enterica serovar Typhi Ty2
ucgcgauccgccag

SEQ ID NO: 3726536 - RNA, 15 nt, Salmonella enterica enterica serovar Typhi Ty2
ucgcgauucgggccg

SEQ ID NO: 3726537 - RNA, 15 nt, Salmonella enterica enterica serovar Typhi Ty2
ucgcgauuuuuuucc

SEQ ID NO: 3726538 - RNA, 15 nt, Salmonella enterica enterica serovar Typhi Ty2
ucgcgcaccauaaua

SEQ ID NO: 3726539 - RNA, 19 nt, Salmonella enterica enterica serovar Typhi Ty2
ucgcgcagauagagcgccu

SEQ ID NO: 3726540 - RNA, 22 nt, Salmonella enterica enterica serovar Typhi Ty2
ucgcuuuacccgggccaucuuu

SEQ ID NO: 3726541 - RNA, 23 nt, Salmonella enterica enterica serovar Typhi Ty2
ucgcuuuuacucuuccugcugcg

SEQ ID NO: 3726542 - RNA, 19 nt, Salmonella enterica enterica serovar Typhi Ty2
ucgcuuuuugcgccagcgc

SEQ ID NO: 3726543 - RNA, 19 nt, Salmonella enterica enterica serovar Typhi Ty2
ucggaaacuauccuggccu

SEQ ID NO: 3726544 - RNA, 19 nt, Salmonella enterica enterica serovar Typhi Ty2
ucggaaaucuguuccagcg

SEQ ID NO: 3726545 - RNA, 15 nt, Salmonella enterica enterica serovar Typhi Ty2
ucggaacgcuguaug

SEQ ID NO: 3726546 - RNA, 21 nt, Salmonella enterica enterica serovar Typhi Ty2
ucggaagacugcuccggcaag

SEQ ID NO: 3726547 - RNA, 18 nt, Salmonella enterica enterica serovar Typhi Ty2
ucggaagacuggcgcagc

SEQ ID NO: 3726548 - RNA, 19 nt, Salmonella enterica enterica serovar Typhi Ty2
ucggaagacuggcgcagca

SEQ ID NO: 3726549 - RNA, 22 nt, Salmonella enterica enterica serovar Typhi Ty2
ucggaaguauacauccacuggu

SEQ ID NO: 3726550 - RNA, 20 nt, Salmonella enterica enterica serovar Typhi Ty2
ucggaauaauguaaaaaaau

SEQ ID NO: 3726551 - RNA, 20 nt, Salmonella enterica enterica serovar Typhi Ty2
ucggaaugacaaacgccacc

SEQ ID NO: 3726552 - RNA, 21 nt, Salmonella enterica enterica serovar Typhi Ty2
ucggacacgacguggacgcug

SEQ ID NO: 3726553 - RNA, 23 nt, Salmonella enterica enterica serovar Typhi Ty2
ucggagaaauagacgagcgaaaa

SEQ ID NO: 3726554 - RNA, 18 nt, Salmonella enterica enterica serovar Typhi Ty2
ucggagauuucauccucu

SEQ ID NO: 3726555 - RNA, 16 nt, Salmonella enterica enterica serovar Typhi Ty2
ucggagguucgaaucc

SEQ ID NO: 3726556 - RNA, 21 nt, Salmonella enterica enterica serovar Typhi Ty2
ucggagguuuucucauccagc

SEQ ID NO: 3726557 - RNA, 19 nt, Salmonella enterica enterica serovar Typhi Ty2
ucggauaaacgcugcgcaa

SEQ ID NO: 3726558 - RNA, 19 nt, Salmonella enterica enterica serovar Typhi Ty2
ucggauaaggcguuuacgc

SEQ ID NO: 3726559 - RNA, 16 nt, Salmonella enterica enterica serovar Typhi Ty2
ucggaugaucgucaac

SEQ ID NO: 3726560 - RNA, 14 nt, Salmonella enterica enterica serovar Typhi Ty2
ucggauguacugua

SEQ ID NO: 3726561 - RNA, 17 nt, Salmonella enterica enterica serovar Typhi Ty2
ucggcaaacagcuucau

SEQ ID NO: 3726562 - RNA, 18 nt, Salmonella enterica enterica serovar Typhi Ty2
ucggcaaacauagccuca

SEQ ID NO: 3726563 - RNA, 20 nt, Salmonella enterica enterica serovar Typhi Ty2
ucggcaaacgccgccuggau

SEQ ID NO: 3726564 - RNA, 13 nt, Salmonella enterica enterica serovar Typhi Ty2
ucggcaaagccca

SEQ ID NO: 3726565 - RNA, 14 nt, Salmonella enterica enterica serovar Typhi Ty2
ucggcaaagucuuu

SEQ ID NO: 3726566 - RNA, 19 nt, Salmonella enterica enterica serovar Typhi Ty2
ucggcaagaauuucaauca

SEQ ID NO: 3726567 - RNA, 21 nt, Salmonella enterica enterica serovar Typhi Ty2
ucggcaauaugcuguuuaugg

SEQ ID NO: 3726568 - RNA, 18 nt, Salmonella enterica enterica serovar Typhi Ty2
ucggcaauggccagauga

SEQ ID NO: 3726569 - RNA, 21 nt, Salmonella enterica enterica serovar Typhi Ty2
ucggcaauuuccggcgacgua

SEQ ID NO: 3726570 - RNA, 14 nt, Salmonella enterica enterica serovar Typhi Ty2
ucggcaauuucuuu

SEQ ID NO: 3726571 - RNA, 18 nt, Salmonella enterica enterica serovar Typhi Ty2
ucggcagcaauacgcccg

SEQ ID NO: 3726572 - RNA, 13 nt, Salmonella enterica enterica serovar Typhi Ty2
ucggguuuuccug

SEQ ID NO: 3726573 - RNA, 15 nt, Salmonella enterica enterica serovar Typhi Ty2
ucgguaaugggcgau

SEQ ID NO: 3726574 - RNA, 22 nt, Salmonella enterica enterica serovar Typhi Ty2
ucgguacgcgucugaaugacgc

SEQ ID NO: 3726575 - RNA, 15 nt, Salmonella enterica enterica serovar Typhi Ty2
ucgguacuccccuuu

SEQ ID NO: 3726576 - RNA, 19 nt, Salmonella enterica enterica serovar Typhi Ty2
ucgguaguguuaucgccga

SEQ ID NO: 3726577 - RNA, 22 nt, Salmonella enterica enterica serovar Typhi Ty2
ucggucaucagggcguaagcgc

SEQ ID NO: 3726578 - RNA, 19 nt, Salmonella enterica enterica serovar Typhi Ty2
ucggugacggaaaccagca

SEQ ID NO: 3726579 - RNA, 14 nt, Salmonella enterica enterica serovar Typhi Ty2
ucggugauccagca

SEQ ID NO: 3726580 - RNA, 13 nt, Salmonella enterica enterica serovar Typhi Ty2
ucggugcccggcu

SEQ ID NO: 3726581 - RNA, 17 nt, Salmonella enterica enterica serovar Typhi Ty2
ucgguggaaaccgcaga

SEQ ID NO: 3726582 - RNA, 18 nt, Salmonella enterica enterica serovar Typhi Ty2
ucgguggaaaccgcagaa

SEQ ID NO: 3726583 - RNA, 15 nt, Salmonella enterica enterica serovar Typhi Ty2
ucgguggauaaauuu

SEQ ID NO: 3726584 - RNA, 22 nt, Salmonella enterica enterica serovar Typhi Ty2
ucggugguuuuaacccccagca

SEQ ID NO: 3726585 - RNA, 23 nt, Salmonella enterica enterica serovar Typhi Ty2
ucgguugauguaugaacugcauc

SEQ ID NO: 3726586 - RNA, 16 nt, Salmonella enterica enterica serovar Typhi Ty2
ucgguuuauccccgcu

SEQ ID NO: 3726587 - RNA, 23 nt, Salmonella enterica enterica serovar Typhi Ty2
ucgguuucgcggcguucauggca

SEQ ID NO: 3726588 - RNA, 20 nt, Salmonella enterica enterica serovar Typhi Ty2
ucguaaacacgacgccgccg

SEQ ID NO: 3726589 - RNA, 19 nt, Salmonella enterica enterica serovar Typhi Ty2
ucguaaagcgcauccagcu

SEQ ID NO: 3726590 - RNA, 22 nt, Salmonella enterica enterica serovar Typhi Ty2
ucguaacgcauauccagcagau

SEQ ID NO: 3726591 - RNA, 16 nt, Salmonella enterica enterica serovar Typhi Ty2
ucguaaucuaaaauua

SEQ ID NO: 3726592 - RNA, 18 nt, Salmonella enterica enterica serovar Typhi Ty2
ucguaaugagcacuuucc

SEQ ID NO: 3726593 - RNA, 11 nt, Salmonella enterica enterica serovar Typhi Ty2
ucguaccuuca

SEQ ID NO: 3726594 - RNA, 14 nt, Salmonella enterica enterica serovar Typhi Ty2
ucguacguuuuucc

SEQ ID NO: 3726595 - RNA, 15 nt, Salmonella enterica enterica serovar Typhi Ty2
ucguagccgcgcgcc

SEQ ID NO: 3726596 - RNA, 21 nt, Salmonella enterica enterica serovar Typhi Ty2
ucguagcgaauaaucccggcg

SEQ ID NO: 3726597 - RNA, 18 nt, Salmonella enterica enterica serovar Typhi Ty2
ucguaguggaucagcaga

SEQ ID NO: 3726598 - RNA, 13 nt, Salmonella enterica enterica serovar Typhi Ty2
ucguauccccagu

SEQ ID NO: 3726599 - RNA, 21 nt, Salmonella enterica enterica serovar Typhi Ty2
ucguauccccagucuuccugc

SEQ ID NO: 3726600 - RNA, 12 nt, Salmonella enterica enterica serovar Typhi Ty2
ucguauuauugg

SEQ ID NO: 3726601 - RNA, 14 nt, Salmonella enterica enterica serovar Typhi Ty2
ucguauuauuggug

SEQ ID NO: 3726602 - RNA, 19 nt, Salmonella enterica enterica serovar Typhi Ty2
ucguauuggggaucgggca

SEQ ID NO: 3726603 - RNA, 15 nt, Salmonella enterica enterica serovar Typhi Ty2
ucguauuuauuuucu

SEQ ID NO: 3726604 - RNA, 19 nt, Salmonella enterica enterica serovar Typhi Ty2
ucgucaaugugaauccagg

SEQ ID NO: 3726605 - RNA, 13 nt, Salmonella enterica enterica serovar Typhi Ty2
ucgucacagaccc

SEQ ID NO: 3726606 - RNA, 12 nt, Salmonella enterica enterica serovar Typhi Ty2
ucgucaccagca

SEQ ID NO: 3726607 - RNA, 19 nt, Salmonella enterica enterica serovar Typhi Ty2
ucgucaccggaucgcugag

SEQ ID NO: 3726608 - RNA, 19 nt, Salmonella enterica enterica serovar Typhi Ty2
ucgucaccugauagcgggu

SEQ ID NO: 3726609 - RNA, 23 nt, Salmonella enterica enterica serovar Typhi Ty2
ucgucaccuguagggucgccgcg

SEQ ID NO: 3726610 - RNA, 21 nt, Salmonella enterica enterica serovar Typhi Ty2
ucgucaggccgccgcaaaagc

SEQ ID NO: 3726611 - RNA, 15 nt, Salmonella enterica enterica serovar Typhi Ty2
ucgucaggcggcugc

SEQ ID NO: 3726612 - RNA, 12 nt, Salmonella enterica enterica serovar Typhi Ty2
ucgucaguucca

SEQ ID NO: 3726613 - RNA, 20 nt, Salmonella enterica enterica serovar Typhi Ty2
ucgucauaaauacacgaggc

SEQ ID NO: 3726614 - RNA, 21 nt, Salmonella enterica enterica serovar Typhi Ty2
ucgucauagcguugauaugcu

SEQ ID NO: 3726615 - RNA, 23 nt, Salmonella enterica enterica serovar Typhi Ty2
ucgucauagugagcgacuucaaa

SEQ ID NO: 3726616 - RNA, 11 nt, Salmonella enterica enterica serovar Typhi Ty2
ucgucaucgcg

SEQ ID NO: 3726617 - RNA, 12 nt, Salmonella enterica enterica serovar Typhi Ty2
ucgucaugcgcc

SEQ ID NO: 3726618 - RNA, 13 nt, Salmonella enterica enterica serovar Typhi Ty2
ucgucauggcgua

SEQ ID NO: 3726619 - RNA, 15 nt, Salmonella enterica enterica serovar Typhi Ty2
ucgucauuaaugccu

SEQ ID NO: 3726620 - RNA, 19 nt, Salmonella enterica enterica serovar Typhi Ty2
ucgucccaggccagaugcg

SEQ ID NO: 3726621 - RNA, 12 nt, Salmonella enterica enterica serovar Typhi Ty2
ucguccugcaau

SEQ ID NO: 3726622 - RNA, 16 nt, Salmonella enterica enterica serovar Typhi Ty2
ucguccuguagccgug

SEQ ID NO: 3726623 - RNA, 18 nt, Salmonella enterica enterica serovar Typhi Ty2
ucgucgccaaucagcagc

SEQ ID NO: 3726624 - RNA, 23 nt, Salmonella enterica enterica serovar Typhi Ty2
ucgucgccaccaugcugguuggg

SEQ ID NO: 3726625 - RNA, 16 nt, Salmonella enterica enterica serovar Typhi Ty2
ucgucgccuuccagcg

SEQ ID NO: 3726626 - RNA, 17 nt, Salmonella enterica enterica serovar Typhi Ty2
ucgucgcuaagcgucag

SEQ ID NO: 3726627 - RNA, 15 nt, Salmonella enterica enterica serovar Typhi Ty2
ucgucggcaagaauu

SEQ ID NO: 3726628 - RNA, 22 nt, Salmonella enterica enterica serovar Typhi Ty2
ucgucggcaagaauuucaauca

SEQ ID NO: 3726629 - RNA, 16 nt, Salmonella enterica enterica serovar Typhi Ty2
ucgucgggauaagcga

SEQ ID NO: 3726630 - RNA, 21 nt, Salmonella enterica enterica serovar Typhi Ty2
ucgucuauuuccgcuucgcuu

SEQ ID NO: 3726631 - RNA, 16 nt, Salmonella enterica enterica serovar Typhi Ty2
ucgucugacgcuugca

SEQ ID NO: 3726632 - RNA, 23 nt, Salmonella enterica enterica serovar Typhi Ty2
ucgucuuguguggagguuucuuc

SEQ ID NO: 3726633 - RNA, 22 nt, Salmonella enterica enterica serovar Typhi Ty2
ucgugaaucaucaucauccgcg

SEQ ID NO: 3726634 - RNA, 23 nt, Salmonella enterica enterica serovar Typhi Ty2
ucgugaaucaucaucauccgcgc

SEQ ID NO: 3726635 - RNA, 15 nt, Salmonella enterica enterica serovar Typhi Ty2
ucgugacccacacau

SEQ ID NO: 3726636 - RNA, 13 nt, Salmonella enterica enterica serovar Typhi Ty2
ucgugaggaaaaa

SEQ ID NO: 3726637 - RNA, 13 nt, Salmonella enterica enterica serovar Typhi Ty2
ucgugauaacgcg

SEQ ID NO: 3726638 - RNA, 18 nt, Salmonella enterica enterica serovar Typhi Ty2
ucgugaucgccaaagcgu

SEQ ID NO: 3726639 - RNA, 20 nt, Salmonella enterica enterica serovar Typhi Ty2
ucgugcaggauucgaaccug

SEQ ID NO: 3726640 - RNA, 23 nt, Salmonella enterica enterica serovar Typhi Ty2
ucgugcaucaggaaauccuggau

SEQ ID NO: 3726641 - RNA, 16 nt, Salmonella enterica enterica serovar Typhi Ty2
ucguggcgcuguucuu

SEQ ID NO: 3726642 - RNA, 18 nt, Salmonella enterica enterica serovar Typhi Ty2
ucgugguuagacaucacg

SEQ ID NO: 3726643 - RNA, 21 nt, Salmonella enterica enterica serovar Typhi Ty2
ucgugugcgguauagaucaga

SEQ ID NO: 3726644 - RNA, 22 nt, Salmonella enterica enterica serovar Typhi Ty2
ucguuaaucucaaacuuggcca

SEQ ID NO: 3726645 - RNA, 19 nt, Salmonella enterica enterica serovar Typhi Ty2
ucguuaaugcuguccugca

SEQ ID NO: 3726646 - RNA, 14 nt, Salmonella enterica enterica serovar Typhi Ty2
ucguuaccagcauc

SEQ ID NO: 3726647 - RNA, 14 nt, Salmonella enterica enterica serovar Typhi Ty2
ucguuaccgcuuca

SEQ ID NO: 3726648 - RNA, 23 nt, Salmonella enterica enterica serovar Typhi Ty2
ucguuaccggcuccggcaaauuc

SEQ ID NO: 3726649 - RNA, 20 nt, Salmonella enterica enterica serovar Typhi Ty2
ucguuagcaaauugcugaug

SEQ ID NO: 3726650 - RNA, 23 nt, Salmonella enterica enterica serovar Typhi Ty2
ucguuagugauacgcggcugaug

SEQ ID NO: 3726651 - RNA, 13 nt, Salmonella enterica enterica serovar Typhi Ty2
ucguuauuuccga

SEQ ID NO: 3726652 - RNA, 19 nt, Salmonella enterica enterica serovar Typhi Ty2
ucguuauuuuccugaaaaa

SEQ ID NO: 3726653 - RNA, 21 nt, Salmonella enterica enterica serovar Typhi Ty2
ucguucaacggcaaaucgcgg

SEQ ID NO: 3726654 - RNA, 18 nt, Salmonella enterica enterica serovar Typhi Ty2
ucuccgucucucauuuuc

SEQ ID NO: 3726655 - RNA, 17 nt, Salmonella enterica enterica serovar Typhi Ty2
ucuccucuucaguaagc

SEQ ID NO: 3726656 - RNA, 20 nt, Salmonella enterica enterica serovar Typhi Ty2
ucuccugaagccagugcccg

SEQ ID NO: 3726657 - RNA, 21 nt, Salmonella enterica enterica serovar Typhi Ty2
ucuccugcgauagcugcugac

SEQ ID NO: 3726658 - RNA, 13 nt, Salmonella enterica enterica serovar Typhi Ty2
ucuccugcgccag

SEQ ID NO: 3726659 - RNA, 21 nt, Salmonella enterica enterica serovar Typhi Ty2
ucuccuguaaugaggcaaauc

SEQ ID NO: 3726660 - RNA, 19 nt, Salmonella enterica enterica serovar Typhi Ty2
ucucgaauccacuuuuguc

SEQ ID NO: 3726661 - RNA, 19 nt, Salmonella enterica enterica serovar Typhi Ty2
ucucgcaagauuccagaua

SEQ ID NO: 3726662 - RNA, 17 nt, Salmonella enterica enterica serovar Typhi Ty2
ucucgccaaaccacacc

SEQ ID NO: 3726663 - RNA, 16 nt, Salmonella enterica enterica serovar Typhi Ty2
ucucgcgaccagagac

SEQ ID NO: 3726664 - RNA, 14 nt, Salmonella enterica enterica serovar Typhi Ty2
ucucgcucgcccgc

SEQ ID NO: 3726665 - RNA, 22 nt, Salmonella enterica enterica serovar Typhi Ty2
ucucgcugccggaaagccccag

SEQ ID NO: 3726666 - RNA, 12 nt, Salmonella enterica enterica serovar Typhi Ty2
ucucgucaaggu

SEQ ID NO: 3726667 - RNA, 16 nt, Salmonella enterica enterica serovar Typhi Ty2
ucucuacacaacgcga

SEQ ID NO: 3726668 - RNA, 12 nt, Salmonella enterica enterica serovar Typhi Ty2
ucucuauugauu

SEQ ID NO: 3726669 - RNA, 15 nt, Salmonella enterica enterica serovar Typhi Ty2
ucucucauuuucuuu

SEQ ID NO: 3726670 - RNA, 17 nt, Salmonella enterica enterica serovar Typhi Ty2
ucucucccaggcauccu

SEQ ID NO: 3726671 - RNA, 14 nt, Salmonella enterica enterica serovar Typhi Ty2
ucucucccuggcag

SEQ ID NO: 3726672 - RNA, 20 nt, Salmonella enterica enterica serovar Typhi Ty2
ucucugaaaagaguagucuu

SEQ ID NO: 3726673 - RNA, 15 nt, Salmonella enterica enterica serovar Typhi Ty2
ucucugacaggaaug

SEQ ID NO: 3726674 - RNA, 19 nt, Salmonella enterica enterica serovar Typhi Ty2
ucucuguccggaauaacuc

SEQ ID NO: 3726675 - RNA, 15 nt, Salmonella enterica enterica serovar Typhi Ty2
ucucugucgccgccc

SEQ ID NO: 3726676 - RNA, 18 nt, Salmonella enterica enterica serovar Typhi Ty2
ucucuuaauguaaaacaa

SEQ ID NO: 3726677 - RNA, 19 nt, Salmonella enterica enterica serovar Typhi Ty2
ucucuuacguugcauuuau

SEQ ID NO: 3726678 - RNA, 16 nt, Salmonella enterica enterica serovar Typhi Ty2
ucucuucaauaacgaa

SEQ ID NO: 3726679 - RNA, 21 nt, Salmonella enterica enterica serovar Typhi Ty2
ucucuucaugcauaaccgcgc

SEQ ID NO: 3726680 - RNA, 16 nt, Salmonella enterica enterica serovar Typhi Ty2
ucucuuccgccagcgc

SEQ ID NO: 3726681 - RNA, 14 nt, Salmonella enterica enterica serovar Typhi Ty2
ucucuuccgcgguc

SEQ ID NO: 3726682 - RNA, 17 nt, Salmonella enterica enterica serovar Typhi Ty2
ucucuucgacaucuuca

SEQ ID NO: 3726683 - RNA, 22 nt, Salmonella enterica enterica serovar Typhi Ty2
ucucuucguuauuuuccugaaa

SEQ ID NO: 3726684 - RNA, 14 nt, Salmonella enterica enterica serovar Typhi Ty2
ucucuucuuuuaca

SEQ ID NO: 3726685 - RNA, 17 nt, Salmonella enterica enterica serovar Typhi Ty2
ucucuugcauaauaucc

SEQ ID NO: 3726686 - RNA, 15 nt, Salmonella enterica enterica serovar Typhi Ty2
ucucuugugcuucca

SEQ ID NO: 3726687 - RNA, 20 nt, Salmonella enterica enterica serovar Typhi Ty2
ucucuugugcuuccagcucc

SEQ ID NO: 3726688 - RNA, 14 nt, Salmonella enterica enterica serovar Typhi Ty2
ucucuuuagcgcua

SEQ ID NO: 3726689 - RNA, 12 nt, Salmonella enterica enterica serovar Typhi Ty2
ucucuuuauuga

SEQ ID NO: 3726690 - RNA, 14 nt, Salmonella enterica enterica serovar Typhi Ty2
ucucuuucaccagc

SEQ ID NO: 3726691 - RNA, 18 nt, Salmonella enterica enterica serovar Typhi Ty2
ucucuuuuugcagcagcg

SEQ ID NO: 3726692 - RNA, 23 nt, Salmonella enterica enterica serovar Typhi Ty2
ucugaaaaaccgucggcaauaca

SEQ ID NO: 3726693 - RNA, 20 nt, Salmonella enterica enterica serovar Typhi Ty2
ucugaaacgcuucaccggcg

SEQ ID NO: 3726694 - RNA, 23 nt, Salmonella enterica enterica serovar Typhi Ty2
ucugaaaguaagcuauuccugua

SEQ ID NO: 3726695 - RNA, 12 nt, Salmonella enterica enterica serovar Typhi Ty2
ucugaaaugcuc

SEQ ID NO: 3726696 - RNA, 16 nt, Salmonella enterica enterica serovar Typhi Ty2
ucugaagcguaaaaau

SEQ ID NO: 3726697 - RNA, 19 nt, Salmonella enterica enterica serovar Typhi Ty2
ucugaagcuaaccgcgcaa

SEQ ID NO: 3726698 - RNA, 15 nt, Salmonella enterica enterica serovar Typhi Ty2
ucugaaucagugcau

SEQ ID NO: 3726699 - RNA, 16 nt, Salmonella enterica enterica serovar Typhi Ty2
ucugaaucucuuccca

SEQ ID NO: 3726700 - RNA, 22 nt, Salmonella enterica enterica serovar Typhi Ty2
ucugaauuuccugcgcuuuuug

SEQ ID NO: 3726701 - RNA, 11 nt, Salmonella enterica enterica serovar Typhi Ty2
ucugacaucag

SEQ ID NO: 3726702 - RNA, 11 nt, Salmonella enterica enterica serovar Typhi Ty2
ucugaccaguu

SEQ ID NO: 3726703 - RNA, 13 nt, Salmonella enterica enterica serovar Typhi Ty2
ucugacggccugu

SEQ ID NO: 3726704 - RNA, 22 nt, Salmonella enterica enterica serovar Typhi Ty2
ucugacggguaguaucgcucua

SEQ ID NO: 3726705 - RNA, 20 nt, Salmonella enterica enterica serovar Typhi Ty2
ucugacugaucgauccacuu

SEQ ID NO: 3726706 - RNA, 13 nt, Salmonella enterica enterica serovar Typhi Ty2
ucugacugcguga

SEQ ID NO: 3726707 - RNA, 17 nt, Salmonella enterica enterica serovar Typhi Ty2
ucugacugcgugagugu

SEQ ID NO: 3726708 - RNA, 22 nt, Salmonella enterica enterica serovar Typhi Ty2
ucugagccaauuuaugccggag

SEQ ID NO: 3726709 - RNA, 16 nt, Salmonella enterica enterica serovar Typhi Ty2
ucugagcgcaaacauc

SEQ ID NO: 3726710 - RNA, 15 nt, Salmonella enterica enterica serovar Typhi Ty2
ucugaggauuuuuac

SEQ ID NO: 3726711 - RNA, 20 nt, Salmonella enterica enterica serovar Typhi Ty2
ucugauagcccuauucguga

SEQ ID NO: 3726712 - RNA, 21 nt, Salmonella enterica enterica serovar Typhi Ty2
ucugauagggacacauuucuu

SEQ ID NO: 3726713 - RNA, 14 nt, Salmonella enterica enterica serovar Typhi Ty2
ucugaugccugaag

SEQ ID NO: 3726714 - RNA, 23 nt, Salmonella enterica enterica serovar Typhi Ty2
ucugauuucgacgauaaaaaaag

SEQ ID NO: 3726715 - RNA, 17 nt, Salmonella enterica enterica serovar Typhi Ty2
ucugcaaaauauauaau

SEQ ID NO: 3726716 - RNA, 16 nt, Salmonella enterica enterica serovar Typhi Ty2
ucugcaccacgguguc

SEQ ID NO: 3726717 - RNA, 22 nt, Salmonella enterica enterica serovar Typhi Ty2
ucugcagcgagcgcauacgcug

SEQ ID NO: 3726718 - RNA, 21 nt, Salmonella enterica enterica serovar Typhi Ty2
ucugcaggcgggugcgcagcc

SEQ ID NO: 3726719 - RNA, 16 nt, Salmonella enterica enterica serovar Typhi Ty2
ucugccauuucugcuc

SEQ ID NO: 3726720 - RNA, 20 nt, Salmonella enterica enterica serovar Typhi Ty2
ucugccuguagcagcgccag

SEQ ID NO: 3726721 - RNA, 16 nt, Salmonella enterica enterica serovar Typhi Ty2
ucugccuuuaacaaau

SEQ ID NO: 3726722 - RNA, 14 nt, Salmonella enterica enterica serovar Typhi Ty2
ucugccuuuuuuaa

SEQ ID NO: 3726723 - RNA, 17 nt, Salmonella enterica enterica serovar Typhi Ty2
ucugcgcauuaacgcca

SEQ ID NO: 3726724 - RNA, 19 nt, Salmonella enterica enterica serovar Typhi Ty2
ucugcgccaccagcgcagu

SEQ ID NO: 3726725 - RNA, 22 nt, Salmonella enterica enterica serovar Typhi Ty2
ucugcgccagccagcucaccag

SEQ ID NO: 3726726 - RNA, 17 nt, Salmonella enterica enterica serovar Typhi Ty2
ucugcgccgcaucgcca

SEQ ID NO: 3726727 - RNA, 18 nt, Salmonella enterica enterica serovar Typhi Ty2
ucugcgccgcuugugccg

SEQ ID NO: 3726728 - RNA, 17 nt, Salmonella enterica enterica serovar Typhi Ty2
ucugcgccuuuuaccuu

SEQ ID NO: 3726729 - RNA, 20 nt, Salmonella enterica enterica serovar Typhi Ty2
ucugcgcgccgcaggccgga

SEQ ID NO: 3726730 - RNA, 13 nt, Salmonella enterica enterica serovar Typhi Ty2
ucugcgugaagac

SEQ ID NO: 3726731 - RNA, 21 nt, Salmonella enterica enterica serovar Typhi Ty2
ucugcgugacgccaagcagcg

SEQ ID NO: 3726732 - RNA, 22 nt, Salmonella enterica enterica serovar Typhi Ty2
ucugcgugagccggacacugcg

SEQ ID NO: 3726733 - RNA, 13 nt, Salmonella enterica enterica serovar Typhi Ty2
ucugcguugcgcg

SEQ ID NO: 3726734 - RNA, 17 nt, Salmonella enterica enterica serovar Typhi Ty2
ucugcucagaaauauuc

SEQ ID NO: 3726735 - RNA, 14 nt, Salmonella enterica enterica serovar Typhi Ty2
ucugcuccgccagc

SEQ ID NO: 3726736 - RNA, 18 nt, Salmonella enterica enterica serovar Typhi Ty2
ucuuauuagcgauuuaau

SEQ ID NO: 3726737 - RNA, 15 nt, Salmonella enterica enterica serovar Typhi Ty2
ucuuauuauuauugu

SEQ ID NO: 3726738 - RNA, 13 nt, Salmonella enterica enterica serovar Typhi Ty2
ucuucaaacggca

SEQ ID NO: 3726739 - RNA, 22 nt, Salmonella enterica enterica serovar Typhi Ty2
ucuucaacauugucgaacugca

SEQ ID NO: 3726740 - RNA, 22 nt, Salmonella enterica enterica serovar Typhi Ty2
ucuucaacgugcaucuccucgc

SEQ ID NO: 3726741 - RNA, 14 nt, Salmonella enterica enterica serovar Typhi Ty2
ucuucaauaacgaa

SEQ ID NO: 3726742 - RNA, 17 nt, Salmonella enterica enterica serovar Typhi Ty2
ucuucaaugaacaauaa

SEQ ID NO: 3726743 - RNA, 17 nt, Salmonella enterica enterica serovar Typhi Ty2
ucuucaauggcgccgug

SEQ ID NO: 3726744 - RNA, 15 nt, Salmonella enterica enterica serovar Typhi Ty2
ucuucaccuugcugc

SEQ ID NO: 3726745 - RNA, 19 nt, Salmonella enterica enterica serovar Typhi Ty2
ucuucaccuuuccagucaa

SEQ ID NO: 3726746 - RNA, 14 nt, Salmonella enterica enterica serovar Typhi Ty2
ucuucacgacgcuc

SEQ ID NO: 3726747 - RNA, 22 nt, Salmonella enterica enterica serovar Typhi Ty2
ucuucacgcagucguuccagac

SEQ ID NO: 3726748 - RNA, 23 nt, Salmonella enterica enterica serovar Typhi Ty2
ucuucacgccgugaauuucugcu

SEQ ID NO: 3726749 - RNA, 16 nt, Salmonella enterica enterica serovar Typhi Ty2
ucuucacuaaaaacag

SEQ ID NO: 3726750 - RNA, 18 nt, Salmonella enterica enterica serovar Typhi Ty2
ucuucaguaaccagggag

SEQ ID NO: 3726751 - RNA, 16 nt, Salmonella enterica enterica serovar Typhi Ty2
ucuucaguaauuucga

SEQ ID NO: 3726752 - RNA, 13 nt, Salmonella enterica enterica serovar Typhi Ty2
ucuucaucagcca

SEQ ID NO: 3726753 - RNA, 16 nt, Salmonella enterica enterica serovar Typhi Ty2
ucuucaucagccagca

SEQ ID NO: 3726754 - RNA, 20 nt, Salmonella enterica enterica serovar Typhi Ty2
ucuuccaaccgugucugcug

SEQ ID NO: 3726755 - RNA, 23 nt, Salmonella enterica enterica serovar Typhi Ty2
ucuuccaccacggcaaaaauaug

SEQ ID NO: 3726756 - RNA, 17 nt, Salmonella enterica enterica serovar Typhi Ty2
ucuuccagcgccaaaaa

SEQ ID NO: 3726757 - RNA, 18 nt, Salmonella enterica enterica serovar Typhi Ty2
ucuuccaucagccaggcg

SEQ ID NO: 3726758 - RNA, 16 nt, Salmonella enterica enterica serovar Typhi Ty2
ucuuccaugccuucau

SEQ ID NO: 3726759 - RNA, 15 nt, Salmonella enterica enterica serovar Typhi Ty2
ucuuccauucccacc

SEQ ID NO: 3726760 - RNA, 18 nt, Salmonella enterica enterica serovar Typhi Ty2
ucuuccauugcuuuuuug

SEQ ID NO: 3726761 - RNA, 12 nt, Salmonella enterica enterica serovar Typhi Ty2
ucuucccauauu

SEQ ID NO: 3726762 - RNA, 18 nt, Salmonella enterica enterica serovar Typhi Ty2
ucuuccccgaucagaaaa

SEQ ID NO: 3726763 - RNA, 21 nt, Salmonella enterica enterica serovar Typhi Ty2
ucuucccgaauagcccucggu

SEQ ID NO: 3726764 - RNA, 12 nt, Salmonella enterica enterica serovar Typhi Ty2
ucuucccggcag

SEQ ID NO: 3726765 - RNA, 22 nt, Salmonella enterica enterica serovar Typhi Ty2
ucuucccuccccugcgccuuaa

SEQ ID NO: 3726766 - RNA, 20 nt, Salmonella enterica enterica serovar Typhi Ty2
ucuuccgcaauaugcgucag

SEQ ID NO: 3726767 - RNA, 17 nt, Salmonella enterica enterica serovar Typhi Ty2
ucuuccgccagcgccag

SEQ ID NO: 3726768 - RNA, 14 nt, Salmonella enterica enterica serovar Typhi Ty2
ucuuccgccagguc

SEQ ID NO: 3726769 - RNA, 19 nt, Salmonella enterica enterica serovar Typhi Ty2
ucuuccgccaggucgcggu

SEQ ID NO: 3726770 - RNA, 18 nt, Salmonella enterica enterica serovar Typhi Ty2
ucuuccggcauaaaaagc

SEQ ID NO: 3726771 - RNA, 23 nt, Salmonella enterica enterica serovar Typhi Ty2
ucuuccggcaucacaucgccguu

SEQ ID NO: 3726772 - RNA, 12 nt, Salmonella enterica enterica serovar Typhi Ty2
ucuuccggcguc

SEQ ID NO: 3726773 - RNA, 17 nt, Salmonella enterica enterica serovar Typhi Ty2
ucuuccgguagcgccug

SEQ ID NO: 3726774 - RNA, 14 nt, Salmonella enterica enterica serovar Typhi Ty2
ucuuccgucaaaaa

SEQ ID NO: 3726775 - RNA, 19 nt, Salmonella enterica enterica serovar Typhi Ty2
ucuuccgucagcgaaucga

SEQ ID NO: 3726776 - RNA, 11 nt, Salmonella enterica enterica serovar Typhi Ty2
ucuuccucaca

SEQ ID NO: 3726777 - RNA, 15 nt, Salmonella enterica enterica serovar Typhi Ty2
ucuuccucacagccu

SEQ ID NO: 3726778 - RNA, 16 nt, Salmonella enterica enterica serovar Typhi Ty2
ucuuccugcugcgcca

SEQ ID NO: 3726779 - RNA, 20 nt, Salmonella enterica enterica serovar Typhi Ty2
ucuuccugcugcgccagcgc

SEQ ID NO: 3726780 - RNA, 18 nt, Salmonella enterica enterica serovar Typhi Ty2
ucuucgacacauuucagc

SEQ ID NO: 3726781 - RNA, 16 nt, Salmonella enterica enterica serovar Typhi Ty2
ucuucgacauauuuac

SEQ ID NO: 3726782 - RNA, 20 nt, Salmonella enterica enterica serovar Typhi Ty2
ucuucgacauauuuacgugc

SEQ ID NO: 3726783 - RNA, 16 nt, Salmonella enterica enterica serovar Typhi Ty2
ucuucgaccgccauaa

SEQ ID NO: 3726784 - RNA, 21 nt, Salmonella enterica enterica serovar Typhi Ty2
ucuucgauuguugacugccag

SEQ ID NO: 3726785 - RNA, 17 nt, Salmonella enterica enterica serovar Typhi Ty2
ucuucgcaguagauucu

SEQ ID NO: 3726786 - RNA, 14 nt, Salmonella enterica enterica serovar Typhi Ty2
ucuucgccauuaca

SEQ ID NO: 3726787 - RNA, 21 nt, Salmonella enterica enterica serovar Typhi Ty2
ucuucgcccauugccacccau

SEQ ID NO: 3726788 - RNA, 15 nt, Salmonella enterica enterica serovar Typhi Ty2
ucuucggcauaacgu

SEQ ID NO: 3726789 - RNA, 23 nt, Salmonella enterica enterica serovar Typhi Ty2
ucuucggcgcgccgcuggcgaug

SEQ ID NO: 3726790 - RNA, 15 nt, Salmonella enterica enterica serovar Typhi Ty2
ucuucggcuucaccg

SEQ ID NO: 3726791 - RNA, 21 nt, Salmonella enterica enterica serovar Typhi Ty2
ucuucgggaucaauuuugcuc

SEQ ID NO: 3726792 - RNA, 20 nt, Salmonella enterica enterica serovar Typhi Ty2
ucuucgugacccgccagcau

SEQ ID NO: 3726793 - RNA, 15 nt, Salmonella enterica enterica serovar Typhi Ty2
ucuucguguaacgca

SEQ ID NO: 3726794 - RNA, 20 nt, Salmonella enterica enterica serovar Typhi Ty2
ucuucguguaacgcauacau

SEQ ID NO: 3726795 - RNA, 17 nt, Salmonella enterica enterica serovar Typhi Ty2
ucuucguuagcggcguu

SEQ ID NO: 3726796 - RNA, 15 nt, Salmonella enterica enterica serovar Typhi Ty2
ucuucuaaaucauac

SEQ ID NO: 3726797 - RNA, 16 nt, Salmonella enterica enterica serovar Typhi Ty2
ucuucuaccaccuuau

SEQ ID NO: 3726798 - RNA, 23 nt, Salmonella enterica enterica serovar Typhi Ty2
ucuucucaggcgagcccugugcg

SEQ ID NO: 3726799 - RNA, 15 nt, Salmonella enterica enterica serovar Typhi Ty2
ucuucucuucuucaa

SEQ ID NO: 3726800 - RNA, 17 nt, Salmonella enterica enterica serovar Typhi Ty2
ucuucugccuuuuuuaa

SEQ ID NO: 3726801 - RNA, 17 nt, Salmonella enterica enterica serovar Typhi Ty2
ucuucuggcguuuuaau

SEQ ID NO: 3726802 - RNA, 19 nt, Salmonella enterica enterica serovar Typhi Ty2
ucuucuguaauacgcugua

SEQ ID NO: 3726803 - RNA, 19 nt, Salmonella enterica enterica serovar Typhi Ty2
ucuucuucgcguuuuucga

SEQ ID NO: 3726804 - RNA, 15 nt, Salmonella enterica enterica serovar Typhi Ty2
ucuugauaucaucau

SEQ ID NO: 3726805 - RNA, 16 nt, Salmonella enterica enterica serovar Typhi Ty2
ucuugcaacccauauu

SEQ ID NO: 3726806 - RNA, 23 nt, Salmonella enterica enterica serovar Typhi Ty2
ucuugcaacccauauucgucuuc

SEQ ID NO: 3726807 - RNA, 15 nt, Salmonella enterica enterica serovar Typhi Ty2
ucuugccacuggccu

SEQ ID NO: 3726808 - RNA, 21 nt, Salmonella enterica enterica serovar Typhi Ty2
ucuugccacuggccucccagu

SEQ ID NO: 3726809 - RNA, 11 nt, Salmonella enterica enterica serovar Typhi Ty2
ucuugcgcagc

SEQ ID NO: 3726810 - RNA, 13 nt, Salmonella enterica enterica serovar Typhi Ty2
ucuugcguuaugu

SEQ ID NO: 3726811 - RNA, 15 nt, Salmonella enterica enterica serovar Typhi Ty2
ucuugcucucaggca

SEQ ID NO: 3726812 - RNA, 15 nt, Salmonella enterica enterica serovar Typhi Ty2
ucuugcuuuauuuuu

SEQ ID NO: 3726813 - RNA, 15 nt, Salmonella enterica enterica serovar Typhi Ty2
ucuuggagagcauca

SEQ ID NO: 3726814 - RNA, 17 nt, Salmonella enterica enterica serovar Typhi Ty2
ucuuggaugauuuucuu

SEQ ID NO: 3726815 - RNA, 17 nt, Salmonella enterica enterica serovar Typhi Ty2
ucuugguaccaaacagc

SEQ ID NO: 3726816 - RNA, 21 nt, Salmonella enterica enterica serovar Typhi Ty2
ucuugguuuuaucuguaauua

SEQ ID NO: 3726817 - RNA, 21 nt, Salmonella enterica enterica serovar Typhi Ty2
ucuugucaggcagaaauaacu

SEQ ID NO: 3726818 - RNA, 14 nt, Salmonella enterica enterica serovar Typhi Ty2
ugaaaucgguaauc

SEQ ID NO: 3726819 - RNA, 15 nt, Salmonella enterica enterica serovar Typhi Ty2
ugaaaucgucgccaa

SEQ ID NO: 3726820 - RNA, 20 nt, Salmonella enterica enterica serovar Typhi Ty2
ugaaauggccccaaaucaga

SEQ ID NO: 3726821 - RNA, 15 nt, Salmonella enterica enterica serovar Typhi Ty2
ugaaauuaaucaggc

SEQ ID NO: 3726822 - RNA, 22 nt, Salmonella enterica enterica serovar Typhi Ty2
ugaaauuauuccuuaucacauu

SEQ ID NO: 3726823 - RNA, 18 nt, Salmonella enterica enterica serovar Typhi Ty2
ugaaauucuaugccaggc

SEQ ID NO: 3726824 - RNA, 21 nt, Salmonella enterica enterica serovar Typhi Ty2
ugaaauugaucacaaaaucau

SEQ ID NO: 3726825 - RNA, 21 nt, Salmonella enterica enterica serovar Typhi Ty2
ugaacaaaggcagccaacaaa

SEQ ID NO: 3726826 - RNA, 12 nt, Salmonella enterica enterica serovar Typhi Ty2
ugaacaccagca

SEQ ID NO: 3726827 - RNA, 22 nt, Salmonella enterica enterica serovar Typhi Ty2
ugaacagcaaacgccuuccgga

SEQ ID NO: 3726828 - RNA, 18 nt, Salmonella enterica enterica serovar Typhi Ty2
ugaacagccagaagccug

SEQ ID NO: 3726829 - RNA, 17 nt, Salmonella enterica enterica serovar Typhi Ty2
ugaacagcgucauccag

SEQ ID NO: 3726830 - RNA, 11 nt, Salmonella enterica enterica serovar Typhi Ty2
ugaacaggcag

SEQ ID NO: 3726831 - RNA, 12 nt, Salmonella enterica enterica serovar Typhi Ty2
ugaacaggcagc

SEQ ID NO: 3726832 - RNA, 20 nt, Salmonella enterica enterica serovar Typhi Ty2
ugaacaggcugugcaacauc

SEQ ID NO: 3726833 - RNA, 18 nt, Salmonella enterica enterica serovar Typhi Ty2
ugaacagucccaccagcg

SEQ ID NO: 3726834 - RNA, 15 nt, Salmonella enterica enterica serovar Typhi Ty2
ugaacauaaagucag

SEQ ID NO: 3726835 - RNA, 18 nt, Salmonella enterica enterica serovar Typhi Ty2
ugaacauacguuuaaagc

SEQ ID NO: 3726836 - RNA, 20 nt, Salmonella enterica enterica serovar Typhi Ty2
ugaacauacguuuaaagcgc

SEQ ID NO: 3726837 - RNA, 23 nt, Salmonella enterica enterica serovar Typhi Ty2
ugaacauaugaaggauacggaau

SEQ ID NO: 3726838 - RNA, 13 nt, Salmonella enterica enterica serovar Typhi Ty2
ugaacauuuuuuc

SEQ ID NO: 3726839 - RNA, 22 nt, Salmonella enterica enterica serovar Typhi Ty2
ugaaccacggagagacaguuca

SEQ ID NO: 3726840 - RNA, 16 nt, Salmonella enterica enterica serovar Typhi Ty2
ugaaccauaucaaaca

SEQ ID NO: 3726841 - RNA, 23 nt, Salmonella enterica enterica serovar Typhi Ty2
ugaaccaucggcaaacgccgccu

SEQ ID NO: 3726842 - RNA, 20 nt, Salmonella enterica enterica serovar Typhi Ty2
ugaacccgaccgucuuuguc

SEQ ID NO: 3726843 - RNA, 20 nt, Salmonella enterica enterica serovar Typhi Ty2
ugaaccgguaaagcagugca

SEQ ID NO: 3726844 - RNA, 20 nt, Salmonella enterica enterica serovar Typhi Ty2
ugaacgagucuuaccagguc

SEQ ID NO: 3726845 - RNA, 21 nt, Salmonella enterica enterica serovar Typhi Ty2
ugaacgauguaucgcgcggau

SEQ ID NO: 3726846 - RNA, 14 nt, Salmonella enterica enterica serovar Typhi Ty2
ugaacgccaaauac

SEQ ID NO: 3726847 - RNA, 13 nt, Salmonella enterica enterica serovar Typhi Ty2
ugaacgccaggcc

SEQ ID NO: 3726848 - RNA, 19 nt, Salmonella enterica enterica serovar Typhi Ty2
ugaacgcugcuguuaaccu

SEQ ID NO: 3726849 - RNA, 16 nt, Salmonella enterica enterica serovar Typhi Ty2
ugaacggcucaaaaua

SEQ ID NO: 3726850 - RNA, 19 nt, Salmonella enterica enterica serovar Typhi Ty2
ugaacuacggcccuggcuc

SEQ ID NO: 3726851 - RNA, 20 nt, Salmonella enterica enterica serovar Typhi Ty2
ugaacuacggcccuggcuca

SEQ ID NO: 3726852 - RNA, 22 nt, Salmonella enterica enterica serovar Typhi Ty2
ugaacuacggcccuggcucaau

SEQ ID NO: 3726853 - RNA, 13 nt, Salmonella enterica enterica serovar Typhi Ty2
ugaacucccggcg

SEQ ID NO: 3726854 - RNA, 23 nt, Salmonella enterica enterica serovar Typhi Ty2
ugaacucuaugcaaaagaaaaaa

SEQ ID NO: 3726855 - RNA, 14 nt, Salmonella enterica enterica serovar Typhi Ty2
ugaacucuuucaga

SEQ ID NO: 3726856 - RNA, 16 nt, Salmonella enterica enterica serovar Typhi Ty2
ugaacuguaaccggcg

SEQ ID NO: 3726857 - RNA, 18 nt, Salmonella enterica enterica serovar Typhi Ty2
ugaacuuccguaaaaaga

SEQ ID NO: 3726858 - RNA, 19 nt, Salmonella enterica enterica serovar Typhi Ty2
ugaacuuuuugcaggagcu

SEQ ID NO: 3726859 - RNA, 19 nt, Salmonella enterica enterica serovar Typhi Ty2
ugaagaaaauacugauuaa

SEQ ID NO: 3726860 - RNA, 18 nt, Salmonella enterica enterica serovar Typhi Ty2
ugaagaaguucuucuggc

SEQ ID NO: 3726861 - RNA, 19 nt, Salmonella enterica enterica serovar Typhi Ty2
ugaagacgacgggaaaaag

SEQ ID NO: 3726862 - RNA, 20 nt, Salmonella enterica enterica serovar Typhi Ty2
ugaagacguugaauauuggc

SEQ ID NO: 3726863 - RNA, 21 nt, Salmonella enterica enterica serovar Typhi Ty2
ugaagauggucuguaccacca

SEQ ID NO: 3726864 - RNA, 17 nt, Salmonella enterica enterica serovar Typhi Ty2
ugaagauuuuuauuccc

SEQ ID NO: 3726865 - RNA, 20 nt, Salmonella enterica enterica serovar Typhi Ty2
ugaagauuuuuauucccgcc

SEQ ID NO: 3726866 - RNA, 18 nt, Salmonella enterica enterica serovar Typhi Ty2
ugaagcaucaauaucugc

SEQ ID NO: 3726867 - RNA, 20 nt, Salmonella enterica enterica serovar Typhi Ty2
ugaagccauccucacgcaac

SEQ ID NO: 3726868 - RNA, 14 nt, Salmonella enterica enterica serovar Typhi Ty2
ugaagcgcaguguu

SEQ ID NO: 3726869 - RNA, 15 nt, Salmonella enterica enterica serovar Typhi Ty2
ugaagcgcaguguua

SEQ ID NO: 3726870 - RNA, 19 nt, Salmonella enterica enterica serovar Typhi Ty2
ugaagcgcaucggugacaa

SEQ ID NO: 3726871 - RNA, 15 nt, Salmonella enterica enterica serovar Typhi Ty2
ugaagcuggagccac

SEQ ID NO: 3726872 - RNA, 13 nt, Salmonella enterica enterica serovar Typhi Ty2
ugaagcuguuuug

SEQ ID NO: 3726873 - RNA, 18 nt, Salmonella enterica enterica serovar Typhi Ty2
ugaaggcgcuccccugcu

SEQ ID NO: 3726874 - RNA, 17 nt, Salmonella enterica enterica serovar Typhi Ty2
ugaaggcguaugaauga

SEQ ID NO: 3726875 - RNA, 22 nt, Salmonella enterica enterica serovar Typhi Ty2
ugaaggguaaaacguuauuggc

SEQ ID NO: 3726876 - RNA, 15 nt, Salmonella enterica enterica serovar Typhi Ty2
ugaagucgaaauuuu

SEQ ID NO: 3726877 - RNA, 14 nt, Salmonella enterica enterica serovar Typhi Ty2
ugaaguguuccuga

SEQ ID NO: 3726878 - RNA, 18 nt, Salmonella enterica enterica serovar Typhi Ty2
ugaaguguuccugagcca

SEQ ID NO: 3726879 - RNA, 15 nt, Salmonella enterica enterica serovar Typhi Ty2
ugaaguuauccagcg

SEQ ID NO: 3726880 - RNA, 13 nt, Salmonella enterica enterica serovar Typhi Ty2
ugaauaaaccaga

SEQ ID NO: 3726881 - RNA, 14 nt, Salmonella enterica enterica serovar Typhi Ty2
ugaauaaccaucgg

SEQ ID NO: 3726882 - RNA, 16 nt, Salmonella enterica enterica serovar Typhi Ty2
ugaauaaucucugcga

SEQ ID NO: 3726883 - RNA, 14 nt, Salmonella enterica enterica serovar Typhi Ty2
ugaauaaugaccuc

SEQ ID NO: 3726884 - RNA, 16 nt, Salmonella enterica enterica serovar Typhi Ty2
ugaauaauuucuucuu

SEQ ID NO: 3726885 - RNA, 18 nt, Salmonella enterica enterica serovar Typhi Ty2
ugaauaauuucuucuuua

SEQ ID NO: 3726886 - RNA, 12 nt, Salmonella enterica enterica serovar Typhi Ty2
ugaauacacaaa

SEQ ID NO: 3726887 - RNA, 19 nt, Salmonella enterica enterica serovar Typhi Ty2
ugaauaccagcggcaaaca

SEQ ID NO: 3726888 - RNA, 12 nt, Salmonella enterica enterica serovar Typhi Ty2
ugaauagccagc

SEQ ID NO: 3726889 - RNA, 15 nt, Salmonella enterica enterica serovar Typhi Ty2
ugaauagccagcccc

SEQ ID NO: 3726890 - RNA, 22 nt, Salmonella enterica enterica serovar Typhi Ty2
ugaauagcuuucaccggucgca

SEQ ID NO: 3726891 - RNA, 20 nt, Salmonella enterica enterica serovar Typhi Ty2
ugaauaugaucugcacaaca

SEQ ID NO: 3726892 - RNA, 17 nt, Salmonella enterica enterica serovar Typhi Ty2
ugaauauucggcuccag

SEQ ID NO: 3726893 - RNA, 13 nt, Salmonella enterica enterica serovar Typhi Ty2
ugaauauuuugcu

SEQ ID NO: 3726894 - RNA, 16 nt, Salmonella enterica enterica serovar Typhi Ty2
ugaaucaagcuuugcg

SEQ ID NO: 3726895 - RNA, 21 nt, Salmonella enterica enterica serovar Typhi Ty2
ugaaucagauacggcuccagc

SEQ ID NO: 3726896 - RNA, 13 nt, Salmonella enterica enterica serovar Typhi Ty2
ugaaucagcaucu

SEQ ID NO: 3726897 - RNA, 24 nt, Salmonella enterica enterica serovar Typhi Ty2
ugaaucaucagaaucguccagauu

SEQ ID NO: 3726898 - RNA, 22 nt, Salmonella enterica enterica serovar Typhi Ty2
ugaauccauacgguuguugauu

SEQ ID NO: 3726899 - RNA, 21 nt, Salmonella enterica enterica serovar Typhi Ty2
ugaauccccagaauuucuuug

SEQ ID NO: 3726900 - RNA, 17 nt, Salmonella enterica enterica serovar Typhi Ty2
ugaccugggcgccagag

SEQ ID NO: 3726901 - RNA, 17 nt, Salmonella enterica enterica serovar Typhi Ty2
ugaccuuaauccagcag

SEQ ID NO: 3726902 - RNA, 20 nt, Salmonella enterica enterica serovar Typhi Ty2
ugacgaaaaccguccacauc

SEQ ID NO: 3726903 - RNA, 17 nt, Salmonella enterica enterica serovar Typhi Ty2
ugacgaaaagauaacgg

SEQ ID NO: 3726904 - RNA, 20 nt, Salmonella enterica enterica serovar Typhi Ty2
ugacgaauaccgugcacgcu

SEQ ID NO: 3726905 - RNA, 16 nt, Salmonella enterica enterica serovar Typhi Ty2
ugacgaauagcgcgcu

SEQ ID NO: 3726906 - RNA, 15 nt, Salmonella enterica enterica serovar Typhi Ty2
ugacgacccgcuucc

SEQ ID NO: 3726907 - RNA, 18 nt, Salmonella enterica enterica serovar Typhi Ty2
ugacgacuaccgccgaua

SEQ ID NO: 3726908 - RNA, 16 nt, Salmonella enterica enterica serovar Typhi Ty2
ugacgagggaagggga

SEQ ID NO: 3726909 - RNA, 16 nt, Salmonella enterica enterica serovar Typhi Ty2
ugacgagucggaucau

SEQ ID NO: 3726910 - RNA, 19 nt, Salmonella enterica enterica serovar Typhi Ty2
ugacgauacgucauaucau

SEQ ID NO: 3726911 - RNA, 14 nt, Salmonella enterica enterica serovar Typhi Ty2
ugacgaucaugccg

SEQ ID NO: 3726912 - RNA, 19 nt, Salmonella enterica enterica serovar Typhi Ty2
ugacgaucaugccgcccag

SEQ ID NO: 3726913 - RNA, 13 nt, Salmonella enterica enterica serovar Typhi Ty2
ugacgcagcaguu

SEQ ID NO: 3726914 - RNA, 16 nt, Salmonella enterica enterica serovar Typhi Ty2
ugacgcagcaucucaa

SEQ ID NO: 3726915 - RNA, 14 nt, Salmonella enterica enterica serovar Typhi Ty2
ugacgccaggcaga

SEQ ID NO: 3726916 - RNA, 21 nt, Salmonella enterica enterica serovar Typhi Ty2
ugacgccaguucccacagcuu

SEQ ID NO: 3726917 - RNA, 14 nt, Salmonella enterica enterica serovar Typhi Ty2
ugacgcccaucagc

SEQ ID NO: 3726918 - RNA, 20 nt, Salmonella enterica enterica serovar Typhi Ty2
ugacgccccauguggccagc

SEQ ID NO: 3726919 - RNA, 20 nt, Salmonella enterica enterica serovar Typhi Ty2
ugacgccgaccaccgcccug

SEQ ID NO: 3726920 - RNA, 18 nt, Salmonella enterica enterica serovar Typhi Ty2
ugacgcgaauuauagaac

SEQ ID NO: 3726921 - RNA, 18 nt, Salmonella enterica enterica serovar Typhi Ty2
ugacgcgcauacucauua

SEQ ID NO: 3726922 - RNA, 16 nt, Salmonella enterica enterica serovar Typhi Ty2
ugacgcucuccuccaa

SEQ ID NO: 3726923 - RNA, 16 nt, Salmonella enterica enterica serovar Typhi Ty2
ugacggaaaccagcau

SEQ ID NO: 3726924 - RNA, 19 nt, Salmonella enterica enterica serovar Typhi Ty2
ugacggauucuuccucucg

SEQ ID NO: 3726925 - RNA, 16 nt, Salmonella enterica enterica serovar Typhi Ty2
ugacggcgcugucacu

SEQ ID NO: 3726926 - RNA, 21 nt, Salmonella enterica enterica serovar Typhi Ty2
ugacggcggaagaggcgccug

SEQ ID NO: 3726927 - RNA, 18 nt, Salmonella enterica enterica serovar Typhi Ty2
ugacgggaaaucucccug

SEQ ID NO: 3726928 - RNA, 17 nt, Salmonella enterica enterica serovar Typhi Ty2
ugacgggcgaucgacua

SEQ ID NO: 3726929 - RNA, 22 nt, Salmonella enterica enterica serovar Typhi Ty2
ugacgguaaaguaauuuccaua

SEQ ID NO: 3726930 - RNA, 22 nt, Salmonella enterica enterica serovar Typhi Ty2
ugacgguauucccggucaagcg

SEQ ID NO: 3726931 - RNA, 16 nt, Salmonella enterica enterica serovar Typhi Ty2
ugacggugauguuggc

SEQ ID NO: 3726932 - RNA, 13 nt, Salmonella enterica enterica serovar Typhi Ty2
ugacguacaaaca

SEQ ID NO: 3726933 - RNA, 18 nt, Salmonella enterica enterica serovar Typhi Ty2
ugacguagauucugauug

SEQ ID NO: 3726934 - RNA, 13 nt, Salmonella enterica enterica serovar Typhi Ty2
ugacguccaggcc

SEQ ID NO: 3726935 - RNA, 21 nt, Salmonella enterica enterica serovar Typhi Ty2
ugacgucgcaagacgaaaaau

SEQ ID NO: 3726936 - RNA, 20 nt, Salmonella enterica enterica serovar Typhi Ty2
ugacgucgcagccugauggc

SEQ ID NO: 3726937 - RNA, 14 nt, Salmonella enterica enterica serovar Typhi Ty2
ugacgugagagaaa

SEQ ID NO: 3726938 - RNA, 17 nt, Salmonella enterica enterica serovar Typhi Ty2
ugacguuaucugucagc

SEQ ID NO: 3726939 - RNA, 16 nt, Salmonella enterica enterica serovar Typhi Ty2
ugacguugcgaaucag

SEQ ID NO: 3726940 - RNA, 15 nt, Salmonella enterica enterica serovar Typhi Ty2
ugacuaaaucagcau

SEQ ID NO: 3726941 - RNA, 15 nt, Salmonella enterica enterica serovar Typhi Ty2
ugacuacgucagaug

SEQ ID NO: 3726942 - RNA, 14 nt, Salmonella enterica enterica serovar Typhi Ty2
ugacuacugugacg

SEQ ID NO: 3726943 - RNA, 15 nt, Salmonella enterica enterica serovar Typhi Ty2
ugacuauccacagcg

SEQ ID NO: 3726944 - RNA, 18 nt, Salmonella enterica enterica serovar Typhi Ty2
ugacucaugaaccuggcg

SEQ ID NO: 3726945 - RNA, 12 nt, Salmonella enterica enterica serovar Typhi Ty2
ugacucugccuc

SEQ ID NO: 3726946 - RNA, 23 nt, Salmonella enterica enterica serovar Typhi Ty2
ugacugaaauuacgccauaaaaa

SEQ ID NO: 3726947 - RNA, 15 nt, Salmonella enterica enterica serovar Typhi Ty2
ugacugaacucauca

SEQ ID NO: 3726948 - RNA, 20 nt, Salmonella enterica enterica serovar Typhi Ty2
ugacugcgggggcaaaugcg

SEQ ID NO: 3726949 - RNA, 19 nt, Salmonella enterica enterica serovar Typhi Ty2
ugacugguuuguugcgucu

SEQ ID NO: 3726950 - RNA, 16 nt, Salmonella enterica enterica serovar Typhi Ty2
ugacuucacacugugg

SEQ ID NO: 3726951 - RNA, 13 nt, Salmonella enterica enterica serovar Typhi Ty2
ugacuucaucaaa

SEQ ID NO: 3726952 - RNA, 20 nt, Salmonella enterica enterica serovar Typhi Ty2
ugacuucugcucgguaaaaa

SEQ ID NO: 3726953 - RNA, 22 nt, Salmonella enterica enterica serovar Typhi Ty2
ugacuucugcucgguaaaaagu

SEQ ID NO: 3726954 - RNA, 21 nt, Salmonella enterica enterica serovar Typhi Ty2
ugacuuuaccgguuucaaucc

SEQ ID NO: 3726955 - RNA, 17 nt, Salmonella enterica enterica serovar Typhi Ty2
ugacuuuccugguaauc

SEQ ID NO: 3726956 - RNA, 12 nt, Salmonella enterica enterica serovar Typhi Ty2
ugacuuugcucu

SEQ ID NO: 3726957 - RNA, 12 nt, Salmonella enterica enterica serovar Typhi Ty2
ugacuuuuacgc

SEQ ID NO: 3726958 - RNA, 21 nt, Salmonella enterica enterica serovar Typhi Ty2
ugacuuuuuucaaccucacug

SEQ ID NO: 3726959 - RNA, 14 nt, Salmonella enterica enterica serovar Typhi Ty2
ugagaaaaauuuaa

SEQ ID NO: 3726960 - RNA, 14 nt, Salmonella enterica enterica serovar Typhi Ty2
ugagaaaagcagag

SEQ ID NO: 3726961 - RNA, 18 nt, Salmonella enterica enterica serovar Typhi Ty2
ugagaaaagcgaaaauaa

SEQ ID NO: 3726962 - RNA, 23 nt, Salmonella enterica enterica serovar Typhi Ty2
ugagaaaauuacgcccaucagcc

SEQ ID NO: 3726963 - RNA, 18 nt, Salmonella enterica enterica serovar Typhi Ty2
ugagaaauuauuuuaaau

SEQ ID NO: 3726964 - RNA, 12 nt, Salmonella enterica enterica serovar Typhi Ty2
ugagaagaaaaa

SEQ ID NO: 3726965 - RNA, 18 nt, Salmonella enterica enterica serovar Typhi Ty2
ugagaauuuccaguucaa

SEQ ID NO: 3726966 - RNA, 13 nt, Salmonella enterica enterica serovar Typhi Ty2
ugagaccauccug

SEQ ID NO: 3726967 - RNA, 18 nt, Salmonella enterica enterica serovar Typhi Ty2
ugagacgcagccucucuu

SEQ ID NO: 3726968 - RNA, 22 nt, Salmonella enterica enterica serovar Typhi Ty2
ugagagaacguugccgcaggca

SEQ ID NO: 3726969 - RNA, 17 nt, Salmonella enterica enterica serovar Typhi Ty2
ugagagacggagaaaaa

SEQ ID NO: 3726970 - RNA, 19 nt, Salmonella enterica enterica serovar Typhi Ty2
ugagagcacguaggccuga

SEQ ID NO: 3726971 - RNA, 21 nt, Salmonella enterica enterica serovar Typhi Ty2
ugagauccgggcuggcaaaca

SEQ ID NO: 3726972 - RNA, 18 nt, Salmonella enterica enterica serovar Typhi Ty2
ugagaucgguaauuucca

SEQ ID NO: 3726973 - RNA, 18 nt, Salmonella enterica enterica serovar Typhi Ty2
ugagcacgcggaagaaau

SEQ ID NO: 3726974 - RNA, 19 nt, Salmonella enterica enterica serovar Typhi Ty2
ugagcagacauauuuucaa

SEQ ID NO: 3726975 - RNA, 12 nt, Salmonella enterica enterica serovar Typhi Ty2
ugagcagcgcga

SEQ ID NO: 3726976 - RNA, 21 nt, Salmonella enterica enterica serovar Typhi Ty2
ugagcauuacgucggaacgcg

SEQ ID NO: 3726977 - RNA, 14 nt, Salmonella enterica enterica serovar Typhi Ty2
ugagcauugcgcuc

SEQ ID NO: 3726978 - RNA, 19 nt, Salmonella enterica enterica serovar Typhi Ty2
ugagccacgguaguuucaa

SEQ ID NO: 3726979 - RNA, 17 nt, Salmonella enterica enterica serovar Typhi Ty2
ugagcccacagcggaug

SEQ ID NO: 3726980 - RNA, 14 nt, Salmonella enterica enterica serovar Typhi Ty2
ugagcccuccucca

SEQ ID NO: 3726981 - RNA, 16 nt, Salmonella enterica enterica serovar Typhi Ty2
ugagcccuccuccagc

SEQ ID NO: 3726982 - RNA, 23 nt, Salmonella enterica enterica serovar Typhi Ty2
ugauagagguuaccgggcuaaac

SEQ ID NO: 3726983 - RNA, 23 nt, Salmonella enterica enterica serovar Typhi Ty2
ugauagcaaucauccugauuuua

SEQ ID NO: 3726984 - RNA, 20 nt, Salmonella enterica enterica serovar Typhi Ty2
ugauagcaggcacuguggug

SEQ ID NO: 3726985 - RNA, 21 nt, Salmonella enterica enterica serovar Typhi Ty2
ugauagcccguuaugccaucu

SEQ ID NO: 3726986 - RNA, 17 nt, Salmonella enterica enterica serovar Typhi Ty2
ugauagccguucuccag

SEQ ID NO: 3726987 - RNA, 15 nt, Salmonella enterica enterica serovar Typhi Ty2
ugauagcgaggcagc

SEQ ID NO: 3726988 - RNA, 20 nt, Salmonella enterica enterica serovar Typhi Ty2
ugauaggccagcuacaccug

SEQ ID NO: 3726989 - RNA, 21 nt, Salmonella enterica enterica serovar Typhi Ty2
ugauagguucaauaugccagg

SEQ ID NO: 3726990 - RNA, 18 nt, Salmonella enterica enterica serovar Typhi Ty2
ugauaguuuaaauccagc

SEQ ID NO: 3726991 - RNA, 14 nt, Salmonella enterica enterica serovar Typhi Ty2
ugauauagcgccau

SEQ ID NO: 3726992 - RNA, 18 nt, Salmonella enterica enterica serovar Typhi Ty2
ugauauccacgcgcacca

SEQ ID NO: 3726993 - RNA, 16 nt, Salmonella enterica enterica serovar Typhi Ty2
ugauaucgccccagaa

SEQ ID NO: 3726994 - RNA, 21 nt, Salmonella enterica enterica serovar Typhi Ty2
ugauaucggccggaugccagu

SEQ ID NO: 3726995 - RNA, 15 nt, Salmonella enterica enterica serovar Typhi Ty2
ugauaugcaguucau

SEQ ID NO: 3726996 - RNA, 14 nt, Salmonella enterica enterica serovar Typhi Ty2
ugauauggaaagug

SEQ ID NO: 3726997 - RNA, 23 nt, Salmonella enterica enterica serovar Typhi Ty2
ugauauugcguaagcagcugcuu

SEQ ID NO: 3726998 - RNA, 16 nt, Salmonella enterica enterica serovar Typhi Ty2
ugauauugugcauacu

SEQ ID NO: 3726999 - RNA, 18 nt, Salmonella enterica enterica serovar Typhi Ty2
ugaucaaucaacucuuua

SEQ ID NO: 3727000 - RNA, 14 nt, Salmonella enterica enterica serovar Typhi Ty2
ugaucaauuugccu

SEQ ID NO: 3727001 - RNA, 23 nt, Salmonella enterica enterica serovar Typhi Ty2
ugaucaauuugccuuuauucauu

SEQ ID NO: 3727002 - RNA, 17 nt, Salmonella enterica enterica serovar Typhi Ty2
ugaucaccgcccuggcg

SEQ ID NO: 3727003 - RNA, 19 nt, Salmonella enterica enterica serovar Typhi Ty2
ugaucaggaaaucuuccag

SEQ ID NO: 3727004 - RNA, 13 nt, Salmonella enterica enterica serovar Typhi Ty2
ugaucaggcaaaa

SEQ ID NO: 3727005 - RNA, 12 nt, Salmonella enterica enterica serovar Typhi Ty2
ugaucccaaugu

SEQ ID NO: 3727006 - RNA, 11 nt, Salmonella enterica enterica serovar Typhi Ty2
ugaucccacca

SEQ ID NO: 3727007 - RNA, 13 nt, Salmonella enterica enterica serovar Typhi Ty2
ugaucccccagaa

SEQ ID NO: 3727008 - RNA, 19 nt, Salmonella enterica enterica serovar Typhi Ty2
ugauccgcccccuccagua

SEQ ID NO: 3727009 - RNA, 20 nt, Salmonella enterica enterica serovar Typhi Ty2
ugauccguucgaucagcugg

SEQ ID NO: 3727010 - RNA, 19 nt, Salmonella enterica enterica serovar Typhi Ty2
ugauccuguaacgcauaag

SEQ ID NO: 3727011 - RNA, 14 nt, Salmonella enterica enterica serovar Typhi Ty2
ugaucgaaaaugcg

SEQ ID NO: 3727012 - RNA, 21 nt, Salmonella enterica enterica serovar Typhi Ty2
ugaucgaaaaugcgcaugaug

SEQ ID NO: 3727013 - RNA, 12 nt, Salmonella enterica enterica serovar Typhi Ty2
ugaucgaauuca

SEQ ID NO: 3727014 - RNA, 17 nt, Salmonella enterica enterica serovar Typhi Ty2
ugaucgccaaagcguaa

SEQ ID NO: 3727015 - RNA, 24 nt, Salmonella enterica enterica serovar Typhi Ty2
ugaucgccggagaauccuuccagu

SEQ ID NO: 3727016 - RNA, 14 nt, Salmonella enterica enterica serovar Typhi Ty2
ugaucgccucuucg

SEQ ID NO: 3727017 - RNA, 17 nt, Salmonella enterica enterica serovar Typhi Ty2
ugaucgcuggugcccgg

SEQ ID NO: 3727018 - RNA, 12 nt, Salmonella enterica enterica serovar Typhi Ty2
ugaucggcuggc

SEQ ID NO: 3727019 - RNA, 14 nt, Salmonella enterica enterica serovar Typhi Ty2
ugaucggguuuucc

SEQ ID NO: 3727020 - RNA, 18 nt, Salmonella enterica enterica serovar Typhi Ty2
ugaucggguuuuccugaa

SEQ ID NO: 3727021 - RNA, 18 nt, Salmonella enterica enterica serovar Typhi Ty2
ugaucgugauaggccaga

SEQ ID NO: 3727022 - RNA, 23 nt, Salmonella enterica enterica serovar Typhi Ty2
ugaucgugccaugaccauucaca

SEQ ID NO: 3727023 - RNA, 15 nt, Salmonella enterica enterica serovar Typhi Ty2
ugaucguuucauuuu

SEQ ID NO: 3727024 - RNA, 14 nt, Salmonella enterica enterica serovar Typhi Ty2
ugaucugcgccggc

SEQ ID NO: 3727025 - RNA, 22 nt, Salmonella enterica enterica serovar Typhi Ty2
ugaucugcgccggcugcgcugc

SEQ ID NO: 3727026 - RNA, 19 nt, Salmonella enterica enterica serovar Typhi Ty2
ugaucuuaccucuccugaa

SEQ ID NO: 3727027 - RNA, 18 nt, Salmonella enterica enterica serovar Typhi Ty2
ugaucuucaaccucuaua

SEQ ID NO: 3727028 - RNA, 22 nt, Salmonella enterica enterica serovar Typhi Ty2
ugaucuucaaccucuauaacuu

SEQ ID NO: 3727029 - RNA, 20 nt, Salmonella enterica enterica serovar Typhi Ty2
ugaucuucauaaauagccag

SEQ ID NO: 3727030 - RNA, 12 nt, Salmonella enterica enterica serovar Typhi Ty2
ugaucuuucugg

SEQ ID NO: 3727031 - RNA, 19 nt, Salmonella enterica enterica serovar Typhi Ty2
ugaugaacaugcccggaug

SEQ ID NO: 3727032 - RNA, 21 nt, Salmonella enterica enterica serovar Typhi Ty2
ugaugacgcgaauuauagaac

SEQ ID NO: 3727033 - RNA, 20 nt, Salmonella enterica enterica serovar Typhi Ty2
ugaugacgcgcaggccguca

SEQ ID NO: 3727034 - RNA, 21 nt, Salmonella enterica enterica serovar Typhi Ty2
ugaugacucauuaaaaaaaca

SEQ ID NO: 3727035 - RNA, 13 nt, Salmonella enterica enterica serovar Typhi Ty2
ugaugagaggcga

SEQ ID NO: 3727036 - RNA, 19 nt, Salmonella enterica enterica serovar Typhi Ty2
ugaugagauacgucaucau

SEQ ID NO: 3727037 - RNA, 18 nt, Salmonella enterica enterica serovar Typhi Ty2
ugaugagaugcaggccaa

SEQ ID NO: 3727038 - RNA, 17 nt, Salmonella enterica enterica serovar Typhi Ty2
ugaugagcaggccaggg

SEQ ID NO: 3727039 - RNA, 13 nt, Salmonella enterica enterica serovar Typhi Ty2
ugaugagcgccau

SEQ ID NO: 3727040 - RNA, 17 nt, Salmonella enterica enterica serovar Typhi Ty2
ugaugaucaauaacgcc

SEQ ID NO: 3727041 - RNA, 18 nt, Salmonella enterica enterica serovar Typhi Ty2
ugaugaucuucagcccgu

SEQ ID NO: 3727042 - RNA, 21 nt, Salmonella enterica enterica serovar Typhi Ty2
ugaugaugcguuuguuggaga

SEQ ID NO: 3727043 - RNA, 16 nt, Salmonella enterica enterica serovar Typhi Ty2
ugaugcaucagaacaa

SEQ ID NO: 3727044 - RNA, 20 nt, Salmonella enterica enterica serovar Typhi Ty2
ugaugcaucagaacaaacuu

SEQ ID NO: 3727045 - RNA, 22 nt, Salmonella enterica enterica serovar Typhi Ty2
ugaugccccagaacaacgggaa

SEQ ID NO: 3727046 - RNA, 18 nt, Salmonella enterica enterica serovar Typhi Ty2
ugaugcgccugucuccag

SEQ ID NO: 3727047 - RNA, 19 nt, Salmonella enterica enterica serovar Typhi Ty2
ugaugcgccugucuccagc

SEQ ID NO: 3727048 - RNA, 20 nt, Salmonella enterica enterica serovar Typhi Ty2
ugaugcgcguuuagcgccag

SEQ ID NO: 3727049 - RNA, 18 nt, Salmonella enterica enterica serovar Typhi Ty2
ugaugcguauccagcgcg

SEQ ID NO: 3727050 - RNA, 23 nt, Salmonella enterica enterica serovar Typhi Ty2
ugaugcguuguaccguuuuccag

SEQ ID NO: 3727051 - RNA, 18 nt, Salmonella enterica enterica serovar Typhi Ty2
ugaugcguuuguuggaga

SEQ ID NO: 3727052 - RNA, 20 nt, Salmonella enterica enterica serovar Typhi Ty2
ugaugcuguaggccggguaa

SEQ ID NO: 3727053 - RNA, 15 nt, Salmonella enterica enterica serovar Typhi Ty2
ugauggccacaucgu

SEQ ID NO: 3727054 - RNA, 14 nt, Salmonella enterica enterica serovar Typhi Ty2
ugauggccuggcgg

SEQ ID NO: 3727055 - RNA, 17 nt, Salmonella enterica enterica serovar Typhi Ty2
ugauggccuuugugauc

SEQ ID NO: 3727056 - RNA, 17 nt, Salmonella enterica enterica serovar Typhi Ty2
ugauggcgaacagcccc

SEQ ID NO: 3727057 - RNA, 19 nt, Salmonella enterica enterica serovar Typhi Ty2
ugauggcgaucagcgccac

SEQ ID NO: 3727058 - RNA, 20 nt, Salmonella enterica enterica serovar Typhi Ty2
ugauggcgcgacgcuuauca

SEQ ID NO: 3727059 - RNA, 18 nt, Salmonella enterica enterica serovar Typhi Ty2
ugauggcgcuaagccagc

SEQ ID NO: 3727060 - RNA, 16 nt, Salmonella enterica enterica serovar Typhi Ty2
ugauggcgcuacgcca

SEQ ID NO: 3727061 - RNA, 20 nt, Salmonella enterica enterica serovar Typhi Ty2
ugauggcgcuacgcuuauca

SEQ ID NO: 3727062 - RNA, 13 nt, Salmonella enterica enterica serovar Typhi Ty2
ugauggcgcugcg

SEQ ID NO: 3727063 - RNA, 17 nt, Salmonella enterica enterica serovar Typhi Ty2
ugauggcguagcgccau

SEQ ID NO: 3727064 - RNA, 17 nt, Salmonella enterica enterica serovar Typhi Ty2
ugcacaauacgccgagc

SEQ ID NO: 3727065 - RNA, 13 nt, Salmonella enterica enterica serovar Typhi Ty2
ugcacagucugca

SEQ ID NO: 3727066 - RNA, 18 nt, Salmonella enterica enterica serovar Typhi Ty2
ugcacaucgccauuaaaa

SEQ ID NO: 3727067 - RNA, 19 nt, Salmonella enterica enterica serovar Typhi Ty2
ugcacauguuucagcaccu

SEQ ID NO: 3727068 - RNA, 19 nt, Salmonella enterica enterica serovar Typhi Ty2
ugcacauuagcaauugcca

SEQ ID NO: 3727069 - RNA, 19 nt, Salmonella enterica enterica serovar Typhi Ty2
ugcacauucagguggcuga

SEQ ID NO: 3727070 - RNA, 17 nt, Salmonella enterica enterica serovar Typhi Ty2
ugcacauugcaggcuuu

SEQ ID NO: 3727071 - RNA, 20 nt, Salmonella enterica enterica serovar Typhi Ty2
ugcaccaacgauaaauuuuc

SEQ ID NO: 3727072 - RNA, 22 nt, Salmonella enterica enterica serovar Typhi Ty2
ugcaccacccgguuauaacgcg

SEQ ID NO: 3727073 - RNA, 16 nt, Salmonella enterica enterica serovar Typhi Ty2
ugcaccagaacucccu

SEQ ID NO: 3727074 - RNA, 19 nt, Salmonella enterica enterica serovar Typhi Ty2
ugcaccagaacucccuguu

SEQ ID NO: 3727075 - RNA, 16 nt, Salmonella enterica enterica serovar Typhi Ty2
ugcaccaucucuuacu

SEQ ID NO: 3727076 - RNA, 16 nt, Salmonella enterica enterica serovar Typhi Ty2
ugcacccgccuuaccc

SEQ ID NO: 3727077 - RNA, 17 nt, Salmonella enterica enterica serovar Typhi Ty2
ugcaccgcuaaaaaaca

SEQ ID NO: 3727078 - RNA, 18 nt, Salmonella enterica enterica serovar Typhi Ty2
ugcaccucagaccguuag

SEQ ID NO: 3727079 - RNA, 22 nt, Salmonella enterica enterica serovar Typhi Ty2
ugcaccuuaaccgucugcucag

SEQ ID NO: 3727080 - RNA, 17 nt, Salmonella enterica enterica serovar Typhi Ty2
ugcacgaaauguagagc

SEQ ID NO: 3727081 - RNA, 20 nt, Salmonella enterica enterica serovar Typhi Ty2
ugcacgccaggguaauacug

SEQ ID NO: 3727082 - RNA, 20 nt, Salmonella enterica enterica serovar Typhi Ty2
ugcacgccugcuucacguau

SEQ ID NO: 3727083 - RNA, 16 nt, Salmonella enterica enterica serovar Typhi Ty2
ugcacgcgcggcgcca

SEQ ID NO: 3727084 - RNA, 16 nt, Salmonella enterica enterica serovar Typhi Ty2
ugcacgguugaagcga

SEQ ID NO: 3727085 - RNA, 15 nt, Salmonella enterica enterica serovar Typhi Ty2
ugcacugcugauagu

SEQ ID NO: 3727086 - RNA, 23 nt, Salmonella enterica enterica serovar Typhi Ty2
ugcacuggucaucgaaggcaucu

SEQ ID NO: 3727087 - RNA, 18 nt, Salmonella enterica enterica serovar Typhi Ty2
ugcacuucaugccgaaca

SEQ ID NO: 3727088 - RNA, 13 nt, Salmonella enterica enterica serovar Typhi Ty2
ugcacuuccugcg

SEQ ID NO: 3727089 - RNA, 22 nt, Salmonella enterica enterica serovar Typhi Ty2
ugcagacaauuuccgccgccag

SEQ ID NO: 3727090 - RNA, 14 nt, Salmonella enterica enterica serovar Typhi Ty2
ugcagaccucugca

SEQ ID NO: 3727091 - RNA, 23 nt, Salmonella enterica enterica serovar Typhi Ty2
ugcagacgugcaauaucgcggca

SEQ ID NO: 3727092 - RNA, 18 nt, Salmonella enterica enterica serovar Typhi Ty2
ugcagacugcacuuccug

SEQ ID NO: 3727093 - RNA, 15 nt, Salmonella enterica enterica serovar Typhi Ty2
ugcagauauugcgga

SEQ ID NO: 3727094 - RNA, 22 nt, Salmonella enterica enterica serovar Typhi Ty2
ugcagaucaagcgggggcgccu

SEQ ID NO: 3727095 - RNA, 18 nt, Salmonella enterica enterica serovar Typhi Ty2
ugcagauuacugagcagu

SEQ ID NO: 3727096 - RNA, 18 nt, Salmonella enterica enterica serovar Typhi Ty2
ugcagcaaauaaucguag

SEQ ID NO: 3727097 - RNA, 23 nt, Salmonella enterica enterica serovar Typhi Ty2
ugcagcaacugauucaaaaggug

SEQ ID NO: 3727098 - RNA, 11 nt, Salmonella enterica enterica serovar Typhi Ty2
ugcagcaagaa

SEQ ID NO: 3727099 - RNA, 16 nt, Salmonella enterica enterica serovar Typhi Ty2
ugcagcaagcggcugu

SEQ ID NO: 3727100 - RNA, 24 nt, Salmonella enterica enterica serovar Typhi Ty2
ugcagcaagcggcugucaucaaug

SEQ ID NO: 3727101 - RNA, 12 nt, Salmonella enterica enterica serovar Typhi Ty2
ugcagcagccag

SEQ ID NO: 3727102 - RNA, 18 nt, Salmonella enterica enterica serovar Typhi Ty2
ugcagcauugggauggau

SEQ ID NO: 3727103 - RNA, 14 nt, Salmonella enterica enterica serovar Typhi Ty2
ugcagccaggccau

SEQ ID NO: 3727104 - RNA, 18 nt, Salmonella enterica enterica serovar Typhi Ty2
ugcagccauagcgcgccg

SEQ ID NO: 3727105 - RNA, 15 nt, Salmonella enterica enterica serovar Typhi Ty2
ugcagcgaccuggga

SEQ ID NO: 3727106 - RNA, 15 nt, Salmonella enterica enterica serovar Typhi Ty2
ugcagcgccagagau

SEQ ID NO: 3727107 - RNA, 13 nt, Salmonella enterica enterica serovar Typhi Ty2
ugcagcgccgccu

SEQ ID NO: 3727108 - RNA, 16 nt, Salmonella enterica enterica serovar Typhi Ty2
ugcagcgccgccugua

SEQ ID NO: 3727109 - RNA, 16 nt, Salmonella enterica enterica serovar Typhi Ty2
ugcagcgcuguccaga

SEQ ID NO: 3727110 - RNA, 18 nt, Salmonella enterica enterica serovar Typhi Ty2
ugcagcggaauucccaca

SEQ ID NO: 3727111 - RNA, 16 nt, Salmonella enterica enterica serovar Typhi Ty2
ugcagcggcagugaug

SEQ ID NO: 3727112 - RNA, 21 nt, Salmonella enterica enterica serovar Typhi Ty2
ugcagcggcaguuccggcguu
